United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 19

SEQ ID NO: 813625 - RNA, 22 nt, Human
gccuggcuugccagcccuggcg

SEQ ID NO: 813626 - RNA, 22 nt, Human
ccuuggcugugcugcccuuugc

SEQ ID NO: 813627 - RNA, 22 nt, Human
cucagucaguuuuugugagaga

SEQ ID NO: 813628 - RNA, 22 nt, Human
cagaaaaccugacucuagaacu

SEQ ID NO: 813629 - RNA, 22 nt, Human
aagcuuuagagaugaguuccuu

SEQ ID NO: 813630 - RNA, 22 nt, Human
uccagccuaauguucuucccac

SEQ ID NO: 813631 - RNA, 22 nt, Human
uaccauuucuacauaucuuguc

SEQ ID NO: 813632 - RNA, 22 nt, Human
uuuacuuucucaaguauauagg

SEQ ID NO: 813633 - RNA, 22 nt, Human
uucauugaaggagggacuugcu

SEQ ID NO: 813634 - RNA, 22 nt, Human
cuggagggugagccucaucucu

SEQ ID NO: 813635 - RNA, 22 nt, Human
acuggaguacaguggcgugaac

SEQ ID NO: 813636 - RNA, 20 nt, Human
acaugcuugagaggaugcag

SEQ ID NO: 813637 - RNA, 22 nt, Human
aaucuggagagucaucucugac

SEQ ID NO: 813638 - RNA, 22 nt, Human
ucuuuauuuuaugcuugugcaa

SEQ ID NO: 813639 - RNA, 22 nt, Human
uucugacacauuacuacaugga

SEQ ID NO: 813640 - RNA, 22 nt, Human
uaagugucucucgaauuaugcu

SEQ ID NO: 813641 - RNA, 21 nt, Human
ggacucuacacaggccaucuu

SEQ ID NO: 813642 - RNA, 22 nt, Human
aagaauguucuuguagucauga

SEQ ID NO: 813643 - RNA, 17 nt, Human
ggcucccugacuaugga

SEQ ID NO: 813644 - RNA, 22 nt, Human
caggcagagugagaagcccuug

SEQ ID NO: 813645 - RNA, 22 nt, Human
agcuccugauacaugcaggaau

SEQ ID NO: 813646 - RNA, 23 nt, Human
ggacacaggccuugucugcgccu

SEQ ID NO: 813647 - RNA, 22 nt, Human
cucuuuguggaacggcaguguc

SEQ ID NO: 813648 - RNA, 22 nt, Human
cugugcugcuagaccuggauuc

SEQ ID NO: 813649 - RNA, 22 nt, Human
gauuucuuugcaagcuguguuc

SEQ ID NO: 813650 - RNA, 22 nt, Human
auaaaaucagaguuggauugga

SEQ ID NO: 813651 - RNA, 22 nt, Human
uucagcagucguccaggaaaag

SEQ ID NO: 813652 - RNA, 22 nt, Human
uaaggcagccucaggguagggu

SEQ ID NO: 813653 - RNA, 22 nt, Human
gcacauuugagacauccaggca

SEQ ID NO: 813654 - RNA, 22 nt, Human
ucagugucuugggcuugaaugc

SEQ ID NO: 813655 - RNA, 22 nt, Human
gagucaggcuagggugacaggc

SEQ ID NO: 813656 - RNA, 22 nt, Human
ugaaggcuugguggcagccucu

SEQ ID NO: 813657 - RNA, 22 nt, Human
gcagcuuccugaguguggacag

SEQ ID NO: 813658 - RNA, 22 nt, Human
aaaggcaguggguauguggauc

SEQ ID NO: 813659 - RNA, 22 nt, Human
agcacagggcccagccuaggcc

SEQ ID NO: 813660 - RNA, 22 nt, Human
cagagagagucaaaucuuugcu

SEQ ID NO: 813661 - RNA, 22 nt, Human
aagaagcaggucacagacaggg

SEQ ID NO: 813662 - RNA, 22 nt, Human
ucacauucauggugcuaauaaa

SEQ ID NO: 813663 - RNA, 21 nt, Human
gcaaccagaccacagggcagu

SEQ ID NO: 813664 - RNA, 22 nt, Human
gaggcagagugcaccccaggag

SEQ ID NO: 813665 - RNA, 22 nt, Human
uugaagaauuaggacgugagua

SEQ ID NO: 813666 - RNA, 22 nt, Human
uacagaggaggggauuuuaaua

SEQ ID NO: 813667 - RNA, 22 nt, Human
caggaaaaugucaauggaaagc

SEQ ID NO: 813668 - RNA, 22 nt, Human
ccacuuugaaccacugaggugg

SEQ ID NO: 813669 - RNA, 22 nt, Human
aauagcaauuacccuucaacuc

SEQ ID NO: 813670 - RNA, 18 nt, Human
agaggcuggacaggggau

SEQ ID NO: 813671 - RNA, 22 nt, Human
ugaaaagugaucauggauuagg

SEQ ID NO: 813672 - RNA, 22 nt, Human
caggacuggaagucucaagaga

SEQ ID NO: 813673 - RNA, 22 nt, Human
aguagucacuucuauuaauggc

SEQ ID NO: 813674 - RNA, 22 nt, Human
gggccaggucggugaaugguca

SEQ ID NO: 813675 - RNA, 22 nt, Human
uagaauguagugcuucaagauu

SEQ ID NO: 813676 - RNA, 22 nt, Human
augcaaauauuaaugguaugac

SEQ ID NO: 813677 - RNA, 22 nt, Human
aaggagaguacaggaguuggua

SEQ ID NO: 813678 - RNA, 19 nt, Human
uggucucugucucuuugca

SEQ ID NO: 813679 - RNA, 22 nt, Human
gagaggcagaggccugaaaccg

SEQ ID NO: 813680 - RNA, 22 nt, Human
uaauucaugggcccagugauau

SEQ ID NO: 813681 - RNA, 22 nt, Human
cacacaucaaccuagacauugu

SEQ ID NO: 813682 - RNA, 22 nt, Human
ccuggagagcucgggccaggca

SEQ ID NO: 813683 - RNA, 22 nt, Human
ucauuuugcagagcugaggaac

SEQ ID NO: 813684 - RNA, 19 nt, Human
cagaggcaccagguauaga

SEQ ID NO: 813685 - RNA, 22 nt, Human
aaggacagggaugguugauugu

SEQ ID NO: 813686 - RNA, 18 nt, Human
ucagccuguugucugccu

SEQ ID NO: 813687 - RNA, 22 nt, Human
augaaacucuaacuuaacaagu

SEQ ID NO: 813688 - RNA, 22 nt, Human
aggcccagagcaggaaaggguu

SEQ ID NO: 813689 - RNA, 22 nt, Human
ucuaaauggaaagaaaauaccu

SEQ ID NO: 813690 - RNA, 20 nt, Human
aggggugaucgggugacacu

SEQ ID NO: 813691 - RNA, 22 nt, Human
cugaggcugcccagggccaggu

SEQ ID NO: 813692 - RNA, 22 nt, Human
aaauacuguugaaugaaguaag

SEQ ID NO: 813693 - RNA, 22 nt, Human
cuggcaggaucuaaccagggaa

SEQ ID NO: 813694 - RNA, 22 nt, Human
aguggggagguccaggccaccc

SEQ ID NO: 813695 - RNA, 22 nt, Human
gcauucuugguggagugcuaaa

SEQ ID NO: 813696 - RNA, 22 nt, Human
acagugauucugcaaaccauau

SEQ ID NO: 813697 - RNA, 22 nt, Human
ggccagggccaaggcuuuccca

SEQ ID NO: 813698 - RNA, 22 nt, Human
uaauaauuggcaauguugagca

SEQ ID NO: 813699 - RNA, 22 nt, Human
uaaauucagugaguaauuucug

SEQ ID NO: 813700 - RNA, 22 nt, Human
ggaugggcugaaagguagcccc

SEQ ID NO: 813701 - RNA, 22 nt, Human
uuucugcuuucagagugagaca

SEQ ID NO: 813702 - RNA, 22 nt, Human
cucugccugugucgccaccaca

SEQ ID NO: 813703 - RNA, 22 nt, Human
ccaggcuggauuuugcaguuca

SEQ ID NO: 813704 - RNA, 22 nt, Human
ccccagcacuuggaguggggag

SEQ ID NO: 813705 - RNA, 22 nt, Human
aguacagauuuagacacgauag

SEQ ID NO: 813706 - RNA, 22 nt, Human
auuuacacuugguuuacuagag

SEQ ID NO: 813707 - RNA, 22 nt, Human
ugggccaguuggaauggauacu

SEQ ID NO: 813708 - RNA, 22 nt, Human
ugagcaguucgacuucuucccc

SEQ ID NO: 813709 - RNA, 22 nt, Human
ccuggcaagugggcucccagau

SEQ ID NO: 813710 - RNA, 22 nt, Human
ggcuggcaggcacaguaugcaa

SEQ ID NO: 813711 - RNA, 22 nt, Human
agccagcuggagaccacuguuu

SEQ ID NO: 813712 - RNA, 22 nt, Human
cuuuauucugcaaauugccuug

SEQ ID NO: 813713 - RNA, 22 nt, Human
agcaggcuugguccccagccuc

SEQ ID NO: 813714 - RNA, 22 nt, Human
uuucaugugcauuuagguucau

SEQ ID NO: 813715 - RNA, 22 nt, Human
uuucaaguggggacauuugaga

SEQ ID NO: 813716 - RNA, 22 nt, Human
caggaaacauaugugcuugagg

SEQ ID NO: 813717 - RNA, 22 nt, Human
gacccaggguuucugcacaggg

SEQ ID NO: 813718 - RNA, 22 nt, Human
cuguggcucaauugccuacuga

SEQ ID NO: 813719 - RNA, 22 nt, Human
cucuuugggaugggcucugcug

SEQ ID NO: 813720 - RNA, 22 nt, Human
caaauuuaaguuagaaagcaau

SEQ ID NO: 813721 - RNA, 22 nt, Human
ucacaggagucaaggaauagua

SEQ ID NO: 813722 - RNA, 22 nt, Human
guccuuaaccacuuguguuuau

SEQ ID NO: 813723 - RNA, 22 nt, Human
agcaagcuaacauaggagauug

SEQ ID NO: 813724 - RNA, 22 nt, Human
aauguauuauacauaauuugug

SEQ ID NO: 813725 - RNA, 22 nt, Human
gcugcugguccucagagcucau

SEQ ID NO: 813726 - RNA, 22 nt, Human
auggggaagcaauuggauuucc

SEQ ID NO: 813727 - RNA, 22 nt, Human
agacaauacauuuauucccuuu

SEQ ID NO: 813728 - RNA, 22 nt, Human
uccagagaucucucuucccugu

SEQ ID NO: 813729 - RNA, 23 nt, Human
ugucuuuguuaggacuguguuua

SEQ ID NO: 813730 - RNA, 22 nt, Human
ggaguagcugcauuccgagcac

SEQ ID NO: 813731 - RNA, 22 nt, Human
gagccagacugccugaagcuca

SEQ ID NO: 813732 - RNA, 22 nt, Human
guccuguguaagccaggacaau

SEQ ID NO: 813733 - RNA, 22 nt, Human
ccaggcucaggugcgagagaca

SEQ ID NO: 813734 - RNA, 22 nt, Human
gggcucugggauucagagcaag

SEQ ID NO: 813735 - RNA, 22 nt, Human
aagcuggagaguuucacagaug

SEQ ID NO: 813736 - RNA, 22 nt, Human
uuuguguuuaauacaaggaccu

SEQ ID NO: 813737 - RNA, 22 nt, Human
uuucacagcuuccacuuaagga

SEQ ID NO: 813738 - RNA, 22 nt, Human
cacaugcaggagccaauguaca

SEQ ID NO: 813739 - RNA, 22 nt, Human
auaauauuugcauuacugugau

SEQ ID NO: 813740 - RNA, 22 nt, Human
uucacauaaauagaucacauca

SEQ ID NO: 813741 - RNA, 22 nt, Human
uacagcaaugccugaaauagua

SEQ ID NO: 813742 - RNA, 22 nt, Human
uuuguauaagaacauucuagca

SEQ ID NO: 813743 - RNA, 22 nt, Human
cugagagguaagcagcgcagug

SEQ ID NO: 813744 - RNA, 19 nt, Human
aggguccagggagcggcuc

SEQ ID NO: 813745 - RNA, 22 nt, Human
uccuagcuugucaguucucuaa

SEQ ID NO: 813746 - RNA, 22 nt, Human
ugagggaggcccuuugagcaga

SEQ ID NO: 813747 - RNA, 22 nt, Human
acugcucaaggaucugguaggg

SEQ ID NO: 813748 - RNA, 22 nt, Human
ugugaggccuagacagccuggg

SEQ ID NO: 813749 - RNA, 22 nt, Human
agcugcagagguuugugcaaca

SEQ ID NO: 813750 - RNA, 22 nt, Human
accaggguugagucagcugcgu

SEQ ID NO: 813751 - RNA, 22 nt, Human
gcaugugggaacacuuaggcac

SEQ ID NO: 813752 - RNA, 22 nt, Human
ugcccccugguggccagagccg

SEQ ID NO: 813753 - RNA, 22 nt, Human
agaugggccuucgagcaugccc

SEQ ID NO: 813754 - RNA, 22 nt, Human
cugaaauucugccucugcacaa

SEQ ID NO: 813755 - RNA, 22 nt, Human
uaacaaaguauuguuuguguau

SEQ ID NO: 813756 - RNA, 22 nt, Human
gccucugcaccaguacugugcc

SEQ ID NO: 813757 - RNA, 22 nt, Human
cauguguauuauucuuguggaa

SEQ ID NO: 813758 - RNA, 22 nt, Human
aggcuguccucucuugcucagu

SEQ ID NO: 813759 - RNA, 22 nt, Human
cuuuacagauggauaauuguuu

SEQ ID NO: 813760 - RNA, 22 nt, Human
ugcauguuucuguauguuaaug

SEQ ID NO: 813761 - RNA, 22 nt, Human
uagcaggagagaaguuuuaagu

SEQ ID NO: 813762 - RNA, 22 nt, Human
uuuugguaauuaaguagauauu

SEQ ID NO: 813763 - RNA, 22 nt, Human
ggaccugcucucccaguucucu

SEQ ID NO: 813764 - RNA, 22 nt, Human
acaacuuuaauggguuucagcu

SEQ ID NO: 813765 - RNA, 22 nt, Human
auuaauaucccccgccguucug

SEQ ID NO: 813766 - RNA, 22 nt, Human
uugcuauuuugagagucauagu

SEQ ID NO: 813767 - RNA, 21 nt, Human
guucaauagcucuuugaaugc

SEQ ID NO: 813768 - RNA, 22 nt, Human
ccauuuguaccauuucuuugua

SEQ ID NO: 813769 - RNA, 22 nt, Human
cuacauuauguuuauugggacu

SEQ ID NO: 813770 - RNA, 22 nt, Human
caaacuuacuguguuuaaagag

SEQ ID NO: 813771 - RNA, 22 nt, Human
aaugccuuggagagccuagagg

SEQ ID NO: 813772 - RNA, 19 nt, Human
auacacguguauacauaca

SEQ ID NO: 813773 - RNA, 22 nt, Human
uaaggacagcagcuacuuuucc

SEQ ID NO: 813774 - RNA, 22 nt, Human
acauauuuugaaagcuuucuaa

SEQ ID NO: 813775 - RNA, 22 nt, Human
aggauugugccuccagucagaa

SEQ ID NO: 813776 - RNA, 22 nt, Human
uacuacauacagaauuuagaga

SEQ ID NO: 813777 - RNA, 22 nt, Human
caauguuuuuccuuccuuaaua

SEQ ID NO: 813778 - RNA, 22 nt, Human
uaccaaaaccaagccauuaucu

SEQ ID NO: 813779 - RNA, 22 nt, Human
acaccuuuuauucgccaggcac

SEQ ID NO: 813780 - RNA, 19 nt, Human
caggauuguuuaaagcuuu

SEQ ID NO: 813781 - RNA, 22 nt, Human
aagacacuuucuaaauagaagu

SEQ ID NO: 813782 - RNA, 22 nt, Human
ccuccccacagcccaggagacu

SEQ ID NO: 813783 - RNA, 22 nt, Human
auacaacagaaaaugauuauuc

SEQ ID NO: 813784 - RNA, 22 nt, Human
uaucuuugguagcuuuccuaag

SEQ ID NO: 813785 - RNA, 22 nt, Human
uuacuguagcuugacauauguc

SEQ ID NO: 813786 - RNA, 17 nt, Human
uguguaaguugcauaga

SEQ ID NO: 813787 - RNA, 22 nt, Human
aguaacagguguacagacuauc

SEQ ID NO: 813788 - RNA, 22 nt, Human
ugcuuguauucauaucacagcu

SEQ ID NO: 813789 - RNA, 22 nt, Human
auacaggaugcugaacaucucu

SEQ ID NO: 813790 - RNA, 22 nt, Human
auacaugugugugcauacaugu

SEQ ID NO: 813791 - RNA, 22 nt, Human
guuuccaagucucucaacaccc

SEQ ID NO: 813792 - RNA, 20 nt, Human
uuucacaaugaacaugucuc

SEQ ID NO: 813793 - RNA, 22 nt, Human
uuuccuguccugguacuuggca

SEQ ID NO: 813794 - RNA, 22 nt, Human
cugacagcgagagaguugcccc

SEQ ID NO: 813795 - RNA, 22 nt, Human
aguaucagaugugauuaaaggg

SEQ ID NO: 813796 - RNA, 22 nt, Human
uguacacauuaagcucuuuaga

SEQ ID NO: 813797 - RNA, 20 nt, Human
uaugauaauuacaaaauagu

SEQ ID NO: 813798 - RNA, 22 nt, Human
uuguagucuaggauagauuuuu

SEQ ID NO: 813799 - RNA, 22 nt, Human
caaucaaugcugcuaguuccuu

SEQ ID NO: 813800 - RNA, 22 nt, Human
cugucacagcccgcgucuccuc

SEQ ID NO: 813801 - RNA, 22 nt, Human
auacacauguuauuguggaagc

SEQ ID NO: 813802 - RNA, 22 nt, Human
auauaguuggguuucauucuac

SEQ ID NO: 813803 - RNA, 22 nt, Human
ucagcacaggucuugcaaaaca

SEQ ID NO: 813804 - RNA, 22 nt, Human
uuuccacacucacugcacucau

SEQ ID NO: 813805 - RNA, 22 nt, Human
auagcaaaggacaauagucagu

SEQ ID NO: 813806 - RNA, 22 nt, Human
gcugucugcugggucgcucagg

SEQ ID NO: 813807 - RNA, 22 nt, Human
aaaagagccacuuaugaccuca

SEQ ID NO: 813808 - RNA, 22 nt, Human
auaggcauaacacugauguccu

SEQ ID NO: 813809 - RNA, 22 nt, Human
acaugacagugacuuuauaaga

SEQ ID NO: 813810 - RNA, 22 nt, Human
auauggcuguugcacaucuaag

SEQ ID NO: 813811 - RNA, 22 nt, Human
cagaaagcaguugucaaugggc

SEQ ID NO: 813812 - RNA, 22 nt, Human
augcauugaggaugacaugagu

SEQ ID NO: 813813 - RNA, 22 nt, Human
uacauguacaugcauagguaga

SEQ ID NO: 813814 - RNA, 22 nt, Human
ccagcuggaacggcagcccagc

SEQ ID NO: 813815 - RNA, 22 nt, Human
cauagacauugauagguuauau

SEQ ID NO: 813816 - RNA, 22 nt, Human
uaucacauacuucucauccagg

SEQ ID NO: 813817 - RNA, 22 nt, Human
gaccacugaaugcacuucuaau

SEQ ID NO: 813818 - RNA, 22 nt, Human
uauacuacgcaccaaacaaagg

SEQ ID NO: 813819 - RNA, 22 nt, Human
cucagcuucuaccuccugagug

SEQ ID NO: 813820 - RNA, 22 nt, Human
acaagucaguggaauuaauauu

SEQ ID NO: 813821 - RNA, 22 nt, Human
auuagguaguauaaucuuuguu

SEQ ID NO: 813822 - RNA, 22 nt, Human
ugucuuacagcaaucuguucug

SEQ ID NO: 813823 - RNA, 22 nt, Human
aagauuuaccacuuuauucaag

SEQ ID NO: 813824 - RNA, 22 nt, Human
auucccagauuuauauugauag

SEQ ID NO: 813825 - RNA, 20 nt, Human
uacaauauucccacuuugcu

SEQ ID NO: 813826 - RNA, 22 nt, Human
ucuccccaguauggauucucug

SEQ ID NO: 813827 - RNA, 23 nt, Human
ucuggcugcuccuuucaaugcuc

SEQ ID NO: 813828 - RNA, 22 nt, Human
uccugucucaguguauuugcag

SEQ ID NO: 813829 - RNA, 22 nt, Human
augaacaguacaaagcacagac

SEQ ID NO: 813830 - RNA, 22 nt, Human
auugucgucaauggacacauag

SEQ ID NO: 813831 - RNA, 20 nt, Human
aauagcacagcucaaacauu

SEQ ID NO: 813832 - RNA, 22 nt, Human
uaaaaucaugacagauugacau

SEQ ID NO: 813833 - RNA, 22 nt, Human
auggugguagaagcacuaugug

SEQ ID NO: 813834 - RNA, 22 nt, Human
gcaguaaauugagagucauguu

SEQ ID NO: 813835 - RNA, 22 nt, Human
auacaugacucacacauucugc

SEQ ID NO: 813836 - RNA, 22 nt, Human
gagguauaguucuauuagauga

SEQ ID NO: 813837 - RNA, 23 nt, Human
uugcauuaauguggaggcacagg

SEQ ID NO: 813838 - RNA, 22 nt, Human
agccacugugugaccagcuguc

SEQ ID NO: 813839 - RNA, 19 nt, Human
aaauccaagcucaggccuc

SEQ ID NO: 813840 - RNA, 22 nt, Human
aaagcacauuacaagcucaguc

SEQ ID NO: 813841 - RNA, 22 nt, Human
uaggcacugguuguggauaguu

SEQ ID NO: 813842 - RNA, 22 nt, Human
ccgcuguccuggagcugcugcu

SEQ ID NO: 813843 - RNA, 22 nt, Human
ugcuugcugaaaggcauuuaga

SEQ ID NO: 813844 - RNA, 22 nt, Human
uuuccagaaauaccauuuggug

SEQ ID NO: 813845 - RNA, 21 nt, Human
acaguacuugagaucuuuuga

SEQ ID NO: 813846 - RNA, 22 nt, Human
augacagcucuagcacacagua

SEQ ID NO: 813847 - RNA, 22 nt, Human
agcugucuaccugcagaguccu

SEQ ID NO: 813848 - RNA, 22 nt, Human
auuuccagcagcauauuugucu

SEQ ID NO: 813849 - RNA, 22 nt, Human
ugcaugguuauauacuacuagu

SEQ ID NO: 813850 - RNA, 22 nt, Human
acaugcacccaguuacacucuc

SEQ ID NO: 813851 - RNA, 22 nt, Human
aauaaguacuuggggauaacuu

SEQ ID NO: 813852 - RNA, 22 nt, Human
cugcuucacccugccugagaac

SEQ ID NO: 813853 - RNA, 22 nt, Human
uccguuuucacacugcuauaaa

SEQ ID NO: 813854 - RNA, 22 nt, Human
guuauguaaucuaacacucagu

SEQ ID NO: 813855 - RNA, 22 nt, Human
ucccuguccugggcaaucccag

SEQ ID NO: 813856 - RNA, 22 nt, Human
aauuauguuugcuuuagaugga

SEQ ID NO: 813857 - RNA, 22 nt, Human
cucugaauggacacuccagugu

SEQ ID NO: 813858 - RNA, 22 nt, Human
uugacuauacucuggcggaaaa

SEQ ID NO: 813859 - RNA, 20 nt, Human
ucauaugugguuguauacaa

SEQ ID NO: 813860 - RNA, 22 nt, Human
gcuuccaaugcuucuaucacau

SEQ ID NO: 813861 - RNA, 22 nt, Human
auguacaaucuaucacaagaag

SEQ ID NO: 813862 - RNA, 22 nt, Human
aguccccucuaacccaacuuua

SEQ ID NO: 813863 - RNA, 22 nt, Human
uuauuuaaaagugguaagauuc

SEQ ID NO: 813864 - RNA, 22 nt, Human
gacauacagcccucucccuggu

SEQ ID NO: 813865 - RNA, 22 nt, Human
gucuccugaggcauccauugaa

SEQ ID NO: 813866 - RNA, 22 nt, Human
guguaucaacauguuuuuugug

SEQ ID NO: 813867 - RNA, 22 nt, Human
acaagauagcuuagaagauuca

SEQ ID NO: 813868 - RNA, 22 nt, Human
acagcuggccgaggcucaggga

SEQ ID NO: 813869 - RNA, 22 nt, Human
ucacacaucucagguguuuaau

SEQ ID NO: 813870 - RNA, 22 nt, Human
cugcauaucaaauuacuccugg

SEQ ID NO: 813871 - RNA, 22 nt, Human
ugcaugguguaauucuaaugcu

SEQ ID NO: 813872 - RNA, 22 nt, Human
acucauuugcaugaugugcuau

SEQ ID NO: 813873 - RNA, 20 nt, Human
aaagauacuuuuuguaaugg

SEQ ID NO: 813874 - RNA, 22 nt, Human
uucaguaugcugaaugauuuuu

SEQ ID NO: 813875 - RNA, 22 nt, Human
ugcauaaacuucucugguguga

SEQ ID NO: 813876 - RNA, 22 nt, Human
uaucuguuuuuacagugucuuu

SEQ ID NO: 813877 - RNA, 22 nt, Human
uccccaguaagccugcacugug

SEQ ID NO: 813878 - RNA, 22 nt, Human
aguuuccacuggagacacugug

SEQ ID NO: 813879 - RNA, 22 nt, Human
guacauauccuuuacguuuugu

SEQ ID NO: 813880 - RNA, 22 nt, Human
caacagcuggaggcuuggcccg

SEQ ID NO: 813881 - RNA, 22 nt, Human
guguacacuugaacugacgguu

SEQ ID NO: 813882 - RNA, 22 nt, Human
uuuccagucucugccuccaagg

SEQ ID NO: 813883 - RNA, 22 nt, Human
uucuuugcccauguuuccuaag

SEQ ID NO: 813884 - RNA, 22 nt, Human
ucugcuguuuacugugugauau

SEQ ID NO: 813885 - RNA, 22 nt, Human
cuguuccuccaccucaacaaac

SEQ ID NO: 813886 - RNA, 22 nt, Human
uacauguuauuucacuauuggu

SEQ ID NO: 813887 - RNA, 22 nt, Human
gucugugcaguuacuagcuggu

SEQ ID NO: 813888 - RNA, 22 nt, Human
cugcaguucuucuccucaaggc

SEQ ID NO: 813889 - RNA, 22 nt, Human
auuggccagacuuauccuucag

SEQ ID NO: 813890 - RNA, 19 nt, Human
aggucuaaucauaagacaa

SEQ ID NO: 813891 - RNA, 22 nt, Human
cagcuggaggagcagcuuccag

SEQ ID NO: 813892 - RNA, 22 nt, Human
ccugucugaaggcagggggaug

SEQ ID NO: 813893 - RNA, 22 nt, Human
augcacacguacccuacaaggc

SEQ ID NO: 813894 - RNA, 22 nt, Human
uuauuuaaaauguagguuggga

SEQ ID NO: 813895 - RNA, 22 nt, Human
cuauacagcagcuuacuaguua

SEQ ID NO: 813896 - RNA, 22 nt, Human
agccuauucaucugaucuugaa

SEQ ID NO: 813897 - RNA, 18 nt, Human
uauaaacacacuuagguu

SEQ ID NO: 813898 - RNA, 22 nt, Human
uucaguuuugcuuuuaaucaug

SEQ ID NO: 813899 - RNA, 22 nt, Human
cacaucauguuaauucauuaca

SEQ ID NO: 813900 - RNA, 22 nt, Human
uuugacaugugcuuauaacuuu

SEQ ID NO: 813901 - RNA, 22 nt, Human
aaugguaauauuucauaguugu

SEQ ID NO: 813902 - RNA, 22 nt, Human
aagcauuucagguagagauauu

SEQ ID NO: 813903 - RNA, 22 nt, Human
cucccucaggccuuagcccugc

SEQ ID NO: 813904 - RNA, 23 nt, Human
aguguucagcauguaguaaauac

SEQ ID NO: 813905 - RNA, 22 nt, Human
aacaguaugugagauuuacaca

SEQ ID NO: 813906 - RNA, 22 nt, Human
uugcaaauaauagccugaaacu

SEQ ID NO: 813907 - RNA, 22 nt, Human
uuaaguauauccauuugacugg

SEQ ID NO: 813908 - RNA, 22 nt, Human
acagagacacggaagcuaaaga

SEQ ID NO: 813909 - RNA, 22 nt, Human
ucauacauguuguguucaaaug

SEQ ID NO: 813910 - RNA, 22 nt, Human
ucacagcugggguuuuggcagc

SEQ ID NO: 813911 - RNA, 22 nt, Human
caggaacacaaugagucucaaa

SEQ ID NO: 813912 - RNA, 21 nt, Human
ugcauauauaagugcauacac

SEQ ID NO: 813913 - RNA, 22 nt, Human
agccugugcuguguuugcucca

SEQ ID NO: 813914 - RNA, 22 nt, Human
uauaugcagauuuucaucaucg

SEQ ID NO: 813915 - RNA, 22 nt, Human
ucugccaucaagaugcucuggc

SEQ ID NO: 813916 - RNA, 20 nt, Human
aaaaacaguaaugcugaaga

SEQ ID NO: 813917 - RNA, 22 nt, Human
uugcaguugcuguauuuaagga

SEQ ID NO: 813918 - RNA, 22 nt, Human
uuaagguucagaaaucaauacc

SEQ ID NO: 813919 - RNA, 22 nt, Human
auauuuguuuggcagaguucag

SEQ ID NO: 813920 - RNA, 22 nt, Human
uugaguuuccugacagcgaagg

SEQ ID NO: 813921 - RNA, 22 nt, Human
auuuacugagguaaauaaacug

SEQ ID NO: 813922 - RNA, 22 nt, Human
uuaauggauuggagguuucaau

SEQ ID NO: 813923 - RNA, 22 nt, Human
aauaucuagccuuuagcagcuu

SEQ ID NO: 813924 - RNA, 21 nt, Human
uaaacauaaccuuguauggcu

SEQ ID NO: 813925 - RNA, 22 nt, Human
gucuugcacuuaccuaagaacu

SEQ ID NO: 813926 - RNA, 22 nt, Human
ucugcuugugucuguccagccu

SEQ ID NO: 813927 - RNA, 22 nt, Human
ucuggauggucagcucuuccug

SEQ ID NO: 813928 - RNA, 20 nt, Human
uguauuuaaugaaggcuuuu

SEQ ID NO: 813929 - RNA, 22 nt, Human
gucaggaugagggaugaggagu

SEQ ID NO: 813930 - RNA, 22 nt, Human
uuccaauaaaauguuauuugca

SEQ ID NO: 813931 - RNA, 22 nt, Human
uaguauuuccuguaagcuauag

SEQ ID NO: 813932 - RNA, 22 nt, Human
ggagcugugcugggugaucagg

SEQ ID NO: 813933 - RNA, 21 nt, Human
uuggccgugcagaugaacagc

SEQ ID NO: 813934 - RNA, 22 nt, Human
gcuucugcagagccguccugag

SEQ ID NO: 813935 - RNA, 22 nt, Human
uaucuguagucucaugguuccu

SEQ ID NO: 813936 - RNA, 22 nt, Human
uuccccuugauaaugcaguaag

SEQ ID NO: 813937 - RNA, 22 nt, Human
cuggugcuguagccugauugag

SEQ ID NO: 813938 - RNA, 22 nt, Human
augcacaagguagauuauuauu

SEQ ID NO: 813939 - RNA, 22 nt, Human
uacuguauacuacugcuguucu

SEQ ID NO: 813940 - RNA, 22 nt, Human
guguuucccuggcacaagaacc

SEQ ID NO: 813941 - RNA, 22 nt, Human
acagcugggaacucacacagca

SEQ ID NO: 813942 - RNA, 22 nt, Human
acacacagaaggaagccccacu

SEQ ID NO: 813943 - RNA, 22 nt, Human
auuccucagcaggccuuuuguu

SEQ ID NO: 813944 - RNA, 22 nt, Human
uaaaaguuagcuaggacaaagu

SEQ ID NO: 813945 - RNA, 22 nt, Human
ugguaaaugucuaacaaucacu

SEQ ID NO: 813946 - RNA, 22 nt, Human
aguaauggguugaaauuuaguu

SEQ ID NO: 813947 - RNA, 22 nt, Human
uucaaacaguguagaauauaug

SEQ ID NO: 813948 - RNA, 22 nt, Human
caauaguaaauuacggaggaga

SEQ ID NO: 813949 - RNA, 22 nt, Human
uugcauauccuccaacacaugg

SEQ ID NO: 813950 - RNA, 21 nt, Human
ucugugcuuuuuuggcuccua

SEQ ID NO: 813951 - RNA, 22 nt, Human
uaaagcauguuucaguaagguu

SEQ ID NO: 813952 - RNA, 19 nt, Human
guuggcacugaaaauggcu

SEQ ID NO: 813953 - RNA, 22 nt, Human
cuugcuuuaucugguuucucau

SEQ ID NO: 813954 - RNA, 22 nt, Human
augcugugccuggaaagcggcu

SEQ ID NO: 813955 - RNA, 22 nt, Human
gccuuugcugugacaaugcugg

SEQ ID NO: 813956 - RNA, 22 nt, Human
ccucuaaauuguuugaaguugg

SEQ ID NO: 813957 - RNA, 22 nt, Human
gcacaguauuuaguagaaugag

SEQ ID NO: 813958 - RNA, 22 nt, Human
auguaguauuuggaaauguaaa

SEQ ID NO: 813959 - RNA, 22 nt, Human
cuggcucgcauuauauuuuggg

SEQ ID NO: 813960 - RNA, 22 nt, Human
ucauacauguuguguucaaaug

SEQ ID NO: 813961 - RNA, 22 nt, Human
uacuguauacuacugcuguucu

SEQ ID NO: 813962 - RNA, 22 nt, Human
ugcuuuauucgacaucugguag

SEQ ID NO: 813963 - RNA, 22 nt, Human
cugccguguuuuucauguuaaa

SEQ ID NO: 813964 - RNA, 21 nt, Human
gcccacagugaggaggauccc

SEQ ID NO: 813965 - RNA, 22 nt, Human
cagcaugaauguguucguaggg

SEQ ID NO: 813966 - RNA, 22 nt, Human
auacaacagaaaaugauuauuc

SEQ ID NO: 813967 - RNA, 22 nt, Human
ugcuaauaaacuccaggcugag

SEQ ID NO: 813968 - RNA, 22 nt, Human
uucuguaauucuguuaguuuca

SEQ ID NO: 813969 - RNA, 22 nt, Human
aaauugcauuuuaaagguagau

SEQ ID NO: 813970 - RNA, 22 nt, Human
augcuugcccauguuucugaag

SEQ ID NO: 813971 - RNA, 22 nt, Human
caggcacaaugagcgccaucuu

SEQ ID NO: 813972 - RNA, 22 nt, Human
auggaguguggccaggcaguaa

SEQ ID NO: 813973 - RNA, 22 nt, Human
gugucccaaagauuagaaauca

SEQ ID NO: 813974 - RNA, 22 nt, Human
uaagaaacauuuuuaugacagu

SEQ ID NO: 813975 - RNA, 22 nt, Human
uccagccauaucuuguagcccu

SEQ ID NO: 813976 - RNA, 22 nt, Human
acaugcuuucuagguccuucug

SEQ ID NO: 813977 - RNA, 23 nt, Human
aagaaugcuucugaagagcugcc

SEQ ID NO: 813978 - RNA, 22 nt, Human
auuauguagcuaaaaauugugu

SEQ ID NO: 813979 - RNA, 22 nt, Human
uaaagcaaugaaaguuuugcag

SEQ ID NO: 813980 - RNA, 22 nt, Human
aacacauggcaagagcaggaaa

SEQ ID NO: 813981 - RNA, 22 nt, Human
auguacauuauucgagugaugg

SEQ ID NO: 813982 - RNA, 22 nt, Human
cacaauuuccauugagcagcag

SEQ ID NO: 813983 - RNA, 22 nt, Human
auguggcuuucugcguuuucuc

SEQ ID NO: 813984 - RNA, 22 nt, Human
uuccauacgacugaggucucgg

SEQ ID NO: 813985 - RNA, 22 nt, Human
ccugugcaugccaggguacacc

SEQ ID NO: 813986 - RNA, 22 nt, Human
ugcugcccacuguauuucucca

SEQ ID NO: 813987 - RNA, 21 nt, Human
uugcuguuuucccaaugcagu

SEQ ID NO: 813988 - RNA, 22 nt, Human
aauuauguuugcuuuagaugga

SEQ ID NO: 813989 - RNA, 22 nt, Human
gcacaaaagguacuucauguag

SEQ ID NO: 813990 - RNA, 22 nt, Human
guuuuaguggguggccacugau

SEQ ID NO: 813991 - RNA, 22 nt, Human
gagcugcauagcugggauccuc

SEQ ID NO: 813992 - RNA, 22 nt, Human
auauggcuguugcacaucuaag

SEQ ID NO: 813993 - RNA, 22 nt, Human
augcacaagguagauuauuauu

SEQ ID NO: 813994 - RNA, 22 nt, Human
aacaggcuaaauuguccauuuc

SEQ ID NO: 813995 - RNA, 22 nt, Human
gaauacaaauaauaccaaggug

SEQ ID NO: 813996 - RNA, 22 nt, Human
ugcugcucuucaccauggccuc

SEQ ID NO: 813997 - RNA, 22 nt, Human
aaaugcacaauaaaguaaaggc

SEQ ID NO: 813998 - RNA, 22 nt, Human
auguauacgugcaggucacagg

SEQ ID NO: 813999 - RNA, 22 nt, Human
gacauacagcccucucccuggu

SEQ ID NO: 814000 - RNA, 21 nt, Human
uaaacauaaccuuguauggcu

SEQ ID NO: 814001 - RNA, 22 nt, Human
ugcaaauauuccaugcuguuca

SEQ ID NO: 814002 - RNA, 18 nt, Human
aguaaauguuaaauauug

SEQ ID NO: 814003 - RNA, 22 nt, Human
uuucuacacuucgugguguuuu

SEQ ID NO: 814004 - RNA, 22 nt, Human
uccugugccuccaccugcuccg

SEQ ID NO: 814005 - RNA, 22 nt, Human
augcacacguacccuacaaggc

SEQ ID NO: 814006 - RNA, 22 nt, Human
cagcugcuguucaguuuuguuu

SEQ ID NO: 814007 - RNA, 22 nt, Human
acuguagucuaaauauagucuu

SEQ ID NO: 814008 - RNA, 22 nt, Human
aucugccuggcuccaggugagc

SEQ ID NO: 814009 - RNA, 22 nt, Human
ugcacacaguucucaggaaaga

SEQ ID NO: 814010 - RNA, 22 nt, Human
uguucauaucauuuugaaagcu

SEQ ID NO: 814011 - RNA, 22 nt, Human
caguuaaacagauugaguguua

SEQ ID NO: 814012 - RNA, 22 nt, Human
uuguacuuaaauaugcaaauag

SEQ ID NO: 814013 - RNA, 18 nt, Human
ggaggcucugugguuucc

SEQ ID NO: 814014 - RNA, 22 nt, Human
aaagcacauuacaagcucaguc

SEQ ID NO: 814015 - RNA, 22 nt, Human
aaggcacauauuuuagagucac

SEQ ID NO: 814016 - RNA, 22 nt, Human
uugcugccagcgcccugcaggg

SEQ ID NO: 814017 - RNA, 18 nt, Human
cugccuguugcugagagg

SEQ ID NO: 814018 - RNA, 22 nt, Human
aauuauugagcaucuacugugu

SEQ ID NO: 814019 - RNA, 22 nt, Human
cauugcugugggcauuugcugc

SEQ ID NO: 814020 - RNA, 22 nt, Human
aucauccuagaaggaagcuagg

SEQ ID NO: 814021 - RNA, 22 nt, Human
gcuguaacuuuuucauuuucaa

SEQ ID NO: 814022 - RNA, 22 nt, Human
augcccugggagugcuguacca

SEQ ID NO: 814023 - RNA, 22 nt, Human
uaaaaucaugacagauugacau

SEQ ID NO: 814024 - RNA, 22 nt, Human
cuacuguaguuaaaguuuugua

SEQ ID NO: 814025 - RNA, 22 nt, Human
acaaaugcuuaguucaccaaaa

SEQ ID NO: 814026 - RNA, 22 nt, Human
uuacuguagcuugacauauguc

SEQ ID NO: 814027 - RNA, 22 nt, Human
auauaguuggguuucauucuac

SEQ ID NO: 814028 - RNA, 22 nt, Human
uguaauguuagaaacaauugcu

SEQ ID NO: 814029 - RNA, 22 nt, Human
aauugcuuuacaagccguuuaa

SEQ ID NO: 814030 - RNA, 22 nt, Human
ccacuguuuccuuucugcuggc

SEQ ID NO: 814031 - RNA, 22 nt, Human
uucaguaugcugaaugauuuuu

SEQ ID NO: 814032 - RNA, 22 nt, Human
cauuguccucugaugccuuccc

SEQ ID NO: 814033 - RNA, 22 nt, Human
uucacauaaucugcagcaagcg

SEQ ID NO: 814034 - RNA, 22 nt, Human
ugcagugaugcuucuggcucag

SEQ ID NO: 814035 - RNA, 22 nt, Human
agcugcaccggcuggaccacug

SEQ ID NO: 814036 - RNA, 22 nt, Human
aaucuguugucaggaauccaca

SEQ ID NO: 814037 - RNA, 19 nt, Human
ccauucugucucugccaca

SEQ ID NO: 814038 - RNA, 22 nt, Human
uuucuacauuuguaaccagauu

SEQ ID NO: 814039 - RNA, 22 nt, Human
cauucauaggaggagaugauua

SEQ ID NO: 814040 - RNA, 22 nt, Human
auacacauguuauuguggaagc

SEQ ID NO: 814041 - RNA, 22 nt, Human
auagcaaaggacaauagucagu

SEQ ID NO: 814042 - RNA, 22 nt, Human
accuuguuguagguacaaaaga

SEQ ID NO: 814043 - RNA, 22 nt, Human
cugcauaucaaauuacuccugg

SEQ ID NO: 814044 - RNA, 22 nt, Human
uugcaguugcuguauuuaagga

SEQ ID NO: 814045 - RNA, 22 nt, Human
cugugcuggcagaccuggaguu

SEQ ID NO: 814046 - RNA, 19 nt, Human
auacacguguauacauaca

SEQ ID NO: 814047 - RNA, 22 nt, Human
ugcugcucaagcugcagcaaaa

SEQ ID NO: 814048 - RNA, 22 nt, Human
gugcacagaaacauacaaugug

SEQ ID NO: 814049 - RNA, 21 nt, Human
agccugcaauguagguaccgg

SEQ ID NO: 814050 - RNA, 22 nt, Human
cccuuguuuuugaguacaauag

SEQ ID NO: 814051 - RNA, 22 nt, Human
uguaucauauggggaagcuuca

SEQ ID NO: 814052 - RNA, 22 nt, Human
gccuguuucuccuccuuggccc

SEQ ID NO: 814053 - RNA, 22 nt, Human
aauacagugaaagugagcaagg

SEQ ID NO: 814054 - RNA, 20 nt, Human
uaugugcaguuugguuuauc

SEQ ID NO: 814055 - RNA, 19 nt, Human
aaauccaagcucaggccuc

SEQ ID NO: 814056 - RNA, 22 nt, Human
auggccugcagugcugccacag

SEQ ID NO: 814057 - RNA, 22 nt, Human
cuuugugauaguguuaagacca

SEQ ID NO: 814058 - RNA, 20 nt, Human
aauagcacagcucaaacauu

SEQ ID NO: 814059 - RNA, 22 nt, Human
uccucuucaaaauagcucugaa

SEQ ID NO: 814060 - RNA, 22 nt, Human
ugcauguuuuauaccaaagcuu

SEQ ID NO: 814061 - RNA, 22 nt, Human
uucaaacaguguagaauauaug

SEQ ID NO: 814062 - RNA, 22 nt, Human
cugcccaucuggccacacacag

SEQ ID NO: 814063 - RNA, 22 nt, Human
ucacacaucucagguguuuaau

SEQ ID NO: 814064 - RNA, 22 nt, Human
ccugugucaucagcuguggcua

SEQ ID NO: 814065 - RNA, 22 nt, Human
gauguauagcuuuaacugaccc

SEQ ID NO: 814066 - RNA, 22 nt, Human
auggcuguguuguuccucugaa

SEQ ID NO: 814067 - RNA, 22 nt, Human
uguguacauguaucaacuaucg

SEQ ID NO: 814068 - RNA, 22 nt, Human
aaguuacacauuuucauuguaa

SEQ ID NO: 814069 - RNA, 22 nt, Human
aaaugcaugugcuauagaugug

SEQ ID NO: 814070 - RNA, 22 nt, Human
cuuccugcaacaccuguguugc

SEQ ID NO: 814071 - RNA, 22 nt, Human
acagugucuccugguacccagu

SEQ ID NO: 814072 - RNA, 22 nt, Human
aucauccauggcugaucauaaa

SEQ ID NO: 814073 - RNA, 22 nt, Human
uuuuccuucugauacuccauuu

SEQ ID NO: 814074 - RNA, 22 nt, Human
acaguaaucugggaacuuguua

SEQ ID NO: 814075 - RNA, 20 nt, Human
aaaaacaguaaugcugaaga

SEQ ID NO: 814076 - RNA, 22 nt, Human
ugcaucauuaagguacaguugg

SEQ ID NO: 814077 - RNA, 22 nt, Human
auugcacaucugcacuacagcc

SEQ ID NO: 814078 - RNA, 22 nt, Human
uuccaauaaaauguuauuugca

SEQ ID NO: 814079 - RNA, 22 nt, Human
cauugcuuugugcauauuuaaa

SEQ ID NO: 814080 - RNA, 22 nt, Human
auacaugacucacacauucugc

SEQ ID NO: 814081 - RNA, 22 nt, Human
uuugcaaaguccauugaaguua

SEQ ID NO: 814082 - RNA, 22 nt, Human
cauuuuccucugcugguguuca

SEQ ID NO: 814083 - RNA, 22 nt, Human
uuuucuuggaguggcuguccuu

SEQ ID NO: 814084 - RNA, 22 nt, Human
ucaccuguucaacagcaauaau

SEQ ID NO: 814085 - RNA, 22 nt, Human
uacauguacaugcauagguaga

SEQ ID NO: 814086 - RNA, 22 nt, Human
cugcaucaguggauaugauggu

SEQ ID NO: 814087 - RNA, 22 nt, Human
uaucaguagaacaauggacauu

SEQ ID NO: 814088 - RNA, 22 nt, Human
uucaauagaaagucccuaguua

SEQ ID NO: 814089 - RNA, 22 nt, Human
cacuguuuuacauguuauuuaa

SEQ ID NO: 814090 - RNA, 22 nt, Human
uuaccacagugccugucuaaug

SEQ ID NO: 814091 - RNA, 22 nt, Human
aaauacaguggcagcagauaau

SEQ ID NO: 814092 - RNA, 22 nt, Human
auacaugugugugcauacaugu

SEQ ID NO: 814093 - RNA, 22 nt, Human
ucuguuauaaaucacacugcau

SEQ ID NO: 814094 - RNA, 22 nt, Human
caggguggcaggcaccauggcc

SEQ ID NO: 814095 - RNA, 22 nt, Human
cacaguuuuaucuuauacugau

SEQ ID NO: 814096 - RNA, 22 nt, Human
uaucuguauucugacagucacu

SEQ ID NO: 814097 - RNA, 22 nt, Human
aaaggugccucuuacaaggcuu

SEQ ID NO: 814098 - RNA, 22 nt, Human
uacaguaaccagucuacuuaga

SEQ ID NO: 814099 - RNA, 20 nt, Human
auuugcuuaccuuguuucua

SEQ ID NO: 814100 - RNA, 22 nt, Human
ccuuuguucacuggagagugga

SEQ ID NO: 814101 - RNA, 22 nt, Human
gagcugcagcggcugacgcaac

SEQ ID NO: 814102 - RNA, 22 nt, Human
auggcauuugaaucugucuuuu

SEQ ID NO: 814103 - RNA, 22 nt, Human
guuuccaggcuuugguaugguu

SEQ ID NO: 814104 - RNA, 22 nt, Human
gcuuccaaugcuucuaucacau

SEQ ID NO: 814105 - RNA, 19 nt, Human
ucaaagucugagucacuuu

SEQ ID NO: 814106 - RNA, 22 nt, Human
uucuuugcccauguuuccuaag

SEQ ID NO: 814107 - RNA, 22 nt, Human
agagucaguuaugucaagugcu

SEQ ID NO: 814108 - RNA, 22 nt, Human
uccuuagagugguugugcuaug

SEQ ID NO: 814109 - RNA, 22 nt, Human
auguccaggaagucuuaacuca

SEQ ID NO: 814110 - RNA, 22 nt, Human
gacuacaggugugugccaccau

SEQ ID NO: 814111 - RNA, 22 nt, Human
gaauaauugugaugcuugaagu

SEQ ID NO: 814112 - RNA, 22 nt, Human
ugucccuggacuccaggagcca

SEQ ID NO: 814113 - RNA, 22 nt, Human
agucagcuugucucuaggguug

SEQ ID NO: 814114 - RNA, 22 nt, Human
uccccaguaagccugcacugug

SEQ ID NO: 814115 - RNA, 22 nt, Human
ucugcucagccgaucugcuccg

SEQ ID NO: 814116 - RNA, 22 nt, Human
acugugugccaggcgcuggucu

SEQ ID NO: 814117 - RNA, 22 nt, Human
uaauuuugucacagugacaugc

SEQ ID NO: 814118 - RNA, 22 nt, Human
acagugcaaauaggacugucuu

SEQ ID NO: 814119 - RNA, 22 nt, Human
acuucagugugguauaaaacgu

SEQ ID NO: 814120 - RNA, 22 nt, Human
cuacagcuguguguuuaugugc

SEQ ID NO: 814121 - RNA, 22 nt, Human
ugcucccaggcauucucuguug

SEQ ID NO: 814122 - RNA, 22 nt, Human
uuguacuuaaauaugcaaauag

SEQ ID NO: 814123 - RNA, 22 nt, Human
ugucuuuagccacuugccucuu

SEQ ID NO: 814124 - RNA, 22 nt, Human
agcaccauugcaaauauggcag

SEQ ID NO: 814125 - RNA, 22 nt, Human
gcuucugcagagccguccugag

SEQ ID NO: 814126 - RNA, 22 nt, Human
gccuucugaucgcuggacugac

SEQ ID NO: 814127 - RNA, 22 nt, Human
acauauuuugaaagcuuucuaa

SEQ ID NO: 814128 - RNA, 19 nt, Human
cuucaguguucaccuggcc

SEQ ID NO: 814129 - RNA, 22 nt, Human
uuccuccagccuggagcacuuc

SEQ ID NO: 814130 - RNA, 22 nt, Human
auguaguauuuggaaauguaaa

SEQ ID NO: 814131 - RNA, 18 nt, Human
cuuuagcugucaucuuug

SEQ ID NO: 814132 - RNA, 22 nt, Human
ugccauagcaaugguaagcuga

SEQ ID NO: 814133 - RNA, 22 nt, Human
uggcucaucuuuuuagacuuau

SEQ ID NO: 814134 - RNA, 22 nt, Human
cccagguaaggaugcuccucau

SEQ ID NO: 814135 - RNA, 22 nt, Human
gagguccacugaggcaacaggg

SEQ ID NO: 814136 - RNA, 22 nt, Human
gucuggagccacugcugcugcu

SEQ ID NO: 814137 - RNA, 22 nt, Human
caagggcagcagccucaagcgg

SEQ ID NO: 814138 - RNA, 22 nt, Human
auuaguagcacacagagaucag

SEQ ID NO: 814139 - RNA, 22 nt, Human
ugcccugcagacccugcagugu

SEQ ID NO: 814140 - RNA, 22 nt, Human
cccugccuacaggguuuucuuu

SEQ ID NO: 814141 - RNA, 22 nt, Human
ucaucuccauacggucucgcag

SEQ ID NO: 814142 - RNA, 22 nt, Human
uuggcaauauuuacugaaguug

SEQ ID NO: 814143 - RNA, 22 nt, Human
aggaaauuuugaaucagugucu

SEQ ID NO: 814144 - RNA, 22 nt, Human
uugcaaauaauagccugaaacu

SEQ ID NO: 814145 - RNA, 22 nt, Human
cugaccaguccuuagcaccugg

SEQ ID NO: 814146 - RNA, 22 nt, Human
uaucuguauucugacagucacu

SEQ ID NO: 814147 - RNA, 22 nt, Human
cuuccugcaacaccuguguugc

SEQ ID NO: 814148 - RNA, 22 nt, Human
aauguuaaguuuagauuauaac

SEQ ID NO: 814149 - RNA, 22 nt, Human
uuugggcaggcuuuucccuaga

SEQ ID NO: 814150 - RNA, 22 nt, Human
acagggcaccugagguaggaag

SEQ ID NO: 814151 - RNA, 22 nt, Human
auuuccuggaggaauggaagca

SEQ ID NO: 814152 - RNA, 22 nt, Human
uaguauuuccuguaagcuauag

SEQ ID NO: 814153 - RNA, 22 nt, Human
ugcagcaucuccuugugccaug

SEQ ID NO: 814154 - RNA, 22 nt, Human
uccucagcaaacacuucacucu

SEQ ID NO: 814155 - RNA, 22 nt, Human
gaccaaggaagaggggagccag

SEQ ID NO: 814156 - RNA, 22 nt, Human
aauagcaaaugcucauuugaaa

SEQ ID NO: 814157 - RNA, 22 nt, Human
caugaaaugauauuuggguggg

SEQ ID NO: 814158 - RNA, 22 nt, Human
caauguuuuuccuuccuuaaua

SEQ ID NO: 814159 - RNA, 21 nt, Human
uccugccuuaguccagagcag

SEQ ID NO: 814160 - RNA, 22 nt, Human
ugccuaggcuggaaugcagugg

SEQ ID NO: 814161 - RNA, 22 nt, Human
gcucgcuuagauuuuccucuga

SEQ ID NO: 814162 - RNA, 22 nt, Human
agcaaauaauugucuuugaggg

SEQ ID NO: 814163 - RNA, 22 nt, Human
ccagucagccaagcugcagcgg

SEQ ID NO: 814164 - RNA, 22 nt, Human
cucagcuucuaccuccugagug

SEQ ID NO: 814165 - RNA, 22 nt, Human
cugcagaugguauuguucuggu

SEQ ID NO: 814166 - RNA, 22 nt, Human
uguuaguauuggcaaauuuguu

SEQ ID NO: 814167 - RNA, 22 nt, Human
cuaaagucauacaaggugggag

SEQ ID NO: 814168 - RNA, 22 nt, Human
agagcuccaggguuuuguagug

SEQ ID NO: 814169 - RNA, 22 nt, Human
auguccagaguaaagcacauuc

SEQ ID NO: 814170 - RNA, 22 nt, Human
uuugaaauguaucaguauaggu

SEQ ID NO: 814171 - RNA, 22 nt, Human
uucaguaagcacuucuagagcu

SEQ ID NO: 814172 - RNA, 22 nt, Human
gucuccugaggcauccauugaa

SEQ ID NO: 814173 - RNA, 22 nt, Human
guugaaauccuaacccccuagu

SEQ ID NO: 814174 - RNA, 22 nt, Human
gggcagcaaaucugagucuggu

SEQ ID NO: 814175 - RNA, 22 nt, Human
aaauacaguggcagcagauaau

SEQ ID NO: 814176 - RNA, 22 nt, Human
ugcccucagcagcagcuccugc

SEQ ID NO: 814177 - RNA, 22 nt, Human
gccugccuucggugcgcagcgg

SEQ ID NO: 814178 - RNA, 22 nt, Human
auacacauguuauuguggaagc

SEQ ID NO: 814179 - RNA, 22 nt, Human
aauacagauggcaugugaagau

SEQ ID NO: 814180 - RNA, 16 nt, Human
ucauugaagacaguac

SEQ ID NO: 814181 - RNA, 22 nt, Human
cagguuccaguugcagggacuu

SEQ ID NO: 814182 - RNA, 22 nt, Human
ugagcuucuuuauuuggccaga

SEQ ID NO: 814183 - RNA, 22 nt, Human
aacaucuagguucucaucgaua

SEQ ID NO: 814184 - RNA, 22 nt, Human
ccuccccacagcccaggagacu

SEQ ID NO: 814185 - RNA, 18 nt, Human
aguaaauguuaaauauug

SEQ ID NO: 814186 - RNA, 23 nt, Human
aguacauuugacccaaauaagcu

SEQ ID NO: 814187 - RNA, 22 nt, Human
acucacagggccucaguuuucc

SEQ ID NO: 814188 - RNA, 22 nt, Human
uguuccucugaacuucuuccaa

SEQ ID NO: 814189 - RNA, 22 nt, Human
agccugugcuguguuugcucca

SEQ ID NO: 814190 - RNA, 22 nt, Human
gccuucugauugcuggacugac

SEQ ID NO: 814191 - RNA, 22 nt, Human
uggaaauacaagaaguauguca

SEQ ID NO: 814192 - RNA, 22 nt, Human
gagcugcauagcugggauccuc

SEQ ID NO: 814193 - RNA, 22 nt, Human
aaucuguugucaggaauccaca

SEQ ID NO: 814194 - RNA, 22 nt, Human
uucaguuuugcuuuuaaucaug

SEQ ID NO: 814195 - RNA, 22 nt, Human
uccugaccacuaggaccaggcu

SEQ ID NO: 814196 - RNA, 22 nt, Human
uacaccagauuauuuauaacau

SEQ ID NO: 814197 - RNA, 22 nt, Human
aucuguucuucaaaauauuaca

SEQ ID NO: 814198 - RNA, 22 nt, Human
auagcaaaggacaauagucagu

SEQ ID NO: 814199 - RNA, 22 nt, Human
uccucuucaaaauagcucugaa

SEQ ID NO: 814200 - RNA, 22 nt, Human
uuagcaaacaucuucgugugag

SEQ ID NO: 814201 - RNA, 22 nt, Human
agcucugcuucuugggaagaug

SEQ ID NO: 814202 - RNA, 22 nt, Human
uaucuguuuuuacagugucuuu

SEQ ID NO: 814203 - RNA, 22 nt, Human
cucaguguuaaagacuuuccag

SEQ ID NO: 814204 - RNA, 22 nt, Human
acagcuucgaggaucucauccc

SEQ ID NO: 814205 - RNA, 22 nt, Human
uugucaggaacuaugauuaugc

SEQ ID NO: 814206 - RNA, 22 nt, Human
uauuacaguucgaguuucuagg

SEQ ID NO: 814207 - RNA, 22 nt, Human
uaaaugcaguacaaauuguucu

SEQ ID NO: 814208 - RNA, 22 nt, Human
caagucugaccucugggugaag

SEQ ID NO: 814209 - RNA, 22 nt, Human
uagcuucccugcuggaucauaa

SEQ ID NO: 814210 - RNA, 22 nt, Human
ugcuccaucuagagcucugcag

SEQ ID NO: 814211 - RNA, 22 nt, Human
ggcucugcugguaagaugccuc

SEQ ID NO: 814212 - RNA, 21 nt, Human
uuccuccucuggagaagaaga

SEQ ID NO: 814213 - RNA, 22 nt, Human
aacugguucuggaggcugcagg

SEQ ID NO: 814214 - RNA, 22 nt, Human
uguuccugacggccaaagaggu

SEQ ID NO: 814215 - RNA, 22 nt, Human
uugggagaaauaguugauccgc

SEQ ID NO: 814216 - RNA, 22 nt, Human
ugagcugcuucuuauaaugugu

SEQ ID NO: 814217 - RNA, 22 nt, Human
uaccaaaaccaagccauuaucu

SEQ ID NO: 814218 - RNA, 22 nt, Human
ugauuugaaaccuuuggcaaga

SEQ ID NO: 814219 - RNA, 22 nt, Human
aagcaaaagguuacacuucugg

SEQ ID NO: 814220 - RNA, 20 nt, Human
augucaggaagggagucagg

SEQ ID NO: 814221 - RNA, 22 nt, Human
acucauguccuaggaguaaagc

SEQ ID NO: 814222 - RNA, 21 nt, Human
cugcacugugauuuaaaaugu

SEQ ID NO: 814223 - RNA, 22 nt, Human
acucagaguuugcguuccauac

SEQ ID NO: 814224 - RNA, 22 nt, Human
uuccuuggaaagagacgucgcu

SEQ ID NO: 814225 - RNA, 22 nt, Human
uugcuuuauuccuagcccuugu

SEQ ID NO: 814226 - RNA, 22 nt, Human
ccgcuguccuggagcugcugcu

SEQ ID NO: 814227 - RNA, 22 nt, Human
cuuuggaaaaauaccuggcaua

SEQ ID NO: 814228 - RNA, 22 nt, Human
gucauuuuugacuuugaaguga

SEQ ID NO: 814229 - RNA, 22 nt, Human
cuguuccuccaccucaacaaac

SEQ ID NO: 814230 - RNA, 22 nt, Human
aggcuguccucucuugcucagu

SEQ ID NO: 814231 - RNA, 22 nt, Human
cacaucauguuaauucauuaca

SEQ ID NO: 814232 - RNA, 22 nt, Human
aaugugcugguaacugcuuugc

SEQ ID NO: 814233 - RNA, 22 nt, Human
caguguuuagcacagugcuugg

SEQ ID NO: 814234 - RNA, 22 nt, Human
ugaguguuguaaccauaugauu

SEQ ID NO: 814235 - RNA, 22 nt, Human
uaucacauacuucucauccagg

SEQ ID NO: 814236 - RNA, 22 nt, Human
ucaucuguuaugggaguuuuug

SEQ ID NO: 814237 - RNA, 22 nt, Human
auguccagaguaaagcacauuc

SEQ ID NO: 814238 - RNA, 22 nt, Human
caugcauuucuaccaaggaaua

SEQ ID NO: 814239 - RNA, 22 nt, Human
uagcugucagcaaucaaguggu

SEQ ID NO: 814240 - RNA, 22 nt, Human
gacauuuauuggauuuuacgag

SEQ ID NO: 814241 - RNA, 22 nt, Human
gccagguaugaauuacgcacga

SEQ ID NO: 814242 - RNA, 22 nt, Human
guuguacauaugaggauaaguu

SEQ ID NO: 814243 - RNA, 22 nt, Human
agaaucugcauuuuaacaagau

SEQ ID NO: 814244 - RNA, 22 nt, Human
cuugacacugucacucaggcca

SEQ ID NO: 814245 - RNA, 22 nt, Human
gagcuguucugugauugaucua

SEQ ID NO: 814246 - RNA, 22 nt, Human
ugcacccacuuagcugaaguuc

SEQ ID NO: 814247 - RNA, 22 nt, Human
cacaguuuugucuugguuucca

SEQ ID NO: 814248 - RNA, 22 nt, Human
uggaaauacaagaaguauguca

SEQ ID NO: 814249 - RNA, 20 nt, Human
ucaggguuucccauucuugg

SEQ ID NO: 814250 - RNA, 22 nt, Human
gauacuuuguggaauccuggau

SEQ ID NO: 814251 - RNA, 22 nt, Human
aucccugugacgagcaucccua

SEQ ID NO: 814252 - RNA, 22 nt, Human
uuggaaaugcauuuguuauuau

SEQ ID NO: 814253 - RNA, 22 nt, Human
guuuacaacaucuuguccuuca

SEQ ID NO: 814254 - RNA, 18 nt, Human
uauaaacacacuuagguu

SEQ ID NO: 814255 - RNA, 22 nt, Human
uaaguauguuagaaaaucaagu

SEQ ID NO: 814256 - RNA, 22 nt, Human
cauaaauuguacccauuccaac

SEQ ID NO: 814257 - RNA, 21 nt, Human
ugcauauauaagugcauacac

SEQ ID NO: 814258 - RNA, 22 nt, Human
uuuucuuggaguggcuguccuu

SEQ ID NO: 814259 - RNA, 22 nt, Human
ucccacugucuucucgugcucg

SEQ ID NO: 814260 - RNA, 22 nt, Human
ugcauguuucuguauguuaaug

SEQ ID NO: 814261 - RNA, 22 nt, Human
auguaacauaugugaucgcauu

SEQ ID NO: 814262 - RNA, 22 nt, Human
gcugucugcugggucgcucagg

SEQ ID NO: 814263 - RNA, 22 nt, Human
uauaugcagauuuucaucaucg

SEQ ID NO: 814264 - RNA, 20 nt, Human
uacaauauucccacuuugcu

SEQ ID NO: 814265 - RNA, 22 nt, Human
aguacaagugaugugguaaaaa

SEQ ID NO: 814266 - RNA, 22 nt, Human
acaauuucuaauauagaucuua

SEQ ID NO: 814267 - RNA, 22 nt, Human
ucugccaucaagaugcucuggc

SEQ ID NO: 814268 - RNA, 22 nt, Human
aagcauuuuagauaaagcauca

SEQ ID NO: 814269 - RNA, 22 nt, Human
ugcauuucccauuguguggcuc

SEQ ID NO: 814270 - RNA, 22 nt, Human
gacauacagcccucucccuggu

SEQ ID NO: 814271 - RNA, 22 nt, Human
uuaaguauauccauuugacugg

SEQ ID NO: 814272 - RNA, 21 nt, Human
gcaggguuugugcugugaguu

SEQ ID NO: 814273 - RNA, 22 nt, Human
auacaugugugugcauacaugu

SEQ ID NO: 814274 - RNA, 22 nt, Human
aauggcaaaguguuuucauacc

SEQ ID NO: 814275 - RNA, 22 nt, Human
cccuguccugcuaggcccuggu

SEQ ID NO: 814276 - RNA, 22 nt, Human
cacaguuuuaucuuauacugau

SEQ ID NO: 814277 - RNA, 22 nt, Human
ugggaugagcuauauagaaagu

SEQ ID NO: 814278 - RNA, 22 nt, Human
ucgcuuuaauggucuucacagc

SEQ ID NO: 814279 - RNA, 22 nt, Human
acugcauuaucaccaagaugua

SEQ ID NO: 814280 - RNA, 22 nt, Human
auuucagaguagaucguuauuu

SEQ ID NO: 814281 - RNA, 22 nt, Human
uagcagcacuauuuguuguagu

SEQ ID NO: 814282 - RNA, 22 nt, Human
ugcaugguuauauacuacuagu

SEQ ID NO: 814283 - RNA, 22 nt, Human
cccacugcugcucuccauggca

SEQ ID NO: 814284 - RNA, 22 nt, Human
agcaguuuauccucauaaugga

SEQ ID NO: 814285 - RNA, 22 nt, Human
aauaguguauuuuucaaaauua

SEQ ID NO: 814286 - RNA, 22 nt, Human
acauuuaaugauccuacuguga

SEQ ID NO: 814287 - RNA, 22 nt, Human
uccugaaggccugaguuccacc

SEQ ID NO: 814288 - RNA, 22 nt, Human
uggaaacacccacgcaugcaua

SEQ ID NO: 814289 - RNA, 19 nt, Human
cauaauacaguggaucuga

SEQ ID NO: 814290 - RNA, 22 nt, Human
ugaaaacacuuuaguuuagguc

SEQ ID NO: 814291 - RNA, 22 nt, Human
ucuguauaaaguaccgguggca

SEQ ID NO: 814292 - RNA, 22 nt, Human
aggucccugcagcagacugcca

SEQ ID NO: 814293 - RNA, 22 nt, Human
aucaucaucuaaauugugucgc

SEQ ID NO: 814294 - RNA, 20 nt, Human
ccacaguggagacuggagac

SEQ ID NO: 814295 - RNA, 22 nt, Human
cauuaacacuuuggauuuagac

SEQ ID NO: 814296 - RNA, 22 nt, Human
acucauuugcaugaugugcuau

SEQ ID NO: 814297 - RNA, 22 nt, Human
agcagugugggcugcacgcugg

SEQ ID NO: 814298 - RNA, 22 nt, Human
ucuguuauaaaucacacugcau

SEQ ID NO: 814299 - RNA, 22 nt, Human
ucacacaucucagguguuuaau

SEQ ID NO: 814300 - RNA, 22 nt, Human
cauuuacauuuaagguuaauau

SEQ ID NO: 814301 - RNA, 21 nt, Human
gccaccucaaucuucuagcgc

SEQ ID NO: 814302 - RNA, 22 nt, Human
acauucaugcaccuuccuaucc

SEQ ID NO: 814303 - RNA, 22 nt, Human
cccaccacgugcuuugcuggag

SEQ ID NO: 814304 - RNA, 17 nt, Human
acuuguauugugcuuua

SEQ ID NO: 814305 - RNA, 22 nt, Human
ucauacauguuguguucaaaug

SEQ ID NO: 814306 - RNA, 22 nt, Human
cacuuuuaacaggagaauuccc

SEQ ID NO: 814307 - RNA, 22 nt, Human
auguacaaucuaucacaagaag

SEQ ID NO: 814308 - RNA, 22 nt, Human
auacacauguuauuguggaagc

SEQ ID NO: 814309 - RNA, 22 nt, Human
uccugugccuccaccugcuccg

SEQ ID NO: 814310 - RNA, 22 nt, Human
caauaaaguggaggcccgggcu

SEQ ID NO: 814311 - RNA, 22 nt, Human
uuccaggacuggguguuugaag

SEQ ID NO: 814312 - RNA, 23 nt, Human
aguacauuugacccaaauaagcu

SEQ ID NO: 814313 - RNA, 22 nt, Human
uaaccuguuaagggcugaccca

SEQ ID NO: 814314 - RNA, 22 nt, Human
guucucugccggcaccuacccg

SEQ ID NO: 814315 - RNA, 22 nt, Human
auacaacagaaaaugauuauuc

SEQ ID NO: 814316 - RNA, 22 nt, Human
ccaugcccuugucaucuccagg

SEQ ID NO: 814317 - RNA, 22 nt, Human
gagucacauacuauguaauaga

SEQ ID NO: 814318 - RNA, 22 nt, Human
cuuuacagauggauaauuguuu

SEQ ID NO: 814319 - RNA, 22 nt, Human
ggcccucucuacauguuagacg

SEQ ID NO: 814320 - RNA, 22 nt, Human
uucaacaacuugguucaaaugg

SEQ ID NO: 814321 - RNA, 22 nt, Human
uguuaguauuggcaaauuuguu

SEQ ID NO: 814322 - RNA, 22 nt, Human
cugccaucugagccaaaagugc

SEQ ID NO: 814323 - RNA, 22 nt, Human
aaggcaguuaauuuggcuagaa

SEQ ID NO: 814324 - RNA, 22 nt, Human
cauguguauuauucuuguggaa

SEQ ID NO: 814325 - RNA, 22 nt, Human
uucacagugguaaggguuguga

SEQ ID NO: 814326 - RNA, 22 nt, Human
augcauaucuccuaucuccuca

SEQ ID NO: 814327 - RNA, 22 nt, Human
uuagcacccugauacuagaaug

SEQ ID NO: 814328 - RNA, 22 nt, Human
aaacacaucauucaugucguca

SEQ ID NO: 814329 - RNA, 22 nt, Human
acaguguuacuugauaguguau

SEQ ID NO: 814330 - RNA, 20 nt, Human
auuugcuuaccuuguuucua

SEQ ID NO: 814331 - RNA, 22 nt, Human
ggcaccuuucaucccaucuaga

SEQ ID NO: 814332 - RNA, 22 nt, Human
ccccagugguugcaacagcaga

SEQ ID NO: 814333 - RNA, 22 nt, Human
auccauuugccgugcuaugugc

SEQ ID NO: 814334 - RNA, 22 nt, Human
uaucaguagaacaauggacauu

SEQ ID NO: 814335 - RNA, 22 nt, Human
gccucugcaccaguacugugcc

SEQ ID NO: 814336 - RNA, 23 nt, Human
cagcacaguacauuuccugucuc

SEQ ID NO: 814337 - RNA, 22 nt, Human
acaagucaguggaauuaauauu

SEQ ID NO: 814338 - RNA, 22 nt, Human
acaccuuuuauucgccaggcac

SEQ ID NO: 814339 - RNA, 22 nt, Human
cuuguauuaggaagaaugcuuu

SEQ ID NO: 814340 - RNA, 22 nt, Human
uuguaacaguagcugucagcuc

SEQ ID NO: 814341 - RNA, 21 nt, Human
aggcaugagcccugcauggac

SEQ ID NO: 814342 - RNA, 22 nt, Human
uuaccacagugccugucuaaug

SEQ ID NO: 814343 - RNA, 22 nt, Human
ccacuuaagagaacagcuauag

SEQ ID NO: 814344 - RNA, 22 nt, Human
guaugucuuaggguucaguaac

SEQ ID NO: 814345 - RNA, 22 nt, Human
agcaauguuggccuauauaccu

SEQ ID NO: 814346 - RNA, 22 nt, Human
ccauuuguaccauuucuuugua

SEQ ID NO: 814347 - RNA, 22 nt, Human
ugcugcacuuauggcucugagg

SEQ ID NO: 814348 - RNA, 22 nt, Human
uguguccugugaucucuagggu

SEQ ID NO: 814349 - RNA, 22 nt, Human
uuacaguuaaugugacuaacca

SEQ ID NO: 814350 - RNA, 22 nt, Human
uucucugguuugcuguuucuga

SEQ ID NO: 814351 - RNA, 22 nt, Human
auggcuguguuguuccucugaa

SEQ ID NO: 814352 - RNA, 22 nt, Human
agcaggcauuugauauauauuu

SEQ ID NO: 814353 - RNA, 22 nt, Human
uaacacauagauauuuuaacuu

SEQ ID NO: 814354 - RNA, 22 nt, Human
uaguguguggucucucccuugu

SEQ ID NO: 814355 - RNA, 20 nt, Human
ucucccugcccaucucagau

SEQ ID NO: 814356 - RNA, 22 nt, Human
uuucaugauuaacuuagugaau

SEQ ID NO: 814357 - RNA, 22 nt, Human
gguuauuguggagaaguuccgg

SEQ ID NO: 814358 - RNA, 23 nt, Human
uguguucagucaaggaucagagu

SEQ ID NO: 814359 - RNA, 22 nt, Human
ugcaucauuaagguacaguugg

SEQ ID NO: 814360 - RNA, 22 nt, Human
uccacagggaugccugcggcuu

SEQ ID NO: 814361 - RNA, 22 nt, Human
ucucauacguuuccagguguca

SEQ ID NO: 814362 - RNA, 22 nt, Human
auauaaguguguggcuguuagu

SEQ ID NO: 814363 - RNA, 22 nt, Human
guugcauuaaucugcucaggcu

SEQ ID NO: 814364 - RNA, 22 nt, Human
auacuaagcucauuacauuuug

SEQ ID NO: 814365 - RNA, 21 nt, Human
agagacugucacugcaguacc

SEQ ID NO: 814366 - RNA, 22 nt, Human
ucuguagcauucaccagcccug

SEQ ID NO: 814367 - RNA, 23 nt, Human
ccccacuaccgugaugugcgagg

SEQ ID NO: 814368 - RNA, 22 nt, Human
uuuguguuggaagaaaugcuac

SEQ ID NO: 814369 - RNA, 22 nt, Human
uguauauacacacucccauguu

SEQ ID NO: 814370 - RNA, 22 nt, Human
acaugcacccaguuacacucuc

SEQ ID NO: 814371 - RNA, 22 nt, Human
uuuacagagaauguacauaaag

SEQ ID NO: 814372 - RNA, 22 nt, Human
uuccauacgacugaggucucgg

SEQ ID NO: 814373 - RNA, 19 nt, Human
uccugcccaccagccaggg

SEQ ID NO: 814374 - RNA, 22 nt, Human
cagccuuugggucagaagauuc

SEQ ID NO: 814375 - RNA, 22 nt, Human
uaauucuagauugacauuuuga

SEQ ID NO: 814376 - RNA, 20 nt, Human
cuguuugcuaucaugagcug

SEQ ID NO: 814377 - RNA, 22 nt, Human
uaaaugcaguacaaauuguucu

SEQ ID NO: 814378 - RNA, 22 nt, Human
auauacacuguuucaguugaag

SEQ ID NO: 814379 - RNA, 22 nt, Human
uguaccacucuacuaaggguuc

SEQ ID NO: 814380 - RNA, 22 nt, Human
uccucuucaaaauagcucugaa

SEQ ID NO: 814381 - RNA, 22 nt, Human
cacauuuaugggcugggaggca

SEQ ID NO: 814382 - RNA, 22 nt, Human
aacaguaugugagauuuacaca

SEQ ID NO: 814383 - RNA, 23 nt, Human
acauuacacgcaguaauugcccc

SEQ ID NO: 814384 - RNA, 19 nt, Human
caguuuguccagaggggac

SEQ ID NO: 814385 - RNA, 22 nt, Human
gucccugauaagagccaucgau

SEQ ID NO: 814386 - RNA, 22 nt, Human
uuugacaugugcuuauaacuuu

SEQ ID NO: 814387 - RNA, 22 nt, Human
cugccuuggcccuaguucaugg

SEQ ID NO: 814388 - RNA, 22 nt, Human
uuguugcaagccuggaaucugg

SEQ ID NO: 814389 - RNA, 22 nt, Human
augaacaguacaaagcacagac

SEQ ID NO: 814390 - RNA, 22 nt, Human
ccacccagccagaugcaggaag

SEQ ID NO: 814391 - RNA, 22 nt, Human
gccuuugcugugacaaugcugg

SEQ ID NO: 814392 - RNA, 22 nt, Human
uguguacauguaucaacuaucg

SEQ ID NO: 814393 - RNA, 22 nt, Human
acucuguuugcagguagcucag

SEQ ID NO: 814394 - RNA, 22 nt, Human
uauacuacgcaccaaacaaagg

SEQ ID NO: 814395 - RNA, 21 nt, Human
acaaauuguuuauauaggaag

SEQ ID NO: 814396 - RNA, 22 nt, Human
uugaugcugucuuucagaauca

SEQ ID NO: 814397 - RNA, 22 nt, Human
aacagguagggacucuaacuug

SEQ ID NO: 814398 - RNA, 22 nt, Human
acaaguuucauuguuuagaacc

SEQ ID NO: 814399 - RNA, 22 nt, Human
aaauugcaaaaguacuuuuagg

SEQ ID NO: 814400 - RNA, 22 nt, Human
aaguuacacauuuucauuguaa

SEQ ID NO: 814401 - RNA, 22 nt, Human
ucacuuuaccucauucaggcag

SEQ ID NO: 814402 - RNA, 22 nt, Human
uggaagguguggcaggucuagu

SEQ ID NO: 814403 - RNA, 22 nt, Human
ugucuucuaccuugacagcauu

SEQ ID NO: 814404 - RNA, 21 nt, Human
ucccacuggcccagggcucca

SEQ ID NO: 814405 - RNA, 22 nt, Human
ugucacagagcgugcaacagaa

SEQ ID NO: 814406 - RNA, 22 nt, Human
auugcacaucugcacuacagcc

SEQ ID NO: 814407 - RNA, 22 nt, Human
auggccugcagugcugccacag

SEQ ID NO: 814408 - RNA, 22 nt, Human
auuugcuuguucaccaguacuu

SEQ ID NO: 814409 - RNA, 22 nt, Human
uaaguauuggccuauagcuaga

SEQ ID NO: 814410 - RNA, 19 nt, Human
auacacguguauacauaca

SEQ ID NO: 814411 - RNA, 22 nt, Human
auggugguagaagcacuaugug

SEQ ID NO: 814412 - RNA, 22 nt, Human
ucccacugcuuugcucugcuca

SEQ ID NO: 814413 - RNA, 22 nt, Human
guuuauuggguauuguggagcc

SEQ ID NO: 814414 - RNA, 22 nt, Human
uugcauauccuccaacacaugg

SEQ ID NO: 814415 - RNA, 19 nt, Human
acacaccagugccugugac

SEQ ID NO: 814416 - RNA, 22 nt, Human
uccucagcaaacacuucacucu

SEQ ID NO: 814417 - RNA, 22 nt, Human
cauuucaaacaguuacagcugc

SEQ ID NO: 814418 - RNA, 22 nt, Human
uguacauauucaagcacuucua

SEQ ID NO: 814419 - RNA, 22 nt, Human
acaugacagugacuuuauaaga

SEQ ID NO: 814420 - RNA, 22 nt, Human
aucauccauggcugaucauaaa

SEQ ID NO: 814421 - RNA, 22 nt, Human
cauccauagauugagagauggu

SEQ ID NO: 814422 - RNA, 22 nt, Human
uugcuauuuugagagucauagu

SEQ ID NO: 814423 - RNA, 22 nt, Human
guccacauaggaacccagcuuc

SEQ ID NO: 814424 - RNA, 22 nt, Human
uucucugaguacguuucagugu

SEQ ID NO: 814425 - RNA, 22 nt, Human
augcuacauuuugguuuauaaa

SEQ ID NO: 814426 - RNA, 22 nt, Human
gucaucaucaggcagaugcugc

SEQ ID NO: 814427 - RNA, 22 nt, Human
auacaugacucacacauucugc

SEQ ID NO: 814428 - RNA, 22 nt, Human
aauggcuguucucugugauugg

SEQ ID NO: 814429 - RNA, 18 nt, Human
uacagcuugaguugacug

SEQ ID NO: 814430 - RNA, 22 nt, Human
uccacagguccucuuugcaaag

SEQ ID NO: 814431 - RNA, 22 nt, Human
guguacacuugaacugacgguu

SEQ ID NO: 814432 - RNA, 22 nt, Human
auauggcuguugcacaucuaag

SEQ ID NO: 814433 - RNA, 22 nt, Human
caauguacaaaauaauuacaca

SEQ ID NO: 814434 - RNA, 22 nt, Human
uuugcacuuaaauuuacaacac

SEQ ID NO: 814435 - RNA, 22 nt, Human
gugggugucaguaucuuuaacg

SEQ ID NO: 814436 - RNA, 22 nt, Human
guaugugucuuagaacuuggga

SEQ ID NO: 814437 - RNA, 18 nt, Human
uccaccgcgugcaccucu

SEQ ID NO: 814438 - RNA, 22 nt, Human
uacaguaaccagucuacuuaga

SEQ ID NO: 814439 - RNA, 22 nt, Human
uuagcacugucugguuaucuug

SEQ ID NO: 814440 - RNA, 22 nt, Human
cccugccuacaggguuuucuuu

SEQ ID NO: 814441 - RNA, 22 nt, Human
ucagccaggccaggcauucaca

SEQ ID NO: 814442 - RNA, 22 nt, Human
acaacuuuaauggguuucagcu

SEQ ID NO: 814443 - RNA, 22 nt, Human
cacauuuaaagguugaagcuga

SEQ ID NO: 814444 - RNA, 22 nt, Human
aauaaguacuuggggauaacuu

SEQ ID NO: 814445 - RNA, 22 nt, Human
ccugugcaugccaggguacacc

SEQ ID NO: 814446 - RNA, 22 nt, Human
uuaguguccagaguuuuuauua

SEQ ID NO: 814447 - RNA, 22 nt, Human
cugcacagucauuuccucucaa

SEQ ID NO: 814448 - RNA, 22 nt, Human
ugcauuugcaauggguacacaa

SEQ ID NO: 814449 - RNA, 22 nt, Human
aaggaggaauguagccagcucc

SEQ ID NO: 814450 - RNA, 22 nt, Human
gaugucuggcuaccacucgcac

SEQ ID NO: 814451 - RNA, 22 nt, Human
uuacaguuuacauaagaauugu

SEQ ID NO: 814452 - RNA, 22 nt, Human
uugggcugcagcaauuauuagu

SEQ ID NO: 814453 - RNA, 22 nt, Human
ugggugguugcugaggcuccuu

SEQ ID NO: 814454 - RNA, 22 nt, Human
ucacaauacucacucaauggcu

SEQ ID NO: 814455 - RNA, 22 nt, Human
uuguacacacaggaacaaacgu

SEQ ID NO: 814456 - RNA, 22 nt, Human
uauagcagcaugauuuauaguc

SEQ ID NO: 814457 - RNA, 22 nt, Human
aguaacagguguacagacuauc

SEQ ID NO: 814458 - RNA, 22 nt, Human
aaauugcauuuuaaagguagau

SEQ ID NO: 814459 - RNA, 22 nt, Human
aucauuaacccuugaugcuggg

SEQ ID NO: 814460 - RNA, 22 nt, Human
uguccugugcacuguagcaugu

SEQ ID NO: 814461 - RNA, 23 nt, Human
gcugccaaggaggcaggggugcc

SEQ ID NO: 814462 - RNA, 23 nt, Human
cagcacaguacauuuccugucuc

SEQ ID NO: 814463 - RNA, 22 nt, Human
uaaaaguuagcuaggacaaagu

SEQ ID NO: 814464 - RNA, 22 nt, Human
ggagaugccuuguuucaggaac

SEQ ID NO: 814465 - RNA, 22 nt, Human
augcugagugagugaaacccag

SEQ ID NO: 814466 - RNA, 22 nt, Human
gccacccuggacgcacuguucg

SEQ ID NO: 814467 - RNA, 22 nt, Human
aauacagugaaagugagcaagg

SEQ ID NO: 814468 - RNA, 22 nt, Human
cuucuggcguuggaggucugag

SEQ ID NO: 814469 - RNA, 22 nt, Human
ugucccuggacuccaggagcca

SEQ ID NO: 814470 - RNA, 22 nt, Human
ucuuugcauggacauguguuuu

SEQ ID NO: 814471 - RNA, 22 nt, Human
ccgcuguccuggagcugcugcu

SEQ ID NO: 814472 - RNA, 22 nt, Human
accuuuaugaaacagcugucgu

SEQ ID NO: 814473 - RNA, 22 nt, Human
acagugcaaauaggacugucuu

SEQ ID NO: 814474 - RNA, 22 nt, Human
auucuugauauagauaguuaau

SEQ ID NO: 814475 - RNA, 22 nt, Human
agagaauuaacauuccauggcu

SEQ ID NO: 814476 - RNA, 22 nt, Human
gucuccugaggcauccauugaa

SEQ ID NO: 814477 - RNA, 22 nt, Human
agcucugcuucuugggaagaug

SEQ ID NO: 814478 - RNA, 22 nt, Human
gcgcugccucugcucuccccac

SEQ ID NO: 814479 - RNA, 22 nt, Human
auguuugaaauuguaaguauau

SEQ ID NO: 814480 - RNA, 22 nt, Human
auaguguguaaagugcagugau

SEQ ID NO: 814481 - RNA, 22 nt, Human
cgauuuccgcuugaucugaucu

SEQ ID NO: 814482 - RNA, 22 nt, Human
ucugcucagccgaucugcuccg

SEQ ID NO: 814483 - RNA, 22 nt, Human
aaucugagggaacuugaacucc

SEQ ID NO: 814484 - RNA, 22 nt, Human
ugucuuaugcugcauagacuau

SEQ ID NO: 814485 - RNA, 22 nt, Human
uucuggagacccagcaacaggg

SEQ ID NO: 814486 - RNA, 22 nt, Human
aaugaacacuuagccuuucuau

SEQ ID NO: 814487 - RNA, 22 nt, Human
guuucuuauuucaacuggaaca

SEQ ID NO: 814488 - RNA, 22 nt, Human
aaacugaggcucccgagggugu

SEQ ID NO: 814489 - RNA, 22 nt, Human
caacuuuagaccccaaguagcu

SEQ ID NO: 814490 - RNA, 22 nt, Human
auugugcaccuacugugugcag

SEQ ID NO: 814491 - RNA, 22 nt, Human
guuuugaauacuacuagaacuu

SEQ ID NO: 814492 - RNA, 22 nt, Human
uaguguguggucucucccuugu

SEQ ID NO: 814493 - RNA, 22 nt, Human
ggaccugaacauaaaacgaggc

SEQ ID NO: 814494 - RNA, 22 nt, Human
guaugucaugagccuugugcgu

SEQ ID NO: 814495 - RNA, 22 nt, Human
gaauguuaaugcacuucuagcu

SEQ ID NO: 814496 - RNA, 22 nt, Human
caggcgaccccuaggagcaaca

SEQ ID NO: 814497 - RNA, 22 nt, Human
ccacugauucugccaggucucu

SEQ ID NO: 814498 - RNA, 21 nt, Human
uaaacauaaccuuguauggcu

SEQ ID NO: 814499 - RNA, 22 nt, Human
cuuggcauguucaucugcuugg

SEQ ID NO: 814500 - RNA, 22 nt, Human
uacuuugagaugaugcugaucg

SEQ ID NO: 814501 - RNA, 22 nt, Human
ucauuguuucugcuuuucauga

SEQ ID NO: 814502 - RNA, 22 nt, Human
cuaaauguuuuaucuuccuggc

SEQ ID NO: 814503 - RNA, 18 nt, Human
gccagcccuccaaccucc

SEQ ID NO: 814504 - RNA, 22 nt, Human
cugagcugcucccgcugcagcg

SEQ ID NO: 814505 - RNA, 22 nt, Human
uucaacaacuugguucaaaugg

SEQ ID NO: 814506 - RNA, 22 nt, Human
gugauuucagguuuuucauacu

SEQ ID NO: 814507 - RNA, 22 nt, Human
uucagucuuguugaaaacuugg

SEQ ID NO: 814508 - RNA, 17 nt, Human
cauucuguaaucuuucu

SEQ ID NO: 814509 - RNA, 22 nt, Human
acagcuucgaggaucucauccc

SEQ ID NO: 814510 - RNA, 22 nt, Human
aguacuuuuuguucaauugugc

SEQ ID NO: 814511 - RNA, 22 nt, Human
uguuccugacggccaaagaggu

SEQ ID NO: 814512 - RNA, 22 nt, Human
aacaugaugacauuguaagcuu

SEQ ID NO: 814513 - RNA, 21 nt, Human
cugcacugugauuuaaaaugu

SEQ ID NO: 814514 - RNA, 22 nt, Human
aagcaauucacaguucacuuaa

SEQ ID NO: 814515 - RNA, 21 nt, Human
uuccuccucuggagaagaaga

SEQ ID NO: 814516 - RNA, 22 nt, Human
ugcuccaucuagagcucugcag

SEQ ID NO: 814517 - RNA, 18 nt, Human
agcucacagaucuguuuu

SEQ ID NO: 814518 - RNA, 22 nt, Human
gcagcaaucuucacagugucau

SEQ ID NO: 814519 - RNA, 22 nt, Human
gaugcugauuuuacuguuuucu

SEQ ID NO: 814520 - RNA, 22 nt, Human
cagagcugagucuucaagguug

SEQ ID NO: 814521 - RNA, 22 nt, Human
uuccagagaguuauuccccugg

SEQ ID NO: 814522 - RNA, 22 nt, Human
agcugugaccuucaagagcuac

SEQ ID NO: 814523 - RNA, 22 nt, Human
aaauacaguggcagcagauaau

SEQ ID NO: 814524 - RNA, 22 nt, Human
agguccugucuuaucucuguaa

SEQ ID NO: 814525 - RNA, 22 nt, Human
uugauguaauacuuugcaacca

SEQ ID NO: 814526 - RNA, 19 nt, Human
ucuuucauuucuagcucug

SEQ ID NO: 814527 - RNA, 22 nt, Human
caguauuuaggauuaggagaga

SEQ ID NO: 814528 - RNA, 22 nt, Human
ggcucugcugguaagaugccuc

SEQ ID NO: 814529 - RNA, 22 nt, Human
cugagcugguucucuugugaaa

SEQ ID NO: 814530 - RNA, 22 nt, Human
cugcaucaguggauaugauggu

SEQ ID NO: 814531 - RNA, 22 nt, Human
ccuguaccgcgaucugcugcgc

SEQ ID NO: 814532 - RNA, 22 nt, Human
uguguacauguaucaacuaucg

SEQ ID NO: 814533 - RNA, 22 nt, Human
uguaccacucuacuaaggguuc

SEQ ID NO: 814534 - RNA, 21 nt, Human
uccagcacagaugaccucccc

SEQ ID NO: 814535 - RNA, 22 nt, Human
cucacucaguuuuuaguucauc

SEQ ID NO: 814536 - RNA, 21 nt, Human
uggcaggcagcuggaagcuug

SEQ ID NO: 814537 - RNA, 22 nt, Human
gcugccaauccagcugugggag

SEQ ID NO: 814538 - RNA, 22 nt, Human
augcaguuagguaauagucuca

SEQ ID NO: 814539 - RNA, 22 nt, Human
guccacauaggaacccagcuuc

SEQ ID NO: 814540 - RNA, 22 nt, Human
uuccuuggagucaaacagggag

SEQ ID NO: 814541 - RNA, 22 nt, Human
uucgcuuugcccguugucauuu

SEQ ID NO: 814542 - RNA, 22 nt, Human
aauuauugagcaucuacugugu

SEQ ID NO: 814543 - RNA, 22 nt, Human
uuccuuggaaagagacgucgcu

SEQ ID NO: 814544 - RNA, 22 nt, Human
caguauuucauucagaauuguu

SEQ ID NO: 814545 - RNA, 22 nt, Human
uugaugcugucuuucagaauca

SEQ ID NO: 814546 - RNA, 22 nt, Human
ggaccugcucucccaguucucu

SEQ ID NO: 814547 - RNA, 22 nt, Human
gugcgggccuggggguuucucu

SEQ ID NO: 814548 - RNA, 22 nt, Human
uuucugaggaauuaauacagaa

SEQ ID NO: 814549 - RNA, 22 nt, Human
aaaccuguuaauagagcgaugc

SEQ ID NO: 814550 - RNA, 22 nt, Human
cuaguagcccauuuuggauacc

SEQ ID NO: 814551 - RNA, 18 nt, Human
auuugcaggcaugcaggc

SEQ ID NO: 814552 - RNA, 22 nt, Human
aaacaucuucucuugauucuuu

SEQ ID NO: 814553 - RNA, 22 nt, Human
ccacuuaagagaacagcuauag

SEQ ID NO: 814554 - RNA, 22 nt, Human
ugcacccacuuagcugaaguuc

SEQ ID NO: 814555 - RNA, 22 nt, Human
uaucuagagccuggaagucuug

SEQ ID NO: 814556 - RNA, 22 nt, Human
ccaaaauauuagugcuuaagua

SEQ ID NO: 814557 - RNA, 20 nt, Human
ugagucagcugcaugggugg

SEQ ID NO: 814558 - RNA, 22 nt, Human
uugcaguuuugacagaccaaau

SEQ ID NO: 814559 - RNA, 22 nt, Human
cucagcuucuaccuccugagug

SEQ ID NO: 814560 - RNA, 22 nt, Human
cuccagcucgcgagcucugcuc

SEQ ID NO: 814561 - RNA, 22 nt, Human
cucuggcaauugcugcugacuc

SEQ ID NO: 814562 - RNA, 22 nt, Human
agccacugugugaccagcuguc

SEQ ID NO: 814563 - RNA, 22 nt, Human
cagcagcucaggcuccuuccca

SEQ ID NO: 814564 - RNA, 22 nt, Human
uugucaggaacuaugauuaugc

SEQ ID NO: 814565 - RNA, 18 nt, Human
uacagcuugaguugacug

SEQ ID NO: 814566 - RNA, 22 nt, Human
uccuuggcaugccgucuucucc

SEQ ID NO: 814567 - RNA, 22 nt, Human
agugaaauaugcccauugcugu

SEQ ID NO: 814568 - RNA, 22 nt, Human
cugaaagcaaaguaauucuuaa

SEQ ID NO: 814569 - RNA, 22 nt, Human
uccucagcaaacacuucacucu

SEQ ID NO: 814570 - RNA, 22 nt, Human
cacagcuucuccccgcugcggc

SEQ ID NO: 814571 - RNA, 22 nt, Human
gugagagugguuuauguccaug

SEQ ID NO: 814572 - RNA, 22 nt, Human
aaucuguuuuaaaguuugugcc

SEQ ID NO: 814573 - RNA, 22 nt, Human
uggcaacucaauuucuacaaga

SEQ ID NO: 814574 - RNA, 22 nt, Human
uucugugcucaaaacuuuccaa

SEQ ID NO: 814575 - RNA, 23 nt, Human
acagaagccaggagccgcugggc

SEQ ID NO: 814576 - RNA, 22 nt, Human
uuuggcaagcgaguacuuucug

SEQ ID NO: 814577 - RNA, 22 nt, Human
augguuuuguccucuuugguuc

SEQ ID NO: 814578 - RNA, 22 nt, Human
cacuguugaagauacuuccucu

SEQ ID NO: 814579 - RNA, 22 nt, Human
ucccacacagcccgcucaccgg

SEQ ID NO: 814580 - RNA, 22 nt, Human
ugauaguaucugauuauuucac

SEQ ID NO: 814581 - RNA, 22 nt, Human
uccacagguccucuuugcaaag

SEQ ID NO: 814582 - RNA, 22 nt, Human
agucacuguuuaaucuagcuaa

SEQ ID NO: 814583 - RNA, 22 nt, Human
caaacauuuguuggaaccccug

SEQ ID NO: 814584 - RNA, 20 nt, Human
cuguuugcuaucaugagcug

SEQ ID NO: 814585 - RNA, 22 nt, Human
gccuguuucuccuccuuggccc

SEQ ID NO: 814586 - RNA, 22 nt, Human
uucuuuucuuuaggcauugugu

SEQ ID NO: 814587 - RNA, 18 nt, Human
cugcccagagcauuucau

SEQ ID NO: 814588 - RNA, 22 nt, Human
agugcuguaacaacuuauuugg

SEQ ID NO: 814589 - RNA, 22 nt, Human
uuucugugguggguaguucaga

SEQ ID NO: 814590 - RNA, 22 nt, Human
gaggaaccaaucugugauauuc

SEQ ID NO: 814591 - RNA, 22 nt, Human
cuguauuucccacauucucuau

SEQ ID NO: 814592 - RNA, 22 nt, Human
gcuguggucugugagcuccaaa

SEQ ID NO: 814593 - RNA, 22 nt, Human
uguucuucuagauugccuuuua

SEQ ID NO: 814594 - RNA, 22 nt, Human
aggguagggccguagggccaug

SEQ ID NO: 814595 - RNA, 22 nt, Human
ggcagaggagcuggaaacaugg

SEQ ID NO: 814596 - RNA, 22 nt, Human
uuuucagugggcaaugauguga

SEQ ID NO: 814597 - RNA, 22 nt, Human
cccaagagguggagguugcagu

SEQ ID NO: 814598 - RNA, 22 nt, Human
auuacaaaagaagggagaaggu

SEQ ID NO: 814599 - RNA, 22 nt, Human
caugcugugugguuagaacugu

SEQ ID NO: 814600 - RNA, 22 nt, Human
cccaggaaugggaaggaggaau

SEQ ID NO: 814601 - RNA, 22 nt, Human
uccaggagguugagugaguucc

SEQ ID NO: 814602 - RNA, 22 nt, Human
ucaucugucauccacaaagcug

SEQ ID NO: 814603 - RNA, 22 nt, Human
agcagagccugggcuaggggug

SEQ ID NO: 814604 - RNA, 21 nt, Human
agucuguuaggaugacucuga

SEQ ID NO: 814605 - RNA, 22 nt, Human
aaggccagacaggaccacaucu

SEQ ID NO: 814606 - RNA, 19 nt, Human
uugaaauuguuugauaugg

SEQ ID NO: 814607 - RNA, 22 nt, Human
ugcauguggaccccuggugccu

SEQ ID NO: 814608 - RNA, 22 nt, Human
uccaggaguuugaccugugggc

SEQ ID NO: 814609 - RNA, 22 nt, Human
ucucaggaagauuagggcuaag

SEQ ID NO: 814610 - RNA, 22 nt, Human
agaggucagauuucuccuggug

SEQ ID NO: 814611 - RNA, 22 nt, Human
uuucacauuuaggcgugaauug

SEQ ID NO: 814612 - RNA, 22 nt, Human
caaguaaagaaucacauuucuu

SEQ ID NO: 814613 - RNA, 22 nt, Human
gaucauuugcaggaaacauuaa

SEQ ID NO: 814614 - RNA, 20 nt, Human
aggcagcuggccaggcaggu

SEQ ID NO: 814615 - RNA, 22 nt, Human
uuucuucagccacuccaaacug

SEQ ID NO: 814616 - RNA, 22 nt, Human
aggaaagguagcgugccagcag

SEQ ID NO: 814617 - RNA, 22 nt, Human
uucacagauguauuggaacucc

SEQ ID NO: 814618 - RNA, 22 nt, Human
uuugaagucaggcuuucuaccc

SEQ ID NO: 814619 - RNA, 22 nt, Human
caguucuuauuuggccaguguc

SEQ ID NO: 814620 - RNA, 22 nt, Human
acuggcagagacccugauggcc

SEQ ID NO: 814621 - RNA, 22 nt, Human
auuaaauuggaucugcauaguu

SEQ ID NO: 814622 - RNA, 22 nt, Human
uguggaaaauuggaacguuccu

SEQ ID NO: 814623 - RNA, 22 nt, Human
gagguagcaugcuggaagggac

SEQ ID NO: 814624 - RNA, 22 nt, Human
accaggaggaaguguuaaugau

SEQ ID NO: 814625 - RNA, 22 nt, Human
uugcauuucccauugaguaaug

SEQ ID NO: 814626 - RNA, 22 nt, Human
cccaggagguagagguugcagu

SEQ ID NO: 814627 - RNA, 22 nt, Human
gucuucaacaauaacuaccacu

SEQ ID NO: 814628 - RNA, 22 nt, Human
ugaugaaauguugaggcaguga

SEQ ID NO: 814629 - RNA, 22 nt, Human
uaauuauuugaagacauuagag

SEQ ID NO: 814630 - RNA, 22 nt, Human
ugcuuuggaucuauuugcugag

SEQ ID NO: 814631 - RNA, 22 nt, Human
auucauuuagguauucacuuac

SEQ ID NO: 814632 - RNA, 22 nt, Human
gauggacagccuggaaggaaag

SEQ ID NO: 814633 - RNA, 22 nt, Human
ggaggcagaauagagugugggu

SEQ ID NO: 814634 - RNA, 22 nt, Human
uuauuugcccauguuuagcaga

SEQ ID NO: 814635 - RNA, 22 nt, Human
uucauuaguucugaagaugucu

SEQ ID NO: 814636 - RNA, 22 nt, Human
uuugaaagaaaccagugaguga

SEQ ID NO: 814637 - RNA, 22 nt, Human
uauuauuaaauggcagaauuuu

SEQ ID NO: 814638 - RNA, 22 nt, Human
uugcaucuagggcaacccagag

SEQ ID NO: 814639 - RNA, 22 nt, Human
caaggccacuccagagacuggu

SEQ ID NO: 814640 - RNA, 22 nt, Human
ucuuugcaggccaaauuguuaa

SEQ ID NO: 814641 - RNA, 22 nt, Human
gacggcagaaacucaugagguc

SEQ ID NO: 814642 - RNA, 21 nt, Human
uuccagagauuguuucaccug

SEQ ID NO: 814643 - RNA, 22 nt, Human
auugaaagcacaaagaacaagu

SEQ ID NO: 814644 - RNA, 20 nt, Human
uucuucucuaguuaucuuca

SEQ ID NO: 814645 - RNA, 22 nt, Human
gucaggauuauuuuauuaaaag

SEQ ID NO: 814646 - RNA, 22 nt, Human
cacauauuguaguucaccagga

SEQ ID NO: 814647 - RNA, 22 nt, Human
agauggagaaugacaauuaagg

SEQ ID NO: 814648 - RNA, 22 nt, Human
ccaggcugcagucaaggggcau

SEQ ID NO: 814649 - RNA, 22 nt, Human
aaaugauugucaaaguucuguu

SEQ ID NO: 814650 - RNA, 22 nt, Human
ucauucuuuaccaaguugucac

SEQ ID NO: 814651 - RNA, 20 nt, Human
gcucccagccugcagucccc

SEQ ID NO: 814652 - RNA, 22 nt, Human
accauguguuuuacacauggua

SEQ ID NO: 814653 - RNA, 22 nt, Human
ucuacuguagugaugcugcagu

SEQ ID NO: 814654 - RNA, 22 nt, Human
ucacacagauugguagagcuga

SEQ ID NO: 814655 - RNA, 22 nt, Human
uggaggaaguugcuggaaguca

SEQ ID NO: 814656 - RNA, 22 nt, Human
ucuuugcacugugcaagcagaa

SEQ ID NO: 814657 - RNA, 18 nt, Human
aagaggaggaaacccagg

SEQ ID NO: 814658 - RNA, 22 nt, Human
aggccagcaagaaagagagucu

SEQ ID NO: 814659 - RNA, 19 nt, Human
ugccuggacaaaugugggg

SEQ ID NO: 814660 - RNA, 22 nt, Human
gcucaggaucagccaccucuuu

SEQ ID NO: 814661 - RNA, 22 nt, Human
gaggcagugucgguggcaggau

SEQ ID NO: 814662 - RNA, 22 nt, Human
uuugaaauuaagauauugucca

SEQ ID NO: 814663 - RNA, 22 nt, Human
caggaggaagaacucugcaaca

SEQ ID NO: 814664 - RNA, 22 nt, Human
ccuggagauuucuucaagcuuu

SEQ ID NO: 814665 - RNA, 22 nt, Human
cagggagggacaauugucaccu

SEQ ID NO: 814666 - RNA, 21 nt, Human
gaacauuuggguuguuucuac

SEQ ID NO: 814667 - RNA, 22 nt, Human
cauuuccagcuccugcaucaug

SEQ ID NO: 814668 - RNA, 22 nt, Human
uguuuuaaucucccauugcucu

SEQ ID NO: 814669 - RNA, 22 nt, Human
cauuuguauguuccuccuuagg

SEQ ID NO: 814670 - RNA, 22 nt, Human
augugucuuugagacucugcua

SEQ ID NO: 814671 - RNA, 22 nt, Human
uuucauggcuaggacuagagug

SEQ ID NO: 814672 - RNA, 22 nt, Human
acaggagaauuaucuggaacaa

SEQ ID NO: 814673 - RNA, 22 nt, Human
augauguuaccaguacuuagag

SEQ ID NO: 814674 - RNA, 22 nt, Human
ggagcacuauaauagagauuuu

SEQ ID NO: 814675 - RNA, 22 nt, Human
ugucucaguacacuccgauguu

SEQ ID NO: 814676 - RNA, 20 nt, Human
uugauaggcagcuugucagg

SEQ ID NO: 814677 - RNA, 22 nt, Human
agaggacaaaaugagaagugcu

SEQ ID NO: 814678 - RNA, 22 nt, Human
cauuugcagagggugacacucu

SEQ ID NO: 814679 - RNA, 22 nt, Human
aggaugagccgcgcaagcugac

SEQ ID NO: 814680 - RNA, 22 nt, Human
uauuuguugaguuguuaugucu

SEQ ID NO: 814681 - RNA, 22 nt, Human
cccaggaacuccagagcuccuc

SEQ ID NO: 814682 - RNA, 22 nt, Human
ccucagaugucuuaaggcacug

SEQ ID NO: 814683 - RNA, 22 nt, Human
uucucugaguacguuucagugu

SEQ ID NO: 814684 - RNA, 22 nt, Human
uuucuaggcacagugucuuccc

SEQ ID NO: 814685 - RNA, 22 nt, Human
auucuucagaauaucuggcacu

SEQ ID NO: 814686 - RNA, 22 nt, Human
ccacaucucgguccccucuuug

SEQ ID NO: 814687 - RNA, 22 nt, Human
cuuuccaagaaugcagauaccu

SEQ ID NO: 814688 - RNA, 22 nt, Human
uagaagcaguaauagaaauagg

SEQ ID NO: 814689 - RNA, 19 nt, Human
aggguggcaaaggagggug

SEQ ID NO: 814690 - RNA, 19 nt, Human
acuggcaguuucugcaugg

SEQ ID NO: 814691 - RNA, 22 nt, Human
gcagaggccuagguggaaggcc

SEQ ID NO: 814692 - RNA, 22 nt, Human
ugccuugcacauaauauacauu

SEQ ID NO: 814693 - RNA, 22 nt, Human
gcuuuggaugugugccugaggu

SEQ ID NO: 814694 - RNA, 22 nt, Human
ggcuuggaccagucacaguggu

SEQ ID NO: 814695 - RNA, 22 nt, Human
uuuucagaggccuaagagguuu

SEQ ID NO: 814696 - RNA, 22 nt, Human
acauguaaaaggaacaugcaug

SEQ ID NO: 814697 - RNA, 22 nt, Human
cuccaggaaaauagggaaugag

SEQ ID NO: 814698 - RNA, 22 nt, Human
ugaggcaggaaguuauauaaug

SEQ ID NO: 814699 - RNA, 22 nt, Human
cucagaagaacaaaggcucuac

SEQ ID NO: 814700 - RNA, 22 nt, Human
guuugcauuuauuagucuucug

SEQ ID NO: 814701 - RNA, 22 nt, Human
aggcaguguguagcuggaagag

SEQ ID NO: 814702 - RNA, 22 nt, Human
uagaaaugauugguugagcucu

SEQ ID NO: 814703 - RNA, 22 nt, Human
acacaaauuguaggauaauugc

SEQ ID NO: 814704 - RNA, 22 nt, Human
cugaacucuuuaugacagcuug

SEQ ID NO: 814705 - RNA, 22 nt, Human
aguggcaggcggagauguagga

SEQ ID NO: 814706 - RNA, 21 nt, Human
auaagcaugcugauuacauuu

SEQ ID NO: 814707 - RNA, 20 nt, Human
uauuuguauuugggaaaguu

SEQ ID NO: 814708 - RNA, 22 nt, Human
uacaaagagguaauugcauaua

SEQ ID NO: 814709 - RNA, 21 nt, Human
uggagacucugguucuuugug

SEQ ID NO: 814710 - RNA, 19 nt, Human
caggaugaucccaugacac

SEQ ID NO: 814711 - RNA, 22 nt, Human
uccauguguuuuccuguccaca

SEQ ID NO: 814712 - RNA, 22 nt, Human
ggcagcauauauucagugggca

SEQ ID NO: 814713 - RNA, 18 nt, Human
ggcaucugcacagcagcc

SEQ ID NO: 814714 - RNA, 22 nt, Human
uaucuuguaauagguccacuug

SEQ ID NO: 814715 - RNA, 22 nt, Human
gucuucuuguguugccugucuu

SEQ ID NO: 814716 - RNA, 22 nt, Human
cagugguuauacuuacuguuuc

SEQ ID NO: 814717 - RNA, 22 nt, Human
aagugagugguaaggagcaugg

SEQ ID NO: 814718 - RNA, 22 nt, Human
gugguuuugccauuacaaguaa

SEQ ID NO: 814719 - RNA, 22 nt, Human
cucccaggcacagggaggagcc

SEQ ID NO: 814720 - RNA, 22 nt, Human
gagcagcuccagccgcaugacu

SEQ ID NO: 814721 - RNA, 22 nt, Human
uucccucucacuuaaagcuugg

SEQ ID NO: 814722 - RNA, 22 nt, Human
agcuagccuaggcagagugcau

SEQ ID NO: 814723 - RNA, 22 nt, Human
ucucgacagccuggcacagugg

SEQ ID NO: 814724 - RNA, 22 nt, Human
ugguuuugcuaaaauagaaaga

SEQ ID NO: 814725 - RNA, 22 nt, Human
aaaauuauucauggcuuuugga

SEQ ID NO: 814726 - RNA, 22 nt, Human
aggcagcucuguggccucccag

SEQ ID NO: 814727 - RNA, 22 nt, Human
gugaaggacuagcauggagggc

SEQ ID NO: 814728 - RNA, 22 nt, Human
caggaugggauguagugggccc

SEQ ID NO: 814729 - RNA, 20 nt, Human
uuuuccagaaaguaucauug

SEQ ID NO: 814730 - RNA, 20 nt, Human
acuugcugggcuuuguuacc

SEQ ID NO: 814731 - RNA, 23 nt, Human
uggcagcuguguaagagaaagca

SEQ ID NO: 814732 - RNA, 22 nt, Human
gcuugaaaauucauagguauuu

SEQ ID NO: 814733 - RNA, 22 nt, Human
aaaauacuguggaguguugaaa

SEQ ID NO: 814734 - RNA, 20 nt, Human
guugaaaguaauaugaugcu

SEQ ID NO: 814735 - RNA, 22 nt, Human
ucuuagaaugucaacugauguu

SEQ ID NO: 814736 - RNA, 22 nt, Human
uuaaauuccagccucauaauag

SEQ ID NO: 814737 - RNA, 22 nt, Human
gaggccaggaagcccaagauca

SEQ ID NO: 814738 - RNA, 22 nt, Human
ugaggcaggagaaucaccggaa

SEQ ID NO: 814739 - RNA, 22 nt, Human
cccaggagagagacuugaaucu

SEQ ID NO: 814740 - RNA, 22 nt, Human
aaauauaguaaaugcauaguuc

SEQ ID NO: 814741 - RNA, 22 nt, Human
auuuugaugcuaucuaaugaau

SEQ ID NO: 814742 - RNA, 22 nt, Human
ggcagcuucucccaggcuguuu

SEQ ID NO: 814743 - RNA, 20 nt, Human
gggagucuggaugaaagaug

SEQ ID NO: 814744 - RNA, 19 nt, Human
agacagagcucaguggguu

SEQ ID NO: 814745 - RNA, 22 nt, Human
cauuuguaggaugcuucuuguu

SEQ ID NO: 814746 - RNA, 22 nt, Human
ucaguucugcuagaaaaacagu

SEQ ID NO: 814747 - RNA, 21 nt, Human
augucaaaugcuuuauuuuau

SEQ ID NO: 814748 - RNA, 22 nt, Human
uuacuuuggguccugcuuauaa

SEQ ID NO: 814749 - RNA, 18 nt, Human
uugcuuuguaagcuugca

SEQ ID NO: 814750 - RNA, 22 nt, Human
gggcagcuagcccucuagccca

SEQ ID NO: 814751 - RNA, 22 nt, Human
ggagcuguucaggacugcuuca

SEQ ID NO: 814752 - RNA, 22 nt, Human
caugcugugcaucuugaugacc

SEQ ID NO: 814753 - RNA, 22 nt, Human
ucauuuaauagcuuuugucuuu

SEQ ID NO: 814754 - RNA, 22 nt, Human
ggcaagcucaggccucaggugu

SEQ ID NO: 814755 - RNA, 22 nt, Human
uguuuuaaagccauugccuuuc

SEQ ID NO: 814756 - RNA, 22 nt, Human
gcucaggaccgaggggugggaa

SEQ ID NO: 814757 - RNA, 22 nt, Human
cauaauaucuccgauuacuugc

SEQ ID NO: 814758 - RNA, 22 nt, Human
ggccagcuuugagcugcaggaa

SEQ ID NO: 814759 - RNA, 22 nt, Human
gaggcaguuugccaugccagga

SEQ ID NO: 814760 - RNA, 22 nt, Human
aggaagcuccuggagagccagu

SEQ ID NO: 814761 - RNA, 21 nt, Human
aucauucuggaaaauucaagc

SEQ ID NO: 814762 - RNA, 22 nt, Human
gccaggagacuccauucauuug

SEQ ID NO: 814763 - RNA, 22 nt, Human
agagacugcgugucagcgcugg

SEQ ID NO: 814764 - RNA, 22 nt, Human
cuuuuauuuugaauuaagggcu

SEQ ID NO: 814765 - RNA, 22 nt, Human
cccagcaguaaccaguggaaau

SEQ ID NO: 814766 - RNA, 22 nt, Human
ggugaaggucagagcaggaaaa

SEQ ID NO: 814767 - RNA, 22 nt, Human
gguggagcuggaccaggagagg

SEQ ID NO: 814768 - RNA, 22 nt, Human
augauguugauaaauuacuuua

SEQ ID NO: 814769 - RNA, 22 nt, Human
uugaaauaucaaguuauuagug

SEQ ID NO: 814770 - RNA, 22 nt, Human
auucuucaucacuaccuuguga

SEQ ID NO: 814771 - RNA, 22 nt, Human
uccaggaggacugagggggcug

SEQ ID NO: 814772 - RNA, 22 nt, Human
gaggccaggagugcuguaaguu

SEQ ID NO: 814773 - RNA, 23 nt, Human
agaugagccaacaccuccaugcc

SEQ ID NO: 814774 - RNA, 20 nt, Human
caggagggacauuucagcau

SEQ ID NO: 814775 - RNA, 22 nt, Human
cccaggagagaggggauaaagc

SEQ ID NO: 814776 - RNA, 22 nt, Human
cagucuucuaaccuagcagccu

SEQ ID NO: 814777 - RNA, 22 nt, Human
uuauuacacugaaagaauugcg

SEQ ID NO: 814778 - RNA, 22 nt, Human
caggagaucuuaggaauucuua

SEQ ID NO: 814779 - RNA, 19 nt, Human
uuagccauccacagugaaa

SEQ ID NO: 814780 - RNA, 20 nt, Human
cauuuguuagcuuucuacug

SEQ ID NO: 814781 - RNA, 22 nt, Human
acaugcauacacguacauaccu

SEQ ID NO: 814782 - RNA, 22 nt, Human
uuuaaauuuguguuuagagggu

SEQ ID NO: 814783 - RNA, 22 nt, Human
cuguucucuggcgguggcuguu

SEQ ID NO: 814784 - RNA, 22 nt, Human
uaauacagaaguguauuaaaau

SEQ ID NO: 814785 - RNA, 22 nt, Human
aguccaaggagagacagcauuu

SEQ ID NO: 814786 - RNA, 20 nt, Human
cgugcugugaccuugagcau

SEQ ID NO: 814787 - RNA, 22 nt, Human
caggagaaauguggcugcuacc

SEQ ID NO: 814788 - RNA, 22 nt, Human
ggcagcuaggggcagggaauuc

SEQ ID NO: 814789 - RNA, 22 nt, Human
uucuucaguguagcaacuguau

SEQ ID NO: 814790 - RNA, 22 nt, Human
uuuguuaauucuuauguuagag

SEQ ID NO: 814791 - RNA, 22 nt, Human
gaggcagcaucuauggugggaa

SEQ ID NO: 814792 - RNA, 22 nt, Human
uggcagcugcguuguguuucug

SEQ ID NO: 814793 - RNA, 22 nt, Human
agggcagccucucagccuaggu

SEQ ID NO: 814794 - RNA, 22 nt, Human
uuaaaaugaauauugauuagca

SEQ ID NO: 814795 - RNA, 20 nt, Human
cugcugugauucccuccucc

SEQ ID NO: 814796 - RNA, 18 nt, Human
aagaggaggagcagguug

SEQ ID NO: 814797 - RNA, 22 nt, Human
ucaccgccuugcccggccgggc

SEQ ID NO: 814798 - RNA, 21 nt, Human
ucugagagcaacugcccuuua

SEQ ID NO: 814799 - RNA, 22 nt, Human
auccaugaagguacuucucagg

SEQ ID NO: 814800 - RNA, 22 nt, Human
cccaggagguggagguugcagu

SEQ ID NO: 814801 - RNA, 21 nt, Human
cugcuguggcccccgacaugc

SEQ ID NO: 814802 - RNA, 22 nt, Human
cuugauguauaaguugauaugu

SEQ ID NO: 814803 - RNA, 22 nt, Human
ucaggaugguguggaggaaaua

SEQ ID NO: 814804 - RNA, 22 nt, Human
guaggcagucucucaggugauc

SEQ ID NO: 814805 - RNA, 23 nt, Human
ucagucuucccugucaguaauag

SEQ ID NO: 814806 - RNA, 23 nt, Human
ucuccuccuagauacagucaugg

SEQ ID NO: 814807 - RNA, 22 nt, Human
gcaugucaugucauguaggaau

SEQ ID NO: 814808 - RNA, 22 nt, Human
uggcagcagacaaaaggccauu

SEQ ID NO: 814809 - RNA, 22 nt, Human
ucugaaggugcuagagaaagcu

SEQ ID NO: 814810 - RNA, 22 nt, Human
uucauugugaacacauucugcc

SEQ ID NO: 814811 - RNA, 22 nt, Human
cccaggaauuggaggcugcagu

SEQ ID NO: 814812 - RNA, 22 nt, Human
gcaucuaauccaguccagcauc

SEQ ID NO: 814813 - RNA, 22 nt, Human
cuacccagagugaaucucuuaa

SEQ ID NO: 814814 - RNA, 20 nt, Human
cucaggauacugcaaaguug

SEQ ID NO: 814815 - RNA, 22 nt, Human
ugcauaguucuccuuccuccuc

SEQ ID NO: 814816 - RNA, 20 nt, Human
cuucuucauuaacccuacug

SEQ ID NO: 814817 - RNA, 22 nt, Human
cugcgcagggguggcgccagaa

SEQ ID NO: 814818 - RNA, 22 nt, Human
uucuacaugguugcucagaggg

SEQ ID NO: 814819 - RNA, 21 nt, Human
ggcagcguguggacaggaagg

SEQ ID NO: 814820 - RNA, 22 nt, Human
aagagaggacauggugaaccug

SEQ ID NO: 814821 - RNA, 22 nt, Human
gugguaauagagcuccaaacua

SEQ ID NO: 814822 - RNA, 22 nt, Human
agaagucauuuauguuagauga

SEQ ID NO: 814823 - RNA, 22 nt, Human
agacgagggcccccaggacagc

SEQ ID NO: 814824 - RNA, 22 nt, Human
aaagauaauguuuccuuauucu

SEQ ID NO: 814825 - RNA, 22 nt, Human
aggcagucuaucucuggagccu

SEQ ID NO: 814826 - RNA, 22 nt, Human
aagauggagcacgagcagaagc

SEQ ID NO: 814827 - RNA, 21 nt, Human
acagucuccccagaucucucc

SEQ ID NO: 814828 - RNA, 22 nt, Human
ugaguucucacccauucuucuu

SEQ ID NO: 814829 - RNA, 22 nt, Human
aucaggaucugcaucauaagaa

SEQ ID NO: 814830 - RNA, 22 nt, Human
ugaacaaacugcauucuucacu

SEQ ID NO: 814831 - RNA, 22 nt, Human
ggcaggcagaggcugagacagg

SEQ ID NO: 814832 - RNA, 22 nt, Human
uguugauuaguguuuagacuua

SEQ ID NO: 814833 - RNA, 22 nt, Human
uuaaauuuuagaaacagacucu

SEQ ID NO: 814834 - RNA, 22 nt, Human
gugcuuucugcugcauuccucu

SEQ ID NO: 814835 - RNA, 22 nt, Human
aucaggaucagggcuagcagag

SEQ ID NO: 814836 - RNA, 22 nt, Human
aaggcagccaugugcuuugggu

SEQ ID NO: 814837 - RNA, 19 nt, Human
ucugccucuggucaggcuc

SEQ ID NO: 814838 - RNA, 22 nt, Human
aaaggccacuugaaggauuuuu

SEQ ID NO: 814839 - RNA, 20 nt, Human
uugagcuuuuaguacagaca

SEQ ID NO: 814840 - RNA, 22 nt, Human
gaggagcugggcugagaggguc

SEQ ID NO: 814841 - RNA, 22 nt, Human
caggcagaguuagagcaacugg

SEQ ID NO: 814842 - RNA, 22 nt, Human
ugaguaauaaacugucuugcuc

SEQ ID NO: 814843 - RNA, 22 nt, Human
gcauucuuuuuaggagguuccu

SEQ ID NO: 814844 - RNA, 22 nt, Human
guggcaggagacuggaagaugg

SEQ ID NO: 814845 - RNA, 21 nt, Human
uccaggaguggcugggcaggg

SEQ ID NO: 814846 - RNA, 22 nt, Human
ugcacauucacuuagguauugu

SEQ ID NO: 814847 - RNA, 22 nt, Human
ucaggauguccaaaauccagcc

SEQ ID NO: 814848 - RNA, 22 nt, Human
cagagccaggucuaggagucuc

SEQ ID NO: 814849 - RNA, 22 nt, Human
ucagugaucuaaggguauggcc

SEQ ID NO: 814850 - RNA, 22 nt, Human
gugacagucaaagacaugacuu

SEQ ID NO: 814851 - RNA, 22 nt, Human
uaaggccagccagcaaaucugu

SEQ ID NO: 814852 - RNA, 22 nt, Human
ugaggcagugcugggaagccug

SEQ ID NO: 814853 - RNA, 19 nt, Human
agccuggcuuugcucugcu

SEQ ID NO: 814854 - RNA, 22 nt, Human
guucuugccagcauccucaggu

SEQ ID NO: 814855 - RNA, 22 nt, Human
agcaccaugaccuugccauuga

SEQ ID NO: 814856 - RNA, 22 nt, Human
cuucagagugcagaagauuggg

SEQ ID NO: 814857 - RNA, 23 nt, Human
uggacgccgacuuuggaggcgcu

SEQ ID NO: 814858 - RNA, 22 nt, Human
ucucagucagccuugauguccc

SEQ ID NO: 814859 - RNA, 22 nt, Human
aaagcagagcagggcacuuaug

SEQ ID NO: 814860 - RNA, 22 nt, Human
aggucagcaugaguagaaggua

SEQ ID NO: 814861 - RNA, 22 nt, Human
gggcagcugucuugguucucaa

SEQ ID NO: 814862 - RNA, 22 nt, Human
aaggcagccucugccagccggg

SEQ ID NO: 814863 - RNA, 23 nt, Human
uccaggagcaugcuggcuggcga

SEQ ID NO: 814864 - RNA, 22 nt, Human
caggaugaagggcaaaggcaag

SEQ ID NO: 814865 - RNA, 21 nt, Human
agcaccuuacagcuauaaugg

SEQ ID NO: 814866 - RNA, 22 nt, Human
cugcuguguugccagugucacc

SEQ ID NO: 814867 - RNA, 20 nt, Human
aggcaccugucacaggugag

SEQ ID NO: 814868 - RNA, 22 nt, Human
aggguagggcccggagacagac

SEQ ID NO: 814869 - RNA, 22 nt, Human
ccaggagagcagaagcccaggc

SEQ ID NO: 814870 - RNA, 22 nt, Human
ucuuugaaagcuguucuagagu

SEQ ID NO: 814871 - RNA, 22 nt, Human
uggcagcuggagggcaauggcc

SEQ ID NO: 814872 - RNA, 22 nt, Human
gggagacacgcugcaggcauaa

SEQ ID NO: 814873 - RNA, 22 nt, Human
uucuucuuucccccugugguac

SEQ ID NO: 814874 - RNA, 22 nt, Human
ggagggacccacucuagaggug

SEQ ID NO: 814875 - RNA, 22 nt, Human
uucucagaugauucagauaaac

SEQ ID NO: 814876 - RNA, 22 nt, Human
gaaaggcaguacagcugagccu

SEQ ID NO: 814877 - RNA, 18 nt, Human
uaggagagaauuuauuua

SEQ ID NO: 814878 - RNA, 18 nt, Human
ugaauagggguuugcaga

SEQ ID NO: 814879 - RNA, 22 nt, Human
ucucaguguguuuucucucaga

SEQ ID NO: 814880 - RNA, 22 nt, Human
cugacagucucauugauuugcu

SEQ ID NO: 814881 - RNA, 22 nt, Human
uucaauucaauucuaaauauau

SEQ ID NO: 814882 - RNA, 22 nt, Human
uucauugucucuguuugccuuc

SEQ ID NO: 814883 - RNA, 22 nt, Human
uuggaaagcaagcuggacauac

SEQ ID NO: 814884 - RNA, 22 nt, Human
ugaggcagcaauuguauuguau

SEQ ID NO: 814885 - RNA, 22 nt, Human
cagcagagggagccauugaaau

SEQ ID NO: 814886 - RNA, 22 nt, Human
uuucuuauacuauauugucauc

SEQ ID NO: 814887 - RNA, 22 nt, Human
gaauagcuuccuuuuuuccaaa

SEQ ID NO: 814888 - RNA, 22 nt, Human
cucaggaugucggugacuauug

SEQ ID NO: 814889 - RNA, 20 nt, Human
augugucuguaaacaacucu

SEQ ID NO: 814890 - RNA, 22 nt, Human
uuaaauauuauguugucugcaa

SEQ ID NO: 814891 - RNA, 22 nt, Human
ccccaggagauuugggagcaca

SEQ ID NO: 814892 - RNA, 22 nt, Human
guucuucaggcugugcucuaga

SEQ ID NO: 814893 - RNA, 22 nt, Human
aucaggaugcugucaguuacca

SEQ ID NO: 814894 - RNA, 22 nt, Human
uccaugagggacacuggaugcu

SEQ ID NO: 814895 - RNA, 22 nt, Human
cagaggcauacucccagucuug

SEQ ID NO: 814896 - RNA, 21 nt, Human
uucuucaugaugauuaauggc

SEQ ID NO: 814897 - RNA, 22 nt, Human
ucugcaggcuuggaguggcagc

SEQ ID NO: 814898 - RNA, 22 nt, Human
aggcagcuggaaaacuccaggc

SEQ ID NO: 814899 - RNA, 22 nt, Human
cccaagagcuucuaggacgcug

SEQ ID NO: 814900 - RNA, 22 nt, Human
auguucuguuuuguaauucaua

SEQ ID NO: 814901 - RNA, 22 nt, Human
gcucaggaucccaggggugugc

SEQ ID NO: 814902 - RNA, 22 nt, Human
ucauuucaaguucugacagcua

SEQ ID NO: 814903 - RNA, 22 nt, Human
gccacaggcacuuaagggcugg

SEQ ID NO: 814904 - RNA, 22 nt, Human
guguuuuaagaaagaagcucag

SEQ ID NO: 814905 - RNA, 22 nt, Human
gacagaggcuggagcaccuccu

SEQ ID NO: 814906 - RNA, 22 nt, Human
ugaggcagguggauuacaaggu

SEQ ID NO: 814907 - RNA, 22 nt, Human
gcccaggaaauaaaagugggcu

SEQ ID NO: 814908 - RNA, 22 nt, Human
gaagcagcgaaguggaagggac

SEQ ID NO: 814909 - RNA, 22 nt, Human
gcagggaagaucuuggagcugc

SEQ ID NO: 814910 - RNA, 22 nt, Human
uauaucaccaaaaacaguucug

SEQ ID NO: 814911 - RNA, 22 nt, Human
ugaacucgggaggaggcugcag

SEQ ID NO: 814912 - RNA, 17 nt, Human
aggcaggcagagcggga

SEQ ID NO: 814913 - RNA, 22 nt, Human
cccaggcagccugcagggaagg

SEQ ID NO: 814914 - RNA, 21 nt, Human
uggcaggcagcuggaagcuug

SEQ ID NO: 814915 - RNA, 22 nt, Human
uauuucuaagagauaucuguac

SEQ ID NO: 814916 - RNA, 22 nt, Human
uaaggccaccguuauagaacca

SEQ ID NO: 814917 - RNA, 22 nt, Human
uuugcaaagaaauuauugcugu

SEQ ID NO: 814918 - RNA, 22 nt, Human
agcuggcaguaugacuggugac

SEQ ID NO: 814919 - RNA, 22 nt, Human
agaaaugaagagagucaagguu

SEQ ID NO: 814920 - RNA, 22 nt, Human
caggcagcguccugcuuccugu

SEQ ID NO: 814921 - RNA, 22 nt, Human
gcagcugccccgacugugaguc

SEQ ID NO: 814922 - RNA, 23 nt, Human
gcagaggagcaagcuggacacca

SEQ ID NO: 814923 - RNA, 21 nt, Human
uucucagagucuauuacaguu

SEQ ID NO: 814924 - RNA, 22 nt, Human
aucugcaggaaugugugcagag

SEQ ID NO: 814925 - RNA, 22 nt, Human
cagcagagaaauuaaacuucug

SEQ ID NO: 814926 - RNA, 22 nt, Human
acaaauguggacauggauaaug

SEQ ID NO: 814927 - RNA, 22 nt, Human
uuccugagggacuuuugagauu

SEQ ID NO: 814928 - RNA, 21 nt, Human
uaaggccaagucuauuucugu

SEQ ID NO: 814929 - RNA, 22 nt, Human
uuuucaguaaugucuacauaau

SEQ ID NO: 814930 - RNA, 22 nt, Human
ucuggcuuucauuuguuuaaag

SEQ ID NO: 814931 - RNA, 22 nt, Human
gaggcagcuuggggcugugggu

SEQ ID NO: 814932 - RNA, 22 nt, Human
cccaggaagagugaguggcauu

SEQ ID NO: 814933 - RNA, 21 nt, Human
gacaggacuagaccagagcuc

SEQ ID NO: 814934 - RNA, 22 nt, Human
ugaaagcacaaguucuaacagg

SEQ ID NO: 814935 - RNA, 22 nt, Human
auucuucacuguuucagaauga

SEQ ID NO: 814936 - RNA, 21 nt, Human
acucaggagacuaacuauguc

SEQ ID NO: 814937 - RNA, 22 nt, Human
gaggcagcugggauacaaggga

SEQ ID NO: 814938 - RNA, 22 nt, Human
aggcaguuuaggcagcgauuua

SEQ ID NO: 814939 - RNA, 22 nt, Human
agcugccccaugagaggcaggu

SEQ ID NO: 814940 - RNA, 22 nt, Human
uaaaugaagaaauggagauugu

SEQ ID NO: 814941 - RNA, 22 nt, Human
gcagcugcagacccucagugcu

SEQ ID NO: 814942 - RNA, 19 nt, Human
agauggcaaaaugcaaaga

SEQ ID NO: 814943 - RNA, 22 nt, Human
acaugauuuuaguaucauaaua

SEQ ID NO: 814944 - RNA, 22 nt, Human
ugcuuagacgucaaguacagcc

SEQ ID NO: 814945 - RNA, 22 nt, Human
agaggagguccuuuucugaugu

SEQ ID NO: 814946 - RNA, 22 nt, Human
uucaggauggcggauguugggg

SEQ ID NO: 814947 - RNA, 22 nt, Human
agugcugucaguuuuauagaua

SEQ ID NO: 814948 - RNA, 22 nt, Human
ggaggugguggcagugacaauu

SEQ ID NO: 814949 - RNA, 22 nt, Human
aaguauaagcuauucuucauga

SEQ ID NO: 814950 - RNA, 22 nt, Human
auguuucaaugcacuuuagccu

SEQ ID NO: 814951 - RNA, 22 nt, Human
cagcugacuucauaggaagaca

SEQ ID NO: 814952 - RNA, 22 nt, Human
uacuaucucuucuaacuucaga

SEQ ID NO: 814953 - RNA, 22 nt, Human
ggggcagccuccaggaaagcug

SEQ ID NO: 814954 - RNA, 22 nt, Human
aguuauaugugaaaacacguau

SEQ ID NO: 814955 - RNA, 22 nt, Human
agggggugucucugauuggguu

SEQ ID NO: 814956 - RNA, 22 nt, Human
ugaaacauuugaugaucuuugg

SEQ ID NO: 814957 - RNA, 21 nt, Human
uggaggaauaaagcacagaag

SEQ ID NO: 814958 - RNA, 17 nt, Human
aggcagcucagaacauc

SEQ ID NO: 814959 - RNA, 22 nt, Human
ccaggaagcugucugauaugaa

SEQ ID NO: 814960 - RNA, 22 nt, Human
agggagcucaguuggaagcggu

SEQ ID NO: 814961 - RNA, 22 nt, Human
uuuuuauaacucuuuugugaca

SEQ ID NO: 814962 - RNA, 22 nt, Human
cagaggcagugggguugcuccu

SEQ ID NO: 814963 - RNA, 22 nt, Human
gaggcagcauucgcauagacag

SEQ ID NO: 814964 - RNA, 22 nt, Human
aggacaggauugagcugaacug

SEQ ID NO: 814965 - RNA, 22 nt, Human
uuucuucaauugcuaacaagga

SEQ ID NO: 814966 - RNA, 18 nt, Human
cugcuugggagacgucag

SEQ ID NO: 814967 - RNA, 22 nt, Human
cauuuguuuagaagucuuuaua

SEQ ID NO: 814968 - RNA, 22 nt, Human
cuguuaaucugcuugcaugaug

SEQ ID NO: 814969 - RNA, 22 nt, Human
gagugucugaauuagagcacaa

SEQ ID NO: 814970 - RNA, 22 nt, Human
caggauggagggagggcuguua

SEQ ID NO: 814971 - RNA, 22 nt, Human
agccuauuccaggaugagcuca

SEQ ID NO: 814972 - RNA, 22 nt, Human
aggcagcagucaugaggaaaga

SEQ ID NO: 814973 - RNA, 22 nt, Human
ucauggauggccgggaggugau

SEQ ID NO: 814974 - RNA, 22 nt, Human
uauuucagguauggugugaaau

SEQ ID NO: 814975 - RNA, 19 nt, Human
cuucuucuuggcagccaag

SEQ ID NO: 814976 - RNA, 22 nt, Human
cuuaaauuggaugaguuaaguu

SEQ ID NO: 814977 - RNA, 22 nt, Human
aauugcuaaagauuauguuuuc

SEQ ID NO: 814978 - RNA, 22 nt, Human
cauuuucagcacccaucugaaa

SEQ ID NO: 814979 - RNA, 22 nt, Human
gccaggagccagcuucuuagca

SEQ ID NO: 814980 - RNA, 22 nt, Human
uccaugagaacccuuggagaua

SEQ ID NO: 814981 - RNA, 22 nt, Human
ggcaggcaaugaggaugggaag

SEQ ID NO: 814982 - RNA, 22 nt, Human
gcugcuguugauuuaguccaau

SEQ ID NO: 814983 - RNA, 22 nt, Human
cccuuagcuccaagggguuugg

SEQ ID NO: 814984 - RNA, 22 nt, Human
ggcagcaucucuggcagcagcu

SEQ ID NO: 814985 - RNA, 23 nt, Human
uugcacauuggagcuggucuucu

SEQ ID NO: 814986 - RNA, 21 nt, Human
aaaggccauaaucacggagca

SEQ ID NO: 814987 - RNA, 22 nt, Human
auucuucaaagagugucaaagu

SEQ ID NO: 814988 - RNA, 22 nt, Human
ccugucacgaugacugcacucu

SEQ ID NO: 814989 - RNA, 22 nt, Human
aaggcagcaagaauuccagguu

SEQ ID NO: 814990 - RNA, 22 nt, Human
gauuuuauuagcccaaacuuug

SEQ ID NO: 814991 - RNA, 22 nt, Human
ugccuguguccccuucuuggca

SEQ ID NO: 814992 - RNA, 22 nt, Human
uuucauuuugguuaugccauaa

SEQ ID NO: 814993 - RNA, 22 nt, Human
uggcagcucauuuggaaaugga

SEQ ID NO: 814994 - RNA, 22 nt, Human
uaaacauuuguuauucuuguuu

SEQ ID NO: 814995 - RNA, 22 nt, Human
uggccaggcagguagaacggcc

SEQ ID NO: 814996 - RNA, 22 nt, Human
ggaggacaggggcugcagcaca

SEQ ID NO: 814997 - RNA, 22 nt, Human
cugcaucacagcaggaggcaca

SEQ ID NO: 814998 - RNA, 19 nt, Human
uggagaggaaaugcugcuc

SEQ ID NO: 814999 - RNA, 22 nt, Human
uucagcaaacacgaugcuuguu

SEQ ID NO: 815000 - RNA, 22 nt, Human
gccaggaggggagaguguguca

SEQ ID NO: 815001 - RNA, 22 nt, Human
gcgucugaguugcgggggcuca

SEQ ID NO: 815002 - RNA, 22 nt, Human
auacagauguugaauguuauau

SEQ ID NO: 815003 - RNA, 22 nt, Human
aacaugcugccuuucuacgagu

SEQ ID NO: 815004 - RNA, 22 nt, Human
ugcugaaacaauaacauacugg

SEQ ID NO: 815005 - RNA, 22 nt, Human
uguguucuggaaagcucacuga

SEQ ID NO: 815006 - RNA, 22 nt, Human
uuagccauuuuauacaagugua

SEQ ID NO: 815007 - RNA, 22 nt, Human
ugaggcagcaauugauuauuca

SEQ ID NO: 815008 - RNA, 22 nt, Human
uucaggauucuuucagacuggg

SEQ ID NO: 815009 - RNA, 22 nt, Human
agaggaggcagcuuaacucagu

SEQ ID NO: 815010 - RNA, 22 nt, Human
ggcugaaggaugaaagcugcag

SEQ ID NO: 815011 - RNA, 17 nt, Human
ucaggauguagcaguag

SEQ ID NO: 815012 - RNA, 22 nt, Human
agacucaagcagauaggaauua

SEQ ID NO: 815013 - RNA, 23 nt, Human
ucguugaauagcaauagcacaac

SEQ ID NO: 815014 - RNA, 22 nt, Human
uugcauuugaucuuggguucuc

SEQ ID NO: 815015 - RNA, 22 nt, Human
ccuggagaccagaggauacuuc

SEQ ID NO: 815016 - RNA, 22 nt, Human
gaggcugcccaacuggagugga

SEQ ID NO: 815017 - RNA, 22 nt, Human
augcugugauuguagaaauauu

SEQ ID NO: 815018 - RNA, 22 nt, Human
ucccaggauguuuauggcuggu

SEQ ID NO: 815019 - RNA, 22 nt, Human
gauuucuucauuuguggugaau

SEQ ID NO: 815020 - RNA, 22 nt, Human
ccacagagcauuagauuucaga

SEQ ID NO: 815021 - RNA, 22 nt, Human
agggcagccauugagggauucu

SEQ ID NO: 815022 - RNA, 22 nt, Human
cucuucuugucucugguuagaa

SEQ ID NO: 815023 - RNA, 22 nt, Human
uugcugaauugaauccuuuggu

SEQ ID NO: 815024 - RNA, 22 nt, Human
ucagggugaaccaggcaggaau

SEQ ID NO: 815025 - RNA, 22 nt, Human
caugcuguguguuuuagcucca

SEQ ID NO: 815026 - RNA, 22 nt, Human
acagucauuagauacaaugucu

SEQ ID NO: 815027 - RNA, 22 nt, Human
guuaaauucgaugauggauaaa

SEQ ID NO: 815028 - RNA, 22 nt, Human
gaggagcuugaggcuaggagcc

SEQ ID NO: 815029 - RNA, 22 nt, Human
ggucagagggugggcugccugu

SEQ ID NO: 815030 - RNA, 22 nt, Human
augcugugcuggcuaaccaugg

SEQ ID NO: 815031 - RNA, 22 nt, Human
aggcaguggaaggagaaagcaa

SEQ ID NO: 815032 - RNA, 22 nt, Human
gagagggauacugaguuuuggu

SEQ ID NO: 815033 - RNA, 22 nt, Human
aagacugucuuuucugagugac

SEQ ID NO: 815034 - RNA, 22 nt, Human
augcugugccuucucugugcca

SEQ ID NO: 815035 - RNA, 22 nt, Human
caggagagcccggguccgggcu

SEQ ID NO: 815036 - RNA, 22 nt, Human
uuugacauggaauaacucauuu

SEQ ID NO: 815037 - RNA, 22 nt, Human
ugaggggagaagcagcagccug

SEQ ID NO: 815038 - RNA, 22 nt, Human
gcuguucucuguaacaugcauu

SEQ ID NO: 815039 - RNA, 22 nt, Human
uuuuagauaguuuaacugcacu

SEQ ID NO: 815040 - RNA, 17 nt, Human
ugauaguucauuuuaag

SEQ ID NO: 815041 - RNA, 22 nt, Human
gcggagggcgagcccgcggagc

SEQ ID NO: 815042 - RNA, 20 nt, Human
uuucugugcccaggucuguu

SEQ ID NO: 815043 - RNA, 23 nt, Human
uuucaacuccugccauuauuucu

SEQ ID NO: 815044 - RNA, 22 nt, Human
aggcagcccugugcuggaugcu

SEQ ID NO: 815045 - RNA, 18 nt, Human
ugcuggguaacuguaugg

SEQ ID NO: 815046 - RNA, 22 nt, Human
caggaggggguggaguuucgcc

SEQ ID NO: 815047 - RNA, 22 nt, Human
acaauacaggcuucuggacuua

SEQ ID NO: 815048 - RNA, 22 nt, Human
uuuccucacuucaugagaguuu

SEQ ID NO: 815049 - RNA, 22 nt, Human
uuuuaacuuaaaauacauagau

SEQ ID NO: 815050 - RNA, 22 nt, Human
caagauggguguugugaugguu

SEQ ID NO: 815051 - RNA, 21 nt, Human
auucugaguugucagucuuca

SEQ ID NO: 815052 - RNA, 22 nt, Human
ugccaggagucaggccaggcag

SEQ ID NO: 815053 - RNA, 20 nt, Human
cccaggaguuugcucuuacu

SEQ ID NO: 815054 - RNA, 22 nt, Human
ggaggaggggugacugaaugcu

SEQ ID NO: 815055 - RNA, 20 nt, Human
cccaggagugagcagcuuua

SEQ ID NO: 815056 - RNA, 22 nt, Human
aggacagcagugcuggcacuug

SEQ ID NO: 815057 - RNA, 18 nt, Human
agcuucccucugagaggg

SEQ ID NO: 815058 - RNA, 22 nt, Human
aacuuucuuggaugucucaaca

SEQ ID NO: 815059 - RNA, 22 nt, Human
ugaaaugaagggcuuguucugg

SEQ ID NO: 815060 - RNA, 22 nt, Human
gagucuuugguaaagucugcug

SEQ ID NO: 815061 - RNA, 22 nt, Human
aauaucaguauauuguaucagu

SEQ ID NO: 815062 - RNA, 22 nt, Human
auacauauaugguacuuccugg

SEQ ID NO: 815063 - RNA, 22 nt, Human
acccaggagcaggcugggcagu

SEQ ID NO: 815064 - RNA, 21 nt, Human
uaauaauuccacuacagagua

SEQ ID NO: 815065 - RNA, 22 nt, Human
aaauguuuugcucccauguggu

SEQ ID NO: 815066 - RNA, 22 nt, Human
cggagaggugggggcagcaucu

SEQ ID NO: 815067 - RNA, 22 nt, Human
uugcuuuguuacugcaguuucc

SEQ ID NO: 815068 - RNA, 22 nt, Human
ggagcuguuggcagcuaucuug

SEQ ID NO: 815069 - RNA, 23 nt, Human
cccaggaguuucacugcaaaggu

SEQ ID NO: 815070 - RNA, 22 nt, Human
ucccaggaaaacacucgaggac

SEQ ID NO: 815071 - RNA, 22 nt, Human
gucaggaucucccaguacauau

SEQ ID NO: 815072 - RNA, 21 nt, Human
uuugaaagugggugauucuuu

SEQ ID NO: 815073 - RNA, 22 nt, Human
ugaaggccucugguacaugcca

SEQ ID NO: 815074 - RNA, 22 nt, Human
ucucuucuaauuuucccgagua

SEQ ID NO: 815075 - RNA, 22 nt, Human
agagggcugcugcacagugcuc

SEQ ID NO: 815076 - RNA, 22 nt, Human
uggcagcuugaaugcagucuuu

SEQ ID NO: 815077 - RNA, 22 nt, Human
cccaggaaaagcagugccagca

SEQ ID NO: 815078 - RNA, 22 nt, Human
acccaggacaaaauaaccaggu

SEQ ID NO: 815079 - RNA, 22 nt, Human
auuugcuuuaagguauaaaagg

SEQ ID NO: 815080 - RNA, 22 nt, Human
uugaaaggaauacagaggccua

SEQ ID NO: 815081 - RNA, 22 nt, Human
cagaaggcuggcagauugagau

SEQ ID NO: 815082 - RNA, 22 nt, Human
caggcagcaucagucugcugua

SEQ ID NO: 815083 - RNA, 22 nt, Human
acuggcaggcugcuggccggcg

SEQ ID NO: 815084 - RNA, 22 nt, Human
gggcagcucggaagugggaaag

SEQ ID NO: 815085 - RNA, 22 nt, Human
ggcucagagaccugcgaucuga

SEQ ID NO: 815086 - RNA, 22 nt, Human
ucugggaacucugucauuuccc

SEQ ID NO: 815087 - RNA, 22 nt, Human
auuuucaaaacaucugcugugu

SEQ ID NO: 815088 - RNA, 22 nt, Human
aaucuguuuaguucugcguaug

SEQ ID NO: 815089 - RNA, 22 nt, Human
ucugucuucaucagcaugugau

SEQ ID NO: 815090 - RNA, 22 nt, Human
gccaucacauccaggcuaccuc

SEQ ID NO: 815091 - RNA, 22 nt, Human
cuggcaguguccagcucgugau

SEQ ID NO: 815092 - RNA, 22 nt, Human
gcaggggcuaaggacacagaga

SEQ ID NO: 815093 - RNA, 21 nt, Human
agggagcuggccacacagccu

SEQ ID NO: 815094 - RNA, 22 nt, Human
gccaggaguguguggcuauguu

SEQ ID NO: 815095 - RNA, 22 nt, Human
acccaggagguggaggcugcag

SEQ ID NO: 815096 - RNA, 22 nt, Human
ucccaggaaugucugaaaguga

SEQ ID NO: 815097 - RNA, 22 nt, Human
uuugaaagagcugauacaugaa

SEQ ID NO: 815098 - RNA, 22 nt, Human
uccuuagagacaagaccaguuu

SEQ ID NO: 815099 - RNA, 22 nt, Human
gaggcaugcagagcuggagcag

SEQ ID NO: 815100 - RNA, 22 nt, Human
uagcucuucaaucacugucucc

SEQ ID NO: 815101 - RNA, 18 nt, Human
agggagagaccgcggguc

SEQ ID NO: 815102 - RNA, 22 nt, Human
agagggauaauauguauuguaa

SEQ ID NO: 815103 - RNA, 22 nt, Human
ucuuugaauucaaacuguucaa

SEQ ID NO: 815104 - RNA, 22 nt, Human
ggaggggagguccagcugaucu

SEQ ID NO: 815105 - RNA, 22 nt, Human
uuucaaauagaaucuuuccaaa

SEQ ID NO: 815106 - RNA, 22 nt, Human
uaauuccaaguugagacaugca

SEQ ID NO: 815107 - RNA, 22 nt, Human
agucccuguacuuuccacugcc

SEQ ID NO: 815108 - RNA, 22 nt, Human
uuuacauuucccucugucaguu

SEQ ID NO: 815109 - RNA, 22 nt, Human
gccaggaggcuuaacuggacag

SEQ ID NO: 815110 - RNA, 17 nt, Human
cucacggaggaugaauc

SEQ ID NO: 815111 - RNA, 22 nt, Human
aggcacagcacaccuggccccc

SEQ ID NO: 815112 - RNA, 22 nt, Human
ggagaagggacagacucagcuu

SEQ ID NO: 815113 - RNA, 22 nt, Human
uugaaaguagcagcugcauaug

SEQ ID NO: 815114 - RNA, 22 nt, Human
ccuggagagagaggccaacugc

SEQ ID NO: 815115 - RNA, 22 nt, Human
aucaggaugacuauaaggcugc

SEQ ID NO: 815116 - RNA, 22 nt, Human
cuuaaauucuuaaugcccucau

SEQ ID NO: 815117 - RNA, 22 nt, Human
aaggcagccuuuguuugauuga

SEQ ID NO: 815118 - RNA, 22 nt, Human
auguuuuugagauacaaacaga

SEQ ID NO: 815119 - RNA, 22 nt, Human
gcugugcuugggaagaaucucu

SEQ ID NO: 815120 - RNA, 22 nt, Human
ccuucauugcaucuuuaagaga

SEQ ID NO: 815121 - RNA, 20 nt, Human
uguuaaaggacacuugcuuu

SEQ ID NO: 815122 - RNA, 22 nt, Human
ugagagggcccagagcacacca

SEQ ID NO: 815123 - RNA, 22 nt, Human
aggcagcuuucagugucucuca

SEQ ID NO: 815124 - RNA, 22 nt, Human
ucucucagaggaagaggcagug

SEQ ID NO: 815125 - RNA, 22 nt, Human
uucaauucuaaacuaauauucu

SEQ ID NO: 815126 - RNA, 22 nt, Human
acugcuuuaucugagaaguccu

SEQ ID NO: 815127 - RNA, 22 nt, Human
ucuucuucccaucccucaaaug

SEQ ID NO: 815128 - RNA, 22 nt, Human
gauuucuugauaauucaaaucc

SEQ ID NO: 815129 - RNA, 20 nt, Human
auccaugagagucuggauuc

SEQ ID NO: 815130 - RNA, 22 nt, Human
gaagcagcugccagagaugucu

SEQ ID NO: 815131 - RNA, 22 nt, Human
uugcaggauuuuagagaugaca

SEQ ID NO: 815132 - RNA, 22 nt, Human
ggcagacuguaauaggagaauu

SEQ ID NO: 815133 - RNA, 22 nt, Human
ucuuagcauuucauaacaacug

SEQ ID NO: 815134 - RNA, 22 nt, Human
ucacacagguuugcaaugauuu

SEQ ID NO: 815135 - RNA, 22 nt, Human
cagauccacccuuguagugaca

SEQ ID NO: 815136 - RNA, 22 nt, Human
uuucacagcuggguggcagagu

SEQ ID NO: 815137 - RNA, 23 nt, Human
agacaguggccgagagguacuag

SEQ ID NO: 815138 - RNA, 22 nt, Human
acagucuugcuguauggucagg

SEQ ID NO: 815139 - RNA, 22 nt, Human
agacaggaugcauacucuuggu

SEQ ID NO: 815140 - RNA, 22 nt, Human
auugaaagauauacuguucuca

SEQ ID NO: 815141 - RNA, 22 nt, Human
gugcagcugcaggagucagguc

SEQ ID NO: 815142 - RNA, 22 nt, Human
aggcaguuuauccccagagccu

SEQ ID NO: 815143 - RNA, 22 nt, Human
gcccaggaucugcucagaucau

SEQ ID NO: 815144 - RNA, 22 nt, Human
aagcagcuuuugaagagugagg

SEQ ID NO: 815145 - RNA, 22 nt, Human
cugcaucaguggauaugauggu

SEQ ID NO: 815146 - RNA, 22 nt, Human
aacaguaaagacagaauuuauc

SEQ ID NO: 815147 - RNA, 22 nt, Human
uguuuucagucauauagcaggu

SEQ ID NO: 815148 - RNA, 22 nt, Human
cuggcaaguacugggccagcuc

SEQ ID NO: 815149 - RNA, 22 nt, Human
cccaggagcuucucucugccuc

SEQ ID NO: 815150 - RNA, 22 nt, Human
ggguggagcuuggacaccagua

SEQ ID NO: 815151 - RNA, 22 nt, Human
uucaaacaguguagaauauaug

SEQ ID NO: 815152 - RNA, 22 nt, Human
cuucucaguugcaagugucaga

SEQ ID NO: 815153 - RNA, 22 nt, Human
ucucacuuuccagacuuuucaa

SEQ ID NO: 815154 - RNA, 22 nt, Human
gcaggcagagguggaggagaca

SEQ ID NO: 815155 - RNA, 22 nt, Human
uaucuguuguccaugcagaaag

SEQ ID NO: 815156 - RNA, 22 nt, Human
agggcaguucaacuucauagug

SEQ ID NO: 815157 - RNA, 22 nt, Human
auucuucauuuacuguuacuug

SEQ ID NO: 815158 - RNA, 23 nt, Human
ugcaugugaauucauacuuguuu

SEQ ID NO: 815159 - RNA, 22 nt, Human
ucaugcuuaaaagacacuugag

SEQ ID NO: 815160 - RNA, 22 nt, Human
gaauacauuggaaaucagaaua

SEQ ID NO: 815161 - RNA, 22 nt, Human
ggaaaugacuuggugcuucguu

SEQ ID NO: 815162 - RNA, 22 nt, Human
ccaggagagcauugcacagagg

SEQ ID NO: 815163 - RNA, 22 nt, Human
uccagaaacuuuuccagucuca

SEQ ID NO: 815164 - RNA, 22 nt, Human
auggaaagugcauggaagucau

SEQ ID NO: 815165 - RNA, 19 nt, Human
acauuuaaauucagaucuc

SEQ ID NO: 815166 - RNA, 22 nt, Human
ggcagcuuucucacccaugacc

SEQ ID NO: 815167 - RNA, 22 nt, Human
aucauuacuccuguaaaauugu

SEQ ID NO: 815168 - RNA, 22 nt, Human
aauaauuagugggacagagaac

SEQ ID NO: 815169 - RNA, 22 nt, Human
uuguuugaggucacugauauuu

SEQ ID NO: 815170 - RNA, 22 nt, Human
caugauuuugucuuguguuaau

SEQ ID NO: 815171 - RNA, 22 nt, Human
aaggcagcaggauuuggugacu

SEQ ID NO: 815172 - RNA, 22 nt, Human
guccucuggaagaugaguucuu

SEQ ID NO: 815173 - RNA, 22 nt, Human
uggaaggagacugggaagugug

SEQ ID NO: 815174 - RNA, 21 nt, Human
aggcagcuggaaggccuggcu

SEQ ID NO: 815175 - RNA, 22 nt, Human
aauauaauuuuauuccuagagu

SEQ ID NO: 815176 - RNA, 22 nt, Human
aggcagacucaauggcuagaua

SEQ ID NO: 815177 - RNA, 22 nt, Human
gcccaggaguucaagucuagug

SEQ ID NO: 815178 - RNA, 18 nt, Human
gagaggagccagaauuuu

SEQ ID NO: 815179 - RNA, 22 nt, Human
gaggggagacagggaaaucagu

SEQ ID NO: 815180 - RNA, 22 nt, Human
ugugaaagcaagucuaguucuc

SEQ ID NO: 815181 - RNA, 22 nt, Human
ugcauggacucaucagacaaga

SEQ ID NO: 815182 - RNA, 22 nt, Human
cugacuguaauucuguucuuaa

SEQ ID NO: 815183 - RNA, 22 nt, Human
acaucucaugaaugauaaauca

SEQ ID NO: 815184 - RNA, 22 nt, Human
gucuucaauagagccucaauuu

SEQ ID NO: 815185 - RNA, 22 nt, Human
ugaaguuauauauguugaaaau

SEQ ID NO: 815186 - RNA, 22 nt, Human
auugcuguggaaauauaagaug

SEQ ID NO: 815187 - RNA, 22 nt, Human
uuccuuaguugacugucuuagu

SEQ ID NO: 815188 - RNA, 22 nt, Human
auguuauuaaaguacagauucu

SEQ ID NO: 815189 - RNA, 22 nt, Human
gcaggcaguuauuuaguagaau

SEQ ID NO: 815190 - RNA, 22 nt, Human
gagaggaguagacacuuugguu

SEQ ID NO: 815191 - RNA, 22 nt, Human
auuucagaugaccaaauggaaa

SEQ ID NO: 815192 - RNA, 23 nt, Human
cugcccugaucuugaucuauugu

SEQ ID NO: 815193 - RNA, 19 nt, Human
uuugaaagaguuuuauugg

SEQ ID NO: 815194 - RNA, 22 nt, Human
gugcugugugauccaugcuggc

SEQ ID NO: 815195 - RNA, 22 nt, Human
acacauuucucuuuuuguaagu

SEQ ID NO: 815196 - RNA, 22 nt, Human
cuuaagauuugagauaccuaau

SEQ ID NO: 815197 - RNA, 22 nt, Human
auucuucacauaagugcuguac

SEQ ID NO: 815198 - RNA, 22 nt, Human
uaaagcacauaucuuacaauaa

SEQ ID NO: 815199 - RNA, 22 nt, Human
gcccaggaagugacucagaugu

SEQ ID NO: 815200 - RNA, 23 nt, Human
guaaaauacgcagugcaguguga

SEQ ID NO: 815201 - RNA, 22 nt, Human
gacagcuguggagaggcaugug

SEQ ID NO: 815202 - RNA, 22 nt, Human
uggagcugggguuugaaucugg

SEQ ID NO: 815203 - RNA, 20 nt, Human
cugagagucugugcuuaguc

SEQ ID NO: 815204 - RNA, 22 nt, Human
ggugaagguggaacgcagagca

SEQ ID NO: 815205 - RNA, 22 nt, Human
uugggcucaggaguuugagacc

SEQ ID NO: 815206 - RNA, 22 nt, Human
agugugucugaucacuugugag

SEQ ID NO: 815207 - RNA, 22 nt, Human
cauuuccacuucugaaaacugg

SEQ ID NO: 815208 - RNA, 22 nt, Human
ucacauucucagcaucuauaca

SEQ ID NO: 815209 - RNA, 22 nt, Human
caggguggcacucagcgcaucu

SEQ ID NO: 815210 - RNA, 22 nt, Human
cauucucaauaguagaugagua

SEQ ID NO: 815211 - RNA, 22 nt, Human
caggcagccugagggaucuggg

SEQ ID NO: 815212 - RNA, 22 nt, Human
acagaauugaaaguauaaucug

SEQ ID NO: 815213 - RNA, 22 nt, Human
cugcuguguggauucaauggcu

SEQ ID NO: 815214 - RNA, 22 nt, Human
ugcuucagaggaaaggcaaaag

SEQ ID NO: 815215 - RNA, 22 nt, Human
aggcaggcucaggcccaugcuu

SEQ ID NO: 815216 - RNA, 22 nt, Human
cugcugagaaaagacugaggga

SEQ ID NO: 815217 - RNA, 22 nt, Human
uuguuuuaucuuucuacagacu

SEQ ID NO: 815218 - RNA, 20 nt, Human
ggcaggcuuuauauggaggg

SEQ ID NO: 815219 - RNA, 22 nt, Human
uuucagaaagcugaacauauga

SEQ ID NO: 815220 - RNA, 22 nt, Human
gcuggcuugauaguuucugcuu

SEQ ID NO: 815221 - RNA, 22 nt, Human
uuaggaguccagaugucuuggg

SEQ ID NO: 815222 - RNA, 22 nt, Human
guacauuucucuuguucuuauu

SEQ ID NO: 815223 - RNA, 22 nt, Human
aggcugcuucaauggauaagau

SEQ ID NO: 815224 - RNA, 22 nt, Human
ugaggcaguauuuuagugacuu

SEQ ID NO: 815225 - RNA, 22 nt, Human
cagcugcaguucaaugcuugcu

SEQ ID NO: 815226 - RNA, 22 nt, Human
ggaggcugagaaguccaagauc

SEQ ID NO: 815227 - RNA, 22 nt, Human
cucccaggguagggagagacua

SEQ ID NO: 815228 - RNA, 22 nt, Human
cugaacuuauugagugcuugcu

SEQ ID NO: 815229 - RNA, 20 nt, Human
aggacagcagcugccacuug

SEQ ID NO: 815230 - RNA, 22 nt, Human
agucacuguucugucaugucaa

SEQ ID NO: 815231 - RNA, 22 nt, Human
ucaggagauguaaccuuagcug

SEQ ID NO: 815232 - RNA, 22 nt, Human
gcccaggaguucaaggcugcag

SEQ ID NO: 815233 - RNA, 22 nt, Human
uccaggaggcaccuuuggacca

SEQ ID NO: 815234 - RNA, 22 nt, Human
ucucuucuauuugagacuauuu

SEQ ID NO: 815235 - RNA, 17 nt, Human
uucucugagcuguauug

SEQ ID NO: 815236 - RNA, 22 nt, Human
uuuuaucuucauuccuaucuac

SEQ ID NO: 815237 - RNA, 21 nt, Human
cccaggaguccuauuuaaaug

SEQ ID NO: 815238 - RNA, 22 nt, Human
aggcagcuaagauggauaauga

SEQ ID NO: 815239 - RNA, 22 nt, Human
ucaggagagagaaauuggggcu

SEQ ID NO: 815240 - RNA, 22 nt, Human
aggcagucuaguccccaggcaa

SEQ ID NO: 815241 - RNA, 22 nt, Human
ucuucuccagugcuucugcaca

SEQ ID NO: 815242 - RNA, 22 nt, Human
cagagacauuaagugccaugau

SEQ ID NO: 815243 - RNA, 22 nt, Human
auauuguugacuauaagaguaa

SEQ ID NO: 815244 - RNA, 22 nt, Human
aggaggggcaaugauagucugg

SEQ ID NO: 815245 - RNA, 22 nt, Human
gaucuguuucauucacagucug

SEQ ID NO: 815246 - RNA, 22 nt, Human
ccagaggaaaaauaucucccua

SEQ ID NO: 815247 - RNA, 22 nt, Human
ggggcagcucccgagggcagga

SEQ ID NO: 815248 - RNA, 22 nt, Human
uuugacaugcaaagcacuuuag

SEQ ID NO: 815249 - RNA, 22 nt, Human
cagugaaaucacaacuuuaguu

SEQ ID NO: 815250 - RNA, 22 nt, Human
auugcuaggaacagguugcacc

SEQ ID NO: 815251 - RNA, 22 nt, Human
auucuucacaccuguuccuguu

SEQ ID NO: 815252 - RNA, 22 nt, Human
cuggcugugcagucuuccagaa

SEQ ID NO: 815253 - RNA, 22 nt, Human
ggacagcugcuuucaggccaca

SEQ ID NO: 815254 - RNA, 22 nt, Human
gcccaggacucagggugucgcg

SEQ ID NO: 815255 - RNA, 22 nt, Human
ggagcugugcagugacuacaga

SEQ ID NO: 815256 - RNA, 22 nt, Human
uauuuccaagcugaauccaaug

SEQ ID NO: 815257 - RNA, 22 nt, Human
uuucaaagucaauaucauuacc

SEQ ID NO: 815258 - RNA, 22 nt, Human
agagagcauugaggaaaucuuc

SEQ ID NO: 815259 - RNA, 22 nt, Human
uugcugugucauuuguuuaauc

SEQ ID NO: 815260 - RNA, 22 nt, Human
uagcacauacauaauagauaga

SEQ ID NO: 815261 - RNA, 22 nt, Human
cccaggagguggagguugcggu

SEQ ID NO: 815262 - RNA, 20 nt, Human
gaagcagcuucauguagaca

SEQ ID NO: 815263 - RNA, 22 nt, Human
gcuacugauugaccuuggagag

SEQ ID NO: 815264 - RNA, 22 nt, Human
uuacaagauaaccugaugcugu

SEQ ID NO: 815265 - RNA, 23 nt, Human
aaugauuucaugaugauagcagc

SEQ ID NO: 815266 - RNA, 22 nt, Human
agucucugcaugccugcugugc

SEQ ID NO: 815267 - RNA, 22 nt, Human
augcugugucaggaauuugaua

SEQ ID NO: 815268 - RNA, 22 nt, Human
ugaggggagguuggggcacauc

SEQ ID NO: 815269 - RNA, 22 nt, Human
caggcagcucgaugccuuguug

SEQ ID NO: 815270 - RNA, 20 nt, Human
aggagggaccuggauuggcg

SEQ ID NO: 815271 - RNA, 20 nt, Human
uacagaaugcaauaaaaugg

SEQ ID NO: 815272 - RNA, 22 nt, Human
gggauggggagcuggaaagggg

SEQ ID NO: 815273 - RNA, 22 nt, Human
gccauuuucugucuuguuuauu

SEQ ID NO: 815274 - RNA, 22 nt, Human
auguuuccauuuucuuguauca

SEQ ID NO: 815275 - RNA, 22 nt, Human
guagggagcccagagcccagug

SEQ ID NO: 815276 - RNA, 22 nt, Human
ccccaggagcuuguuuuagaga

SEQ ID NO: 815277 - RNA, 22 nt, Human
cuucaggauuuaggaagaugaa

SEQ ID NO: 815278 - RNA, 22 nt, Human
auuugcuugugcuaugaaaguu

SEQ ID NO: 815279 - RNA, 22 nt, Human
ccugcugugaagccaggccugu

SEQ ID NO: 815280 - RNA, 22 nt, Human
caggauggucucgaucuccuga

SEQ ID NO: 815281 - RNA, 22 nt, Human
uuucaguguaucuuccaaaagc

SEQ ID NO: 815282 - RNA, 22 nt, Human
uugaacaguccuaagagacccu

SEQ ID NO: 815283 - RNA, 22 nt, Human
gaugccucuuuuggcugaauua

SEQ ID NO: 815284 - RNA, 22 nt, Human
acugugugacuguuauuacugu

SEQ ID NO: 815285 - RNA, 22 nt, Human
aaauaguucagcuuguaaaccc

SEQ ID NO: 815286 - RNA, 22 nt, Human
cauucauuagaauagauaugua

SEQ ID NO: 815287 - RNA, 22 nt, Human
ugugccagccucuggcuguguc

SEQ ID NO: 815288 - RNA, 22 nt, Human
caaggccaguucaccaagggca

SEQ ID NO: 815289 - RNA, 22 nt, Human
cuucugugcuucacaguugcca

SEQ ID NO: 815290 - RNA, 23 nt, Human
aguaaagcaauuguuggcgagag

SEQ ID NO: 815291 - RNA, 22 nt, Human
cccgggaggaggaaguugcagu

SEQ ID NO: 815292 - RNA, 22 nt, Human
uuugcaaagugacuauuauaug

SEQ ID NO: 815293 - RNA, 22 nt, Human
ccaggagcagauauggacauaa

SEQ ID NO: 815294 - RNA, 22 nt, Human
cucaggaugcaauuccaucaag

SEQ ID NO: 815295 - RNA, 22 nt, Human
gaggcagcaaaauauaucauaa

SEQ ID NO: 815296 - RNA, 22 nt, Human
cccucuacagggaagcgcuuuc

SEQ ID NO: 815297 - RNA, 22 nt, Human
uugaauaggacucagcagugau

SEQ ID NO: 815298 - RNA, 22 nt, Human
ucucauugguauauacaugugu

SEQ ID NO: 815299 - RNA, 22 nt, Human
gccaggaggcugcuguguaggc

SEQ ID NO: 815300 - RNA, 22 nt, Human
uaauuauuaugacaacaauugc

SEQ ID NO: 815301 - RNA, 22 nt, Human
gaccuggaggauccucuucuug

SEQ ID NO: 815302 - RNA, 22 nt, Human
ucucuuucuauaugugagucuu

SEQ ID NO: 815303 - RNA, 22 nt, Human
ccuggacucaggcugugggcac

SEQ ID NO: 815304 - RNA, 22 nt, Human
ucauacaucuguccuggagcuc

SEQ ID NO: 815305 - RNA, 23 nt, Human
ccacuagcaccuguucaacuucu

SEQ ID NO: 815306 - RNA, 22 nt, Human
auacauacauguaugcacauac

SEQ ID NO: 815307 - RNA, 23 nt, Human
cuugcaggaagcagauggcacac

SEQ ID NO: 815308 - RNA, 22 nt, Human
ugugcaggugcaggaagggggc

SEQ ID NO: 815309 - RNA, 22 nt, Human
uagcuuuccuuguugccugugc

SEQ ID NO: 815310 - RNA, 22 nt, Human
aggcacaggccucagcacccag

SEQ ID NO: 815311 - RNA, 22 nt, Human
uucaggaugaaagugugcaaca

SEQ ID NO: 815312 - RNA, 22 nt, Human
ggggcagcuaccggaaguaggg

SEQ ID NO: 815313 - RNA, 22 nt, Human
agugagaguauuaaugugaacu

SEQ ID NO: 815314 - RNA, 17 nt, Human
aagagaggcugagcugg

SEQ ID NO: 815315 - RNA, 22 nt, Human
uagugcuugagucucuccguac

SEQ ID NO: 815316 - RNA, 22 nt, Human
ucaggagaaagccaauuagagu

SEQ ID NO: 815317 - RNA, 22 nt, Human
uucauugugauucuuggcuagc

SEQ ID NO: 815318 - RNA, 22 nt, Human
uuugcaguagacaucuuauuuu

SEQ ID NO: 815319 - RNA, 21 nt, Human
aaauacagaaacuuguuuuca

SEQ ID NO: 815320 - RNA, 22 nt, Human
uuuuccagagcugucucuugca

SEQ ID NO: 815321 - RNA, 23 nt, Human
aucauucuccaaucuggagcagg

SEQ ID NO: 815322 - RNA, 21 nt, Human
gcucagaguauugcacuguuu

SEQ ID NO: 815323 - RNA, 22 nt, Human
uuugacauugccaauuugcuca

SEQ ID NO: 815324 - RNA, 22 nt, Human
ggcagcuuguccuucaggagag

SEQ ID NO: 815325 - RNA, 22 nt, Human
ugaggcaggagaauggcgggaa

SEQ ID NO: 815326 - RNA, 22 nt, Human
ucaggagaaucagggcuguccu

SEQ ID NO: 815327 - RNA, 22 nt, Human
aucuugcauuugcuaaaaugca

SEQ ID NO: 815328 - RNA, 22 nt, Human
uagugcuuuaggccugaguguc

SEQ ID NO: 815329 - RNA, 22 nt, Human
gcucacugcaaccucugcuucc

SEQ ID NO: 815330 - RNA, 22 nt, Human
ucaagugcuugugagguauuug

SEQ ID NO: 815331 - RNA, 22 nt, Human
ucucacuggguauaaaugagua

SEQ ID NO: 815332 - RNA, 22 nt, Human
auggagggugguaagacagaga

SEQ ID NO: 815333 - RNA, 22 nt, Human
gagagcaggaggcagcgggacg

SEQ ID NO: 815334 - RNA, 22 nt, Human
ucaggagaacuuccuucuaccc

SEQ ID NO: 815335 - RNA, 22 nt, Human
gaucuucuauguaaugaagugu

SEQ ID NO: 815336 - RNA, 22 nt, Human
uccaggagggguaggcaguaug

SEQ ID NO: 815337 - RNA, 22 nt, Human
guaggcagugguuggaagagaa

SEQ ID NO: 815338 - RNA, 22 nt, Human
cucagugugaaugcucaguaaa

SEQ ID NO: 815339 - RNA, 17 nt, Human
uggcagcugaaagcucu

SEQ ID NO: 815340 - RNA, 22 nt, Human
acuuugcagggcuugauaucca

SEQ ID NO: 815341 - RNA, 22 nt, Human
caggcagcugcgacaagagagc

SEQ ID NO: 815342 - RNA, 22 nt, Human
gaacccaggcuuuugaggcugu

SEQ ID NO: 815343 - RNA, 22 nt, Human
aggcaguggcugagaccagggg

SEQ ID NO: 815344 - RNA, 22 nt, Human
aauuuccagaucagaugacuca

SEQ ID NO: 815345 - RNA, 22 nt, Human
gucuauauauugcuugaauaau

SEQ ID NO: 815346 - RNA, 22 nt, Human
gccaggaggucagccccucaac

SEQ ID NO: 815347 - RNA, 22 nt, Human
auuccaguuggguucuaauaca

SEQ ID NO: 815348 - RNA, 22 nt, Human
aaaguauuugugauuuuuacca

SEQ ID NO: 815349 - RNA, 22 nt, Human
augaggcaucugcagucacuag

SEQ ID NO: 815350 - RNA, 22 nt, Human
auuaaauuagcaaacugugaaa

SEQ ID NO: 815351 - RNA, 22 nt, Human
ggaggugggauuaggaccuaaa

SEQ ID NO: 815352 - RNA, 22 nt, Human
cuucagaaugggacuguguuug

SEQ ID NO: 815353 - RNA, 22 nt, Human
uagugcuuaacacaaagugauu

SEQ ID NO: 815354 - RNA, 22 nt, Human
ugaggcagaguaagauacauga

SEQ ID NO: 815355 - RNA, 22 nt, Human
gaggccaaucaauagggcaaua

SEQ ID NO: 815356 - RNA, 22 nt, Human
augaggcauuccacucaaacuc

SEQ ID NO: 815357 - RNA, 22 nt, Human
ucauuucucccggccaaaaacu

SEQ ID NO: 815358 - RNA, 22 nt, Human
uaucuaaaggauuuaauuuagu

SEQ ID NO: 815359 - RNA, 22 nt, Human
gaccaaggaagaggggagccag

SEQ ID NO: 815360 - RNA, 22 nt, Human
uggaggaaaaaaccaggcagag

SEQ ID NO: 815361 - RNA, 22 nt, Human
cucacugacgaggaagcugaga

SEQ ID NO: 815362 - RNA, 22 nt, Human
agagagagggaaacugcuaaac

SEQ ID NO: 815363 - RNA, 22 nt, Human
aaggcaguuugggccaccaucu

SEQ ID NO: 815364 - RNA, 22 nt, Human
cccaggaaaugggcucuugccu

SEQ ID NO: 815365 - RNA, 22 nt, Human
ucucacugcaaauauuauguau

SEQ ID NO: 815366 - RNA, 23 nt, Human
auuucuaggggauuuucuggugc

SEQ ID NO: 815367 - RNA, 22 nt, Human
uuucaugaggggcaaaaucuca

SEQ ID NO: 815368 - RNA, 22 nt, Human
cagacaggaauucuggcguggu

SEQ ID NO: 815369 - RNA, 22 nt, Human
aagcaccugcaguugacaaaaa

SEQ ID NO: 815370 - RNA, 18 nt, Human
gcaggagauggguggggu

SEQ ID NO: 815371 - RNA, 22 nt, Human
aggcacaggaaugucauccagu

SEQ ID NO: 815372 - RNA, 22 nt, Human
gugagggguggcugagcaguuu

SEQ ID NO: 815373 - RNA, 20 nt, Human
gagauggacagaugaagggg

SEQ ID NO: 815374 - RNA, 22 nt, Human
cugagggugcuauucuugccuu

SEQ ID NO: 815375 - RNA, 22 nt, Human
acaggagaaaucuggucaaaag

SEQ ID NO: 815376 - RNA, 22 nt, Human
guguugaugacauuuuagaaac

SEQ ID NO: 815377 - RNA, 22 nt, Human
ccccaggagaaaucuuaaacua

SEQ ID NO: 815378 - RNA, 21 nt, Human
gauugaaaccauggcagugag

SEQ ID NO: 815379 - RNA, 22 nt, Human
cugucauuuaagacauucugga

SEQ ID NO: 815380 - RNA, 22 nt, Human
uuucaaaguugggaauuguaau

SEQ ID NO: 815381 - RNA, 22 nt, Human
gaggcugcuguuagcccugggc

SEQ ID NO: 815382 - RNA, 22 nt, Human
ggacagcucugccaggagcuca

SEQ ID NO: 815383 - RNA, 17 nt, Human
guccuacccauggucua

SEQ ID NO: 815384 - RNA, 22 nt, Human
cccaggaggcagagguugcagu

SEQ ID NO: 815385 - RNA, 22 nt, Human
uagaaaugugauaauagcuuaa

SEQ ID NO: 815386 - RNA, 22 nt, Human
cacaaaugugcagaaaugugag

SEQ ID NO: 815387 - RNA, 23 nt, Human
ucccaggaaucugcauuuuuaac

SEQ ID NO: 815388 - RNA, 22 nt, Human
ucaggagaguguucaguggagg

SEQ ID NO: 815389 - RNA, 22 nt, Human
uauuucagcacaugggauaggu

SEQ ID NO: 815390 - RNA, 22 nt, Human
aggcaacuuuuggggaugaugg

SEQ ID NO: 815391 - RNA, 22 nt, Human
cauuuguaguaucuguuuauau

SEQ ID NO: 815392 - RNA, 22 nt, Human
agcugcuacugcucugccagag

SEQ ID NO: 815393 - RNA, 22 nt, Human
cucaugucuucacccauucuaa

SEQ ID NO: 815394 - RNA, 22 nt, Human
cccaggaagaggggucaggugu

SEQ ID NO: 815395 - RNA, 22 nt, Human
agcugcccuguggggaggguug

SEQ ID NO: 815396 - RNA, 22 nt, Human
augaaacaguguguauagcaaa

SEQ ID NO: 815397 - RNA, 22 nt, Human
auuucacucauucauguuacuu

SEQ ID NO: 815398 - RNA, 22 nt, Human
uccauuuuguagguaugcuaca

SEQ ID NO: 815399 - RNA, 22 nt, Human
auuaaauuaaguggcuaauuua

SEQ ID NO: 815400 - RNA, 22 nt, Human
uuugaagucagacacugcuuug

SEQ ID NO: 815401 - RNA, 22 nt, Human
acaugcauaggagaagucuuua

SEQ ID NO: 815402 - RNA, 22 nt, Human
ggaggggucucuagcgaggaga

SEQ ID NO: 815403 - RNA, 22 nt, Human
cccaggaaugagcaggcagggg

SEQ ID NO: 815404 - RNA, 22 nt, Human
ccuugcauauauuauaucuuug

SEQ ID NO: 815405 - RNA, 19 nt, Human
uggggcuguguuuugaccc

SEQ ID NO: 815406 - RNA, 22 nt, Human
gaaguacaguuuuaucuagcca

SEQ ID NO: 815407 - RNA, 22 nt, Human
aggcaagcgcagaagcggagga

SEQ ID NO: 815408 - RNA, 22 nt, Human
cccaggagauggagguugcagu

SEQ ID NO: 815409 - RNA, 20 nt, Human
cucaggauugucuagccccu

SEQ ID NO: 815410 - RNA, 22 nt, Human
uuuugugagcccauaaaugcca

SEQ ID NO: 815411 - RNA, 22 nt, Human
uuugagauggagucuugcucug

SEQ ID NO: 815412 - RNA, 22 nt, Human
cccaggagacagaaacagaggu

SEQ ID NO: 815413 - RNA, 22 nt, Human
uggcagcugauuagauggugcc

SEQ ID NO: 815414 - RNA, 23 nt, Human
auucuucauuaucuucuagaaaa

SEQ ID NO: 815415 - RNA, 19 nt, Human
ucucacaguuuccuugccu

SEQ ID NO: 815416 - RNA, 23 nt, Human
auuugagaaaguauuuuuaagac

SEQ ID NO: 815417 - RNA, 22 nt, Human
ccucuucuaggacguccuugug

SEQ ID NO: 815418 - RNA, 22 nt, Human
ugaggggagcccgcccuggacg

SEQ ID NO: 815419 - RNA, 22 nt, Human
aguuugaauugaaaugcagaug

SEQ ID NO: 815420 - RNA, 22 nt, Human
auauaauacaaccugcuaagug

SEQ ID NO: 815421 - RNA, 22 nt, Human
uucaggaucacuaaacccucca

SEQ ID NO: 815422 - RNA, 22 nt, Human
agaccauagggaccucagguug

SEQ ID NO: 815423 - RNA, 22 nt, Human
aauccugugugacucuggggag

SEQ ID NO: 815424 - RNA, 22 nt, Human
ggcuuggaaauugcaggacaca

SEQ ID NO: 815425 - RNA, 22 nt, Human
aaggcaguaaaaucuaccuugc

SEQ ID NO: 815426 - RNA, 22 nt, Human
cccaggaggcagauguugcagu

SEQ ID NO: 815427 - RNA, 22 nt, Human
aaaggccaauaaagacaagcug

SEQ ID NO: 815428 - RNA, 22 nt, Human
cagcaggagcagucagacuccu

SEQ ID NO: 815429 - RNA, 22 nt, Human
acuugcauuauauuuaucacaa

SEQ ID NO: 815430 - RNA, 22 nt, Human
ugaaucauggauaaauagcuua

SEQ ID NO: 815431 - RNA, 22 nt, Human
acauuuuuauucaucaaagcag

SEQ ID NO: 815432 - RNA, 22 nt, Human
uccuuagagauacugucuugaa

SEQ ID NO: 815433 - RNA, 22 nt, Human
gaaacugugaggaucuuaacuu

SEQ ID NO: 815434 - RNA, 22 nt, Human
gaggccaggacaugaaagcuga

SEQ ID NO: 815435 - RNA, 22 nt, Human
ucugcaggcucuagaugagguu

SEQ ID NO: 815436 - RNA, 22 nt, Human
uucauguguauggaacauuuuu

SEQ ID NO: 815437 - RNA, 22 nt, Human
uaucaucuuguugucaugcagc

SEQ ID NO: 815438 - RNA, 20 nt, Human
cccaggagcugugccccauc

SEQ ID NO: 815439 - RNA, 19 nt, Human
cccaggaggcggagguugc

SEQ ID NO: 815440 - RNA, 22 nt, Human
cucccagggucuaggcugcugg

SEQ ID NO: 815441 - RNA, 22 nt, Human
aucuuguuauaagagauaaugg

SEQ ID NO: 815442 - RNA, 22 nt, Human
ugccuggauucgguuguuguca

SEQ ID NO: 815443 - RNA, 21 nt, Human
uucuucuuggacuguuuuggc

SEQ ID NO: 815444 - RNA, 22 nt, Human
agaccgagaaguucuccaggcc

SEQ ID NO: 815445 - RNA, 22 nt, Human
guuuucugauuagcaaaucuga

SEQ ID NO: 815446 - RNA, 17 nt, Human
agagagagcaugccacc

SEQ ID NO: 815447 - RNA, 22 nt, Human
uucuuugaguuaguacagucca

SEQ ID NO: 815448 - RNA, 23 nt, Human
acauacauggagauaaagugaug

SEQ ID NO: 815449 - RNA, 22 nt, Human
aaggccagccugagagcuaaca

SEQ ID NO: 815450 - RNA, 22 nt, Human
uccauuuuucaugacuccucaa

SEQ ID NO: 815451 - RNA, 22 nt, Human
auuauuauuguugauguuaggg

SEQ ID NO: 815452 - RNA, 22 nt, Human
uuucaaagaguuguaaauuacu

SEQ ID NO: 815453 - RNA, 19 nt, Human
ucucugcuucucuuggcau

SEQ ID NO: 815454 - RNA, 22 nt, Human
uuacuuugcuuucucauuacag

SEQ ID NO: 815455 - RNA, 22 nt, Human
uccaggaguccugggagugauu

SEQ ID NO: 815456 - RNA, 22 nt, Human
ucuucacauggaacaugaagcu

SEQ ID NO: 815457 - RNA, 22 nt, Human
caggcagcugaggacuuugcua

SEQ ID NO: 815458 - RNA, 22 nt, Human
aaaugaugcucacagauuagug

SEQ ID NO: 815459 - RNA, 22 nt, Human
aggguccugggugcaguugcuu

SEQ ID NO: 815460 - RNA, 22 nt, Human
augugaggaagaaagagguaag

SEQ ID NO: 815461 - RNA, 22 nt, Human
gagcgauguggguauguagaag

SEQ ID NO: 815462 - RNA, 22 nt, Human
ucucuguacaguacaugccgug

SEQ ID NO: 815463 - RNA, 22 nt, Human
cucacugucuguacuagcugau

SEQ ID NO: 815464 - RNA, 22 nt, Human
uucucuuuugugaugugagaug

SEQ ID NO: 815465 - RNA, 22 nt, Human
aggagaggaaucauuauuacaa

SEQ ID NO: 815466 - RNA, 22 nt, Human
acauuucuaguuguucaucucc

SEQ ID NO: 815467 - RNA, 22 nt, Human
cucuccucagaacaggcccucu

SEQ ID NO: 815468 - RNA, 20 nt, Human
aggaagcugagauguagagg

SEQ ID NO: 815469 - RNA, 22 nt, Human
augcagcuucaggauuaugaug

SEQ ID NO: 815470 - RNA, 22 nt, Human
cagaggcagccgggggagaacg

SEQ ID NO: 815471 - RNA, 22 nt, Human
agcccagggacagggcggaugu

SEQ ID NO: 815472 - RNA, 22 nt, Human
uccucagaaaccccugugaggu

SEQ ID NO: 815473 - RNA, 22 nt, Human
cuacccagcaccuaggcugccu

SEQ ID NO: 815474 - RNA, 22 nt, Human
cugccaucugagccaaaagugc

SEQ ID NO: 815475 - RNA, 22 nt, Human
ucuuuggaucccaacuggcugg

SEQ ID NO: 815476 - RNA, 22 nt, Human
uggcagcuguguccagguagaa

SEQ ID NO: 815477 - RNA, 21 nt, Human
uguaaguuucaucugaauugg

SEQ ID NO: 815478 - RNA, 19 nt, Human
uauggcaggccgaggcacu

SEQ ID NO: 815479 - RNA, 22 nt, Human
agaccaagaaaggaugaggauc

SEQ ID NO: 815480 - RNA, 22 nt, Human
uuuggaauuggcauucuauucu

SEQ ID NO: 815481 - RNA, 22 nt, Human
uggcagcugccauguccacgug

SEQ ID NO: 815482 - RNA, 21 nt, Human
gccaggaguagauuacauuua

SEQ ID NO: 815483 - RNA, 22 nt, Human
ucucaggagccacagcgggagu

SEQ ID NO: 815484 - RNA, 22 nt, Human
ugaggcaggaguucaggcugcg

SEQ ID NO: 815485 - RNA, 19 nt, Human
uuucccagcccuugcugug

SEQ ID NO: 815486 - RNA, 22 nt, Human
uggaagggagugacagucagag

SEQ ID NO: 815487 - RNA, 22 nt, Human
aucugcagaggacaggcgagga

SEQ ID NO: 815488 - RNA, 22 nt, Human
uugaauaguuuuggauagcaua

SEQ ID NO: 815489 - RNA, 22 nt, Human
aagggagguaaagcuauuuaaa

SEQ ID NO: 815490 - RNA, 22 nt, Human
gugguaauuuaauccuacacug

SEQ ID NO: 815491 - RNA, 22 nt, Human
gcagagcuccccaagacaccaa

SEQ ID NO: 815492 - RNA, 22 nt, Human
acacauauucauauguacuuac

SEQ ID NO: 815493 - RNA, 23 nt, Human
uuagagaugauuaaaaaaucuug

SEQ ID NO: 815494 - RNA, 22 nt, Human
augcuguggggagugaggguag

SEQ ID NO: 815495 - RNA, 22 nt, Human
ugaaaugauuauaugguguuug

SEQ ID NO: 815496 - RNA, 22 nt, Human
gcccaggagaggccagggcuga

SEQ ID NO: 815497 - RNA, 22 nt, Human
uagcucuucauuucaucugauu

SEQ ID NO: 815498 - RNA, 21 nt, Human
ugcugaugucagagaagcaag

SEQ ID NO: 815499 - RNA, 22 nt, Human
ccaugagcuucaacugacacag

SEQ ID NO: 815500 - RNA, 22 nt, Human
gaggcagcgggucaggaccgug

SEQ ID NO: 815501 - RNA, 22 nt, Human
uggaguuccuuugaaaggcucu

SEQ ID NO: 815502 - RNA, 22 nt, Human
ccaaaugugccuguuucaacaa

SEQ ID NO: 815503 - RNA, 22 nt, Human
uccaggagugauaaggccacug

SEQ ID NO: 815504 - RNA, 22 nt, Human
gagacagugguugcagaagcuc

SEQ ID NO: 815505 - RNA, 22 nt, Human
ucuccuccuuuuuucaacauag

SEQ ID NO: 815506 - RNA, 22 nt, Human
cacaauuuccuugcuucacuuu

SEQ ID NO: 815507 - RNA, 22 nt, Human
cugcccaggaaggagaggaugg

SEQ ID NO: 815508 - RNA, 22 nt, Human
augcugugccuggaaagcggcu

SEQ ID NO: 815509 - RNA, 22 nt, Human
cccaggaaguggagguugcagu

SEQ ID NO: 815510 - RNA, 22 nt, Human
agcacauucugccuugcuuugc

SEQ ID NO: 815511 - RNA, 22 nt, Human
augcugugaaaaagaaggcuga

SEQ ID NO: 815512 - RNA, 22 nt, Human
uucuuuugggaauuacguaugc

SEQ ID NO: 815513 - RNA, 22 nt, Human
uugaaagaagaagcugcgaugu

SEQ ID NO: 815514 - RNA, 22 nt, Human
gagagucuaggaaccucauaua

SEQ ID NO: 815515 - RNA, 22 nt, Human
gggcagcucagccaccaugcag

SEQ ID NO: 815516 - RNA, 22 nt, Human
gcaucuaaauaaacgugggagu

SEQ ID NO: 815517 - RNA, 22 nt, Human
uuucacauuagauaugucauuu

SEQ ID NO: 815518 - RNA, 22 nt, Human
uagugcuuaauaaauuucagaa

SEQ ID NO: 815519 - RNA, 22 nt, Human
aguaaaucagaccucauuaugu

SEQ ID NO: 815520 - RNA, 22 nt, Human
cagaguggcacucugcuggaug

SEQ ID NO: 815521 - RNA, 22 nt, Human
ucauuucaaugauacuacuaag

SEQ ID NO: 815522 - RNA, 22 nt, Human
auguagagcaguguuguccaau

SEQ ID NO: 815523 - RNA, 22 nt, Human
ucuuuuggaaaugaugugcagg

SEQ ID NO: 815524 - RNA, 21 nt, Human
gcugcccaacccugcaucucc

SEQ ID NO: 815525 - RNA, 22 nt, Human
cagaagaguagcugaacaaguu

SEQ ID NO: 815526 - RNA, 22 nt, Human
cagcugccuucugcgggaaguc

SEQ ID NO: 815527 - RNA, 22 nt, Human
cauuuguuggucagauuguagu

SEQ ID NO: 815528 - RNA, 22 nt, Human
cuguaaauaugaagaauauaug

SEQ ID NO: 815529 - RNA, 22 nt, Human
cagcagaggcacgucugugaau

SEQ ID NO: 815530 - RNA, 22 nt, Human
aaccauuugccauuaucuuaag

SEQ ID NO: 815531 - RNA, 22 nt, Human
cagauggaacacagaaaggaga

SEQ ID NO: 815532 - RNA, 20 nt, Human
caggaugauuggacacgaug

SEQ ID NO: 815533 - RNA, 22 nt, Human
uucuuacagaguuuacagagcc

SEQ ID NO: 815534 - RNA, 22 nt, Human
cagaguggcgacccccucagcu

SEQ ID NO: 815535 - RNA, 23 nt, Human
accaggaguugucucaggaaaca

SEQ ID NO: 815536 - RNA, 20 nt, Human
auuuggcaugaaguauugau

SEQ ID NO: 815537 - RNA, 22 nt, Human
gcaggagacaacuguaaggaga

SEQ ID NO: 815538 - RNA, 22 nt, Human
agaaaugaaaccaaagccuaga

SEQ ID NO: 815539 - RNA, 22 nt, Human
ggugaagggccuuaggagacag

SEQ ID NO: 815540 - RNA, 22 nt, Human
cugccuccugccgugcagcuuc

SEQ ID NO: 815541 - RNA, 22 nt, Human
ugacaguuaagguauacauuca

SEQ ID NO: 815542 - RNA, 22 nt, Human
caaauaguaugagcaaugauuc

SEQ ID NO: 815543 - RNA, 22 nt, Human
cuguuucaagugaagucagaca

SEQ ID NO: 815544 - RNA, 22 nt, Human
ucuucccuaaucaccaucuuca

SEQ ID NO: 815545 - RNA, 22 nt, Human
gacagguggggaaacuaaggua

SEQ ID NO: 815546 - RNA, 22 nt, Human
uuucaaacauaucuucauuacu

SEQ ID NO: 815547 - RNA, 22 nt, Human
auugaaaggcaaaguaggaagc

SEQ ID NO: 815548 - RNA, 22 nt, Human
acccaggauagagugcugcagu

SEQ ID NO: 815549 - RNA, 22 nt, Human
agugcuuucuugcuccaucagu

SEQ ID NO: 815550 - RNA, 22 nt, Human
gaagcagcaaguauaggacagg

SEQ ID NO: 815551 - RNA, 22 nt, Human
uacaucauaauaauacuuagaa

SEQ ID NO: 815552 - RNA, 22 nt, Human
uccugucuaaagaccugcaggc

SEQ ID NO: 815553 - RNA, 22 nt, Human
ccagggaguuuccaaucugaga

SEQ ID NO: 815554 - RNA, 22 nt, Human
auacacauguguaugugcaugc

SEQ ID NO: 815555 - RNA, 22 nt, Human
uggcagcugucuguggggucuc

SEQ ID NO: 815556 - RNA, 22 nt, Human
uggcagcuuuuuguuucaggcu

SEQ ID NO: 815557 - RNA, 22 nt, Human
cucaggauguacuacagaaggc

SEQ ID NO: 815558 - RNA, 22 nt, Human
uuauccuggauuauauauguga

SEQ ID NO: 815559 - RNA, 22 nt, Human
cccaggaguaagugacauuguu

SEQ ID NO: 815560 - RNA, 22 nt, Human
uacaaaguaauguauaauaucg

SEQ ID NO: 815561 - RNA, 22 nt, Human
uguuuuaagagcgcacuuuaua

SEQ ID NO: 815562 - RNA, 22 nt, Human
gagggagggccaggucccaacc

SEQ ID NO: 815563 - RNA, 17 nt, Human
aaucuguuuacagucag

SEQ ID NO: 815564 - RNA, 22 nt, Human
uacagcuaggcaaaaaugacau

SEQ ID NO: 815565 - RNA, 19 nt, Human
ugcugcuguccuugcaggg

SEQ ID NO: 815566 - RNA, 22 nt, Human
gacccaggaagcuacuucuggu

SEQ ID NO: 815567 - RNA, 22 nt, Human
acuuuugguucuguaacuguga

SEQ ID NO: 815568 - RNA, 22 nt, Human
guggcagcggugugcaaggagg

SEQ ID NO: 815569 - RNA, 22 nt, Human
gauuuuaauuauaggagguccu

SEQ ID NO: 815570 - RNA, 22 nt, Human
ggaggggauuuaguagaugcua

SEQ ID NO: 815571 - RNA, 22 nt, Human
cauuuguaauacugacuugcag

SEQ ID NO: 815572 - RNA, 22 nt, Human
acuugcugguggcauuuacagu

SEQ ID NO: 815573 - RNA, 22 nt, Human
uuucuuaguccuagagugauuu

SEQ ID NO: 815574 - RNA, 22 nt, Human
gggagggguugcauguuugagu

SEQ ID NO: 815575 - RNA, 22 nt, Human
gucccauaaguagugcaacuug

SEQ ID NO: 815576 - RNA, 22 nt, Human
uuucauugcagagucugugugc

SEQ ID NO: 815577 - RNA, 22 nt, Human
gucugucucccugugacugaga

SEQ ID NO: 815578 - RNA, 22 nt, Human
cagaggcaaaagagguggaggu

SEQ ID NO: 815579 - RNA, 22 nt, Human
uuugcagugucagcuucugugu

SEQ ID NO: 815580 - RNA, 22 nt, Human
aagauaaacucuugauuucuga

SEQ ID NO: 815581 - RNA, 22 nt, Human
ucauuugugugagugauuugac

SEQ ID NO: 815582 - RNA, 22 nt, Human
ucagugugaggucuuccacccg

SEQ ID NO: 815583 - RNA, 22 nt, Human
uaggcagcgcuuggcugugcuu

SEQ ID NO: 815584 - RNA, 22 nt, Human
agucuugcauuuucugaagaug

SEQ ID NO: 815585 - RNA, 22 nt, Human
gaucuucucuuuaguagaaaca

SEQ ID NO: 815586 - RNA, 22 nt, Human
gcaggagagccagcaggcuucc

SEQ ID NO: 815587 - RNA, 22 nt, Human
agagggcagggcgguaaguccu

SEQ ID NO: 815588 - RNA, 22 nt, Human
ccagugcuaagguagccucugc

SEQ ID NO: 815589 - RNA, 22 nt, Human
gcccaggaggcagagguugugg

SEQ ID NO: 815590 - RNA, 22 nt, Human
auccaugauuaguaggauaaag

SEQ ID NO: 815591 - RNA, 22 nt, Human
aaagacuuggcuuaugauuugc

SEQ ID NO: 815592 - RNA, 22 nt, Human
aaauacagaguugcuuaaaagc

SEQ ID NO: 815593 - RNA, 22 nt, Human
uguccauggauagagcugcucg

SEQ ID NO: 815594 - RNA, 22 nt, Human
cccagaaggucgaggcugcagu

SEQ ID NO: 815595 - RNA, 22 nt, Human
cccaggaggucgaagcugcagu

SEQ ID NO: 815596 - RNA, 22 nt, Human
ggagaggacauggcucccacag

SEQ ID NO: 815597 - RNA, 22 nt, Human
gagacagcacaggccacuggga

SEQ ID NO: 815598 - RNA, 22 nt, Human
uguugagacugagggagucagc

SEQ ID NO: 815599 - RNA, 18 nt, Human
ggcagggaaaagauaggg

SEQ ID NO: 815600 - RNA, 22 nt, Human
gugcugugcgcuuuuucuguau

SEQ ID NO: 815601 - RNA, 22 nt, Human
cugugauuguuaguuccuauac

SEQ ID NO: 815602 - RNA, 22 nt, Human
ugaggcaggacauggacaacug

SEQ ID NO: 815603 - RNA, 22 nt, Human
ggagauggaauagauucugacu

SEQ ID NO: 815604 - RNA, 22 nt, Human
agaggacagguuuuccaugggc

SEQ ID NO: 815605 - RNA, 18 nt, Human
acucaggaaaugaugaca

SEQ ID NO: 815606 - RNA, 22 nt, Human
gcugcugucagugguggcaguu

SEQ ID NO: 815607 - RNA, 22 nt, Human
guucuucaguaaaauuaaaugu

SEQ ID NO: 815608 - RNA, 22 nt, Human
gucaggauuuacaaacuucagu

SEQ ID NO: 815609 - RNA, 22 nt, Human
cugcugugccucuuuucacgug

SEQ ID NO: 815610 - RNA, 22 nt, Human
ugcugaaaacucaaccauugug

SEQ ID NO: 815611 - RNA, 22 nt, Human
gaggagcuugugagaagauguc

SEQ ID NO: 815612 - RNA, 19 nt, Human
uuugcagugguuccuuugu

SEQ ID NO: 815613 - RNA, 22 nt, Human
caggggaguuuuaugcaacaga

SEQ ID NO: 815614 - RNA, 22 nt, Human
uuauccaagcagaagcugcaca

SEQ ID NO: 815615 - RNA, 22 nt, Human
ggggggugcugaucaguggagc

SEQ ID NO: 815616 - RNA, 22 nt, Human
cugacccauauaagaguggagg

SEQ ID NO: 815617 - RNA, 22 nt, Human
ugcugcugauggcaccuaggca

SEQ ID NO: 815618 - RNA, 22 nt, Human
gcccaggaagccaccgggaagu

SEQ ID NO: 815619 - RNA, 22 nt, Human
ggcagcuuccugagccagcagc

SEQ ID NO: 815620 - RNA, 22 nt, Human
caguugccuacuacauggcagg

SEQ ID NO: 815621 - RNA, 22 nt, Human
agagggcagucucagauuggga

SEQ ID NO: 815622 - RNA, 22 nt, Human
ucacuucacacccacuaucaug

SEQ ID NO: 815623 - RNA, 20 nt, Human
agcaagaguaaggacagcga

SEQ ID NO: 815624 - RNA, 22 nt, Human
cauuuguuaaccaguguggauu

SEQ ID NO: 815625 - RNA, 22 nt, Human
aguggcagagugcacucaggca

SEQ ID NO: 815626 - RNA, 22 nt, Human
gcaaguuauuuccauuuaaagc

SEQ ID NO: 815627 - RNA, 22 nt, Human
agaggggagagcuaagcaauuc

SEQ ID NO: 815628 - RNA, 22 nt, Human
uggagagguuuaaacaaaaguu

SEQ ID NO: 815629 - RNA, 22 nt, Human
caguuucuauggcugggcucug

SEQ ID NO: 815630 - RNA, 22 nt, Human
agaggcaggagguugacuugag

SEQ ID NO: 815631 - RNA, 22 nt, Human
guguguuucagaagccaggugu

SEQ ID NO: 815632 - RNA, 22 nt, Human
auucaaauuaaguuaauucagc

SEQ ID NO: 815633 - RNA, 22 nt, Human
gauuucuugaccccugucucag

SEQ ID NO: 815634 - RNA, 22 nt, Human
uccaggagagguguggggacug

SEQ ID NO: 815635 - RNA, 22 nt, Human
cugcauuagucaugcuuugcag

SEQ ID NO: 815636 - RNA, 22 nt, Human
aguguguccagaaaucuguauu

SEQ ID NO: 815637 - RNA, 22 nt, Human
gcccaggauggcuggaggugcu

SEQ ID NO: 815638 - RNA, 22 nt, Human
gcagcugaaagggaucucuaca

SEQ ID NO: 815639 - RNA, 22 nt, Human
cgaggcaggcaggcggaggaua

SEQ ID NO: 815640 - RNA, 22 nt, Human
gaucuucuagcagaaguaauuu

SEQ ID NO: 815641 - RNA, 22 nt, Human
uuggaauucaaguuguagcuua

SEQ ID NO: 815642 - RNA, 22 nt, Human
gugcauuugugcaugcacaugu

SEQ ID NO: 815643 - RNA, 22 nt, Human
aaggcagcagaggaaaggugcu

SEQ ID NO: 815644 - RNA, 19 nt, Human
ugcuagaaauucugugacu

SEQ ID NO: 815645 - RNA, 22 nt, Human
agcugcccagcuaggaagaagg

SEQ ID NO: 815646 - RNA, 22 nt, Human
uggaaagucucuuuugacugua

SEQ ID NO: 815647 - RNA, 22 nt, Human
uccauuuucaucucauguauaa

SEQ ID NO: 815648 - RNA, 22 nt, Human
uugguuuagagagugugguuac

SEQ ID NO: 815649 - RNA, 22 nt, Human
acuuaaaaagaaucuuuucacg

SEQ ID NO: 815650 - RNA, 22 nt, Human
agcccaggcagagggaugcuug

SEQ ID NO: 815651 - RNA, 22 nt, Human
aagcgccaugguuccugcgcag

SEQ ID NO: 815652 - RNA, 22 nt, Human
acuguguggaccacucugaggc

SEQ ID NO: 815653 - RNA, 22 nt, Human
aggaagcuccaugaaggcagag

SEQ ID NO: 815654 - RNA, 23 nt, Human
uccuuccuuugagaggcuccauc

SEQ ID NO: 815655 - RNA, 22 nt, Human
gccaggagagcuccuucagguu

SEQ ID NO: 815656 - RNA, 23 nt, Human
agaggcaggaguggcuugcccgg

SEQ ID NO: 815657 - RNA, 22 nt, Human
cuggccaggcuugggacagaca

SEQ ID NO: 815658 - RNA, 22 nt, Human
aagcagaggaccgacggaggga

SEQ ID NO: 815659 - RNA, 22 nt, Human
uugaacauuggcaauuucauau

SEQ ID NO: 815660 - RNA, 21 nt, Human
ggauggauagggaagagauuu

SEQ ID NO: 815661 - RNA, 22 nt, Human
caguuucuacgaaggucaaccc

SEQ ID NO: 815662 - RNA, 22 nt, Human
uaaauuguuuucuagaaguugu

SEQ ID NO: 815663 - RNA, 22 nt, Human
cagucuuuguucccauuacuga

SEQ ID NO: 815664 - RNA, 22 nt, Human
cccaggagaugcacuccauugg

SEQ ID NO: 815665 - RNA, 22 nt, Human
ugccuguguugauuacuuuguc

SEQ ID NO: 815666 - RNA, 22 nt, Human
uugugguuaaccgcacauuuuu

SEQ ID NO: 815667 - RNA, 22 nt, Human
aucaggauuauuaaaucuggau

SEQ ID NO: 815668 - RNA, 22 nt, Human
caggcaggucagugaagaagga

SEQ ID NO: 815669 - RNA, 22 nt, Human
uucuuuuccuacacagcgauuu

SEQ ID NO: 815670 - RNA, 22 nt, Human
uucauucuugucuuuguauagu

SEQ ID NO: 815671 - RNA, 20 nt, Human
ucucuucuggggagauaaaa

SEQ ID NO: 815672 - RNA, 22 nt, Human
acugcccucccaucuauugcaa

SEQ ID NO: 815673 - RNA, 22 nt, Human
ugcuggguagaaguauuagucu

SEQ ID NO: 815674 - RNA, 22 nt, Human
agucugucuacuuaaagucugu

SEQ ID NO: 815675 - RNA, 22 nt, Human
uugcauuugagaaaguucuccu

SEQ ID NO: 815676 - RNA, 22 nt, Human
aggaagcucaaagccaugaugu

SEQ ID NO: 815677 - RNA, 22 nt, Human
agcugcccagauaggaggaggc

SEQ ID NO: 815678 - RNA, 21 nt, Human
gggcagcucuguuuuauuuuc

SEQ ID NO: 815679 - RNA, 22 nt, Human
aggcagcuggacauaacuaacc

SEQ ID NO: 815680 - RNA, 17 nt, Human
uagcuguguuucagcua

SEQ ID NO: 815681 - RNA, 17 nt, Human
gcugacccuggagaagu

SEQ ID NO: 815682 - RNA, 22 nt, Human
ucaguucuuuauuucacaguga

SEQ ID NO: 815683 - RNA, 22 nt, Human
ucucaggaucuaauacauggua

SEQ ID NO: 815684 - RNA, 22 nt, Human
aucaggaucacagaaacuuuua

SEQ ID NO: 815685 - RNA, 22 nt, Human
ugcuagugcaggguuuucaguu

SEQ ID NO: 815686 - RNA, 22 nt, Human
ugcacauuaguguuugagaugc

SEQ ID NO: 815687 - RNA, 22 nt, Human
uugaaguuguaguucagugaag

SEQ ID NO: 815688 - RNA, 22 nt, Human
ugaggggagacagaguggacuc

SEQ ID NO: 815689 - RNA, 22 nt, Human
aagggcagccugacucacgguc

SEQ ID NO: 815690 - RNA, 22 nt, Human
gucaggauguuuauucuccagu

SEQ ID NO: 815691 - RNA, 21 nt, Human
uugaaaguaaauucagcagcu

SEQ ID NO: 815692 - RNA, 22 nt, Human
ucaggauggcuucugcaucaaa

SEQ ID NO: 815693 - RNA, 15 nt, Human
cuccaugauuuugca

SEQ ID NO: 815694 - RNA, 23 nt, Human
uuuuccagaaucgacucuguaga

SEQ ID NO: 815695 - RNA, 23 nt, Human
uacaugcuauaauuucacccuca

SEQ ID NO: 815696 - RNA, 18 nt, Human
ccagguggugacagagau

SEQ ID NO: 815697 - RNA, 22 nt, Human
ugguaaauauguccauucucuu

SEQ ID NO: 815698 - RNA, 22 nt, Human
agacaaaugguaauuaugucua

SEQ ID NO: 815699 - RNA, 22 nt, Human
cgcagggauuucaaggggccuu

SEQ ID NO: 815700 - RNA, 22 nt, Human
gauguguuuccaggauuuguuu

SEQ ID NO: 815701 - RNA, 22 nt, Human
cuucugagcagaccuccugggg

SEQ ID NO: 815702 - RNA, 22 nt, Human
gcaggagagucugugccagguu

SEQ ID NO: 815703 - RNA, 22 nt, Human
gaaggggacuggcagcugcaga

SEQ ID NO: 815704 - RNA, 22 nt, Human
cuuugcaaacgauuaccacaug

SEQ ID NO: 815705 - RNA, 22 nt, Human
uccaggagaggccugaccaggu

SEQ ID NO: 815706 - RNA, 22 nt, Human
uaagauaaguggguugagaugg

SEQ ID NO: 815707 - RNA, 22 nt, Human
ucucuucuagcuucuugugguu

SEQ ID NO: 815708 - RNA, 22 nt, Human
ggaggggagucucccaaagccg

SEQ ID NO: 815709 - RNA, 22 nt, Human
ccagaggaggggggucuuucug

SEQ ID NO: 815710 - RNA, 22 nt, Human
uuuuccagauuggacuuagucc

SEQ ID NO: 815711 - RNA, 22 nt, Human
uuucaguuacugcuauaucauu

SEQ ID NO: 815712 - RNA, 22 nt, Human
gaaggccaagaggcuccaagau

SEQ ID NO: 815713 - RNA, 22 nt, Human
cagaccagaaggaagccgacaa

SEQ ID NO: 815714 - RNA, 22 nt, Human
uucaggaugacaccauguccag

SEQ ID NO: 815715 - RNA, 22 nt, Human
ggaggaggcggcagaaguuccu

SEQ ID NO: 815716 - RNA, 22 nt, Human
aaagccauuacaaaauuucaua

SEQ ID NO: 815717 - RNA, 22 nt, Human
ugaggcagugugagauaauaaa

SEQ ID NO: 815718 - RNA, 22 nt, Human
cauguuuacuaccaggagaaug

SEQ ID NO: 815719 - RNA, 22 nt, Human
aggaggggcauagaaauguaau

SEQ ID NO: 815720 - RNA, 22 nt, Human
ucugggaagcugcgugccuguu

SEQ ID NO: 815721 - RNA, 22 nt, Human
ucccaggagcaccuuuugagcc

SEQ ID NO: 815722 - RNA, 22 nt, Human
uuguaaauaguaguaagaugcc

SEQ ID NO: 815723 - RNA, 22 nt, Human
uggggcucaccuaggcuggaag

SEQ ID NO: 815724 - RNA, 23 nt, Human
uucuuucaagaaguucacagugc

SEQ ID NO: 815725 - RNA, 17 nt, Human
gagacagcaggagcccc

SEQ ID NO: 815726 - RNA, 22 nt, Human
aaagcagaggugauaugacuua

SEQ ID NO: 815727 - RNA, 22 nt, Human
ccuggauucaagucuuucuuuc

SEQ ID NO: 815728 - RNA, 22 nt, Human
uaugaacucuggagucugagug

SEQ ID NO: 815729 - RNA, 22 nt, Human
auuuccaggagaaaggauuuua

SEQ ID NO: 815730 - RNA, 21 nt, Human
cccagggaagccgcagucacc

SEQ ID NO: 815731 - RNA, 22 nt, Human
ucaucugucccaggcuuuuuuc

SEQ ID NO: 815732 - RNA, 22 nt, Human
ccaggagaugauguuggggauu

SEQ ID NO: 815733 - RNA, 22 nt, Human
gacccaggcccaaggcugccag

SEQ ID NO: 815734 - RNA, 18 nt, Human
gugcugugggcaguggcc

SEQ ID NO: 815735 - RNA, 22 nt, Human
cuccaggaaagccugaggcccg

SEQ ID NO: 815736 - RNA, 22 nt, Human
uuccuuaggcuguuugcagugc

SEQ ID NO: 815737 - RNA, 22 nt, Human
uauaucauggagauuaacauuc

SEQ ID NO: 815738 - RNA, 22 nt, Human
ggcagcuucuuaauauggagac

SEQ ID NO: 815739 - RNA, 22 nt, Human
cugcugucauagccaucccucc

SEQ ID NO: 815740 - RNA, 22 nt, Human
agaggcggagguugcagugagc

SEQ ID NO: 815741 - RNA, 22 nt, Human
ggagguggcagagggacauucu

SEQ ID NO: 815742 - RNA, 22 nt, Human
ugcaugugcccacucuggcuua

SEQ ID NO: 815743 - RNA, 19 nt, Human
uucauucucuuauuguugu

SEQ ID NO: 815744 - RNA, 19 nt, Human
agggaguuuauauuugcac

SEQ ID NO: 815745 - RNA, 22 nt, Human
ggugaguugggguucacagguc

SEQ ID NO: 815746 - RNA, 17 nt, Human
acucaggaucugggagu

SEQ ID NO: 815747 - RNA, 22 nt, Human
uggaaggaagccaaggaagguu

SEQ ID NO: 815748 - RNA, 22 nt, Human
uauuuucuguggaggaccagau

SEQ ID NO: 815749 - RNA, 22 nt, Human
ugcuggaauaauuucauguuaa

SEQ ID NO: 815750 - RNA, 22 nt, Human
gaggcagcagaacauggaagag

SEQ ID NO: 815751 - RNA, 17 nt, Human
aggccagaugaggcaag

SEQ ID NO: 815752 - RNA, 22 nt, Human
ucuuugaauuucugacugucuu

SEQ ID NO: 815753 - RNA, 22 nt, Human
ucaggauaaaauguaauggcaa

SEQ ID NO: 815754 - RNA, 22 nt, Human
uccaggaggugaggggaccaaa

SEQ ID NO: 815755 - RNA, 22 nt, Human
gagggccagcagccucagcaug

SEQ ID NO: 815756 - RNA, 22 nt, Human
aggcagcccacaggacacagga

SEQ ID NO: 815757 - RNA, 22 nt, Human
uuaacaugucuugacuucaucu

SEQ ID NO: 815758 - RNA, 21 nt, Human
agcagaggcugccuggugacu

SEQ ID NO: 815759 - RNA, 22 nt, Human
agggagcuuccgaacuacagcu

SEQ ID NO: 815760 - RNA, 22 nt, Human
cugccaggcagcagagggagaa

SEQ ID NO: 815761 - RNA, 20 nt, Human
agcugccccugggcacugcc

SEQ ID NO: 815762 - RNA, 22 nt, Human
gggcagcucugcccaucagagg

SEQ ID NO: 815763 - RNA, 22 nt, Human
ugauuuccccagucuugcugcu

SEQ ID NO: 815764 - RNA, 22 nt, Human
cugucauugagccugucagggc

SEQ ID NO: 815765 - RNA, 22 nt, Human
ucugcaucauuuuucagagccg

SEQ ID NO: 815766 - RNA, 22 nt, Human
caggauggucagaugcauuguc

SEQ ID NO: 815767 - RNA, 22 nt, Human
gagggcuccauuccccgugccc

SEQ ID NO: 815768 - RNA, 22 nt, Human
uauuucagcaagaagaaugugg

SEQ ID NO: 815769 - RNA, 22 nt, Human
aaugagacacgugaagcagaug

SEQ ID NO: 815770 - RNA, 22 nt, Human
cugguacaaaaugcugauauca

SEQ ID NO: 815771 - RNA, 22 nt, Human
aaguguauauaugacuuauaaa

SEQ ID NO: 815772 - RNA, 19 nt, Human
uucuccaggcugcagaggg

SEQ ID NO: 815773 - RNA, 22 nt, Human
caagauggagaagcagcaaggg

SEQ ID NO: 815774 - RNA, 22 nt, Human
aguccaugguucugacucaucu

SEQ ID NO: 815775 - RNA, 21 nt, Human
aggcagcucaggcccagagag

SEQ ID NO: 815776 - RNA, 22 nt, Human
ggaggaggggcgcuuugucuau

SEQ ID NO: 815777 - RNA, 22 nt, Human
cuugaaagaagggucuuuuaau

SEQ ID NO: 815778 - RNA, 22 nt, Human
aaucauucuuauuucacagcaa

SEQ ID NO: 815779 - RNA, 22 nt, Human
acauuuaaccaaacuguuuaau

SEQ ID NO: 815780 - RNA, 22 nt, Human
uauuuuaaagacugccagccua

SEQ ID NO: 815781 - RNA, 22 nt, Human
gagugcaggccugagcaccauc

SEQ ID NO: 815782 - RNA, 22 nt, Human
aggcagcuggcagcacccaggg

SEQ ID NO: 815783 - RNA, 21 nt, Human
ggcagccugacccccagagag

SEQ ID NO: 815784 - RNA, 22 nt, Human
gagaggugaaggcugcccuggg

SEQ ID NO: 815785 - RNA, 22 nt, Human
caggacagcucaacaccuccuc

SEQ ID NO: 815786 - RNA, 22 nt, Human
uuagcaucugcuguaagcuuau

SEQ ID NO: 815787 - RNA, 22 nt, Human
uccauuuuagaagaaaauccac

SEQ ID NO: 815788 - RNA, 22 nt, Human
gagguggucgaggagggguacc

SEQ ID NO: 815789 - RNA, 22 nt, Human
gagccaggggucagcuccgagg

SEQ ID NO: 815790 - RNA, 22 nt, Human
cuuuuccacugagccucacaaa

SEQ ID NO: 815791 - RNA, 22 nt, Human
aaggcagcacagcaacugcuca

SEQ ID NO: 815792 - RNA, 22 nt, Human
ucuuuguaaaugccuagcauaa

SEQ ID NO: 815793 - RNA, 22 nt, Human
agacucaagacugcagaagacg

SEQ ID NO: 815794 - RNA, 22 nt, Human
uugcaucuaccauaucaaagau

SEQ ID NO: 815795 - RNA, 22 nt, Human
gcuguguuggugaagcuguagc

SEQ ID NO: 815796 - RNA, 22 nt, Human
ucccaggaugaagacaguguug

SEQ ID NO: 815797 - RNA, 22 nt, Human
gagggcuccucacauucucuau

SEQ ID NO: 815798 - RNA, 21 nt, Human
cuugaaagguagagucuacag

SEQ ID NO: 815799 - RNA, 22 nt, Human
ccccaggacguggcccucauag

SEQ ID NO: 815800 - RNA, 22 nt, Human
uggcagucuggguuggcaguua

SEQ ID NO: 815801 - RNA, 22 nt, Human
gaggcugccccuuccucagcug

SEQ ID NO: 815802 - RNA, 22 nt, Human
ucacagacacagggagaagcau

SEQ ID NO: 815803 - RNA, 22 nt, Human
uugaaagacuucuccugugaaa

SEQ ID NO: 815804 - RNA, 22 nt, Human
gacccaggcucgugggacggcu

SEQ ID NO: 815805 - RNA, 22 nt, Human
ggcagggaagcuggcaucacgg

SEQ ID NO: 815806 - RNA, 19 nt, Human
aucugccuuagugcugcug

SEQ ID NO: 815807 - RNA, 20 nt, Human
agcauuugaaauaugacuau

SEQ ID NO: 815808 - RNA, 22 nt, Human
uucugugaaucuuuuuucccac

SEQ ID NO: 815809 - RNA, 17 nt, Human
caaggccagcaucuuca

SEQ ID NO: 815810 - RNA, 22 nt, Human
cccaggaggguggccucugccc

SEQ ID NO: 815811 - RNA, 22 nt, Human
gcucagagcuugaaguuccacu

SEQ ID NO: 815812 - RNA, 22 nt, Human
ugcugcugaucauuuauagucu

SEQ ID NO: 815813 - RNA, 19 nt, Human
caagugaagccugggaugg

SEQ ID NO: 815814 - RNA, 22 nt, Human
agggcagcagcggcccaggccu

SEQ ID NO: 815815 - RNA, 17 nt, Human
ccuguguuugcuccuuc

SEQ ID NO: 815816 - RNA, 22 nt, Human
aagauuauggcagauaacaauu

SEQ ID NO: 815817 - RNA, 22 nt, Human
aguuucuuuagauagaaaguuc

SEQ ID NO: 815818 - RNA, 22 nt, Human
acaaaugugucuaauugugccu

SEQ ID NO: 815819 - RNA, 22 nt, Human
aacauuuaugauugagguaaau

SEQ ID NO: 815820 - RNA, 22 nt, Human
guuuuauaggugaaauauuacu

SEQ ID NO: 815821 - RNA, 22 nt, Human
uuagccaugcccuagaagagga

SEQ ID NO: 815822 - RNA, 22 nt, Human
gagcagcucugggugacccagu

SEQ ID NO: 815823 - RNA, 22 nt, Human
ugaggcaggaugcuugcacagg

SEQ ID NO: 815824 - RNA, 22 nt, Human
aaggcagccagauccuuugggu

SEQ ID NO: 815825 - RNA, 22 nt, Human
uucuucuuuaucucaguauccu

SEQ ID NO: 815826 - RNA, 22 nt, Human
agcuucuuggcucagcacuugg

SEQ ID NO: 815827 - RNA, 21 nt, Human
cccaggaggagcuccggcucc

SEQ ID NO: 815828 - RNA, 22 nt, Human
ucauuuauaaggaugcaauuaa

SEQ ID NO: 815829 - RNA, 22 nt, Human
ucucucuugucaccccaucugc

SEQ ID NO: 815830 - RNA, 22 nt, Human
auuaucuauguagaaugauuuu

SEQ ID NO: 815831 - RNA, 22 nt, Human
cugcgcagcaaucagagaggag

SEQ ID NO: 815832 - RNA, 22 nt, Human
ugucucugauaaguaguucagu

SEQ ID NO: 815833 - RNA, 22 nt, Human
uaaguggaagguuauaugcuaa

SEQ ID NO: 815834 - RNA, 22 nt, Human
cccaggaguuggaggcuacggu

SEQ ID NO: 815835 - RNA, 22 nt, Human
gggcagcuggccagguauucug

SEQ ID NO: 815836 - RNA, 22 nt, Human
cugaaugaggaaaagagugagg

SEQ ID NO: 815837 - RNA, 22 nt, Human
agggaggucuuugaggggcuua

SEQ ID NO: 815838 - RNA, 17 nt, Human
caagagagaugacugga

SEQ ID NO: 815839 - RNA, 22 nt, Human
gaaggccacaaaaaaugucaua

SEQ ID NO: 815840 - RNA, 22 nt, Human
acagucucuccacacugcaggg

SEQ ID NO: 815841 - RNA, 22 nt, Human
gcccaggaguugaaugcagcag

SEQ ID NO: 815842 - RNA, 22 nt, Human
uuucacaacugcuuauuugaga

SEQ ID NO: 815843 - RNA, 22 nt, Human
cgccucagccguggucaucuuc

SEQ ID NO: 815844 - RNA, 22 nt, Human
uagggaggaggguuuucaaauc

SEQ ID NO: 815845 - RNA, 22 nt, Human
aagaggagacuucagcaacuug

SEQ ID NO: 815846 - RNA, 16 nt, Human
ucccaggaggcggaac

SEQ ID NO: 815847 - RNA, 22 nt, Human
uauuucagggagaauaaauuug

SEQ ID NO: 815848 - RNA, 18 nt, Human
gcagcuagccaggggggc

SEQ ID NO: 815849 - RNA, 22 nt, Human
aagagggcugcaaucuuauugc

SEQ ID NO: 815850 - RNA, 22 nt, Human
gcauuuccugugcuuggcauau

SEQ ID NO: 815851 - RNA, 22 nt, Human
guugaaaguggagaaccugguu

SEQ ID NO: 815852 - RNA, 22 nt, Human
cuucugaggcagcuauucaguu

SEQ ID NO: 815853 - RNA, 22 nt, Human
gggcagcuggauaguuuuaaau

SEQ ID NO: 815854 - RNA, 17 nt, Human
acacagggagagggagc

SEQ ID NO: 815855 - RNA, 20 nt, Human
gucaggauuaguaaacucug

SEQ ID NO: 815856 - RNA, 22 nt, Human
aggcagaucacuugaggccagg

SEQ ID NO: 815857 - RNA, 22 nt, Human
agaggcagcagucauacuacag

SEQ ID NO: 815858 - RNA, 16 nt, Human
cuuccucuucacuggc

SEQ ID NO: 815859 - RNA, 23 nt, Human
auugaugacuugauuacacuuuu

SEQ ID NO: 815860 - RNA, 22 nt, Human
uuucucugcugccugugucgau

SEQ ID NO: 815861 - RNA, 22 nt, Human
ucccaggaugugcgugccgccg

SEQ ID NO: 815862 - RNA, 22 nt, Human
aagcuggaacaucuugaggaag

SEQ ID NO: 815863 - RNA, 22 nt, Human
ucuuugcaaaauacaacaaugg

SEQ ID NO: 815864 - RNA, 22 nt, Human
uccaugagcuagcuuuccaaag

SEQ ID NO: 815865 - RNA, 22 nt, Human
gagggagucugugcaaagaauu

SEQ ID NO: 815866 - RNA, 22 nt, Human
cuguaugaggaucagacuggac

SEQ ID NO: 815867 - RNA, 22 nt, Human
cugcuuuggacaacuauucuug

SEQ ID NO: 815868 - RNA, 22 nt, Human
ucuacugugguccuuguaacca

SEQ ID NO: 815869 - RNA, 22 nt, Human
gaggaaccacucugagaagcca

SEQ ID NO: 815870 - RNA, 22 nt, Human
uuaugauuugccacagauuggu

SEQ ID NO: 815871 - RNA, 19 nt, Human
uuucuuaggccuuuggccu

SEQ ID NO: 815872 - RNA, 22 nt, Human
aggaagcuggugugaggaugaa

SEQ ID NO: 815873 - RNA, 22 nt, Human
gaggcugaggguuagagaguca

SEQ ID NO: 815874 - RNA, 22 nt, Human
ucagagagccucaggcacugcc

SEQ ID NO: 815875 - RNA, 22 nt, Human
uuagaaagcuuuccauagucaa

SEQ ID NO: 815876 - RNA, 22 nt, Human
gaggccagggaugcaaugagag

SEQ ID NO: 815877 - RNA, 22 nt, Human
gaagcagcuggugagauggagc

SEQ ID NO: 815878 - RNA, 22 nt, Human
uugcagcuucgagucuaucugu

SEQ ID NO: 815879 - RNA, 22 nt, Human
cagcuggccaaucagggcgccc

SEQ ID NO: 815880 - RNA, 18 nt, Human
aggcagacacuagagguc

SEQ ID NO: 815881 - RNA, 22 nt, Human
caggacagagcccagacugugu

SEQ ID NO: 815882 - RNA, 22 nt, Human
ucuuccaagguugcacacuauc

SEQ ID NO: 815883 - RNA, 22 nt, Human
cccagcaggaggagguugcagu

SEQ ID NO: 815884 - RNA, 22 nt, Human
ugaauaguccuuggaauaacug

SEQ ID NO: 815885 - RNA, 22 nt, Human
auauucuucuuguucagacuau

SEQ ID NO: 815886 - RNA, 17 nt, Human
ugaaggccaugaccacg

SEQ ID NO: 815887 - RNA, 22 nt, Human
acaguacauaauccugagucug

SEQ ID NO: 815888 - RNA, 22 nt, Human
gucacuguuuccuauuauauuu

SEQ ID NO: 815889 - RNA, 22 nt, Human
uucagcaaauggacuguucagg

SEQ ID NO: 815890 - RNA, 22 nt, Human
caggcagcccugcaccaagugu

SEQ ID NO: 815891 - RNA, 21 nt, Human
agcagaggcagaauguaugca

SEQ ID NO: 815892 - RNA, 22 nt, Human
cauuuucaugaguuucuguuca

SEQ ID NO: 815893 - RNA, 22 nt, Human
guaucacuuuugagagugagaa

SEQ ID NO: 815894 - RNA, 22 nt, Human
uucaugugaucacagauuguaa

SEQ ID NO: 815895 - RNA, 22 nt, Human
aaggaaccuggaguagagggag

SEQ ID NO: 815896 - RNA, 23 nt, Human
gggcagcuuaagcuuguuuuucu

SEQ ID NO: 815897 - RNA, 22 nt, Human
aaggcagcaacuaauggaucuc

SEQ ID NO: 815898 - RNA, 22 nt, Human
agcauccaacaggagggaaggg

SEQ ID NO: 815899 - RNA, 22 nt, Human
uuuguaugugauaagacuauuc

SEQ ID NO: 815900 - RNA, 22 nt, Human
aggcagauauuggggugaugug

SEQ ID NO: 815901 - RNA, 22 nt, Human
uugcuuuguggugguucuucca

SEQ ID NO: 815902 - RNA, 22 nt, Human
ugugaacuggcagguggacggg

SEQ ID NO: 815903 - RNA, 22 nt, Human
gcucucuugguggcuguccugg

SEQ ID NO: 815904 - RNA, 22 nt, Human
agcccaggucucaaaguacagg

SEQ ID NO: 815905 - RNA, 21 nt, Human
ggacagcugcgcgcagggcuc

SEQ ID NO: 815906 - RNA, 22 nt, Human
ucuccucucuuaccugguacaa

SEQ ID NO: 815907 - RNA, 22 nt, Human
acuucaugcagaagagagcugu

SEQ ID NO: 815908 - RNA, 22 nt, Human
cugcagagcaaguaacauccuc

SEQ ID NO: 815909 - RNA, 22 nt, Human
ucuggcaggcaaucggcucugg

SEQ ID NO: 815910 - RNA, 17 nt, Human
agauggcaggaggcaga

SEQ ID NO: 815911 - RNA, 22 nt, Human
aguuugaaauguuggcaauauu

SEQ ID NO: 815912 - RNA, 22 nt, Human
uuucuuguaagauguuuauuaa

SEQ ID NO: 815913 - RNA, 22 nt, Human
ucacaaauagcuauauuaagga

SEQ ID NO: 815914 - RNA, 22 nt, Human
ugaggcagucacccccuccugc

SEQ ID NO: 815915 - RNA, 22 nt, Human
uagggauguccugagacuuggc

SEQ ID NO: 815916 - RNA, 22 nt, Human
ugaggcaggagguugagaacug

SEQ ID NO: 815917 - RNA, 22 nt, Human
ucaggauguuaauauagcauua

SEQ ID NO: 815918 - RNA, 22 nt, Human
uaggcagcagugcuaugauucu

SEQ ID NO: 815919 - RNA, 22 nt, Human
ugaggggaacugaugcccauug

SEQ ID NO: 815920 - RNA, 23 nt, Human
aaggccagaauuucaauggugcc

SEQ ID NO: 815921 - RNA, 22 nt, Human
gagaggauccacaaaccaggaa

SEQ ID NO: 815922 - RNA, 22 nt, Human
cugcuguguuccuccugcaucu

SEQ ID NO: 815923 - RNA, 22 nt, Human
cugggaaauggcuucgagcuca

SEQ ID NO: 815924 - RNA, 22 nt, Human
gcccaggaaagauagggccuca

SEQ ID NO: 815925 - RNA, 22 nt, Human
gguuugaacagcuuuggagaag

SEQ ID NO: 815926 - RNA, 22 nt, Human
gggaggugauggcaagcagcgg

SEQ ID NO: 815927 - RNA, 22 nt, Human
uaaggccaauuacauauguuca

SEQ ID NO: 815928 - RNA, 22 nt, Human
ugaugaaaauaugauucugagg

SEQ ID NO: 815929 - RNA, 22 nt, Human
gcaucuaaacuugcaucauugu

SEQ ID NO: 815930 - RNA, 22 nt, Human
gagguagccacagauagagacu

SEQ ID NO: 815931 - RNA, 22 nt, Human
aaaaacuguaauuacuuuugca

SEQ ID NO: 815932 - RNA, 22 nt, Human
cagcugccccgcuggcugacca

SEQ ID NO: 815933 - RNA, 22 nt, Human
uagcccagcaugagcagagcug

SEQ ID NO: 815934 - RNA, 22 nt, Human
cccaggagaauauaauguucuu

SEQ ID NO: 815935 - RNA, 22 nt, Human
guugaaugaaucauucuaugua

SEQ ID NO: 815936 - RNA, 21 nt, Human
uuugaaagcuacaucuauagc

SEQ ID NO: 815937 - RNA, 22 nt, Human
uggaaggaaagguagcagagaa

SEQ ID NO: 815938 - RNA, 22 nt, Human
uucaacuauuaugaauaaaauu

SEQ ID NO: 815939 - RNA, 19 nt, Human
ggcagucucaagcagcaca

SEQ ID NO: 815940 - RNA, 22 nt, Human
cuggccagaguuggagggugug

SEQ ID NO: 815941 - RNA, 22 nt, Human
ucaggagacuuaugucacagug

SEQ ID NO: 815942 - RNA, 22 nt, Human
ugaaggaaugaguauacuguuu

SEQ ID NO: 815943 - RNA, 22 nt, Human
cauuuccugucuggaggucaaa

SEQ ID NO: 815944 - RNA, 22 nt, Human
augcuguguggucaaguuaauu

SEQ ID NO: 815945 - RNA, 22 nt, Human
aucauucuauuguugagcugcc

SEQ ID NO: 815946 - RNA, 22 nt, Human
auguuauaguuauaaaaugagg

SEQ ID NO: 815947 - RNA, 22 nt, Human
gggcagcugccccucucugggc

SEQ ID NO: 815948 - RNA, 22 nt, Human
aaggcagucugguuucaaagca

SEQ ID NO: 815949 - RNA, 22 nt, Human
aggcagacaaggacacaguggg

SEQ ID NO: 815950 - RNA, 22 nt, Human
ugcauauuguccuugauauuau

SEQ ID NO: 815951 - RNA, 22 nt, Human
ccaggcugugguuuagauagag

SEQ ID NO: 815952 - RNA, 22 nt, Human
auaguuugugaaacacagcagu

SEQ ID NO: 815953 - RNA, 22 nt, Human
aguuggagugaacaugagauug

SEQ ID NO: 815954 - RNA, 22 nt, Human
cauuuguaucugggcugcugug

SEQ ID NO: 815955 - RNA, 22 nt, Human
uggagaggaaagugcaguuuug

SEQ ID NO: 815956 - RNA, 22 nt, Human
aggcagcguagcaaggcuagua

SEQ ID NO: 815957 - RNA, 22 nt, Human
ugaacucucucaagugacagaa

SEQ ID NO: 815958 - RNA, 22 nt, Human
uuuauucaucaucuguucauau

SEQ ID NO: 815959 - RNA, 22 nt, Human
uucaacuagauuuauacaauuc

SEQ ID NO: 815960 - RNA, 20 nt, Human
aggaggcauagucuggaaag

SEQ ID NO: 815961 - RNA, 22 nt, Human
gauggcaggugauagccgaguc

SEQ ID NO: 815962 - RNA, 22 nt, Human
caagauggacauaaggagagaa

SEQ ID NO: 815963 - RNA, 22 nt, Human
uuuucaguuccaucucugcucu

SEQ ID NO: 815964 - RNA, 22 nt, Human
uccaggaggcucugguugacgu

SEQ ID NO: 815965 - RNA, 22 nt, Human
cuucucagcauuuugucagucu

SEQ ID NO: 815966 - RNA, 22 nt, Human
agaccaagugcaggugccacua

SEQ ID NO: 815967 - RNA, 22 nt, Human
augaaacacacacgcgcauacu

SEQ ID NO: 815968 - RNA, 22 nt, Human
acccaggacucucuuccaguag

SEQ ID NO: 815969 - RNA, 22 nt, Human
caguuucuuggaugccaauuuc

SEQ ID NO: 815970 - RNA, 22 nt, Human
ccaggagacuguacugauauuu

SEQ ID NO: 815971 - RNA, 20 nt, Human
cuucuucagccuaugcuuca

SEQ ID NO: 815972 - RNA, 22 nt, Human
gcccaggauucuuucuuccuua

SEQ ID NO: 815973 - RNA, 22 nt, Human
agcuggcagucauccuagugag

SEQ ID NO: 815974 - RNA, 22 nt, Human
uaagcugugggagauuggcaua

SEQ ID NO: 815975 - RNA, 22 nt, Human
aguggacucuucccagugcuug

SEQ ID NO: 815976 - RNA, 22 nt, Human
augaaggcaguuaaacgucauc

SEQ ID NO: 815977 - RNA, 19 nt, Human
aaggcagcaguagcaucca

SEQ ID NO: 815978 - RNA, 22 nt, Human
gcaggagacuggcugugguagu

SEQ ID NO: 815979 - RNA, 22 nt, Human
aauagcucacugauuucucuuu

SEQ ID NO: 815980 - RNA, 22 nt, Human
ucuuagcacagcuauauaaguu

SEQ ID NO: 815981 - RNA, 22 nt, Human
cauaauauacuacauugaugaa

SEQ ID NO: 815982 - RNA, 22 nt, Human
gaggcaguguuuacugcccugu

SEQ ID NO: 815983 - RNA, 22 nt, Human
ggauggcagucugcaugagaaa

SEQ ID NO: 815984 - RNA, 22 nt, Human
caaggccauaagagauacaaaa

SEQ ID NO: 815985 - RNA, 17 nt, Human
gccaggagguuugagcu

SEQ ID NO: 815986 - RNA, 22 nt, Human
gaaauauuguacuggagauguu

SEQ ID NO: 815987 - RNA, 22 nt, Human
uugauuucuauucagauguaga

SEQ ID NO: 815988 - RNA, 22 nt, Human
ccauggcaauggucagucuauu

SEQ ID NO: 815989 - RNA, 22 nt, Human
uggcagcuauggucuaagggcc

SEQ ID NO: 815990 - RNA, 22 nt, Human
aaucuuucccuauuaaaugugg

SEQ ID NO: 815991 - RNA, 22 nt, Human
aggaugagaagauuggaaucuu

SEQ ID NO: 815992 - RNA, 22 nt, Human
agacaguguguguauauauggu

SEQ ID NO: 815993 - RNA, 22 nt, Human
auucugaguccaugggggcagg

SEQ ID NO: 815994 - RNA, 22 nt, Human
gcugaaugaauguauuuuaaaa

SEQ ID NO: 815995 - RNA, 22 nt, Human
uccaugucuucaugugucuaac

SEQ ID NO: 815996 - RNA, 22 nt, Human
guuauauauaguauuucucuga

SEQ ID NO: 815997 - RNA, 19 nt, Human
gcagcugcuugaaaagaaa

SEQ ID NO: 815998 - RNA, 22 nt, Human
aggagaggguggcauuaaguuu

SEQ ID NO: 815999 - RNA, 22 nt, Human
ggcagcacugcagcuuguuggg

SEQ ID NO: 816000 - RNA, 22 nt, Human
aggcagacugugcgggaagagu

SEQ ID NO: 816001 - RNA, 22 nt, Human
gugcagcugugguggagccagg

SEQ ID NO: 816002 - RNA, 22 nt, Human
guugaaagcuuuucauuuaguu

SEQ ID NO: 816003 - RNA, 23 nt, Human
uucauuugucuacuucacuuguu

SEQ ID NO: 816004 - RNA, 22 nt, Human
aggcagauuacuugaggccagg

SEQ ID NO: 816005 - RNA, 22 nt, Human
ucugagaggcaucugcacuucu

SEQ ID NO: 816006 - RNA, 22 nt, Human
ucagucucuggggcuucuguuu

SEQ ID NO: 816007 - RNA, 22 nt, Human
guuuucaaggggauuuaacuga

SEQ ID NO: 816008 - RNA, 22 nt, Human
caggcagcuagauuuauaacaa

SEQ ID NO: 816009 - RNA, 20 nt, Human
ucacaucuggcagcugauga

SEQ ID NO: 816010 - RNA, 22 nt, Human
agcaccauugcaaauauggcag

SEQ ID NO: 816011 - RNA, 22 nt, Human
uucuacagacuauaacugugau

SEQ ID NO: 816012 - RNA, 22 nt, Human
gaggucaggcuugcagcagggu

SEQ ID NO: 816013 - RNA, 22 nt, Human
uuuuaucuaccuaugcucauuu

SEQ ID NO: 816014 - RNA, 22 nt, Human
cugcugugaguuuggaggucua

SEQ ID NO: 816015 - RNA, 22 nt, Human
caaggccaugagcagcgagugu

SEQ ID NO: 816016 - RNA, 23 nt, Human
uugaaagguagcuggcagcuaga

SEQ ID NO: 816017 - RNA, 22 nt, Human
uucacagacauugcagacugaa

SEQ ID NO: 816018 - RNA, 22 nt, Human
ugcuucugggcaaaugugugug

SEQ ID NO: 816019 - RNA, 22 nt, Human
uuugaaagacagaauauuuuug

SEQ ID NO: 816020 - RNA, 19 nt, Human
ggcaggcuggauagagagg

SEQ ID NO: 816021 - RNA, 22 nt, Human
agggggugcccagaugaaggau

SEQ ID NO: 816022 - RNA, 22 nt, Human
ucucuucuaauuaggguccaug

SEQ ID NO: 816023 - RNA, 18 nt, Human
ucauuuguuuugcaugaa

SEQ ID NO: 816024 - RNA, 23 nt, Human
gugcugugagccccuuggccucc

SEQ ID NO: 816025 - RNA, 22 nt, Human
ggaggugggcuaaggacucucu

SEQ ID NO: 816026 - RNA, 19 nt, Human
uuacuuggcaaagucaguc

SEQ ID NO: 816027 - RNA, 22 nt, Human
uugcagcuucuaccacuguuuc

SEQ ID NO: 816028 - RNA, 22 nt, Human
aggcagccaucugcaggaagga

SEQ ID NO: 816029 - RNA, 23 nt, Human
uggagcugacagucagagggagg

SEQ ID NO: 816030 - RNA, 22 nt, Human
gccaggagcaugucauuguuga

SEQ ID NO: 816031 - RNA, 22 nt, Human
ucucucuuuuuaaucauguaau

SEQ ID NO: 816032 - RNA, 22 nt, Human
gccaggagggaaaggacaauuu

SEQ ID NO: 816033 - RNA, 22 nt, Human
uacuuuuuagcacagugugugc

SEQ ID NO: 816034 - RNA, 22 nt, Human
gacagcugugcaggagaagggg

SEQ ID NO: 816035 - RNA, 22 nt, Human
auucuucauuguugauucaugu

SEQ ID NO: 816036 - RNA, 22 nt, Human
cauuuguagcuauuuacuguau

SEQ ID NO: 816037 - RNA, 22 nt, Human
ucauuuguugaacuuuagugcg

SEQ ID NO: 816038 - RNA, 22 nt, Human
ggaggcaggaaagacagguuca

SEQ ID NO: 816039 - RNA, 22 nt, Human
uucugaaagccaauucauugaa

SEQ ID NO: 816040 - RNA, 22 nt, Human
aucaggaucacugggagucuug

SEQ ID NO: 816041 - RNA, 22 nt, Human
ggcagcucugcuccacaugagu

SEQ ID NO: 816042 - RNA, 22 nt, Human
cauuguuaauugguaucuuaca

SEQ ID NO: 816043 - RNA, 22 nt, Human
uucagggagagcgggacgggug

SEQ ID NO: 816044 - RNA, 22 nt, Human
ugcuugaaagggguuucccagu

SEQ ID NO: 816045 - RNA, 22 nt, Human
caggauggucuucauuuggcuc

SEQ ID NO: 816046 - RNA, 22 nt, Human
aaggaaccauuugugugcaugg

SEQ ID NO: 816047 - RNA, 22 nt, Human
ugcaggaaucagaggggaagcg

SEQ ID NO: 816048 - RNA, 22 nt, Human
gcauugaguccacucugucuuu

SEQ ID NO: 816049 - RNA, 22 nt, Human
uucagugucaauuuuuaaauau

SEQ ID NO: 816050 - RNA, 22 nt, Human
ugcucccagggacucuggcugg

SEQ ID NO: 816051 - RNA, 22 nt, Human
aagggaggccagagguuuugca

SEQ ID NO: 816052 - RNA, 20 nt, Human
cugcccagccacugagggau

SEQ ID NO: 816053 - RNA, 22 nt, Human
uuccaugaaggagacugagaag

SEQ ID NO: 816054 - RNA, 22 nt, Human
uccaggagagguagaggguucc

SEQ ID NO: 816055 - RNA, 22 nt, Human
uuucccagagguaugaauaagu

SEQ ID NO: 816056 - RNA, 22 nt, Human
uugcaaaggggaauaaagcaau

SEQ ID NO: 816057 - RNA, 22 nt, Human
caaguaaacaauaugugauuca

SEQ ID NO: 816058 - RNA, 22 nt, Human
cccaggaaugaggggcggaggc

SEQ ID NO: 816059 - RNA, 22 nt, Human
ccaggauggggagcagauagaa

SEQ ID NO: 816060 - RNA, 22 nt, Human
ucugggaacacacgucacuuca

SEQ ID NO: 816061 - RNA, 22 nt, Human
augaggcaaucaugguccaguu

SEQ ID NO: 816062 - RNA, 22 nt, Human
gauuuuauauggcauacugugg

SEQ ID NO: 816063 - RNA, 22 nt, Human
uguucauuuggcccuuuuguau

SEQ ID NO: 816064 - RNA, 22 nt, Human
agauggagaccuuggaugaacu

SEQ ID NO: 816065 - RNA, 22 nt, Human
acagcauugcuccaucucaaga

SEQ ID NO: 816066 - RNA, 22 nt, Human
ccaggcugccgaggaaagaaag

SEQ ID NO: 816067 - RNA, 18 nt, Human
agggaguuuuagggaagg

SEQ ID NO: 816068 - RNA, 22 nt, Human
acuguagcugccacuggaugca

SEQ ID NO: 816069 - RNA, 22 nt, Human
cuuaaagaaauugaggagagga

SEQ ID NO: 816070 - RNA, 22 nt, Human
auugaaagagaauguagcucuu

SEQ ID NO: 816071 - RNA, 22 nt, Human
aggcuagcaaugggagaugagu

SEQ ID NO: 816072 - RNA, 17 nt, Human
agcugaccagauggacu

SEQ ID NO: 816073 - RNA, 22 nt, Human
cccaggagaauauuuuuggguc

SEQ ID NO: 816074 - RNA, 22 nt, Human
guugacagcuggugagcugcua

SEQ ID NO: 816075 - RNA, 19 nt, Human
cucucacucgccacauccu

SEQ ID NO: 816076 - RNA, 22 nt, Human
agucucuuauucccuauugcug

SEQ ID NO: 816077 - RNA, 22 nt, Human
ggcagaggaggggugaauuugc

SEQ ID NO: 816078 - RNA, 22 nt, Human
cccaggaaaucaggcuuucuag

SEQ ID NO: 816079 - RNA, 22 nt, Human
uuucacagguacaaacacuccu

SEQ ID NO: 816080 - RNA, 22 nt, Human
cagaggaugaucuggccucucu

SEQ ID NO: 816081 - RNA, 22 nt, Human
gagggagggacuagcauucucu

SEQ ID NO: 816082 - RNA, 23 nt, Human
auguuauuauuagcagucuugcc

SEQ ID NO: 816083 - RNA, 22 nt, Human
cacaugaguccugccagguaug

SEQ ID NO: 816084 - RNA, 20 nt, Human
gggcaguucaaugccacucu

SEQ ID NO: 816085 - RNA, 19 nt, Human
uaucuguuuccugcuuguc

SEQ ID NO: 816086 - RNA, 22 nt, Human
cagacaggcaggugcugcuuug

SEQ ID NO: 816087 - RNA, 22 nt, Human
aggcaggcccucuggaaaggua

SEQ ID NO: 816088 - RNA, 22 nt, Human
ggugagaggcagaggacagcuu

SEQ ID NO: 816089 - RNA, 22 nt, Human
gagaggaguuacuauuuccgag

SEQ ID NO: 816090 - RNA, 22 nt, Human
aggggaugauccucccgcagcg

SEQ ID NO: 816091 - RNA, 22 nt, Human
auguuucaccaguuuuauaaga

SEQ ID NO: 816092 - RNA, 22 nt, Human
aauauccacacugugucccugc

SEQ ID NO: 816093 - RNA, 23 nt, Human
uccaggagaauuccagggcccgg

SEQ ID NO: 816094 - RNA, 22 nt, Human
gucaggauuggggucaugaguc

SEQ ID NO: 816095 - RNA, 22 nt, Human
uucaggaugcagagguuguagu

SEQ ID NO: 816096 - RNA, 22 nt, Human
accaggaguagaauaucuguga

SEQ ID NO: 816097 - RNA, 22 nt, Human
aaacaugaauagauauuaaaca

SEQ ID NO: 816098 - RNA, 21 nt, Human
ucacagacuggucagugaggc

SEQ ID NO: 816099 - RNA, 22 nt, Human
acccaggagagagcuauaaaau

SEQ ID NO: 816100 - RNA, 22 nt, Human
uuccucagcuggccugauuggg

SEQ ID NO: 816101 - RNA, 22 nt, Human
agugcuuuagcauccaacuguc

SEQ ID NO: 816102 - RNA, 22 nt, Human
gggcagcucuggcugugggaag

SEQ ID NO: 816103 - RNA, 22 nt, Human
gaggcagcaggcugaggaggau

SEQ ID NO: 816104 - RNA, 22 nt, Human
ucuucagacuccaaauguuuua

SEQ ID NO: 816105 - RNA, 22 nt, Human
acagucuugagcaucagccaga

SEQ ID NO: 816106 - RNA, 19 nt, Human
aguggcagaucuggaagua

SEQ ID NO: 816107 - RNA, 22 nt, Human
auuggcagaaacagcagggcca

SEQ ID NO: 816108 - RNA, 22 nt, Human
auguuuccgugagcauccuuga

SEQ ID NO: 816109 - RNA, 22 nt, Human
ugaggcaguucuuacuuguauu

SEQ ID NO: 816110 - RNA, 22 nt, Human
acagugcuaaacacuucuugaa

SEQ ID NO: 816111 - RNA, 22 nt, Human
cucagaauuuagggcucugagg

SEQ ID NO: 816112 - RNA, 22 nt, Human
cucagagaggcaguggaaguca

SEQ ID NO: 816113 - RNA, 22 nt, Human
caggcagcugcuggguucagcc

SEQ ID NO: 816114 - RNA, 22 nt, Human
acacaaguucuaaagauugcgc

SEQ ID NO: 816115 - RNA, 22 nt, Human
uguccucuuccagugcuccuuc

SEQ ID NO: 816116 - RNA, 16 nt, Human
ccccaggacuuggcac

SEQ ID NO: 816117 - RNA, 22 nt, Human
aggaaaacacaguauugaugga

SEQ ID NO: 816118 - RNA, 20 nt, Human
aagggcagagggaacagacu

SEQ ID NO: 816119 - RNA, 22 nt, Human
agaggccaggcugcagagggau

SEQ ID NO: 816120 - RNA, 22 nt, Human
uccauuuucuaaguaucacuua

SEQ ID NO: 816121 - RNA, 22 nt, Human
aucacugucgucaucugagauu

SEQ ID NO: 816122 - RNA, 22 nt, Human
ccucaggaaaugaauaaauggc

SEQ ID NO: 816123 - RNA, 22 nt, Human
cuugaaagauuuggccucugug

SEQ ID NO: 816124 - RNA, 20 nt, Human
augcuuucuugugugcugcu

SEQ ID NO: 816125 - RNA, 22 nt, Human
ccaugagccaggcugaggaagc

SEQ ID NO: 816126 - RNA, 22 nt, Human
agagugcaaccgaaacaagcag

SEQ ID NO: 816127 - RNA, 21 nt, Human
agcagaggggacauguuugau

SEQ ID NO: 816128 - RNA, 22 nt, Human
cuucucagaggccagaagcuau

SEQ ID NO: 816129 - RNA, 22 nt, Human
cagcugccugucuggaggcaau

SEQ ID NO: 816130 - RNA, 22 nt, Human
ucaggaauccagacagggcaca

SEQ ID NO: 816131 - RNA, 22 nt, Human
ggcagcuaguuuaagaaagagg

SEQ ID NO: 816132 - RNA, 22 nt, Human
ucccaggacaggccacauggaa

SEQ ID NO: 816133 - RNA, 22 nt, Human
cuucuucauaggcaguccuguu

SEQ ID NO: 816134 - RNA, 22 nt, Human
cugcugugccuuaaaaugcaag

SEQ ID NO: 816135 - RNA, 22 nt, Human
agucaauucuuuucaacucaag

SEQ ID NO: 816136 - RNA, 22 nt, Human
uauuuccaggccccacucuaga

SEQ ID NO: 816137 - RNA, 22 nt, Human
cugcuucuccaaaguaggacuu

SEQ ID NO: 816138 - RNA, 22 nt, Human
cugucccuucauuauucacuac

SEQ ID NO: 816139 - RNA, 18 nt, Human
gucacuguguuucugagc

SEQ ID NO: 816140 - RNA, 22 nt, Human
caacugcugacaccaucacucc

SEQ ID NO: 816141 - RNA, 22 nt, Human
guuguuuugcaggauccuuaca

SEQ ID NO: 816142 - RNA, 22 nt, Human
gaccauuucuaggaaucagacu

SEQ ID NO: 816143 - RNA, 22 nt, Human
gucuucuuuucagucugcuugu

SEQ ID NO: 816144 - RNA, 22 nt, Human
agagugcagauaagagaauguu

SEQ ID NO: 816145 - RNA, 22 nt, Human
gggacgggcaguccaagggguc

SEQ ID NO: 816146 - RNA, 22 nt, Human
gcagcucccagcuugaaagguc

SEQ ID NO: 816147 - RNA, 22 nt, Human
gucuccugagccuugacugcaa

SEQ ID NO: 816148 - RNA, 22 nt, Human
agcccagguucuaaagccaaac

SEQ ID NO: 816149 - RNA, 22 nt, Human
gucacuguauccagguuccagc

SEQ ID NO: 816150 - RNA, 22 nt, Human
ggcaagaaggcuucagguagcu

SEQ ID NO: 816151 - RNA, 22 nt, Human
ucugucccugagagcucaggag

SEQ ID NO: 816152 - RNA, 22 nt, Human
auguuuccagguucuuccuaug

SEQ ID NO: 816153 - RNA, 22 nt, Human
auuauauaggacuugcccuucc

SEQ ID NO: 816154 - RNA, 22 nt, Human
gaagcagcagcuggggacaguu

SEQ ID NO: 816155 - RNA, 22 nt, Human
cagaccucaguccucaguagga

SEQ ID NO: 816156 - RNA, 21 nt, Human
ucucugguuggaguugugcca

SEQ ID NO: 816157 - RNA, 22 nt, Human
auucuuauuuaaauagagucug

SEQ ID NO: 816158 - RNA, 22 nt, Human
guucuucaucuuaaccaucugu

SEQ ID NO: 816159 - RNA, 22 nt, Human
gcugucccgcugacuuccagcu

SEQ ID NO: 816160 - RNA, 22 nt, Human
ucaggagggugacaggcccugg

SEQ ID NO: 816161 - RNA, 22 nt, Human
cuuuguagcugcuucugauuua

SEQ ID NO: 816162 - RNA, 22 nt, Human
aucauucuaguccuuauggucu

SEQ ID NO: 816163 - RNA, 22 nt, Human
aggagaggcaucaagaaaaucg

SEQ ID NO: 816164 - RNA, 22 nt, Human
ugcugugagguugagaaggaag

SEQ ID NO: 816165 - RNA, 22 nt, Human
agaggcaggaagagcugauuuu

SEQ ID NO: 816166 - RNA, 22 nt, Human
uauuuucuggacagucuugcuu

SEQ ID NO: 816167 - RNA, 22 nt, Human
aggucagcaggccaggggcgaa

SEQ ID NO: 816168 - RNA, 22 nt, Human
ggcagccuugagggaggccugg

SEQ ID NO: 816169 - RNA, 22 nt, Human
auacaacuuuacaugcaauucc

SEQ ID NO: 816170 - RNA, 22 nt, Human
accaggaguugggggugggacc

SEQ ID NO: 816171 - RNA, 22 nt, Human
gaggagagggcugcgggcccac

SEQ ID NO: 816172 - RNA, 22 nt, Human
ccucugcucugguccaugugcu

SEQ ID NO: 816173 - RNA, 21 nt, Human
gacaaagugaagcaggcagga

SEQ ID NO: 816174 - RNA, 22 nt, Human
uggagagguugaauaacuuguc

SEQ ID NO: 816175 - RNA, 22 nt, Human
cccaggaagaaauucugauuug

SEQ ID NO: 816176 - RNA, 22 nt, Human
cuugggaaugcuaacagaugac

SEQ ID NO: 816177 - RNA, 19 nt, Human
agcauuuggaauucuacac

SEQ ID NO: 816178 - RNA, 22 nt, Human
uucaggauaugugauaucugaa

SEQ ID NO: 816179 - RNA, 22 nt, Human
cucaggauucucgacacucaca

SEQ ID NO: 816180 - RNA, 22 nt, Human
agggagcugagcugugagcagc

SEQ ID NO: 816181 - RNA, 20 nt, Human
ucucagcauaagaacccuuc

SEQ ID NO: 816182 - RNA, 20 nt, Human
cagaggcaaggagacuugga

SEQ ID NO: 816183 - RNA, 22 nt, Human
uugauacaggcucuauuucauc

SEQ ID NO: 816184 - RNA, 22 nt, Human
cuggcugggagcgagcugcuca

SEQ ID NO: 816185 - RNA, 22 nt, Human
uuugaaagucaaccuuccaguu

SEQ ID NO: 816186 - RNA, 22 nt, Human
cuuaagauuugcgauaccuaau

SEQ ID NO: 816187 - RNA, 22 nt, Human
uuugaagugggcauuagaaccu

SEQ ID NO: 816188 - RNA, 22 nt, Human
caggagaggaggcuacuucuua

SEQ ID NO: 816189 - RNA, 22 nt, Human
ggaagagggaaccacgacugua

SEQ ID NO: 816190 - RNA, 20 nt, Human
ucauuucuugggguuccaag

SEQ ID NO: 816191 - RNA, 22 nt, Human
ugcuguguucuccugacucacc

SEQ ID NO: 816192 - RNA, 22 nt, Human
auuguauaacagcauguauuuu

SEQ ID NO: 816193 - RNA, 22 nt, Human
gcauguguggaggagaugugcu

SEQ ID NO: 816194 - RNA, 22 nt, Human
cccaggagaucuggaucucguc

SEQ ID NO: 816195 - RNA, 22 nt, Human
agucuucucauuucacaugcuu

SEQ ID NO: 816196 - RNA, 22 nt, Human
cuucuucaauagcaagcgcaua

SEQ ID NO: 816197 - RNA, 22 nt, Human
aaaggccaugguuggaguguuu

SEQ ID NO: 816198 - RNA, 22 nt, Human
agcugaaagugcuuugaggacu

SEQ ID NO: 816199 - RNA, 22 nt, Human
uugaaagucacaauggcauuaa

SEQ ID NO: 816200 - RNA, 22 nt, Human
aggaguggugcaggaccugcca

SEQ ID NO: 816201 - RNA, 22 nt, Human
ugucugugaccucuuaggcaag

SEQ ID NO: 816202 - RNA, 22 nt, Human
aagggaggaggauuuauuguac

SEQ ID NO: 816203 - RNA, 22 nt, Human
uuuguuuagaugguaaaucagu

SEQ ID NO: 816204 - RNA, 22 nt, Human
uaucuguuggcuccuaguugua

SEQ ID NO: 816205 - RNA, 22 nt, Human
accaggaggccuggagcacaaa

SEQ ID NO: 816206 - RNA, 22 nt, Human
ggagaggggcaaguuuaucuag

SEQ ID NO: 816207 - RNA, 19 nt, Human
gacagugcaguuguaguac

SEQ ID NO: 816208 - RNA, 22 nt, Human
augcagcugucagggagaacau

SEQ ID NO: 816209 - RNA, 22 nt, Human
uuccaugaagggcagccucuca

SEQ ID NO: 816210 - RNA, 22 nt, Human
ccaggaaauggcuugcuucuuu

SEQ ID NO: 816211 - RNA, 22 nt, Human
uuggcaggaauauugcagaggu

SEQ ID NO: 816212 - RNA, 22 nt, Human
aggcagacaaggucccuggucu

SEQ ID NO: 816213 - RNA, 22 nt, Human
cccaggagacauauagaaggac

SEQ ID NO: 816214 - RNA, 21 nt, Human
ucacaucuauguuaagcaaac

SEQ ID NO: 816215 - RNA, 22 nt, Human
aagcaccucuaugauugcuuuu

SEQ ID NO: 816216 - RNA, 22 nt, Human
cugccaggcgauggauuggcug

SEQ ID NO: 816217 - RNA, 22 nt, Human
acccaggaugauaauguucaca

SEQ ID NO: 816218 - RNA, 22 nt, Human
gguuauauaauucagugcuuuc

SEQ ID NO: 816219 - RNA, 22 nt, Human
cucaugauguagcgaaugagaa

SEQ ID NO: 816220 - RNA, 22 nt, Human
cagcucccgccaucgggaggca

SEQ ID NO: 816221 - RNA, 22 nt, Human
uacugccuggagcauuggugcu

SEQ ID NO: 816222 - RNA, 23 nt, Human
aggcagcagguuguccaggguga

SEQ ID NO: 816223 - RNA, 22 nt, Human
uauuuccaccuauuauuuucug

SEQ ID NO: 816224 - RNA, 22 nt, Human
gagaggggcccaagccacauag

SEQ ID NO: 816225 - RNA, 22 nt, Human
gaaauauugggacucagagcuu

SEQ ID NO: 816226 - RNA, 22 nt, Human
gcugcugugccuggcguccugu

SEQ ID NO: 816227 - RNA, 22 nt, Human
ggcagcuggguuggccagaaac

SEQ ID NO: 816228 - RNA, 22 nt, Human
uggcagcuguuaauguuuuguu

SEQ ID NO: 816229 - RNA, 23 nt, Human
uagggcagcugggagggacaugc

SEQ ID NO: 816230 - RNA, 22 nt, Human
ugucuuuggaauauuuagcuga

SEQ ID NO: 816231 - RNA, 22 nt, Human
ccuccuuuccuguuuuccugag

SEQ ID NO: 816232 - RNA, 22 nt, Human
aaucauaauuguauacauucau

SEQ ID NO: 816233 - RNA, 22 nt, Human
uggaggggcaauggagcgcgga

SEQ ID NO: 816234 - RNA, 22 nt, Human
gagggaauggugugcaagaggu

SEQ ID NO: 816235 - RNA, 22 nt, Human
auuuucaucauggguuuaacau

SEQ ID NO: 816236 - RNA, 22 nt, Human
caagauggaguccgggaaugug

SEQ ID NO: 816237 - RNA, 22 nt, Human
ggugagggaguggaacgaggug

SEQ ID NO: 816238 - RNA, 23 nt, Human
ugaguucucaucuuggcuucuau

SEQ ID NO: 816239 - RNA, 22 nt, Human
ucuuaaagagcgcaauuugagg

SEQ ID NO: 816240 - RNA, 22 nt, Human
uaugauuuguagacauuugauu

SEQ ID NO: 816241 - RNA, 22 nt, Human
cccaggagguggaguucacagu

SEQ ID NO: 816242 - RNA, 20 nt, Human
uggcaucucucaauuguagg

SEQ ID NO: 816243 - RNA, 22 nt, Human
agcccagggaaccaggaagugg

SEQ ID NO: 816244 - RNA, 23 nt, Human
uugcauagacauccucauagauu

SEQ ID NO: 816245 - RNA, 22 nt, Human
uggcagcuagcuguuuucaugc

SEQ ID NO: 816246 - RNA, 19 nt, Human
cuuugucagaacaugcuuc

SEQ ID NO: 816247 - RNA, 22 nt, Human
aggaaacuccccuacaucucaa

SEQ ID NO: 816248 - RNA, 22 nt, Human
uagggaugagccaguggguagu

SEQ ID NO: 816249 - RNA, 22 nt, Human
ucaauucaacacaugcacauug

SEQ ID NO: 816250 - RNA, 22 nt, Human
agugcuuugaacgaaaggcuga

SEQ ID NO: 816251 - RNA, 22 nt, Human
uuuccaagacuccaguucuccc

SEQ ID NO: 816252 - RNA, 22 nt, Human
acuucuucuucagcugggggau

SEQ ID NO: 816253 - RNA, 22 nt, Human
uagggauguggugagaacugag

SEQ ID NO: 816254 - RNA, 22 nt, Human
aggagacaucuaacuguagguu

SEQ ID NO: 816255 - RNA, 22 nt, Human
ucaggagacuggcagugcccac

SEQ ID NO: 816256 - RNA, 22 nt, Human
agcuucccaagguuggaagguu

SEQ ID NO: 816257 - RNA, 22 nt, Human
gaggcagcugaagcuucaaaga

SEQ ID NO: 816258 - RNA, 22 nt, Human
ccugcuguaaugugucuuuauu

SEQ ID NO: 816259 - RNA, 21 nt, Human
cgcagagcgaacuugcggcgc

SEQ ID NO: 816260 - RNA, 22 nt, Human
uccagccuaggggaacagcugc

SEQ ID NO: 816261 - RNA, 21 nt, Human
cccaggagaagaaaagaugca

SEQ ID NO: 816262 - RNA, 22 nt, Human
uucucagagugaccaagucuuu

SEQ ID NO: 816263 - RNA, 22 nt, Human
auauuucaugggguuccauacu

SEQ ID NO: 816264 - RNA, 22 nt, Human
gauuucuugauaaguaguguga

SEQ ID NO: 816265 - RNA, 22 nt, Human
uggcagcagccauggaaggccc

SEQ ID NO: 816266 - RNA, 22 nt, Human
uuucuucauagaccuugucuug

SEQ ID NO: 816267 - RNA, 22 nt, Human
agguccagcuguugcagccucc

SEQ ID NO: 816268 - RNA, 18 nt, Human
cauuguacaaugcuuuau

SEQ ID NO: 816269 - RNA, 22 nt, Human
auuuuacuuugugaauauugac

SEQ ID NO: 816270 - RNA, 22 nt, Human
aucauucuagcuguuguguuga

SEQ ID NO: 816271 - RNA, 22 nt, Human
gucaggaugcuauuguuauuaa

SEQ ID NO: 816272 - RNA, 22 nt, Human
cauucauuuaugaaauaucuau

SEQ ID NO: 816273 - RNA, 22 nt, Human
aguucuuuugugaacauaugcu

SEQ ID NO: 816274 - RNA, 22 nt, Human
cagucucucugaaguauuaaga

SEQ ID NO: 816275 - RNA, 22 nt, Human
agugcuuugguauagaacuauu

SEQ ID NO: 816276 - RNA, 22 nt, Human
uaucuguuguaguacagaugau

SEQ ID NO: 816277 - RNA, 20 nt, Human
uuucugugagaaacacuguu

SEQ ID NO: 816278 - RNA, 18 nt, Human
ggcagcuugacuagcaac

SEQ ID NO: 816279 - RNA, 22 nt, Human
gcccaggaguugguggcugcag

SEQ ID NO: 816280 - RNA, 22 nt, Human
gggcagcuggcuuauagguuug

SEQ ID NO: 816281 - RNA, 22 nt, Human
uugaagagugccuuccagacau

SEQ ID NO: 816282 - RNA, 20 nt, Human
caucaucacaugagccaauu

SEQ ID NO: 816283 - RNA, 22 nt, Human
augcugugguagacagcauucc

SEQ ID NO: 816284 - RNA, 22 nt, Human
cucaggaucgcuugcccuaggg

SEQ ID NO: 816285 - RNA, 22 nt, Human
uccccagggcugcagagggugu

SEQ ID NO: 816286 - RNA, 19 nt, Human
ucauuguugguuugucggg

SEQ ID NO: 816287 - RNA, 22 nt, Human
uauuuccagcaguaagaagaca

SEQ ID NO: 816288 - RNA, 22 nt, Human
caggcagcgcucguggccuggc

SEQ ID NO: 816289 - RNA, 22 nt, Human
gaaggucaccuccccucucugg

SEQ ID NO: 816290 - RNA, 22 nt, Human
gcuccuucaggugguagcuguu

SEQ ID NO: 816291 - RNA, 22 nt, Human
ucuacccagagcuaugaccuga

SEQ ID NO: 816292 - RNA, 19 nt, Human
uugaaagauuagcuuucua

SEQ ID NO: 816293 - RNA, 22 nt, Human
auuuggcaacauuaauugaauc

SEQ ID NO: 816294 - RNA, 22 nt, Human
aauguauuccucaugcaagagu

SEQ ID NO: 816295 - RNA, 22 nt, Human
uguccucagauaugucuacucu

SEQ ID NO: 816296 - RNA, 22 nt, Human
aggcagcauccagaggagaaug

SEQ ID NO: 816297 - RNA, 22 nt, Human
uuugaaaguccuaggagagucc

SEQ ID NO: 816298 - RNA, 22 nt, Human
uuuauuguuaucaugggugagu

SEQ ID NO: 816299 - RNA, 22 nt, Human
aggcagguccccuggaaggcac

SEQ ID NO: 816300 - RNA, 22 nt, Human
acacauauauacauauuugugc

SEQ ID NO: 816301 - RNA, 21 nt, Human
aaucauacaaaacaugucagg

SEQ ID NO: 816302 - RNA, 22 nt, Human
uuugacaucaauacccuagaau

SEQ ID NO: 816303 - RNA, 21 nt, Human
ggcagcucagcagauggggac

SEQ ID NO: 816304 - RNA, 22 nt, Human
ccaggagagcgcccucccggcc

SEQ ID NO: 816305 - RNA, 22 nt, Human
aagcagaguccccuucccaugg

SEQ ID NO: 816306 - RNA, 22 nt, Human
uuuuuguagucauuagaagagg

SEQ ID NO: 816307 - RNA, 22 nt, Human
agaggccagguccagaguuugu

SEQ ID NO: 816308 - RNA, 22 nt, Human
uccaggagguugagacugcagu

SEQ ID NO: 816309 - RNA, 22 nt, Human
uuugacaucuaagaauucuuac

SEQ ID NO: 816310 - RNA, 22 nt, Human
cucacugugccuuuucccaaac

SEQ ID NO: 816311 - RNA, 22 nt, Human
uggcagcuccuggggccagcac

SEQ ID NO: 816312 - RNA, 22 nt, Human
aaagauuauggcauugaaauac

SEQ ID NO: 816313 - RNA, 22 nt, Human
ucaaauaaugccauucaucauc

SEQ ID NO: 816314 - RNA, 22 nt, Human
auuacaguaacagcuacaaugc

SEQ ID NO: 816315 - RNA, 22 nt, Human
cagcuggcgggcagagccgcca

SEQ ID NO: 816316 - RNA, 22 nt, Human
ucaggaugaccacgagccucua

SEQ ID NO: 816317 - RNA, 22 nt, Human
auucugagacaauugccgucag

SEQ ID NO: 816318 - RNA, 22 nt, Human
uccaggagggauugggcugugg

SEQ ID NO: 816319 - RNA, 22 nt, Human
aauggccagcaacaggagugaa

SEQ ID NO: 816320 - RNA, 22 nt, Human
uagcuguguaagcuugguaaga

SEQ ID NO: 816321 - RNA, 22 nt, Human
acacaaugcauauuuuuccaga

SEQ ID NO: 816322 - RNA, 22 nt, Human
uuccaagaguaaauucaaauug

SEQ ID NO: 816323 - RNA, 22 nt, Human
gagugcagaugaacagaagauu

SEQ ID NO: 816324 - RNA, 22 nt, Human
ccaggagaugggaaaguagcag

SEQ ID NO: 816325 - RNA, 22 nt, Human
ugaaaugagcauuuauucuuua

SEQ ID NO: 816326 - RNA, 22 nt, Human
uagggaggcuacuucuuguagg

SEQ ID NO: 816327 - RNA, 22 nt, Human
ucaggaugagcucauaacuaug

SEQ ID NO: 816328 - RNA, 22 nt, Human
aagaggaggacgguucccagaa

SEQ ID NO: 816329 - RNA, 22 nt, Human
cuagggaguggcagagcuggga

SEQ ID NO: 816330 - RNA, 19 nt, Human
aaaaacuuaguccagaaag

SEQ ID NO: 816331 - RNA, 21 nt, Human
ggagggcagcccagacuggcu

SEQ ID NO: 816332 - RNA, 20 nt, Human
uccaggagaacugggagccg

SEQ ID NO: 816333 - RNA, 22 nt, Human
aaggagaguacaggaguuggua

SEQ ID NO: 816334 - RNA, 22 nt, Human
caucaucaaaacaaauggaguc

SEQ ID NO: 816335 - RNA, 22 nt, Human
gcuucccacagcuggacugggg

SEQ ID NO: 816336 - RNA, 22 nt, Human
ugccuggaaggcccaugggaag

SEQ ID NO: 816337 - RNA, 22 nt, Human
guagccauuggcaaugaagccu

SEQ ID NO: 816338 - RNA, 22 nt, Human
ucacugcucuccaauguggagu

SEQ ID NO: 816339 - RNA, 22 nt, Human
agagggcaaguguaguccagua

SEQ ID NO: 816340 - RNA, 22 nt, Human
ccauccugcauugcuauucaga

SEQ ID NO: 816341 - RNA, 22 nt, Human
uaaauuauguuccauguccuuu

SEQ ID NO: 816342 - RNA, 22 nt, Human
cugcuguguuggcauuggauag

SEQ ID NO: 816343 - RNA, 22 nt, Human
agaaaugacacacaugagacau

SEQ ID NO: 816344 - RNA, 22 nt, Human
aggcagaugggagcuggaaguu

SEQ ID NO: 816345 - RNA, 22 nt, Human
ugugugucagagucuccauggu

SEQ ID NO: 816346 - RNA, 22 nt, Human
gcuuggcauugaccauuaucau

SEQ ID NO: 816347 - RNA, 22 nt, Human
ccagugcuucuuugcuagcugg

SEQ ID NO: 816348 - RNA, 19 nt, Human
ugaaauggcaguugcuaaa

SEQ ID NO: 816349 - RNA, 22 nt, Human
gagcaccucaauuugcuauuug

SEQ ID NO: 816350 - RNA, 22 nt, Human
uggcagcugaggggaggcuuug

SEQ ID NO: 816351 - RNA, 20 nt, Human
uuucuugucggcuguugcug

SEQ ID NO: 816352 - RNA, 22 nt, Human
uuugcaaauaccaugaaacuug

SEQ ID NO: 816353 - RNA, 22 nt, Human
aucugccucuucuucauugcga

SEQ ID NO: 816354 - RNA, 22 nt, Human
cccaggaggacauuccauaccc

SEQ ID NO: 816355 - RNA, 22 nt, Human
ucacaucucccuggaggacaca

SEQ ID NO: 816356 - RNA, 20 nt, Human
aggcaguuagaaggagauga

SEQ ID NO: 816357 - RNA, 22 nt, Human
ucauuuguacuugugugcuugu

SEQ ID NO: 816358 - RNA, 22 nt, Human
ucuucauuccguagauauuuau

SEQ ID NO: 816359 - RNA, 22 nt, Human
uugauguacagaauuguucaca

SEQ ID NO: 816360 - RNA, 22 nt, Human
aaaaacugcaauuacuuuuguc

SEQ ID NO: 816361 - RNA, 22 nt, Human
uuucugcugugcuuucuugcgu

SEQ ID NO: 816362 - RNA, 22 nt, Human
uccaggagugugugcuaauggg

SEQ ID NO: 816363 - RNA, 22 nt, Human
gaaaggccauuucugaggguuu

SEQ ID NO: 816364 - RNA, 20 nt, Human
gaugggaaucggagcuggua

SEQ ID NO: 816365 - RNA, 22 nt, Human
auuucagguaccugugggaucc

SEQ ID NO: 816366 - RNA, 22 nt, Human
augauguuauuuucagaaacau

SEQ ID NO: 816367 - RNA, 19 nt, Human
uggcaggcccaggauggac

SEQ ID NO: 816368 - RNA, 22 nt, Human
aucugccugagucuagguuuuc

SEQ ID NO: 816369 - RNA, 22 nt, Human
gcuggcagggacagcugcgugu

SEQ ID NO: 816370 - RNA, 22 nt, Human
agaccuggauuccaauccuacc

SEQ ID NO: 816371 - RNA, 22 nt, Human
ucuacugcacuggugucucauc

SEQ ID NO: 816372 - RNA, 17 nt, Human
cccaugagcccacuccc

SEQ ID NO: 816373 - RNA, 22 nt, Human
cuuguccccagcagguugguuu

SEQ ID NO: 816374 - RNA, 17 nt, Human
ucccaggaacagggaau

SEQ ID NO: 816375 - RNA, 22 nt, Human
agcccaggugagggguucgaaa

SEQ ID NO: 816376 - RNA, 23 nt, Human
ugaaggccuggaggacgcguugu

SEQ ID NO: 816377 - RNA, 22 nt, Human
gagagggagccagccaggaacc

SEQ ID NO: 816378 - RNA, 22 nt, Human
uuagagucaagcugcauguucu

SEQ ID NO: 816379 - RNA, 22 nt, Human
ggauggcauguugggcucuguu

SEQ ID NO: 816380 - RNA, 22 nt, Human
uaggcagcugcaaacuucgguc

SEQ ID NO: 816381 - RNA, 22 nt, Human
aaggcagcucagcucauggcag

SEQ ID NO: 816382 - RNA, 20 nt, Human
aucuucuuggccagcuugcu

SEQ ID NO: 816383 - RNA, 22 nt, Human
agucauaugacccuucacaaac

SEQ ID NO: 816384 - RNA, 22 nt, Human
cccaggaguucgaggcuguagu

SEQ ID NO: 816385 - RNA, 22 nt, Human
gucaggauuugaacucaggucu

SEQ ID NO: 816386 - RNA, 22 nt, Human
gaaggccaguuuugagauaggu

SEQ ID NO: 816387 - RNA, 22 nt, Human
ugaggggauacgguacacauug

SEQ ID NO: 816388 - RNA, 22 nt, Human
guccaugauucuguguaguaga

SEQ ID NO: 816389 - RNA, 19 nt, Human
ugaguucugugguucucaa

SEQ ID NO: 816390 - RNA, 19 nt, Human
uucuccagccugaccugag

SEQ ID NO: 816391 - RNA, 21 nt, Human
aggcaucuaaagagaguagac

SEQ ID NO: 816392 - RNA, 22 nt, Human
agucucagaaaagaagcaugga

SEQ ID NO: 816393 - RNA, 22 nt, Human
gaggccagcuaguccaggaagu

SEQ ID NO: 816394 - RNA, 22 nt, Human
gaggaaccaaaucagcuugcac

SEQ ID NO: 816395 - RNA, 19 nt, Human
agcagcuggagguggagug

SEQ ID NO: 816396 - RNA, 22 nt, Human
uuuaaauuauaguuaaugucug

SEQ ID NO: 816397 - RNA, 22 nt, Human
agaaggggagaagcuaccagga

SEQ ID NO: 816398 - RNA, 22 nt, Human
ugaggggagcuagcaugccuug

SEQ ID NO: 816399 - RNA, 22 nt, Human
uucuuaacuggaaaaugucaga

SEQ ID NO: 816400 - RNA, 22 nt, Human
ugagggagagggcgaaaaugaa

SEQ ID NO: 816401 - RNA, 22 nt, Human
cagagggaaaaggggaguaaua

SEQ ID NO: 816402 - RNA, 22 nt, Human
agcagagguuuguuggaaaccu

SEQ ID NO: 816403 - RNA, 22 nt, Human
aguucucagcuuaguaugcugu

SEQ ID NO: 816404 - RNA, 22 nt, Human
ggcaggcugcuugggucauguc

SEQ ID NO: 816405 - RNA, 22 nt, Human
agccagcugugggcucaggcgg

SEQ ID NO: 816406 - RNA, 22 nt, Human
aagcagagcaagcguauuuauu

SEQ ID NO: 816407 - RNA, 19 nt, Human
ugaggggcucacagucuca

SEQ ID NO: 816408 - RNA, 22 nt, Human
cccuugcacauuugucuuuaau

SEQ ID NO: 816409 - RNA, 22 nt, Human
cuguggaaggccuguccugaaa

SEQ ID NO: 816410 - RNA, 22 nt, Human
ccaggagagcaaaggucacucu

SEQ ID NO: 816411 - RNA, 22 nt, Human
gugcauuugacgaauacucacu

SEQ ID NO: 816412 - RNA, 22 nt, Human
cccuggaggcaaagguugcagu

SEQ ID NO: 816413 - RNA, 22 nt, Human
uucucagaggagucgggagcug

SEQ ID NO: 816414 - RNA, 22 nt, Human
caggaugguggcaugaucagaa

SEQ ID NO: 816415 - RNA, 22 nt, Human
uuugaaagggaaauaaacuccu

SEQ ID NO: 816416 - RNA, 22 nt, Human
uucagcaagaccaccauguacc

SEQ ID NO: 816417 - RNA, 22 nt, Human
uucuucaaccaucuacauaaac

SEQ ID NO: 816418 - RNA, 22 nt, Human
uggcagcuccggguaggggcug

SEQ ID NO: 816419 - RNA, 22 nt, Human
ucucccaggcugcccuguggac

SEQ ID NO: 816420 - RNA, 22 nt, Human
uugaauaguguuuucaguauac

SEQ ID NO: 816421 - RNA, 23 nt, Human
cuuugccacccagagccugacag

SEQ ID NO: 816422 - RNA, 22 nt, Human
aaugcauauguaggcaagcagu

SEQ ID NO: 816423 - RNA, 22 nt, Human
ucaucuugcugccauugcuuua

SEQ ID NO: 816424 - RNA, 22 nt, Human
ucuccucuauuucuguauguau

SEQ ID NO: 816425 - RNA, 22 nt, Human
auuucccaugugaaucaauugg

SEQ ID NO: 816426 - RNA, 22 nt, Human
aaggccagcuuguagggcuggu

SEQ ID NO: 816427 - RNA, 22 nt, Human
auacaacuuuaucuguaaugag

SEQ ID NO: 816428 - RNA, 22 nt, Human
uccaggaggccucauuuccugu

SEQ ID NO: 816429 - RNA, 22 nt, Human
ucagguggcuuggagggggacg

SEQ ID NO: 816430 - RNA, 17 nt, Human
aagacagaagccaugag

SEQ ID NO: 816431 - RNA, 22 nt, Human
gcugcccagacauugaaucagg

SEQ ID NO: 816432 - RNA, 23 nt, Human
ccacagagcugccaauuccugug

SEQ ID NO: 816433 - RNA, 22 nt, Human
gaggcaucugggcacagaagug

SEQ ID NO: 816434 - RNA, 22 nt, Human
gcuccucuucucccacugaaug

SEQ ID NO: 816435 - RNA, 22 nt, Human
uagggaugacgaaaggacagag

SEQ ID NO: 816436 - RNA, 22 nt, Human
ucugcugugggucuauauuuua

SEQ ID NO: 816437 - RNA, 22 nt, Human
cccuuagcucaauuucuugccc

SEQ ID NO: 816438 - RNA, 17 nt, Human
uuugaaaggaugucagu

SEQ ID NO: 816439 - RNA, 22 nt, Human
cuguggaaaauuuguauguaau

SEQ ID NO: 816440 - RNA, 22 nt, Human
ugcuuuggccacuagaauucag

SEQ ID NO: 816441 - RNA, 22 nt, Human
uguguuauugccacugaagacc

SEQ ID NO: 816442 - RNA, 22 nt, Human
cuuagaaaugcagauucucagg

SEQ ID NO: 816443 - RNA, 22 nt, Human
gcugccagcuuuccuuggcuga

SEQ ID NO: 816444 - RNA, 18 nt, Human
uuugcaaaggaaguaugg

SEQ ID NO: 816445 - RNA, 22 nt, Human
cucaggauuuacuaauuucaag

SEQ ID NO: 816446 - RNA, 22 nt, Human
gcccaggauggagaauaguggu

SEQ ID NO: 816447 - RNA, 22 nt, Human
agccuuguuggucugaguuugg

SEQ ID NO: 816448 - RNA, 22 nt, Human
gaggagagccugcacuuugacc

SEQ ID NO: 816449 - RNA, 22 nt, Human
uugauuaaacaggcauauucaa

SEQ ID NO: 816450 - RNA, 22 nt, Human
uucucugaaggccaugcucacu

SEQ ID NO: 816451 - RNA, 22 nt, Human
ucacaguuauagucuguagaau

SEQ ID NO: 816452 - RNA, 21 nt, Human
ucaggagagcccaucuacaaa

SEQ ID NO: 816453 - RNA, 22 nt, Human
cucacuguccaacaggcuuuac

SEQ ID NO: 816454 - RNA, 22 nt, Human
agcgagggaggucugaggacag

SEQ ID NO: 816455 - RNA, 22 nt, Human
uuugaaugcaggacauacagaa

SEQ ID NO: 816456 - RNA, 22 nt, Human
aggagcagcuucugaaccaugu

SEQ ID NO: 816457 - RNA, 22 nt, Human
agcagcauuaugauauaucuua

SEQ ID NO: 816458 - RNA, 22 nt, Human
gacccaggguggucaccugaaa

SEQ ID NO: 816459 - RNA, 22 nt, Human
auaucacaguaguuguuuaguu

SEQ ID NO: 816460 - RNA, 18 nt, Human
ucuuuggacaacuacugg

SEQ ID NO: 816461 - RNA, 22 nt, Human
ugcugcuguuuccuacaucuca

SEQ ID NO: 816462 - RNA, 22 nt, Human
ccagguaggagagagggauccu

SEQ ID NO: 816463 - RNA, 22 nt, Human
uggcagagcaaaaagauagaau

SEQ ID NO: 816464 - RNA, 22 nt, Human
gaugagcauuguuucauguguu

SEQ ID NO: 816465 - RNA, 22 nt, Human
cuuaacagagagaaguguugcu

SEQ ID NO: 816466 - RNA, 22 nt, Human
ucacugcugcugccaugaugga

SEQ ID NO: 816467 - RNA, 22 nt, Human
ugcuugugagaguuuuuucaga

SEQ ID NO: 816468 - RNA, 20 nt, Human
caguccaaucagaggccacc

SEQ ID NO: 816469 - RNA, 22 nt, Human
uagggcagagcuuguacacgau

SEQ ID NO: 816470 - RNA, 22 nt, Human
ucucaggacuuugggaagcuca

SEQ ID NO: 816471 - RNA, 22 nt, Human
ccacagcugaccgcaggugagc

SEQ ID NO: 816472 - RNA, 22 nt, Human
ucucugaguaagugacaguuca

SEQ ID NO: 816473 - RNA, 22 nt, Human
cccaggagguuggggcuacagu

SEQ ID NO: 816474 - RNA, 20 nt, Human
gggugggagagucugagggu

SEQ ID NO: 816475 - RNA, 22 nt, Human
uaucaauacauguuaucagugu

SEQ ID NO: 816476 - RNA, 22 nt, Human
uugacacagaucaauauucaac

SEQ ID NO: 816477 - RNA, 22 nt, Human
uguuugaacugaauaacauagu

SEQ ID NO: 816478 - RNA, 22 nt, Human
gagagaaaugugcaguuugggc

SEQ ID NO: 816479 - RNA, 22 nt, Human
uuugcacuagcauuuguccaug

SEQ ID NO: 816480 - RNA, 20 nt, Human
ccagaagagaugaucaucca

SEQ ID NO: 816481 - RNA, 22 nt, Human
uugaaagugccaaguccuagug

SEQ ID NO: 816482 - RNA, 22 nt, Human
ucuucucuccugcuuggcagaa

SEQ ID NO: 816483 - RNA, 22 nt, Human
gcucacugccauucucuagaug

SEQ ID NO: 816484 - RNA, 22 nt, Human
gaccauuugcuaguaaauugca

SEQ ID NO: 816485 - RNA, 22 nt, Human
gucuuuaugguaugaaaacuga

SEQ ID NO: 816486 - RNA, 21 nt, Human
auacacauacacauaaaugug

SEQ ID NO: 816487 - RNA, 22 nt, Human
uaauaucuacuucauagaguuu

SEQ ID NO: 816488 - RNA, 22 nt, Human
uuuuucaagacaaccugcaugu

SEQ ID NO: 816489 - RNA, 22 nt, Human
uucuucuccgaggagggcuggu

SEQ ID NO: 816490 - RNA, 22 nt, Human
cagaguucaaagccugcuggga

SEQ ID NO: 816491 - RNA, 22 nt, Human
gauguuucaugcuagcaugugu

SEQ ID NO: 816492 - RNA, 22 nt, Human
ggcaggcugggugucauggagu

SEQ ID NO: 816493 - RNA, 22 nt, Human
aggcagcuuuguaguaaagcua

SEQ ID NO: 816494 - RNA, 21 nt, Human
auugaaagucaacaaucaguu

SEQ ID NO: 816495 - RNA, 22 nt, Human
agggcagcacaaggcauggacu

SEQ ID NO: 816496 - RNA, 22 nt, Human
acaaauaugguacucggagaaa

SEQ ID NO: 816497 - RNA, 22 nt, Human
uucucagagcucacuguaguaa

SEQ ID NO: 816498 - RNA, 22 nt, Human
acucaggaagaaagcagcuggu

SEQ ID NO: 816499 - RNA, 22 nt, Human
aggcaccuugcgguccagugaa

SEQ ID NO: 816500 - RNA, 22 nt, Human
cccaaggacacgggcagggaca

SEQ ID NO: 816501 - RNA, 22 nt, Human
aguuauuacucuuuaacauauu

SEQ ID NO: 816502 - RNA, 22 nt, Human
aggacagggauucaaacuccca

SEQ ID NO: 816503 - RNA, 19 nt, Human
ugugaaagcuaguguucuu

SEQ ID NO: 816504 - RNA, 22 nt, Human
ucauuuguucucauucucuacu

SEQ ID NO: 816505 - RNA, 22 nt, Human
uuugcagugauucuugcaguga

SEQ ID NO: 816506 - RNA, 22 nt, Human
acccaggaggcaagguugcagu

SEQ ID NO: 816507 - RNA, 22 nt, Human
caggguggcacaucacagcauu

SEQ ID NO: 816508 - RNA, 22 nt, Human
guccaugacugugacucacaug

SEQ ID NO: 816509 - RNA, 22 nt, Human
uccaggaggguuuucugccuuc

SEQ ID NO: 816510 - RNA, 22 nt, Human
ugaaggccagggauuugcagcc

SEQ ID NO: 816511 - RNA, 23 nt, Human
agaggggagcaucugcuggcuga

SEQ ID NO: 816512 - RNA, 22 nt, Human
uuuuagcacuaagugauaugcu

SEQ ID NO: 816513 - RNA, 22 nt, Human
uaugaacuuuugaugugacaug

SEQ ID NO: 816514 - RNA, 22 nt, Human
ccucacugcuauguguuugcuc

SEQ ID NO: 816515 - RNA, 21 nt, Human
aaugcauuaacauaaagcuga

SEQ ID NO: 816516 - RNA, 20 nt, Human
uuucaguuaucuugaccuuc

SEQ ID NO: 816517 - RNA, 22 nt, Human
cccuggaguccuggcaguugau

SEQ ID NO: 816518 - RNA, 21 nt, Human
uacagaaugcgcuucagucug

SEQ ID NO: 816519 - RNA, 18 nt, Human
uggcagcaggaagccauu

SEQ ID NO: 816520 - RNA, 22 nt, Human
gugauuuugagaccuauauagu

SEQ ID NO: 816521 - RNA, 22 nt, Human
uuucuucagagagagcuuuccc

SEQ ID NO: 816522 - RNA, 22 nt, Human
cucaggauuaaggaaucuaaau

SEQ ID NO: 816523 - RNA, 22 nt, Human
agcuacccgaggacaggcuaag

SEQ ID NO: 816524 - RNA, 22 nt, Human
agaggauguucuaggcacucau

SEQ ID NO: 816525 - RNA, 22 nt, Human
cucuucuugcuagacugagugc

SEQ ID NO: 816526 - RNA, 22 nt, Human
uuauucuucuucucuugccagg

SEQ ID NO: 816527 - RNA, 23 nt, Human
uccaugagaugugggcuucuagu

SEQ ID NO: 816528 - RNA, 22 nt, Human
ggaggcgauccugggaaacacc

SEQ ID NO: 816529 - RNA, 22 nt, Human
uucugaaccauugagcacugcc

SEQ ID NO: 816530 - RNA, 22 nt, Human
uaaaugagggcugacaugauug

SEQ ID NO: 816531 - RNA, 22 nt, Human
aggguaggaacugaguggaagg

SEQ ID NO: 816532 - RNA, 22 nt, Human
uuugcagucuggccugcuuugg

SEQ ID NO: 816533 - RNA, 22 nt, Human
gacagcuggcaguggaaaggug

SEQ ID NO: 816534 - RNA, 22 nt, Human
uucauucugcaguucucagcuc

SEQ ID NO: 816535 - RNA, 22 nt, Human
gggcaguugauggaggucugga

SEQ ID NO: 816536 - RNA, 22 nt, Human
uucuuaaaacuuauggacaggu

SEQ ID NO: 816537 - RNA, 22 nt, Human
ucaggaugguccuuuaugagaa

SEQ ID NO: 816538 - RNA, 22 nt, Human
uugcccagaguccacagcguac

SEQ ID NO: 816539 - RNA, 19 nt, Human
agucuuucccacucgucuu

SEQ ID NO: 816540 - RNA, 22 nt, Human
accaggaggccuugguucugag

SEQ ID NO: 816541 - RNA, 22 nt, Human
gucagagagggcacgugcacac

SEQ ID NO: 816542 - RNA, 22 nt, Human
cagcuggcuggucagugcacaa

SEQ ID NO: 816543 - RNA, 22 nt, Human
gggcagcugccagaggccaugg

SEQ ID NO: 816544 - RNA, 22 nt, Human
gucaggaugggcagccaaacua

SEQ ID NO: 816545 - RNA, 19 nt, Human
accaggaguaucagagcug

SEQ ID NO: 816546 - RNA, 22 nt, Human
uucuucuuuccuauaauuaauu

SEQ ID NO: 816547 - RNA, 22 nt, Human
aacaugauggggaagaacaaga

SEQ ID NO: 816548 - RNA, 22 nt, Human
uggcagcugucagaaugcaaau

SEQ ID NO: 816549 - RNA, 22 nt, Human
aagacaauuugauacuaguugc

SEQ ID NO: 816550 - RNA, 19 nt, Human
ccaggagagcuuggagaag

SEQ ID NO: 816551 - RNA, 22 nt, Human
cccaggagacugagcuguaacc

SEQ ID NO: 816552 - RNA, 22 nt, Human
uacccaggggcugagcagaggu

SEQ ID NO: 816553 - RNA, 22 nt, Human
cagcuucugcuaucgaacaucu

SEQ ID NO: 816554 - RNA, 22 nt, Human
aggcaggcacuccggaaguguc

SEQ ID NO: 816555 - RNA, 22 nt, Human
ucagagaguuagugucuuagcu

SEQ ID NO: 816556 - RNA, 22 nt, Human
agugcuuugugcucucacugca

SEQ ID NO: 816557 - RNA, 22 nt, Human
auucauaacggcaaaugucacc

SEQ ID NO: 816558 - RNA, 22 nt, Human
cccaggaaagagacugcugggu

SEQ ID NO: 816559 - RNA, 22 nt, Human
caaggccaaagggccacuguca

SEQ ID NO: 816560 - RNA, 19 nt, Human
ugcaagcuuuuucuuguua

SEQ ID NO: 816561 - RNA, 22 nt, Human
cccaucacagacacuggguuau

SEQ ID NO: 816562 - RNA, 16 nt, Human
auuuccagauuaugca

SEQ ID NO: 816563 - RNA, 22 nt, Human
uccaggagaccagauguaggcc

SEQ ID NO: 816564 - RNA, 23 nt, Human
uugcuuucaucaugagaugcucc

SEQ ID NO: 816565 - RNA, 22 nt, Human
aaaacaguuuaggcaucacagu

SEQ ID NO: 816566 - RNA, 22 nt, Human
caggcagccuucucgucucaca

SEQ ID NO: 816567 - RNA, 21 nt, Human
uccaggagcacgggacuagga

SEQ ID NO: 816568 - RNA, 22 nt, Human
agggauggaagacuugaagacc

SEQ ID NO: 816569 - RNA, 22 nt, Human
aggcagcuuuaacugguaguag

SEQ ID NO: 816570 - RNA, 22 nt, Human
agacaggcagaggcugcagagg

SEQ ID NO: 816571 - RNA, 22 nt, Human
auucacaaaaugauauagauac

SEQ ID NO: 816572 - RNA, 21 nt, Human
aggucagcccagcucuggaag

SEQ ID NO: 816573 - RNA, 22 nt, Human
cugccagucuaugcugcucggc

SEQ ID NO: 816574 - RNA, 22 nt, Human
uuauacauguguuuugagauga

SEQ ID NO: 816575 - RNA, 22 nt, Human
cagcuccucacgagucuugaaa

SEQ ID NO: 816576 - RNA, 22 nt, Human
cggcagcucgagggccacccgu

SEQ ID NO: 816577 - RNA, 22 nt, Human
uccaggaguccuggguggcccc

SEQ ID NO: 816578 - RNA, 22 nt, Human
ucuuuguaacugucuauugaga

SEQ ID NO: 816579 - RNA, 22 nt, Human
ugauuuuuagcuauucugaaga

SEQ ID NO: 816580 - RNA, 22 nt, Human
gagagcuguuuaucuucuucaa

SEQ ID NO: 816581 - RNA, 22 nt, Human
caaugugguggcagaugucagu

SEQ ID NO: 816582 - RNA, 22 nt, Human
gauaaugaugacaaugacaacc

SEQ ID NO: 816583 - RNA, 22 nt, Human
ucuuuccauggccacacagucu

SEQ ID NO: 816584 - RNA, 20 nt, Human
aguuauaguaucuagccaug

SEQ ID NO: 816585 - RNA, 19 nt, Human
uguguguuuauauauguau

SEQ ID NO: 816586 - RNA, 22 nt, Human
uuuguagaggguaauugacaga

SEQ ID NO: 816587 - RNA, 22 nt, Human
uugaaaguuaucuagauucuga

SEQ ID NO: 816588 - RNA, 22 nt, Human
uauuuguauguguguacauaua

SEQ ID NO: 816589 - RNA, 22 nt, Human
acugccauuggucaaaugagug

SEQ ID NO: 816590 - RNA, 22 nt, Human
aucuacccacugaacacaauau

SEQ ID NO: 816591 - RNA, 22 nt, Human
uuagccauggacugaauugacu

SEQ ID NO: 816592 - RNA, 22 nt, Human
uaacauuagguagacauaagcc

SEQ ID NO: 816593 - RNA, 22 nt, Human
aguggcaguagaugagcugguu

SEQ ID NO: 816594 - RNA, 22 nt, Human
caggauagaaaggccauggagu

SEQ ID NO: 816595 - RNA, 22 nt, Human
uacccagggcuuuucugaugca

SEQ ID NO: 816596 - RNA, 22 nt, Human
gaaggccauuagagccugugcc

SEQ ID NO: 816597 - RNA, 23 nt, Human
gggcaguuauguuguccuuggcu

SEQ ID NO: 816598 - RNA, 22 nt, Human
uagcuaucuguguccagaucca

SEQ ID NO: 816599 - RNA, 22 nt, Human
uaaugucagcauaguuuauuuu

SEQ ID NO: 816600 - RNA, 22 nt, Human
aauaugcauuaacuguguacau

SEQ ID NO: 816601 - RNA, 20 nt, Human
cagaggcauuuucagacucu

SEQ ID NO: 816602 - RNA, 22 nt, Human
cagacagggaccucgcuccaga

SEQ ID NO: 816603 - RNA, 22 nt, Human
auugcuguaaauuaucuuauua

SEQ ID NO: 816604 - RNA, 19 nt, Human
ggcagcuggacgcuguuca

SEQ ID NO: 816605 - RNA, 22 nt, Human
cuaaucaucuuucucuuaaagc

SEQ ID NO: 816606 - RNA, 22 nt, Human
uacuuccuguuuccaugucugu

SEQ ID NO: 816607 - RNA, 20 nt, Human
ggggcugcaugcagagaaga

SEQ ID NO: 816608 - RNA, 22 nt, Human
acucaggaaaaauguagugaua

SEQ ID NO: 816609 - RNA, 22 nt, Human
caggaaagggaugggcugccac

SEQ ID NO: 816610 - RNA, 22 nt, Human
aggguggcugaguagauggaag

SEQ ID NO: 816611 - RNA, 22 nt, Human
uucuccaacacaagcaugaugu

SEQ ID NO: 816612 - RNA, 22 nt, Human
aauaucagcacuuuugugguau

SEQ ID NO: 816613 - RNA, 22 nt, Human
gccaggagugucccacucauuu

SEQ ID NO: 816614 - RNA, 21 nt, Human
cucaaagaccaaaaguguaga

SEQ ID NO: 816615 - RNA, 22 nt, Human
uucucagguagugcugaugcug

SEQ ID NO: 816616 - RNA, 22 nt, Human
cugcugugcagacagacucucu

SEQ ID NO: 816617 - RNA, 22 nt, Human
uaaauuaugucacaugacucug

SEQ ID NO: 816618 - RNA, 20 nt, Human
cccagguaggugccaugagu

SEQ ID NO: 816619 - RNA, 21 nt, Human
uuagaaagcucacuacaguua

SEQ ID NO: 816620 - RNA, 17 nt, Human
gcgcagcuccuggcgcg

SEQ ID NO: 816621 - RNA, 22 nt, Human
cugcuguggccagccaggucaa

SEQ ID NO: 816622 - RNA, 22 nt, Human
aaagccaugggucuuuggcaua

SEQ ID NO: 816623 - RNA, 22 nt, Human
ugcugaaauuagaacauugagg

SEQ ID NO: 816624 - RNA, 22 nt, Human
uucaugugaauauauuugucuu

SEQ ID NO: 816625 - RNA, 22 nt, Human
cccaggaggugugcccaacucg

SEQ ID NO: 816626 - RNA, 22 nt, Human
uuugaaaguucuucugacacua

SEQ ID NO: 816627 - RNA, 22 nt, Human
agaggagugggaagcagugcaa

SEQ ID NO: 816628 - RNA, 22 nt, Human
caggaugagaagggcucuuacg

SEQ ID NO: 816629 - RNA, 23 nt, Human
cuugcagggcuggaggcuuagaa

SEQ ID NO: 816630 - RNA, 22 nt, Human
aacaugcucuguuucuuggaug

SEQ ID NO: 816631 - RNA, 22 nt, Human
uguacauagaucuugaaaauua

SEQ ID NO: 816632 - RNA, 22 nt, Human
uauguguuugacacccugcaag

SEQ ID NO: 816633 - RNA, 22 nt, Human
ggcucagacucccaggcccucu

SEQ ID NO: 816634 - RNA, 22 nt, Human
uugcaauagccuuauuuccaaa

SEQ ID NO: 816635 - RNA, 21 nt, Human
ugaggcaggggugcuuuuguc

SEQ ID NO: 816636 - RNA, 22 nt, Human
guucuucagauuccauuucagu

SEQ ID NO: 816637 - RNA, 22 nt, Human
augugaggcagcacggagauua

SEQ ID NO: 816638 - RNA, 22 nt, Human
agaggaggaagagcuuuaaaau

SEQ ID NO: 816639 - RNA, 22 nt, Human
aucugcuugaaugagcaacagg

SEQ ID NO: 816640 - RNA, 22 nt, Human
aggguggcuggaggaaucagaa

SEQ ID NO: 816641 - RNA, 22 nt, Human
cuucucagucaccugugagucu

SEQ ID NO: 816642 - RNA, 22 nt, Human
auugaaagguuuugagcagaua

SEQ ID NO: 816643 - RNA, 22 nt, Human
auucuucacauggauaggaucu

SEQ ID NO: 816644 - RNA, 22 nt, Human
ugcuggguuaccuaagccuaaa

SEQ ID NO: 816645 - RNA, 22 nt, Human
ugcugcuguauccuuaguguca

SEQ ID NO: 816646 - RNA, 23 nt, Human
acuuuauugaccccaggucaguu

SEQ ID NO: 816647 - RNA, 22 nt, Human
acaaauauuuacugaauccacu

SEQ ID NO: 816648 - RNA, 22 nt, Human
agacccagaaagcagcugcauu

SEQ ID NO: 816649 - RNA, 22 nt, Human
uuuucauuguuccucgagcauu

SEQ ID NO: 816650 - RNA, 22 nt, Human
uaaggccagcaugaaugcagca

SEQ ID NO: 816651 - RNA, 22 nt, Human
auaaaugauucagcaggaaaua

SEQ ID NO: 816652 - RNA, 22 nt, Human
auggcagccugagcagaggaau

SEQ ID NO: 816653 - RNA, 22 nt, Human
cuggcuguauuaguuugauccu

SEQ ID NO: 816654 - RNA, 20 nt, Human
agcuucuucugucuaauuuu

SEQ ID NO: 816655 - RNA, 22 nt, Human
guuuuucuuugugugaagacaa

SEQ ID NO: 816656 - RNA, 22 nt, Human
uucauucuuauuugugaucugg

SEQ ID NO: 816657 - RNA, 20 nt, Human
aggaggggauagaaucaaag

SEQ ID NO: 816658 - RNA, 22 nt, Human
auucuucagcaggggacacuau

SEQ ID NO: 816659 - RNA, 22 nt, Human
aaggcaguacuuuauguccaua

SEQ ID NO: 816660 - RNA, 22 nt, Human
ccaggacaaguguggccauggc

SEQ ID NO: 816661 - RNA, 22 nt, Human
accaggagacaugaccaaugag

SEQ ID NO: 816662 - RNA, 22 nt, Human
ucuucauuuuauagcaucugug

SEQ ID NO: 816663 - RNA, 22 nt, Human
ucuuugaacuuggcugaucucu

SEQ ID NO: 816664 - RNA, 22 nt, Human
aggcaagcugcagagaguccuu

SEQ ID NO: 816665 - RNA, 22 nt, Human
gagaggucaucucccaucagca

SEQ ID NO: 816666 - RNA, 19 nt, Human
cuggccaggccaggggccc

SEQ ID NO: 816667 - RNA, 22 nt, Human
aaggcagccgugugacugcaug

SEQ ID NO: 816668 - RNA, 22 nt, Human
ucccaggauguuggcggcaggu

SEQ ID NO: 816669 - RNA, 22 nt, Human
uucacauuggugauauguuucu

SEQ ID NO: 816670 - RNA, 22 nt, Human
uuguaaaugaccuuuucuaauu

SEQ ID NO: 816671 - RNA, 22 nt, Human
uugagaagaggcuuuguaggaa

SEQ ID NO: 816672 - RNA, 22 nt, Human
gggcagcucuuugguauccuuc

SEQ ID NO: 816673 - RNA, 22 nt, Human
aaggcaguaggaucuuccacag

SEQ ID NO: 816674 - RNA, 22 nt, Human
aaguugagaugucauaggagac

SEQ ID NO: 816675 - RNA, 22 nt, Human
agggacuuguguccuauguaug

SEQ ID NO: 816676 - RNA, 22 nt, Human
aggagaggcucuaacucugugu

SEQ ID NO: 816677 - RNA, 22 nt, Human
cagagggcacaugguuuccuca

SEQ ID NO: 816678 - RNA, 17 nt, Human
cagacaggcugucaccc

SEQ ID NO: 816679 - RNA, 22 nt, Human
cagcuggcaaguggagcagggu

SEQ ID NO: 816680 - RNA, 22 nt, Human
ggcaugcugcguacagaugaac

SEQ ID NO: 816681 - RNA, 22 nt, Human
cugcuuuguaaaauagacauaa

SEQ ID NO: 816682 - RNA, 22 nt, Human
acaacauucuuaaauacacuga

SEQ ID NO: 816683 - RNA, 22 nt, Human
uaucuaaauggaauauuccaga

SEQ ID NO: 816684 - RNA, 22 nt, Human
aaggcagccuuuugaguugauu

SEQ ID NO: 816685 - RNA, 22 nt, Human
uuucaguuuuugcucgauguau

SEQ ID NO: 816686 - RNA, 21 nt, Human
auacauucuauuaagcauuua

SEQ ID NO: 816687 - RNA, 22 nt, Human
uucuugcaggucacucacugag

SEQ ID NO: 816688 - RNA, 22 nt, Human
acaauguguuuuuauacauuug

SEQ ID NO: 816689 - RNA, 22 nt, Human
cggcagcugauugcagagcacc

SEQ ID NO: 816690 - RNA, 22 nt, Human
uuuacuuuugguaaggucauuu

SEQ ID NO: 816691 - RNA, 22 nt, Human
uucccaugccuggccccuaucc

SEQ ID NO: 816692 - RNA, 22 nt, Human
cagugauguuucugcaucagag

SEQ ID NO: 816693 - RNA, 22 nt, Human
agcuggcagcucucagggguac

SEQ ID NO: 816694 - RNA, 22 nt, Human
uucaggauucugugucugacaa

SEQ ID NO: 816695 - RNA, 22 nt, Human
gaccauuuguugaaaagauuau

SEQ ID NO: 816696 - RNA, 22 nt, Human
aaguccaugaucaagauguggc

SEQ ID NO: 816697 - RNA, 22 nt, Human
ccagugcuuccaggaauacggu

SEQ ID NO: 816698 - RNA, 22 nt, Human
cacucaggguacaauggagggc

SEQ ID NO: 816699 - RNA, 22 nt, Human
aggcaggcucaaugcccagucu

SEQ ID NO: 816700 - RNA, 22 nt, Human
uuucaguuuaugucuugaauua

SEQ ID NO: 816701 - RNA, 22 nt, Human
gcucccagcaauugaggcagcc

SEQ ID NO: 816702 - RNA, 22 nt, Human
ucacugucugaaagaaauggcc

SEQ ID NO: 816703 - RNA, 22 nt, Human
uaucuguuugcucacagguguu

SEQ ID NO: 816704 - RNA, 22 nt, Human
gcccaggaggucaaguagcuau

SEQ ID NO: 816705 - RNA, 22 nt, Human
gcccaguaguucaagguugcag

SEQ ID NO: 816706 - RNA, 22 nt, Human
acacagaguauuuagaaggggu

SEQ ID NO: 816707 - RNA, 22 nt, Human
ucaucucaaaacccaaggggca

SEQ ID NO: 816708 - RNA, 19 nt, Human
gcuuuggagggagguucua

SEQ ID NO: 816709 - RNA, 22 nt, Human
guugaaaguagaugcuauuugg

SEQ ID NO: 816710 - RNA, 22 nt, Human
caggcagcugggucaccguccc

SEQ ID NO: 816711 - RNA, 22 nt, Human
gaagcagcuuucuggugaggag

SEQ ID NO: 816712 - RNA, 22 nt, Human
aggcagauuuaggagaaaagaa

SEQ ID NO: 816713 - RNA, 22 nt, Human
gcucaggaaaacagucuaguaa

SEQ ID NO: 816714 - RNA, 22 nt, Human
uucuucaaauagcagggaguca

SEQ ID NO: 816715 - RNA, 22 nt, Human
agaggggaaggaugugauguga

SEQ ID NO: 816716 - RNA, 22 nt, Human
acagagagaaacaaucagcagc

SEQ ID NO: 816717 - RNA, 22 nt, Human
ucugcagguguuggaaggguca

SEQ ID NO: 816718 - RNA, 22 nt, Human
gagagaggccuccauguacuga

SEQ ID NO: 816719 - RNA, 22 nt, Human
acccaggaggugacacagggcu

SEQ ID NO: 816720 - RNA, 22 nt, Human
cuggaggcacccuuagagaggc

SEQ ID NO: 816721 - RNA, 22 nt, Human
uuuguaaaggccugaauuucag

SEQ ID NO: 816722 - RNA, 22 nt, Human
caaauagugucacauugugagg

SEQ ID NO: 816723 - RNA, 22 nt, Human
ucuucagagugaaagucuguga

SEQ ID NO: 816724 - RNA, 17 nt, Human
uucaaagcuuaucaagg

SEQ ID NO: 816725 - RNA, 22 nt, Human
acccaggacaugggcacccgug

SEQ ID NO: 816726 - RNA, 22 nt, Human
acccaggacuuggcaaccucau

SEQ ID NO: 816727 - RNA, 22 nt, Human
uggcagcugcaggccuccugag

SEQ ID NO: 816728 - RNA, 22 nt, Human
cuuuggcacagucucauuugau

SEQ ID NO: 816729 - RNA, 22 nt, Human
augacaguucuacacuuaaucu

SEQ ID NO: 816730 - RNA, 22 nt, Human
uagcccagaagagggaagcaac

SEQ ID NO: 816731 - RNA, 22 nt, Human
uuucaguuuccagcuuugucau

SEQ ID NO: 816732 - RNA, 22 nt, Human
cugcugugcaacauugcaccua

SEQ ID NO: 816733 - RNA, 22 nt, Human
uucaggauucucucccauuuac

SEQ ID NO: 816734 - RNA, 22 nt, Human
accgaaggaaacuggaaccguu

SEQ ID NO: 816735 - RNA, 22 nt, Human
ucugggaacagccuggcugugu

SEQ ID NO: 816736 - RNA, 22 nt, Human
cauuguuaccaucuuuuaccua

SEQ ID NO: 816737 - RNA, 22 nt, Human
auuuccauagagcgucucacag

SEQ ID NO: 816738 - RNA, 22 nt, Human
aauauaugugguauugaccagc

SEQ ID NO: 816739 - RNA, 22 nt, Human
guucuucaucauuaacacucug

SEQ ID NO: 816740 - RNA, 22 nt, Human
ugcccaggaucuggcgaugcuc

SEQ ID NO: 816741 - RNA, 22 nt, Human
ucauuucccuccuacaaagagg

SEQ ID NO: 816742 - RNA, 17 nt, Human
gccucugcuugugucau

SEQ ID NO: 816743 - RNA, 22 nt, Human
auuuguagugaagugaaaauaa

SEQ ID NO: 816744 - RNA, 22 nt, Human
ucugcaggaggcuggcugcagg

SEQ ID NO: 816745 - RNA, 22 nt, Human
cuggaaauuggagaugauguuu

SEQ ID NO: 816746 - RNA, 22 nt, Human
guuaucaugcuucaucaucacu

SEQ ID NO: 816747 - RNA, 21 nt, Human
ucuugaaaauuguagcaguuu

SEQ ID NO: 816748 - RNA, 21 nt, Human
acagcauguuuguguguuugc

SEQ ID NO: 816749 - RNA, 22 nt, Human
uggcaggcagugugggagcugg

SEQ ID NO: 816750 - RNA, 22 nt, Human
caggcagcauuuacucugauga

SEQ ID NO: 816751 - RNA, 22 nt, Human
acucagaaccauuuacucugag

SEQ ID NO: 816752 - RNA, 22 nt, Human
caguucuuuguggggaguucuc

SEQ ID NO: 816753 - RNA, 22 nt, Human
uucuuuuacauuaagauuucag

SEQ ID NO: 816754 - RNA, 22 nt, Human
acacauuucuaaauuuuuaccg

SEQ ID NO: 816755 - RNA, 22 nt, Human
aaaggaagauugagcuuuucca

SEQ ID NO: 816756 - RNA, 22 nt, Human
uugcauuuccuguacuguuuga

SEQ ID NO: 816757 - RNA, 22 nt, Human
cucaggauggaagccuacagga

SEQ ID NO: 816758 - RNA, 22 nt, Human
cacucaggcugugucaggagga

SEQ ID NO: 816759 - RNA, 22 nt, Human
caacauuucaaggucuuuagga

SEQ ID NO: 816760 - RNA, 22 nt, Human
gcuucccagcagaggaaagacu

SEQ ID NO: 816761 - RNA, 22 nt, Human
gaggcaccucgcgggaggaggc

SEQ ID NO: 816762 - RNA, 22 nt, Human
uagagcugggcagugcucugag

SEQ ID NO: 816763 - RNA, 22 nt, Human
uugcugugaaaccaugggaagu

SEQ ID NO: 816764 - RNA, 22 nt, Human
cccaggagguggagguugcagc

SEQ ID NO: 816765 - RNA, 22 nt, Human
augcuuuuccaggagaaauaua

SEQ ID NO: 816766 - RNA, 22 nt, Human
uaagaacuucggacauguuauc

SEQ ID NO: 816767 - RNA, 22 nt, Human
auuucucuuagcaagacauuac

SEQ ID NO: 816768 - RNA, 22 nt, Human
ugaaaugaaacagaacauauca

SEQ ID NO: 816769 - RNA, 22 nt, Human
accauccugaaaccuucaugcu

SEQ ID NO: 816770 - RNA, 22 nt, Human
uccaugaggaccaaauucguag

SEQ ID NO: 816771 - RNA, 22 nt, Human
ggcuuugccuggaauuuccuug

SEQ ID NO: 816772 - RNA, 22 nt, Human
uacuuucuguccuucuguuaaa

SEQ ID NO: 816773 - RNA, 19 nt, Human
gugcuuuuuaagagcucag

SEQ ID NO: 816774 - RNA, 22 nt, Human
aaaccgcaauuacuuuugcguc

SEQ ID NO: 816775 - RNA, 22 nt, Human
uugcugaaaucuaugacauccu

SEQ ID NO: 816776 - RNA, 22 nt, Human
uaggaggguuagagggaaauau

SEQ ID NO: 816777 - RNA, 22 nt, Human
uuuuuaguagagguggguuuca

SEQ ID NO: 816778 - RNA, 22 nt, Human
uccaggagguaugaguggcccc

SEQ ID NO: 816779 - RNA, 22 nt, Human
ucuucacaggagccugccugcc

SEQ ID NO: 816780 - RNA, 22 nt, Human
aggcacaguuucauccccgggc

SEQ ID NO: 816781 - RNA, 22 nt, Human
cccaggauggggcugcaguuau

SEQ ID NO: 816782 - RNA, 22 nt, Human
agacaaauggaguaugagcaac

SEQ ID NO: 816783 - RNA, 22 nt, Human
uccauucauucauugaugaaca

SEQ ID NO: 816784 - RNA, 22 nt, Human
caggauggccccggggcugugc

SEQ ID NO: 816785 - RNA, 22 nt, Human
cuguauuuguccucuauuuauu

SEQ ID NO: 816786 - RNA, 22 nt, Human
uuccaagagcuuuaauuguuga

SEQ ID NO: 816787 - RNA, 22 nt, Human
aguaaaaauugaggugcaaaau

SEQ ID NO: 816788 - RNA, 22 nt, Human
gaggcagccucaguggaccucg

SEQ ID NO: 816789 - RNA, 22 nt, Human
cagaggaguucaguacacagcc

SEQ ID NO: 816790 - RNA, 22 nt, Human
uuagaaagaacuuuagauauca

SEQ ID NO: 816791 - RNA, 22 nt, Human
aaauuaguacauugcaaagucc

SEQ ID NO: 816792 - RNA, 22 nt, Human
aaacugcuuuccacaguggcua

SEQ ID NO: 816793 - RNA, 22 nt, Human
ugaaagguagcuggccucauag

SEQ ID NO: 816794 - RNA, 22 nt, Human
caagaugggcaccccagcaccu

SEQ ID NO: 816795 - RNA, 22 nt, Human
aguuugaaaguauugacagaag

SEQ ID NO: 816796 - RNA, 22 nt, Human
uuugaaagcaggugugggaggg

SEQ ID NO: 816797 - RNA, 22 nt, Human
aggaaaggccuuugcauuuggu

SEQ ID NO: 816798 - RNA, 22 nt, Human
aaguuugcauagauuaagcauu

SEQ ID NO: 816799 - RNA, 22 nt, Human
uggagacucugcaucugugaca

SEQ ID NO: 816800 - RNA, 22 nt, Human
uacuuuuagccuauuugauucu

SEQ ID NO: 816801 - RNA, 22 nt, Human
uggcagcuagauaguguguuua

SEQ ID NO: 816802 - RNA, 22 nt, Human
uucucuuuucaccaguugcuaa

SEQ ID NO: 816803 - RNA, 20 nt, Human
ccacaggaguccagucgacc

SEQ ID NO: 816804 - RNA, 22 nt, Human
augaguucaauuguuucaguca

SEQ ID NO: 816805 - RNA, 17 nt, Human
ucauuuguugugacuag

SEQ ID NO: 816806 - RNA, 22 nt, Human
cauugcuuccuaugucccuucu

SEQ ID NO: 816807 - RNA, 21 nt, Human
uuugaaagcccuauguuuuca

SEQ ID NO: 816808 - RNA, 17 nt, Human
uccaggagaggcaaugg

SEQ ID NO: 816809 - RNA, 22 nt, Human
uucugugauugacauguggcuu

SEQ ID NO: 816810 - RNA, 22 nt, Human
ugcccaggcuggaaugcagugg

SEQ ID NO: 816811 - RNA, 22 nt, Human
uuuaacagguaaaguaaaugug

SEQ ID NO: 816812 - RNA, 22 nt, Human
cuucugcaauaaguuuuggucc

SEQ ID NO: 816813 - RNA, 22 nt, Human
aaauugcauuuuaaagguagau

SEQ ID NO: 816814 - RNA, 22 nt, Human
aaagccagagcaagcugucaca

SEQ ID NO: 816815 - RNA, 22 nt, Human
aucugccugcaguggagguggg

SEQ ID NO: 816816 - RNA, 22 nt, Human
acucagaagauauaaugacuca

SEQ ID NO: 816817 - RNA, 19 nt, Human
uucccaggaaaggggugca

SEQ ID NO: 816818 - RNA, 22 nt, Human
agcugaugccauguggaacagu

SEQ ID NO: 816819 - RNA, 22 nt, Human
auuucaaggcuauuaauauaaa

SEQ ID NO: 816820 - RNA, 22 nt, Human
aguucuucauaaccuuacugug

SEQ ID NO: 816821 - RNA, 22 nt, Human
aggccagcagcaugacggcauc

SEQ ID NO: 816822 - RNA, 22 nt, Human
uguggaaaagaauaagggagau

SEQ ID NO: 816823 - RNA, 22 nt, Human
cacaaaugguuguagacauuaa

SEQ ID NO: 816824 - RNA, 22 nt, Human
auuguuaugaaaauaagauguu

SEQ ID NO: 816825 - RNA, 22 nt, Human
cucccagagagcaggugggccg

SEQ ID NO: 816826 - RNA, 22 nt, Human
uccaggagacacaagguacaua

SEQ ID NO: 816827 - RNA, 22 nt, Human
aggagaaggaagugcaucacua

SEQ ID NO: 816828 - RNA, 22 nt, Human
gacagugcauuuccuggcaugg

SEQ ID NO: 816829 - RNA, 22 nt, Human
ugagccuguccugugcauguga

SEQ ID NO: 816830 - RNA, 22 nt, Human
ucaaucacguguuccauguucu

SEQ ID NO: 816831 - RNA, 22 nt, Human
uuuccagguauuaauacuguau

SEQ ID NO: 816832 - RNA, 23 nt, Human
aggcagcuggguagcaucuuucu

SEQ ID NO: 816833 - RNA, 22 nt, Human
augaaggcuguguggagccccc

SEQ ID NO: 816834 - RNA, 22 nt, Human
aaaggccacacagagcagggag

SEQ ID NO: 816835 - RNA, 17 nt, Human
cccacggaggugugaaa

SEQ ID NO: 816836 - RNA, 22 nt, Human
ggcagcugucucugaguuagca

SEQ ID NO: 816837 - RNA, 22 nt, Human
uuauucuuuucuccagaauccc

SEQ ID NO: 816838 - RNA, 22 nt, Human
uucuucucagggucccacaugg

SEQ ID NO: 816839 - RNA, 22 nt, Human
cuucuucaagagaaugggagac

SEQ ID NO: 816840 - RNA, 22 nt, Human
uucuucuucuggcugcaccugg

SEQ ID NO: 816841 - RNA, 22 nt, Human
gauggcagguaguggucucauc

SEQ ID NO: 816842 - RNA, 22 nt, Human
uauuuccaaaagccuauuauga

SEQ ID NO: 816843 - RNA, 22 nt, Human
caggaugagaggcccagggaag

SEQ ID NO: 816844 - RNA, 22 nt, Human
agucuugcucuugcaucugcuu

SEQ ID NO: 816845 - RNA, 22 nt, Human
cucucuguuaugcuuucaugaa

SEQ ID NO: 816846 - RNA, 22 nt, Human
cccaugagauucugaauuuggc

SEQ ID NO: 816847 - RNA, 22 nt, Human
ucugcuguucauucuuuuagcu

SEQ ID NO: 816848 - RNA, 22 nt, Human
uuugaaaggguuaugagacuga

SEQ ID NO: 816849 - RNA, 22 nt, Human
gaaggaggcguuagcccuagga

SEQ ID NO: 816850 - RNA, 22 nt, Human
ccaggagauuuuuccauagcac

SEQ ID NO: 816851 - RNA, 22 nt, Human
uuugcagucaaauuugcuaaau

SEQ ID NO: 816852 - RNA, 22 nt, Human
gaggacaggagacucacuguuu

SEQ ID NO: 816853 - RNA, 22 nt, Human
cuacccaggcuggagugcagua

SEQ ID NO: 816854 - RNA, 23 nt, Human
gagugcagaauagacaugcagug

SEQ ID NO: 816855 - RNA, 22 nt, Human
cauuuguaucauauguaucuua

SEQ ID NO: 816856 - RNA, 22 nt, Human
gccucugcaauuacauugugcc

SEQ ID NO: 816857 - RNA, 22 nt, Human
aggcggcuccgggagugugggc

SEQ ID NO: 816858 - RNA, 22 nt, Human
cuauuucaaggcccagauauga

SEQ ID NO: 816859 - RNA, 22 nt, Human
agucucuuccuucaaggcuggu

SEQ ID NO: 816860 - RNA, 22 nt, Human
ugguaauuaauuugauagguuc

SEQ ID NO: 816861 - RNA, 22 nt, Human
ugagccugguugcagugucugg

SEQ ID NO: 816862 - RNA, 22 nt, Human
cagagaaaaaauccugcucuca

SEQ ID NO: 816863 - RNA, 22 nt, Human
ucugcugugauuugcuaccugu

SEQ ID NO: 816864 - RNA, 17 nt, Human
cagcucugcaucuuccu

SEQ ID NO: 816865 - RNA, 22 nt, Human
gauguagagggaagauuuuaaa

SEQ ID NO: 816866 - RNA, 23 nt, Human
uggaggaaacacaucagaagacc

SEQ ID NO: 816867 - RNA, 23 nt, Human
uucuucucaauuaguugauucag

SEQ ID NO: 816868 - RNA, 22 nt, Human
ucauuucuauugcuacugucug

SEQ ID NO: 816869 - RNA, 22 nt, Human
caggcagggagcuggaaaggau

SEQ ID NO: 816870 - RNA, 22 nt, Human
uaaugucaaggugauagauuug

SEQ ID NO: 816871 - RNA, 22 nt, Human
aaugaaauguagcuuauccaua

SEQ ID NO: 816872 - RNA, 22 nt, Human
augcuguguggccaccuccaug

SEQ ID NO: 816873 - RNA, 22 nt, Human
gagguggugguggaggcauagc

SEQ ID NO: 816874 - RNA, 22 nt, Human
cucuccucugaaguggugaccc

SEQ ID NO: 816875 - RNA, 22 nt, Human
ccaggaaauagugcugugaucu

SEQ ID NO: 816876 - RNA, 22 nt, Human
cucacuguuuaauagcuggauc

SEQ ID NO: 816877 - RNA, 19 nt, Human
uggagggguuugaaugugg

SEQ ID NO: 816878 - RNA, 22 nt, Human
uagcacauuguugaccagaagg

SEQ ID NO: 816879 - RNA, 22 nt, Human
gaaauauucuugucuuguuuuc

SEQ ID NO: 816880 - RNA, 22 nt, Human
ggaggcagaacuucccgucagu

SEQ ID NO: 816881 - RNA, 22 nt, Human
aaguguagauuauggagugucu

SEQ ID NO: 816882 - RNA, 22 nt, Human
caggagagauaugaguccccac

SEQ ID NO: 816883 - RNA, 22 nt, Human
gaggcacugcaguacagugacu

SEQ ID NO: 816884 - RNA, 22 nt, Human
uuucaggguacauggagcaaau

SEQ ID NO: 816885 - RNA, 22 nt, Human
agaggcggagcuugcagugagc

SEQ ID NO: 816886 - RNA, 22 nt, Human
ucugcaggcuguacaggaagca

SEQ ID NO: 816887 - RNA, 22 nt, Human
gcagcuccuccugggcuggaga

SEQ ID NO: 816888 - RNA, 22 nt, Human
uucuucaaaacaacacuggccu

SEQ ID NO: 816889 - RNA, 22 nt, Human
uacugcauaacuggcauguggg

SEQ ID NO: 816890 - RNA, 22 nt, Human
aauaucaacaguguccuucuaa

SEQ ID NO: 816891 - RNA, 22 nt, Human
acccaggagcucugggguccuc

SEQ ID NO: 816892 - RNA, 22 nt, Human
uauguuauuuucauacaacaga

SEQ ID NO: 816893 - RNA, 22 nt, Human
ucuucaucucagauuaacagga

SEQ ID NO: 816894 - RNA, 20 nt, Human
ucaggaugugcugagugaag

SEQ ID NO: 816895 - RNA, 22 nt, Human
gcugauguuuaguugauguuac

SEQ ID NO: 816896 - RNA, 22 nt, Human
uaaggccaaacuauuauaguuc

SEQ ID NO: 816897 - RNA, 22 nt, Human
cagucucuugcuucauuaguug

SEQ ID NO: 816898 - RNA, 22 nt, Human
acuaagugauucuaagcaucuu

SEQ ID NO: 816899 - RNA, 23 nt, Human
cccuggaguaaauucuuggaagg

SEQ ID NO: 816900 - RNA, 22 nt, Human
cauuuguacagaacagcuuuau

SEQ ID NO: 816901 - RNA, 22 nt, Human
gaggaggccaguggaaggaagc

SEQ ID NO: 816902 - RNA, 18 nt, Human
ucaggagacacagacgca

SEQ ID NO: 816903 - RNA, 22 nt, Human
gcaccugauugauuucacugcu

SEQ ID NO: 816904 - RNA, 22 nt, Human
uuucaucuaacacuacauaggg

SEQ ID NO: 816905 - RNA, 22 nt, Human
uuucucuguucucuaacuguaa

SEQ ID NO: 816906 - RNA, 22 nt, Human
cagggaggaugggcuguuuugc

SEQ ID NO: 816907 - RNA, 22 nt, Human
uuuuuauaugaaggauagugcg

SEQ ID NO: 816908 - RNA, 22 nt, Human
caaauauuccagguacaucccu

SEQ ID NO: 816909 - RNA, 22 nt, Human
uguuguuuucucauggagaaua

SEQ ID NO: 816910 - RNA, 22 nt, Human
cuacccagauccaggauggcua

SEQ ID NO: 816911 - RNA, 22 nt, Human
aagcuggcaugucaccugagaa

SEQ ID NO: 816912 - RNA, 22 nt, Human
auagucuuagaucagauaaagu

SEQ ID NO: 816913 - RNA, 22 nt, Human
uaaggccaaggggccauagucu

SEQ ID NO: 816914 - RNA, 18 nt, Human
ugaggcagucagugaugg

SEQ ID NO: 816915 - RNA, 19 nt, Human
gaggucagcaagaaguauu

SEQ ID NO: 816916 - RNA, 22 nt, Human
cuuaaauuuucaucuacaagaa

SEQ ID NO: 816917 - RNA, 22 nt, Human
acagcagcuugcgugucugguc

SEQ ID NO: 816918 - RNA, 22 nt, Human
ccagagagaaauggauuugagu

SEQ ID NO: 816919 - RNA, 22 nt, Human
auugaaaguccuaucuaaggga

SEQ ID NO: 816920 - RNA, 22 nt, Human
ccucaggauccgcaggugcagu

SEQ ID NO: 816921 - RNA, 22 nt, Human
uuccucagaaaauacuguccaa

SEQ ID NO: 816922 - RNA, 22 nt, Human
uugcugaaaacaguggguauug

SEQ ID NO: 816923 - RNA, 22 nt, Human
aaauuauuacaagcuaguuggc

SEQ ID NO: 816924 - RNA, 22 nt, Human
ggagugucagaaacaguguccu

SEQ ID NO: 816925 - RNA, 22 nt, Human
uccauuuuagagaugaagaaac

SEQ ID NO: 816926 - RNA, 22 nt, Human
cagagggcucuuggcugccugc

SEQ ID NO: 816927 - RNA, 22 nt, Human
acaacauuauacauagaaagcu

SEQ ID NO: 816928 - RNA, 22 nt, Human
aagcagaggguauggccagguu

SEQ ID NO: 816929 - RNA, 22 nt, Human
ugaggcaggacuugcauaaagu

SEQ ID NO: 816930 - RNA, 22 nt, Human
cugcuguggaugcaggaccuca

SEQ ID NO: 816931 - RNA, 21 nt, Human
aaugaaguggcuauuuugagg

SEQ ID NO: 816932 - RNA, 20 nt, Human
gggcagcuccccucauucug

SEQ ID NO: 816933 - RNA, 22 nt, Human
aucccaugagaccacguuggcu

SEQ ID NO: 816934 - RNA, 22 nt, Human
cagugauggauauggagaaguc

SEQ ID NO: 816935 - RNA, 22 nt, Human
uuuccagagcaugucugcucag

SEQ ID NO: 816936 - RNA, 22 nt, Human
gcagagcuucuguccuucagga

SEQ ID NO: 816937 - RNA, 22 nt, Human
uuauuuaaaagugguaagauuc

SEQ ID NO: 816938 - RNA, 22 nt, Human
gaucauuuugaugcccuuuuag

SEQ ID NO: 816939 - RNA, 22 nt, Human
ucuguggauuuuaguguucaug

SEQ ID NO: 816940 - RNA, 22 nt, Human
cggagccugcuuguugcagcug

SEQ ID NO: 816941 - RNA, 22 nt, Human
auugcuguacacuucuagaucu

SEQ ID NO: 816942 - RNA, 22 nt, Human
acccaggagacagguugcagug

SEQ ID NO: 816943 - RNA, 23 nt, Human
uaugaacugcauugcuggugugu

SEQ ID NO: 816944 - RNA, 22 nt, Human
agucucugucguagaucagcgu

SEQ ID NO: 816945 - RNA, 22 nt, Human
uggcaaggcugugggggcagag

SEQ ID NO: 816946 - RNA, 23 nt, Human
uccugaggguuucccagccuugg

SEQ ID NO: 816947 - RNA, 22 nt, Human
ucuugcuaaagaccaacacauu

SEQ ID NO: 816948 - RNA, 22 nt, Human
aggcuagcuuuggcucaguaaa

SEQ ID NO: 816949 - RNA, 21 nt, Human
ucucugugucuuuaagcugga

SEQ ID NO: 816950 - RNA, 22 nt, Human
cugcuuugcauagcugccagag

SEQ ID NO: 816951 - RNA, 22 nt, Human
uauuuuaucugccagaguggag

SEQ ID NO: 816952 - RNA, 23 nt, Human
uguugaaguaacuguuacauaga

SEQ ID NO: 816953 - RNA, 22 nt, Human
accaggagaggcacuugcaaug

SEQ ID NO: 816954 - RNA, 23 nt, Human
gugagucuugccuuugcugugga

SEQ ID NO: 816955 - RNA, 22 nt, Human
cccaggaggcagaaguugcagu

SEQ ID NO: 816956 - RNA, 22 nt, Human
ugcuuggcuuucugagcuucug

SEQ ID NO: 816957 - RNA, 22 nt, Human
cagaagaggacuggguagcuca

SEQ ID NO: 816958 - RNA, 18 nt, Human
acugugugaauuagcucc

SEQ ID NO: 816959 - RNA, 21 nt, Human
auggagggaccagggaagcag

SEQ ID NO: 816960 - RNA, 22 nt, Human
cccaaggaagacgcuugugaua

SEQ ID NO: 816961 - RNA, 22 nt, Human
ucuaaccuuugaaacugcuuuc

SEQ ID NO: 816962 - RNA, 21 nt, Human
uucuucaguuuaauauaaaau

SEQ ID NO: 816963 - RNA, 22 nt, Human
cuucagaggggacucaaaguca

SEQ ID NO: 816964 - RNA, 22 nt, Human
aaagccauugaacuguacuuua

SEQ ID NO: 816965 - RNA, 22 nt, Human
uguucuuuggcuucacagcucu

SEQ ID NO: 816966 - RNA, 22 nt, Human
gggcagcuccuguggaauccac

SEQ ID NO: 816967 - RNA, 22 nt, Human
ugccuugcgggcguuucuguug

SEQ ID NO: 816968 - RNA, 22 nt, Human
agucucugcugguugugccuau

SEQ ID NO: 816969 - RNA, 22 nt, Human
aagcuggagaguuaggugaaua

SEQ ID NO: 816970 - RNA, 22 nt, Human
gggugggacugaagucugaggg

SEQ ID NO: 816971 - RNA, 22 nt, Human
aaaacuaaauacgcuuugccuc

SEQ ID NO: 816972 - RNA, 22 nt, Human
gagugcaguuggggugagggga

SEQ ID NO: 816973 - RNA, 22 nt, Human
auguuucagauacagaucaaau

SEQ ID NO: 816974 - RNA, 22 nt, Human
agugcuuuccuucuugugacau

SEQ ID NO: 816975 - RNA, 23 nt, Human
ucucaagaggaagcagggcucau

SEQ ID NO: 816976 - RNA, 22 nt, Human
gaggcagaaguugcagugagca

SEQ ID NO: 816977 - RNA, 22 nt, Human
gcugggaagugcaagaucaagg

SEQ ID NO: 816978 - RNA, 22 nt, Human
agggagcucuaaguagagggac

SEQ ID NO: 816979 - RNA, 22 nt, Human
gagguagcgaguggacagugca

SEQ ID NO: 816980 - RNA, 22 nt, Human
gaaauauuacaguggaggggau

SEQ ID NO: 816981 - RNA, 22 nt, Human
agucaauuaucucuaggucauc

SEQ ID NO: 816982 - RNA, 22 nt, Human
aggaagcuuagugaaaggacca

SEQ ID NO: 816983 - RNA, 22 nt, Human
cucaagacugaucgcaguggaa

SEQ ID NO: 816984 - RNA, 20 nt, Human
ugaaggccagcagcauaggg

SEQ ID NO: 816985 - RNA, 22 nt, Human
auuauuauauagggaaaguccc

SEQ ID NO: 816986 - RNA, 22 nt, Human
uugauacauuuuuaggauaaac

SEQ ID NO: 816987 - RNA, 22 nt, Human
auguauuucuauguagugaaga

SEQ ID NO: 816988 - RNA, 22 nt, Human
agugcagccgagaucaggugcu

SEQ ID NO: 816989 - RNA, 22 nt, Human
auuuuacuacuccaauuaauga

SEQ ID NO: 816990 - RNA, 22 nt, Human
ugcuguguggaugugaagaauc

SEQ ID NO: 816991 - RNA, 22 nt, Human
uggaaauguauuugggcaugcc

SEQ ID NO: 816992 - RNA, 22 nt, Human
gaaccucagugaaacuggaggu

SEQ ID NO: 816993 - RNA, 20 nt, Human
acaggagaucugaggaaagg

SEQ ID NO: 816994 - RNA, 22 nt, Human
uaggcagcuuagguuagaagug

SEQ ID NO: 816995 - RNA, 22 nt, Human
auucuucaccugagucagucua

SEQ ID NO: 816996 - RNA, 22 nt, Human
aagccgaggccacacagcagga

SEQ ID NO: 816997 - RNA, 22 nt, Human
aaaauauuuuagggccaggaga

SEQ ID NO: 816998 - RNA, 21 nt, Human
agggagcuuuagguagaaguu

SEQ ID NO: 816999 - RNA, 22 nt, Human
uuacaagcagcuacauaucaca

SEQ ID NO: 817000 - RNA, 22 nt, Human
aaucuucuacuugacaguucuc

SEQ ID NO: 817001 - RNA, 22 nt, Human
uuuccauguuggugaaaugagg

SEQ ID NO: 817002 - RNA, 22 nt, Human
cuuagaaaucgaacucagguua

SEQ ID NO: 817003 - RNA, 22 nt, Human
aggcuggagggcaauggcaaga

SEQ ID NO: 817004 - RNA, 22 nt, Human
agaggcagaaguguucaaaccc

SEQ ID NO: 817005 - RNA, 22 nt, Human
uaccauuucauucuuuccucau

SEQ ID NO: 817006 - RNA, 22 nt, Human
caagaugugccuaaucagaccu

SEQ ID NO: 817007 - RNA, 22 nt, Human
uccaggagcucauccacgucaa

SEQ ID NO: 817008 - RNA, 22 nt, Human
cagcugacagugaggugggggc

SEQ ID NO: 817009 - RNA, 22 nt, Human
uucacagaugccugaugugugg

SEQ ID NO: 817010 - RNA, 22 nt, Human
aaugucugcucuacucaggagg

SEQ ID NO: 817011 - RNA, 22 nt, Human
ugcccaggguuucuaagagcag

SEQ ID NO: 817012 - RNA, 22 nt, Human
gaaauuauugcuagagacugca

SEQ ID NO: 817013 - RNA, 22 nt, Human
ucacugcucagucuguacuaca

SEQ ID NO: 817014 - RNA, 22 nt, Human
cugcuucugggaugauggagua

SEQ ID NO: 817015 - RNA, 22 nt, Human
agggaagcuuguuacugagaag

SEQ ID NO: 817016 - RNA, 20 nt, Human
acaggggcagcacaauaaug

SEQ ID NO: 817017 - RNA, 22 nt, Human
aggagcagaauuuaaugugcag

SEQ ID NO: 817018 - RNA, 22 nt, Human
cccaggagagggaaccaaaugu

SEQ ID NO: 817019 - RNA, 22 nt, Human
agacagguaaauagagaugcug

SEQ ID NO: 817020 - RNA, 22 nt, Human
uccugagagcagcugcuuugga

SEQ ID NO: 817021 - RNA, 22 nt, Human
cggagaggaccugcaacucgcu

SEQ ID NO: 817022 - RNA, 22 nt, Human
aaggcagcuucaccacagcauu

SEQ ID NO: 817023 - RNA, 22 nt, Human
auaaagauuucuuuuucucuac

SEQ ID NO: 817024 - RNA, 22 nt, Human
agagcagcacguuguccccaca

SEQ ID NO: 817025 - RNA, 22 nt, Human
gcuccucugucaaaugagagug

SEQ ID NO: 817026 - RNA, 22 nt, Human
aaggcagccauagcaccaucca

SEQ ID NO: 817027 - RNA, 22 nt, Human
ccaggagagcaggcgugcagcu

SEQ ID NO: 817028 - RNA, 22 nt, Human
uaucuguuaugggcugaauugc

SEQ ID NO: 817029 - RNA, 22 nt, Human
uuuaaauucugucugccgcuua

SEQ ID NO: 817030 - RNA, 22 nt, Human
ccugcugugaccggggagcagg

SEQ ID NO: 817031 - RNA, 22 nt, Human
aucaggauagugguuaccuggg

SEQ ID NO: 817032 - RNA, 22 nt, Human
aaagauuugaguucugcuuaua

SEQ ID NO: 817033 - RNA, 22 nt, Human
guuuuaguggguggccacugau

SEQ ID NO: 817034 - RNA, 22 nt, Human
cuuugcaaacugucacacuuuc

SEQ ID NO: 817035 - RNA, 21 nt, Human
gggugggaggacacagcaggc

SEQ ID NO: 817036 - RNA, 22 nt, Human
aagcaaaggcaggagcuuguga

SEQ ID NO: 817037 - RNA, 22 nt, Human
uucuucuccuaaggagaguccu

SEQ ID NO: 817038 - RNA, 22 nt, Human
uuuuaucugcuucauuaguuga

SEQ ID NO: 817039 - RNA, 22 nt, Human
auacaaagacaaaucucaaucu

SEQ ID NO: 817040 - RNA, 22 nt, Human
ucauuuguucaucugcucuucu

SEQ ID NO: 817041 - RNA, 22 nt, Human
ugucucugaggugagggucagc

SEQ ID NO: 817042 - RNA, 22 nt, Human
ucagagaguuggaaagaauuaa

SEQ ID NO: 817043 - RNA, 22 nt, Human
ugucucugggugauucaguccu

SEQ ID NO: 817044 - RNA, 22 nt, Human
ugaaggccagcucuuuaucagc

SEQ ID NO: 817045 - RNA, 22 nt, Human
uuugaaagggacaaagucacug

SEQ ID NO: 817046 - RNA, 22 nt, Human
uuucaucuucccagagaccuug

SEQ ID NO: 817047 - RNA, 22 nt, Human
cuccaugaauuugagcuuugug

SEQ ID NO: 817048 - RNA, 22 nt, Human
ggugguggagccagcugggagu

SEQ ID NO: 817049 - RNA, 21 nt, Human
auuucagagcacacaaguaaa

SEQ ID NO: 817050 - RNA, 22 nt, Human
uagcacaucuggcgcuuauagg

SEQ ID NO: 817051 - RNA, 22 nt, Human
uccaggagucuagccucaggcc

SEQ ID NO: 817052 - RNA, 22 nt, Human
cccauucauccucgcuuccuuc

SEQ ID NO: 817053 - RNA, 17 nt, Human
gucauucucagaaaaug

SEQ ID NO: 817054 - RNA, 22 nt, Human
ucacaaauauuuuaacaguagg

SEQ ID NO: 817055 - RNA, 22 nt, Human
ugaaaugagagcacagaauaaa

SEQ ID NO: 817056 - RNA, 22 nt, Human
cagacaggguccuguccgucac

SEQ ID NO: 817057 - RNA, 22 nt, Human
gaagaggaugacaggagccggu

SEQ ID NO: 817058 - RNA, 22 nt, Human
ugaaaugaaugugauucgauag

SEQ ID NO: 817059 - RNA, 22 nt, Human
cugcugugcauauuuaucuagg

SEQ ID NO: 817060 - RNA, 22 nt, Human
acauuuaaauaccuauguuucu

SEQ ID NO: 817061 - RNA, 22 nt, Human
cuucucagaucucagcuuugag

SEQ ID NO: 817062 - RNA, 20 nt, Human
guaaaauauggucuuugggu

SEQ ID NO: 817063 - RNA, 22 nt, Human
ucucuguaguugggcagcugcu

SEQ ID NO: 817064 - RNA, 22 nt, Human
gcagaggggaagcugaggaauu

SEQ ID NO: 817065 - RNA, 19 nt, Human
augucuggguaacagcugc

SEQ ID NO: 817066 - RNA, 22 nt, Human
agacaggagagggaacugccgg

SEQ ID NO: 817067 - RNA, 22 nt, Human
acauuguuugagaauacagaug

SEQ ID NO: 817068 - RNA, 22 nt, Human
aggugagggugccagugcaugg

SEQ ID NO: 817069 - RNA, 22 nt, Human
uuucacauaugguuguugauug

SEQ ID NO: 817070 - RNA, 22 nt, Human
aauuuccaaauuucugucacac

SEQ ID NO: 817071 - RNA, 22 nt, Human
ucucaggaaauaggauuugagu

SEQ ID NO: 817072 - RNA, 22 nt, Human
aggagggagaugcccauccugg

SEQ ID NO: 817073 - RNA, 22 nt, Human
ggagcggagggagggccacugu

SEQ ID NO: 817074 - RNA, 22 nt, Human
caggaaugaggucguaaguguc

SEQ ID NO: 817075 - RNA, 22 nt, Human
uucaggauccccuugaugggcu

SEQ ID NO: 817076 - RNA, 22 nt, Human
uggcagcugguacagugggucu

SEQ ID NO: 817077 - RNA, 22 nt, Human
cccaggaggcagagguuggagc

SEQ ID NO: 817078 - RNA, 22 nt, Human
accaggagccacaggaggagcc

SEQ ID NO: 817079 - RNA, 22 nt, Human
uuucagcugguaaaggaguagc

SEQ ID NO: 817080 - RNA, 22 nt, Human
cuggcuuucucugugguguuca

SEQ ID NO: 817081 - RNA, 22 nt, Human
ccagcagagcauggggaggaag

SEQ ID NO: 817082 - RNA, 22 nt, Human
gcagcuaccacccaggaaggac

SEQ ID NO: 817083 - RNA, 22 nt, Human
agugagggaugaagaacugcgg

SEQ ID NO: 817084 - RNA, 22 nt, Human
ccacugaggcaggcaguaucua

SEQ ID NO: 817085 - RNA, 22 nt, Human
ugauugaacugagcuucaagau

SEQ ID NO: 817086 - RNA, 22 nt, Human
agaggggaaguaaugaaugaua

SEQ ID NO: 817087 - RNA, 22 nt, Human
cuucaugcugauauccucgaug

SEQ ID NO: 817088 - RNA, 22 nt, Human
cagcugcuuuaguuuuccaucc

SEQ ID NO: 817089 - RNA, 22 nt, Human
ugaggcaggaguuaaugugcuc

SEQ ID NO: 817090 - RNA, 22 nt, Human
ggaggaugccaagcugugcaca

SEQ ID NO: 817091 - RNA, 22 nt, Human
ucuacagacagagcagguggga

SEQ ID NO: 817092 - RNA, 22 nt, Human
guucuucaucauuuuagauagg

SEQ ID NO: 817093 - RNA, 22 nt, Human
cucccaggacucagaggagaag

SEQ ID NO: 817094 - RNA, 22 nt, Human
uuaagauagaacccaguagucu

SEQ ID NO: 817095 - RNA, 20 nt, Human
gaguuccccauuucuccugg

SEQ ID NO: 817096 - RNA, 22 nt, Human
gaggggaaagugugaggcugcg

SEQ ID NO: 817097 - RNA, 22 nt, Human
ccaggaguggcuggugaccuuc

SEQ ID NO: 817098 - RNA, 22 nt, Human
cagggaggcugucuuaugccug

SEQ ID NO: 817099 - RNA, 22 nt, Human
ucuucaauuagauuuaccaauu

SEQ ID NO: 817100 - RNA, 22 nt, Human
cccaggaacagggcucagaccc

SEQ ID NO: 817101 - RNA, 22 nt, Human
gcugcugucacggugcuaaggg

SEQ ID NO: 817102 - RNA, 22 nt, Human
aaacauuugcaacucgguuugg

SEQ ID NO: 817103 - RNA, 22 nt, Human
uuugacaaaggaaaaaugcaca

SEQ ID NO: 817104 - RNA, 22 nt, Human
aggcaagcccccagugaggcuc

SEQ ID NO: 817105 - RNA, 22 nt, Human
cauuuguaguuaaaaaugucuc

SEQ ID NO: 817106 - RNA, 22 nt, Human
ucuuuccaaggacucuguagca

SEQ ID NO: 817107 - RNA, 22 nt, Human
agagggagcccagucauagcug

SEQ ID NO: 817108 - RNA, 22 nt, Human
acaguuaucuuugaaauagaga

SEQ ID NO: 817109 - RNA, 20 nt, Human
aagcacauuucuacaauaau

SEQ ID NO: 817110 - RNA, 22 nt, Human
caaggccaagguuuugugaacu

SEQ ID NO: 817111 - RNA, 22 nt, Human
uucuucuucaagugcugcauuc

SEQ ID NO: 817112 - RNA, 22 nt, Human
ugaggcagccugcauuaaagag

SEQ ID NO: 817113 - RNA, 22 nt, Human
cagcugccccuccagggcuggg

SEQ ID NO: 817114 - RNA, 23 nt, Human
uuugaaaguaucaacucgccuga

SEQ ID NO: 817115 - RNA, 22 nt, Human
gaaggccauuuuuagguagaau

SEQ ID NO: 817116 - RNA, 22 nt, Human
ucugaaagaagggcagucuuuu

SEQ ID NO: 817117 - RNA, 22 nt, Human
uucaggaucauuuguuuuaucu

SEQ ID NO: 817118 - RNA, 22 nt, Human
gccaggagcccugggcaaguuc

SEQ ID NO: 817119 - RNA, 19 nt, Human
caggaaggggcgaaucugg

SEQ ID NO: 817120 - RNA, 22 nt, Human
gagggagugccagagggccagc

SEQ ID NO: 817121 - RNA, 22 nt, Human
cauuuuaaaugauuuaagccaa

SEQ ID NO: 817122 - RNA, 22 nt, Human
gggagucugggcuagacuccuu

SEQ ID NO: 817123 - RNA, 22 nt, Human
gaggcagcagggcugguuccuu

SEQ ID NO: 817124 - RNA, 22 nt, Human
ucauuauuuuggacuggagugu

SEQ ID NO: 817125 - RNA, 22 nt, Human
ucccaggaagaucccagggacc

SEQ ID NO: 817126 - RNA, 22 nt, Human
ucucaggaauagaguggcagca

SEQ ID NO: 817127 - RNA, 21 nt, Human
cccacggaaugaugaggcacu

SEQ ID NO: 817128 - RNA, 20 nt, Human
cugcugugguccuuuauuuu

SEQ ID NO: 817129 - RNA, 22 nt, Human
uugaaauacugcauuguucagu

SEQ ID NO: 817130 - RNA, 22 nt, Human
uaucuguuccaggcacucagcu

SEQ ID NO: 817131 - RNA, 22 nt, Human
caggaaaggugugucaugaugg

SEQ ID NO: 817132 - RNA, 22 nt, Human
aggaagcuagagccaccggacu

SEQ ID NO: 817133 - RNA, 22 nt, Human
aggguagguguaagauagcccu

SEQ ID NO: 817134 - RNA, 22 nt, Human
uguacauacauagauauacaca

SEQ ID NO: 817135 - RNA, 22 nt, Human
ucugggaaugaauaagaccugu

SEQ ID NO: 817136 - RNA, 22 nt, Human
cuacuucuaaguacauggugau

SEQ ID NO: 817137 - RNA, 22 nt, Human
uuucuagggcucuugucuucug

SEQ ID NO: 817138 - RNA, 22 nt, Human
caaauacuggguaaguuaauuu

SEQ ID NO: 817139 - RNA, 22 nt, Human
ugaguuuuuucaacauaugaag

SEQ ID NO: 817140 - RNA, 22 nt, Human
uacacacagaggccaugggauu

SEQ ID NO: 817141 - RNA, 22 nt, Human
cccaggaggcggagguuguggu

SEQ ID NO: 817142 - RNA, 22 nt, Human
ggguggaguagaaagaugaauu

SEQ ID NO: 817143 - RNA, 21 nt, Human
uucaaaaugguguguuugucu

SEQ ID NO: 817144 - RNA, 22 nt, Human
acauuuuuuagagucccacauu

SEQ ID NO: 817145 - RNA, 22 nt, Human
ugaaaugauaucugauaacaaa

SEQ ID NO: 817146 - RNA, 22 nt, Human
uucuucuugucugcccucacau

SEQ ID NO: 817147 - RNA, 22 nt, Human
auucugauaucuuauucuagcu

SEQ ID NO: 817148 - RNA, 22 nt, Human
gggcagcuguaucugagcuuau

SEQ ID NO: 817149 - RNA, 18 nt, Human
ccucagggagagagacgc

SEQ ID NO: 817150 - RNA, 22 nt, Human
ugaaugaguuuggcugcuguuc

SEQ ID NO: 817151 - RNA, 21 nt, Human
gugcuuuuccuuaauguucuu

SEQ ID NO: 817152 - RNA, 23 nt, Human
cuuuuaacuagaguaucagcugc

SEQ ID NO: 817153 - RNA, 22 nt, Human
uaugccugauaacugugucucu

SEQ ID NO: 817154 - RNA, 18 nt, Human
gagucuuuguuacugcug

SEQ ID NO: 817155 - RNA, 22 nt, Human
caguucuuaauaccaugugguu

SEQ ID NO: 817156 - RNA, 22 nt, Human
ccagaccacccuggccaugcac

SEQ ID NO: 817157 - RNA, 22 nt, Human
ugauuuccuaggucuggagaag

SEQ ID NO: 817158 - RNA, 19 nt, Human
cuugcugggugguuucugc

SEQ ID NO: 817159 - RNA, 23 nt, Human
ggcagcucucaucugaugacuga

SEQ ID NO: 817160 - RNA, 22 nt, Human
uugaagaggacuuugcagcugu

SEQ ID NO: 817161 - RNA, 22 nt, Human
aaauuagucgguuuaggaauuu

SEQ ID NO: 817162 - RNA, 22 nt, Human
aggcagagcuggguuuugaaau

SEQ ID NO: 817163 - RNA, 22 nt, Human
ugaguucuaguggcugcagauu

SEQ ID NO: 817164 - RNA, 22 nt, Human
ucaauucugguccucaggaacu

SEQ ID NO: 817165 - RNA, 22 nt, Human
aggccagcucuacccuuggacu

SEQ ID NO: 817166 - RNA, 22 nt, Human
ggcagcuggggcagugcccugu

SEQ ID NO: 817167 - RNA, 22 nt, Human
uacugcaugguggaguggagcu

SEQ ID NO: 817168 - RNA, 22 nt, Human
ggaggacacuggcucugccuuc

SEQ ID NO: 817169 - RNA, 22 nt, Human
aaaggugacugcagcagcuauu

SEQ ID NO: 817170 - RNA, 22 nt, Human
aaggcaguagguguuucaaacu

SEQ ID NO: 817171 - RNA, 22 nt, Human
aaauuauucucauguguuucuu

SEQ ID NO: 817172 - RNA, 22 nt, Human
ggcaucuccaaaacaugaacuc

SEQ ID NO: 817173 - RNA, 22 nt, Human
gagggaugguaguugacacuga

SEQ ID NO: 817174 - RNA, 22 nt, Human
gaugccuccaaaugagggcaga

SEQ ID NO: 817175 - RNA, 22 nt, Human
ggccaggagcugcacagggcuc

SEQ ID NO: 817176 - RNA, 22 nt, Human
agaaaacuugucacagcucuca

SEQ ID NO: 817177 - RNA, 22 nt, Human
cucccaggggaacuaucaagua

SEQ ID NO: 817178 - RNA, 22 nt, Human
gcaggagaacaaagcaagcugc

SEQ ID NO: 817179 - RNA, 22 nt, Human
aagacuguacauuuuccagucu

SEQ ID NO: 817180 - RNA, 22 nt, Human
aggagagaauguuccaggcuug

SEQ ID NO: 817181 - RNA, 22 nt, Human
cuggccagcugacagcagggcu

SEQ ID NO: 817182 - RNA, 22 nt, Human
ucaggagacauucuuaaaguag

SEQ ID NO: 817183 - RNA, 22 nt, Human
ccagcagagucuaggaaggagg

SEQ ID NO: 817184 - RNA, 22 nt, Human
aaggcagcagugcacgacugau

SEQ ID NO: 817185 - RNA, 22 nt, Human
ucaggagagaaagaauacaauu

SEQ ID NO: 817186 - RNA, 22 nt, Human
gauggcagcauauugacagcau

SEQ ID NO: 817187 - RNA, 22 nt, Human
gugggagcuuuggcaucaggcu

SEQ ID NO: 817188 - RNA, 22 nt, Human
uggcuguguuaccacuucaugu

SEQ ID NO: 817189 - RNA, 22 nt, Human
auuugcuucugugaaaucaagu

SEQ ID NO: 817190 - RNA, 22 nt, Human
auuauucuuaugucaucauggc

SEQ ID NO: 817191 - RNA, 22 nt, Human
uuugacauuauccuguuacugg

SEQ ID NO: 817192 - RNA, 23 nt, Human
uuucuucagaagccuugcgaggc

SEQ ID NO: 817193 - RNA, 22 nt, Human
cuagccugggauuugaacuuau

SEQ ID NO: 817194 - RNA, 22 nt, Human
uuugaacuucuaccugucauau

SEQ ID NO: 817195 - RNA, 22 nt, Human
cagcucugaggaacacuccuuu

SEQ ID NO: 817196 - RNA, 22 nt, Human
gaggggaagacuucuggacagu

SEQ ID NO: 817197 - RNA, 22 nt, Human
uccuucuuucccccuagucauu

SEQ ID NO: 817198 - RNA, 22 nt, Human
agaaaugaagcaggaguuauua

SEQ ID NO: 817199 - RNA, 22 nt, Human
gcacagcucgagcucaggaggg

SEQ ID NO: 817200 - RNA, 22 nt, Human
cggagggguuugaacagaggag

SEQ ID NO: 817201 - RNA, 22 nt, Human
cagcuccugaggacugcuggga

SEQ ID NO: 817202 - RNA, 22 nt, Human
cagaaccaggaacugauggaga

SEQ ID NO: 817203 - RNA, 22 nt, Human
uggaaugacagagagucugaau

SEQ ID NO: 817204 - RNA, 22 nt, Human
uuugaauagcauaggauuacau

SEQ ID NO: 817205 - RNA, 22 nt, Human
caacugugaauuuuaugauacc

SEQ ID NO: 817206 - RNA, 22 nt, Human
auaucaguaucuauguauuugu

SEQ ID NO: 817207 - RNA, 22 nt, Human
uccaggagugcugguuagagua

SEQ ID NO: 817208 - RNA, 22 nt, Human
agucucuuuaaucacagugucu

SEQ ID NO: 817209 - RNA, 22 nt, Human
caggcagcucugcuuuuccuaa

SEQ ID NO: 817210 - RNA, 22 nt, Human
uucuaugccauguucagcuacu

SEQ ID NO: 817211 - RNA, 23 nt, Human
ucagagagcuguugagagcugcc

SEQ ID NO: 817212 - RNA, 22 nt, Human
aggcagugcugugcccugaacc

SEQ ID NO: 817213 - RNA, 18 nt, Human
uugagggaggggcagagu

SEQ ID NO: 817214 - RNA, 22 nt, Human
cugcugugcuuguggccacccg

SEQ ID NO: 817215 - RNA, 22 nt, Human
gcacaauuauuuaugcaguaug

SEQ ID NO: 817216 - RNA, 22 nt, Human
uuucaguuguccuguuaauagc

SEQ ID NO: 817217 - RNA, 22 nt, Human
aggcagcuuaagcccuggccca

SEQ ID NO: 817218 - RNA, 22 nt, Human
agcccaggaaucugcaucuuga

SEQ ID NO: 817219 - RNA, 22 nt, Human
aguggcagagguugacugcagu

SEQ ID NO: 817220 - RNA, 23 nt, Human
aggcccaacucugugagggcugc

SEQ ID NO: 817221 - RNA, 22 nt, Human
caggagaggcuguacguuucuc

SEQ ID NO: 817222 - RNA, 22 nt, Human
uuuggacuuagccugcagaauu

SEQ ID NO: 817223 - RNA, 22 nt, Human
aggcagcugugaggacuggauu

SEQ ID NO: 817224 - RNA, 23 nt, Human
agaugaggcuucuccauguuggu

SEQ ID NO: 817225 - RNA, 22 nt, Human
cuucuucauguauugauagucu

SEQ ID NO: 817226 - RNA, 22 nt, Human
aagauggaguaguguaaugguu

SEQ ID NO: 817227 - RNA, 22 nt, Human
uugaaaguuuauggagucugca

SEQ ID NO: 817228 - RNA, 22 nt, Human
ucagugcacagagauuuuuguu

SEQ ID NO: 817229 - RNA, 22 nt, Human
aagggcaggaaaagauggaugu

SEQ ID NO: 817230 - RNA, 22 nt, Human
gcucucuuuuuccagugguggu

SEQ ID NO: 817231 - RNA, 22 nt, Human
ccucagggaaugggaggcuggg

SEQ ID NO: 817232 - RNA, 22 nt, Human
caguugcuggaugugcagcucu

SEQ ID NO: 817233 - RNA, 22 nt, Human
uuccaugacaccgagggaaguc

SEQ ID NO: 817234 - RNA, 22 nt, Human
aaaguauucuugacuguuuuuc

SEQ ID NO: 817235 - RNA, 22 nt, Human
aauuuguuaaaagugagugaca

SEQ ID NO: 817236 - RNA, 22 nt, Human
ucucaggaagugauauugagac

SEQ ID NO: 817237 - RNA, 16 nt, Human
aggaggggaauuagga

SEQ ID NO: 817238 - RNA, 21 nt, Human
agacaguaacucuucuacucc

SEQ ID NO: 817239 - RNA, 22 nt, Human
cucaggauauugggcuggagca

SEQ ID NO: 817240 - RNA, 22 nt, Human
uuugaaagccuggcuuuucucu

SEQ ID NO: 817241 - RNA, 22 nt, Human
ugaggcagcuuuuucugugugu

SEQ ID NO: 817242 - RNA, 18 nt, Human
ugagaggcagguagagga

SEQ ID NO: 817243 - RNA, 23 nt, Human
cagaaaacccagagcucaguccc

SEQ ID NO: 817244 - RNA, 23 nt, Human
acuauaaaguuguucugauuuac

SEQ ID NO: 817245 - RNA, 22 nt, Human
uucaaauacauucuuugccacu

SEQ ID NO: 817246 - RNA, 22 nt, Human
cucaacagcucugccauacucc

SEQ ID NO: 817247 - RNA, 22 nt, Human
augcugugagugugccgcagag

SEQ ID NO: 817248 - RNA, 19 nt, Human
uaaggccaaaaguaagugu

SEQ ID NO: 817249 - RNA, 22 nt, Human
cccuugcaucccauguguggcc

SEQ ID NO: 817250 - RNA, 23 nt, Human
aggauguaggauguauggcagag

SEQ ID NO: 817251 - RNA, 22 nt, Human
auggaaagggaagcaaggaaca

SEQ ID NO: 817252 - RNA, 22 nt, Human
uuaaauauuuucagcaggguca

SEQ ID NO: 817253 - RNA, 22 nt, Human
caaaugauaccuauuacuaggc

SEQ ID NO: 817254 - RNA, 22 nt, Human
cccaugagguggagguugcagu

SEQ ID NO: 817255 - RNA, 22 nt, Human
caaggccagagccagcgauaag

SEQ ID NO: 817256 - RNA, 22 nt, Human
agucugucugucacuucugcag

SEQ ID NO: 817257 - RNA, 22 nt, Human
aguccuuugggaaaaaugacua

SEQ ID NO: 817258 - RNA, 22 nt, Human
gcucaggagcucuugguggcgc

SEQ ID NO: 817259 - RNA, 22 nt, Human
cuugcugucuugcauuuagagc

SEQ ID NO: 817260 - RNA, 22 nt, Human
uuaaaauagccagugccccucu

SEQ ID NO: 817261 - RNA, 22 nt, Human
caaggccagggaauuuuucugg

SEQ ID NO: 817262 - RNA, 22 nt, Human
aucacaaaggcugcuucaugau

SEQ ID NO: 817263 - RNA, 20 nt, Human
ugaggcaggagaauggcaug

SEQ ID NO: 817264 - RNA, 22 nt, Human
cugagacuuucaugugcuuuua

SEQ ID NO: 817265 - RNA, 22 nt, Human
aggaugaggcuggcaggucuug

SEQ ID NO: 817266 - RNA, 22 nt, Human
ugcacagugaccccuggugacu

SEQ ID NO: 817267 - RNA, 22 nt, Human
ucagcugcucaaauuuauguca

SEQ ID NO: 817268 - RNA, 22 nt, Human
augcuuuuaugucacaugguca

SEQ ID NO: 817269 - RNA, 22 nt, Human
ucauucuugaucacuaguuagu

SEQ ID NO: 817270 - RNA, 22 nt, Human
gcagagaagaugcccaggcuuc

SEQ ID NO: 817271 - RNA, 23 nt, Human
agggugagcaagcuauggagacc

SEQ ID NO: 817272 - RNA, 22 nt, Human
cacaugugugcugaggacugug

SEQ ID NO: 817273 - RNA, 22 nt, Human
gauuucuuuagguguaauagug

SEQ ID NO: 817274 - RNA, 22 nt, Human
uccaggagacacccuugugugu

SEQ ID NO: 817275 - RNA, 22 nt, Human
cccaggagguggagcuugcagu

SEQ ID NO: 817276 - RNA, 22 nt, Human
ucuucagauggccaguuguccc

SEQ ID NO: 817277 - RNA, 22 nt, Human
gaggcagugcauugucuagggg

SEQ ID NO: 817278 - RNA, 22 nt, Human
uugcuucaguagcucuuuaaag

SEQ ID NO: 817279 - RNA, 22 nt, Human
ggagagugggagcaacuguugc

SEQ ID NO: 817280 - RNA, 22 nt, Human
uucuucaguuugguaaauguaa

SEQ ID NO: 817281 - RNA, 22 nt, Human
cugagccagcuggcaugugcua

SEQ ID NO: 817282 - RNA, 22 nt, Human
ucugaaaugcaaauuugacuga

SEQ ID NO: 817283 - RNA, 22 nt, Human
uuuaacagaugcuaugucuacc

SEQ ID NO: 817284 - RNA, 22 nt, Human
aaaggccaagcaugagguggac

SEQ ID NO: 817285 - RNA, 22 nt, Human
cauuuuaagaugaccugguuuc

SEQ ID NO: 817286 - RNA, 22 nt, Human
auuuagaacuuuguuugccaau

SEQ ID NO: 817287 - RNA, 22 nt, Human
auuaaaauuccaagguaugcca

SEQ ID NO: 817288 - RNA, 22 nt, Human
uuugaaaggaauuaggaugaca

SEQ ID NO: 817289 - RNA, 22 nt, Human
auuggcaggaaccgaggagggg

SEQ ID NO: 817290 - RNA, 19 nt, Human
guugaaaguaggugagggu

SEQ ID NO: 817291 - RNA, 22 nt, Human
ugccugugguuccaguuuuuuc

SEQ ID NO: 817292 - RNA, 22 nt, Human
cuucagaauccagaaucagaau

SEQ ID NO: 817293 - RNA, 22 nt, Human
aucaggaugacaacugcugggu

SEQ ID NO: 817294 - RNA, 22 nt, Human
caaggccacguucugcaugcgg

SEQ ID NO: 817295 - RNA, 22 nt, Human
uucaucaauguguuuaauaaug

SEQ ID NO: 817296 - RNA, 22 nt, Human
uacaacauuguguugcuucaua

SEQ ID NO: 817297 - RNA, 22 nt, Human
aggaagcugcuggaguagugug

SEQ ID NO: 817298 - RNA, 22 nt, Human
gcccaggaguuggaggcugcag

SEQ ID NO: 817299 - RNA, 22 nt, Human
cugcugugggcaggguagcugg

SEQ ID NO: 817300 - RNA, 22 nt, Human
gagagcuggguucaaguagcug

SEQ ID NO: 817301 - RNA, 22 nt, Human
cauugcuguuaauugucucuag

SEQ ID NO: 817302 - RNA, 22 nt, Human
uuauuucauguaaaauuuaugu

SEQ ID NO: 817303 - RNA, 22 nt, Human
aagggcagagggaaucccacau

SEQ ID NO: 817304 - RNA, 22 nt, Human
gagugcagaugccagccccagu

SEQ ID NO: 817305 - RNA, 22 nt, Human
uuugaauaucacaaacuuucaa

SEQ ID NO: 817306 - RNA, 22 nt, Human
aaaggugacacucugccagcug

SEQ ID NO: 817307 - RNA, 22 nt, Human
ugaaucaguauaaauucucaaa

SEQ ID NO: 817308 - RNA, 22 nt, Human
cagagagggcggcccuggcuuc

SEQ ID NO: 817309 - RNA, 22 nt, Human
ggaggaugagcuacgaggagcu

SEQ ID NO: 817310 - RNA, 22 nt, Human
ucacaguaucacacaaggauua

SEQ ID NO: 817311 - RNA, 22 nt, Human
gugguuuucuccaacccagaac

SEQ ID NO: 817312 - RNA, 22 nt, Human
uuuccuaggagauugaucacau

SEQ ID NO: 817313 - RNA, 22 nt, Human
cuugcuucauuagugucuuagu

SEQ ID NO: 817314 - RNA, 19 nt, Human
cccaggagcaguauugaug

SEQ ID NO: 817315 - RNA, 22 nt, Human
gucccaggugggcuccaccucu

SEQ ID NO: 817316 - RNA, 22 nt, Human
uuuuaguguagucaccgugggu

SEQ ID NO: 817317 - RNA, 22 nt, Human
aaggcagcaccgccuccugaaa

SEQ ID NO: 817318 - RNA, 22 nt, Human
ucugcuguauuagguugaacug

SEQ ID NO: 817319 - RNA, 22 nt, Human
ucagucuuugcuuaugacaaua

SEQ ID NO: 817320 - RNA, 22 nt, Human
auugaaagaguuuucugcugca

SEQ ID NO: 817321 - RNA, 22 nt, Human
uuugcaauuugugcugcaaaug

SEQ ID NO: 817322 - RNA, 22 nt, Human
ugcuuugggucucucuaguuuc

SEQ ID NO: 817323 - RNA, 22 nt, Human
agugcagcaugcuggggaggcu

SEQ ID NO: 817324 - RNA, 22 nt, Human
gcagaggccaggccaccagcaa

SEQ ID NO: 817325 - RNA, 22 nt, Human
uuucucaguuacuagcuguggu

SEQ ID NO: 817326 - RNA, 22 nt, Human
auuuaaauuuucugauggagag

SEQ ID NO: 817327 - RNA, 22 nt, Human
ucuuuucaucauuuaauaggua

SEQ ID NO: 817328 - RNA, 22 nt, Human
cagucucagaggugggaguggg

SEQ ID NO: 817329 - RNA, 22 nt, Human
cuucucagcaugguuacuguga

SEQ ID NO: 817330 - RNA, 22 nt, Human
uggcagcuggaucccaaggcag

SEQ ID NO: 817331 - RNA, 22 nt, Human
aguguuugagacacauuucacu

SEQ ID NO: 817332 - RNA, 22 nt, Human
gugucccaggccucuggaauua

SEQ ID NO: 817333 - RNA, 22 nt, Human
aggcagcauuugaauccagguc

SEQ ID NO: 817334 - RNA, 23 nt, Human
aaauuauugcucuucaauugccu

SEQ ID NO: 817335 - RNA, 22 nt, Human
gaaaggugccccauaggcagga

SEQ ID NO: 817336 - RNA, 22 nt, Human
uucuagaugauaaaccagcagc

SEQ ID NO: 817337 - RNA, 22 nt, Human
ggaggagggguuuacauuggaa

SEQ ID NO: 817338 - RNA, 22 nt, Human
gagaggcaggcgcugcaauggu

SEQ ID NO: 817339 - RNA, 22 nt, Human
cuucucaaaguugugaaucagg

SEQ ID NO: 817340 - RNA, 22 nt, Human
aguaaagcagaguugcaguaca

SEQ ID NO: 817341 - RNA, 22 nt, Human
gaggagaggccaucguuguuau

SEQ ID NO: 817342 - RNA, 22 nt, Human
caguuuuugccauuaagaguaa

SEQ ID NO: 817343 - RNA, 22 nt, Human
ugucccucugaggcuucccugg

SEQ ID NO: 817344 - RNA, 22 nt, Human
acccaggaaaacauggugcaga

SEQ ID NO: 817345 - RNA, 22 nt, Human
uucuccagaccuugugacuaug

SEQ ID NO: 817346 - RNA, 22 nt, Human
auccaugaucaauuuauuacua

SEQ ID NO: 817347 - RNA, 22 nt, Human
cauagagugauguaagguaugu

SEQ ID NO: 817348 - RNA, 22 nt, Human
ggaggggaugguuugacccugg

SEQ ID NO: 817349 - RNA, 22 nt, Human
aucuuucuccauauacaucuuu

SEQ ID NO: 817350 - RNA, 22 nt, Human
ucugcagggaugugagggguga

SEQ ID NO: 817351 - RNA, 22 nt, Human
uucaggauaguggugaguggca

SEQ ID NO: 817352 - RNA, 22 nt, Human
ucacaugaguauuauuuuccaa

SEQ ID NO: 817353 - RNA, 22 nt, Human
ucuucagacccuuagcugugau

SEQ ID NO: 817354 - RNA, 22 nt, Human
ucugguaaccuuuaucccuccu

SEQ ID NO: 817355 - RNA, 22 nt, Human
aucacauugccagugauuaccc

SEQ ID NO: 817356 - RNA, 22 nt, Human
ucagucuucccuccagugcaac

SEQ ID NO: 817357 - RNA, 22 nt, Human
cacauuuaauccuuuauaagua

SEQ ID NO: 817358 - RNA, 22 nt, Human
ccaggaugacccccacuuuccu

SEQ ID NO: 817359 - RNA, 20 nt, Human
gcagcuacucugucucgcuc

SEQ ID NO: 817360 - RNA, 22 nt, Human
cacccugggcugggccuguuaa

SEQ ID NO: 817361 - RNA, 22 nt, Human
uccaggagcauccaggugaagc

SEQ ID NO: 817362 - RNA, 22 nt, Human
gaggggaaaguucugcacaagg

SEQ ID NO: 817363 - RNA, 22 nt, Human
ucccaggaauugaagccagugu

SEQ ID NO: 817364 - RNA, 22 nt, Human
cucuucuuauggccguggcuga

SEQ ID NO: 817365 - RNA, 23 nt, Human
gaggcacucaggaaaugugagug

SEQ ID NO: 817366 - RNA, 22 nt, Human
gcucccagacugaccagaggug

SEQ ID NO: 817367 - RNA, 22 nt, Human
uuauacuaaaacgcauugaauu

SEQ ID NO: 817368 - RNA, 21 nt, Human
uucuucaaagaagaaggcaca

SEQ ID NO: 817369 - RNA, 19 nt, Human
caaggccaccauuucuccg

SEQ ID NO: 817370 - RNA, 22 nt, Human
ugugauauuugaguauugucaa

SEQ ID NO: 817371 - RNA, 22 nt, Human
aggccagccucaggcagggacc

SEQ ID NO: 817372 - RNA, 22 nt, Human
ucacaaaugaggaaaucgagca

SEQ ID NO: 817373 - RNA, 22 nt, Human
uaaaaugaucucucauguucuu

SEQ ID NO: 817374 - RNA, 22 nt, Human
caggauggugugagugugagga

SEQ ID NO: 817375 - RNA, 22 nt, Human
uauuucuucgggauucaagcua

SEQ ID NO: 817376 - RNA, 22 nt, Human
caguggagagacuuuuacucuu

SEQ ID NO: 817377 - RNA, 22 nt, Human
ggccagaggugguacauagcuu

SEQ ID NO: 817378 - RNA, 22 nt, Human
aaggagagguuguccguguugu

SEQ ID NO: 817379 - RNA, 22 nt, Human
aaggccagaguacuagaggcug

SEQ ID NO: 817380 - RNA, 22 nt, Human
uccaggaguggggcagaggucu

SEQ ID NO: 817381 - RNA, 22 nt, Human
augcuguggaugccuugcccca

SEQ ID NO: 817382 - RNA, 22 nt, Human
ucucagucuuugcaaggaugcu

SEQ ID NO: 817383 - RNA, 21 nt, Human
agccuguugguuuacugcuca

SEQ ID NO: 817384 - RNA, 22 nt, Human
ggccagagaauaugccuuacgu

SEQ ID NO: 817385 - RNA, 22 nt, Human
uuugaaguguuauuucuaucac

SEQ ID NO: 817386 - RNA, 22 nt, Human
ccaggagacaaagaugacugcu

SEQ ID NO: 817387 - RNA, 22 nt, Human
ggcacagagcccagcuuccuag

SEQ ID NO: 817388 - RNA, 22 nt, Human
ugaaggcccagccacagaaugg

SEQ ID NO: 817389 - RNA, 22 nt, Human
gaaggccacggaauggagcugg

SEQ ID NO: 817390 - RNA, 22 nt, Human
gugcuuuuaaaggcaauuagua

SEQ ID NO: 817391 - RNA, 22 nt, Human
ccucaggaaccacauugcugcu

SEQ ID NO: 817392 - RNA, 18 nt, Human
aauuuccauaugaauugc

SEQ ID NO: 817393 - RNA, 22 nt, Human
cccuggagguggagguugcagg

SEQ ID NO: 817394 - RNA, 22 nt, Human
uuuugcuugagugcacaaaaug

SEQ ID NO: 817395 - RNA, 22 nt, Human
ucugggaaguccucugucaugc

SEQ ID NO: 817396 - RNA, 21 nt, Human
uuucuuaggcucuaaaaugac

SEQ ID NO: 817397 - RNA, 21 nt, Human
ugcuggaaaaagugguucuag

SEQ ID NO: 817398 - RNA, 22 nt, Human
ugaggcagaaauuccuguuuuc

SEQ ID NO: 817399 - RNA, 22 nt, Human
uggcagcucccagagcuuccaa

SEQ ID NO: 817400 - RNA, 22 nt, Human
ugcuuucaaaggcuuucuagau

SEQ ID NO: 817401 - RNA, 22 nt, Human
aagaagagaaaugugcugcugg

SEQ ID NO: 817402 - RNA, 22 nt, Human
ucaugcuuauugcauauuugga

SEQ ID NO: 817403 - RNA, 22 nt, Human
auuugcaaagucguaucuguga

SEQ ID NO: 817404 - RNA, 22 nt, Human
aggcagcugcccucuccuuccu

SEQ ID NO: 817405 - RNA, 22 nt, Human
uucuucucggcugucagauagu

SEQ ID NO: 817406 - RNA, 22 nt, Human
cuuagcaugugguguccuugua

SEQ ID NO: 817407 - RNA, 22 nt, Human
aaguaaaauguuuccuuuauua

SEQ ID NO: 817408 - RNA, 22 nt, Human
uuccuuaguguuagauucugug

SEQ ID NO: 817409 - RNA, 22 nt, Human
ugcccacauggugccauggcca

SEQ ID NO: 817410 - RNA, 22 nt, Human
caggcagcugacugucagauau

SEQ ID NO: 817411 - RNA, 22 nt, Human
ugacauaauaauccaaacauac

SEQ ID NO: 817412 - RNA, 21 nt, Human
cucaggauggcggccuggugg

SEQ ID NO: 817413 - RNA, 22 nt, Human
gaggcugcuuugaugacaggag

SEQ ID NO: 817414 - RNA, 22 nt, Human
agaccaugggcucugaagagca

SEQ ID NO: 817415 - RNA, 22 nt, Human
gagguggaaggcaggaacaaau

SEQ ID NO: 817416 - RNA, 22 nt, Human
agaggccggccgagcccauggg

SEQ ID NO: 817417 - RNA, 22 nt, Human
aacugcuguggccuaguacuua

SEQ ID NO: 817418 - RNA, 21 nt, Human
ugaaaugagaaugcugagcac

SEQ ID NO: 817419 - RNA, 18 nt, Human
aaacuggcuuggccugug

SEQ ID NO: 817420 - RNA, 22 nt, Human
ugaggcagaaaauagcaguuca

SEQ ID NO: 817421 - RNA, 22 nt, Human
aggguggcaccuggaagggaug

SEQ ID NO: 817422 - RNA, 22 nt, Human
gaggccagaguuccccgaguca

SEQ ID NO: 817423 - RNA, 22 nt, Human
agaaaugaauauguagugguua

SEQ ID NO: 817424 - RNA, 22 nt, Human
uugaaggacauccuauuucuag

SEQ ID NO: 817425 - RNA, 22 nt, Human
acaggccacaguggagucucug

SEQ ID NO: 817426 - RNA, 22 nt, Human
gagaggcagaggccugaaaccg

SEQ ID NO: 817427 - RNA, 22 nt, Human
agcaccuguugcacuucauaau

SEQ ID NO: 817428 - RNA, 22 nt, Human
gccaggaguucagaugcauguu

SEQ ID NO: 817429 - RNA, 22 nt, Human
aucuccaggcauuucaagagac

SEQ ID NO: 817430 - RNA, 22 nt, Human
agccagcucccuccccugcagg

SEQ ID NO: 817431 - RNA, 22 nt, Human
aucaggauucaguaucuccagc

SEQ ID NO: 817432 - RNA, 22 nt, Human
uguaggccuauguccagcaauu

SEQ ID NO: 817433 - RNA, 22 nt, Human
cuauuacauuucuggacauuca

SEQ ID NO: 817434 - RNA, 20 nt, Human
agagcagcaguuggugaggu

SEQ ID NO: 817435 - RNA, 22 nt, Human
gcugcccauuccacuggauggu

SEQ ID NO: 817436 - RNA, 22 nt, Human
gagagucuagugcaccuaguuu

SEQ ID NO: 817437 - RNA, 22 nt, Human
cuguaguugaugauuucugaua

SEQ ID NO: 817438 - RNA, 22 nt, Human
uuugaaaucuaaucaaggaaca

SEQ ID NO: 817439 - RNA, 22 nt, Human
auugaaagcauggauuuggauu

SEQ ID NO: 817440 - RNA, 22 nt, Human
auuuccuuugcaaagacugugc

SEQ ID NO: 817441 - RNA, 22 nt, Human
cauggcugcgagaagagugggu

SEQ ID NO: 817442 - RNA, 22 nt, Human
auggaguucuuuaaauucacag

SEQ ID NO: 817443 - RNA, 22 nt, Human
cucaggauugugccuagggaga

SEQ ID NO: 817444 - RNA, 22 nt, Human
uuucuagucucgaucucuuaau

SEQ ID NO: 817445 - RNA, 22 nt, Human
ucauuuguugcuguuaccugag

SEQ ID NO: 817446 - RNA, 22 nt, Human
uuaaauuagucaagcuucucug

SEQ ID NO: 817447 - RNA, 22 nt, Human
aggcagcuuucuguaggggugu

SEQ ID NO: 817448 - RNA, 19 nt, Human
auacagauguauccaugau

SEQ ID NO: 817449 - RNA, 23 nt, Human
acagaaaguucugcuggacagag

SEQ ID NO: 817450 - RNA, 22 nt, Human
aaguggacuaauacaaggacua

SEQ ID NO: 817451 - RNA, 22 nt, Human
auacuguuucucuucuacauga

SEQ ID NO: 817452 - RNA, 22 nt, Human
gagggaggugauacugaacgua

SEQ ID NO: 817453 - RNA, 22 nt, Human
uuucaaaccuacuuguauguuu

SEQ ID NO: 817454 - RNA, 22 nt, Human
cuuuggcaaugucauuuucaau

SEQ ID NO: 817455 - RNA, 22 nt, Human
ccaugagacagcaacugaaagu

SEQ ID NO: 817456 - RNA, 22 nt, Human
ccuuaaauucuccauuugaaag

SEQ ID NO: 817457 - RNA, 22 nt, Human
caguaaagcauguaugucuuca

SEQ ID NO: 817458 - RNA, 22 nt, Human
uuccaugaaauguguuaugcuu

SEQ ID NO: 817459 - RNA, 22 nt, Human
cggaggggauacauuuucugaa

SEQ ID NO: 817460 - RNA, 21 nt, Human
aggcagcaggauccagggaca

SEQ ID NO: 817461 - RNA, 22 nt, Human
uuguugguggaauugaugcuag

SEQ ID NO: 817462 - RNA, 22 nt, Human
aggaagcugccugggaugggaa

SEQ ID NO: 817463 - RNA, 22 nt, Human
ucuaaagaagaggguucugcgg

SEQ ID NO: 817464 - RNA, 22 nt, Human
auuuguugcuagcagcacugau

SEQ ID NO: 817465 - RNA, 22 nt, Human
cugcugugucagaguccagggg

SEQ ID NO: 817466 - RNA, 22 nt, Human
uggcaucucaaacaggcagauu

SEQ ID NO: 817467 - RNA, 22 nt, Human
aaacugcugguugcuggccagc

SEQ ID NO: 817468 - RNA, 22 nt, Human
guuauaaaaugcacaguuguuu

SEQ ID NO: 817469 - RNA, 21 nt, Human
aucacauuggcuguuauuauu

SEQ ID NO: 817470 - RNA, 23 nt, Human
aggcgagcucuucuccagcacgu

SEQ ID NO: 817471 - RNA, 22 nt, Human
cagcaggauaugguggagagag

SEQ ID NO: 817472 - RNA, 22 nt, Human
cgaggcagggaagcugcaaaag

SEQ ID NO: 817473 - RNA, 22 nt, Human
aagacauugucauuuuauaauu

SEQ ID NO: 817474 - RNA, 22 nt, Human
uuuacaaccucauauucugaug

SEQ ID NO: 817475 - RNA, 22 nt, Human
augcaucuauucccaagggcag

SEQ ID NO: 817476 - RNA, 22 nt, Human
ccaggaaaauaccaagcuuuaa

SEQ ID NO: 817477 - RNA, 22 nt, Human
ucccaggacuuccaguuggagg

SEQ ID NO: 817478 - RNA, 22 nt, Human
ugcugaugaguccuucuaucgc

SEQ ID NO: 817479 - RNA, 22 nt, Human
gaaucucaguggaagcaggaag

SEQ ID NO: 817480 - RNA, 22 nt, Human
uauuugaaaguguacaaaaacu

SEQ ID NO: 817481 - RNA, 22 nt, Human
cuucagaagaaaagcagugugu

SEQ ID NO: 817482 - RNA, 22 nt, Human
ccugcuguucuguuuagugaac

SEQ ID NO: 817483 - RNA, 22 nt, Human
uccaugaggcagggaggcuggc

SEQ ID NO: 817484 - RNA, 22 nt, Human
gaggcagccagagguucucauu

SEQ ID NO: 817485 - RNA, 22 nt, Human
gcagaagucagaccaucugaau

SEQ ID NO: 817486 - RNA, 22 nt, Human
cuggcugugcugcaggcuuugg

SEQ ID NO: 817487 - RNA, 20 nt, Human
ccucaguguccuggacuggg

SEQ ID NO: 817488 - RNA, 22 nt, Human
uuugaaagcaccauuugaguag

SEQ ID NO: 817489 - RNA, 22 nt, Human
agucucuuuguggacucugccu

SEQ ID NO: 817490 - RNA, 22 nt, Human
uucacagacuuuccauagauug

SEQ ID NO: 817491 - RNA, 22 nt, Human
cccaggagaccugugaaaggac

SEQ ID NO: 817492 - RNA, 21 nt, Human
uuucacaaaaguaugugacaa

SEQ ID NO: 817493 - RNA, 22 nt, Human
cugcuguguaucauuuuagaug

SEQ ID NO: 817494 - RNA, 22 nt, Human
uaucuguugucuuuuacaugua

SEQ ID NO: 817495 - RNA, 22 nt, Human
uuuuucagccaugaauuacacu

SEQ ID NO: 817496 - RNA, 22 nt, Human
uugcucaggcuggugugcagug

SEQ ID NO: 817497 - RNA, 22 nt, Human
ucauuuguggaagugauugugg

SEQ ID NO: 817498 - RNA, 22 nt, Human
ggaugggagcagaggacgacca

SEQ ID NO: 817499 - RNA, 22 nt, Human
cagaccagcucuaugaacccaa

SEQ ID NO: 817500 - RNA, 22 nt, Human
cuguggaauugaugcuuagugu

SEQ ID NO: 817501 - RNA, 22 nt, Human
auguucuuguucaaaugucagu

SEQ ID NO: 817502 - RNA, 22 nt, Human
aggccagcacgacagccgcagg

SEQ ID NO: 817503 - RNA, 22 nt, Human
uucuucaacaaggacacuguua

SEQ ID NO: 817504 - RNA, 22 nt, Human
aucaggauagucuguaaauugu

SEQ ID NO: 817505 - RNA, 22 nt, Human
accaggagggacccugguggcc

SEQ ID NO: 817506 - RNA, 21 nt, Human
uucugggaaaugagcuggggc

SEQ ID NO: 817507 - RNA, 22 nt, Human
cccaggaguuagagguuguggu

SEQ ID NO: 817508 - RNA, 22 nt, Human
uagaaacaucagcuaaccaaaa

SEQ ID NO: 817509 - RNA, 22 nt, Human
gcuuugaagacuuuuccagggu

SEQ ID NO: 817510 - RNA, 22 nt, Human
agugcuuuaccuagauaauguu

SEQ ID NO: 817511 - RNA, 22 nt, Human
uucugggagagaaagggccuug

SEQ ID NO: 817512 - RNA, 22 nt, Human
agagggauggccccguaacuca

SEQ ID NO: 817513 - RNA, 22 nt, Human
aggacuuagaacauuauguacu

SEQ ID NO: 817514 - RNA, 22 nt, Human
accaggagucuagccuagucaa

SEQ ID NO: 817515 - RNA, 22 nt, Human
cauuguuauagcauuacacacc

SEQ ID NO: 817516 - RNA, 22 nt, Human
cccaggagauggugcguggucu

SEQ ID NO: 817517 - RNA, 22 nt, Human
gcugcccaggagagguggggcu

SEQ ID NO: 817518 - RNA, 22 nt, Human
cucuucuuuaguccagaccauc

SEQ ID NO: 817519 - RNA, 22 nt, Human
ugaagggggagauauaugugug

SEQ ID NO: 817520 - RNA, 22 nt, Human
cauauaaauacaacauguguua

SEQ ID NO: 817521 - RNA, 22 nt, Human
cagcuuucaucagugacacuca

SEQ ID NO: 817522 - RNA, 22 nt, Human
ggguggagaggcuaaguccagu

SEQ ID NO: 817523 - RNA, 22 nt, Human
aagcaccuggguuauaucuuag

SEQ ID NO: 817524 - RNA, 22 nt, Human
ugcugagguuucgucugcuugc

SEQ ID NO: 817525 - RNA, 22 nt, Human
ggaggggagauguuugggcuca

SEQ ID NO: 817526 - RNA, 22 nt, Human
uuaauuuuaaccuguuuguguc

SEQ ID NO: 817527 - RNA, 22 nt, Human
aucaggaucaugcuggguggga

SEQ ID NO: 817528 - RNA, 22 nt, Human
ugaggggaaggcaugauaaaua

SEQ ID NO: 817529 - RNA, 22 nt, Human
uuugacauuggcuuauucuguu

SEQ ID NO: 817530 - RNA, 22 nt, Human
cuugaacucaaugugaggaaga

SEQ ID NO: 817531 - RNA, 22 nt, Human
auguuucaccagcaaauuaccu

SEQ ID NO: 817532 - RNA, 22 nt, Human
gcccaggagguugggcugugca

SEQ ID NO: 817533 - RNA, 22 nt, Human
uucucagauccaucagaagucc

SEQ ID NO: 817534 - RNA, 22 nt, Human
acuuucugcaguguuggaaaug

SEQ ID NO: 817535 - RNA, 22 nt, Human
cuagcaucagaugagaagcugu

SEQ ID NO: 817536 - RNA, 19 nt, Human
ucaucucacagggccuggc

SEQ ID NO: 817537 - RNA, 22 nt, Human
uuucaacaccagagaccaugcg

SEQ ID NO: 817538 - RNA, 23 nt, Human
aggucagcaggcaaggaaauggc

SEQ ID NO: 817539 - RNA, 22 nt, Human
cagagccacuuggagaugagaa

SEQ ID NO: 817540 - RNA, 22 nt, Human
uugcucagcacuggagccagcu

SEQ ID NO: 817541 - RNA, 22 nt, Human
gcgcaggagccgcggagggccg

SEQ ID NO: 817542 - RNA, 22 nt, Human
cagaggcaggauaagaacugcg

SEQ ID NO: 817543 - RNA, 22 nt, Human
uacccaggagaaacagcagggc

SEQ ID NO: 817544 - RNA, 22 nt, Human
cuuugcaauagaggcacacaug

SEQ ID NO: 817545 - RNA, 22 nt, Human
agauggcagggguaccuggaag

SEQ ID NO: 817546 - RNA, 22 nt, Human
auuuaaaugcuuaagaggguuu

SEQ ID NO: 817547 - RNA, 22 nt, Human
auguggaggaaaugaguguaca

SEQ ID NO: 817548 - RNA, 21 nt, Human
uucucagaucgaguagugaga

SEQ ID NO: 817549 - RNA, 22 nt, Human
caggcagccugcggucugcaca

SEQ ID NO: 817550 - RNA, 22 nt, Human
auuuccagugcacugaauagaa

SEQ ID NO: 817551 - RNA, 22 nt, Human
aagaagagaacuggcauccuaa

SEQ ID NO: 817552 - RNA, 22 nt, Human
uggugguuaugcgcuuuguggg

SEQ ID NO: 817553 - RNA, 22 nt, Human
acucaggaaaugagaggcucuc

SEQ ID NO: 817554 - RNA, 22 nt, Human
cugcuguggugucaagcaucuc

SEQ ID NO: 817555 - RNA, 22 nt, Human
gugauuuucuccuccuagaagu

SEQ ID NO: 817556 - RNA, 20 nt, Human
aaacauucauguacaaguga

SEQ ID NO: 817557 - RNA, 22 nt, Human
guguguuuagcauuagcagggg

SEQ ID NO: 817558 - RNA, 20 nt, Human
accaggagauggaggcaggg

SEQ ID NO: 817559 - RNA, 22 nt, Human
ucgagcucuggagccaaggaug

SEQ ID NO: 817560 - RNA, 17 nt, Human
caggcagacauguaagc

SEQ ID NO: 817561 - RNA, 22 nt, Human
uucacagucacccuucuccaug

SEQ ID NO: 817562 - RNA, 22 nt, Human
agaaguuguagguuugcauauu

SEQ ID NO: 817563 - RNA, 22 nt, Human
cucacugugaccucagcagaca

SEQ ID NO: 817564 - RNA, 22 nt, Human
ucccuucacagaugcgauguuu

SEQ ID NO: 817565 - RNA, 22 nt, Human
uccaugagacagauacuguaag

SEQ ID NO: 817566 - RNA, 22 nt, Human
cuucuucacacuggucugaagc

SEQ ID NO: 817567 - RNA, 18 nt, Human
gagagggaucccucagga

SEQ ID NO: 817568 - RNA, 17 nt, Human
cauuuguugaucaguug

SEQ ID NO: 817569 - RNA, 22 nt, Human
auuuucagagacaucuggacuu

SEQ ID NO: 817570 - RNA, 22 nt, Human
gaggccaaguuggagaccaggu

SEQ ID NO: 817571 - RNA, 22 nt, Human
gagggcaguagccucguacccu

SEQ ID NO: 817572 - RNA, 20 nt, Human
agacaggagcccccauucag

SEQ ID NO: 817573 - RNA, 22 nt, Human
uugcagcuuagugauguuaucu

SEQ ID NO: 817574 - RNA, 22 nt, Human
ucucugguuauuaacuaacucc

SEQ ID NO: 817575 - RNA, 21 nt, Human
uuucuucacuuugccccaugu

SEQ ID NO: 817576 - RNA, 22 nt, Human
uucuucuugaaacuuuagguug

SEQ ID NO: 817577 - RNA, 22 nt, Human
uuacacaacaucuguauuauua

SEQ ID NO: 817578 - RNA, 22 nt, Human
aaaggccaccaacaugaagcau

SEQ ID NO: 817579 - RNA, 22 nt, Human
cagcugacccagugaggaggca

SEQ ID NO: 817580 - RNA, 22 nt, Human
ggaggccagggacccagucagc

SEQ ID NO: 817581 - RNA, 22 nt, Human
aggcaggccccugagaauagac

SEQ ID NO: 817582 - RNA, 22 nt, Human
aagggcaggagaagacggauau

SEQ ID NO: 817583 - RNA, 22 nt, Human
guuuuauaggcuguugcuauau

SEQ ID NO: 817584 - RNA, 22 nt, Human
cuaauacacccuauugcuuguu

SEQ ID NO: 817585 - RNA, 22 nt, Human
aggcagcagugauaagauagga

SEQ ID NO: 817586 - RNA, 22 nt, Human
caaggccauauugccuguaugu

SEQ ID NO: 817587 - RNA, 22 nt, Human
cuuacagagaagaaaauguagu

SEQ ID NO: 817588 - RNA, 22 nt, Human
cugcccagaagccagaugggca

SEQ ID NO: 817589 - RNA, 22 nt, Human
ucccaggacaugggcucugcuc

SEQ ID NO: 817590 - RNA, 22 nt, Human
guucuucacauuucauugagga

SEQ ID NO: 817591 - RNA, 22 nt, Human
ugcaggaacugggagggauagu

SEQ ID NO: 817592 - RNA, 22 nt, Human
ggcagucuuaucagcauuggac

SEQ ID NO: 817593 - RNA, 22 nt, Human
ugaguuuugucuugcuagaagu

SEQ ID NO: 817594 - RNA, 22 nt, Human
uuguuauaaagacuaaauaugu

SEQ ID NO: 817595 - RNA, 22 nt, Human
gagggucccugcucagggccag

SEQ ID NO: 817596 - RNA, 21 nt, Human
ccugcugugaucuuagugagu

SEQ ID NO: 817597 - RNA, 22 nt, Human
uuaucacuuaugagcuuuuugc

SEQ ID NO: 817598 - RNA, 22 nt, Human
ucacagacauggugagguaaca

SEQ ID NO: 817599 - RNA, 22 nt, Human
uuucuucucgacaccuuauccc

SEQ ID NO: 817600 - RNA, 22 nt, Human
cacagcauaaugaaauauacuu

SEQ ID NO: 817601 - RNA, 22 nt, Human
auaucaaacgaaguuauuuuaa

SEQ ID NO: 817602 - RNA, 22 nt, Human
ggcagcucacgggcauggggug

SEQ ID NO: 817603 - RNA, 22 nt, Human
agcccaggagguggagguugca

SEQ ID NO: 817604 - RNA, 22 nt, Human
uuuuauagcugaauaguauucc

SEQ ID NO: 817605 - RNA, 17 nt, Human
gcuguaguuugauaaga

SEQ ID NO: 817606 - RNA, 23 nt, Human
acugucugauauguuuuccauca

SEQ ID NO: 817607 - RNA, 23 nt, Human
ucucuuucaagagcuuaaugugc

SEQ ID NO: 817608 - RNA, 19 nt, Human
gaggcgaggcgugcaggag

SEQ ID NO: 817609 - RNA, 22 nt, Human
gaauauuuuuaaagggacuaau

SEQ ID NO: 817610 - RNA, 22 nt, Human
ucagucucaucaacucuauucc

SEQ ID NO: 817611 - RNA, 18 nt, Human
cugcccagagcacuugug

SEQ ID NO: 817612 - RNA, 22 nt, Human
uaacaauaguguuugcuaguca

SEQ ID NO: 817613 - RNA, 22 nt, Human
gaggagagaugguagauugggu

SEQ ID NO: 817614 - RNA, 22 nt, Human
uuucacuagaacguucuuguuu

SEQ ID NO: 817615 - RNA, 20 nt, Human
uuucacagucccuguuuccu

SEQ ID NO: 817616 - RNA, 22 nt, Human
aguuauaaucugcuacugauau

SEQ ID NO: 817617 - RNA, 22 nt, Human
ucuuucaaugagcauucuuucc

SEQ ID NO: 817618 - RNA, 22 nt, Human
uuauuauagauuaugcaagauu

SEQ ID NO: 817619 - RNA, 18 nt, Human
ugugaacacauuuuucug

SEQ ID NO: 817620 - RNA, 22 nt, Human
ugcccagggauaagccuagaga

SEQ ID NO: 817621 - RNA, 22 nt, Human
accaggaguaacagugaguggu

SEQ ID NO: 817622 - RNA, 22 nt, Human
gauggcaggcaggugaguagag

SEQ ID NO: 817623 - RNA, 22 nt, Human
ccucaggggucacugugaggag

SEQ ID NO: 817624 - RNA, 22 nt, Human
uuucaaagaccauuaacuauca

SEQ ID NO: 817625 - RNA, 22 nt, Human
cagugcugggcagaggagagcg

SEQ ID NO: 817626 - RNA, 22 nt, Human
uugaacuguaagcaugucugcc

SEQ ID NO: 817627 - RNA, 22 nt, Human
cucaggaugcaggucacaggac

SEQ ID NO: 817628 - RNA, 22 nt, Human
augcuguguauuuuacucuuuc

SEQ ID NO: 817629 - RNA, 22 nt, Human
aucauuucccuuuagaucacaa

SEQ ID NO: 817630 - RNA, 20 nt, Human
cagagccaagagcagcaucu

SEQ ID NO: 817631 - RNA, 22 nt, Human
cuuuggcagccucugcuauuga

SEQ ID NO: 817632 - RNA, 22 nt, Human
ggaagaggaggagccaggcuuu

SEQ ID NO: 817633 - RNA, 22 nt, Human
cugcuguguuucacaccucugg

SEQ ID NO: 817634 - RNA, 22 nt, Human
gcagaggagcaaguugcuacag

SEQ ID NO: 817635 - RNA, 22 nt, Human
aggcucagaggugagcaucugc

SEQ ID NO: 817636 - RNA, 22 nt, Human
ucacccuugauaauguucuucu

SEQ ID NO: 817637 - RNA, 22 nt, Human
ucccaggaauccguccucuaga

SEQ ID NO: 817638 - RNA, 22 nt, Human
uuggcagugaugcagcuuguuc

SEQ ID NO: 817639 - RNA, 22 nt, Human
ucucugaguauccugaacugcc

SEQ ID NO: 817640 - RNA, 22 nt, Human
cauuaaaauaucucaugguguu

SEQ ID NO: 817641 - RNA, 22 nt, Human
uauagccauuuccaguggcauc

SEQ ID NO: 817642 - RNA, 22 nt, Human
gaggaggcuuccgggaggcacg

SEQ ID NO: 817643 - RNA, 22 nt, Human
agcucccagagcucgagaguaa

SEQ ID NO: 817644 - RNA, 22 nt, Human
uagauuuuacuucugucauuac

SEQ ID NO: 817645 - RNA, 22 nt, Human
ugcuguggcaguuuauguauag

SEQ ID NO: 817646 - RNA, 22 nt, Human
uuuaaauggcauuuucccagau

SEQ ID NO: 817647 - RNA, 20 nt, Human
ugaaggccauuuguuccaga

SEQ ID NO: 817648 - RNA, 22 nt, Human
gcugcugugaauuuuuuaaaug

SEQ ID NO: 817649 - RNA, 22 nt, Human
aagaacuuccuaauauauuuuc

SEQ ID NO: 817650 - RNA, 22 nt, Human
uccaggagauacacugcaccag

SEQ ID NO: 817651 - RNA, 22 nt, Human
gcaaagcauucuguggagucua

SEQ ID NO: 817652 - RNA, 22 nt, Human
auugaggcagcauaguucaggg

SEQ ID NO: 817653 - RNA, 22 nt, Human
ggcagcuuguccuggaggaugg

SEQ ID NO: 817654 - RNA, 20 nt, Human
ucagaugggagugagccauc

SEQ ID NO: 817655 - RNA, 22 nt, Human
aagcaauagcaacaacuuuaca

SEQ ID NO: 817656 - RNA, 21 nt, Human
aggaggggucuuucccacuga

SEQ ID NO: 817657 - RNA, 22 nt, Human
aguauugugacucaaguauucu

SEQ ID NO: 817658 - RNA, 22 nt, Human
cagcaggauuugaaaggaagag

SEQ ID NO: 817659 - RNA, 22 nt, Human
gaccauuuuuacagagcauuca

SEQ ID NO: 817660 - RNA, 22 nt, Human
auuaguaaaacauuguauaugu

SEQ ID NO: 817661 - RNA, 22 nt, Human
auucuucauaccuacugagguu

SEQ ID NO: 817662 - RNA, 22 nt, Human
uuccaugaaagugaaauggagc

SEQ ID NO: 817663 - RNA, 22 nt, Human
uacauaguauucacauuguuuu

SEQ ID NO: 817664 - RNA, 22 nt, Human
ccccaggaagccucagauuugc

SEQ ID NO: 817665 - RNA, 22 nt, Human
uggcagcuggcucugcgcaggc

SEQ ID NO: 817666 - RNA, 20 nt, Human
uugauucaagggcugaugga

SEQ ID NO: 817667 - RNA, 22 nt, Human
cauucuuacacaauauuuuaau

SEQ ID NO: 817668 - RNA, 22 nt, Human
gagcagcucgagaaggaagcag

SEQ ID NO: 817669 - RNA, 22 nt, Human
aggcagugcaugcaaaggucgg

SEQ ID NO: 817670 - RNA, 22 nt, Human
gcauguguugguuuaugcaugu

SEQ ID NO: 817671 - RNA, 22 nt, Human
ucugggaaaugcuguuccuugu

SEQ ID NO: 817672 - RNA, 21 nt, Human
ucauuugugaucugauuucca

SEQ ID NO: 817673 - RNA, 18 nt, Human
agaggggagguaagucug

SEQ ID NO: 817674 - RNA, 20 nt, Human
uucacagaggacucagguca

SEQ ID NO: 817675 - RNA, 22 nt, Human
cuugcugugugguguucucaga

SEQ ID NO: 817676 - RNA, 22 nt, Human
uaaugcuuaacagcuggcuuuu

SEQ ID NO: 817677 - RNA, 22 nt, Human
cccaggagauaacguucccaag

SEQ ID NO: 817678 - RNA, 22 nt, Human
gcccaggaguugaagggcugac

SEQ ID NO: 817679 - RNA, 22 nt, Human
aggcagcuuucuggugcaccau

SEQ ID NO: 817680 - RNA, 22 nt, Human
ugaaaggugacauuucuuggau

SEQ ID NO: 817681 - RNA, 22 nt, Human
cgucuuccucuuacgaugcgcu

SEQ ID NO: 817682 - RNA, 22 nt, Human
acccaggagccgugagagguua

SEQ ID NO: 817683 - RNA, 22 nt, Human
aaaagucugcucucauuucaga

SEQ ID NO: 817684 - RNA, 22 nt, Human
cccagggaagccauuucugacu

SEQ ID NO: 817685 - RNA, 22 nt, Human
gaacuguaguuaauacuacaca

SEQ ID NO: 817686 - RNA, 22 nt, Human
aggcagguuggugagaagacug

SEQ ID NO: 817687 - RNA, 22 nt, Human
uugagaagaaauaguuugcaau

SEQ ID NO: 817688 - RNA, 22 nt, Human
gcuaugcaggagccuaaugaca

SEQ ID NO: 817689 - RNA, 23 nt, Human
cccaggagccugaguccucucug

SEQ ID NO: 817690 - RNA, 22 nt, Human
aauacauauggaauuccauguu

SEQ ID NO: 817691 - RNA, 22 nt, Human
ccaggcugagcaugauuggagc

SEQ ID NO: 817692 - RNA, 23 nt, Human
uugauuucaaaugcagagaacac

SEQ ID NO: 817693 - RNA, 22 nt, Human
gaggagagaacauuccuccaua

SEQ ID NO: 817694 - RNA, 22 nt, Human
uuuugaauaauucagaaacagc

SEQ ID NO: 817695 - RNA, 22 nt, Human
uugcauuuaaguagauguuaca

SEQ ID NO: 817696 - RNA, 22 nt, Human
auucuucauacagacaaguccu

SEQ ID NO: 817697 - RNA, 22 nt, Human
gaucauuuacuuguucuggacu

SEQ ID NO: 817698 - RNA, 22 nt, Human
cucaggauagcugcgcagccug

SEQ ID NO: 817699 - RNA, 23 nt, Human
uuuauccaacucuguaaucucuc

SEQ ID NO: 817700 - RNA, 22 nt, Human
cuugaaagcuuugcgucuucua

SEQ ID NO: 817701 - RNA, 22 nt, Human
cccaggaguuugaguucagcau

SEQ ID NO: 817702 - RNA, 22 nt, Human
caauacuuccuuguuagaggca

SEQ ID NO: 817703 - RNA, 22 nt, Human
ugaggcagggagaguggauaug

SEQ ID NO: 817704 - RNA, 22 nt, Human
uucuacaauaugaauaaugaag

SEQ ID NO: 817705 - RNA, 22 nt, Human
gaggagagaagcuaacggugcu

SEQ ID NO: 817706 - RNA, 22 nt, Human
uguagggaggaaggguuggaaa

SEQ ID NO: 817707 - RNA, 22 nt, Human
uuugaaagcuacuuucggguca

SEQ ID NO: 817708 - RNA, 22 nt, Human
agaggcaguauacaauccgagc

SEQ ID NO: 817709 - RNA, 22 nt, Human
auuaaauuuucacuaggcuccc

SEQ ID NO: 817710 - RNA, 22 nt, Human
cuucuucaaccugaaaguuuca

SEQ ID NO: 817711 - RNA, 22 nt, Human
cuucuucaucuguaaaacuugg

SEQ ID NO: 817712 - RNA, 22 nt, Human
aggcagugccuggaccccagcu

SEQ ID NO: 817713 - RNA, 22 nt, Human
uucucagaauugacugggagca

SEQ ID NO: 817714 - RNA, 22 nt, Human
agugcuuugagcguuugaaaag

SEQ ID NO: 817715 - RNA, 22 nt, Human
gccagagguucaacaacugucu

SEQ ID NO: 817716 - RNA, 22 nt, Human
uucaggaucaaguugccaguag

SEQ ID NO: 817717 - RNA, 22 nt, Human
agguaggggguuugggaacugc

SEQ ID NO: 817718 - RNA, 22 nt, Human
cucuuucugauucgcugggacc

SEQ ID NO: 817719 - RNA, 22 nt, Human
aggagggagcuuaagccaggca

SEQ ID NO: 817720 - RNA, 22 nt, Human
ugaacuccaaauacugcugauu

SEQ ID NO: 817721 - RNA, 15 nt, Human
caggagaggaagguu

SEQ ID NO: 817722 - RNA, 22 nt, Human
ugaggcaggaauggggaaaagu

SEQ ID NO: 817723 - RNA, 22 nt, Human
ugccgcagugcggggagggccc

SEQ ID NO: 817724 - RNA, 22 nt, Human
augcugugucuagcaggaacac

SEQ ID NO: 817725 - RNA, 22 nt, Human
gauugaaacauaggcagucgag

SEQ ID NO: 817726 - RNA, 22 nt, Human
aucacauuguuagcauagacug

SEQ ID NO: 817727 - RNA, 22 nt, Human
aggcaagcauugggaacagggc

SEQ ID NO: 817728 - RNA, 22 nt, Human
auuucauugaaguuaauucuuc

SEQ ID NO: 817729 - RNA, 22 nt, Human
ucaggaggccaccaggaccugu

SEQ ID NO: 817730 - RNA, 22 nt, Human
ugaaggccuaacuuccagugcu

SEQ ID NO: 817731 - RNA, 22 nt, Human
uggagaggagcaccauggccau

SEQ ID NO: 817732 - RNA, 21 nt, Human
agaggcaggcauuaaguacac

SEQ ID NO: 817733 - RNA, 22 nt, Human
augcugagugagugaaacccag

SEQ ID NO: 817734 - RNA, 22 nt, Human
aucuuucuauuucuaaaaacua

SEQ ID NO: 817735 - RNA, 22 nt, Human
cagcaggaccauugaggcauca

SEQ ID NO: 817736 - RNA, 22 nt, Human
aacaucuacuaagugccaggca

SEQ ID NO: 817737 - RNA, 22 nt, Human
uucuccucuguuggccuucccu

SEQ ID NO: 817738 - RNA, 22 nt, Human
aggcaguuguagagagggcucu

SEQ ID NO: 817739 - RNA, 22 nt, Human
uucuucaugcuguugcugcuug

SEQ ID NO: 817740 - RNA, 22 nt, Human
agaccaagacuauaaugagagg

SEQ ID NO: 817741 - RNA, 22 nt, Human
augcuguggaaguuccugaagc

SEQ ID NO: 817742 - RNA, 22 nt, Human
ucauuguuucugcuuuucauga

SEQ ID NO: 817743 - RNA, 22 nt, Human
ggagccuggucagguuggcucc

SEQ ID NO: 817744 - RNA, 22 nt, Human
ccuccucugggaagauucagag

SEQ ID NO: 817745 - RNA, 22 nt, Human
aaaggccagguuggcugguauu

SEQ ID NO: 817746 - RNA, 23 nt, Human
ucucaggacacacaugucuauca

SEQ ID NO: 817747 - RNA, 22 nt, Human
gcagggaagacccggagcagcg

SEQ ID NO: 817748 - RNA, 22 nt, Human
cuggcagucugccucuucacug

SEQ ID NO: 817749 - RNA, 22 nt, Human
agggcagcucucaccucuggcc

SEQ ID NO: 817750 - RNA, 22 nt, Human
ugaaaugacaaagguuuuucuu

SEQ ID NO: 817751 - RNA, 22 nt, Human
cugcccaggcugaaggaacauc

SEQ ID NO: 817752 - RNA, 23 nt, Human
uggaaagcggaccuggggcagag

SEQ ID NO: 817753 - RNA, 22 nt, Human
uucaggauggaguaccuuuuau

SEQ ID NO: 817754 - RNA, 22 nt, Human
augcuguguuuuaaauggaaau

SEQ ID NO: 817755 - RNA, 22 nt, Human
ccaggagacccagggaaggagc

SEQ ID NO: 817756 - RNA, 22 nt, Human
cccaggagagaggccaguuggc

SEQ ID NO: 817757 - RNA, 22 nt, Human
uuugcaguuucauugcugaaau

SEQ ID NO: 817758 - RNA, 22 nt, Human
guuuuucuaggaccaugugauu

SEQ ID NO: 817759 - RNA, 22 nt, Human
uaggcagccagcaucaguuggg

SEQ ID NO: 817760 - RNA, 22 nt, Human
uaaggccaaguucauauacaac

SEQ ID NO: 817761 - RNA, 22 nt, Human
aguacauauaguaauuuagcca

SEQ ID NO: 817762 - RNA, 22 nt, Human
cccaggaggccaagguugcagu

SEQ ID NO: 817763 - RNA, 22 nt, Human
agaggccacuuugccugugaug

SEQ ID NO: 817764 - RNA, 20 nt, Human
ugcugucguguuuucugcuu

SEQ ID NO: 817765 - RNA, 22 nt, Human
agaaaugacaagacugaucagg

SEQ ID NO: 817766 - RNA, 17 nt, Human
agagggaaaaugcgguu

SEQ ID NO: 817767 - RNA, 22 nt, Human
aagacugugucuauggcuacuc

SEQ ID NO: 817768 - RNA, 22 nt, Human
cuacagacccaccuuggaagaa

SEQ ID NO: 817769 - RNA, 22 nt, Human
agggagcuucuggccucagccu

SEQ ID NO: 817770 - RNA, 22 nt, Human
ucaggagacaaagggugcggag

SEQ ID NO: 817771 - RNA, 18 nt, Human
gcagcugacacuggaguu

SEQ ID NO: 817772 - RNA, 22 nt, Human
auguucuuucagccagugcauc

SEQ ID NO: 817773 - RNA, 22 nt, Human
aaaggccacugcaagggaaggu

SEQ ID NO: 817774 - RNA, 22 nt, Human
cagaaggcuuuguggaguagac

SEQ ID NO: 817775 - RNA, 22 nt, Human
uugagaagaauguguugaguuu

SEQ ID NO: 817776 - RNA, 22 nt, Human
ugaugaaacugagguuccaaga

SEQ ID NO: 817777 - RNA, 22 nt, Human
ccucuucuagguuucagccugc

SEQ ID NO: 817778 - RNA, 22 nt, Human
acauacauauguuuaaaugcau

SEQ ID NO: 817779 - RNA, 22 nt, Human
uucauucuugggaucagagagu

SEQ ID NO: 817780 - RNA, 18 nt, Human
uggcagcuagguaaagaa

SEQ ID NO: 817781 - RNA, 22 nt, Human
aggagacauaacuaugaugaga

SEQ ID NO: 817782 - RNA, 22 nt, Human
accaggagagauuuuauugaga

SEQ ID NO: 817783 - RNA, 22 nt, Human
guccucuguuagaaaugugcuu

SEQ ID NO: 817784 - RNA, 22 nt, Human
guggaaugaauagauuugcauu

SEQ ID NO: 817785 - RNA, 22 nt, Human
aaauacuagaauucagaguuga

SEQ ID NO: 817786 - RNA, 22 nt, Human
gggcaguuuauucuagaugguu

SEQ ID NO: 817787 - RNA, 21 nt, Human
uucuccccagcgaauccucgg

SEQ ID NO: 817788 - RNA, 22 nt, Human
uuacaguuuaguccaagccaga

SEQ ID NO: 817789 - RNA, 22 nt, Human
gaggagaggggcucccaagagc

SEQ ID NO: 817790 - RNA, 22 nt, Human
agaguucugcucuucucaguga

SEQ ID NO: 817791 - RNA, 22 nt, Human
gggaggugauuaggaccaugua

SEQ ID NO: 817792 - RNA, 22 nt, Human
auuugcuuucagguauaaaagg

SEQ ID NO: 817793 - RNA, 22 nt, Human
cagaggauucccuagugaccug

SEQ ID NO: 817794 - RNA, 22 nt, Human
aggagagcuggugucuggaauc

SEQ ID NO: 817795 - RNA, 22 nt, Human
gaggccuggagccgccuaggcg

SEQ ID NO: 817796 - RNA, 22 nt, Human
gcccaggaaaugccccguggug

SEQ ID NO: 817797 - RNA, 22 nt, Human
accuugaugccuuuccaagaug

SEQ ID NO: 817798 - RNA, 20 nt, Human
aggcucagcugagcucuugg

SEQ ID NO: 817799 - RNA, 22 nt, Human
caugucuguguacacaugcaca

SEQ ID NO: 817800 - RNA, 22 nt, Human
uuuguuaaauauuuauugagug

SEQ ID NO: 817801 - RNA, 22 nt, Human
aaaggccauuacuugcuuuuag

SEQ ID NO: 817802 - RNA, 22 nt, Human
gggacuucauagcuaggcacuu

SEQ ID NO: 817803 - RNA, 22 nt, Human
cucucagacugaagggccugug

SEQ ID NO: 817804 - RNA, 22 nt, Human
uccaggaguuugagacugcagu

SEQ ID NO: 817805 - RNA, 22 nt, Human
aucaggauuacacggggaugcu

SEQ ID NO: 817806 - RNA, 22 nt, Human
cacagcuaggaggaaagcagag

SEQ ID NO: 817807 - RNA, 21 nt, Human
ucacuagugccuucugucauu

SEQ ID NO: 817808 - RNA, 22 nt, Human
ggccagcucugcacagcagcug

SEQ ID NO: 817809 - RNA, 22 nt, Human
aggacagcaguuggugagguuc

SEQ ID NO: 817810 - RNA, 17 nt, Human
uuucaucugggaccacc

SEQ ID NO: 817811 - RNA, 22 nt, Human
uuucacaaaugucuuuaacuug

SEQ ID NO: 817812 - RNA, 22 nt, Human
ggcagcuuucaauaggguuaug

SEQ ID NO: 817813 - RNA, 22 nt, Human
ccaagaugaucuuuacaguguu

SEQ ID NO: 817814 - RNA, 20 nt, Human
gcccaagguccagaaggggg

SEQ ID NO: 817815 - RNA, 22 nt, Human
gcuagaaaucgacuucagaauu

SEQ ID NO: 817816 - RNA, 22 nt, Human
uucacagaauggcaaguuaugg

SEQ ID NO: 817817 - RNA, 22 nt, Human
cuugcuggugguguuuucuaug

SEQ ID NO: 817818 - RNA, 22 nt, Human
uuagagucaaaauggcauguua

SEQ ID NO: 817819 - RNA, 19 nt, Human
aaagcagaggagcaucuga

SEQ ID NO: 817820 - RNA, 22 nt, Human
cuuccuucugaagcauagaagc

SEQ ID NO: 817821 - RNA, 22 nt, Human
cagagcagucuggagauccagc

SEQ ID NO: 817822 - RNA, 22 nt, Human
ucccaggaucugagggcagaga

SEQ ID NO: 817823 - RNA, 22 nt, Human
cugcugugacagcugccguguu

SEQ ID NO: 817824 - RNA, 22 nt, Human
gcuggcaggagccuuucccuuu

SEQ ID NO: 817825 - RNA, 23 nt, Human
cccagggacacgaugacaccucc

SEQ ID NO: 817826 - RNA, 23 nt, Human
ucuugaaaagccuacagcaguuc

SEQ ID NO: 817827 - RNA, 22 nt, Human
uaugaaacauucauacaaauaa

SEQ ID NO: 817828 - RNA, 22 nt, Human
aggcaggcacacuuccuccagg

SEQ ID NO: 817829 - RNA, 22 nt, Human
uucauucuuugaaucugaggua

SEQ ID NO: 817830 - RNA, 22 nt, Human
agggugguucuuuuaguggaag

SEQ ID NO: 817831 - RNA, 22 nt, Human
gcaagcugcucuuauguggagg

SEQ ID NO: 817832 - RNA, 22 nt, Human
acaguggagaaggcaugaggcu

SEQ ID NO: 817833 - RNA, 22 nt, Human
aggccagaaaugucagggagug

SEQ ID NO: 817834 - RNA, 22 nt, Human
ccaggagaagcaucugagugua

SEQ ID NO: 817835 - RNA, 22 nt, Human
auuucagauucagaaauguagg

SEQ ID NO: 817836 - RNA, 22 nt, Human
gcagcugcagagaccggguggg

SEQ ID NO: 817837 - RNA, 22 nt, Human
auagcuguuagauuggggucga

SEQ ID NO: 817838 - RNA, 22 nt, Human
ugaaggccagcagagugaaggc

SEQ ID NO: 817839 - RNA, 22 nt, Human
uugcauuugacaaauuauuuaa

SEQ ID NO: 817840 - RNA, 22 nt, Human
uuugaaagaauuuauguacuuu

SEQ ID NO: 817841 - RNA, 16 nt, Human
gcccaggacgggaggc

SEQ ID NO: 817842 - RNA, 22 nt, Human
cugccaggcacgugcagcauca

SEQ ID NO: 817843 - RNA, 22 nt, Human
agggaguuagaaauccaggaua

SEQ ID NO: 817844 - RNA, 22 nt, Human
agggagcucacaguccaguaga

SEQ ID NO: 817845 - RNA, 22 nt, Human
aaagcagacugauuugcaucac

SEQ ID NO: 817846 - RNA, 22 nt, Human
ggcagaagauaggacagggaau

SEQ ID NO: 817847 - RNA, 22 nt, Human
ugaaaugaucaguuugguuacu

SEQ ID NO: 817848 - RNA, 22 nt, Human
uuauuuacaacucuucucuucc

SEQ ID NO: 817849 - RNA, 22 nt, Human
ucccaggaaggauucggcauuu

SEQ ID NO: 817850 - RNA, 22 nt, Human
cucaucugauaaaucacucuua

SEQ ID NO: 817851 - RNA, 22 nt, Human
ccaggagaugggagcaucuaaa

SEQ ID NO: 817852 - RNA, 22 nt, Human
gcagcugccuucagcuggaugg

SEQ ID NO: 817853 - RNA, 22 nt, Human
gcagcuucaguaggugaagaca

SEQ ID NO: 817854 - RNA, 19 nt, Human
gagcgcagagggcagggga

SEQ ID NO: 817855 - RNA, 22 nt, Human
acaauauuguacccagaaguuu

SEQ ID NO: 817856 - RNA, 22 nt, Human
caaaugauacuguuuuuagucu

SEQ ID NO: 817857 - RNA, 22 nt, Human
augcugugucaccuuaggauuu

SEQ ID NO: 817858 - RNA, 19 nt, Human
aggcagcaggccagggaug

SEQ ID NO: 817859 - RNA, 22 nt, Human
caggcagccaggggaccugucc

SEQ ID NO: 817860 - RNA, 22 nt, Human
uuuggaaugguaccuucaguug

SEQ ID NO: 817861 - RNA, 22 nt, Human
aucaggauucaccccagagcug

SEQ ID NO: 817862 - RNA, 22 nt, Human
ccagcagaggggcggagugcag

SEQ ID NO: 817863 - RNA, 20 nt, Human
gcccaggaucucugaggcau

SEQ ID NO: 817864 - RNA, 22 nt, Human
gaggccagaagugccucgggcu

SEQ ID NO: 817865 - RNA, 22 nt, Human
agggagugguuaagaaggugca

SEQ ID NO: 817866 - RNA, 22 nt, Human
caaggccaguuucuccuaguca

SEQ ID NO: 817867 - RNA, 22 nt, Human
gcccaggaugguguguaguggu

SEQ ID NO: 817868 - RNA, 22 nt, Human
guuauacauauguguuaacaaa

SEQ ID NO: 817869 - RNA, 22 nt, Human
aaggcagcaugaaucccuguac

SEQ ID NO: 817870 - RNA, 22 nt, Human
caaggccacugcucagguuucc

SEQ ID NO: 817871 - RNA, 22 nt, Human
aggcagcugaccacaguaugau

SEQ ID NO: 817872 - RNA, 22 nt, Human
ugaugaauaaacuugagaguca

SEQ ID NO: 817873 - RNA, 22 nt, Human
cacaggagagcugggaggugcc

SEQ ID NO: 817874 - RNA, 22 nt, Human
uagcacaucuucuuggccugca

SEQ ID NO: 817875 - RNA, 17 nt, Human
uccaugagacaugaaga

SEQ ID NO: 817876 - RNA, 22 nt, Human
ucuucagaggaagucagucuuu

SEQ ID NO: 817877 - RNA, 22 nt, Human
uaguuaaaauaauggagauguu

SEQ ID NO: 817878 - RNA, 22 nt, Human
uccaggaggcagggcugugccc

SEQ ID NO: 817879 - RNA, 20 nt, Human
ucauuguguugccaauuccc

SEQ ID NO: 817880 - RNA, 22 nt, Human
cucaggauagauuguccucuca

SEQ ID NO: 817881 - RNA, 20 nt, Human
cugcugugugugccucagcc

SEQ ID NO: 817882 - RNA, 22 nt, Human
guggcaggagagacacagccau

SEQ ID NO: 817883 - RNA, 22 nt, Human
auacuguuuugugacuuaucuu

SEQ ID NO: 817884 - RNA, 22 nt, Human
uaacaguguggacuugagaucu

SEQ ID NO: 817885 - RNA, 22 nt, Human
aggccagacagcuagaaacagg

SEQ ID NO: 817886 - RNA, 22 nt, Human
agagugucugguagcugcucug

SEQ ID NO: 817887 - RNA, 21 nt, Human
gauuugcagaaacuagacagg

SEQ ID NO: 817888 - RNA, 22 nt, Human
agccagcuguucuggggcagca

SEQ ID NO: 817889 - RNA, 23 nt, Human
accaggagaaaagcuuugcggga

SEQ ID NO: 817890 - RNA, 22 nt, Human
aaaauugaagugaucaggaacu

SEQ ID NO: 817891 - RNA, 22 nt, Human
ucugcuguaaagaauuucugcc

SEQ ID NO: 817892 - RNA, 22 nt, Human
gaggagcuggcugucgggaggc

SEQ ID NO: 817893 - RNA, 22 nt, Human
ccacagagacaggguccuugcu

SEQ ID NO: 817894 - RNA, 22 nt, Human
uuuauuuggcauccagggagaa

SEQ ID NO: 817895 - RNA, 19 nt, Human
aggcaggugcagagguccc

SEQ ID NO: 817896 - RNA, 22 nt, Human
uucucacuauguauguagauug

SEQ ID NO: 817897 - RNA, 22 nt, Human
gagagguccauuccccugucag

SEQ ID NO: 817898 - RNA, 22 nt, Human
uuauagaaggagcauucacuua

SEQ ID NO: 817899 - RNA, 22 nt, Human
augaggcaguacacacaaagcc

SEQ ID NO: 817900 - RNA, 22 nt, Human
cagucucuaaaucaaucugaau

SEQ ID NO: 817901 - RNA, 22 nt, Human
accaggaguuuugaccaggggc

SEQ ID NO: 817902 - RNA, 22 nt, Human
aacauacauauuucagugucca

SEQ ID NO: 817903 - RNA, 22 nt, Human
cagcuuccgaccgggggcugca

SEQ ID NO: 817904 - RNA, 22 nt, Human
uaaggccaauuaacaaccaggg

SEQ ID NO: 817905 - RNA, 22 nt, Human
aagcaauauacugauaugauua

SEQ ID NO: 817906 - RNA, 22 nt, Human
augcuguguuugagaaccuagg

SEQ ID NO: 817907 - RNA, 22 nt, Human
uuucaucuuccuuggcauaggu

SEQ ID NO: 817908 - RNA, 22 nt, Human
acccaggauaaucuguguaucu

SEQ ID NO: 817909 - RNA, 22 nt, Human
ugaaaugagauaauuuaagugc

SEQ ID NO: 817910 - RNA, 22 nt, Human
aaucuucuuucuuaacaguaca

SEQ ID NO: 817911 - RNA, 19 nt, Human
ugcauaaauuauauacuuu

SEQ ID NO: 817912 - RNA, 22 nt, Human
gaggcugauucggggaacagca

SEQ ID NO: 817913 - RNA, 22 nt, Human
cuugaaguugcaaaacauuaau

SEQ ID NO: 817914 - RNA, 22 nt, Human
cagaugaggcaaccucauugcu

SEQ ID NO: 817915 - RNA, 22 nt, Human
uagaaauaaaucugcagcuggg

SEQ ID NO: 817916 - RNA, 22 nt, Human
ugaggcagggaguuuaauuguc

SEQ ID NO: 817917 - RNA, 22 nt, Human
ugagacaguuuuucuauuucca

SEQ ID NO: 817918 - RNA, 22 nt, Human
ucuggcaggucaaucauucuuu

SEQ ID NO: 817919 - RNA, 15 nt, Human
uggcagcuuguuaag

SEQ ID NO: 817920 - RNA, 22 nt, Human
auuuccaguccuaaugaucugg

SEQ ID NO: 817921 - RNA, 22 nt, Human
gucaggauuuuaaaaucccagu

SEQ ID NO: 817922 - RNA, 23 nt, Human
cagggaggagauacuguguaucu

SEQ ID NO: 817923 - RNA, 22 nt, Human
cucugcauuuuaacagaugauu

SEQ ID NO: 817924 - RNA, 22 nt, Human
agaaaauauucauugagaggcu

SEQ ID NO: 817925 - RNA, 22 nt, Human
aggcagcuggaggcagagacua

SEQ ID NO: 817926 - RNA, 22 nt, Human
cuugaaagcacuccuuugacug

SEQ ID NO: 817927 - RNA, 18 nt, Human
uuccaugauuccuuucac

SEQ ID NO: 817928 - RNA, 22 nt, Human
acuuggcaaguaucuauaaagu

SEQ ID NO: 817929 - RNA, 22 nt, Human
ucaggagagaguuggguaggcu

SEQ ID NO: 817930 - RNA, 22 nt, Human
agaggggaggcgaaccagaguc

SEQ ID NO: 817931 - RNA, 22 nt, Human
gaggacagagccgccuggcaag

SEQ ID NO: 817932 - RNA, 22 nt, Human
agugugagcccuggaguggugc

SEQ ID NO: 817933 - RNA, 22 nt, Human
ugaaagggguugaguuacagcu

SEQ ID NO: 817934 - RNA, 22 nt, Human
ugaggcaggaggauugcaggau

SEQ ID NO: 817935 - RNA, 22 nt, Human
uuccagcaggcagacaggagau

SEQ ID NO: 817936 - RNA, 22 nt, Human
ugccaggauauaagagugcgau

SEQ ID NO: 817937 - RNA, 22 nt, Human
ccauccuaucugaccuacuugu

SEQ ID NO: 817938 - RNA, 22 nt, Human
aucugccuggcuccaggugagc

SEQ ID NO: 817939 - RNA, 22 nt, Human
agcccaggaaguugaggcuugc

SEQ ID NO: 817940 - RNA, 22 nt, Human
acucaggaaaugaagacugguu

SEQ ID NO: 817941 - RNA, 22 nt, Human
uucaugugauaaaugugugacu

SEQ ID NO: 817942 - RNA, 17 nt, Human
ggcagccucaggcguuu

SEQ ID NO: 817943 - RNA, 22 nt, Human
uuaacaauagaguuucuucagg

SEQ ID NO: 817944 - RNA, 22 nt, Human
aaugucugagucucuguauccc

SEQ ID NO: 817945 - RNA, 22 nt, Human
cauuucacaaauggccacauca

SEQ ID NO: 817946 - RNA, 22 nt, Human
acccaggagacggaggugcagu

SEQ ID NO: 817947 - RNA, 22 nt, Human
uaaauuauggcuggcagagcag

SEQ ID NO: 817948 - RNA, 22 nt, Human
ugugaaggagaugaagggagug

SEQ ID NO: 817949 - RNA, 22 nt, Human
uccaggagaaggccauccagcg

SEQ ID NO: 817950 - RNA, 22 nt, Human
guucuucaaagugacaacuaaa

SEQ ID NO: 817951 - RNA, 22 nt, Human
gaaauauuucucuugagccccu

SEQ ID NO: 817952 - RNA, 18 nt, Human
ggucuuuaggucaguguc

SEQ ID NO: 817953 - RNA, 22 nt, Human
uucaggauuauacucucuuccc

SEQ ID NO: 817954 - RNA, 22 nt, Human
agucuuuccugcuugacuguuc

SEQ ID NO: 817955 - RNA, 19 nt, Human
aauacaguguuauagaauu

SEQ ID NO: 817956 - RNA, 22 nt, Human
aaaaugaugcuguaauuuggca

SEQ ID NO: 817957 - RNA, 22 nt, Human
uuuguuuacucauucauugaug

SEQ ID NO: 817958 - RNA, 22 nt, Human
aaugauuuccccuacacagaag

SEQ ID NO: 817959 - RNA, 22 nt, Human
gagggugggccagauaugaggg

SEQ ID NO: 817960 - RNA, 22 nt, Human
gcaagcugaugugauagugaaa

SEQ ID NO: 817961 - RNA, 22 nt, Human
auugugcaaauauuaucuguag

SEQ ID NO: 817962 - RNA, 22 nt, Human
uuucaugagauuccuccacauc

SEQ ID NO: 817963 - RNA, 22 nt, Human
aagugggaauagaaaugaaggu

SEQ ID NO: 817964 - RNA, 22 nt, Human
acaccauacucauguugguucc

SEQ ID NO: 817965 - RNA, 18 nt, Human
gaaaggagagacaguagg

SEQ ID NO: 817966 - RNA, 20 nt, Human
agauuauuccuaagauuucu

SEQ ID NO: 817967 - RNA, 22 nt, Human
aauacaguaauuuugaugaguu

SEQ ID NO: 817968 - RNA, 22 nt, Human
guuuucaauuauaagauggcuu

SEQ ID NO: 817969 - RNA, 22 nt, Human
auacaacagaaaaugauuauuc

SEQ ID NO: 817970 - RNA, 21 nt, Human
ucuuccuccacagcgugccac

SEQ ID NO: 817971 - RNA, 22 nt, Human
uuucaaaauuuugcagugguaa

SEQ ID NO: 817972 - RNA, 22 nt, Human
aagagagggguugcauggaaau

SEQ ID NO: 817973 - RNA, 22 nt, Human
augaaggcuguguagauggaug

SEQ ID NO: 817974 - RNA, 22 nt, Human
uucugagguccaugcaguacug

SEQ ID NO: 817975 - RNA, 22 nt, Human
gucuucuuuaaccuacuaaagc

SEQ ID NO: 817976 - RNA, 22 nt, Human
cugcacaguuugauuucuugcu

SEQ ID NO: 817977 - RNA, 22 nt, Human
ucccaggaggugcuuccuagga

SEQ ID NO: 817978 - RNA, 22 nt, Human
auucauuugcuauuguguaugg

SEQ ID NO: 817979 - RNA, 22 nt, Human
ggagaggauguuuuaguaacuu

SEQ ID NO: 817980 - RNA, 22 nt, Human
uucucagagcacugcugacaaa

SEQ ID NO: 817981 - RNA, 22 nt, Human
ugcauguguguguauuuauaaa

SEQ ID NO: 817982 - RNA, 22 nt, Human
uuaaagggccgauuuccaggcc

SEQ ID NO: 817983 - RNA, 22 nt, Human
cuccaggagggggauggcugua

SEQ ID NO: 817984 - RNA, 22 nt, Human
ucauuguuauguuuugcugucu

SEQ ID NO: 817985 - RNA, 22 nt, Human
acauaccauacauggugagaug

SEQ ID NO: 817986 - RNA, 22 nt, Human
uaaaacuuaacuauccagauua

SEQ ID NO: 817987 - RNA, 23 nt, Human
cccauuuucauguuaacuccugg

SEQ ID NO: 817988 - RNA, 22 nt, Human
aggagggacaccaauauauguu

SEQ ID NO: 817989 - RNA, 22 nt, Human
uggcagcuauuacaaggaaguc

SEQ ID NO: 817990 - RNA, 22 nt, Human
gcugcccacaaugauuacaugg

SEQ ID NO: 817991 - RNA, 22 nt, Human
cuuuccaaugcauuuccaaugu

SEQ ID NO: 817992 - RNA, 22 nt, Human
ggugaaggcacaagagggcaag

SEQ ID NO: 817993 - RNA, 22 nt, Human
gcagaggagaugaagauacuuu

SEQ ID NO: 817994 - RNA, 19 nt, Human
ucccaggaagcaaauguca

SEQ ID NO: 817995 - RNA, 22 nt, Human
uauuucagucacuucuucucug

SEQ ID NO: 817996 - RNA, 22 nt, Human
acuguugucaggcugcuuugga

SEQ ID NO: 817997 - RNA, 22 nt, Human
cagaggcaggaagaugggcagu

SEQ ID NO: 817998 - RNA, 22 nt, Human
aucuuucagggccauuuguauu

SEQ ID NO: 817999 - RNA, 22 nt, Human
uagggcaggugaagaaaagcua

SEQ ID NO: 818000 - RNA, 22 nt, Human
caaggccaagucucugugaaga

SEQ ID NO: 818001 - RNA, 22 nt, Human
gaggcauggccugaggcuagga

SEQ ID NO: 818002 - RNA, 22 nt, Human
ucagauggguuuugaaggaugu

SEQ ID NO: 818003 - RNA, 22 nt, Human
agaccauggccauccuaggaaa

SEQ ID NO: 818004 - RNA, 22 nt, Human
ucucucuucaacccuuaacuag

SEQ ID NO: 818005 - RNA, 22 nt, Human
cccaggagguguagcugcgugg

SEQ ID NO: 818006 - RNA, 22 nt, Human
aggcaguggaugucaggaaugg

SEQ ID NO: 818007 - RNA, 22 nt, Human
agugcuuuauguuguugugcaa

SEQ ID NO: 818008 - RNA, 22 nt, Human
caggaugagguagaggcagaua

SEQ ID NO: 818009 - RNA, 22 nt, Human
agggagcuaggauccugaaggu

SEQ ID NO: 818010 - RNA, 22 nt, Human
acacauuuacauguuuacguau

SEQ ID NO: 818011 - RNA, 23 nt, Human
uaauucacauauacauugcuuca

SEQ ID NO: 818012 - RNA, 21 nt, Human
ccaggaaggacugagcucccu

SEQ ID NO: 818013 - RNA, 22 nt, Human
uagggcagaguccaggaugggc

SEQ ID NO: 818014 - RNA, 23 nt, Human
auguauuuaaauuucagugauga

SEQ ID NO: 818015 - RNA, 22 nt, Human
accaggaggcuacacuguccca

SEQ ID NO: 818016 - RNA, 22 nt, Human
agaggaugguugaggaagaccu

SEQ ID NO: 818017 - RNA, 19 nt, Human
uuugaaaggauuguuauuu

SEQ ID NO: 818018 - RNA, 22 nt, Human
uacaguaagaugaaauagcaau

SEQ ID NO: 818019 - RNA, 22 nt, Human
gcugcccaggguggagccggcu

SEQ ID NO: 818020 - RNA, 22 nt, Human
agggcagcccuucugggagggc

SEQ ID NO: 818021 - RNA, 22 nt, Human
uuuaaaaucagaugggaguugg

SEQ ID NO: 818022 - RNA, 22 nt, Human
uuauucuuuaaacauauauguu

SEQ ID NO: 818023 - RNA, 22 nt, Human
uggaguucucaggugagggcuu

SEQ ID NO: 818024 - RNA, 22 nt, Human
uggaguucauccaugacagcuu

SEQ ID NO: 818025 - RNA, 18 nt, Human
aguaaagcuuauuacaug

SEQ ID NO: 818026 - RNA, 22 nt, Human
auccagucaaaauuaguaaggu

SEQ ID NO: 818027 - RNA, 22 nt, Human
ucucagaguuuagagcugagcc

SEQ ID NO: 818028 - RNA, 22 nt, Human
cugcugugugaccauggacagg

SEQ ID NO: 818029 - RNA, 22 nt, Human
gaggauggaggugugagcuaug

SEQ ID NO: 818030 - RNA, 22 nt, Human
uugcacuaggaaaaggcagcca

SEQ ID NO: 818031 - RNA, 22 nt, Human
uuuauuguuuagaagggggcug

SEQ ID NO: 818032 - RNA, 17 nt, Human
gcccaggaaggacggcc

SEQ ID NO: 818033 - RNA, 22 nt, Human
agcagagguguuuauuauggga

SEQ ID NO: 818034 - RNA, 22 nt, Human
uccaggagggggagccgugccg

SEQ ID NO: 818035 - RNA, 22 nt, Human
cccaggaugucgaggcugcagu

SEQ ID NO: 818036 - RNA, 22 nt, Human
gccugcagaacugugaggcaau

SEQ ID NO: 818037 - RNA, 22 nt, Human
uuugaaaggaaguuaauacuuu

SEQ ID NO: 818038 - RNA, 22 nt, Human
gggcagcucucacagcagccaa

SEQ ID NO: 818039 - RNA, 22 nt, Human
ggagggaaugucuagcauucuu

SEQ ID NO: 818040 - RNA, 22 nt, Human
cgaggcagaggcugaaacggcu

SEQ ID NO: 818041 - RNA, 22 nt, Human
uuucacaucagagguagauuag

SEQ ID NO: 818042 - RNA, 22 nt, Human
aacauucuauuuugcuaaaaca

SEQ ID NO: 818043 - RNA, 22 nt, Human
gggcacagaagucuaagacauc

SEQ ID NO: 818044 - RNA, 22 nt, Human
cagcagagcugggcuuugaauu

SEQ ID NO: 818045 - RNA, 22 nt, Human
cugcugugagcacuccagccug

SEQ ID NO: 818046 - RNA, 22 nt, Human
uggaaauggaucugaugagucu

SEQ ID NO: 818047 - RNA, 22 nt, Human
uaauuauucuagucacauagca

SEQ ID NO: 818048 - RNA, 22 nt, Human
ucugcaggcuuauaggaugggu

SEQ ID NO: 818049 - RNA, 22 nt, Human
cugcuuccauaaauaaugugcu

SEQ ID NO: 818050 - RNA, 22 nt, Human
uuugaaaggagcuuuauccaga

SEQ ID NO: 818051 - RNA, 22 nt, Human
cagcaggaggugaguagcaggu

SEQ ID NO: 818052 - RNA, 22 nt, Human
aacauucugguucuaaaaaccu

SEQ ID NO: 818053 - RNA, 23 nt, Human
uggcaaggaaugggauggagacu

SEQ ID NO: 818054 - RNA, 22 nt, Human
ugaaggccacuuccugugagcu

SEQ ID NO: 818055 - RNA, 22 nt, Human
cccaggaggcgcagguugcggu

SEQ ID NO: 818056 - RNA, 22 nt, Human
ccccggaggcggagguugcagu

SEQ ID NO: 818057 - RNA, 22 nt, Human
ccaggagaaugggauuacccua

SEQ ID NO: 818058 - RNA, 22 nt, Human
uugguuuaggaacuggcuugga

SEQ ID NO: 818059 - RNA, 22 nt, Human
uugcuagcugguguaugcauug

SEQ ID NO: 818060 - RNA, 20 nt, Human
aggcagcugggaaaugaggg

SEQ ID NO: 818061 - RNA, 22 nt, Human
uucaacuaauguuuauuuuaug

SEQ ID NO: 818062 - RNA, 22 nt, Human
augggaggaugcucgggugcuc

SEQ ID NO: 818063 - RNA, 22 nt, Human
cccuggaggucagaggccuggg

SEQ ID NO: 818064 - RNA, 22 nt, Human
uuugcauaagucauguccagug

SEQ ID NO: 818065 - RNA, 22 nt, Human
aauauuguuucaagaucacaga

SEQ ID NO: 818066 - RNA, 22 nt, Human
gcuccucuauuccccacauuuu

SEQ ID NO: 818067 - RNA, 22 nt, Human
agucucugggcaugguugugac

SEQ ID NO: 818068 - RNA, 19 nt, Human
uucacaauuaugaaauuag

SEQ ID NO: 818069 - RNA, 23 nt, Human
uuccagaguccacaucugccacc

SEQ ID NO: 818070 - RNA, 22 nt, Human
uucaggaugcucagaguagucu

SEQ ID NO: 818071 - RNA, 22 nt, Human
cagcuccugggccaucuccuag

SEQ ID NO: 818072 - RNA, 22 nt, Human
gaagcagccacggggagacaga

SEQ ID NO: 818073 - RNA, 22 nt, Human
ggugaagggugucauggcauuu

SEQ ID NO: 818074 - RNA, 22 nt, Human
aggcagaggagaaugaucuucc

SEQ ID NO: 818075 - RNA, 19 nt, Human
uagaggagaagggaagugg

SEQ ID NO: 818076 - RNA, 22 nt, Human
cucuucuugaaagaggaauuca

SEQ ID NO: 818077 - RNA, 19 nt, Human
uccucagugacaaccucag

SEQ ID NO: 818078 - RNA, 22 nt, Human
cugcugugcaggugccuaugau

SEQ ID NO: 818079 - RNA, 22 nt, Human
cuucugugauuugguuaggaua

SEQ ID NO: 818080 - RNA, 22 nt, Human
agcagacauaucucaugucaca

SEQ ID NO: 818081 - RNA, 22 nt, Human
cgaggcagacaaaaguuggaag

SEQ ID NO: 818082 - RNA, 22 nt, Human
aaauguuucuacuugugagcau

SEQ ID NO: 818083 - RNA, 22 nt, Human
uuagccauugucagcacauggc

SEQ ID NO: 818084 - RNA, 22 nt, Human
agagggaucacccuguuucugg

SEQ ID NO: 818085 - RNA, 22 nt, Human
aaccauuugcaguuacugagac

SEQ ID NO: 818086 - RNA, 22 nt, Human
uagaaaugaauguuuaaaaguc

SEQ ID NO: 818087 - RNA, 22 nt, Human
acauugcugcauucuccuuccc

SEQ ID NO: 818088 - RNA, 19 nt, Human
caggaaugagguaauggcu

SEQ ID NO: 818089 - RNA, 22 nt, Human
auacuaaaguauagaacuuagu

SEQ ID NO: 818090 - RNA, 22 nt, Human
cucuucuugccugaugaggcag

SEQ ID NO: 818091 - RNA, 22 nt, Human
ggccagcagucacagggucaga

SEQ ID NO: 818092 - RNA, 22 nt, Human
aggcagugcucaagacagcagc

SEQ ID NO: 818093 - RNA, 22 nt, Human
uaggcagcauggauucugaaua

SEQ ID NO: 818094 - RNA, 22 nt, Human
aauuuuaaucaguggugcugag

SEQ ID NO: 818095 - RNA, 22 nt, Human
auauauuugagaauauucauga

SEQ ID NO: 818096 - RNA, 22 nt, Human
ucuucaaguuccaaagugcagg

SEQ ID NO: 818097 - RNA, 20 nt, Human
cuguggaauuuuaccaugcg

SEQ ID NO: 818098 - RNA, 22 nt, Human
auaaauaucacuguugucccuc

SEQ ID NO: 818099 - RNA, 22 nt, Human
ccucuucugcuucaggagcacu

SEQ ID NO: 818100 - RNA, 22 nt, Human
ugcauggaggaagaugaaugca

SEQ ID NO: 818101 - RNA, 22 nt, Human
auugucuuuccacugagaaguu

SEQ ID NO: 818102 - RNA, 23 nt, Human
ggagaggggugugggcaucuuua

SEQ ID NO: 818103 - RNA, 19 nt, Human
agaaguuagacauugcaau

SEQ ID NO: 818104 - RNA, 22 nt, Human
aucacauucuuucaaagcaguc

SEQ ID NO: 818105 - RNA, 22 nt, Human
aaagccaugaauguuauagagg

SEQ ID NO: 818106 - RNA, 22 nt, Human
gcagaggauagcauaugaaccu

SEQ ID NO: 818107 - RNA, 22 nt, Human
aggacagcccuugagagcacau

SEQ ID NO: 818108 - RNA, 19 nt, Human
uucauucuuucuacuuacc

SEQ ID NO: 818109 - RNA, 22 nt, Human
agugauggugagugagaagcuc

SEQ ID NO: 818110 - RNA, 22 nt, Human
gcucaggacuggaggagcgggg

SEQ ID NO: 818111 - RNA, 22 nt, Human
agagacagaggcaauauagcuu

SEQ ID NO: 818112 - RNA, 22 nt, Human
ucccaggauuuuaggcucucag

SEQ ID NO: 818113 - RNA, 22 nt, Human
gauuucuuuaugaaguacagaa

SEQ ID NO: 818114 - RNA, 22 nt, Human
agacagcugggaaauggagugu

SEQ ID NO: 818115 - RNA, 22 nt, Human
uuuauauuucccaggauuggcc

SEQ ID NO: 818116 - RNA, 22 nt, Human
cccaggaaacccgaaggcgacc

SEQ ID NO: 818117 - RNA, 22 nt, Human
guuuauaaggcccaauauuucu

SEQ ID NO: 818118 - RNA, 22 nt, Human
cagcuucugucugauuagcaag

SEQ ID NO: 818119 - RNA, 22 nt, Human
gcuguguuugacaguagcagac

SEQ ID NO: 818120 - RNA, 22 nt, Human
agcugcccuuuaugaugcugaa

SEQ ID NO: 818121 - RNA, 22 nt, Human
ugaggcaggacugagcgggaug

SEQ ID NO: 818122 - RNA, 22 nt, Human
gaaacugugaucguguucuggg

SEQ ID NO: 818123 - RNA, 22 nt, Human
cagcuggccccacaguagaggc

SEQ ID NO: 818124 - RNA, 21 nt, Human
cucaggaucuuauauauuagu

SEQ ID NO: 818125 - RNA, 22 nt, Human
ucagaaaagguagcugugacaa

SEQ ID NO: 818126 - RNA, 20 nt, Human
aagagaggaaguuauacuag

SEQ ID NO: 818127 - RNA, 22 nt, Human
aggaagcuaaccagggagugag

SEQ ID NO: 818128 - RNA, 22 nt, Human
aggagcagaacugauucugacu

SEQ ID NO: 818129 - RNA, 22 nt, Human
gaggcagcuuaggguacugacu

SEQ ID NO: 818130 - RNA, 22 nt, Human
gacccaggagugcagagagugg

SEQ ID NO: 818131 - RNA, 22 nt, Human
ccugcucagagcgucuugugug

SEQ ID NO: 818132 - RNA, 20 nt, Human
gccaggagggugugaugagc

SEQ ID NO: 818133 - RNA, 22 nt, Human
aggguggccaugagggagagau

SEQ ID NO: 818134 - RNA, 22 nt, Human
ggagaggaaaugccagcacuuc

SEQ ID NO: 818135 - RNA, 22 nt, Human
gagggagggaaaguuuaacacu

SEQ ID NO: 818136 - RNA, 22 nt, Human
gagaaggaguagcugaccuggg

SEQ ID NO: 818137 - RNA, 22 nt, Human
cagaggcacaagaaagcaaggc

SEQ ID NO: 818138 - RNA, 22 nt, Human
aaaggagacuucagaucuccuu

SEQ ID NO: 818139 - RNA, 22 nt, Human
ucugggaacugagcuccccuag

SEQ ID NO: 818140 - RNA, 22 nt, Human
uugguuuacuaggauucaaauu

SEQ ID NO: 818141 - RNA, 22 nt, Human
cuucuucaguugcauguauugg

SEQ ID NO: 818142 - RNA, 22 nt, Human
acaaaugucuccucuuuuguua

SEQ ID NO: 818143 - RNA, 22 nt, Human
auaagcauguuagaauauuuga

SEQ ID NO: 818144 - RNA, 23 nt, Human
cugcugugaaacaugguuuuggu

SEQ ID NO: 818145 - RNA, 22 nt, Human
acauucuuaacaguuaaaaacu

SEQ ID NO: 818146 - RNA, 22 nt, Human
aucaggaucugggagccugaaa

SEQ ID NO: 818147 - RNA, 22 nt, Human
cuacccaggcuuagagggcugg

SEQ ID NO: 818148 - RNA, 22 nt, Human
uuauuuaaugugaucugaagag

SEQ ID NO: 818149 - RNA, 22 nt, Human
cuggaguuagaguagacacuga

SEQ ID NO: 818150 - RNA, 22 nt, Human
ucaggagaaggcaauguggaaa

SEQ ID NO: 818151 - RNA, 22 nt, Human
uucagaaugugaccuuauuugg

SEQ ID NO: 818152 - RNA, 22 nt, Human
uccauuuucuugcucuagguaa

SEQ ID NO: 818153 - RNA, 22 nt, Human
uguuuuuaaauaaugauagaaa

SEQ ID NO: 818154 - RNA, 22 nt, Human
aggcggcugguguccugcaggu

SEQ ID NO: 818155 - RNA, 22 nt, Human
cagagagagucaaaucuuugcu

SEQ ID NO: 818156 - RNA, 22 nt, Human
caggguggggaaauagcgcccu

SEQ ID NO: 818157 - RNA, 22 nt, Human
ggcagcuuccuaggagagggca

SEQ ID NO: 818158 - RNA, 22 nt, Human
cugcccaggaaccagaggggca

SEQ ID NO: 818159 - RNA, 22 nt, Human
cuuuggcaaggguuuuaauugu

SEQ ID NO: 818160 - RNA, 22 nt, Human
gauuucuuugcaagcuguguuc

SEQ ID NO: 818161 - RNA, 22 nt, Human
gagggaggggagcuccacccuc

SEQ ID NO: 818162 - RNA, 22 nt, Human
cuagccaugggcauuaaaggua

SEQ ID NO: 818163 - RNA, 22 nt, Human
uucugagacaauugagagucua

SEQ ID NO: 818164 - RNA, 22 nt, Human
aaggcagcccuggcucagccug

SEQ ID NO: 818165 - RNA, 17 nt, Human
agaacuguaguagcucc

SEQ ID NO: 818166 - RNA, 22 nt, Human
uuugcauaggauggacauuuua

SEQ ID NO: 818167 - RNA, 22 nt, Human
gccaggagaaugcuagcagagg

SEQ ID NO: 818168 - RNA, 22 nt, Human
gaggcaguuccugagugacaag

SEQ ID NO: 818169 - RNA, 22 nt, Human
uuugaaaggugucgagaugugu

SEQ ID NO: 818170 - RNA, 22 nt, Human
cucugcaugccuugcucagaca

SEQ ID NO: 818171 - RNA, 22 nt, Human
gaggcaacacauuuggaaagca

SEQ ID NO: 818172 - RNA, 22 nt, Human
auacuuucugaccaauuaauug

SEQ ID NO: 818173 - RNA, 22 nt, Human
accauuuuggguauuuucagag

SEQ ID NO: 818174 - RNA, 22 nt, Human
gucugucuguuguugagaagca

SEQ ID NO: 818175 - RNA, 22 nt, Human
uggcaaggccacaggugcaguu

SEQ ID NO: 818176 - RNA, 22 nt, Human
uggcagcuacagacagagguga

SEQ ID NO: 818177 - RNA, 22 nt, Human
gcaggaagcauagaagaaugcc

SEQ ID NO: 818178 - RNA, 22 nt, Human
caucacccggaacugugucugc

SEQ ID NO: 818179 - RNA, 22 nt, Human
gcaaauauucaagacuuuucca

SEQ ID NO: 818180 - RNA, 22 nt, Human
gcagcugagagaagaacagggc

SEQ ID NO: 818181 - RNA, 22 nt, Human
gggaagcaggugcagcucgccu

SEQ ID NO: 818182 - RNA, 22 nt, Human
ugaggcagcauucuucaagaca

SEQ ID NO: 818183 - RNA, 22 nt, Human
aaucuguucuacucuauucaga

SEQ ID NO: 818184 - RNA, 22 nt, Human
uuuccaagagcuuauuucugaa

SEQ ID NO: 818185 - RNA, 22 nt, Human
uugauagguuuuauguauaguu

SEQ ID NO: 818186 - RNA, 22 nt, Human
gcugccagccaacuugcugugc

SEQ ID NO: 818187 - RNA, 22 nt, Human
uugcugaaguuaaugcuugcaa

SEQ ID NO: 818188 - RNA, 22 nt, Human
uuaacauacaucaugaacaaug

SEQ ID NO: 818189 - RNA, 22 nt, Human
ucucaagaucucaagauggccc

SEQ ID NO: 818190 - RNA, 22 nt, Human
auucuucaucagagaugcacua

SEQ ID NO: 818191 - RNA, 22 nt, Human
uauuuccauguuagaacuaagu

SEQ ID NO: 818192 - RNA, 22 nt, Human
uagcugcugcagcacagggagg

SEQ ID NO: 818193 - RNA, 22 nt, Human
ugaggcagcccacuuuccuuag

SEQ ID NO: 818194 - RNA, 22 nt, Human
uagaaauguugguauuaacauu

SEQ ID NO: 818195 - RNA, 22 nt, Human
gaaauaagaguccaugccaggu

SEQ ID NO: 818196 - RNA, 23 nt, Human
uccaggagaaccccugucugucc

SEQ ID NO: 818197 - RNA, 22 nt, Human
guaaaauagaauaacguggcua

SEQ ID NO: 818198 - RNA, 22 nt, Human
cucaggaugaaagucaugguga

SEQ ID NO: 818199 - RNA, 22 nt, Human
ccuugcugaccaucaccuuuga

SEQ ID NO: 818200 - RNA, 22 nt, Human
cuccacagcucaggcucagagu

SEQ ID NO: 818201 - RNA, 19 nt, Human
cauuuuaagcauccccagu

SEQ ID NO: 818202 - RNA, 22 nt, Human
agcagaggaggauuuaguuagg

SEQ ID NO: 818203 - RNA, 22 nt, Human
ccaggagagcucuaaauggcug

SEQ ID NO: 818204 - RNA, 22 nt, Human
auauucuugugauuauaaagua

SEQ ID NO: 818205 - RNA, 22 nt, Human
cuggcuugcagcucaucauaaa

SEQ ID NO: 818206 - RNA, 22 nt, Human
auucaaguccagcuucucuaca

SEQ ID NO: 818207 - RNA, 22 nt, Human
aaguauuucguucugaaaaagu

SEQ ID NO: 818208 - RNA, 22 nt, Human
agaggccaugcuagaggccugg

SEQ ID NO: 818209 - RNA, 22 nt, Human
gaggagcugggucagggagaca

SEQ ID NO: 818210 - RNA, 22 nt, Human
cccaugagaccugguuuaaggc

SEQ ID NO: 818211 - RNA, 22 nt, Human
cagucucucagcuuucagcugu

SEQ ID NO: 818212 - RNA, 20 nt, Human
ccucaggaugagggugagca

SEQ ID NO: 818213 - RNA, 22 nt, Human
ucagagaguuacacaaauuguu

SEQ ID NO: 818214 - RNA, 20 nt, Human
agggcagcuugaggagccgg

SEQ ID NO: 818215 - RNA, 22 nt, Human
guaguucugcagugucaccuga

SEQ ID NO: 818216 - RNA, 22 nt, Human
guccucugaaguugugcaaugc

SEQ ID NO: 818217 - RNA, 22 nt, Human
uuaacauuguccuuagcagauu

SEQ ID NO: 818218 - RNA, 23 nt, Human
gccaggaguggguagacuaaugc

SEQ ID NO: 818219 - RNA, 22 nt, Human
auuaaauuggacgcugggggaa

SEQ ID NO: 818220 - RNA, 22 nt, Human
ucugggaaccagugcggcuggg

SEQ ID NO: 818221 - RNA, 22 nt, Human
cccaggaggcagagauagcagu

SEQ ID NO: 818222 - RNA, 22 nt, Human
aggcagcuucugauuagcagcg

SEQ ID NO: 818223 - RNA, 22 nt, Human
gcagagaacccagcagauuggc

SEQ ID NO: 818224 - RNA, 22 nt, Human
uugacaauguccuuugaauuuc

SEQ ID NO: 818225 - RNA, 22 nt, Human
cugcuguguuagcagguuuagu

SEQ ID NO: 818226 - RNA, 22 nt, Human
uugaaagaggcaaaguuugauc

SEQ ID NO: 818227 - RNA, 23 nt, Human
uuucaaauuacucugcagaugac

SEQ ID NO: 818228 - RNA, 22 nt, Human
ucugggaagcugguccuguucu

SEQ ID NO: 818229 - RNA, 22 nt, Human
aggcaguuucugggacagcaua

SEQ ID NO: 818230 - RNA, 17 nt, Human
gagagcugcugcuuccg

SEQ ID NO: 818231 - RNA, 22 nt, Human
cccaguuucaacuuuccagugg

SEQ ID NO: 818232 - RNA, 22 nt, Human
agaggacagacggaaagugcca

SEQ ID NO: 818233 - RNA, 22 nt, Human
ugaggcaggagaaucacaugaa

SEQ ID NO: 818234 - RNA, 19 nt, Human
accaggagacagugagcuu

SEQ ID NO: 818235 - RNA, 22 nt, Human
cugaggaagacagcagcugugu

SEQ ID NO: 818236 - RNA, 22 nt, Human
gaaggccacuuuguguugagaa

SEQ ID NO: 818237 - RNA, 22 nt, Human
ucugucucaaguucuugcacuc

SEQ ID NO: 818238 - RNA, 22 nt, Human
ugucuucagcaaaugccuuucu

SEQ ID NO: 818239 - RNA, 22 nt, Human
aguggcagagccaaguagagcc

SEQ ID NO: 818240 - RNA, 22 nt, Human
uggaaagcgaggaguuggcauu

SEQ ID NO: 818241 - RNA, 22 nt, Human
cugagcugggaguagagacucu

SEQ ID NO: 818242 - RNA, 22 nt, Human
uuuaacagaugugaaauuuuca

SEQ ID NO: 818243 - RNA, 22 nt, Human
augcuuccaaggcuaagacaag

SEQ ID NO: 818244 - RNA, 22 nt, Human
uuucagggagccuagaagagcu

SEQ ID NO: 818245 - RNA, 21 nt, Human
gauuuuaaagagacugccaca

SEQ ID NO: 818246 - RNA, 22 nt, Human
aggagagggguaggauuaauuu

SEQ ID NO: 818247 - RNA, 22 nt, Human
gagaaaugcaugcaugucauca

SEQ ID NO: 818248 - RNA, 22 nt, Human
aggcugcugaggccaccacgcu

SEQ ID NO: 818249 - RNA, 21 nt, Human
ggcagccucuguggaagggga

SEQ ID NO: 818250 - RNA, 22 nt, Human
gucuuucuaugaugaacuguug

SEQ ID NO: 818251 - RNA, 22 nt, Human
accaggagcauuuuuuauuagu

SEQ ID NO: 818252 - RNA, 22 nt, Human
uaaggccaggcuguggucggca

SEQ ID NO: 818253 - RNA, 22 nt, Human
ucauuuaauaauuuuugaguag

SEQ ID NO: 818254 - RNA, 22 nt, Human
caaauguauaaauguacuuucu

SEQ ID NO: 818255 - RNA, 22 nt, Human
aucaggauccaccuugagccug

SEQ ID NO: 818256 - RNA, 22 nt, Human
caacugagcaguagcgucugga

SEQ ID NO: 818257 - RNA, 22 nt, Human
gucuucuguaagaugagguccc

SEQ ID NO: 818258 - RNA, 22 nt, Human
ugaaagguuaaaaguaguauug

SEQ ID NO: 818259 - RNA, 22 nt, Human
ucaacugcaaguuugcuuaguu

SEQ ID NO: 818260 - RNA, 22 nt, Human
ugaacaguuucaagaaaacuuu

SEQ ID NO: 818261 - RNA, 22 nt, Human
cagguaaaaauaaauuugugag

SEQ ID NO: 818262 - RNA, 22 nt, Human
ucucuucucuagugagcaacug

SEQ ID NO: 818263 - RNA, 22 nt, Human
auggagggugucagagagcgaa

SEQ ID NO: 818264 - RNA, 21 nt, Human
uagggcaggcauuggaagaga

SEQ ID NO: 818265 - RNA, 22 nt, Human
gugcaagguacauccuugaugu

SEQ ID NO: 818266 - RNA, 22 nt, Human
ucuucagauaaagggagaguau

SEQ ID NO: 818267 - RNA, 22 nt, Human
uccucagacuucccuuugugua

SEQ ID NO: 818268 - RNA, 22 nt, Human
acccaggaggcagagguugcag

SEQ ID NO: 818269 - RNA, 22 nt, Human
aaagcagauucugaugcaguag

SEQ ID NO: 818270 - RNA, 22 nt, Human
aaggagaaaugguagaugugca

SEQ ID NO: 818271 - RNA, 22 nt, Human
ucuuagaaguuuauggcacgga

SEQ ID NO: 818272 - RNA, 22 nt, Human
auucuuauuauaguaaaacagu

SEQ ID NO: 818273 - RNA, 22 nt, Human
aucuuucaguuucauaccaauu

SEQ ID NO: 818274 - RNA, 22 nt, Human
guaggcagauaggagugcagcc

SEQ ID NO: 818275 - RNA, 17 nt, Human
ggcagcugugugcaugc

SEQ ID NO: 818276 - RNA, 22 nt, Human
gaggcagcugaaggagugacag

SEQ ID NO: 818277 - RNA, 22 nt, Human
cagaauggcuuuuauggcucag

SEQ ID NO: 818278 - RNA, 22 nt, Human
cugcugugcacccaggaaggcu

SEQ ID NO: 818279 - RNA, 22 nt, Human
ggcagcugcaaaucugcucugu

SEQ ID NO: 818280 - RNA, 22 nt, Human
caggcagcagaggaguguggga

SEQ ID NO: 818281 - RNA, 22 nt, Human
cagcagagaccaagugauuuga

SEQ ID NO: 818282 - RNA, 22 nt, Human
cagcuagcuaagaaggccagag

SEQ ID NO: 818283 - RNA, 19 nt, Human
cuucuggcccugagccacc

SEQ ID NO: 818284 - RNA, 22 nt, Human
ccaugagcuuccuauauagggu

SEQ ID NO: 818285 - RNA, 22 nt, Human
gcugauguaagacuuuugguuu

SEQ ID NO: 818286 - RNA, 22 nt, Human
caggauggagaguuguugguug

SEQ ID NO: 818287 - RNA, 22 nt, Human
aggccagcgcugcuagcucccg

SEQ ID NO: 818288 - RNA, 22 nt, Human
aggcagccaaucagaggcugac

SEQ ID NO: 818289 - RNA, 21 nt, Human
acagcaagccuucacaugagu

SEQ ID NO: 818290 - RNA, 22 nt, Human
uucuuucucaacaugaauguuu

SEQ ID NO: 818291 - RNA, 22 nt, Human
aucacuguguauguauaugcag

SEQ ID NO: 818292 - RNA, 22 nt, Human
uugacacaguuuucucauuaag

SEQ ID NO: 818293 - RNA, 21 nt, Human
cucuugugucagagccagagg

SEQ ID NO: 818294 - RNA, 22 nt, Human
uuagccauuaauguccugugca

SEQ ID NO: 818295 - RNA, 22 nt, Human
ucuuugaauccuuuacaucuga

SEQ ID NO: 818296 - RNA, 22 nt, Human
aucuuucaaucaggaaaaaucu

SEQ ID NO: 818297 - RNA, 22 nt, Human
auucuucaccauggauaauuug

SEQ ID NO: 818298 - RNA, 22 nt, Human
gccaggagaaaaggcgaaugau

SEQ ID NO: 818299 - RNA, 22 nt, Human
augauauuugcaaugugcuugc

SEQ ID NO: 818300 - RNA, 22 nt, Human
ugggagcccaagggagcugccg

SEQ ID NO: 818301 - RNA, 22 nt, Human
augcuguguccuagugaaagaa

SEQ ID NO: 818302 - RNA, 22 nt, Human
ucgcugugguuucuguacaugg

SEQ ID NO: 818303 - RNA, 22 nt, Human
ugucugugaccucuuuggagcc

SEQ ID NO: 818304 - RNA, 22 nt, Human
uuugaauguuuuagguacuuaa

SEQ ID NO: 818305 - RNA, 22 nt, Human
acaggacuguggaaggaucucu

SEQ ID NO: 818306 - RNA, 22 nt, Human
ucucuucuaacacuagaaauuc

SEQ ID NO: 818307 - RNA, 22 nt, Human
cagagccauuauggagacuugc

SEQ ID NO: 818308 - RNA, 20 nt, Human
cccagugaagcauggaagag

SEQ ID NO: 818309 - RNA, 22 nt, Human
cucaggaaaggccaugcaaggg

SEQ ID NO: 818310 - RNA, 22 nt, Human
cccaggaccgcgcggcugagcg

SEQ ID NO: 818311 - RNA, 22 nt, Human
gcuguguuuuauguuagguuaa

SEQ ID NO: 818312 - RNA, 22 nt, Human
cauggagauaaacugaaauauu

SEQ ID NO: 818313 - RNA, 22 nt, Human
ggccagcucuuguccacggagg

SEQ ID NO: 818314 - RNA, 22 nt, Human
aaggaguuuggguagucauaca

SEQ ID NO: 818315 - RNA, 22 nt, Human
gcucaggaaauaguuuaguguu

SEQ ID NO: 818316 - RNA, 22 nt, Human
ucaggagauggucuuuauaggc

SEQ ID NO: 818317 - RNA, 22 nt, Human
ccucacugaagaggugacauuu

SEQ ID NO: 818318 - RNA, 22 nt, Human
ugaaucugauuucccuggaggc

SEQ ID NO: 818319 - RNA, 22 nt, Human
cuguguuugaugagaagccacc

SEQ ID NO: 818320 - RNA, 22 nt, Human
auuucccagcuuugaucaguuu

SEQ ID NO: 818321 - RNA, 22 nt, Human
agugcuuucccugaaaccuucc

SEQ ID NO: 818322 - RNA, 22 nt, Human
gcagcugcuggagggaggcagg

SEQ ID NO: 818323 - RNA, 20 nt, Human
ggaggguggaagaaagcaag

SEQ ID NO: 818324 - RNA, 20 nt, Human
agaggaggauuauuuuauuc

SEQ ID NO: 818325 - RNA, 22 nt, Human
gaggcagcuggguccggucggg

SEQ ID NO: 818326 - RNA, 22 nt, Human
ugaggcagauauuuauuggguu

SEQ ID NO: 818327 - RNA, 22 nt, Human
aacacugcugcuggguucugug

SEQ ID NO: 818328 - RNA, 22 nt, Human
auacacauauguguguauaugu

SEQ ID NO: 818329 - RNA, 22 nt, Human
cuuugaauugccguuucaucug

SEQ ID NO: 818330 - RNA, 22 nt, Human
uuuggaauauuaaaaugucuca

SEQ ID NO: 818331 - RNA, 22 nt, Human
uaucuguuaggaucagagcugg

SEQ ID NO: 818332 - RNA, 22 nt, Human
uuauuucauugauuucuaagac

SEQ ID NO: 818333 - RNA, 22 nt, Human
ggcaggcucagcagccaaggag

SEQ ID NO: 818334 - RNA, 22 nt, Human
uucuuaacucaaauauauaucc

SEQ ID NO: 818335 - RNA, 22 nt, Human
ggagaggguguggaaaguuauc

SEQ ID NO: 818336 - RNA, 22 nt, Human
aauauuuguuaguguuuuaaug

SEQ ID NO: 818337 - RNA, 22 nt, Human
gcagaggcuguagggaagguug

SEQ ID NO: 818338 - RNA, 22 nt, Human
guucucucugcuuccaagaugg

SEQ ID NO: 818339 - RNA, 22 nt, Human
uucauucugggcucuaaggaac

SEQ ID NO: 818340 - RNA, 22 nt, Human
uauucaaaguaccuucauugcc

SEQ ID NO: 818341 - RNA, 22 nt, Human
uccaugagagguaacuuuacaa

SEQ ID NO: 818342 - RNA, 22 nt, Human
cccuggaggcuggaggcaguag

SEQ ID NO: 818343 - RNA, 22 nt, Human
uaggagaggugaauggcacacu

SEQ ID NO: 818344 - RNA, 23 nt, Human
aaacugcuuccaauuccugccau

SEQ ID NO: 818345 - RNA, 22 nt, Human
gugguaaucggauucuuaccgg

SEQ ID NO: 818346 - RNA, 22 nt, Human
aucaggauggguuuggcuuagg

SEQ ID NO: 818347 - RNA, 22 nt, Human
agugcuguuagguuaauauagu

SEQ ID NO: 818348 - RNA, 22 nt, Human
aggcagcuggcaaauucuagag

SEQ ID NO: 818349 - RNA, 22 nt, Human
uuaauuaaauucaugagcauug

SEQ ID NO: 818350 - RNA, 22 nt, Human
uuagccauauagaaaaagagcu

SEQ ID NO: 818351 - RNA, 23 nt, Human
acagaaaucauuuguaagguacc

SEQ ID NO: 818352 - RNA, 22 nt, Human
agaggggacagccaccugcccg

SEQ ID NO: 818353 - RNA, 22 nt, Human
cucuggcuucuaccuugcaguu

SEQ ID NO: 818354 - RNA, 20 nt, Human
uaggcagcuugacccuuggu

SEQ ID NO: 818355 - RNA, 20 nt, Human
augauuuugcacuaacuuca

SEQ ID NO: 818356 - RNA, 22 nt, Human
cucuucuuggcccccaugaggg

SEQ ID NO: 818357 - RNA, 22 nt, Human
uuuaucuuuaggacuuugcaga

SEQ ID NO: 818358 - RNA, 22 nt, Human
uccaugaguuugaggaaaagag

SEQ ID NO: 818359 - RNA, 22 nt, Human
cuuugaagagauuacugugcuc

SEQ ID NO: 818360 - RNA, 22 nt, Human
acaggagacccugcugguucug

SEQ ID NO: 818361 - RNA, 22 nt, Human
cagcuacuccucccaugacuuc

SEQ ID NO: 818362 - RNA, 22 nt, Human
aaauuauuaugccccucuauaa

SEQ ID NO: 818363 - RNA, 22 nt, Human
gaggucagucagaccaggguuu

SEQ ID NO: 818364 - RNA, 22 nt, Human
guucuucaggccauccucccag

SEQ ID NO: 818365 - RNA, 22 nt, Human
uucccucuccuacucaggaaag

SEQ ID NO: 818366 - RNA, 22 nt, Human
uauuuuaaagugaagggucuug

SEQ ID NO: 818367 - RNA, 22 nt, Human
gaaggccauugcguccugggau

SEQ ID NO: 818368 - RNA, 22 nt, Human
gaggucaggggagaggcugaug

SEQ ID NO: 818369 - RNA, 19 nt, Human
ucuuucauuucuagcucug

SEQ ID NO: 818370 - RNA, 22 nt, Human
cugcuguguggugaaacucagu

SEQ ID NO: 818371 - RNA, 17 nt, Human
aaggccauuuccaccca

SEQ ID NO: 818372 - RNA, 22 nt, Human
cuuaagaugaggucaugcuaua

SEQ ID NO: 818373 - RNA, 22 nt, Human
ugaggcaguugagcuuccugag

SEQ ID NO: 818374 - RNA, 22 nt, Human
cuugaaagcacuuaguaaauua

SEQ ID NO: 818375 - RNA, 22 nt, Human
aggaugaauaacugaaauggug

SEQ ID NO: 818376 - RNA, 22 nt, Human
ugaaaugagauagauaaucagg

SEQ ID NO: 818377 - RNA, 22 nt, Human
gucauucuuaacaacucaguag

SEQ ID NO: 818378 - RNA, 22 nt, Human
cagcugugaauugucuuaucua

SEQ ID NO: 818379 - RNA, 22 nt, Human
aaaggccacacugcucuuucuc

SEQ ID NO: 818380 - RNA, 22 nt, Human
uauuucagcccuacuacuuggc

SEQ ID NO: 818381 - RNA, 22 nt, Human
ucacuguugaccuggaaguggg

SEQ ID NO: 818382 - RNA, 22 nt, Human
uugaaauggaagugaaaauucu

SEQ ID NO: 818383 - RNA, 22 nt, Human
uuuaaaauuuagaccucuccac

SEQ ID NO: 818384 - RNA, 22 nt, Human
agucuccuuggccucaaugccu

SEQ ID NO: 818385 - RNA, 22 nt, Human
auucuucaguauguguggauug

SEQ ID NO: 818386 - RNA, 22 nt, Human
gaggcagcaauaaaaagaauuu

SEQ ID NO: 818387 - RNA, 22 nt, Human
cccuguacagucucuguggcac

SEQ ID NO: 818388 - RNA, 22 nt, Human
aggggcucaaagugugcaggga

SEQ ID NO: 818389 - RNA, 22 nt, Human
cugcugugauugggagaaaccg

SEQ ID NO: 818390 - RNA, 22 nt, Human
uugugaguagugccgcaauaaa

SEQ ID NO: 818391 - RNA, 22 nt, Human
uugcauuuuuagaugcuucugu

SEQ ID NO: 818392 - RNA, 22 nt, Human
ugaggcagguaagcaaguuuug

SEQ ID NO: 818393 - RNA, 22 nt, Human
uuugaaaguguuuacuugggaa

SEQ ID NO: 818394 - RNA, 19 nt, Human
agaggcagucuccaacagg

SEQ ID NO: 818395 - RNA, 18 nt, Human
caugucugcgccacaagg

SEQ ID NO: 818396 - RNA, 22 nt, Human
gggcagcugcagggauggugac

SEQ ID NO: 818397 - RNA, 22 nt, Human
aggcagcuagagagugaaacug

SEQ ID NO: 818398 - RNA, 16 nt, Human
aaggagggaagagaau

SEQ ID NO: 818399 - RNA, 22 nt, Human
guggaauguccuugaucauaag

SEQ ID NO: 818400 - RNA, 22 nt, Human
ggagcaggagucucuugaauuu

SEQ ID NO: 818401 - RNA, 21 nt, Human
cuguggaagggaacuagaggg

SEQ ID NO: 818402 - RNA, 22 nt, Human
gccaugcuugguaugcugugag

SEQ ID NO: 818403 - RNA, 19 nt, Human
caugcugaccugcuguggu

SEQ ID NO: 818404 - RNA, 22 nt, Human
caucucaugggcaugccaagcu

SEQ ID NO: 818405 - RNA, 22 nt, Human
agaggcagccguauuucaaagg

SEQ ID NO: 818406 - RNA, 22 nt, Human
gaaacuguauguaguuuuuggg

SEQ ID NO: 818407 - RNA, 22 nt, Human
ggagaggagauuguggcauuuu

SEQ ID NO: 818408 - RNA, 22 nt, Human
acagugacguuuauuugagacg

SEQ ID NO: 818409 - RNA, 22 nt, Human
ugagaacugaggauuugaauuc

SEQ ID NO: 818410 - RNA, 22 nt, Human
gagggcauaguuaaauaggagg

SEQ ID NO: 818411 - RNA, 22 nt, Human
aaauguauugcauaggauauuu

SEQ ID NO: 818412 - RNA, 22 nt, Human
ucacaguaaaagcauggaagag

SEQ ID NO: 818413 - RNA, 22 nt, Human
auucucuuuguauaacaucuug

SEQ ID NO: 818414 - RNA, 22 nt, Human
uuccaugagcucugaguucaca

SEQ ID NO: 818415 - RNA, 22 nt, Human
ucagagaggcaauacuguuuaa

SEQ ID NO: 818416 - RNA, 18 nt, Human
cugcugugucgucugggc

SEQ ID NO: 818417 - RNA, 22 nt, Human
uucucugagauagacuaagugg

SEQ ID NO: 818418 - RNA, 22 nt, Human
aucaggauguuuggcugucaua

SEQ ID NO: 818419 - RNA, 22 nt, Human
acacuaaugagaaaggaauuaa

SEQ ID NO: 818420 - RNA, 22 nt, Human
cucuucucugcagccuuugaag

SEQ ID NO: 818421 - RNA, 22 nt, Human
aaugcuuuuugcgaaaugugca

SEQ ID NO: 818422 - RNA, 23 nt, Human
agggagcuaaaaggcuggagcag

SEQ ID NO: 818423 - RNA, 22 nt, Human
uggagucugugaugcucugggu

SEQ ID NO: 818424 - RNA, 22 nt, Human
ucuuugcaaauguuauuaucuu

SEQ ID NO: 818425 - RNA, 22 nt, Human
gagcagcugagcuggaaugaga

SEQ ID NO: 818426 - RNA, 22 nt, Human
gcugguuuccuuaucuauaaag

SEQ ID NO: 818427 - RNA, 22 nt, Human
caaauguaaauucuuuugaagc

SEQ ID NO: 818428 - RNA, 22 nt, Human
cuggguaaguuccuaaggcuca

SEQ ID NO: 818429 - RNA, 22 nt, Human
cuuaaaaucuggcaguuagcua

SEQ ID NO: 818430 - RNA, 20 nt, Human
ugugcaggagagugaggcug

SEQ ID NO: 818431 - RNA, 22 nt, Human
gagaggugaauguggaugccac

SEQ ID NO: 818432 - RNA, 22 nt, Human
auaguuugaaggcuguucuacu

SEQ ID NO: 818433 - RNA, 22 nt, Human
aucaggaugaagcuguagcgaa

SEQ ID NO: 818434 - RNA, 18 nt, Human
augggaggggccaagaga

SEQ ID NO: 818435 - RNA, 22 nt, Human
uggagacugugcuaagggaguu

SEQ ID NO: 818436 - RNA, 23 nt, Human
gaggcagcuccugcagugcccug

SEQ ID NO: 818437 - RNA, 22 nt, Human
cccaggcagugugugcaugcgu

SEQ ID NO: 818438 - RNA, 22 nt, Human
uuuagaaguucacacauuuaaa

SEQ ID NO: 818439 - RNA, 22 nt, Human
ugguaauuuacgcauuucugua

SEQ ID NO: 818440 - RNA, 19 nt, Human
uggcaucuguaaaauggug

SEQ ID NO: 818441 - RNA, 22 nt, Human
ccaggagagcucucguucagug

SEQ ID NO: 818442 - RNA, 22 nt, Human
cugagagugcucuuugauguca

SEQ ID NO: 818443 - RNA, 22 nt, Human
gcauguguuauuuuauguauga

SEQ ID NO: 818444 - RNA, 22 nt, Human
aucugccuccaaguccaugugu

SEQ ID NO: 818445 - RNA, 20 nt, Human
guggcaggcagugaaggagc

SEQ ID NO: 818446 - RNA, 22 nt, Human
augcuguggccagaguucaacu

SEQ ID NO: 818447 - RNA, 22 nt, Human
gagaggggcgcgcagcucgcga

SEQ ID NO: 818448 - RNA, 22 nt, Human
cauuuguuaauuacuauuaucu

SEQ ID NO: 818449 - RNA, 22 nt, Human
acagaaauugggcaaauggaag

SEQ ID NO: 818450 - RNA, 22 nt, Human
cuuucauucuuagauauuagug

SEQ ID NO: 818451 - RNA, 22 nt, Human
cugcuguggguuaagacacugu

SEQ ID NO: 818452 - RNA, 22 nt, Human
ccuucuucuguguggcccaaga

SEQ ID NO: 818453 - RNA, 22 nt, Human
cuugcaggccuuucuagcucua

SEQ ID NO: 818454 - RNA, 22 nt, Human
cacugagcugauagaauuccag

SEQ ID NO: 818455 - RNA, 22 nt, Human
uaucuguucaauggaagaugac

SEQ ID NO: 818456 - RNA, 22 nt, Human
uugaaaggugaacaugaugcac

SEQ ID NO: 818457 - RNA, 23 nt, Human
cuucucagaagucugugccagga

SEQ ID NO: 818458 - RNA, 20 nt, Human
uccaggagguuaguguggcu

SEQ ID NO: 818459 - RNA, 22 nt, Human
ggcagccuugacuagugacuua

SEQ ID NO: 818460 - RNA, 22 nt, Human
gagggaggcaucaugaauccag

SEQ ID NO: 818461 - RNA, 22 nt, Human
ugucaaauuuuuauugcaguau

SEQ ID NO: 818462 - RNA, 22 nt, Human
uucucugaucuugcuagacuga

SEQ ID NO: 818463 - RNA, 22 nt, Human
aaggccaacuaggaugagcuag

SEQ ID NO: 818464 - RNA, 22 nt, Human
uggcagcugaauggcuggaugg

SEQ ID NO: 818465 - RNA, 17 nt, Human
agaggcagauacuugga

SEQ ID NO: 818466 - RNA, 22 nt, Human
uagggauguaaacauaguaauu

SEQ ID NO: 818467 - RNA, 22 nt, Human
aaugucugccagaacugaucau

SEQ ID NO: 818468 - RNA, 18 nt, Human
guaggucaguaccaagca

SEQ ID NO: 818469 - RNA, 22 nt, Human
cucaggauuuaaaggggcacuc

SEQ ID NO: 818470 - RNA, 23 nt, Human
uuugaaguugacugccuuccaga

SEQ ID NO: 818471 - RNA, 22 nt, Human
caggcgagugaacagacucuca

SEQ ID NO: 818472 - RNA, 22 nt, Human
uuucaguucaguuuauuauauc

SEQ ID NO: 818473 - RNA, 22 nt, Human
ucauuuguaccauuuuuuaaga

SEQ ID NO: 818474 - RNA, 22 nt, Human
ggcaugcucuuuguccacagua

SEQ ID NO: 818475 - RNA, 22 nt, Human
cccaggaggaggaaaaagcucg

SEQ ID NO: 818476 - RNA, 22 nt, Human
uggaggaaguggcuggccagaa

SEQ ID NO: 818477 - RNA, 22 nt, Human
agauggaguuaguaccagaguc

SEQ ID NO: 818478 - RNA, 22 nt, Human
uugcaggaaacugagugugagc

SEQ ID NO: 818479 - RNA, 22 nt, Human
aauggccagcugggagaguuga

SEQ ID NO: 818480 - RNA, 22 nt, Human
aagggaggggauguaagccugg

SEQ ID NO: 818481 - RNA, 22 nt, Human
ugaaaugacagucuuaagcucu

SEQ ID NO: 818482 - RNA, 22 nt, Human
gucuucuuguuuugaaggaaau

SEQ ID NO: 818483 - RNA, 18 nt, Human
cucaccauucugcccaau

SEQ ID NO: 818484 - RNA, 22 nt, Human
guggcagcaaaugccuggacua

SEQ ID NO: 818485 - RNA, 22 nt, Human
aucuucucaagcagcauccugu

SEQ ID NO: 818486 - RNA, 17 nt, Human
uuucuccuuccaucuca

SEQ ID NO: 818487 - RNA, 22 nt, Human
agacagugcaagaagagcaggc

SEQ ID NO: 818488 - RNA, 22 nt, Human
uggggcuccuccuggcaggagg

SEQ ID NO: 818489 - RNA, 21 nt, Human
cccaggaggcugagaagagca

SEQ ID NO: 818490 - RNA, 22 nt, Human
uuagccaugugggaaaaacagc

SEQ ID NO: 818491 - RNA, 22 nt, Human
agggcagcagcuccuccuagcu

SEQ ID NO: 818492 - RNA, 22 nt, Human
ggcagcuauuccaagcagcacu

SEQ ID NO: 818493 - RNA, 22 nt, Human
uuagccauuaaauuacaaggug

SEQ ID NO: 818494 - RNA, 22 nt, Human
auggagacgcaagggaccuagg

SEQ ID NO: 818495 - RNA, 22 nt, Human
agaggggaguccuaaucugauu

SEQ ID NO: 818496 - RNA, 22 nt, Human
ggcuuggaaaugguaaugagcu

SEQ ID NO: 818497 - RNA, 22 nt, Human
aaggcagcuuuaaaaaagaugc

SEQ ID NO: 818498 - RNA, 22 nt, Human
cugcuuugggcagcuuuguggc

SEQ ID NO: 818499 - RNA, 22 nt, Human
uucucuuugacauuauucaggu

SEQ ID NO: 818500 - RNA, 15 nt, Human
cccaggaguucgaga

SEQ ID NO: 818501 - RNA, 22 nt, Human
gacuucuauuaauaccucuacu

SEQ ID NO: 818502 - RNA, 22 nt, Human
aggaggcacucacucucagggu

SEQ ID NO: 818503 - RNA, 23 nt, Human
cagcccuuccugcauguuuuugu

SEQ ID NO: 818504 - RNA, 22 nt, Human
gcaggagaaaugaagauugggu

SEQ ID NO: 818505 - RNA, 22 nt, Human
agucucugccagcuuguccucu

SEQ ID NO: 818506 - RNA, 22 nt, Human
aaaauuauagaucuagugccug

SEQ ID NO: 818507 - RNA, 22 nt, Human
gaggcagcugggcuggugguuu

SEQ ID NO: 818508 - RNA, 22 nt, Human
ccauuguaaauucuguggaagu

SEQ ID NO: 818509 - RNA, 22 nt, Human
acauauauuacuaguaaagaca

SEQ ID NO: 818510 - RNA, 22 nt, Human
uugaacugguaguuggaaaucu

SEQ ID NO: 818511 - RNA, 22 nt, Human
guccaugauucugugacacccu

SEQ ID NO: 818512 - RNA, 22 nt, Human
ggccaggagaggagggcacuga

SEQ ID NO: 818513 - RNA, 22 nt, Human
aggccagaaauuuggaguaugu

SEQ ID NO: 818514 - RNA, 22 nt, Human
ccaggcugggcuacaaguugag

SEQ ID NO: 818515 - RNA, 19 nt, Human
uggcagggagaguuugaag

SEQ ID NO: 818516 - RNA, 22 nt, Human
aggagaggucucccuuccccag

SEQ ID NO: 818517 - RNA, 22 nt, Human
agcagccuuugaucaucuggga

SEQ ID NO: 818518 - RNA, 17 nt, Human
uugaacugcugagucag

SEQ ID NO: 818519 - RNA, 22 nt, Human
caagagagaugcagcucacuca

SEQ ID NO: 818520 - RNA, 22 nt, Human
ucagccucucugaguccagacc

SEQ ID NO: 818521 - RNA, 22 nt, Human
cugcuuugauuagaagaguaca

SEQ ID NO: 818522 - RNA, 23 nt, Human
acacauuuuucccguucugaggu

SEQ ID NO: 818523 - RNA, 22 nt, Human
ugcuucuggaaacaguggcugu

SEQ ID NO: 818524 - RNA, 22 nt, Human
gcuuccuaaaugcacagggcag

SEQ ID NO: 818525 - RNA, 22 nt, Human
caaaucuauauguugauauucu

SEQ ID NO: 818526 - RNA, 22 nt, Human
aauuuccagaccccauccacag

SEQ ID NO: 818527 - RNA, 23 nt, Human
cugcuguuuucuguaccugaagc

SEQ ID NO: 818528 - RNA, 22 nt, Human
gaggcagcaugguaccuuggag

SEQ ID NO: 818529 - RNA, 21 nt, Human
uacugagaccucacagugugc

SEQ ID NO: 818530 - RNA, 22 nt, Human
uggcagcuuccugcucauagga

SEQ ID NO: 818531 - RNA, 22 nt, Human
ggauggcaggacaaggacccag

SEQ ID NO: 818532 - RNA, 22 nt, Human
aguucucaagacaauuaccugu

SEQ ID NO: 818533 - RNA, 22 nt, Human
ugaaggcccuaucuccauauac

SEQ ID NO: 818534 - RNA, 22 nt, Human
uaggagagcugaacuauugucu

SEQ ID NO: 818535 - RNA, 22 nt, Human
ggaggggaacuaaucccgugac

SEQ ID NO: 818536 - RNA, 22 nt, Human
uuaguuuucccaucuuuauggu

SEQ ID NO: 818537 - RNA, 22 nt, Human
gaagcacauggcuauagcuauu

SEQ ID NO: 818538 - RNA, 22 nt, Human
aaauuuucagagcacuagagaa

SEQ ID NO: 818539 - RNA, 22 nt, Human
uucucagauauuuacugagcau

SEQ ID NO: 818540 - RNA, 22 nt, Human
uugcugugucugauggcugaga

SEQ ID NO: 818541 - RNA, 22 nt, Human
accaggagccauagagucaggc

SEQ ID NO: 818542 - RNA, 22 nt, Human
gagccaaggguugccauggaga

SEQ ID NO: 818543 - RNA, 22 nt, Human
cacaauguauauguauaucaaa

SEQ ID NO: 818544 - RNA, 22 nt, Human
uuuggaauuggaaagugcugug

SEQ ID NO: 818545 - RNA, 22 nt, Human
gauauuuugagaaauccuauga

SEQ ID NO: 818546 - RNA, 22 nt, Human
uucuucuucauuucugacgaug

SEQ ID NO: 818547 - RNA, 22 nt, Human
gucaggaugagggaugaggagu

SEQ ID NO: 818548 - RNA, 22 nt, Human
uuuuuuaguuaggucagaaugu

SEQ ID NO: 818549 - RNA, 22 nt, Human
agagcagcugugacauggacag

SEQ ID NO: 818550 - RNA, 22 nt, Human
aacauauaaacucuuaaguuca

SEQ ID NO: 818551 - RNA, 23 nt, Human
caguggagacucaugcuuccuua

SEQ ID NO: 818552 - RNA, 21 nt, Human
agccagcuaucacacagcauu

SEQ ID NO: 818553 - RNA, 22 nt, Human
uucuucaaacaaaaguggcaug

SEQ ID NO: 818554 - RNA, 22 nt, Human
gugcugugucuaucaggaauaa

SEQ ID NO: 818555 - RNA, 22 nt, Human
gaucuguuauaaucucuuuuau

SEQ ID NO: 818556 - RNA, 22 nt, Human
caggcagcagccacucugguau

SEQ ID NO: 818557 - RNA, 22 nt, Human
aaagcagaacugagagagcugg

SEQ ID NO: 818558 - RNA, 22 nt, Human
ugcuuggccuacuuguccuuug

SEQ ID NO: 818559 - RNA, 22 nt, Human
acucaggaauggggcugggacu

SEQ ID NO: 818560 - RNA, 22 nt, Human
aggccagaugucgggcuagaag

SEQ ID NO: 818561 - RNA, 22 nt, Human
gaggggcagagguagagaacaa

SEQ ID NO: 818562 - RNA, 20 nt, Human
uucaggauucuagaccacac

SEQ ID NO: 818563 - RNA, 22 nt, Human
ccaggcagcaaauuuucugaau

SEQ ID NO: 818564 - RNA, 22 nt, Human
caacagcugaucuuugaugaag

SEQ ID NO: 818565 - RNA, 22 nt, Human
cauucuuauauuuacucauuca

SEQ ID NO: 818566 - RNA, 22 nt, Human
cagcugacccgugggaggcggg

SEQ ID NO: 818567 - RNA, 22 nt, Human
cagcuuccauaagagauggaga

SEQ ID NO: 818568 - RNA, 22 nt, Human
cccaggagccaucugucuuggc

SEQ ID NO: 818569 - RNA, 22 nt, Human
agcaccugccugcauuggcuau

SEQ ID NO: 818570 - RNA, 22 nt, Human
aggcaguggagcuggaauaggc

SEQ ID NO: 818571 - RNA, 20 nt, Human
augugagggguugaaguggg

SEQ ID NO: 818572 - RNA, 22 nt, Human
gucaggaugacaagugcuuuca

SEQ ID NO: 818573 - RNA, 19 nt, Human
gccaggagggcucuggcug

SEQ ID NO: 818574 - RNA, 22 nt, Human
ggagaggagcuauugggggcuc

SEQ ID NO: 818575 - RNA, 22 nt, Human
cccaggaacagcacagaacagc

SEQ ID NO: 818576 - RNA, 20 nt, Human
accaauguuagcuuaguacu

SEQ ID NO: 818577 - RNA, 22 nt, Human
uuugaauagaggccccucagaa

SEQ ID NO: 818578 - RNA, 22 nt, Human
ugaaaugauguacaagaaggca

SEQ ID NO: 818579 - RNA, 22 nt, Human
aggcagcaugggcccagagucc

SEQ ID NO: 818580 - RNA, 22 nt, Human
ggguacuuaauauuuacggggu

SEQ ID NO: 818581 - RNA, 22 nt, Human
auugaaagauuuugggcucaug

SEQ ID NO: 818582 - RNA, 22 nt, Human
cagcgucucguugugggccucg

SEQ ID NO: 818583 - RNA, 22 nt, Human
uccaggaggaggaaggcugcca

SEQ ID NO: 818584 - RNA, 22 nt, Human
gaggcagagugcaccccaggag

SEQ ID NO: 818585 - RNA, 19 nt, Human
agcuuccauauucucuagu

SEQ ID NO: 818586 - RNA, 22 nt, Human
aagauauucaaagauuuauuag

SEQ ID NO: 818587 - RNA, 18 nt, Human
aggcaggugcuggaaguc

SEQ ID NO: 818588 - RNA, 22 nt, Human
uuugcauaaaggagcauuucuc

SEQ ID NO: 818589 - RNA, 22 nt, Human
cucagaagccuucagucuuggc

SEQ ID NO: 818590 - RNA, 22 nt, Human
cucccagagaccaagcugagaa

SEQ ID NO: 818591 - RNA, 22 nt, Human
cagcugacgccagaguggaauu

SEQ ID NO: 818592 - RNA, 22 nt, Human
aaaaaucuaugacugcuucucc

SEQ ID NO: 818593 - RNA, 22 nt, Human
acucuucuugcugcucauuaau

SEQ ID NO: 818594 - RNA, 22 nt, Human
uucaggauuguguuuuuccuga

SEQ ID NO: 818595 - RNA, 22 nt, Human
gcagcugaauguccauugcugc

SEQ ID NO: 818596 - RNA, 22 nt, Human
ucuuuuggguucuuaugauuua

SEQ ID NO: 818597 - RNA, 20 nt, Human
gcccaggaauuugcauuucu

SEQ ID NO: 818598 - RNA, 22 nt, Human
uggcagcucuguucaacaugag

SEQ ID NO: 818599 - RNA, 22 nt, Human
cacugucuuuugugaagacaau

SEQ ID NO: 818600 - RNA, 22 nt, Human
uccaggagaaaacugacggugg

SEQ ID NO: 818601 - RNA, 21 nt, Human
ugaaugaggaggauggcauuu

SEQ ID NO: 818602 - RNA, 22 nt, Human
uucuucuuaauguccugggaac

SEQ ID NO: 818603 - RNA, 22 nt, Human
uuuggaauguaguuuaaucauc

SEQ ID NO: 818604 - RNA, 22 nt, Human
acaauucugaugguuucccagu

SEQ ID NO: 818605 - RNA, 22 nt, Human
ggaagaggcugagccagguccc

SEQ ID NO: 818606 - RNA, 22 nt, Human
gccugcagauauauaggauggu

SEQ ID NO: 818607 - RNA, 22 nt, Human
cacauauuugaugaagcuuugu

SEQ ID NO: 818608 - RNA, 22 nt, Human
aggcugcucaguagauggagcu

SEQ ID NO: 818609 - RNA, 22 nt, Human
ucuucucucauguaggagggaa

SEQ ID NO: 818610 - RNA, 21 nt, Human
uccaggaguucuaauaggugu

SEQ ID NO: 818611 - RNA, 22 nt, Human
gcuuugaagucugugucuuuug

SEQ ID NO: 818612 - RNA, 22 nt, Human
agcugccgaugcccagcugcau

SEQ ID NO: 818613 - RNA, 22 nt, Human
ccuugcguuuuacagcuucuag

SEQ ID NO: 818614 - RNA, 22 nt, Human
gaggcacuggaggaaaggagaa

SEQ ID NO: 818615 - RNA, 22 nt, Human
uguucucacuggaugcuucaca

SEQ ID NO: 818616 - RNA, 22 nt, Human
gccucugcccuccugggacugc

SEQ ID NO: 818617 - RNA, 22 nt, Human
agacgagggccuggcacacagu

SEQ ID NO: 818618 - RNA, 22 nt, Human
aggccagcccugggcugagaga

SEQ ID NO: 818619 - RNA, 22 nt, Human
acgagagguccuuagaaucugu

SEQ ID NO: 818620 - RNA, 22 nt, Human
gcugaaauucagauuccuaggc

SEQ ID NO: 818621 - RNA, 22 nt, Human
aguggaccagaagacugaagcu

SEQ ID NO: 818622 - RNA, 22 nt, Human
aaaauaacuucuacuauuugca

SEQ ID NO: 818623 - RNA, 22 nt, Human
aagcagcuggaagaguaagaug

SEQ ID NO: 818624 - RNA, 22 nt, Human
uccaugagcuagggauucauca

SEQ ID NO: 818625 - RNA, 22 nt, Human
ugcccaggauugugaggucagg

SEQ ID NO: 818626 - RNA, 22 nt, Human
aggcagcugaggucuggcgccc

SEQ ID NO: 818627 - RNA, 22 nt, Human
cuguguuggcuuuucucuugua

SEQ ID NO: 818628 - RNA, 22 nt, Human
cccaggaggcagagcuugcagu

SEQ ID NO: 818629 - RNA, 22 nt, Human
uuuaaauuuagaagaaacacug

SEQ ID NO: 818630 - RNA, 22 nt, Human
uguugaagauaaaguucucauu

SEQ ID NO: 818631 - RNA, 22 nt, Human
gcccaggauaaugcugucccug

SEQ ID NO: 818632 - RNA, 20 nt, Human
uuucaguugguuaauggcau

SEQ ID NO: 818633 - RNA, 22 nt, Human
aaggcaguuaauuuggcuagaa

SEQ ID NO: 818634 - RNA, 22 nt, Human
ggacaagccugugaguggguuu

SEQ ID NO: 818635 - RNA, 22 nt, Human
acccaggacacagagaugaccc

SEQ ID NO: 818636 - RNA, 20 nt, Human
cuucuucaguaguuuguucu

SEQ ID NO: 818637 - RNA, 22 nt, Human
uccacauccauugcuugacuuu

SEQ ID NO: 818638 - RNA, 22 nt, Human
ccuugcugcgugcuagcacaga

SEQ ID NO: 818639 - RNA, 22 nt, Human
cuucccagaccuuagagugcag

SEQ ID NO: 818640 - RNA, 22 nt, Human
aagagggcagcacagguggguc

SEQ ID NO: 818641 - RNA, 22 nt, Human
uugaaaggguuaaagugguaaa

SEQ ID NO: 818642 - RNA, 20 nt, Human
uauuuacaacuuagagccuc

SEQ ID NO: 818643 - RNA, 22 nt, Human
cccaggaaaguggaggcggcug

SEQ ID NO: 818644 - RNA, 22 nt, Human
cccaggaaaugaacuucugauu

SEQ ID NO: 818645 - RNA, 22 nt, Human
agugcuuuagagaaauggugcu

SEQ ID NO: 818646 - RNA, 22 nt, Human
ccccaggacacauggaccaagu

SEQ ID NO: 818647 - RNA, 18 nt, Human
gaugggagcaagagaaga

SEQ ID NO: 818648 - RNA, 21 nt, Human
acaggagaccgccuggcaguc

SEQ ID NO: 818649 - RNA, 22 nt, Human
gucaggaucaaauugaaguuau

SEQ ID NO: 818650 - RNA, 22 nt, Human
aaaauuauggaguaucccaaag

SEQ ID NO: 818651 - RNA, 22 nt, Human
ccagacaggaacacacaucucc

SEQ ID NO: 818652 - RNA, 22 nt, Human
acaagcaugggcuuugacauca

SEQ ID NO: 818653 - RNA, 22 nt, Human
aaaaugagauacaguuugaaag

SEQ ID NO: 818654 - RNA, 22 nt, Human
cuugcacacauguacaugugua

SEQ ID NO: 818655 - RNA, 22 nt, Human
cugcugugugcuuacuuggguu

SEQ ID NO: 818656 - RNA, 21 nt, Human
gcaaauguucaggaaaaaaga

SEQ ID NO: 818657 - RNA, 22 nt, Human
caggagggcccgagacucuucc

SEQ ID NO: 818658 - RNA, 22 nt, Human
gcagcugagcgugaggaagagu

SEQ ID NO: 818659 - RNA, 22 nt, Human
cauuuauucauuugcuagggcu

SEQ ID NO: 818660 - RNA, 22 nt, Human
cuucagaagccugcagccuuug

SEQ ID NO: 818661 - RNA, 20 nt, Human
uccaugaguuagagacuaua

SEQ ID NO: 818662 - RNA, 17 nt, Human
gaggacagggaaguagg

SEQ ID NO: 818663 - RNA, 22 nt, Human
ucugucuccucugaggugccag

SEQ ID NO: 818664 - RNA, 22 nt, Human
ccucaggauacaggagccacag

SEQ ID NO: 818665 - RNA, 22 nt, Human
ccacuguuuuucaguuaacuuu

SEQ ID NO: 818666 - RNA, 22 nt, Human
uucagaauauuuguuuuacaug

SEQ ID NO: 818667 - RNA, 22 nt, Human
aguaccaugcuuccugacuggu

SEQ ID NO: 818668 - RNA, 22 nt, Human
aacuagucagugauucucagaa

SEQ ID NO: 818669 - RNA, 22 nt, Human
uugcugaagugaagguauguuu

SEQ ID NO: 818670 - RNA, 22 nt, Human
acuggcagcagcagcccuuggg

SEQ ID NO: 818671 - RNA, 19 nt, Human
ugaggggaggagaggccug

SEQ ID NO: 818672 - RNA, 22 nt, Human
cugaaaauguuacacaggaaga

SEQ ID NO: 818673 - RNA, 22 nt, Human
agagcagcuggggcagagacca

SEQ ID NO: 818674 - RNA, 22 nt, Human
gcccaggaguuugcauuuuaac

SEQ ID NO: 818675 - RNA, 22 nt, Human
ccagagagauugcuucuaaaga

SEQ ID NO: 818676 - RNA, 22 nt, Human
uuucuucauucaccuucacccc

SEQ ID NO: 818677 - RNA, 19 nt, Human
ugagaggcuuaaggcagcu

SEQ ID NO: 818678 - RNA, 22 nt, Human
aaauuauaggugccaccuugga

SEQ ID NO: 818679 - RNA, 22 nt, Human
gagcagcucugugccuggagac

SEQ ID NO: 818680 - RNA, 22 nt, Human
agcaccuugcucuuggccuucc

SEQ ID NO: 818681 - RNA, 22 nt, Human
ccaggagaauaauggcagauua

SEQ ID NO: 818682 - RNA, 22 nt, Human
guuugcauauuugcacaggaau

SEQ ID NO: 818683 - RNA, 22 nt, Human
aguugcagacgcagagauguug

SEQ ID NO: 818684 - RNA, 22 nt, Human
uuuguaaauagcaguacucaug

SEQ ID NO: 818685 - RNA, 22 nt, Human
auucaaguucuucugucuuugc

SEQ ID NO: 818686 - RNA, 22 nt, Human
uggcagagugcagaagaggcau

SEQ ID NO: 818687 - RNA, 22 nt, Human
cccauugugguuguugaggaua

SEQ ID NO: 818688 - RNA, 22 nt, Human
ugauugaagaggugaggaaguu

SEQ ID NO: 818689 - RNA, 22 nt, Human
ugaggcagugauguuuaagcac

SEQ ID NO: 818690 - RNA, 22 nt, Human
cagggagggaggaaaauuugcu

SEQ ID NO: 818691 - RNA, 22 nt, Human
caggcagcaggagcccugcucg

SEQ ID NO: 818692 - RNA, 18 nt, Human
ugcuuggagcauuuacca

SEQ ID NO: 818693 - RNA, 22 nt, Human
ucacaauuuggauacagcuaug

SEQ ID NO: 818694 - RNA, 17 nt, Human
agcugaaauugcugaag

SEQ ID NO: 818695 - RNA, 22 nt, Human
guucuucagaggggaaagaacc

SEQ ID NO: 818696 - RNA, 22 nt, Human
ugcugaugcuguucuguuagga

SEQ ID NO: 818697 - RNA, 22 nt, Human
uucuucucucauagauuaaggu

SEQ ID NO: 818698 - RNA, 22 nt, Human
ugagauguaagguaugcuuacu

SEQ ID NO: 818699 - RNA, 22 nt, Human
uuugaaguucccccauaucaga

SEQ ID NO: 818700 - RNA, 22 nt, Human
cagcagaggugguucacauugu

SEQ ID NO: 818701 - RNA, 23 nt, Human
ucaggauauugugugccaaggug

SEQ ID NO: 818702 - RNA, 15 nt, Human
uucaggauaugacuc

SEQ ID NO: 818703 - RNA, 22 nt, Human
aagggcagaauagagaagaugg

SEQ ID NO: 818704 - RNA, 22 nt, Human
uuuauuugaaucaggggagaau

SEQ ID NO: 818705 - RNA, 22 nt, Human
cagcugcuguuacugcuuauua

SEQ ID NO: 818706 - RNA, 22 nt, Human
cuuguaauuauaauguacuguu

SEQ ID NO: 818707 - RNA, 22 nt, Human
ucuuccucuagaucugaggccc

SEQ ID NO: 818708 - RNA, 22 nt, Human
accaggagguguuugcucaagu

SEQ ID NO: 818709 - RNA, 22 nt, Human
cugcuaaaccucucugagagcu

SEQ ID NO: 818710 - RNA, 22 nt, Human
uugcuguguaacuccuggccug

SEQ ID NO: 818711 - RNA, 22 nt, Human
uaguuuuacuugcgaugauaau

SEQ ID NO: 818712 - RNA, 20 nt, Human
cucuccucacccgugucagg

SEQ ID NO: 818713 - RNA, 22 nt, Human
uuuccucauuuaucugcuggga

SEQ ID NO: 818714 - RNA, 21 nt, Human
acagacagggccagugucccc

SEQ ID NO: 818715 - RNA, 22 nt, Human
gcagcugcaauaggcaucaagc

SEQ ID NO: 818716 - RNA, 22 nt, Human
ucccaggacccaggcauucaca

SEQ ID NO: 818717 - RNA, 22 nt, Human
agacagugauguaagcaggagu

SEQ ID NO: 818718 - RNA, 22 nt, Human
caaaugauagagccgauuauca

SEQ ID NO: 818719 - RNA, 22 nt, Human
caaauguauucucacuucaggg

SEQ ID NO: 818720 - RNA, 20 nt, Human
uuuacauuuugaaacaguga

SEQ ID NO: 818721 - RNA, 22 nt, Human
gagaggagguggcuaugacagc

SEQ ID NO: 818722 - RNA, 22 nt, Human
uuuuuggguccaggcuguaucu

SEQ ID NO: 818723 - RNA, 22 nt, Human
ggagugggaacaaugacauggu

SEQ ID NO: 818724 - RNA, 22 nt, Human
ucuuagaaauuccccaguggcu

SEQ ID NO: 818725 - RNA, 22 nt, Human
gaauacaugauacaugaacugc

SEQ ID NO: 818726 - RNA, 22 nt, Human
cggcagcuccgcgccguaggac

SEQ ID NO: 818727 - RNA, 22 nt, Human
uugcuuugccaccagaagucua

SEQ ID NO: 818728 - RNA, 22 nt, Human
cuugcugucccuugguaugaac

SEQ ID NO: 818729 - RNA, 21 nt, Human
cagcagaguaaugcauucgua

SEQ ID NO: 818730 - RNA, 22 nt, Human
cacagacccagaagggaugaag

SEQ ID NO: 818731 - RNA, 22 nt, Human
caaggccaguccauuuuggaag

SEQ ID NO: 818732 - RNA, 22 nt, Human
gagccagcuauguagcaagagg

SEQ ID NO: 818733 - RNA, 22 nt, Human
ggauguugauugaauggccauu

SEQ ID NO: 818734 - RNA, 18 nt, Human
ucuuccaacacugacacc

SEQ ID NO: 818735 - RNA, 22 nt, Human
ggccagaaguuggaaaagagcc

SEQ ID NO: 818736 - RNA, 22 nt, Human
aacauuucagcaaauaagaaca

SEQ ID NO: 818737 - RNA, 22 nt, Human
uuugaaguggaaaaggauuuaa

SEQ ID NO: 818738 - RNA, 22 nt, Human
gaggcaguguugaaaaggagag

SEQ ID NO: 818739 - RNA, 22 nt, Human
aggggagguggcagaaaugugc

SEQ ID NO: 818740 - RNA, 22 nt, Human
gcucaggacccaggugugaccu

SEQ ID NO: 818741 - RNA, 22 nt, Human
aggcaggcugcuauggaguaga

SEQ ID NO: 818742 - RNA, 22 nt, Human
ugcauaaagugccauaguauua

SEQ ID NO: 818743 - RNA, 22 nt, Human
auucaaguggcugcuauguuaa

SEQ ID NO: 818744 - RNA, 22 nt, Human
aggcaggcuggucugaagagug

SEQ ID NO: 818745 - RNA, 21 nt, Human
gcugcaucaaucuacccaggg

SEQ ID NO: 818746 - RNA, 22 nt, Human
auucuucacaaauauauagaag

SEQ ID NO: 818747 - RNA, 20 nt, Human
ucagugauuuugaagaggaa

SEQ ID NO: 818748 - RNA, 21 nt, Human
cacucaggguaugugccaggc

SEQ ID NO: 818749 - RNA, 22 nt, Human
ucuuugcagaauuuaacuuugc

SEQ ID NO: 818750 - RNA, 18 nt, Human
aggcaggcuggagugacu

SEQ ID NO: 818751 - RNA, 19 nt, Human
acaaaugauguugcacuga

SEQ ID NO: 818752 - RNA, 22 nt, Human
cugcugugagugguucuugccu

SEQ ID NO: 818753 - RNA, 22 nt, Human
uccugaggcucacuuugaaugu

SEQ ID NO: 818754 - RNA, 22 nt, Human
uccaggagguuuggaggaagca

SEQ ID NO: 818755 - RNA, 22 nt, Human
cugcuguguuucugcuagaaaa

SEQ ID NO: 818756 - RNA, 22 nt, Human
acuggcaguagagggagcgcau

SEQ ID NO: 818757 - RNA, 22 nt, Human
ugcauguguuugccacagugag

SEQ ID NO: 818758 - RNA, 18 nt, Human
cgaggcaggcggaucacg

SEQ ID NO: 818759 - RNA, 19 nt, Human
uucaggauugacccuacug

SEQ ID NO: 818760 - RNA, 22 nt, Human
ucuucuuccucauuuauacaua

SEQ ID NO: 818761 - RNA, 22 nt, Human
aaaggaagaugccaggacucug

SEQ ID NO: 818762 - RNA, 22 nt, Human
aggcacaguggcucacaccugu

SEQ ID NO: 818763 - RNA, 22 nt, Human
auuguucaaagugcuuugcaug

SEQ ID NO: 818764 - RNA, 22 nt, Human
uggcagcuaucuuuaaugagau

SEQ ID NO: 818765 - RNA, 20 nt, Human
aucaggauucuugcuuuguu

SEQ ID NO: 818766 - RNA, 22 nt, Human
gcaguucuacuuauccauagac

SEQ ID NO: 818767 - RNA, 22 nt, Human
cuccccagguucaggagguggg

SEQ ID NO: 818768 - RNA, 22 nt, Human
cucaggauccaucuccugcccu

SEQ ID NO: 818769 - RNA, 20 nt, Human
uuucaagucagcaauucuca

SEQ ID NO: 818770 - RNA, 22 nt, Human
aucuucucauguguaaugaggu

SEQ ID NO: 818771 - RNA, 22 nt, Human
gaggaacccagcugggguugcc

SEQ ID NO: 818772 - RNA, 22 nt, Human
uuuaagauucaguaaggcaaac

SEQ ID NO: 818773 - RNA, 22 nt, Human
ucuucacaugaccuucaugucu

SEQ ID NO: 818774 - RNA, 22 nt, Human
acucaggagggaucagcuauca

SEQ ID NO: 818775 - RNA, 22 nt, Human
aggcugcugccuuggagagugu

SEQ ID NO: 818776 - RNA, 22 nt, Human
gcccaggagccuggagaugugu

SEQ ID NO: 818777 - RNA, 22 nt, Human
uucaguaaaacacugcaauguc

SEQ ID NO: 818778 - RNA, 22 nt, Human
ugacccauggucugaucauagg

SEQ ID NO: 818779 - RNA, 21 nt, Human
ccauaccuaccucaccugguu

SEQ ID NO: 818780 - RNA, 22 nt, Human
uccuucuuugacaaguggcaga

SEQ ID NO: 818781 - RNA, 21 nt, Human
gagugcagcaagguagagucu

SEQ ID NO: 818782 - RNA, 22 nt, Human
guugaaagaugucuugguuccc

SEQ ID NO: 818783 - RNA, 22 nt, Human
gaggcgagaagcuggagauggu

SEQ ID NO: 818784 - RNA, 19 nt, Human
gaggagcuaucggagacag

SEQ ID NO: 818785 - RNA, 22 nt, Human
ugcaugcugcacacaugcguag

SEQ ID NO: 818786 - RNA, 22 nt, Human
ucagagagugcaaaauauagcu

SEQ ID NO: 818787 - RNA, 22 nt, Human
uuauggcauauuccucauugua

SEQ ID NO: 818788 - RNA, 22 nt, Human
ggcucagaccucccagcuccag

SEQ ID NO: 818789 - RNA, 22 nt, Human
uaacaucuuuagcagcucgaac

SEQ ID NO: 818790 - RNA, 22 nt, Human
aauuuuaagcauaugacugguu

SEQ ID NO: 818791 - RNA, 22 nt, Human
cagugguugguagauacuugag

SEQ ID NO: 818792 - RNA, 22 nt, Human
gaggcagcucuucugaaugggg

SEQ ID NO: 818793 - RNA, 22 nt, Human
cuugcaggauuuugcugcugua

SEQ ID NO: 818794 - RNA, 22 nt, Human
ucagauggcacacagagccugc

SEQ ID NO: 818795 - RNA, 22 nt, Human
uucugggacaucuggacaguuu

SEQ ID NO: 818796 - RNA, 22 nt, Human
uuauuauuggugaguuaaggaa

SEQ ID NO: 818797 - RNA, 20 nt, Human
auaaaauaacugccacaaga

SEQ ID NO: 818798 - RNA, 22 nt, Human
caaauaguuuuucauguauuau

SEQ ID NO: 818799 - RNA, 22 nt, Human
gauggcagucaaccaggugagg

SEQ ID NO: 818800 - RNA, 22 nt, Human
agaggaugauuuuaaggacacu

SEQ ID NO: 818801 - RNA, 22 nt, Human
auauucuuccaaaacaucauuu

SEQ ID NO: 818802 - RNA, 22 nt, Human
cuucuucagcacaauauugaug

SEQ ID NO: 818803 - RNA, 22 nt, Human
aggcaggcaaccaccugggaag

SEQ ID NO: 818804 - RNA, 22 nt, Human
agcaccugucacaagcagaagg

SEQ ID NO: 818805 - RNA, 22 nt, Human
ggccagcugggccaccaggugc

SEQ ID NO: 818806 - RNA, 22 nt, Human
uaaguucauaagcuuauucuua

SEQ ID NO: 818807 - RNA, 22 nt, Human
guugaaagaucauguggcugcc

SEQ ID NO: 818808 - RNA, 20 nt, Human
ucuggcaggugaacgagcug

SEQ ID NO: 818809 - RNA, 22 nt, Human
aacaaaugaccugauuucuucc

SEQ ID NO: 818810 - RNA, 22 nt, Human
acagugcuggcuacaacccugg

SEQ ID NO: 818811 - RNA, 22 nt, Human
gugacaguggucacuuguaguu

SEQ ID NO: 818812 - RNA, 19 nt, Human
uccaggaggcugccauuga

SEQ ID NO: 818813 - RNA, 22 nt, Human
aggccagcuuccagaggggcag

SEQ ID NO: 818814 - RNA, 22 nt, Human
uuaaaugaggcugauguagauu

SEQ ID NO: 818815 - RNA, 19 nt, Human
uggagacugagagugagca

SEQ ID NO: 818816 - RNA, 22 nt, Human
uucaugcuuuuaccgcuguuaa

SEQ ID NO: 818817 - RNA, 22 nt, Human
cagaaauguacugacaugcagu

SEQ ID NO: 818818 - RNA, 22 nt, Human
cacaaauggccguguucaaaga

SEQ ID NO: 818819 - RNA, 22 nt, Human
ggcagcuguaagaugagugaau

SEQ ID NO: 818820 - RNA, 22 nt, Human
gacccaggagagaggguugcau

SEQ ID NO: 818821 - RNA, 22 nt, Human
guaggcagggcuguggggagaa

SEQ ID NO: 818822 - RNA, 22 nt, Human
augcagcugugggcaagaaaug

SEQ ID NO: 818823 - RNA, 22 nt, Human
aggagggaccuaggaauauugc

SEQ ID NO: 818824 - RNA, 17 nt, Human
acagagcacaucaagau

SEQ ID NO: 818825 - RNA, 22 nt, Human
uucuucaauuuuccauauacug

SEQ ID NO: 818826 - RNA, 22 nt, Human
ggagguggcagggaacauaauu

SEQ ID NO: 818827 - RNA, 22 nt, Human
acucaggaaauugagauaaugg

SEQ ID NO: 818828 - RNA, 22 nt, Human
agcuaccuggcuuaucacuguc

SEQ ID NO: 818829 - RNA, 20 nt, Human
ugcguguguauuuauuuucu

SEQ ID NO: 818830 - RNA, 22 nt, Human
guuguuuuuguucucuauagcu

SEQ ID NO: 818831 - RNA, 17 nt, Human
ccaggagagaugcuugu

SEQ ID NO: 818832 - RNA, 22 nt, Human
gaggagagagggacugucugca

SEQ ID NO: 818833 - RNA, 22 nt, Human
ggaggagguggguuaaguugua

SEQ ID NO: 818834 - RNA, 22 nt, Human
uggucuuuaagguagcugucau

SEQ ID NO: 818835 - RNA, 22 nt, Human
guaggcagguggaggagugaag

SEQ ID NO: 818836 - RNA, 22 nt, Human
cuuaacauccugcauuuuucuu

SEQ ID NO: 818837 - RNA, 22 nt, Human
aauacaguagguaauaguucau

SEQ ID NO: 818838 - RNA, 22 nt, Human
gaggguggguuucuugcacguc

SEQ ID NO: 818839 - RNA, 22 nt, Human
caucaucaaaagugacagagaa

SEQ ID NO: 818840 - RNA, 22 nt, Human
cuugaaagucagcagaguggau

SEQ ID NO: 818841 - RNA, 22 nt, Human
gugcauuuaggucacaugaugu

SEQ ID NO: 818842 - RNA, 22 nt, Human
ggcagaggaaggaugaauucac

SEQ ID NO: 818843 - RNA, 22 nt, Human
uguuugaauuuugcuaacgugu

SEQ ID NO: 818844 - RNA, 22 nt, Human
gauggcagcagcagccagggau

SEQ ID NO: 818845 - RNA, 22 nt, Human
cagcuguggcugccacugcucc

SEQ ID NO: 818846 - RNA, 22 nt, Human
ucugggaauuuauuggcacuuu

SEQ ID NO: 818847 - RNA, 22 nt, Human
aaauuguugaucuacaguaagg

SEQ ID NO: 818848 - RNA, 19 nt, Human
ucccaggaaccuuuuauuu

SEQ ID NO: 818849 - RNA, 22 nt, Human
uaggagggcccugaaaauggca

SEQ ID NO: 818850 - RNA, 22 nt, Human
augcugagcagagcugacaugc

SEQ ID NO: 818851 - RNA, 20 nt, Human
uuugucuguuaaguguuucu

SEQ ID NO: 818852 - RNA, 22 nt, Human
caugugguucaaguacuccaca

SEQ ID NO: 818853 - RNA, 23 nt, Human
agcacacuuguacaaugcccuag

SEQ ID NO: 818854 - RNA, 22 nt, Human
ucaaauaccagcaauuucaugu

SEQ ID NO: 818855 - RNA, 22 nt, Human
uagugcuuuaaguuuacagaga

SEQ ID NO: 818856 - RNA, 22 nt, Human
cagugucuccagaugcuccaau

SEQ ID NO: 818857 - RNA, 23 nt, Human
acagacaacacugaugagagaaa

SEQ ID NO: 818858 - RNA, 22 nt, Human
auucugagaaaugcauugucag

SEQ ID NO: 818859 - RNA, 22 nt, Human
aggcaguuguugcugagcagcu

SEQ ID NO: 818860 - RNA, 22 nt, Human
uuucuaggucuuccauacugcc

SEQ ID NO: 818861 - RNA, 22 nt, Human
uuggaugaagucuagcuuuagu

SEQ ID NO: 818862 - RNA, 22 nt, Human
guucuucagcauuagaagucau

SEQ ID NO: 818863 - RNA, 22 nt, Human
auguucuuccaaaucuguaaca

SEQ ID NO: 818864 - RNA, 22 nt, Human
uggcagcugagugcacccccuc

SEQ ID NO: 818865 - RNA, 22 nt, Human
ggaccuggcaauuugcaucucu

SEQ ID NO: 818866 - RNA, 19 nt, Human
uccaggagcaaagccaguu

SEQ ID NO: 818867 - RNA, 17 nt, Human
gaggagcuccaguaggu

SEQ ID NO: 818868 - RNA, 22 nt, Human
gaaggccacaagagaaguuaag

SEQ ID NO: 818869 - RNA, 22 nt, Human
ccaggacagugaacauguaaga

SEQ ID NO: 818870 - RNA, 22 nt, Human
agagguagagguugcagugagc

SEQ ID NO: 818871 - RNA, 19 nt, Human
cccaggagucuggcugguu

SEQ ID NO: 818872 - RNA, 22 nt, Human
uggcagcugugcuucauucuuu

SEQ ID NO: 818873 - RNA, 22 nt, Human
ggagcagggcagugaauucugg

SEQ ID NO: 818874 - RNA, 20 nt, Human
ggcagcuugggcagcaguua

SEQ ID NO: 818875 - RNA, 23 nt, Human
ggagugcaauggcgccaucucgg

SEQ ID NO: 818876 - RNA, 22 nt, Human
uacuaaauaguuuaauuccuca

SEQ ID NO: 818877 - RNA, 22 nt, Human
cagcuggcugcaugaugccaaa

SEQ ID NO: 818878 - RNA, 22 nt, Human
uuuccuaguucuaagaaaugua

SEQ ID NO: 818879 - RNA, 22 nt, Human
cuugcugggguaagucugugcu

SEQ ID NO: 818880 - RNA, 22 nt, Human
gaggagaggcuggacgcgguga

SEQ ID NO: 818881 - RNA, 22 nt, Human
cccaggugcugcgugaagccuc

SEQ ID NO: 818882 - RNA, 22 nt, Human
cagucccuaguggagcucacag

SEQ ID NO: 818883 - RNA, 22 nt, Human
gaaucucaaggcuugugaggau

SEQ ID NO: 818884 - RNA, 22 nt, Human
uacacacaugcauuugccuuau

SEQ ID NO: 818885 - RNA, 22 nt, Human
uuucuucagccuucacaaccug

SEQ ID NO: 818886 - RNA, 22 nt, Human
gcccaggaaguugaggcugccg

SEQ ID NO: 818887 - RNA, 22 nt, Human
ugcauuuccagauuucuggagu

SEQ ID NO: 818888 - RNA, 22 nt, Human
gaggcagcggcucacagagaaa

SEQ ID NO: 818889 - RNA, 22 nt, Human
uuggcaguaaaagaaaaugcuu

SEQ ID NO: 818890 - RNA, 22 nt, Human
uuggcagugucugcaaaaugga

SEQ ID NO: 818891 - RNA, 22 nt, Human
gcucccaggcauggagguaauu

SEQ ID NO: 818892 - RNA, 22 nt, Human
agagggagugaaauggaauaga

SEQ ID NO: 818893 - RNA, 22 nt, Human
caggagauguaagacuucuguu

SEQ ID NO: 818894 - RNA, 22 nt, Human
ucagugugaguaccaugcucag

SEQ ID NO: 818895 - RNA, 20 nt, Human
agaggccaguuaggagucua

SEQ ID NO: 818896 - RNA, 22 nt, Human
gaaggaggugucaguuggacug

SEQ ID NO: 818897 - RNA, 22 nt, Human
uccaggagauucauuaggucau

SEQ ID NO: 818898 - RNA, 22 nt, Human
uugcagcugcaguaaauguuca

SEQ ID NO: 818899 - RNA, 22 nt, Human
ccaggagauaagcugaguuuau

SEQ ID NO: 818900 - RNA, 22 nt, Human
uagggcaggggaggaaucugaa

SEQ ID NO: 818901 - RNA, 22 nt, Human
uuuuguuguaauauaccuaucc

SEQ ID NO: 818902 - RNA, 22 nt, Human
cauuuguauagugcuuagacca

SEQ ID NO: 818903 - RNA, 22 nt, Human
auuggcaguuagugacgaggcu

SEQ ID NO: 818904 - RNA, 22 nt, Human
uaaggccauuauggugggcccg

SEQ ID NO: 818905 - RNA, 23 nt, Human
accaggagccaagaucucccugg

SEQ ID NO: 818906 - RNA, 23 nt, Human
cuccccaguguccucaugcaucu

SEQ ID NO: 818907 - RNA, 22 nt, Human
caggcagcucaaccuugggagc

SEQ ID NO: 818908 - RNA, 22 nt, Human
cccaggagaccuagaucuguuu

SEQ ID NO: 818909 - RNA, 22 nt, Human
uguauuuuuagaccuuuagacc

SEQ ID NO: 818910 - RNA, 20 nt, Human
cugcuguguuauuguagaac

SEQ ID NO: 818911 - RNA, 23 nt, Human
uuuggacuugugacucuucuccu

SEQ ID NO: 818912 - RNA, 22 nt, Human
guucuucagucacaucacagaa

SEQ ID NO: 818913 - RNA, 19 nt, Human
ccauggagagagaugcauu

SEQ ID NO: 818914 - RNA, 22 nt, Human
aagugaagaaauacaugagaau

SEQ ID NO: 818915 - RNA, 22 nt, Human
agcuagaauguuccuuuucauu

SEQ ID NO: 818916 - RNA, 22 nt, Human
aucauucugauggucaaugcua

SEQ ID NO: 818917 - RNA, 22 nt, Human
uucaauucugcucugaucuuag

SEQ ID NO: 818918 - RNA, 22 nt, Human
ucuucucuacaccagcagcccc

SEQ ID NO: 818919 - RNA, 20 nt, Human
ugugaaagcaguagaaugac

SEQ ID NO: 818920 - RNA, 22 nt, Human
cuguggaaauaaacaaugcuaa

SEQ ID NO: 818921 - RNA, 18 nt, Human
agucuucugauccauuuu

SEQ ID NO: 818922 - RNA, 23 nt, Human
cugcuguguuggucucgauggga

SEQ ID NO: 818923 - RNA, 22 nt, Human
ggauggagguucucagaugcuc

SEQ ID NO: 818924 - RNA, 22 nt, Human
aggcagcaugggccccagcucc

SEQ ID NO: 818925 - RNA, 22 nt, Human
aaaggcaggcuuucacaucuca

SEQ ID NO: 818926 - RNA, 22 nt, Human
cacucuccagcacaccccauuu

SEQ ID NO: 818927 - RNA, 22 nt, Human
uucuucagucccacuagccaca

SEQ ID NO: 818928 - RNA, 22 nt, Human
gucaggauuaaugggaguaugc

SEQ ID NO: 818929 - RNA, 22 nt, Human
uucagaaguagcuaagcaguca

SEQ ID NO: 818930 - RNA, 22 nt, Human
aggcacagagaaugcccuccau

SEQ ID NO: 818931 - RNA, 22 nt, Human
guuuuauaauugcuucauaaga

SEQ ID NO: 818932 - RNA, 22 nt, Human
agcugcccugggcuggagaugg

SEQ ID NO: 818933 - RNA, 19 nt, Human
ugcccaggccagguugggc

SEQ ID NO: 818934 - RNA, 22 nt, Human
cacaaugugguuugucaucuuu

SEQ ID NO: 818935 - RNA, 22 nt, Human
gcagaggacagggauuuagauu

SEQ ID NO: 818936 - RNA, 22 nt, Human
aaggagagagcuuugcuggaac

SEQ ID NO: 818937 - RNA, 20 nt, Human
ucacuaguaaccaucugcuu

SEQ ID NO: 818938 - RNA, 22 nt, Human
ugcucuucggggccacugcuug

SEQ ID NO: 818939 - RNA, 22 nt, Human
agcugcccugguaagauugaug

SEQ ID NO: 818940 - RNA, 22 nt, Human
cccaggaaccuaccagcucgag

SEQ ID NO: 818941 - RNA, 22 nt, Human
ucaguagcagaaagcaaugagu

SEQ ID NO: 818942 - RNA, 22 nt, Human
gaaaggccagcucacagaugag

SEQ ID NO: 818943 - RNA, 22 nt, Human
aggcaagcauuuaaccacucau

SEQ ID NO: 818944 - RNA, 22 nt, Human
ggaguaggaguagaacucauca

SEQ ID NO: 818945 - RNA, 22 nt, Human
gcuuuggagccuguguucugcc

SEQ ID NO: 818946 - RNA, 22 nt, Human
ugcuuccuauccacacaaugcc

SEQ ID NO: 818947 - RNA, 22 nt, Human
uaaaauagcaugugcagugaaa

SEQ ID NO: 818948 - RNA, 22 nt, Human
guugaaagagcauggacuugaa

SEQ ID NO: 818949 - RNA, 22 nt, Human
auuugcuuaucuccacaguugu

SEQ ID NO: 818950 - RNA, 22 nt, Human
cuugaaagucacaugcagcccu

SEQ ID NO: 818951 - RNA, 22 nt, Human
gaggaggcacuugagcagaugu

SEQ ID NO: 818952 - RNA, 22 nt, Human
uagugcuuggcccuaccagaua

SEQ ID NO: 818953 - RNA, 22 nt, Human
ugaaagguuauuuaggucugcu

SEQ ID NO: 818954 - RNA, 22 nt, Human
ggaagaggcugaggccaugcug

SEQ ID NO: 818955 - RNA, 23 nt, Human
cuuuuaacuugaucugagaccag

SEQ ID NO: 818956 - RNA, 22 nt, Human
uucuuauagaagcaaccauugu

SEQ ID NO: 818957 - RNA, 22 nt, Human
cauuuauuggcauguaguaggu

SEQ ID NO: 818958 - RNA, 22 nt, Human
uccaggagguagugcuuaauuu

SEQ ID NO: 818959 - RNA, 22 nt, Human
gucuccugagacugcagucacc

SEQ ID NO: 818960 - RNA, 19 nt, Human
ggucagcugggcuagaggc

SEQ ID NO: 818961 - RNA, 22 nt, Human
ccagaagaccccguccaccucc

SEQ ID NO: 818962 - RNA, 22 nt, Human
gaggcagagaccuucaggaccu

SEQ ID NO: 818963 - RNA, 22 nt, Human
acagauguacacucauauauaa

SEQ ID NO: 818964 - RNA, 22 nt, Human
aaauauaauuucugccucaaua

SEQ ID NO: 818965 - RNA, 22 nt, Human
gucauauacacugcauguaauc

SEQ ID NO: 818966 - RNA, 19 nt, Human
ggcagcuugggaagguagc

SEQ ID NO: 818967 - RNA, 22 nt, Human
ggacuucuaagugccagacacu

SEQ ID NO: 818968 - RNA, 22 nt, Human
ucugaacuccagcccugcucuc

SEQ ID NO: 818969 - RNA, 22 nt, Human
ggacagaggguugacagaguau

SEQ ID NO: 818970 - RNA, 21 nt, Human
agagagggagaugaaacaucc

SEQ ID NO: 818971 - RNA, 22 nt, Human
uugaaaguccuucuugaguuac

SEQ ID NO: 818972 - RNA, 22 nt, Human
ucugcugucacucauuugcuuc

SEQ ID NO: 818973 - RNA, 22 nt, Human
uacaaaguagaaauucaguaaa

SEQ ID NO: 818974 - RNA, 22 nt, Human
uuucuucacaggguauugggug

SEQ ID NO: 818975 - RNA, 22 nt, Human
uccaggagucagacagauggug

SEQ ID NO: 818976 - RNA, 22 nt, Human
ugcugaaagucccaaaucucau

SEQ ID NO: 818977 - RNA, 22 nt, Human
cugccaggcagggagauggcug

SEQ ID NO: 818978 - RNA, 22 nt, Human
uucuucaaugugcccuguuuuc

SEQ ID NO: 818979 - RNA, 22 nt, Human
aauauaaugcuguuuuaugcca

SEQ ID NO: 818980 - RNA, 22 nt, Human
ucaggagaaaauaucaggaagu

SEQ ID NO: 818981 - RNA, 22 nt, Human
uuugaaauaugaggcauuauga

SEQ ID NO: 818982 - RNA, 22 nt, Human
gucaggauuauaauccccaugg

SEQ ID NO: 818983 - RNA, 22 nt, Human
uuuguuuagaaagagauuggug

SEQ ID NO: 818984 - RNA, 21 nt, Human
gagacagcccagugccagggc

SEQ ID NO: 818985 - RNA, 22 nt, Human
gaggccaggggccuggagauga

SEQ ID NO: 818986 - RNA, 22 nt, Human
ggccaggaagggaagaucagca

SEQ ID NO: 818987 - RNA, 21 nt, Human
uccuuccuugagguccuuucc

SEQ ID NO: 818988 - RNA, 22 nt, Human
caggcagcucuaauggaaagug

SEQ ID NO: 818989 - RNA, 22 nt, Human
ggaggggaggauuaaugacaaa

SEQ ID NO: 818990 - RNA, 22 nt, Human
uacccaggaggaaacugaggcu

SEQ ID NO: 818991 - RNA, 22 nt, Human
ucauuuuucacacagggucacc

SEQ ID NO: 818992 - RNA, 22 nt, Human
ucauuucuccgaccugcugucc

SEQ ID NO: 818993 - RNA, 22 nt, Human
cacaauuuguuuuaucaguauu

SEQ ID NO: 818994 - RNA, 22 nt, Human
uuucccaguucccugcucuaua

SEQ ID NO: 818995 - RNA, 22 nt, Human
gggcagcugccacuccgcuugc

SEQ ID NO: 818996 - RNA, 22 nt, Human
ccugccugcaccuucucugggg

SEQ ID NO: 818997 - RNA, 22 nt, Human
acucagaaugacugaugcugug

SEQ ID NO: 818998 - RNA, 19 nt, Human
aucugccuguuaucacaua

SEQ ID NO: 818999 - RNA, 22 nt, Human
ucauuauccuaguaucuugaau

SEQ ID NO: 819000 - RNA, 22 nt, Human
ucuuagaaguucauguuccagc

SEQ ID NO: 819001 - RNA, 22 nt, Human
uauugaugcuuggauugggcca

SEQ ID NO: 819002 - RNA, 22 nt, Human
uucuccagagggcucugcagga

SEQ ID NO: 819003 - RNA, 22 nt, Human
auucuuaauugccaugcuguau

SEQ ID NO: 819004 - RNA, 22 nt, Human
cugcuuugacuguuaagaacca

SEQ ID NO: 819005 - RNA, 22 nt, Human
aguuuucacacucaccaaaagg

SEQ ID NO: 819006 - RNA, 18 nt, Human
gaggcagcuagcaauuuu

SEQ ID NO: 819007 - RNA, 22 nt, Human
uggcaguccccugugccuggaa

SEQ ID NO: 819008 - RNA, 22 nt, Human
agacagcuaauaaaugagugug

SEQ ID NO: 819009 - RNA, 22 nt, Human
uggcuucuugggaugggucauu

SEQ ID NO: 819010 - RNA, 22 nt, Human
gcccaggagguggaggugcagu

SEQ ID NO: 819011 - RNA, 22 nt, Human
aaagcagagguugcagugagcu

SEQ ID NO: 819012 - RNA, 22 nt, Human
agagagggcauagaaaaaggga

SEQ ID NO: 819013 - RNA, 22 nt, Human
gguggaaggccuggaaggaggc

SEQ ID NO: 819014 - RNA, 22 nt, Human
gacccaggguauccagagcugc

SEQ ID NO: 819015 - RNA, 22 nt, Human
aagauuauuuaagacaggaacc

SEQ ID NO: 819016 - RNA, 22 nt, Human
cagagcucuauguucauggagg

SEQ ID NO: 819017 - RNA, 22 nt, Human
uguagaaagaauauguuucaua

SEQ ID NO: 819018 - RNA, 22 nt, Human
gacagagaggcugagcaguaca

SEQ ID NO: 819019 - RNA, 22 nt, Human
acagucuacuugagcuuguaua

SEQ ID NO: 819020 - RNA, 19 nt, Human
caggagagcaugcacuuug

SEQ ID NO: 819021 - RNA, 22 nt, Human
ccucaugguacuuacuguagcu

SEQ ID NO: 819022 - RNA, 22 nt, Human
agcugcccuuaauaggcauuca

SEQ ID NO: 819023 - RNA, 22 nt, Human
aaauauagugacacuuauaguc

SEQ ID NO: 819024 - RNA, 22 nt, Human
auugaaagauaggcuacugugg

SEQ ID NO: 819025 - RNA, 22 nt, Human
cucuuaguaaugccaugaagca

SEQ ID NO: 819026 - RNA, 22 nt, Human
gggagagguuacccgagcaacu

SEQ ID NO: 819027 - RNA, 22 nt, Human
gggagcugaauggcaauggaga

SEQ ID NO: 819028 - RNA, 22 nt, Human
ugcaggaaauuccaggguggcc

SEQ ID NO: 819029 - RNA, 22 nt, Human
uucaggauccccaccgcguuua

SEQ ID NO: 819030 - RNA, 22 nt, Human
ugaggcaguauucuccauucca

SEQ ID NO: 819031 - RNA, 22 nt, Human
uauuugcaacauaaaacucuga

SEQ ID NO: 819032 - RNA, 22 nt, Human
uacucagagucauugcccuucu

SEQ ID NO: 819033 - RNA, 22 nt, Human
gggcagcugccaagugcaucgc

SEQ ID NO: 819034 - RNA, 22 nt, Human
aggcaccuugagagcaggagcu

SEQ ID NO: 819035 - RNA, 22 nt, Human
ugccaggauggccagggggcca

SEQ ID NO: 819036 - RNA, 22 nt, Human
agggaagcccuggcugagaccc

SEQ ID NO: 819037 - RNA, 22 nt, Human
ugaaagcagcaccaauaccauu

SEQ ID NO: 819038 - RNA, 22 nt, Human
uggguguguccauauuuugacu

SEQ ID NO: 819039 - RNA, 17 nt, Human
uuagagcuacauguuga

SEQ ID NO: 819040 - RNA, 20 nt, Human
cuugaguucagagcugucau

SEQ ID NO: 819041 - RNA, 19 nt, Human
ucuggcugccaaggauuga

SEQ ID NO: 819042 - RNA, 22 nt, Human
cuaguauuaagugugaguaaaa

SEQ ID NO: 819043 - RNA, 22 nt, Human
uuuguagauuuucucuccagua

SEQ ID NO: 819044 - RNA, 22 nt, Human
guggaaauuuuaggaucaucuu

SEQ ID NO: 819045 - RNA, 22 nt, Human
uaucuguagucucaugguuccu

SEQ ID NO: 819046 - RNA, 22 nt, Human
ucuuauugguaaugauggcauu

SEQ ID NO: 819047 - RNA, 22 nt, Human
auuuugacauugcggcauugcu

SEQ ID NO: 819048 - RNA, 22 nt, Human
augguuuuguccucuuugguuc

SEQ ID NO: 819049 - RNA, 22 nt, Human
guguggcuaggauggcuuugcu

SEQ ID NO: 819050 - RNA, 22 nt, Human
uuucauuauaaaaaguuggcuu

SEQ ID NO: 819051 - RNA, 22 nt, Human
cauuguuggcagagggacagag

SEQ ID NO: 819052 - RNA, 23 nt, Human
cuguggaucuagagggggcccua

SEQ ID NO: 819053 - RNA, 22 nt, Human
guucuuaaagauucaucaagca

SEQ ID NO: 819054 - RNA, 22 nt, Human
uucuguaauucuguuaguuuca

SEQ ID NO: 819055 - RNA, 22 nt, Human
uaauuuugucacagugacaugc

SEQ ID NO: 819056 - RNA, 22 nt, Human
uuuauucucuaguuggucagau

SEQ ID NO: 819057 - RNA, 22 nt, Human
cuuugcuaauguugcauuuuca

SEQ ID NO: 819058 - RNA, 22 nt, Human
gggcucuguuuagaccagagau

SEQ ID NO: 819059 - RNA, 22 nt, Human
uugcuggaguagaaaacuuaac

SEQ ID NO: 819060 - RNA, 23 nt, Human
uuguucuuggaucuuccugaagc

SEQ ID NO: 819061 - RNA, 22 nt, Human
ucauuguuucugcuuuucauga

SEQ ID NO: 819062 - RNA, 22 nt, Human
uuucacauacaguguauaguag

SEQ ID NO: 819063 - RNA, 22 nt, Human
caguuaaacagauugaguguua

SEQ ID NO: 819064 - RNA, 22 nt, Human
cugagggagcugcuggccuugg

SEQ ID NO: 819065 - RNA, 18 nt, Human
uggguggcuagggaguuu

SEQ ID NO: 819066 - RNA, 22 nt, Human
auggaguguggccaggcaguaa

SEQ ID NO: 819067 - RNA, 23 nt, Human
uggcucugagcuuccugguggcc

SEQ ID NO: 819068 - RNA, 22 nt, Human
uuagaaaucaccucugaagauc

SEQ ID NO: 819069 - RNA, 22 nt, Human
augaacugcaguauaaacuugg

SEQ ID NO: 819070 - RNA, 22 nt, Human
caaagaugccaaaaggaagaca

SEQ ID NO: 819071 - RNA, 22 nt, Human
gcuugcugaacaggaaccuggc

SEQ ID NO: 819072 - RNA, 22 nt, Human
aauacagauggcaugugaagau

SEQ ID NO: 819073 - RNA, 22 nt, Human
ucuuuugagggccagaggaaga

SEQ ID NO: 819074 - RNA, 22 nt, Human
guugcaaaugggaagaugguua

SEQ ID NO: 819075 - RNA, 22 nt, Human
cuggccucacagaggcuaagcc

SEQ ID NO: 819076 - RNA, 22 nt, Human
guacacucccccugugaaguug

SEQ ID NO: 819077 - RNA, 22 nt, Human
aaauugcaaaaguacuuuuagg

SEQ ID NO: 819078 - RNA, 22 nt, Human
uuuucaguugugcucucuaguu

SEQ ID NO: 819079 - RNA, 23 nt, Human
uggcuugcuaauguuccaaauaa

SEQ ID NO: 819080 - RNA, 22 nt, Human
ucuaauuuuggcauuuuaaccu

SEQ ID NO: 819081 - RNA, 22 nt, Human
cuaaauguuuuaucuuccuggc

SEQ ID NO: 819082 - RNA, 22 nt, Human
uuuuuaagagucuggaaauagu

SEQ ID NO: 819083 - RNA, 22 nt, Human
aucuggcucccuuggaauccgu

SEQ ID NO: 819084 - RNA, 21 nt, Human
agauuguauggaggugagagg

SEQ ID NO: 819085 - RNA, 22 nt, Human
uguauuucugcuuucucuagua

SEQ ID NO: 819086 - RNA, 22 nt, Human
uguaauguuagaaacaauugcu

SEQ ID NO: 819087 - RNA, 22 nt, Human
ugucuuacagcaaucuguucug

SEQ ID NO: 819088 - RNA, 22 nt, Human
gagcuuuucccgucuuucucgu

SEQ ID NO: 819089 - RNA, 22 nt, Human
cuugcuuuaucugguuucucau

SEQ ID NO: 819090 - RNA, 22 nt, Human
uugaugcugucuuucagaauca

SEQ ID NO: 819091 - RNA, 22 nt, Human
cauugcugugggcauuugcugc

SEQ ID NO: 819092 - RNA, 18 nt, Human
auuugcaggcaugcaggc

SEQ ID NO: 819093 - RNA, 22 nt, Human
cagggagcuggugccagccgac

SEQ ID NO: 819094 - RNA, 19 nt, Human
ggaggcuucuuggggucgg

SEQ ID NO: 819095 - RNA, 22 nt, Human
aauugcuuuacaagccguuuaa

SEQ ID NO: 819096 - RNA, 22 nt, Human
cggcuucucgggucggauuccg

SEQ ID NO: 819097 - RNA, 22 nt, Human
cugguuuuuagugcuuaggagu

SEQ ID NO: 819098 - RNA, 22 nt, Human
uggcuccuuccgcagcaugccu

SEQ ID NO: 819099 - RNA, 22 nt, Human
cuuugugauaguguuaagacca

SEQ ID NO: 819100 - RNA, 18 nt, Human
accugauuggcgcagccc

SEQ ID NO: 819101 - RNA, 22 nt, Human
aggcucugucaggcggagcagc

SEQ ID NO: 819102 - RNA, 22 nt, Human
uuucuucucacccaggacagag

SEQ ID NO: 819103 - RNA, 22 nt, Human
uggugaagucagcggagcccgg

SEQ ID NO: 819104 - RNA, 22 nt, Human
uugaggcacagauuuuaguggc

SEQ ID NO: 819105 - RNA, 22 nt, Human
ggcucuggcgagcuuuaguaca

SEQ ID NO: 819106 - RNA, 22 nt, Human
uaucuguauucugacagucacu

SEQ ID NO: 819107 - RNA, 22 nt, Human
gugggugucaguaucuuuaacg

SEQ ID NO: 819108 - RNA, 22 nt, Human
gcuguauuuauaugaaggcaug

SEQ ID NO: 819109 - RNA, 22 nt, Human
uaccuugugagcuuucuaacau

SEQ ID NO: 819110 - RNA, 22 nt, Human
augcuacauuuugguuuauaaa

SEQ ID NO: 819111 - RNA, 22 nt, Human
uuugcuugauuaggauauggaa

SEQ ID NO: 819112 - RNA, 22 nt, Human
ugccucugcugcauauucaccu

SEQ ID NO: 819113 - RNA, 22 nt, Human
uuucuacacuucgugguguuuu

SEQ ID NO: 819114 - RNA, 22 nt, Human
agcuuucuauauaugaguugcu

SEQ ID NO: 819115 - RNA, 22 nt, Human
uggcucugccccauaccccugc

SEQ ID NO: 819116 - RNA, 22 nt, Human
auggcuucugucuuggaaauuu

SEQ ID NO: 819117 - RNA, 22 nt, Human
guuggcuaugagagcuuuagug

SEQ ID NO: 819118 - RNA, 22 nt, Human
cagcuuuugcagacuucuugcc

SEQ ID NO: 819119 - RNA, 21 nt, Human
ggagucagggucuggcugggg

SEQ ID NO: 819120 - RNA, 22 nt, Human
aggcuuuugcucuggcuccucu

SEQ ID NO: 819121 - RNA, 22 nt, Human
uggcucaucuuuuuagacuuau

SEQ ID NO: 819122 - RNA, 22 nt, Human
cuuuaguucuagaaagugaaac

SEQ ID NO: 819123 - RNA, 22 nt, Human
uacucugcaggauggacuaugg

SEQ ID NO: 819124 - RNA, 22 nt, Human
gaguuugugggaauggaguauu

SEQ ID NO: 819125 - RNA, 22 nt, Human
uauagugucucuagaucaaaga

SEQ ID NO: 819126 - RNA, 22 nt, Human
caauaaaguggaggcccgggcu

SEQ ID NO: 819127 - RNA, 22 nt, Human
uuuuccuuaacagagggagaaa

SEQ ID NO: 819128 - RNA, 22 nt, Human
guugaaauccuaacccccuagu

SEQ ID NO: 819129 - RNA, 22 nt, Human
aguaauggguugaaauuuaguu

SEQ ID NO: 819130 - RNA, 22 nt, Human
uuggaaaugcauuuguuauuau

SEQ ID NO: 819131 - RNA, 22 nt, Human
ggucuggagcuaaucuuguugg

SEQ ID NO: 819132 - RNA, 22 nt, Human
ugcugcuuguuuuguaaauaaa

SEQ ID NO: 819133 - RNA, 22 nt, Human
uuuguaguuguggaugcugaag

SEQ ID NO: 819134 - RNA, 22 nt, Human
aggggcuuguggaguugcuggu

SEQ ID NO: 819135 - RNA, 22 nt, Human
gauugcugggucccacucccag

SEQ ID NO: 819136 - RNA, 22 nt, Human
gaaguucugguguaugugauaa

SEQ ID NO: 819137 - RNA, 22 nt, Human
ugugaagaucaggguccuagag

SEQ ID NO: 819138 - RNA, 22 nt, Human
gaggagcuucagaggaaucuua

SEQ ID NO: 819139 - RNA, 22 nt, Human
cuuuacuucagcaagcuuuccu

SEQ ID NO: 819140 - RNA, 19 nt, Human
agggaguuuauauuugcac

SEQ ID NO: 819141 - RNA, 22 nt, Human
uuuccuacugcccuauacacac

SEQ ID NO: 819142 - RNA, 22 nt, Human
uggcaugcaagaggaggcuccc

SEQ ID NO: 819143 - RNA, 22 nt, Human
uguagggaggaaggguuggaaa

SEQ ID NO: 819144 - RNA, 22 nt, Human
uucuaguuacagaagccuugcu

SEQ ID NO: 819145 - RNA, 22 nt, Human
cacaucauguuaauucauuaca

SEQ ID NO: 819146 - RNA, 22 nt, Human
uuugaaauguaucaguauaggu

SEQ ID NO: 819147 - RNA, 22 nt, Human
aaguuugucucauuugaucuuc

SEQ ID NO: 819148 - RNA, 22 nt, Human
auuguugacuugauuacucaac

SEQ ID NO: 819149 - RNA, 22 nt, Human
uacuuugagaugaugcugaucg

SEQ ID NO: 819150 - RNA, 22 nt, Human
gcugggugauucauuuccauaa

SEQ ID NO: 819151 - RNA, 22 nt, Human
ugucauauagaauguucuauga

SEQ ID NO: 819152 - RNA, 22 nt, Human
gacucugguugcggguucugcu

SEQ ID NO: 819153 - RNA, 22 nt, Human
cagggagccccaauuccaugcc

SEQ ID NO: 819154 - RNA, 22 nt, Human
ugggugaagaggcuaugcuacu

SEQ ID NO: 819155 - RNA, 22 nt, Human
augaauuguccgauguugugca

SEQ ID NO: 819156 - RNA, 22 nt, Human
uguucuuagguauuugacaguc

SEQ ID NO: 819157 - RNA, 22 nt, Human
agguagcuggugcugggcuccu

SEQ ID NO: 819158 - RNA, 22 nt, Human
gcagcuuuggagguggaacucu

SEQ ID NO: 819159 - RNA, 22 nt, Human
gaaaugucaagauauguuugga

SEQ ID NO: 819160 - RNA, 22 nt, Human
ugaggagcaggguggcuuacuc

SEQ ID NO: 819161 - RNA, 22 nt, Human
uauggcuucugggccaaauuua

SEQ ID NO: 819162 - RNA, 22 nt, Human
agggagcugcucugcuuccgug

SEQ ID NO: 819163 - RNA, 22 nt, Human
uauucauguguuggaaaggaac

SEQ ID NO: 819164 - RNA, 22 nt, Human
gcuuuggaaauauagacucaag

SEQ ID NO: 819165 - RNA, 22 nt, Human
aucugguuuggggauccuugug

SEQ ID NO: 819166 - RNA, 22 nt, Human
gugauuucagguuuuucauacu

SEQ ID NO: 819167 - RNA, 19 nt, Human
gaauggguucuguagggag

SEQ ID NO: 819168 - RNA, 22 nt, Human
acuuuagauauuccucuguaca

SEQ ID NO: 819169 - RNA, 22 nt, Human
agcuaauguauguugaaagcac

SEQ ID NO: 819170 - RNA, 22 nt, Human
guuauucuauuaaugugauugu

SEQ ID NO: 819171 - RNA, 22 nt, Human
uuauugagcacauaguaugugg

SEQ ID NO: 819172 - RNA, 22 nt, Human
auauaugaagaagucuugauua

SEQ ID NO: 819173 - RNA, 22 nt, Human
guuguacauaugaggauaaguu

SEQ ID NO: 819174 - RNA, 22 nt, Human
uuguacacacaggaacaaacgu

SEQ ID NO: 819175 - RNA, 22 nt, Human
cugcuuuaaaacugauacauga

SEQ ID NO: 819176 - RNA, 22 nt, Human
ccucuugauugguuggaagcgg

SEQ ID NO: 819177 - RNA, 22 nt, Human
ugauuugaauuuuaaaacacug

SEQ ID NO: 819178 - RNA, 21 nt, Human
uugauuuagcagaucuagcug

SEQ ID NO: 819179 - RNA, 22 nt, Human
cucuauucuaauggauucuggg

SEQ ID NO: 819180 - RNA, 22 nt, Human
aaugugcugguaacugcuuugc

SEQ ID NO: 819181 - RNA, 22 nt, Human
ucauggaugauagcuucauugc

SEQ ID NO: 819182 - RNA, 22 nt, Human
cucucuuuuucgugugccgaag

SEQ ID NO: 819183 - RNA, 23 nt, Human
cauuugauccucacaauaaaugg

SEQ ID NO: 819184 - RNA, 22 nt, Human
acagaauugggguucuugggga

SEQ ID NO: 819185 - RNA, 21 nt, Human
ucugugcuuuuuuggcuccua

SEQ ID NO: 819186 - RNA, 22 nt, Human
cuuucugaggagacgggcuuug

SEQ ID NO: 819187 - RNA, 21 nt, Human
uaagcuaaacauucaguuaac

SEQ ID NO: 819188 - RNA, 22 nt, Human
gauuugucuauauucaaauaug

SEQ ID NO: 819189 - RNA, 22 nt, Human
uaucuuaaaaaucgaagcagau

SEQ ID NO: 819190 - RNA, 22 nt, Human
cuuccucuguggccagagugua

SEQ ID NO: 819191 - RNA, 22 nt, Human
uuugaacuucuaccugucauau

SEQ ID NO: 819192 - RNA, 23 nt, Human
gguuggcuguacccaggcucccu

SEQ ID NO: 819193 - RNA, 22 nt, Human
uuugacaugugcuuauaacuuu

SEQ ID NO: 819194 - RNA, 22 nt, Human
caauguacaaaauaauuacaca

SEQ ID NO: 819195 - RNA, 22 nt, Human
uaguggauguucagagauuuga

SEQ ID NO: 819196 - RNA, 22 nt, Human
augauugaaaaugacauugcca

SEQ ID NO: 819197 - RNA, 22 nt, Human
agagucaguuaugucaagugcu

SEQ ID NO: 819198 - RNA, 22 nt, Human
cucuggaucugcccugacgcca

SEQ ID NO: 819199 - RNA, 22 nt, Human
uuuacuuuugguaaggucauuu

SEQ ID NO: 819200 - RNA, 22 nt, Human
gugaagaugccucaggugaccc

SEQ ID NO: 819201 - RNA, 22 nt, Human
guguacacuugaacugacgguu

SEQ ID NO: 819202 - RNA, 20 nt, Human
cuuguuaaauaugcagguag

SEQ ID NO: 819203 - RNA, 22 nt, Human
gaggggcugggguugacuccaa

SEQ ID NO: 819204 - RNA, 22 nt, Human
uuauuuuguagcucugaucuuu

SEQ ID NO: 819205 - RNA, 22 nt, Human
agaguguggaaauguucagagu

SEQ ID NO: 819206 - RNA, 22 nt, Human
ugugagauuuuauuugauaugc

SEQ ID NO: 819207 - RNA, 22 nt, Human
uugagcuugaggaguuauuuga

SEQ ID NO: 819208 - RNA, 20 nt, Human
uuugauugccccucugacuu

SEQ ID NO: 819209 - RNA, 19 nt, Human
cuggcuucaagcaguccuc

SEQ ID NO: 819210 - RNA, 22 nt, Human
ugcuugacuuaguuucucauuu

SEQ ID NO: 819211 - RNA, 22 nt, Human
uuauugcuaugaugauguguag

SEQ ID NO: 819212 - RNA, 22 nt, Human
auggcucugcugggcaaagcaa

SEQ ID NO: 819213 - RNA, 22 nt, Human
ucugaaauuuuaguuauagaaa

SEQ ID NO: 819214 - RNA, 22 nt, Human
ugaaguuguuaagguugccauu

SEQ ID NO: 819215 - RNA, 22 nt, Human
aauggcugccagggcaggaggu

SEQ ID NO: 819216 - RNA, 20 nt, Human
ugagucagcugcaugggugg

SEQ ID NO: 819217 - RNA, 22 nt, Human
uaacacauagauauuuuaacuu

SEQ ID NO: 819218 - RNA, 23 nt, Human
uggcucuguggaucccucaggag

SEQ ID NO: 819219 - RNA, 22 nt, Human
aaugcuuuuugcgaaaugugca

SEQ ID NO: 819220 - RNA, 20 nt, Human
uugaggagauauugaauacu

SEQ ID NO: 819221 - RNA, 22 nt, Human
uaaaguuggaccugauuuuauu

SEQ ID NO: 819222 - RNA, 22 nt, Human
cuuguauuaggaagaaugcuuu

SEQ ID NO: 819223 - RNA, 22 nt, Human
ucuuauaccccuaaacugcagc

SEQ ID NO: 819224 - RNA, 22 nt, Human
uuauguauggauggcugaaagu

SEQ ID NO: 819225 - RNA, 22 nt, Human
ucuggcuucaguaggguucacu

SEQ ID NO: 819226 - RNA, 22 nt, Human
uucuacauugugaaguucuuua

SEQ ID NO: 819227 - RNA, 22 nt, Human
uugcuauuuugagagucauagu

SEQ ID NO: 819228 - RNA, 22 nt, Human
ucuggcuucaacuuuacugaaa

SEQ ID NO: 819229 - RNA, 22 nt, Human
uuuucaguuccaucucugcucu

SEQ ID NO: 819230 - RNA, 22 nt, Human
uugagcugccuggcuguggcuc

SEQ ID NO: 819231 - RNA, 22 nt, Human
cugggcuuucaggcccuaaggc

SEQ ID NO: 819232 - RNA, 22 nt, Human
uucacauaaucugcagcaagcg

SEQ ID NO: 819233 - RNA, 22 nt, Human
uucugauuguuggaggaugcuu

SEQ ID NO: 819234 - RNA, 21 nt, Human
acuguauuguuuucaaggauc

SEQ ID NO: 819235 - RNA, 22 nt, Human
uggcuuccagaacugagcaaca

SEQ ID NO: 819236 - RNA, 22 nt, Human
ccuuaauuucuguccuucagau

SEQ ID NO: 819237 - RNA, 22 nt, Human
auagucuuagaaucuugagugu

SEQ ID NO: 819238 - RNA, 22 nt, Human
aucugccuggcuccaggugagc

SEQ ID NO: 819239 - RNA, 22 nt, Human
gagguggcugcuugcugggaaa

SEQ ID NO: 819240 - RNA, 22 nt, Human
auucaugcaggauugucuccaa

SEQ ID NO: 819241 - RNA, 22 nt, Human
acucaucuuugaauuuucagua

SEQ ID NO: 819242 - RNA, 22 nt, Human
ugauuugaaaccuuuggcaaga

SEQ ID NO: 819243 - RNA, 21 nt, Human
acucaucuuuuuggagaccag

SEQ ID NO: 819244 - RNA, 22 nt, Human
ugugaagaauuaaugugaauca

SEQ ID NO: 819245 - RNA, 19 nt, Human
aucaggcuucuauuuucuc

SEQ ID NO: 819246 - RNA, 22 nt, Human
uuugacucugggugcuuuuucg

SEQ ID NO: 819247 - RNA, 22 nt, Human
uuucacaugguacugccuguuu

SEQ ID NO: 819248 - RNA, 22 nt, Human
ugagcuucuuuauuuggccaga

SEQ ID NO: 819249 - RNA, 20 nt, Human
agugauuuguuaguacauug

SEQ ID NO: 819250 - RNA, 22 nt, Human
cauugcuguuaauugucucuag

SEQ ID NO: 819251 - RNA, 22 nt, Human
guuucuuauuucaacuggaaca

SEQ ID NO: 819252 - RNA, 22 nt, Human
gauuuucauuauagcuaguuuc

SEQ ID NO: 819253 - RNA, 22 nt, Human parainfluenza virus 1 strain Washington/1964
auugauaugaauuauuggucug

SEQ ID NO: 819254 - RNA, 22 nt, Human parainfluenza virus 1 strain Washington/1964
uccuccugauuuucccgaugcu

SEQ ID NO: 819255 - RNA, 22 nt, Human parainfluenza virus 1 strain Washington/1964
uucuauacaguuugugacaucu

SEQ ID NO: 819256 - RNA, 22 nt, Human parainfluenza virus 1 strain Washington/1964
uaaugggugucauuauugagga

SEQ ID NO: 819257 - RNA, 22 nt, Human parainfluenza virus 1 strain Washington/1964
uuggcacuuucguucauggagg

SEQ ID NO: 819258 - RNA, 22 nt, Human
gcuacugauugaccuuggagag

SEQ ID NO: 819259 - RNA, 22 nt, Human
aagugaagaaauacaugagaau

SEQ ID NO: 819260 - RNA, 22 nt, Human
cuugaaagucacaugcagcccu

SEQ ID NO: 819261 - RNA, 22 nt, Human
uuuguagaggguaauugacaga

SEQ ID NO: 819262 - RNA, 22 nt, Human
ucaggagaacuuccuucuaccc

SEQ ID NO: 819263 - RNA, 22 nt, Human
ugucucugauaaguaguucagu

SEQ ID NO: 819264 - RNA, 22 nt, Human
cuuuggcaaugucauuuucaau

SEQ ID NO: 819265 - RNA, 22 nt, Human
gcagaggacagggauuuagauu

SEQ ID NO: 819266 - RNA, 22 nt, Human
uuuucagaggccuaagagguuu

SEQ ID NO: 819267 - RNA, 22 nt, Human
gucuucuguaagaugagguccc

SEQ ID NO: 819268 - RNA, 22 nt, Human
ucagaaaagguagcugugacaa

SEQ ID NO: 819269 - RNA, 22 nt, Human
ccuccuuuccuguuuuccugag

SEQ ID NO: 819270 - RNA, 22 nt, Human
cuugcacacauguacaugugua

SEQ ID NO: 819271 - RNA, 22 nt, Human
caaggccacguucugcaugcgg

SEQ ID NO: 819272 - RNA, 22 nt, Human
uucauugugaacacauucugcc

SEQ ID NO: 819273 - RNA, 22 nt, Human
uguuugaauuuugcuaacgugu

SEQ ID NO: 819274 - RNA, 22 nt, Human
ucagcugcucaaauuuauguca

SEQ ID NO: 819275 - RNA, 19 nt, Human
uuacuuggcaaagucaguc

SEQ ID NO: 819276 - RNA, 22 nt, Human
auuauuauuguugauguuaggg

SEQ ID NO: 819277 - RNA, 22 nt, Human
uuucaacaccagagaccaugcg

SEQ ID NO: 819278 - RNA, 17 nt, Human
caggcagacauguaagc

SEQ ID NO: 819279 - RNA, 22 nt, Human
cccaggagguggagguugcggu

SEQ ID NO: 819280 - RNA, 22 nt, Human
ucccuucacagaugcgauguuu

SEQ ID NO: 819281 - RNA, 22 nt, Human
auguagagcaguguuguccaau

SEQ ID NO: 819282 - RNA, 22 nt, Human
cccaggaaugagcaggcagggg

SEQ ID NO: 819283 - RNA, 22 nt, Human
aggccagaugucgggcuagaag

SEQ ID NO: 819284 - RNA, 22 nt, Human
cacagcauaaugaaauauacuu

SEQ ID NO: 819285 - RNA, 22 nt, Human
cccaggagaccugugaaaggac

SEQ ID NO: 819286 - RNA, 22 nt, Human
aggagaggguggcauuaaguuu

SEQ ID NO: 819287 - RNA, 22 nt, Human
aagagggcagcacagguggguc

SEQ ID NO: 819288 - RNA, 22 nt, Human
ucauuucuauugcuacugucug

SEQ ID NO: 819289 - RNA, 22 nt, Human
uaaaugagggcugacaugauug

SEQ ID NO: 819290 - RNA, 22 nt, Human
aauguauuccucaugcaagagu

SEQ ID NO: 819291 - RNA, 17 nt, Human
uucaaagcuuaucaagg

SEQ ID NO: 819292 - RNA, 22 nt, Human
guucuucacauuucauugagga

SEQ ID NO: 819293 - RNA, 22 nt, Human
aggcagcagugauaagauagga

SEQ ID NO: 819294 - RNA, 22 nt, Human
uacauaguauucacauuguuuu

SEQ ID NO: 819295 - RNA, 22 nt, Human
uuccaugaaagugaaauggagc

SEQ ID NO: 819296 - RNA, 22 nt, Human
uagggaggaggguuuucaaauc

SEQ ID NO: 819297 - RNA, 22 nt, Human
ugagccuguccugugcauguga

SEQ ID NO: 819298 - RNA, 22 nt, Human
uucccaugccuggccccuaucc

SEQ ID NO: 819299 - RNA, 22 nt, Human
ccaggagagcagaagcccaggc

SEQ ID NO: 819300 - RNA, 22 nt, Human
ggagcaggagucucuugaauuu

SEQ ID NO: 819301 - RNA, 22 nt, Human
guaucacuuuugagagugagaa

SEQ ID NO: 819302 - RNA, 22 nt, Human
gugcauuugugcaugcacaugu

SEQ ID NO: 819303 - RNA, 22 nt, Human
gcuggcuugauaguuucugcuu

SEQ ID NO: 819304 - RNA, 22 nt, Human
agacaggaugcauacucuuggu

SEQ ID NO: 819305 - RNA, 22 nt, Human
auggcagccugagcagaggaau

SEQ ID NO: 819306 - RNA, 22 nt, Human
cucuucuugucucugguuagaa

SEQ ID NO: 819307 - RNA, 22 nt, Human
acuggcaguagagggagcgcau

SEQ ID NO: 819308 - RNA, 22 nt, Human
ccccaggagaaaucuuaaacua

SEQ ID NO: 819309 - RNA, 22 nt, Human
aaguccaugaucaagauguggc

SEQ ID NO: 819310 - RNA, 22 nt, Human
agcuggcagucauccuagugag

SEQ ID NO: 819311 - RNA, 22 nt, Human
cuuuccaaugcauuuccaaugu

SEQ ID NO: 819312 - RNA, 22 nt, Human
uuugcaaagugacuauuauaug

SEQ ID NO: 819313 - RNA, 22 nt, Human
ggaggugggcuaaggacucucu

SEQ ID NO: 819314 - RNA, 22 nt, Human
ucugcaggcuuauaggaugggu

SEQ ID NO: 819315 - RNA, 22 nt, Human
gggugggacugaagucugaggg

SEQ ID NO: 819316 - RNA, 22 nt, Human
cuuaagauuugcgauaccuaau

SEQ ID NO: 819317 - RNA, 23 nt, Human
uggcaaggaaugggauggagacu

SEQ ID NO: 819318 - RNA, 22 nt, Human
aggcagcugaggucuggcgccc

SEQ ID NO: 819319 - RNA, 22 nt, Human
cagcuccugaggacugcuggga

SEQ ID NO: 819320 - RNA, 22 nt, Human
ugaggggagcccgcccuggacg

SEQ ID NO: 819321 - RNA, 22 nt, Human
auguuauuaaaguacagauucu

SEQ ID NO: 819322 - RNA, 21 nt, Human
ggcagccugacccccagagag

SEQ ID NO: 819323 - RNA, 22 nt, Human
aaggcagcaacuaauggaucuc

SEQ ID NO: 819324 - RNA, 22 nt, Human
ccaggagagcgcccucccggcc

SEQ ID NO: 819325 - RNA, 22 nt, Human
uaaugcuuaacagcuggcuuuu

SEQ ID NO: 819326 - RNA, 22 nt, Human
cccaggagaugcacuccauugg

SEQ ID NO: 819327 - RNA, 22 nt, Human
acauuguuugagaauacagaug

SEQ ID NO: 819328 - RNA, 22 nt, Human
uuugaaagggaaauaaacuccu

SEQ ID NO: 819329 - RNA, 22 nt, Human
cccaggaccgcgcggcugagcg

SEQ ID NO: 819330 - RNA, 22 nt, Human
ggaggaugccaagcugugcaca

SEQ ID NO: 819331 - RNA, 16 nt, Human
ccccaggacuuggcac

SEQ ID NO: 819332 - RNA, 22 nt, Human
uacuaaauaguuuaauuccuca

SEQ ID NO: 819333 - RNA, 22 nt, Human
cucaggauggaagccuacagga

SEQ ID NO: 819334 - RNA, 22 nt, Human
aaauuauaggugccaccuugga

SEQ ID NO: 819335 - RNA, 22 nt, Human
gaggcaccucgcgggaggaggc

SEQ ID NO: 819336 - RNA, 22 nt, Human
aaggcagcaagaauuccagguu

SEQ ID NO: 819337 - RNA, 22 nt, Human
gcaggagagccagcaggcuucc

SEQ ID NO: 819338 - RNA, 22 nt, Human
cccaggaacuccagagcuccuc

SEQ ID NO: 819339 - RNA, 22 nt, Human
cagcagaggugguucacauugu

SEQ ID NO: 819340 - RNA, 22 nt, Human
accaggagccacaggaggagcc

SEQ ID NO: 819341 - RNA, 22 nt, Human
uuugaaagagcugauacaugaa

SEQ ID NO: 819342 - RNA, 22 nt, Human
ggguggagcuuggacaccagua

SEQ ID NO: 819343 - RNA, 20 nt, Human
ucacaucuggcagcugauga

SEQ ID NO: 819344 - RNA, 22 nt, Human
ucaucucaaaacccaaggggca

SEQ ID NO: 819345 - RNA, 22 nt, Human
cagaguggcgacccccucagcu

SEQ ID NO: 819346 - RNA, 22 nt, Human
ggaggccagggacccagucagc

SEQ ID NO: 819347 - RNA, 22 nt, Human
aaggccaacuaggaugagcuag

SEQ ID NO: 819348 - RNA, 22 nt, Human
gacagguggggaaacuaaggua

SEQ ID NO: 819349 - RNA, 22 nt, Human
auucuucacauggauaggaucu

SEQ ID NO: 819350 - RNA, 22 nt, Human
cccaggaaaugaacuucugauu

SEQ ID NO: 819351 - RNA, 22 nt, Human
gaggccaaucaauagggcaaua

SEQ ID NO: 819352 - RNA, 22 nt, Human
ugugccagccucuggcuguguc

SEQ ID NO: 819353 - RNA, 22 nt, Human
uugaaauaucaaguuauuagug

SEQ ID NO: 819354 - RNA, 22 nt, Human
cagaauggcuuuuauggcucag

SEQ ID NO: 819355 - RNA, 22 nt, Human
uucaacuaauguuuauuuuaug

SEQ ID NO: 819356 - RNA, 22 nt, Human
aagacugugucuauggcuacuc

SEQ ID NO: 819357 - RNA, 22 nt, Human
aucaggauccaccuugagccug

SEQ ID NO: 819358 - RNA, 22 nt, Human
agugcuuugguauagaacuauu

SEQ ID NO: 819359 - RNA, 22 nt, Human
caggcagaguuagagcaacugg

SEQ ID NO: 819360 - RNA, 22 nt, Human
uuuccucacuucaugagaguuu

SEQ ID NO: 819361 - RNA, 22 nt, Human
ggcuuggaccagucacaguggu

SEQ ID NO: 819362 - RNA, 22 nt, Human
uuuuuuaguuaggucagaaugu

SEQ ID NO: 819363 - RNA, 22 nt, Human
gaggcagcaucuauggugggaa

SEQ ID NO: 819364 - RNA, 22 nt, Human
agcaccauugcaaauauggcag

SEQ ID NO: 819365 - RNA, 20 nt, Human
augugucuguaaacaacucu

SEQ ID NO: 819366 - RNA, 22 nt, Human
uccaggaggccucauuuccugu

SEQ ID NO: 819367 - RNA, 22 nt, Human
auuucagguaccugugggaucc

SEQ ID NO: 819368 - RNA, 22 nt, Human
accaggagaggcacuugcaaug

SEQ ID NO: 819369 - RNA, 20 nt, Human
ccucaggaugagggugagca

SEQ ID NO: 819370 - RNA, 22 nt, Human
uugguuuagagagugugguuac

SEQ ID NO: 819371 - RNA, 22 nt, Human
ggcagcuucucccaggcuguuu

SEQ ID NO: 819372 - RNA, 22 nt, Human
ucaggagaguguucaguggagg

SEQ ID NO: 819373 - RNA, 22 nt, Human
gcugugcuugggaagaaucucu

SEQ ID NO: 819374 - RNA, 22 nt, Human
ccugcuguaaugugucuuuauu

SEQ ID NO: 819375 - RNA, 22 nt, Human
agucuugcauuuucugaagaug

SEQ ID NO: 819376 - RNA, 22 nt, Human
ugaggcagauauuuauuggguu

SEQ ID NO: 819377 - RNA, 22 nt, Human
aaagauuugaguucugcuuaua

SEQ ID NO: 819378 - RNA, 22 nt, Human
cuucuucagcacaauauugaug

SEQ ID NO: 819379 - RNA, 21 nt, Human
uacugagaccucacagugugc

SEQ ID NO: 819380 - RNA, 22 nt, Human
uaucuaaauggaauauuccaga

SEQ ID NO: 819381 - RNA, 22 nt, Human
agacagcuaauaaaugagugug

SEQ ID NO: 819382 - RNA, 22 nt, Human
ugcucccagggacucuggcugg

SEQ ID NO: 819383 - RNA, 22 nt, Human
uuuucagugggcaaugauguga

SEQ ID NO: 819384 - RNA, 22 nt, Human
agacaguguguguauauauggu

SEQ ID NO: 819385 - RNA, 22 nt, Human
uggcuucuugggaugggucauu

SEQ ID NO: 819386 - RNA, 22 nt, Human
cuacagacccaccuuggaagaa

SEQ ID NO: 819387 - RNA, 22 nt, Human
uucacauuggugauauguuucu

SEQ ID NO: 819388 - RNA, 22 nt, Human
aauacaguagguaauaguucau

SEQ ID NO: 819389 - RNA, 22 nt, Human
uucaaacaguguagaauauaug

SEQ ID NO: 819390 - RNA, 22 nt, Human
ugugugucagagucuccauggu

SEQ ID NO: 819391 - RNA, 22 nt, Human
cccaggaggacauuccauaccc

SEQ ID NO: 819392 - RNA, 20 nt, Human
gcucccagccugcagucccc

SEQ ID NO: 819393 - RNA, 22 nt, Human
ccucaggauccgcaggugcagu

SEQ ID NO: 819394 - RNA, 22 nt, Human
uggggcuccuccuggcaggagg

SEQ ID NO: 819395 - RNA, 19 nt, Human
ggucagcugggcuagaggc

SEQ ID NO: 819396 - RNA, 22 nt, Human
gccaggagugucccacucauuu

SEQ ID NO: 819397 - RNA, 22 nt, Human
gggcagcugccccucucugggc

SEQ ID NO: 819398 - RNA, 22 nt, Human
uguacauagaucuugaaaauua

SEQ ID NO: 819399 - RNA, 19 nt, Human
uaucuguuuccugcuuguc

SEQ ID NO: 819400 - RNA, 22 nt, Human
acauaccauacauggugagaug

SEQ ID NO: 819401 - RNA, 22 nt, Human
uaguuuuacuugcgaugauaau

SEQ ID NO: 819402 - RNA, 22 nt, Human
gagggaauggugugcaagaggu

SEQ ID NO: 819403 - RNA, 22 nt, Human
aauauuuguuaguguuuuaaug

SEQ ID NO: 819404 - RNA, 22 nt, Human
ugcugaaagucccaaaucucau

SEQ ID NO: 819405 - RNA, 22 nt, Human
auuuccaguccuaaugaucugg

SEQ ID NO: 819406 - RNA, 22 nt, Human
cuugaaguugcaaaacauuaau

SEQ ID NO: 819407 - RNA, 22 nt, Human
ggacaagccugugaguggguuu

SEQ ID NO: 819408 - RNA, 22 nt, Human
ugcuuggccuacuuguccuuug

SEQ ID NO: 819409 - RNA, 22 nt, Human
cuuuguagcugcuucugauuua

SEQ ID NO: 819410 - RNA, 22 nt, Human
cucaggaugcaauuccaucaag

SEQ ID NO: 819411 - RNA, 22 nt, Human
ggcagcuuguccuucaggagag

SEQ ID NO: 819412 - RNA, 22 nt, Human
ucauuuguugcuguuaccugag

SEQ ID NO: 819413 - RNA, 22 nt, Human
caggagaucuuaggaauucuua

SEQ ID NO: 819414 - RNA, 22 nt, Human
caaggccaaagggccacuguca

SEQ ID NO: 819415 - RNA, 22 nt, Human
agggcagccauugagggauucu

SEQ ID NO: 819416 - RNA, 22 nt, Human
agaaaugacaagacugaucagg

SEQ ID NO: 819417 - RNA, 22 nt, Human
uccaugagcuagggauucauca

SEQ ID NO: 819418 - RNA, 21 nt, Human
gacaaagugaagcaggcagga

SEQ ID NO: 819419 - RNA, 22 nt, Human
gagagucuagugcaccuaguuu

SEQ ID NO: 819420 - RNA, 22 nt, Human
cucuucucugcagccuuugaag

SEQ ID NO: 819421 - RNA, 22 nt, Human
cuucuucauguauugauagucu

SEQ ID NO: 819422 - RNA, 22 nt, Human
agagggcagggcgguaaguccu

SEQ ID NO: 819423 - RNA, 22 nt, Human
gccaggaggcuuaacuggacag

SEQ ID NO: 819424 - RNA, 18 nt, Human
ggucuuuaggucaguguc

SEQ ID NO: 819425 - RNA, 22 nt, Human
uugcauuucccauugaguaaug

SEQ ID NO: 819426 - RNA, 22 nt, Human
agcuucuuggcucagcacuugg

SEQ ID NO: 819427 - RNA, 22 nt, Human
aggcggcuccgggagugugggc

SEQ ID NO: 819428 - RNA, 22 nt, Human
uccuuagagacaagaccaguuu

SEQ ID NO: 819429 - RNA, 22 nt, Human
agggcagcagcuccuccuagcu

SEQ ID NO: 819430 - RNA, 22 nt, Human
aggguagggccguagggccaug

SEQ ID NO: 819431 - RNA, 22 nt, Human
aaggcagcucagcucauggcag

SEQ ID NO: 819432 - RNA, 22 nt, Human
agagguagagguugcagugagc

SEQ ID NO: 819433 - RNA, 22 nt, Human
ucugcugugauuugcuaccugu

SEQ ID NO: 819434 - RNA, 23 nt, Human
uucuucucaauuaguugauucag

SEQ ID NO: 819435 - RNA, 22 nt, Human
augaguucaauuguuucaguca

SEQ ID NO: 819436 - RNA, 22 nt, Human
ucccaggaaugucugaaaguga

SEQ ID NO: 819437 - RNA, 22 nt, Human
gaaggccauuagagccugugcc

SEQ ID NO: 819438 - RNA, 22 nt, Human
caggcagccugcggucugcaca

SEQ ID NO: 819439 - RNA, 22 nt, Human
ccaaaugugccuguuucaacaa

SEQ ID NO: 819440 - RNA, 22 nt, Human
gucccaggugggcuccaccucu

SEQ ID NO: 819441 - RNA, 22 nt, Human
uucauguguauggaacauuuuu

SEQ ID NO: 819442 - RNA, 22 nt, Human
ggcagccuugagggaggccugg

SEQ ID NO: 819443 - RNA, 22 nt, Human
uucauugugauucuuggcuagc

SEQ ID NO: 819444 - RNA, 22 nt, Human
uucugagguccaugcaguacug

SEQ ID NO: 819445 - RNA, 22 nt, Human
cacaauuuguuuuaucaguauu

SEQ ID NO: 819446 - RNA, 23 nt, Human
cuuuuaacuagaguaucagcugc

SEQ ID NO: 819447 - RNA, 20 nt, Human
cagaggcaaggagacuugga

SEQ ID NO: 819448 - RNA, 22 nt, Human
cccaggaggcagagcuugcagu

SEQ ID NO: 819449 - RNA, 22 nt, Human
acccaggaggcagagguugcag

SEQ ID NO: 819450 - RNA, 23 nt, Human
cccauuuucauguuaacuccugg

SEQ ID NO: 819451 - RNA, 22 nt, Human
aacaugcugccuuucuacgagu

SEQ ID NO: 819452 - RNA, 22 nt, Human
ugguaauuuacgcauuucugua

SEQ ID NO: 819453 - RNA, 22 nt, Human
augcuguggggagugaggguag

SEQ ID NO: 819454 - RNA, 22 nt, Human
gcucaggaaauaguuuaguguu

SEQ ID NO: 819455 - RNA, 17 nt, Human
ugauaguucauuuuaag

SEQ ID NO: 819456 - RNA, 22 nt, Human
uaaaugaagaaauggagauugu

SEQ ID NO: 819457 - RNA, 22 nt, Human
aaaggccauuacuugcuuuuag

SEQ ID NO: 819458 - RNA, 22 nt, Human
ugaguucuaguggcugcagauu

SEQ ID NO: 819459 - RNA, 19 nt, Human
cccaggagucuggcugguu

SEQ ID NO: 819460 - RNA, 22 nt, Human
uugcugaauugaauccuuuggu

SEQ ID NO: 819461 - RNA, 22 nt, Human
agaggauguucuaggcacucau

SEQ ID NO: 819462 - RNA, 22 nt, Human
auuacaaaagaagggagaaggu

SEQ ID NO: 819463 - RNA, 22 nt, Human
aggcagcuucugauuagcagcg

SEQ ID NO: 819464 - RNA, 22 nt, Human
cugcugugagcacuccagccug

SEQ ID NO: 819465 - RNA, 22 nt, Human
uccaggaggguuuucugccuuc

SEQ ID NO: 819466 - RNA, 22 nt, Human
uagggauguccugagacuuggc

SEQ ID NO: 819467 - RNA, 22 nt, Human
auuuccaggagaaaggauuuua

SEQ ID NO: 819468 - RNA, 17 nt, Human
gagacagcaggagcccc

SEQ ID NO: 819469 - RNA, 22 nt, Human
aaggccagacaggaccacaucu

SEQ ID NO: 819470 - RNA, 22 nt, Human
uguucauuuggcccuuuuguau

SEQ ID NO: 819471 - RNA, 22 nt, Human
guccaugauucugugacacccu

SEQ ID NO: 819472 - RNA, 22 nt, Human
gauauuuugagaaauccuauga

SEQ ID NO: 819473 - RNA, 22 nt, Human
cucccaggacucagaggagaag

SEQ ID NO: 819474 - RNA, 22 nt, Human
uaaggccaaggggccauagucu

SEQ ID NO: 819475 - RNA, 22 nt, Human
cuuagaaaugcagauucucagg

SEQ ID NO: 819476 - RNA, 18 nt, Human
ucauuuguuuugcaugaa

SEQ ID NO: 819477 - RNA, 22 nt, Human
ggaggggagucucccaaagccg

SEQ ID NO: 819478 - RNA, 21 nt, Human
ugcuggaaaaagugguucuag

SEQ ID NO: 819479 - RNA, 22 nt, Human
uaaggccaaguucauauacaac

SEQ ID NO: 819480 - RNA, 22 nt, Human
auaucacaguaguuguuuaguu

SEQ ID NO: 819481 - RNA, 22 nt, Human
ugcuuucaaaggcuuucuagau

SEQ ID NO: 819482 - RNA, 22 nt, Human
aagggcagaauagagaagaugg

SEQ ID NO: 819483 - RNA, 22 nt, Human
ucaggaauccagacagggcaca

SEQ ID NO: 819484 - RNA, 22 nt, Human
agggagcucuaaguagagggac

SEQ ID NO: 819485 - RNA, 19 nt, Human
ugaggggaggagaggccug

SEQ ID NO: 819486 - RNA, 22 nt, Human
ccaggcagcaaauuuucugaau

SEQ ID NO: 819487 - RNA, 22 nt, Human
aggaagcugcuggaguagugug

SEQ ID NO: 819488 - RNA, 22 nt, Human
auuugcuucugugaaaucaagu

SEQ ID NO: 819489 - RNA, 22 nt, Human
cagagcagucuggagauccagc

SEQ ID NO: 819490 - RNA, 22 nt, Human
uuggaugaagucuagcuuuagu

SEQ ID NO: 819491 - RNA, 19 nt, Human
aguggcagaucuggaagua

SEQ ID NO: 819492 - RNA, 22 nt, Human
gauggcaggugauagccgaguc

SEQ ID NO: 819493 - RNA, 22 nt, Human
auucuucaaagagugucaaagu

SEQ ID NO: 819494 - RNA, 22 nt, Human
ucugggaagcugcgugccuguu

SEQ ID NO: 819495 - RNA, 20 nt, Human
gagauggacagaugaagggg

SEQ ID NO: 819496 - RNA, 22 nt, Human
ugcuuccuauccacacaaugcc

SEQ ID NO: 819497 - RNA, 22 nt, Human
caggaugguggcaugaucagaa

SEQ ID NO: 819498 - RNA, 18 nt, Human
ugugaacacauuuuucug

SEQ ID NO: 819499 - RNA, 22 nt, Human
cuuguaauuauaauguacuguu

SEQ ID NO: 819500 - RNA, 22 nt, Human
cugcugugcuuguggccacccg

SEQ ID NO: 819501 - RNA, 22 nt, Human
cuuugaauugccguuucaucug

SEQ ID NO: 819502 - RNA, 22 nt, Human
cagcuggcaaguggagcagggu

SEQ ID NO: 819503 - RNA, 22 nt, Human
cauuuguauguuccuccuuagg

SEQ ID NO: 819504 - RNA, 19 nt, Human
ucucacaguuuccuugccu

SEQ ID NO: 819505 - RNA, 22 nt, Human
agaggacaaaaugagaagugcu

SEQ ID NO: 819506 - RNA, 22 nt, Human
uuuuuggguccaggcuguaucu

SEQ ID NO: 819507 - RNA, 22 nt, Human
gaggcugcuguuagcccugggc

SEQ ID NO: 819508 - RNA, 22 nt, Human
ucugucccugagagcucaggag

SEQ ID NO: 819509 - RNA, 22 nt, Human
agucucuuccuucaaggcuggu

SEQ ID NO: 819510 - RNA, 17 nt, Human
gaggagcuccaguaggu

SEQ ID NO: 819511 - RNA, 22 nt, Human
ccaggagagcaggcgugcagcu

SEQ ID NO: 819512 - RNA, 22 nt, Human
ucccaggacaugggcucugcuc

SEQ ID NO: 819513 - RNA, 22 nt, Human
aagggcagagggaaucccacau

SEQ ID NO: 819514 - RNA, 22 nt, Human
uuaacauacaucaugaacaaug

SEQ ID NO: 819515 - RNA, 21 nt, Human
aggucagcccagcucuggaag

SEQ ID NO: 819516 - RNA, 22 nt, Human
uaggcagcgcuuggcugugcuu

SEQ ID NO: 819517 - RNA, 22 nt, Human
acucaggaagaaagcagcuggu

SEQ ID NO: 819518 - RNA, 22 nt, Human
aaccauuugccauuaucuuaag

SEQ ID NO: 819519 - RNA, 22 nt, Human
aaaacaguuuaggcaucacagu

SEQ ID NO: 819520 - RNA, 23 nt, Human
cugcuguguuggucucgauggga

SEQ ID NO: 819521 - RNA, 22 nt, Human
uauguguuugacacccugcaag

SEQ ID NO: 819522 - RNA, 22 nt, Human
aaucuguuuaguucugcguaug

SEQ ID NO: 819523 - RNA, 22 nt, Human
cagcuucugucugauuagcaag

SEQ ID NO: 819524 - RNA, 22 nt, Human
gaggagagaacauuccuccaua

SEQ ID NO: 819525 - RNA, 22 nt, Human
gcccaggaguugaaugcagcag

SEQ ID NO: 819526 - RNA, 18 nt, Human
gagaggagccagaauuuu

SEQ ID NO: 819527 - RNA, 22 nt, Human
gaggcaugcagagcuggagcag

SEQ ID NO: 819528 - RNA, 21 nt, Human
auggagggaccagggaagcag

SEQ ID NO: 819529 - RNA, 22 nt, Human
ucuucuuccucauuuauacaua

SEQ ID NO: 819530 - RNA, 22 nt, Human
augcuguguuuuaaauggaaau

SEQ ID NO: 819531 - RNA, 19 nt, Human
acaaaugauguugcacuga

SEQ ID NO: 819532 - RNA, 22 nt, Human
agcugcuacugcucugccagag

SEQ ID NO: 819533 - RNA, 22 nt, Human
agagggaucacccuguuucugg

SEQ ID NO: 819534 - RNA, 22 nt, Human
ugcccaggaucuggcgaugcuc

SEQ ID NO: 819535 - RNA, 22 nt, Human
uuuaaaaucagaugggaguugg

SEQ ID NO: 819536 - RNA, 17 nt, Human
agaggcagauacuugga

SEQ ID NO: 819537 - RNA, 22 nt, Human
ccaggaguggcuggugaccuuc

SEQ ID NO: 819538 - RNA, 22 nt, Human
ccaggagaauaauggcagauua

SEQ ID NO: 819539 - RNA, 23 nt, Human
uggacgccgacuuuggaggcgcu

SEQ ID NO: 819540 - RNA, 22 nt, Human
cauuuccugucuggaggucaaa

SEQ ID NO: 819541 - RNA, 22 nt, Human
ucugcaggcuuggaguggcagc

SEQ ID NO: 819542 - RNA, 22 nt, Human
ggaggcagaacuucccgucagu

SEQ ID NO: 819543 - RNA, 22 nt, Human
ggaggggaacuaaucccgugac

SEQ ID NO: 819544 - RNA, 22 nt, Human
aggguagggcccggagacagac

SEQ ID NO: 819545 - RNA, 20 nt, Human
uccaugaguuagagacuaua

SEQ ID NO: 819546 - RNA, 18 nt, Human
uugcuuuguaagcuugca

SEQ ID NO: 819547 - RNA, 22 nt, Human
auugaaaggcaaaguaggaagc

SEQ ID NO: 819548 - RNA, 22 nt, Human
cagagacauuaagugccaugau

SEQ ID NO: 819549 - RNA, 22 nt, Human
auucuucauuguugauucaugu

SEQ ID NO: 819550 - RNA, 19 nt, Human
uucaggauugacccuacug

SEQ ID NO: 819551 - RNA, 22 nt, Human
acauuuuuauucaucaaagcag

SEQ ID NO: 819552 - RNA, 22 nt, Human
aggaggggcauagaaauguaau

SEQ ID NO: 819553 - RNA, 22 nt, Human
aucuucucauguguaaugaggu

SEQ ID NO: 819554 - RNA, 22 nt, Human
cacccugggcugggccuguuaa

SEQ ID NO: 819555 - RNA, 22 nt, Human
gcucacugccauucucuagaug

SEQ ID NO: 819556 - RNA, 21 nt, Human
gacaggacuagaccagagcuc

SEQ ID NO: 819557 - RNA, 22 nt, Human
cccaggaauuggaggcugcagu

SEQ ID NO: 819558 - RNA, 22 nt, Human
cagcuggcgggcagagccgcca

SEQ ID NO: 819559 - RNA, 22 nt, Human
acuuugcagggcuugauaucca

SEQ ID NO: 819560 - RNA, 22 nt, Human
auuuguagugaagugaaaauaa

SEQ ID NO: 819561 - RNA, 22 nt, Human
ugagaacugaggauuugaauuc

SEQ ID NO: 819562 - RNA, 22 nt, Human
ccagaggaaaaauaucucccua

SEQ ID NO: 819563 - RNA, 22 nt, Human
ggagaggaaaugccagcacuuc

SEQ ID NO: 819564 - RNA, 22 nt, Human
ggcagaggaaggaugaauucac

SEQ ID NO: 819565 - RNA, 22 nt, Human
acccaggaggcaagguugcagu

SEQ ID NO: 819566 - RNA, 19 nt, Human
ucauuguugguuugucggg

SEQ ID NO: 819567 - RNA, 22 nt, Human
ggaguaggaguagaacucauca

SEQ ID NO: 819568 - RNA, 22 nt, Human
aggcagcuggcagcacccaggg

SEQ ID NO: 819569 - RNA, 22 nt, Human
gaggccagcuaguccaggaagu

SEQ ID NO: 819570 - RNA, 22 nt, Human
auuuucagagacaucuggacuu

SEQ ID NO: 819571 - RNA, 22 nt, Human
uuucugcugugcuuucuugcgu

SEQ ID NO: 819572 - RNA, 20 nt, Human
aggcaguuagaaggagauga

SEQ ID NO: 819573 - RNA, 22 nt, Human
agggaggucuuugaggggcuua

SEQ ID NO: 819574 - RNA, 22 nt, Human
gaggagagaugguagauugggu

SEQ ID NO: 819575 - RNA, 22 nt, Human
uuuugcuugagugcacaaaaug

SEQ ID NO: 819576 - RNA, 22 nt, Human
cggagggguuugaacagaggag

SEQ ID NO: 819577 - RNA, 22 nt, Human
auuauucuuaugucaucauggc

SEQ ID NO: 819578 - RNA, 22 nt, Human
cacauuuaauccuuuauaagua

SEQ ID NO: 819579 - RNA, 22 nt, Human
ggugaguugggguucacagguc

SEQ ID NO: 819580 - RNA, 22 nt, Human
uucauucuuugaaucugaggua

SEQ ID NO: 819581 - RNA, 22 nt, Human
cuucaugcugauauccucgaug

SEQ ID NO: 819582 - RNA, 22 nt, Human
gagguagcaugcuggaagggac

SEQ ID NO: 819583 - RNA, 22 nt, Human
uuaugauuugccacagauuggu

SEQ ID NO: 819584 - RNA, 22 nt, Human
gaggucagucagaccaggguuu

SEQ ID NO: 819585 - RNA, 22 nt, Human
gauuucuucauuuguggugaau

SEQ ID NO: 819586 - RNA, 20 nt, Human
ucagaugggagugagccauc

SEQ ID NO: 819587 - RNA, 22 nt, Human
caggauggccccggggcugugc

SEQ ID NO: 819588 - RNA, 22 nt, Human
gugguaauagagcuccaaacua

SEQ ID NO: 819589 - RNA, 23 nt, Human
acuuuauugaccccaggucaguu

SEQ ID NO: 819590 - RNA, 22 nt, Human
uaauuauucuagucacauagca

SEQ ID NO: 819591 - RNA, 22 nt, Human
gcagagaacccagcagauuggc

SEQ ID NO: 819592 - RNA, 22 nt, Human
uucacagacuuuccauagauug

SEQ ID NO: 819593 - RNA, 22 nt, Human
acacauuuacauguuuacguau

SEQ ID NO: 819594 - RNA, 22 nt, Human
agugcugucaguuuuauagaua

SEQ ID NO: 819595 - RNA, 22 nt, Human
ggagaggauguuuuaguaacuu

SEQ ID NO: 819596 - RNA, 22 nt, Human
cagcaggagcagucagacuccu

SEQ ID NO: 819597 - RNA, 22 nt, Human
ccaggagagcucucguucagug

SEQ ID NO: 819598 - RNA, 22 nt, Human
uuauucuuuaaacauauauguu

SEQ ID NO: 819599 - RNA, 22 nt, Human
uccauuuuucaugacuccucaa

SEQ ID NO: 819600 - RNA, 22 nt, Human
aggcagcccugugcuggaugcu

SEQ ID NO: 819601 - RNA, 22 nt, Human
ucccaggaaggauucggcauuu

SEQ ID NO: 819602 - RNA, 22 nt, Human
guugaaagagcauggacuugaa

SEQ ID NO: 819603 - RNA, 22 nt, Human
uuucaguucaguuuauuauauc

SEQ ID NO: 819604 - RNA, 21 nt, Human
cccaggaguccuauuuaaaug

SEQ ID NO: 819605 - RNA, 22 nt, Human
gugggagcuuuggcaucaggcu

SEQ ID NO: 819606 - RNA, 23 nt, Human
ucuccuccuagauacagucaugg

SEQ ID NO: 819607 - RNA, 22 nt, Human
auucuucauaccuacugagguu

SEQ ID NO: 819608 - RNA, 22 nt, Human
cagggaggaugggcuguuuugc

SEQ ID NO: 819609 - RNA, 22 nt, Human
aggaugagccgcgcaagcugac

SEQ ID NO: 819610 - RNA, 22 nt, Human
ucucuucuagcuucuugugguu

SEQ ID NO: 819611 - RNA, 22 nt, Human
uucacagaauggcaaguuaugg

SEQ ID NO: 819612 - RNA, 22 nt, Human
aauauaugugguauugaccagc

SEQ ID NO: 819613 - RNA, 22 nt, Human
ucacugcucagucuguacuaca

SEQ ID NO: 819614 - RNA, 22 nt, Human
uugaagagugccuuccagacau

SEQ ID NO: 819615 - RNA, 22 nt, Human
cauuuuaaaugauuuaagccaa

SEQ ID NO: 819616 - RNA, 22 nt, Human
ggagcggagggagggccacugu

SEQ ID NO: 819617 - RNA, 22 nt, Human
gacagcuguggagaggcaugug

SEQ ID NO: 819618 - RNA, 22 nt, Human
cuggcaaguacugggccagcuc

SEQ ID NO: 819619 - RNA, 21 nt, Human
cccacggaaugaugaggcacu

SEQ ID NO: 819620 - RNA, 22 nt, Human
agacagguaaauagagaugcug

SEQ ID NO: 819621 - RNA, 22 nt, Human
ugaaaggugacauuucuuggau

SEQ ID NO: 819622 - RNA, 23 nt, Human
uccaggagaaccccugucugucc

SEQ ID NO: 819623 - RNA, 22 nt, Human
uugaaagugccaaguccuagug

SEQ ID NO: 819624 - RNA, 22 nt, Human
aauauccacacugugucccugc

SEQ ID NO: 819625 - RNA, 22 nt, Human
caaggccaguuucuccuaguca

SEQ ID NO: 819626 - RNA, 22 nt, Human
gaggccaggaagcccaagauca

SEQ ID NO: 819627 - RNA, 22 nt, Human
cgucuuccucuuacgaugcgcu

SEQ ID NO: 819628 - RNA, 22 nt, Human
ggccagcuuugagcugcaggaa

SEQ ID NO: 819629 - RNA, 22 nt, Human
uccaggagagguagaggguucc

SEQ ID NO: 819630 - RNA, 22 nt, Human
aggaaaggccuuugcauuuggu

SEQ ID NO: 819631 - RNA, 22 nt, Human
agggauggaagacuugaagacc

SEQ ID NO: 819632 - RNA, 22 nt, Human
agggaguuagaaauccaggaua

SEQ ID NO: 819633 - RNA, 23 nt, Human
ucagagagcuguugagagcugcc

SEQ ID NO: 819634 - RNA, 22 nt, Human
uuuuaucugcuucauuaguuga

SEQ ID NO: 819635 - RNA, 22 nt, Human
uggcagcuuccugcucauagga

SEQ ID NO: 819636 - RNA, 22 nt, Human
uuucaaagaccauuaacuauca

SEQ ID NO: 819637 - RNA, 22 nt, Human
cucuucuuauggccguggcuga

SEQ ID NO: 819638 - RNA, 22 nt, Human
cauuguuaauugguaucuuaca

SEQ ID NO: 819639 - RNA, 22 nt, Human
uuugaauguuuuagguacuuaa

SEQ ID NO: 819640 - RNA, 22 nt, Human
gugacaguggucacuuguaguu

SEQ ID NO: 819641 - RNA, 22 nt, Human
ucacagacacagggagaagcau

SEQ ID NO: 819642 - RNA, 22 nt, Human
uuuaacagaugcuaugucuacc

SEQ ID NO: 819643 - RNA, 22 nt, Human
ucuucagagugaaagucuguga

SEQ ID NO: 819644 - RNA, 22 nt, Human
uaucuguuaugggcugaauugc

SEQ ID NO: 819645 - RNA, 22 nt, Human
caaggccaguccauuuuggaag

SEQ ID NO: 819646 - RNA, 22 nt, Human
caggcagcagaggaguguggga

SEQ ID NO: 819647 - RNA, 23 nt, Human
uuuuccagaaucgacucuguaga

SEQ ID NO: 819648 - RNA, 22 nt, Human
cccaggagguggagguugcagu

SEQ ID NO: 819649 - RNA, 22 nt, Human
cugcuuugggcagcuuuguggc

SEQ ID NO: 819650 - RNA, 22 nt, Human
agucaauucuuuucaacucaag

SEQ ID NO: 819651 - RNA, 22 nt, Human
cccaggagguggaguucacagu

SEQ ID NO: 819652 - RNA, 22 nt, Human
uucuuugaguuaguacagucca

SEQ ID NO: 819653 - RNA, 22 nt, Human
ugcaggaaucagaggggaagcg

SEQ ID NO: 819654 - RNA, 22 nt, Human
guugaaaguggagaaccugguu

SEQ ID NO: 819655 - RNA, 22 nt, Human
uucaggauccccaccgcguuua

SEQ ID NO: 819656 - RNA, 20 nt, Human
aggacagcagcugccacuug

SEQ ID NO: 819657 - RNA, 22 nt, Human
gugagggguggcugagcaguuu

SEQ ID NO: 819658 - RNA, 22 nt, Human
aggcagcugugaggacuggauu

SEQ ID NO: 819659 - RNA, 22 nt, Human
uuugcagucuggccugcuuugg

SEQ ID NO: 819660 - RNA, 22 nt, Human
gaggcagcgggucaggaccgug

SEQ ID NO: 819661 - RNA, 22 nt, Human
uuugaaugcaggacauacagaa

SEQ ID NO: 819662 - RNA, 22 nt, Human
acaaauaugguacucggagaaa

SEQ ID NO: 819663 - RNA, 22 nt, Human
uccaggagguugagacugcagu

SEQ ID NO: 819664 - RNA, 22 nt, Human
aaugaaauguagcuuauccaua

SEQ ID NO: 819665 - RNA, 22 nt, Human
aggcuggagggcaauggcaaga

SEQ ID NO: 819666 - RNA, 22 nt, Human
gcucccagacugaccagaggug

SEQ ID NO: 819667 - RNA, 22 nt, Human
gcuucccacagcuggacugggg

SEQ ID NO: 819668 - RNA, 22 nt, Human
uacccagggcuuuucugaugca

SEQ ID NO: 819669 - RNA, 22 nt, Human
caggcagcugggucaccguccc

SEQ ID NO: 819670 - RNA, 22 nt, Human
agcccagggacagggcggaugu

SEQ ID NO: 819671 - RNA, 22 nt, Human
gaaaggccagcucacagaugag

SEQ ID NO: 819672 - RNA, 22 nt, Human
cuucucaaaguugugaaucagg

SEQ ID NO: 819673 - RNA, 22 nt, Human
uucucagguagugcugaugcug

SEQ ID NO: 819674 - RNA, 22 nt, Human
uuuauauuucccaggauuggcc

SEQ ID NO: 819675 - RNA, 22 nt, Human
cagagccacuuggagaugagaa

SEQ ID NO: 819676 - RNA, 22 nt, Human
ccagcagagucuaggaaggagg

SEQ ID NO: 819677 - RNA, 22 nt, Human
uuauuacacugaaagaauugcg

SEQ ID NO: 819678 - RNA, 22 nt, Human
accaggaguaacagugaguggu

SEQ ID NO: 819679 - RNA, 22 nt, Human
acaauucugaugguuucccagu

SEQ ID NO: 819680 - RNA, 22 nt, Human
aagcagaggguauggccagguu

SEQ ID NO: 819681 - RNA, 22 nt, Human
cagcugccccgcuggcugacca

SEQ ID NO: 819682 - RNA, 21 nt, Human
ugaaaugagaaugcugagcac

SEQ ID NO: 819683 - RNA, 22 nt, Human
uccucagaaaccccugugaggu

SEQ ID NO: 819684 - RNA, 22 nt, Human
cugcccaggaaccagaggggca

SEQ ID NO: 819685 - RNA, 22 nt, Human
ggccagaggugguacauagcuu

SEQ ID NO: 819686 - RNA, 22 nt, Human
gcuccucuauuccccacauuuu

SEQ ID NO: 819687 - RNA, 21 nt, Human
ugcugaugucagagaagcaag

SEQ ID NO: 819688 - RNA, 22 nt, Human
ggagaggguguggaaaguuauc

SEQ ID NO: 819689 - RNA, 22 nt, Human
cagaagaguagcugaacaaguu

SEQ ID NO: 819690 - RNA, 22 nt, Human
agaggcagccguauuucaaagg

SEQ ID NO: 819691 - RNA, 22 nt, Human
uucuuaacucaaauauauaucc

SEQ ID NO: 819692 - RNA, 22 nt, Human
cuccaggagggggauggcugua

SEQ ID NO: 819693 - RNA, 22 nt, Human
ugcuggaauaauuucauguuaa

SEQ ID NO: 819694 - RNA, 23 nt, Human
ccacuagcaccuguucaacuucu

SEQ ID NO: 819695 - RNA, 22 nt, Human
aggcaguuuauccccagagccu

SEQ ID NO: 819696 - RNA, 22 nt, Human
agaaaugaauauguagugguua

SEQ ID NO: 819697 - RNA, 22 nt, Human
uauuuccaggccccacucuaga

SEQ ID NO: 819698 - RNA, 22 nt, Human
aguuauaaucugcuacugauau

SEQ ID NO: 819699 - RNA, 22 nt, Human
ucuuagaaguucauguuccagc

SEQ ID NO: 819700 - RNA, 23 nt, Human
aggauguaggauguauggcagag

SEQ ID NO: 819701 - RNA, 22 nt, Human
ucacaaaugaggaaaucgagca

SEQ ID NO: 819702 - RNA, 22 nt, Human
ccaggagauuuuuccauagcac

SEQ ID NO: 819703 - RNA, 22 nt, Human
ugaacuccaaauacugcugauu

SEQ ID NO: 819704 - RNA, 22 nt, Human
uuauggcauauuccucauugua

SEQ ID NO: 819705 - RNA, 22 nt, Human
ugaaagggguugaguuacagcu

SEQ ID NO: 819706 - RNA, 22 nt, Human
auacaacuuuacaugcaauucc

SEQ ID NO: 819707 - RNA, 21 nt, Human
gagugcagcaagguagagucu

SEQ ID NO: 819708 - RNA, 22 nt, Human
ugugauauuugaguauugucaa

SEQ ID NO: 819709 - RNA, 22 nt, Human
agaggagugggaagcagugcaa

SEQ ID NO: 819710 - RNA, 22 nt, Human
cuucugcaauaaguuuuggucc

SEQ ID NO: 819711 - RNA, 22 nt, Human
uucuccagaccuugugacuaug

SEQ ID NO: 819712 - RNA, 20 nt, Human
aggagggaccuggauuggcg

SEQ ID NO: 819713 - RNA, 22 nt, Human
ccaggagcagauauggacauaa

SEQ ID NO: 819714 - RNA, 20 nt, Human
cccagguaggugccaugagu

SEQ ID NO: 819715 - RNA, 22 nt, Human
gaggcagugcauugucuagggg

SEQ ID NO: 819716 - RNA, 22 nt, Human
ggaggugguggcagugacaauu

SEQ ID NO: 819717 - RNA, 22 nt, Human
uccaggaguccugggagugauu

SEQ ID NO: 819718 - RNA, 22 nt, Human
cccaggaggaggaaaaagcucg

SEQ ID NO: 819719 - RNA, 22 nt, Human
ccugcugugaccggggagcagg

SEQ ID NO: 819720 - RNA, 22 nt, Human
ucucucuugucaccccaucugc

SEQ ID NO: 819721 - RNA, 22 nt, Human
ccaggagaagcaucugagugua

SEQ ID NO: 819722 - RNA, 22 nt, Human
auguucuguuuuguaauucaua

SEQ ID NO: 819723 - RNA, 22 nt, Human
uggcagcagacaaaaggccauu

SEQ ID NO: 819724 - RNA, 20 nt, Human
cucaggauacugcaaaguug

SEQ ID NO: 819725 - RNA, 22 nt, Human
cccaggagguggagguugcagc

SEQ ID NO: 819726 - RNA, 22 nt, Human
uaaggccaccguuauagaacca

SEQ ID NO: 819727 - RNA, 22 nt, Human
aggcagauuacuugaggccagg

SEQ ID NO: 819728 - RNA, 22 nt, Human
cauucuuauauuuacucauuca

SEQ ID NO: 819729 - RNA, 22 nt, Human
aucacauuguuagcauagacug

SEQ ID NO: 819730 - RNA, 22 nt, Human
aggcagugcaugcaaaggucgg

SEQ ID NO: 819731 - RNA, 22 nt, Human
gagguggaaggcaggaacaaau

SEQ ID NO: 819732 - RNA, 22 nt, Human
cccaggaaaucaggcuuucuag

SEQ ID NO: 819733 - RNA, 22 nt, Human
ucauuauccuaguaucuugaau

SEQ ID NO: 819734 - RNA, 16 nt, Human
gcccaggacgggaggc

SEQ ID NO: 819735 - RNA, 22 nt, Human
ugcauguggaccccuggugccu

SEQ ID NO: 819736 - RNA, 22 nt, Human
uacaacauuguguugcuucaua

SEQ ID NO: 819737 - RNA, 22 nt, Human
cuggccaggcuugggacagaca

SEQ ID NO: 819738 - RNA, 22 nt, Human
aguggaccagaagacugaagcu

SEQ ID NO: 819739 - RNA, 20 nt, Human
aagcacauuucuacaauaau

SEQ ID NO: 819740 - RNA, 22 nt, Human
aagcaauauacugauaugauua

SEQ ID NO: 819741 - RNA, 22 nt, Human
aacauacauauuucagugucca

SEQ ID NO: 819742 - RNA, 22 nt, Human
ggguacuuaauauuuacggggu

SEQ ID NO: 819743 - RNA, 22 nt, Human
uaaguucauaagcuuauucuua

SEQ ID NO: 819744 - RNA, 23 nt, Human
acacauuuuucccguucugaggu

SEQ ID NO: 819745 - RNA, 21 nt, Human
uuugaaagcuacaucuauagc

SEQ ID NO: 819746 - RNA, 22 nt, Human
cuuaaaaucuggcaguuagcua

SEQ ID NO: 819747 - RNA, 22 nt, Human
gggcagcuagcccucuagccca

SEQ ID NO: 819748 - RNA, 22 nt, Human
cagucucuugcuucauuaguug

SEQ ID NO: 819749 - RNA, 22 nt, Human
aucaggauucaccccagagcug

SEQ ID NO: 819750 - RNA, 19 nt, Human
uuugaaaggauuguuauuu

SEQ ID NO: 819751 - RNA, 22 nt, Human
aggagacaucuaacuguagguu

SEQ ID NO: 819752 - RNA, 22 nt, Human
ugaaggccacuuccugugagcu

SEQ ID NO: 819753 - RNA, 22 nt, Human
aggcagcuuucuggugcaccau

SEQ ID NO: 819754 - RNA, 22 nt, Human
aaucuuucccuauuaaaugugg

SEQ ID NO: 819755 - RNA, 22 nt, Human
ugaaaugaaugugauucgauag

SEQ ID NO: 819756 - RNA, 22 nt, Human
auuaaauuaaguggcuaauuua

SEQ ID NO: 819757 - RNA, 22 nt, Human
aaaauaacuucuacuauuugca

SEQ ID NO: 819758 - RNA, 18 nt, Human
cauuguacaaugcuuuau

SEQ ID NO: 819759 - RNA, 22 nt, Human
uguuuuaaucucccauugcucu

SEQ ID NO: 819760 - RNA, 22 nt, Human
caaggccacugcucagguuucc

SEQ ID NO: 819761 - RNA, 20 nt, Human
gcccaggaucucugaggcau

SEQ ID NO: 819762 - RNA, 22 nt, Human
uucuucaaccaucuacauaaac

SEQ ID NO: 819763 - RNA, 22 nt, Human
cagcuccugggccaucuccuag

SEQ ID NO: 819764 - RNA, 22 nt, Human
ugacaguuaagguauacauuca

SEQ ID NO: 819765 - RNA, 22 nt, Human
uguuguuuucucauggagaaua

SEQ ID NO: 819766 - RNA, 22 nt, Human
uuauacuaaaacgcauugaauu

SEQ ID NO: 819767 - RNA, 22 nt, Human
cauuuguagcuauuuacuguau

SEQ ID NO: 819768 - RNA, 22 nt, Human
cccagggaagccauuucugacu

SEQ ID NO: 819769 - RNA, 22 nt, Human
ccaugagacagcaacugaaagu

SEQ ID NO: 819770 - RNA, 22 nt, Human
uggcagcuagcuguuuucaugc

SEQ ID NO: 819771 - RNA, 22 nt, Human
ggcaugcucuuuguccacagua

SEQ ID NO: 819772 - RNA, 22 nt, Human
gacccaggcccaaggcugccag

SEQ ID NO: 819773 - RNA, 22 nt, Human
ugucucugaggugagggucagc

SEQ ID NO: 819774 - RNA, 22 nt, Human
cagcugacuucauaggaagaca

SEQ ID NO: 819775 - RNA, 22 nt, Human
ggggggugcugaucaguggagc

SEQ ID NO: 819776 - RNA, 22 nt, Human
ucucagaguuuagagcugagcc

SEQ ID NO: 819777 - RNA, 22 nt, Human
agugugucugaucacuugugag

SEQ ID NO: 819778 - RNA, 21 nt, Human
auaagcaugcugauuacauuu

SEQ ID NO: 819779 - RNA, 22 nt, Human
aagacuguacauuuuccagucu

SEQ ID NO: 819780 - RNA, 22 nt, Human
cauuguuaccaucuuuuaccua

SEQ ID NO: 819781 - RNA, 22 nt, Human
ccaggaugacccccacuuuccu

SEQ ID NO: 819782 - RNA, 22 nt, Human
caggcagccugagggaucuggg

SEQ ID NO: 819783 - RNA, 22 nt, Human
uacugcauaacuggcauguggg

SEQ ID NO: 819784 - RNA, 22 nt, Human
cccaugagauucugaauuuggc

SEQ ID NO: 819785 - RNA, 22 nt, Human
gccaggagcccugggcaaguuc

SEQ ID NO: 819786 - RNA, 22 nt, Human
aggagcagaauuuaaugugcag

SEQ ID NO: 819787 - RNA, 22 nt, Human
cccaggagauaacguucccaag

SEQ ID NO: 819788 - RNA, 22 nt, Human
acaauauuguacccagaaguuu

SEQ ID NO: 819789 - RNA, 22 nt, Human
ugucugugaccucuuuggagcc

SEQ ID NO: 819790 - RNA, 22 nt, Human
cacauauuguaguucaccagga

SEQ ID NO: 819791 - RNA, 22 nt, Human
guaaaauagaauaacguggcua

SEQ ID NO: 819792 - RNA, 22 nt, Human
uuucuuauacuauauugucauc

SEQ ID NO: 819793 - RNA, 22 nt, Human
gaaggggacuggcagcugcaga

SEQ ID NO: 819794 - RNA, 22 nt, Human
aaauauaguaaaugcauaguuc

SEQ ID NO: 819795 - RNA, 22 nt, Human
gcagcugagcgugaggaagagu

SEQ ID NO: 819796 - RNA, 22 nt, Human
ggcagcucugcuccacaugagu

SEQ ID NO: 819797 - RNA, 22 nt, Human
uucucugaaggccaugcucacu

SEQ ID NO: 819798 - RNA, 22 nt, Human
cuuugaagagauuacugugcuc

SEQ ID NO: 819799 - RNA, 22 nt, Human
uugaaaguuaucuagauucuga

SEQ ID NO: 819800 - RNA, 22 nt, Human
aggcacagagaaugcccuccau

SEQ ID NO: 819801 - RNA, 22 nt, Human
ugacauaauaauccaaacauac

SEQ ID NO: 819802 - RNA, 22 nt, Human
aaggcagcaugaaucccuguac

SEQ ID NO: 819803 - RNA, 19 nt, Human
gaggcgaggcgugcaggag

SEQ ID NO: 819804 - RNA, 22 nt, Human
agagacugcgugucagcgcugg

SEQ ID NO: 819805 - RNA, 22 nt, Human
ugccuggaaggcccaugggaag

SEQ ID NO: 819806 - RNA, 22 nt, Human
cccaggagagaggggauaaagc

SEQ ID NO: 819807 - RNA, 22 nt, Human
cccaggaggccaagguugcagu

SEQ ID NO: 819808 - RNA, 22 nt, Human
auacacauguguaugugcaugc

SEQ ID NO: 819809 - RNA, 22 nt, Human
ggagaggacauggcucccacag

SEQ ID NO: 819810 - RNA, 22 nt, Human
ucauuucucccggccaaaaacu

SEQ ID NO: 819811 - RNA, 22 nt, Human
auucuucaucagagaugcacua

SEQ ID NO: 819812 - RNA, 22 nt, Human
uuucuucaauugcuaacaagga

SEQ ID NO: 819813 - RNA, 22 nt, Human
acccaggagccgugagagguua

SEQ ID NO: 819814 - RNA, 22 nt, Human
aggggagguggcagaaaugugc

SEQ ID NO: 819815 - RNA, 22 nt, Human
uauuucagggagaauaaauuug

SEQ ID NO: 819816 - RNA, 17 nt, Human
uugaacugcugagucag

SEQ ID NO: 819817 - RNA, 22 nt, Human
aguggcagagugcacucaggca

SEQ ID NO: 819818 - RNA, 22 nt, Human
gucuucuuuucagucugcuugu

SEQ ID NO: 819819 - RNA, 22 nt, Human
ucugggaacucugucauuuccc

SEQ ID NO: 819820 - RNA, 22 nt, Human
cagugaaaucacaacuuuaguu

SEQ ID NO: 819821 - RNA, 22 nt, Human
uuuccaagacuccaguucuccc

SEQ ID NO: 819822 - RNA, 22 nt, Human
ggcagcuucuuaauauggagac

SEQ ID NO: 819823 - RNA, 22 nt, Human
caggguggggaaauagcgcccu

SEQ ID NO: 819824 - RNA, 22 nt, Human
ucacagacauggugagguaaca

SEQ ID NO: 819825 - RNA, 22 nt, Human
aggcaguggcugagaccagggg

SEQ ID NO: 819826 - RNA, 22 nt, Human
uacaaagagguaauugcauaua

SEQ ID NO: 819827 - RNA, 22 nt, Human
ucccaggacuuccaguuggagg

SEQ ID NO: 819828 - RNA, 22 nt, Human
ucucuguaguugggcagcugcu

SEQ ID NO: 819829 - RNA, 22 nt, Human
augaggcaguacacacaaagcc

SEQ ID NO: 819830 - RNA, 22 nt, Human
cccuggaguccuggcaguugau

SEQ ID NO: 819831 - RNA, 22 nt, Human
cuguggaaggccuguccugaaa

SEQ ID NO: 819832 - RNA, 22 nt, Human
ccaggcugugguuuagauagag

SEQ ID NO: 819833 - RNA, 22 nt, Human
aggaagcuuagugaaaggacca

SEQ ID NO: 819834 - RNA, 22 nt, Human
cugcugugcauauuuaucuagg

SEQ ID NO: 819835 - RNA, 23 nt, Human
auuugagaaaguauuuuuaagac

SEQ ID NO: 819836 - RNA, 22 nt, Human
aggcagacaaggucccuggucu

SEQ ID NO: 819837 - RNA, 22 nt, Human
ggagaagggacagacucagcuu

SEQ ID NO: 819838 - RNA, 22 nt, Human
agcaccugucacaagcagaagg

SEQ ID NO: 819839 - RNA, 22 nt, Human
ugaggcagugcugggaagccug

SEQ ID NO: 819840 - RNA, 22 nt, Human
cucuucuuggcccccaugaggg

SEQ ID NO: 819841 - RNA, 20 nt, Human
uuucaguuaucuugaccuuc

SEQ ID NO: 819842 - RNA, 22 nt, Human
ucaggauguuaauauagcauua

SEQ ID NO: 819843 - RNA, 22 nt, Human
cagagagagucaaaucuuugcu

SEQ ID NO: 819844 - RNA, 22 nt, Human
cccaggagcuucucucugccuc

SEQ ID NO: 819845 - RNA, 22 nt, Human
gaggcugccccuuccucagcug

SEQ ID NO: 819846 - RNA, 22 nt, Human
acagucucuccacacugcaggg

SEQ ID NO: 819847 - RNA, 22 nt, Human
caggauggagggagggcuguua

SEQ ID NO: 819848 - RNA, 18 nt, Human
guaggucaguaccaagca

SEQ ID NO: 819849 - RNA, 22 nt, Human
cuugcaggccuuucuagcucua

SEQ ID NO: 819850 - RNA, 22 nt, Human
gcugucccgcugacuuccagcu

SEQ ID NO: 819851 - RNA, 22 nt, Human
gagugucugaauuagagcacaa

SEQ ID NO: 819852 - RNA, 21 nt, Human
uagggcaggcauuggaagaga

SEQ ID NO: 819853 - RNA, 22 nt, Human
uaucuuguaauagguccacuug

SEQ ID NO: 819854 - RNA, 22 nt, Human
agccagcugugggcucaggcgg

SEQ ID NO: 819855 - RNA, 22 nt, Human
cuuuggcaaggguuuuaauugu

SEQ ID NO: 819856 - RNA, 22 nt, Human
cucaggaugcaggucacaggac

SEQ ID NO: 819857 - RNA, 22 nt, Human
acacagaguauuuagaaggggu

SEQ ID NO: 819858 - RNA, 22 nt, Human
cacagacccagaagggaugaag

SEQ ID NO: 819859 - RNA, 23 nt, Human
cuccccaguguccucaugcaucu

SEQ ID NO: 819860 - RNA, 22 nt, Human
ucuuuucaucauuuaauaggua

SEQ ID NO: 819861 - RNA, 22 nt, Human
accaggaggccuugguucugag

SEQ ID NO: 819862 - RNA, 23 nt, Human
uucuuucaagaaguucacagugc

SEQ ID NO: 819863 - RNA, 18 nt, Human
ggcaucugcacagcagcc

SEQ ID NO: 819864 - RNA, 22 nt, Human
aaaauuauggaguaucccaaag

SEQ ID NO: 819865 - RNA, 22 nt, Human
uccaugaguuugaggaaaagag

SEQ ID NO: 819866 - RNA, 22 nt, Human
caugucuguguacacaugcaca

SEQ ID NO: 819867 - RNA, 22 nt, Human
uauuuccagcaguaagaagaca

SEQ ID NO: 819868 - RNA, 22 nt, Human
uaaggccaauuacauauguuca

SEQ ID NO: 819869 - RNA, 22 nt, Human
gaaggccacaagagaaguuaag

SEQ ID NO: 819870 - RNA, 22 nt, Human
gugcuuucugcugcauuccucu

SEQ ID NO: 819871 - RNA, 22 nt, Human
uggcagcucccagagcuuccaa

SEQ ID NO: 819872 - RNA, 22 nt, Human
cuggcuuucucugugguguuca

SEQ ID NO: 819873 - RNA, 22 nt, Human
cagucuucuaaccuagcagccu

SEQ ID NO: 819874 - RNA, 22 nt, Human
augaaggcaguuaaacgucauc

SEQ ID NO: 819875 - RNA, 22 nt, Human
acacaaauuguaggauaauugc

SEQ ID NO: 819876 - RNA, 22 nt, Human
augaggcauuccacucaaacuc

SEQ ID NO: 819877 - RNA, 22 nt, Human
cuucagaaugggacuguguuug

SEQ ID NO: 819878 - RNA, 22 nt, Human
agagcagcacguuguccccaca

SEQ ID NO: 819879 - RNA, 22 nt, Human
ucuggcuuucauuuguuuaaag

SEQ ID NO: 819880 - RNA, 22 nt, Human
uagcuuuccuuguugccugugc

SEQ ID NO: 819881 - RNA, 22 nt, Human
ugaaaugagcauuuauucuuua

SEQ ID NO: 819882 - RNA, 22 nt, Human
cuugcugucuugcauuuagagc

SEQ ID NO: 819883 - RNA, 22 nt, Human
aucugccucuucuucauugcga

SEQ ID NO: 819884 - RNA, 22 nt, Human
aguaccaugcuuccugacuggu

SEQ ID NO: 819885 - RNA, 22 nt, Human
aauuuguuaaaagugagugaca

SEQ ID NO: 819886 - RNA, 22 nt, Human
cuaauacacccuauugcuuguu

SEQ ID NO: 819887 - RNA, 22 nt, Human
caggcagcagccacucugguau

SEQ ID NO: 819888 - RNA, 20 nt, Human
ucucuucuggggagauaaaa

SEQ ID NO: 819889 - RNA, 22 nt, Human
ucuuagaaugucaacugauguu

SEQ ID NO: 819890 - RNA, 22 nt, Human
ccucagggaaugggaggcuggg

SEQ ID NO: 819891 - RNA, 22 nt, Human
acaauacaggcuucuggacuua

SEQ ID NO: 819892 - RNA, 22 nt, Human
aggcaguuguugcugagcagcu

SEQ ID NO: 819893 - RNA, 22 nt, Human
ggagggaaugucuagcauucuu

SEQ ID NO: 819894 - RNA, 22 nt, Human
caggcagcaucagucugcugua

SEQ ID NO: 819895 - RNA, 22 nt, Human
cagaccucaguccucaguagga

SEQ ID NO: 819896 - RNA, 22 nt, Human
gcaccugauugauuucacugcu

SEQ ID NO: 819897 - RNA, 22 nt, Human
auggaaagggaagcaaggaaca

SEQ ID NO: 819898 - RNA, 22 nt, Human
ggacagcucugccaggagcuca

SEQ ID NO: 819899 - RNA, 22 nt, Human
cccaggagguuggggcuacagu

SEQ ID NO: 819900 - RNA, 22 nt, Human
gaggcacuggaggaaaggagaa

SEQ ID NO: 819901 - RNA, 22 nt, Human
cugaacuuauugagugcuugcu

SEQ ID NO: 819902 - RNA, 17 nt, Human
agcugaccagauggacu

SEQ ID NO: 819903 - RNA, 22 nt, Human
gaccuggaggauccucuucuug

SEQ ID NO: 819904 - RNA, 17 nt, Human
uuucaucugggaccacc

SEQ ID NO: 819905 - RNA, 22 nt, Human
cugaggaagacagcagcugugu

SEQ ID NO: 819906 - RNA, 22 nt, Human
agaggaggcagcuuaacucagu

SEQ ID NO: 819907 - RNA, 22 nt, Human
aagauggaguaguguaaugguu

SEQ ID NO: 819908 - RNA, 22 nt, Human
aggcaguggagcuggaauaggc

SEQ ID NO: 819909 - RNA, 18 nt, Human
uugagggaggggcagagu

SEQ ID NO: 819910 - RNA, 22 nt, Human
ccucuucuaggacguccuugug

SEQ ID NO: 819911 - RNA, 22 nt, Human
uggaagggagugacagucagag

SEQ ID NO: 819912 - RNA, 22 nt, Human
ccucaggaaaugaauaaauggc

SEQ ID NO: 819913 - RNA, 22 nt, Human
uuuacaaccucauauucugaug

SEQ ID NO: 819914 - RNA, 22 nt, Human
gacccaggaagcuacuucuggu

SEQ ID NO: 819915 - RNA, 23 nt, Human
cuucucagaagucugugccagga

SEQ ID NO: 819916 - RNA, 22 nt, Human
uccaggagauacacugcaccag

SEQ ID NO: 819917 - RNA, 18 nt, Human
ugcuuggagcauuuacca

SEQ ID NO: 819918 - RNA, 22 nt, Human
acacauuucucuuuuuguaagu

SEQ ID NO: 819919 - RNA, 22 nt, Human
uugaauaggacucagcagugau

SEQ ID NO: 819920 - RNA, 22 nt, Human
gcagaggccaggccaccagcaa

SEQ ID NO: 819921 - RNA, 22 nt, Human
uguggaaaauuggaacguuccu

SEQ ID NO: 819922 - RNA, 22 nt, Human
uuaaauuuuagaaacagacucu

SEQ ID NO: 819923 - RNA, 22 nt, Human
ccacagagcauuagauuucaga

SEQ ID NO: 819924 - RNA, 22 nt, Human
uccaugagacagauacuguaag

SEQ ID NO: 819925 - RNA, 22 nt, Human
aucauuacuccuguaaaauugu

SEQ ID NO: 819926 - RNA, 21 nt, Human
agacaguaacucuucuacucc

SEQ ID NO: 819927 - RNA, 22 nt, Human
caaaugauagagccgauuauca

SEQ ID NO: 819928 - RNA, 22 nt, Human
cugagggugcuauucuugccuu

SEQ ID NO: 819929 - RNA, 20 nt, Human
acaggggcagcacaauaaug

SEQ ID NO: 819930 - RNA, 22 nt, Human
uugcagcuuagugauguuaucu

SEQ ID NO: 819931 - RNA, 22 nt, Human
ugaaagguuaaaaguaguauug

SEQ ID NO: 819932 - RNA, 22 nt, Human
gagagcuggguucaaguagcug

SEQ ID NO: 819933 - RNA, 23 nt, Human
uuugaaaguaucaacucgccuga

SEQ ID NO: 819934 - RNA, 22 nt, Human
agagagggcauagaaaaaggga

SEQ ID NO: 819935 - RNA, 19 nt, Human
ugcugcuguccuugcaggg

SEQ ID NO: 819936 - RNA, 21 nt, Human
uggaggaauaaagcacagaag

SEQ ID NO: 819937 - RNA, 22 nt, Human
gcugccagcuuuccuuggcuga

SEQ ID NO: 819938 - RNA, 22 nt, Human
gaauauuuuuaaagggacuaau

SEQ ID NO: 819939 - RNA, 22 nt, Human
gagaaggaguagcugaccuggg

SEQ ID NO: 819940 - RNA, 21 nt, Human
uaauaauuccacuacagagua

SEQ ID NO: 819941 - RNA, 22 nt, Human
augauauuugcaaugugcuugc

SEQ ID NO: 819942 - RNA, 22 nt, Human
gcucccaggcauggagguaauu

SEQ ID NO: 819943 - RNA, 22 nt, Human
uucaggauuauacucucuuccc

SEQ ID NO: 819944 - RNA, 22 nt, Human
uaaguggaagguuauaugcuaa

SEQ ID NO: 819945 - RNA, 22 nt, Human
ccccaggagauuugggagcaca

SEQ ID NO: 819946 - RNA, 22 nt, Human
ugcauaaagugccauaguauua

SEQ ID NO: 819947 - RNA, 22 nt, Human
caggauggucagaugcauuguc

SEQ ID NO: 819948 - RNA, 22 nt, Human
gcuuugaagucugugucuuuug

SEQ ID NO: 819949 - RNA, 22 nt, Human
uuuauucaucaucuguucauau

SEQ ID NO: 819950 - RNA, 22 nt, Human
gaggaggcuuccgggaggcacg

SEQ ID NO: 819951 - RNA, 20 nt, Human
ucucagcauaagaacccuuc

SEQ ID NO: 819952 - RNA, 22 nt, Human
gagcagcucugggugacccagu

SEQ ID NO: 819953 - RNA, 22 nt, Human
cuuguccccagcagguugguuu

SEQ ID NO: 819954 - RNA, 22 nt, Human
ggcagccuugacuagugacuua

SEQ ID NO: 819955 - RNA, 22 nt, Human
gaucuucuauguaaugaagugu

SEQ ID NO: 819956 - RNA, 22 nt, Human
gcgucugaguugcgggggcuca

SEQ ID NO: 819957 - RNA, 19 nt, Human
caaggccaccauuucuccg

SEQ ID NO: 819958 - RNA, 22 nt, Human
accaggaguagaauaucuguga

SEQ ID NO: 819959 - RNA, 22 nt, Human
guucuucaggccauccucccag

SEQ ID NO: 819960 - RNA, 22 nt, Human
cuacccagauccaggauggcua

SEQ ID NO: 819961 - RNA, 23 nt, Human
uccaggagaauuccagggcccgg

SEQ ID NO: 819962 - RNA, 22 nt, Human
gcagggaagacccggagcagcg

SEQ ID NO: 819963 - RNA, 22 nt, Human
auaguuugugaaacacagcagu

SEQ ID NO: 819964 - RNA, 22 nt, Human
ucugaaaugcaaauuugacuga

SEQ ID NO: 819965 - RNA, 23 nt, Human
cugcugugaaacaugguuuuggu

SEQ ID NO: 819966 - RNA, 22 nt, Human
aaagccaugggucuuuggcaua

SEQ ID NO: 819967 - RNA, 22 nt, Human
gcauugaguccacucugucuuu

SEQ ID NO: 819968 - RNA, 22 nt, Human
acuuucugcaguguuggaaaug

SEQ ID NO: 819969 - RNA, 23 nt, Human
auuucuaggggauuuucuggugc

SEQ ID NO: 819970 - RNA, 22 nt, Human
ggaggaugagcuacgaggagcu

SEQ ID NO: 819971 - RNA, 22 nt, Human
uucuucuuucccccugugguac

SEQ ID NO: 819972 - RNA, 22 nt, Human
agucccuguacuuuccacugcc

SEQ ID NO: 819973 - RNA, 22 nt, Human
ucuuugaauuucugacugucuu

SEQ ID NO: 819974 - RNA, 22 nt, Human
uuuuagauaguuuaacugcacu

SEQ ID NO: 819975 - RNA, 22 nt, Human
ucacacagauugguagagcuga

SEQ ID NO: 819976 - RNA, 22 nt, Human
gccauuuucugucuuguuuauu

SEQ ID NO: 819977 - RNA, 22 nt, Human
caggcagccuucucgucucaca

SEQ ID NO: 819978 - RNA, 19 nt, Human
ggcaggcuggauagagagg

SEQ ID NO: 819979 - RNA, 22 nt, Human
aggcugcugaggccaccacgcu

SEQ ID NO: 819980 - RNA, 22 nt, Human
ucucacuggguauaaaugagua

SEQ ID NO: 819981 - RNA, 22 nt, Human
uuugaaaggguuaugagacuga

SEQ ID NO: 819982 - RNA, 22 nt, Human
ggccagcucuuguccacggagg

SEQ ID NO: 819983 - RNA, 22 nt, Human
gggcagcucuggcugugggaag

SEQ ID NO: 819984 - RNA, 22 nt, Human
aguuauuacucuuuaacauauu

SEQ ID NO: 819985 - RNA, 22 nt, Human
gucagagagggcacgugcacac

SEQ ID NO: 819986 - RNA, 17 nt, Human
ucaggauguagcaguag

SEQ ID NO: 819987 - RNA, 18 nt, Human
agcuucccucugagaggg

SEQ ID NO: 819988 - RNA, 22 nt, Human
ucugagaggcaucugcacuucu

SEQ ID NO: 819989 - RNA, 22 nt, Human
uuuuagcacuaagugauaugcu

SEQ ID NO: 819990 - RNA, 22 nt, Human
agaguucugcucuucucaguga

SEQ ID NO: 819991 - RNA, 23 nt, Human
aaacugcuuccaauuccugccau

SEQ ID NO: 819992 - RNA, 22 nt, Human
uccaggagugugugcuaauggg

SEQ ID NO: 819993 - RNA, 21 nt, Human
cucaaagaccaaaaguguaga

SEQ ID NO: 819994 - RNA, 22 nt, Human
cagcagaggcacgucugugaau

SEQ ID NO: 819995 - RNA, 22 nt, Human
uuuuaucuaccuaugcucauuu

SEQ ID NO: 819996 - RNA, 22 nt, Human
ccuugcauauauuauaucuuug

SEQ ID NO: 819997 - RNA, 22 nt, Human
uccaggaggaggaaggcugcca

SEQ ID NO: 819998 - RNA, 22 nt, Human
aggcaguggaugucaggaaugg

SEQ ID NO: 819999 - RNA, 22 nt, Human
uagcucuucauuucaucugauu

SEQ ID NO: 820000 - RNA, 22 nt, Human
agugcuuuauguuguugugcaa

SEQ ID NO: 820001 - RNA, 22 nt, Human
cagcuggccccacaguagaggc

SEQ ID NO: 820002 - RNA, 21 nt, Human
agggagcuuuagguagaaguu

SEQ ID NO: 820003 - RNA, 22 nt, Human
auauauuugagaauauucauga

SEQ ID NO: 820004 - RNA, 22 nt, Human
agaggaugguugaggaagaccu

SEQ ID NO: 820005 - RNA, 22 nt, Human
uggcagcuuuuuguuucaggcu

SEQ ID NO: 820006 - RNA, 22 nt, Human
augauguuauuuucagaaacau

SEQ ID NO: 820007 - RNA, 22 nt, Human
caguuucuacgaaggucaaccc

SEQ ID NO: 820008 - RNA, 20 nt, Human
uucaggauucuagaccacac

SEQ ID NO: 820009 - RNA, 22 nt, Human
agcgagggaggucugaggacag

SEQ ID NO: 820010 - RNA, 22 nt, Human
ucugggaaaugcuguuccuugu

SEQ ID NO: 820011 - RNA, 22 nt, Human
ccuucauugcaucuuuaagaga

SEQ ID NO: 820012 - RNA, 22 nt, Human
cauucauuuaugaaauaucuau

SEQ ID NO: 820013 - RNA, 22 nt, Human
uggcagcugucuguggggucuc

SEQ ID NO: 820014 - RNA, 22 nt, Human
uuacaagauaaccugaugcugu

SEQ ID NO: 820015 - RNA, 22 nt, Human
gaaauuauugcuagagacugca

SEQ ID NO: 820016 - RNA, 22 nt, Human
ucacugcucuccaauguggagu

SEQ ID NO: 820017 - RNA, 23 nt, Human
uggaggaaacacaucagaagacc

SEQ ID NO: 820018 - RNA, 19 nt, Human
uucauucuuucuacuuacc

SEQ ID NO: 820019 - RNA, 22 nt, Human
aggaugagaagauuggaaucuu

SEQ ID NO: 820020 - RNA, 21 nt, Human
cccaggaggagcuccggcucc

SEQ ID NO: 820021 - RNA, 22 nt, Human
aguucucagcuuaguaugcugu

SEQ ID NO: 820022 - RNA, 22 nt, Human
gaggcagcuggguccggucggg

SEQ ID NO: 820023 - RNA, 22 nt, Human
ucucagucagccuugauguccc

SEQ ID NO: 820024 - RNA, 22 nt, Human
gaggcaguuugccaugccagga

SEQ ID NO: 820025 - RNA, 22 nt, Human
agaaguuguagguuugcauauu

SEQ ID NO: 820026 - RNA, 22 nt, Human
cuucuucaaccugaaaguuuca

SEQ ID NO: 820027 - RNA, 22 nt, Human
ccucugcucugguccaugugcu

SEQ ID NO: 820028 - RNA, 22 nt, Human
gcagcugcagagaccggguggg

SEQ ID NO: 820029 - RNA, 22 nt, Human
auccaugaagguacuucucagg

SEQ ID NO: 820030 - RNA, 22 nt, Human
uucucagauauuuacugagcau

SEQ ID NO: 820031 - RNA, 22 nt, Human
ugugaaagcaagucuaguucuc

SEQ ID NO: 820032 - RNA, 22 nt, Human
ggucagagggugggcugccugu

SEQ ID NO: 820033 - RNA, 22 nt, Human
ggccagagaauaugccuuacgu

SEQ ID NO: 820034 - RNA, 22 nt, Human
ucuacagacagagcagguggga

SEQ ID NO: 820035 - RNA, 22 nt, Human
gucaggauuuuaaaaucccagu

SEQ ID NO: 820036 - RNA, 22 nt, Human
ucuucagaggaagucagucuuu

SEQ ID NO: 820037 - RNA, 22 nt, Human
uccaggagaaaacugacggugg

SEQ ID NO: 820038 - RNA, 22 nt, Human
auauuguugacuauaagaguaa

SEQ ID NO: 820039 - RNA, 18 nt, Human
aggcaggugcuggaaguc

SEQ ID NO: 820040 - RNA, 22 nt, Human
ucuucucucauguaggagggaa

SEQ ID NO: 820041 - RNA, 22 nt, Human
ucuuucaaugagcauucuuucc

SEQ ID NO: 820042 - RNA, 22 nt, Human
aggcaagcccccagugaggcuc

SEQ ID NO: 820043 - RNA, 22 nt, Human
ggcagcaucucuggcagcagcu

SEQ ID NO: 820044 - RNA, 21 nt, Human
aucacauuggcuguuauuauu

SEQ ID NO: 820045 - RNA, 22 nt, Human
cagugguugguagauacuugag

SEQ ID NO: 820046 - RNA, 22 nt, Human
gaggagcugggcugagaggguc

SEQ ID NO: 820047 - RNA, 22 nt, Human
ucuuccucuagaucugaggccc

SEQ ID NO: 820048 - RNA, 22 nt, Human
cagcuccucacgagucuugaaa

SEQ ID NO: 820049 - RNA, 20 nt, Human
caucaucacaugagccaauu

SEQ ID NO: 820050 - RNA, 22 nt, Human
cccaguuucaacuuuccagugg

SEQ ID NO: 820051 - RNA, 22 nt, Human
guuuuauaggcuguugcuauau

SEQ ID NO: 820052 - RNA, 22 nt, Human
uggaaggaaagguagcagagaa

SEQ ID NO: 820053 - RNA, 22 nt, Human
cccaggaguuggaggcuacggu

SEQ ID NO: 820054 - RNA, 22 nt, Human
uucuucaaugugcccuguuuuc

SEQ ID NO: 820055 - RNA, 22 nt, Human
ugaguuuugucuugcuagaagu

SEQ ID NO: 820056 - RNA, 22 nt, Human
ggcuuggaaaugguaaugagcu

SEQ ID NO: 820057 - RNA, 22 nt, Human
cccuugcacauuugucuuuaau

SEQ ID NO: 820058 - RNA, 22 nt, Human
aguaaaucagaccucauuaugu

SEQ ID NO: 820059 - RNA, 22 nt, Human
cagggagggacaauugucaccu

SEQ ID NO: 820060 - RNA, 22 nt, Human
gaggcaacacauuuggaaagca

SEQ ID NO: 820061 - RNA, 22 nt, Human
agcccaggagguggagguugca

SEQ ID NO: 820062 - RNA, 22 nt, Human
guaggcagucucucaggugauc

SEQ ID NO: 820063 - RNA, 20 nt, Human
ggcaggcuuuauauggaggg

SEQ ID NO: 820064 - RNA, 22 nt, Human
cuucagaagccugcagccuuug

SEQ ID NO: 820065 - RNA, 22 nt, Human
acuggcagcagcagcccuuggg

SEQ ID NO: 820066 - RNA, 20 nt, Human
uuucuugucggcuguugcug

SEQ ID NO: 820067 - RNA, 22 nt, Human
uuuagaaguucacacauuuaaa

SEQ ID NO: 820068 - RNA, 22 nt, Human
gagcaccucaauuugcuauuug

SEQ ID NO: 820069 - RNA, 22 nt, Human
ucccaggaauccguccucuaga

SEQ ID NO: 820070 - RNA, 22 nt, Human
uggcagcuugaaugcagucuuu

SEQ ID NO: 820071 - RNA, 22 nt, Human
ugaggcagcaauugauuauuca

SEQ ID NO: 820072 - RNA, 22 nt, Human
uuacuuugcuuucucauuacag

SEQ ID NO: 820073 - RNA, 22 nt, Human
cugcugagaaaagacugaggga

SEQ ID NO: 820074 - RNA, 22 nt, Human
aggccagcacgacagccgcagg

SEQ ID NO: 820075 - RNA, 22 nt, Human
cucaacagcucugccauacucc

SEQ ID NO: 820076 - RNA, 22 nt, Human
cugucauuuaagacauucugga

SEQ ID NO: 820077 - RNA, 22 nt, Human
ucuacugcacuggugucucauc

SEQ ID NO: 820078 - RNA, 22 nt, Human
aucaggauagucuguaaauugu

SEQ ID NO: 820079 - RNA, 22 nt, Human
cuccacagcucaggcucagagu

SEQ ID NO: 820080 - RNA, 20 nt, Human
uccaggagaacugggagccg

SEQ ID NO: 820081 - RNA, 22 nt, Human
ccugcucagagcgucuugugug

SEQ ID NO: 820082 - RNA, 22 nt, Human
gucaggauuuacaaacuucagu

SEQ ID NO: 820083 - RNA, 22 nt, Human
acagaaauugggcaaauggaag

SEQ ID NO: 820084 - RNA, 22 nt, Human
cccaggaaaugggcucuugccu

SEQ ID NO: 820085 - RNA, 22 nt, Human
uggcagcuagauaguguguuua

SEQ ID NO: 820086 - RNA, 22 nt, Human
gcccaggaaagauagggccuca

SEQ ID NO: 820087 - RNA, 22 nt, Human
cacaaugugguuugucaucuuu

SEQ ID NO: 820088 - RNA, 22 nt, Human
aggcaggccccugagaauagac

SEQ ID NO: 820089 - RNA, 22 nt, Human
cccaggaaugaggggcggaggc

SEQ ID NO: 820090 - RNA, 22 nt, Human
gaauacaugauacaugaacugc

SEQ ID NO: 820091 - RNA, 22 nt, Human
auguucuuccaaaucuguaaca

SEQ ID NO: 820092 - RNA, 22 nt, Human
ucucgacagccuggcacagugg

SEQ ID NO: 820093 - RNA, 22 nt, Human
guucuugccagcauccucaggu

SEQ ID NO: 820094 - RNA, 22 nt, Human
gcaucuaauccaguccagcauc

SEQ ID NO: 820095 - RNA, 22 nt, Human
agacgagggcccccaggacagc

SEQ ID NO: 820096 - RNA, 22 nt, Human
uggagcugggguuugaaucugg

SEQ ID NO: 820097 - RNA, 22 nt, Human
gagaggcaggcgcugcaauggu

SEQ ID NO: 820098 - RNA, 22 nt, Human
guugaaugaaucauucuaugua

SEQ ID NO: 820099 - RNA, 22 nt, Human
gaggcaguguuuacugcccugu

SEQ ID NO: 820100 - RNA, 22 nt, Human
aggguaggaacugaguggaagg

SEQ ID NO: 820101 - RNA, 22 nt, Human
aggacagcagugcuggcacuug

SEQ ID NO: 820102 - RNA, 22 nt, Human
cuaaucaucuuucucuuaaagc

SEQ ID NO: 820103 - RNA, 22 nt, Human
uacuuccuguuuccaugucugu

SEQ ID NO: 820104 - RNA, 22 nt, Human
uuuuauagcugaauaguauucc

SEQ ID NO: 820105 - RNA, 22 nt, Human
cccaggaggcagagguuggagc

SEQ ID NO: 820106 - RNA, 22 nt, Human
uggcagagcaaaaagauagaau

SEQ ID NO: 820107 - RNA, 22 nt, Human
agaggcggagguugcagugagc

SEQ ID NO: 820108 - RNA, 22 nt, Human
ucugcaucauuuuucagagccg

SEQ ID NO: 820109 - RNA, 22 nt, Human
cggcagcucgagggccacccgu

SEQ ID NO: 820110 - RNA, 22 nt, Human
ucauuuaauagcuuuugucuuu

SEQ ID NO: 820111 - RNA, 22 nt, Human
gccacaggcacuuaagggcugg

SEQ ID NO: 820112 - RNA, 22 nt, Human
acucaggagggaucagcuauca

SEQ ID NO: 820113 - RNA, 22 nt, Human
gucuccugagacugcagucacc

SEQ ID NO: 820114 - RNA, 22 nt, Human
acagugcuggcuacaacccugg

SEQ ID NO: 820115 - RNA, 22 nt, Human
auuuaaauuuucugauggagag

SEQ ID NO: 820116 - RNA, 22 nt, Human
ggagcugugcagugacuacaga

SEQ ID NO: 820117 - RNA, 22 nt, Human
aauaucaguauauuguaucagu

SEQ ID NO: 820118 - RNA, 23 nt, Human
accaggaguugucucaggaaaca

SEQ ID NO: 820119 - RNA, 21 nt, Human
uugaaaguaaauucagcagcu

SEQ ID NO: 820120 - RNA, 22 nt, Human
uuugacauugccaauuugcuca

SEQ ID NO: 820121 - RNA, 21 nt, Human
auugaaagucaacaaucaguu

SEQ ID NO: 820122 - RNA, 22 nt, Human
uuugcaguuucauugcugaaau

SEQ ID NO: 820123 - RNA, 22 nt, Human
uagauuuuacuucugucauuac

SEQ ID NO: 820124 - RNA, 22 nt, Human
cccaggaaguggagguugcagu

SEQ ID NO: 820125 - RNA, 22 nt, Human
auuugcuugugcuaugaaaguu

SEQ ID NO: 820126 - RNA, 22 nt, Human
ucuuugcaaauguuauuaucuu

SEQ ID NO: 820127 - RNA, 22 nt, Human
ugaggcaguauuuuagugacuu

SEQ ID NO: 820128 - RNA, 22 nt, Human
uucaggauaugugauaucugaa

SEQ ID NO: 820129 - RNA, 22 nt, Human
agcaccugccugcauuggcuau

SEQ ID NO: 820130 - RNA, 22 nt, Human
aaauugcauuuuaaagguagau

SEQ ID NO: 820131 - RNA, 22 nt, Human
aagcagcuggaagaguaagaug

SEQ ID NO: 820132 - RNA, 22 nt, Human
ucaggagaaggcaauguggaaa

SEQ ID NO: 820133 - RNA, 22 nt, Human
gaggccaaguuggagaccaggu

SEQ ID NO: 820134 - RNA, 21 nt, Human
uacagaaugcgcuucagucug

SEQ ID NO: 820135 - RNA, 22 nt, Human
agcugaugccauguggaacagu

SEQ ID NO: 820136 - RNA, 22 nt, Human
cagaggcagugggguugcuccu

SEQ ID NO: 820137 - RNA, 22 nt, Human
agcugcccagauaggaggaggc

SEQ ID NO: 820138 - RNA, 19 nt, Human
ugaguucugugguucucaa

SEQ ID NO: 820139 - RNA, 18 nt, Human
agggaguuuuagggaagg

SEQ ID NO: 820140 - RNA, 19 nt, Human
ucucugcuucucuuggcau

SEQ ID NO: 820141 - RNA, 22 nt, Human
ugcugaugaguccuucuaucgc

SEQ ID NO: 820142 - RNA, 22 nt, Human
gaucuguuauaaucucuuuuau

SEQ ID NO: 820143 - RNA, 22 nt, Human
ucuucccuaaucaccaucuuca

SEQ ID NO: 820144 - RNA, 23 nt, Human
agcacacuuguacaaugcccuag

SEQ ID NO: 820145 - RNA, 22 nt, Human
ugaguaauaaacugucuugcuc

SEQ ID NO: 820146 - RNA, 22 nt, Human
gccaggaguucagaugcauguu

SEQ ID NO: 820147 - RNA, 22 nt, Human
uggaaauggaucugaugagucu

SEQ ID NO: 820148 - RNA, 22 nt, Human
cccaggauggggcugcaguuau

SEQ ID NO: 820149 - RNA, 19 nt, Human
agauggcaaaaugcaaaga

SEQ ID NO: 820150 - RNA, 22 nt, Human
aguuuucacacucaccaaaagg

SEQ ID NO: 820151 - RNA, 22 nt, Human
guucuucagcauuagaagucau

SEQ ID NO: 820152 - RNA, 22 nt, Human
caggauggucucgaucuccuga

SEQ ID NO: 820153 - RNA, 22 nt, Human
aaauuaguacauugcaaagucc

SEQ ID NO: 820154 - RNA, 22 nt, Human
cugcugugcacccaggaaggcu

SEQ ID NO: 820155 - RNA, 20 nt, Human
agggcagcuugaggagccgg

SEQ ID NO: 820156 - RNA, 22 nt, Human
acaguggagaaggcaugaggcu

SEQ ID NO: 820157 - RNA, 22 nt, Human
uaucuguuccaggcacucagcu

SEQ ID NO: 820158 - RNA, 22 nt, Human
aggccagcaagaaagagagucu

SEQ ID NO: 820159 - RNA, 21 nt, Human
uuucuuaggcucuaaaaugac

SEQ ID NO: 820160 - RNA, 23 nt, Human
cccuggaguaaauucuuggaagg

SEQ ID NO: 820161 - RNA, 19 nt, Human
caggagagcaugcacuuug

SEQ ID NO: 820162 - RNA, 22 nt, Human
cuuugcaaacugucacacuuuc

SEQ ID NO: 820163 - RNA, 22 nt, Human
cccaggaggcagagauagcagu

SEQ ID NO: 820164 - RNA, 22 nt, Human
gagguagccacagauagagacu

SEQ ID NO: 820165 - RNA, 22 nt, Human
uucagcaaauggacuguucagg

SEQ ID NO: 820166 - RNA, 22 nt, Human
gagaggggcccaagccacauag

SEQ ID NO: 820167 - RNA, 22 nt, Human
uuugacaucuaagaauucuuac

SEQ ID NO: 820168 - RNA, 22 nt, Human
ucccaggaucugagggcagaga

SEQ ID NO: 820169 - RNA, 22 nt, Human
ccucuucuagguuucagccugc

SEQ ID NO: 820170 - RNA, 22 nt, Human
ugaggcaggaaguuauauaaug

SEQ ID NO: 820171 - RNA, 22 nt, Human
aaggcagccagauccuuugggu

SEQ ID NO: 820172 - RNA, 22 nt, Human
agaggccaugcuagaggccugg

SEQ ID NO: 820173 - RNA, 22 nt, Human
cccaaggaagacgcuugugaua

SEQ ID NO: 820174 - RNA, 22 nt, Human
cauuuccacuucugaaaacugg

SEQ ID NO: 820175 - RNA, 22 nt, Human
ucucaguguguuuucucucaga

SEQ ID NO: 820176 - RNA, 22 nt, Human
cccaggaggcagaaguugcagu

SEQ ID NO: 820177 - RNA, 22 nt, Human
gagaggugaaggcugcccuggg

SEQ ID NO: 820178 - RNA, 22 nt, Human
caaauaguuuuucauguauuau

SEQ ID NO: 820179 - RNA, 20 nt, Human
auaaaauaacugccacaaga

SEQ ID NO: 820180 - RNA, 22 nt, Human
ugccaggauauaagagugcgau

SEQ ID NO: 820181 - RNA, 22 nt, Human
ccucagaugucuuaaggcacug

SEQ ID NO: 820182 - RNA, 22 nt, Human
augugaggcagcacggagauua

SEQ ID NO: 820183 - RNA, 22 nt, Human
cagcugccuucugcgggaaguc

SEQ ID NO: 820184 - RNA, 22 nt, Human
agucucugccagcuuguccucu

SEQ ID NO: 820185 - RNA, 22 nt, Human
ugaaggccuaacuuccagugcu

SEQ ID NO: 820186 - RNA, 22 nt, Human
uggagacugugcuaagggaguu

SEQ ID NO: 820187 - RNA, 23 nt, Human
aggucagcaggcaaggaaauggc

SEQ ID NO: 820188 - RNA, 22 nt, Human
uucuuucucaacaugaauguuu

SEQ ID NO: 820189 - RNA, 19 nt, Human
ucccaggaagcaaauguca

SEQ ID NO: 820190 - RNA, 22 nt, Human
ucacaaauagcuauauuaagga

SEQ ID NO: 820191 - RNA, 22 nt, Human
aguuugaaauguuggcaauauu

SEQ ID NO: 820192 - RNA, 22 nt, Human
aggaaacuccccuacaucucaa

SEQ ID NO: 820193 - RNA, 22 nt, Human
gcagaggauagcauaugaaccu

SEQ ID NO: 820194 - RNA, 22 nt, Human
aaggcagucugguuucaaagca

SEQ ID NO: 820195 - RNA, 22 nt, Human
ucagccucucugaguccagacc

SEQ ID NO: 820196 - RNA, 22 nt, Human
ugaaaugaaacagaacauauca

SEQ ID NO: 820197 - RNA, 22 nt, Human
gcccaggaagugacucagaugu

SEQ ID NO: 820198 - RNA, 22 nt, Human
uuaacauuguccuuagcagauu

SEQ ID NO: 820199 - RNA, 22 nt, Human
aucaggauguuuggcugucaua

SEQ ID NO: 820200 - RNA, 22 nt, Human
uggcagcugagugcacccccuc

SEQ ID NO: 820201 - RNA, 22 nt, Human
ugcuugaaagggguuucccagu

SEQ ID NO: 820202 - RNA, 22 nt, Human
aggaagcuccaugaaggcagag

SEQ ID NO: 820203 - RNA, 23 nt, Human
cccaggaguuucacugcaaaggu

SEQ ID NO: 820204 - RNA, 22 nt, Human
ucucucagaggaagaggcagug

SEQ ID NO: 820205 - RNA, 22 nt, Human
ggacuucuaagugccagacacu

SEQ ID NO: 820206 - RNA, 23 nt, Human
ucagucuucccugucaguaauag

SEQ ID NO: 820207 - RNA, 22 nt, Human
gggcagcugccaagugcaucgc

SEQ ID NO: 820208 - RNA, 22 nt, Human
accgaaggaaacuggaaccguu

SEQ ID NO: 820209 - RNA, 22 nt, Human
uguccauggauagagcugcucg

SEQ ID NO: 820210 - RNA, 22 nt, Human
uccuuagagauacugucuugaa

SEQ ID NO: 820211 - RNA, 22 nt, Human
ccagugcuaagguagccucugc

SEQ ID NO: 820212 - RNA, 22 nt, Human
uuuggaauuggaaagugcugug

SEQ ID NO: 820213 - RNA, 22 nt, Human
gcccaggaugguguguaguggu

SEQ ID NO: 820214 - RNA, 22 nt, Human
uacuuucuguccuucuguuaaa

SEQ ID NO: 820215 - RNA, 22 nt, Human
ucugggaaguccucugucaugc

SEQ ID NO: 820216 - RNA, 22 nt, Human
aaaacuaaauacgcuuugccuc

SEQ ID NO: 820217 - RNA, 19 nt, Human
uugaaagauuagcuuucua

SEQ ID NO: 820218 - RNA, 22 nt, Human
aaggagagagcuuugcuggaac

SEQ ID NO: 820219 - RNA, 22 nt, Human
uccauuuuagagaugaagaaac

SEQ ID NO: 820220 - RNA, 22 nt, Human
ugaaggccagggauuugcagcc

SEQ ID NO: 820221 - RNA, 22 nt, Human
uucaucaauguguuuaauaaug

SEQ ID NO: 820222 - RNA, 22 nt, Human
acagcagcuugcgugucugguc

SEQ ID NO: 820223 - RNA, 22 nt, Human
cuccccagguucaggagguggg

SEQ ID NO: 820224 - RNA, 22 nt, Human
gaaauauugggacucagagcuu

SEQ ID NO: 820225 - RNA, 22 nt, Human
aucauucuaguccuuauggucu

SEQ ID NO: 820226 - RNA, 22 nt, Human
gcaggaagcauagaagaaugcc

SEQ ID NO: 820227 - RNA, 22 nt, Human
aguuggagugaacaugagauug

SEQ ID NO: 820228 - RNA, 20 nt, Human
agcaagaguaaggacagcga

SEQ ID NO: 820229 - RNA, 22 nt, Human
uuccaagagcuuuaauuguuga

SEQ ID NO: 820230 - RNA, 22 nt, Human
ggugguggagccagcugggagu

SEQ ID NO: 820231 - RNA, 22 nt, Human
acaaauguggacauggauaaug

SEQ ID NO: 820232 - RNA, 22 nt, Human
gagggagucugugcaaagaauu

SEQ ID NO: 820233 - RNA, 22 nt, Human
ucugcuguucauucuuuuagcu

SEQ ID NO: 820234 - RNA, 22 nt, Human
aggugagggugccagugcaugg

SEQ ID NO: 820235 - RNA, 22 nt, Human
aggacagcccuugagagcacau

SEQ ID NO: 820236 - RNA, 22 nt, Human
aaagcagacugauuugcaucac

SEQ ID NO: 820237 - RNA, 22 nt, Human
gaggcaguuccugagugacaag

SEQ ID NO: 820238 - RNA, 22 nt, Human
auucuucagaauaucuggcacu

SEQ ID NO: 820239 - RNA, 22 nt, Human
uugcugaaguuaaugcuugcaa

SEQ ID NO: 820240 - RNA, 21 nt, Human
augucaaaugcuuuauuuuau

SEQ ID NO: 820241 - RNA, 22 nt, Human
cuuuccaagaaugcagauaccu

SEQ ID NO: 820242 - RNA, 21 nt, Human
uggagacucugguucuuugug

SEQ ID NO: 820243 - RNA, 22 nt, Human
cccuggagguggagguugcagg

SEQ ID NO: 820244 - RNA, 22 nt, Human
cacaaaugguuguagacauuaa

SEQ ID NO: 820245 - RNA, 22 nt, Human
cccauucauccucgcuuccuuc

SEQ ID NO: 820246 - RNA, 22 nt, Human
gaagcacauggcuauagcuauu

SEQ ID NO: 820247 - RNA, 22 nt, Human
cugucauugagccugucagggc

SEQ ID NO: 820248 - RNA, 22 nt, Human
cccaggcagugugugcaugcgu

SEQ ID NO: 820249 - RNA, 22 nt, Human
uucacagaugccugaugugugg

SEQ ID NO: 820250 - RNA, 22 nt, Human
agccagcuguucuggggcagca

SEQ ID NO: 820251 - RNA, 22 nt, Human
uuuccauguuggugaaaugagg

SEQ ID NO: 820252 - RNA, 22 nt, Human
uuugaaaggagcuuuauccaga

SEQ ID NO: 820253 - RNA, 22 nt, Human
aggagagggguaggauuaauuu

SEQ ID NO: 820254 - RNA, 22 nt, Human
auguuucaccaguuuuauaaga

SEQ ID NO: 820255 - RNA, 22 nt, Human
uccuucuuucccccuagucauu

SEQ ID NO: 820256 - RNA, 22 nt, Human
gccaggagaaugcuagcagagg

SEQ ID NO: 820257 - RNA, 22 nt, Human
gaggaggcacuugagcagaugu

SEQ ID NO: 820258 - RNA, 22 nt, Human
uugaaaguagcagcugcauaug

SEQ ID NO: 820259 - RNA, 22 nt, Human
caggcaggucagugaagaagga

SEQ ID NO: 820260 - RNA, 22 nt, Human
auacuguuuugugacuuaucuu

SEQ ID NO: 820261 - RNA, 19 nt, Human
uucacaauuaugaaauuag

SEQ ID NO: 820262 - RNA, 22 nt, Human
guucucucugcuuccaagaugg

SEQ ID NO: 820263 - RNA, 22 nt, Human
uuuucaguuccaucucugcucu

SEQ ID NO: 820264 - RNA, 23 nt, Human
ucuugaaaagccuacagcaguuc

SEQ ID NO: 820265 - RNA, 22 nt, Human
uacucagagucauugcccuucu

SEQ ID NO: 820266 - RNA, 22 nt, Human
ugaaggccagcucuuuaucagc

SEQ ID NO: 820267 - RNA, 22 nt, Human
cugcagagcaaguaacauccuc

SEQ ID NO: 820268 - RNA, 18 nt, Human
ggcagggaaaagauaggg

SEQ ID NO: 820269 - RNA, 22 nt, Human
uggagagguuuaaacaaaaguu

SEQ ID NO: 820270 - RNA, 22 nt, Human
cagcaggauaugguggagagag

SEQ ID NO: 820271 - RNA, 22 nt, Human
uauguuauuuucauacaacaga

SEQ ID NO: 820272 - RNA, 22 nt, Human
cuggcagucugccucuucacug

SEQ ID NO: 820273 - RNA, 22 nt, Human
gggcagcucugcccaucagagg

SEQ ID NO: 820274 - RNA, 23 nt, Human
acuauaaaguuguucugauuuac

SEQ ID NO: 820275 - RNA, 22 nt, Human
aaagcagagguugcagugagcu

SEQ ID NO: 820276 - RNA, 17 nt, Human
caaggccagcaucuuca

SEQ ID NO: 820277 - RNA, 22 nt, Human
acccaggauaaucuguguaucu

SEQ ID NO: 820278 - RNA, 22 nt, Human
cugccaggcagcagagggagaa

SEQ ID NO: 820279 - RNA, 22 nt, Human
uauuuccaagcugaauccaaug

SEQ ID NO: 820280 - RNA, 22 nt, Human
uucuucaguguagcaacuguau

SEQ ID NO: 820281 - RNA, 22 nt, Human
agucugucugucacuucugcag

SEQ ID NO: 820282 - RNA, 22 nt, Human
ccuggagaccagaggauacuuc

SEQ ID NO: 820283 - RNA, 22 nt, Human
accaggagucuagccuagucaa

SEQ ID NO: 820284 - RNA, 22 nt, Human
gggagacacgcugcaggcauaa

SEQ ID NO: 820285 - RNA, 22 nt, Human
ccccaggagcuuguuuuagaga

SEQ ID NO: 820286 - RNA, 22 nt, Human
acuucuucuucagcugggggau

SEQ ID NO: 820287 - RNA, 22 nt, Human
gagagguccauuccccugucag

SEQ ID NO: 820288 - RNA, 22 nt, Human
caggcagcuagauuuauaacaa

SEQ ID NO: 820289 - RNA, 22 nt, Human
cagugucuccagaugcuccaau

SEQ ID NO: 820290 - RNA, 22 nt, Human
ggaggagggguuuacauuggaa

SEQ ID NO: 820291 - RNA, 22 nt, Human
ucugggaagcugguccuguucu

SEQ ID NO: 820292 - RNA, 22 nt, Human
uuugaauagaggccccucagaa

SEQ ID NO: 820293 - RNA, 22 nt, Human
cuuaaauuuucaucuacaagaa

SEQ ID NO: 820294 - RNA, 22 nt, Human
gucaggaucucccaguacauau

SEQ ID NO: 820295 - RNA, 22 nt, Human
cugggaaauggcuucgagcuca

SEQ ID NO: 820296 - RNA, 22 nt, Human
agcuucccaagguuggaagguu

SEQ ID NO: 820297 - RNA, 22 nt, Human
uggucuuuaagguagcugucau

SEQ ID NO: 820298 - RNA, 22 nt, Human
cuacccaggcuuagagggcugg

SEQ ID NO: 820299 - RNA, 22 nt, Human
uugcaggaaacugagugugagc

SEQ ID NO: 820300 - RNA, 22 nt, Human
uagugcuuuaaguuuacagaga

SEQ ID NO: 820301 - RNA, 22 nt, Human
gaagcagcugccagagaugucu

SEQ ID NO: 820302 - RNA, 22 nt, Human
uaauuauuaugacaacaauugc

SEQ ID NO: 820303 - RNA, 22 nt, Human
auaguuugaaggcuguucuacu

SEQ ID NO: 820304 - RNA, 22 nt, Human
uugcuucaguagcucuuuaaag

SEQ ID NO: 820305 - RNA, 22 nt, Human
accauccugaaaccuucaugcu

SEQ ID NO: 820306 - RNA, 22 nt, Human
uuuggaauauuaaaaugucuca

SEQ ID NO: 820307 - RNA, 22 nt, Human
ucuaaccuuugaaacugcuuuc

SEQ ID NO: 820308 - RNA, 22 nt, Human
gcauguguggaggagaugugcu

SEQ ID NO: 820309 - RNA, 22 nt, Human
ccaggaaauagugcugugaucu

SEQ ID NO: 820310 - RNA, 22 nt, Human
aauauaauuuuauuccuagagu

SEQ ID NO: 820311 - RNA, 22 nt, Human
gcucaggagcucuugguggcgc

SEQ ID NO: 820312 - RNA, 18 nt, Human
gcagcuagccaggggggc

SEQ ID NO: 820313 - RNA, 22 nt, Human
ggauggcauguugggcucuguu

SEQ ID NO: 820314 - RNA, 22 nt, Human
ucuuagcauuucauaacaacug

SEQ ID NO: 820315 - RNA, 22 nt, Human
cccaggagguguagcugcgugg

SEQ ID NO: 820316 - RNA, 22 nt, Human
uucuccagagggcucugcagga

SEQ ID NO: 820317 - RNA, 20 nt, Human
aucuucuuggccagcuugcu

SEQ ID NO: 820318 - RNA, 22 nt, Human
uucucagaugauucagauaaac

SEQ ID NO: 820319 - RNA, 22 nt, Human
aaagcagauucugaugcaguag

SEQ ID NO: 820320 - RNA, 22 nt, Human
auugaaagauuuugggcucaug

SEQ ID NO: 820321 - RNA, 21 nt, Human
ucugagagcaacugcccuuua

SEQ ID NO: 820322 - RNA, 22 nt, Human
caguucuuauuuggccaguguc

SEQ ID NO: 820323 - RNA, 21 nt, Human
aaauacagaaacuuguuuuca

SEQ ID NO: 820324 - RNA, 22 nt, Human
aucuugcauuugcuaaaaugca

SEQ ID NO: 820325 - RNA, 22 nt, Human
uagggcaggugaagaaaagcua

SEQ ID NO: 820326 - RNA, 22 nt, Human
acucaggaauggggcugggacu

SEQ ID NO: 820327 - RNA, 23 nt, Human
gggcagcuuaagcuuguuuuucu

SEQ ID NO: 820328 - RNA, 22 nt, Human
uucucacuauguauguagauug

SEQ ID NO: 820329 - RNA, 22 nt, Human
uuucaguuguccuguuaauagc

SEQ ID NO: 820330 - RNA, 22 nt, Human
cccaggaaaagcagugccagca

SEQ ID NO: 820331 - RNA, 22 nt, Human
gaggucaggggagaggcugaug

SEQ ID NO: 820332 - RNA, 22 nt, Human
ucaguucugcuagaaaaacagu

SEQ ID NO: 820333 - RNA, 22 nt, Human
uuccagcaggcagacaggagau

SEQ ID NO: 820334 - RNA, 22 nt, Human
cagcuguggcugccacugcucc

SEQ ID NO: 820335 - RNA, 22 nt, Human
auucuuauuauaguaaaacagu

SEQ ID NO: 820336 - RNA, 19 nt, Human
uucuccaggcugcagaggg

SEQ ID NO: 820337 - RNA, 22 nt, Human
agcugcccagcuaggaagaagg

SEQ ID NO: 820338 - RNA, 22 nt, Human
uccaggagcauccaggugaagc

SEQ ID NO: 820339 - RNA, 22 nt, Human
uucucagagcacugcugacaaa

SEQ ID NO: 820340 - RNA, 22 nt, Human
acauuucuaguuguucaucucc

SEQ ID NO: 820341 - RNA, 22 nt, Human
caggauggucuucauuuggcuc

SEQ ID NO: 820342 - RNA, 22 nt, Human
cugugauuguuaguuccuauac

SEQ ID NO: 820343 - RNA, 22 nt, Human
gggcagcugccagaggccaugg

SEQ ID NO: 820344 - RNA, 22 nt, Human
aaaauuauagaucuagugccug

SEQ ID NO: 820345 - RNA, 22 nt, Human
aucaggaucugggagccugaaa

SEQ ID NO: 820346 - RNA, 20 nt, Human
aggaagcugagauguagagg

SEQ ID NO: 820347 - RNA, 22 nt, Human
gcauguguugguuuaugcaugu

SEQ ID NO: 820348 - RNA, 22 nt, Human
uuugaaagccuggcuuuucucu

SEQ ID NO: 820349 - RNA, 22 nt, Human
ccaugagcuuccuauauagggu

SEQ ID NO: 820350 - RNA, 22 nt, Human
cugcuuuggacaacuauucuug

SEQ ID NO: 820351 - RNA, 22 nt, Human
aguggcagagguugacugcagu

SEQ ID NO: 820352 - RNA, 22 nt, Human
aggcaggcuggucugaagagug

SEQ ID NO: 820353 - RNA, 18 nt, Human
ccucagggagagagacgc

SEQ ID NO: 820354 - RNA, 22 nt, Human
auugaggcagcauaguucaggg

SEQ ID NO: 820355 - RNA, 22 nt, Human
augcugugcuggcuaaccaugg

SEQ ID NO: 820356 - RNA, 22 nt, Human
agcucccagagcucgagaguaa

SEQ ID NO: 820357 - RNA, 21 nt, Human
uccaggaguggcugggcaggg

SEQ ID NO: 820358 - RNA, 22 nt, Human
aucaggauuauuaaaucuggau

SEQ ID NO: 820359 - RNA, 22 nt, Human
gaggucaggcuugcagcagggu

SEQ ID NO: 820360 - RNA, 22 nt, Human
ugaaaugauaucugauaacaaa

SEQ ID NO: 820361 - RNA, 22 nt, Human
auguggaggaaaugaguguaca

SEQ ID NO: 820362 - RNA, 22 nt, Human
uucuucuucauuucugacgaug

SEQ ID NO: 820363 - RNA, 22 nt, Human
caggagaggcuguacguuucuc

SEQ ID NO: 820364 - RNA, 22 nt, Human
agaggacagacggaaagugcca

SEQ ID NO: 820365 - RNA, 22 nt, Human
ggauggagguucucagaugcuc

SEQ ID NO: 820366 - RNA, 22 nt, Human
uugcauuugaucuuggguucuc

SEQ ID NO: 820367 - RNA, 22 nt, Human
aucauuucccuuuagaucacaa

SEQ ID NO: 820368 - RNA, 19 nt, Human
caggaugaucccaugacac

SEQ ID NO: 820369 - RNA, 22 nt, Human
cucacugacgaggaagcugaga

SEQ ID NO: 820370 - RNA, 22 nt, Human
uucaugugaauauauuugucuu

SEQ ID NO: 820371 - RNA, 22 nt, Human
gaaggaggugucaguuggacug

SEQ ID NO: 820372 - RNA, 22 nt, Human
ugaguucucacccauucuucuu

SEQ ID NO: 820373 - RNA, 22 nt, Human
gcagagcuccccaagacaccaa

SEQ ID NO: 820374 - RNA, 22 nt, Human
ugaggggagacagaguggacuc

SEQ ID NO: 820375 - RNA, 22 nt, Human
ccagugcuuccaggaauacggu

SEQ ID NO: 820376 - RNA, 22 nt, Human
acaggagaaaucuggucaaaag

SEQ ID NO: 820377 - RNA, 22 nt, Human
uuucaaaauuuugcagugguaa

SEQ ID NO: 820378 - RNA, 22 nt, Human
ucucucuucaacccuuaacuag

SEQ ID NO: 820379 - RNA, 22 nt, Human
ugaaucugauuucccuggaggc

SEQ ID NO: 820380 - RNA, 22 nt, Human
agcuaccuggcuuaucacuguc

SEQ ID NO: 820381 - RNA, 22 nt, Human
cagcaggauuugaaaggaagag

SEQ ID NO: 820382 - RNA, 22 nt, Human
uaagauaaguggguugagaugg

SEQ ID NO: 820383 - RNA, 22 nt, Human
augcuuuuaugucacaugguca

SEQ ID NO: 820384 - RNA, 22 nt, Human
cagugauguuucugcaucagag

SEQ ID NO: 820385 - RNA, 22 nt, Human
cuugcuggugguguuuucuaug

SEQ ID NO: 820386 - RNA, 22 nt, Human
gcccaggauggagaauaguggu

SEQ ID NO: 820387 - RNA, 22 nt, Human
ucagauggcacacagagccugc

SEQ ID NO: 820388 - RNA, 22 nt, Human
cuuuggcagccucugcuauuga

SEQ ID NO: 820389 - RNA, 22 nt, Human
cagugcugggcagaggagagcg

SEQ ID NO: 820390 - RNA, 22 nt, Human
gauguuucaugcuagcaugugu

SEQ ID NO: 820391 - RNA, 22 nt, Human
gaaacugugaucguguucuggg

SEQ ID NO: 820392 - RNA, 22 nt, Human
gaggagcugggucagggagaca

SEQ ID NO: 820393 - RNA, 21 nt, Human
gcaaauguucaggaaaaaaga

SEQ ID NO: 820394 - RNA, 22 nt, Human
guugaaaguagaugcuauuugg

SEQ ID NO: 820395 - RNA, 22 nt, Human
cuuagcaugugguguccuugua

SEQ ID NO: 820396 - RNA, 22 nt, Human
agagugucugguagcugcucug

SEQ ID NO: 820397 - RNA, 22 nt, Human
ucauuucaaguucugacagcua

SEQ ID NO: 820398 - RNA, 22 nt, Human
uauuuguauguguguacauaua

SEQ ID NO: 820399 - RNA, 22 nt, Human
uuugacauggaauaacucauuu

SEQ ID NO: 820400 - RNA, 22 nt, Human
uucuuuuacauuaagauuucag

SEQ ID NO: 820401 - RNA, 22 nt, Human
agagggauggccccguaacuca

SEQ ID NO: 820402 - RNA, 22 nt, Human
cagagaaaaaauccugcucuca

SEQ ID NO: 820403 - RNA, 22 nt, Human
acaguuaucuuugaaauagaga

SEQ ID NO: 820404 - RNA, 17 nt, Human
uggcagcugaaagcucu

SEQ ID NO: 820405 - RNA, 22 nt, Human
gcagcugagagaagaacagggc

SEQ ID NO: 820406 - RNA, 22 nt, Human
uaauuauuugaagacauuagag

SEQ ID NO: 820407 - RNA, 22 nt, Human
auuucacucauucauguuacuu

SEQ ID NO: 820408 - RNA, 22 nt, Human
agacaggcagaggcugcagagg

SEQ ID NO: 820409 - RNA, 22 nt, Human
ugaaggcccuaucuccauauac

SEQ ID NO: 820410 - RNA, 22 nt, Human
acaacauuauacauagaaagcu

SEQ ID NO: 820411 - RNA, 22 nt, Human
ucaggagaaaauaucaggaagu

SEQ ID NO: 820412 - RNA, 19 nt, Human
uucccaggaaaggggugca

SEQ ID NO: 820413 - RNA, 22 nt, Human
acuggcagagacccugauggcc

SEQ ID NO: 820414 - RNA, 22 nt, Human
aguugcagacgcagagauguug

SEQ ID NO: 820415 - RNA, 22 nt, Human
gggcagcuguaucugagcuuau

SEQ ID NO: 820416 - RNA, 22 nt, Human
agucucugcugguugugccuau

SEQ ID NO: 820417 - RNA, 22 nt, Human
auucuucaccugagucagucua

SEQ ID NO: 820418 - RNA, 22 nt, Human
ggcagcuaggggcagggaauuc

SEQ ID NO: 820419 - RNA, 22 nt, Human
agcuagccuaggcagagugcau

SEQ ID NO: 820420 - RNA, 22 nt, Human
uccagccuaggggaacagcugc

SEQ ID NO: 820421 - RNA, 20 nt, Human
uuucugugagaaacacuguu

SEQ ID NO: 820422 - RNA, 22 nt, Human
auuaaauuggaucugcauaguu

SEQ ID NO: 820423 - RNA, 22 nt, Human
gucauauacacugcauguaauc

SEQ ID NO: 820424 - RNA, 22 nt, Human
caucacccggaacugugucugc

SEQ ID NO: 820425 - RNA, 22 nt, Human
uccugaggcucacuuugaaugu

SEQ ID NO: 820426 - RNA, 22 nt, Human
agcugaaagugcuuugaggacu

SEQ ID NO: 820427 - RNA, 19 nt, Human
caagugaagccugggaugg

SEQ ID NO: 820428 - RNA, 22 nt, Human
ucuucauuuuauagcaucugug

SEQ ID NO: 820429 - RNA, 22 nt, Human
uccaggagggggagccgugccg

SEQ ID NO: 820430 - RNA, 22 nt, Human
uuaauuaaauucaugagcauug

SEQ ID NO: 820431 - RNA, 21 nt, Human
cucaggaucuuauauauuagu

SEQ ID NO: 820432 - RNA, 22 nt, Human
agacucaagacugcagaagacg

SEQ ID NO: 820433 - RNA, 21 nt, Human
ucucugugucuuuaagcugga

SEQ ID NO: 820434 - RNA, 22 nt, Human
agucucugucguagaucagcgu

SEQ ID NO: 820435 - RNA, 22 nt, Human
gggcacagaagucuaagacauc

SEQ ID NO: 820436 - RNA, 22 nt, Human
gcauucuuuuuaggagguuccu

SEQ ID NO: 820437 - RNA, 22 nt, Human
acacaaugcauauuuuuccaga

SEQ ID NO: 820438 - RNA, 21 nt, Human
acucaggagacuaacuauguc

SEQ ID NO: 820439 - RNA, 22 nt, Human
cacaugugugcugaggacugug

SEQ ID NO: 820440 - RNA, 22 nt, Human
acauucuuaacaguuaaaaacu

SEQ ID NO: 820441 - RNA, 22 nt, Human
uucuuaaaacuuauggacaggu

SEQ ID NO: 820442 - RNA, 22 nt, Human
agaggggaguccuaaucugauu

SEQ ID NO: 820443 - RNA, 21 nt, Human
ggauggauagggaagagauuu

SEQ ID NO: 820444 - RNA, 22 nt, Human
cagcagagaccaagugauuuga

SEQ ID NO: 820445 - RNA, 22 nt, Human
aggcagccaaucagaggcugac

SEQ ID NO: 820446 - RNA, 22 nt, Human
aaggaaccuggaguagagggag

SEQ ID NO: 820447 - RNA, 19 nt, Human
gacagugcaguuguaguac

SEQ ID NO: 820448 - RNA, 22 nt, Human
ucucaggaagugauauugagac

SEQ ID NO: 820449 - RNA, 22 nt, Human
cuagggaguggcagagcuggga

SEQ ID NO: 820450 - RNA, 17 nt, Human
cucacggaggaugaauc

SEQ ID NO: 820451 - RNA, 22 nt, Human
auucauuugcuauuguguaugg

SEQ ID NO: 820452 - RNA, 21 nt, Human
cgcagagcgaacuugcggcgc

SEQ ID NO: 820453 - RNA, 22 nt, Human
aggcacaggaaugucauccagu

SEQ ID NO: 820454 - RNA, 19 nt, Human
uggagggguuugaaugugg

SEQ ID NO: 820455 - RNA, 22 nt, Human
ucagggugaaccaggcaggaau

SEQ ID NO: 820456 - RNA, 23 nt, Human
aggcagcagguuguccaggguga

SEQ ID NO: 820457 - RNA, 22 nt, Human
uuaguuuucccaucuuuauggu

SEQ ID NO: 820458 - RNA, 22 nt, Human
cagcuacuccucccaugacuuc

SEQ ID NO: 820459 - RNA, 22 nt, Human
auugaaagauaggcuacugugg

SEQ ID NO: 820460 - RNA, 22 nt, Human
cauuuguaucauauguaucuua

SEQ ID NO: 820461 - RNA, 22 nt, Human
cagcugccccuccagggcuggg

SEQ ID NO: 820462 - RNA, 22 nt, Human
aaauacuagaauucagaguuga

SEQ ID NO: 820463 - RNA, 22 nt, Human
agggagcuuccgaacuacagcu

SEQ ID NO: 820464 - RNA, 23 nt, Human
gaggcacucaggaaaugugagug

SEQ ID NO: 820465 - RNA, 22 nt, Human
agaggccacuuugccugugaug

SEQ ID NO: 820466 - RNA, 22 nt, Human
uucuucaauuuuccauauacug

SEQ ID NO: 820467 - RNA, 22 nt, Human
uucauucuugucuuuguauagu

SEQ ID NO: 820468 - RNA, 19 nt, Human
uggagaggaaaugcugcuc

SEQ ID NO: 820469 - RNA, 22 nt, Human
aggaugaauaacugaaauggug

SEQ ID NO: 820470 - RNA, 22 nt, Human
cccaggagguggagcuugcagu

SEQ ID NO: 820471 - RNA, 22 nt, Human
uuugaaaucuaaucaaggaaca

SEQ ID NO: 820472 - RNA, 22 nt, Human
uguaggccuauguccagcaauu

SEQ ID NO: 820473 - RNA, 22 nt, Human
cugcugugacagcugccguguu

SEQ ID NO: 820474 - RNA, 22 nt, Human
aucuuucaaucaggaaaaaucu

SEQ ID NO: 820475 - RNA, 22 nt, Human
cucccaggggaacuaucaagua

SEQ ID NO: 820476 - RNA, 22 nt, Human
gauugaaacauaggcagucgag

SEQ ID NO: 820477 - RNA, 22 nt, Human
ucaaucacguguuccauguucu

SEQ ID NO: 820478 - RNA, 22 nt, Human
uacugccuggagcauuggugcu

SEQ ID NO: 820479 - RNA, 22 nt, Human
gacuucuauuaauaccucuacu

SEQ ID NO: 820480 - RNA, 22 nt, Human
ucuggcaggucaaucauucuuu

SEQ ID NO: 820481 - RNA, 22 nt, Human
ccaggagaaugggauuacccua

SEQ ID NO: 820482 - RNA, 22 nt, Human
caguggagagacuuuuacucuu

SEQ ID NO: 820483 - RNA, 19 nt, Human
uuugcagugguuccuuugu

SEQ ID NO: 820484 - RNA, 22 nt, Human
cagaggaguucaguacacagcc

SEQ ID NO: 820485 - RNA, 22 nt, Human
ucaggagggugacaggcccugg

SEQ ID NO: 820486 - RNA, 22 nt, Human
agaggggaaguaaugaaugaua

SEQ ID NO: 820487 - RNA, 22 nt, Human
uuugaaaguucuucugacacua

SEQ ID NO: 820488 - RNA, 22 nt, Human
aaggcaguagguguuucaaacu

SEQ ID NO: 820489 - RNA, 22 nt, Human
ugaaaugacagucuuaagcucu

SEQ ID NO: 820490 - RNA, 22 nt, Human
gaggcagcugggcuggugguuu

SEQ ID NO: 820491 - RNA, 22 nt, Human
auugcuguaaauuaucuuauua

SEQ ID NO: 820492 - RNA, 22 nt, Human
ugccuggauucgguuguuguca

SEQ ID NO: 820493 - RNA, 22 nt, Human
agaggccggccgagcccauggg

SEQ ID NO: 820494 - RNA, 21 nt, Human
uuagaaagcucacuacaguua

SEQ ID NO: 820495 - RNA, 22 nt, Human
uuucacagcuggguggcagagu

SEQ ID NO: 820496 - RNA, 22 nt, Human
aggcagugccuggaccccagcu

SEQ ID NO: 820497 - RNA, 22 nt, Human
uucuuacagaguuuacagagcc

SEQ ID NO: 820498 - RNA, 22 nt, Human
uaccauuucauucuuuccucau

SEQ ID NO: 820499 - RNA, 22 nt, Human
acuguagcugccacuggaugca

SEQ ID NO: 820500 - RNA, 23 nt, Human
agaugaggcuucuccauguuggu

SEQ ID NO: 820501 - RNA, 20 nt, Human
ucauuucuugggguuccaag

SEQ ID NO: 820502 - RNA, 21 nt, Human
acagcaagccuucacaugagu

SEQ ID NO: 820503 - RNA, 22 nt, Human
gccaggagccagcuucuuagca

SEQ ID NO: 820504 - RNA, 22 nt, Human
ucugggaacacacgucacuuca

SEQ ID NO: 820505 - RNA, 22 nt, Human
cuugcuucauuagugucuuagu

SEQ ID NO: 820506 - RNA, 19 nt, Human
uagaggagaagggaagugg

SEQ ID NO: 820507 - RNA, 22 nt, Human
gaggccagggaugcaaugagag

SEQ ID NO: 820508 - RNA, 22 nt, Human
gcagaggcuguagggaagguug

SEQ ID NO: 820509 - RNA, 21 nt, Human
cacucaggguaugugccaggc

SEQ ID NO: 820510 - RNA, 22 nt, Human
guuugcauauuugcacaggaau

SEQ ID NO: 820511 - RNA, 22 nt, Human
gucauucuuaacaacucaguag

SEQ ID NO: 820512 - RNA, 22 nt, Human
cauuuguaguuaaaaaugucuc

SEQ ID NO: 820513 - RNA, 22 nt, Human
gauuucuugauaaguaguguga

SEQ ID NO: 820514 - RNA, 22 nt, Human
uguacauacauagauauacaca

SEQ ID NO: 820515 - RNA, 22 nt, Human
ugcccaggguuucuaagagcag

SEQ ID NO: 820516 - RNA, 22 nt, Human
uaaggccagcaugaaugcagca

SEQ ID NO: 820517 - RNA, 22 nt, Human
gcagaggccuagguggaaggcc

SEQ ID NO: 820518 - RNA, 21 nt, Human
ucucugguuggaguugugcca

SEQ ID NO: 820519 - RNA, 22 nt, Human
uuugaagugggcauuagaaccu

SEQ ID NO: 820520 - RNA, 22 nt, Human
acauauauuacuaguaaagaca

SEQ ID NO: 820521 - RNA, 22 nt, Human
uuauuuaaaagugguaagauuc

SEQ ID NO: 820522 - RNA, 22 nt, Human
gacccaggguauccagagcugc

SEQ ID NO: 820523 - RNA, 22 nt, Human
cucuccucagaacaggcccucu

SEQ ID NO: 820524 - RNA, 22 nt, Human
ccuccucugggaagauucagag

SEQ ID NO: 820525 - RNA, 19 nt, Human
cuuugucagaacaugcuuc

SEQ ID NO: 820526 - RNA, 22 nt, Human
aaggccagcuuguagggcuggu

SEQ ID NO: 820527 - RNA, 22 nt, Human
uuugaaagucaaccuuccaguu

SEQ ID NO: 820528 - RNA, 22 nt, Human
ggagcuguucaggacugcuuca

SEQ ID NO: 820529 - RNA, 22 nt, Human
cuggaguuagaguagacacuga

SEQ ID NO: 820530 - RNA, 22 nt, Human
uauuuuaaagugaagggucuug

SEQ ID NO: 820531 - RNA, 22 nt, Human
uccaugagcuagcuuuccaaag

SEQ ID NO: 820532 - RNA, 22 nt, Human
ccugccugcaccuucucugggg

SEQ ID NO: 820533 - RNA, 22 nt, Human
auauucuugugauuauaaagua

SEQ ID NO: 820534 - RNA, 22 nt, Human
gucuucuuguuuugaaggaaau

SEQ ID NO: 820535 - RNA, 22 nt, Human
aucuuucaguuucauaccaauu

SEQ ID NO: 820536 - RNA, 22 nt, Human
aggccagccucaggcagggacc

SEQ ID NO: 820537 - RNA, 22 nt, Human
uggaaggaagccaaggaagguu

SEQ ID NO: 820538 - RNA, 22 nt, Human
cugcugugccuuaaaaugcaag

SEQ ID NO: 820539 - RNA, 21 nt, Human
agcagaggcugccuggugacu

SEQ ID NO: 820540 - RNA, 22 nt, Human
ucauuuguugaacuuuagugcg

SEQ ID NO: 820541 - RNA, 22 nt, Human
accaggaggcuacacuguccca

SEQ ID NO: 820542 - RNA, 22 nt, Human
acccaggacaugggcacccgug

SEQ ID NO: 820543 - RNA, 22 nt, Human
gcuguucucuguaacaugcauu

SEQ ID NO: 820544 - RNA, 22 nt, Human
gucaggaugacaagugcuuuca

SEQ ID NO: 820545 - RNA, 22 nt, Human
cuggcuguauuaguuugauccu

SEQ ID NO: 820546 - RNA, 22 nt, Human
gaggcagagaccuucaggaccu

SEQ ID NO: 820547 - RNA, 22 nt, Human
aaggcagccgugugacugcaug

SEQ ID NO: 820548 - RNA, 22 nt, Human
ucauuucccuccuacaaagagg

SEQ ID NO: 820549 - RNA, 22 nt, Human
caguuuuugccauuaagaguaa

SEQ ID NO: 820550 - RNA, 22 nt, Human
auggagggugguaagacagaga

SEQ ID NO: 820551 - RNA, 22 nt, Human
aggcagacucaauggcuagaua

SEQ ID NO: 820552 - RNA, 20 nt, Human
agacaggagcccccauucag

SEQ ID NO: 820553 - RNA, 22 nt, Human
gaggauggaggugugagcuaug

SEQ ID NO: 820554 - RNA, 22 nt, Human
uucaugcuuuuaccgcuguuaa

SEQ ID NO: 820555 - RNA, 22 nt, Human
ucucugguuauuaacuaacucc

SEQ ID NO: 820556 - RNA, 22 nt, Human
uuaggaguccagaugucuuggg

SEQ ID NO: 820557 - RNA, 23 nt, Human
aggcccaacucugugagggcugc

SEQ ID NO: 820558 - RNA, 22 nt, Human
aucaggaucacugggagucuug

SEQ ID NO: 820559 - RNA, 22 nt, Human
uucuuaacuggaaaaugucaga

SEQ ID NO: 820560 - RNA, 22 nt, Human
auuguauaacagcauguauuuu

SEQ ID NO: 820561 - RNA, 22 nt, Human
uuacaagcagcuacauaucaca

SEQ ID NO: 820562 - RNA, 22 nt, Human
ugaggcaggacugagcgggaug

SEQ ID NO: 820563 - RNA, 22 nt, Human
uuugaaaggugucgagaugugu

SEQ ID NO: 820564 - RNA, 22 nt, Human
gucuccugagccuugacugcaa

SEQ ID NO: 820565 - RNA, 22 nt, Human
uuauuucauugauuucuaagac

SEQ ID NO: 820566 - RNA, 22 nt, Human
uucagcaagaccaccauguacc

SEQ ID NO: 820567 - RNA, 22 nt, Human
guguugaugacauuuuagaaac

SEQ ID NO: 820568 - RNA, 22 nt, Human
ggggcagcuaccggaaguaggg

SEQ ID NO: 820569 - RNA, 19 nt, Human
caggaaugagguaauggcu

SEQ ID NO: 820570 - RNA, 22 nt, Human
gcugcugucacggugcuaaggg

SEQ ID NO: 820571 - RNA, 22 nt, Human
gacagaggcuggagcaccuccu

SEQ ID NO: 820572 - RNA, 22 nt, Human
ggaggggauuuaguagaugcua

SEQ ID NO: 820573 - RNA, 22 nt, Human
uccaggagauucauuaggucau

SEQ ID NO: 820574 - RNA, 22 nt, Human
uagggcaggggaggaaucugaa

SEQ ID NO: 820575 - RNA, 22 nt, Human
aguuucuuuagauagaaaguuc

SEQ ID NO: 820576 - RNA, 18 nt, Human
uuugcaaaggaaguaugg

SEQ ID NO: 820577 - RNA, 22 nt, Human
uugauagguuuuauguauaguu

SEQ ID NO: 820578 - RNA, 22 nt, Human
ggagaggggcaaguuuaucuag

SEQ ID NO: 820579 - RNA, 22 nt, Human
aaauuauucucauguguuucuu

SEQ ID NO: 820580 - RNA, 22 nt, Human
gcagcugcaauaggcaucaagc

SEQ ID NO: 820581 - RNA, 22 nt, Human
aacacugcugcuggguucugug

SEQ ID NO: 820582 - RNA, 22 nt, Human
ccaggagaugggagcaucuaaa

SEQ ID NO: 820583 - RNA, 22 nt, Human
uuucaucuucccagagaccuug

SEQ ID NO: 820584 - RNA, 22 nt, Human
uaaacauuuguuauucuuguuu

SEQ ID NO: 820585 - RNA, 22 nt, Human
ucuucaauuagauuuaccaauu

SEQ ID NO: 820586 - RNA, 19 nt, Human
ccauggagagagaugcauu

SEQ ID NO: 820587 - RNA, 22 nt, Human
gaagcagcagcuggggacaguu

SEQ ID NO: 820588 - RNA, 22 nt, Human
ggcagcucacgggcauggggug

SEQ ID NO: 820589 - RNA, 22 nt, Human
cuucugagcagaccuccugggg

SEQ ID NO: 820590 - RNA, 22 nt, Human
aggcagauauuggggugaugug

SEQ ID NO: 820591 - RNA, 23 nt, Human
uuccagaguccacaucugccacc

SEQ ID NO: 820592 - RNA, 20 nt, Human
cucaggauugucuagccccu

SEQ ID NO: 820593 - RNA, 22 nt, Human
ggcugaaggaugaaagcugcag

SEQ ID NO: 820594 - RNA, 22 nt, Human
acaggacuguggaaggaucucu

SEQ ID NO: 820595 - RNA, 22 nt, Human
aggcacaguuucauccccgggc

SEQ ID NO: 820596 - RNA, 22 nt, Human
cuccaggaaagccugaggcccg

SEQ ID NO: 820597 - RNA, 22 nt, Human
uccaugagagguaacuuuacaa

SEQ ID NO: 820598 - RNA, 22 nt, Human
auuggcaguuagugacgaggcu

SEQ ID NO: 820599 - RNA, 22 nt, Human
agucuuuccugcuugacuguuc

SEQ ID NO: 820600 - RNA, 22 nt, Human
uugacaauguccuuugaauuuc

SEQ ID NO: 820601 - RNA, 22 nt, Human
uugacacaguuuucucauuaag

SEQ ID NO: 820602 - RNA, 22 nt, Human
gcaggagagucugugccagguu

SEQ ID NO: 820603 - RNA, 22 nt, Human
auugcuguggaaauauaagaug

SEQ ID NO: 820604 - RNA, 22 nt, Human
uuugaauagcauaggauuacau

SEQ ID NO: 820605 - RNA, 22 nt, Human
cggaggggauacauuuucugaa

SEQ ID NO: 820606 - RNA, 18 nt, Human
agucuucugauccauuuu

SEQ ID NO: 820607 - RNA, 23 nt, Human
guaaaauacgcagugcaguguga

SEQ ID NO: 820608 - RNA, 18 nt, Human
gagagggaucccucagga

SEQ ID NO: 820609 - RNA, 22 nt, Human
ucaacugcaaguuugcuuaguu

SEQ ID NO: 820610 - RNA, 22 nt, Human
aauaucagcacuuuugugguau

SEQ ID NO: 820611 - RNA, 22 nt, Human
gagguggugguggaggcauagc

SEQ ID NO: 820612 - RNA, 22 nt, Human
aggcagcuggaggcagagacua

SEQ ID NO: 820613 - RNA, 22 nt, Human
uccaugucuucaugugucuaac

SEQ ID NO: 820614 - RNA, 22 nt, Human
gcugccagccaacuugcugugc

SEQ ID NO: 820615 - RNA, 22 nt, Human
cccuggaggcuggaggcaguag

SEQ ID NO: 820616 - RNA, 22 nt, Human
ugcuuuggccacuagaauucag

SEQ ID NO: 820617 - RNA, 22 nt, Human
uagggauguaaacauaguaauu

SEQ ID NO: 820618 - RNA, 20 nt, Human
cugcugugauucccuccucc

SEQ ID NO: 820619 - RNA, 22 nt, Human
acuuaaaaagaaucuuuucacg

SEQ ID NO: 820620 - RNA, 22 nt, Human
ucccaggauguuuauggcuggu

SEQ ID NO: 820621 - RNA, 22 nt, Human
agaggcagcagucauacuacag

SEQ ID NO: 820622 - RNA, 22 nt, Human
gaggagagagggacugucugca

SEQ ID NO: 820623 - RNA, 22 nt, Human
uggaguucauccaugacagcuu

SEQ ID NO: 820624 - RNA, 22 nt, Human
cagagccaggucuaggagucuc

SEQ ID NO: 820625 - RNA, 22 nt, Human
cugucccuucauuauucacuac

SEQ ID NO: 820626 - RNA, 22 nt, Human
ugaaagguuauuuaggucugcu

SEQ ID NO: 820627 - RNA, 22 nt, Human
aggcagcaugggccccagcucc

SEQ ID NO: 820628 - RNA, 22 nt, Human
cugcugugccucuuuucacgug

SEQ ID NO: 820629 - RNA, 22 nt, Human
ugaugaaaauaugauucugagg

SEQ ID NO: 820630 - RNA, 23 nt, Human
cuuugccacccagagccugacag

SEQ ID NO: 820631 - RNA, 22 nt, Human
uuucaaauagaaucuuuccaaa

SEQ ID NO: 820632 - RNA, 22 nt, Human
caggauggugugagugugagga

SEQ ID NO: 820633 - RNA, 22 nt, Human
aggcagcauuugaauccagguc

SEQ ID NO: 820634 - RNA, 22 nt, Human
cucacuguccaacaggcuuuac

SEQ ID NO: 820635 - RNA, 22 nt, Human
uuucacuagaacguucuuguuu

SEQ ID NO: 820636 - RNA, 22 nt, Human
cauuuucaugaguuucuguuca

SEQ ID NO: 820637 - RNA, 22 nt, Human
cccaggaggugugcccaacucg

SEQ ID NO: 820638 - RNA, 22 nt, Human
agaggcggagcuugcagugagc

SEQ ID NO: 820639 - RNA, 18 nt, Human
gcaggagauggguggggu

SEQ ID NO: 820640 - RNA, 22 nt, Human
ggcagcauauauucagugggca

SEQ ID NO: 820641 - RNA, 22 nt, Human
aucccaugagaccacguuggcu

SEQ ID NO: 820642 - RNA, 22 nt, Human
ugaaugaguuuggcugcuguuc

SEQ ID NO: 820643 - RNA, 22 nt, Human
agcugcccuguggggaggguug

SEQ ID NO: 820644 - RNA, 22 nt, Human
uuucuucauucaccuucacccc

SEQ ID NO: 820645 - RNA, 22 nt, Human
ucacauucucagcaucuauaca

SEQ ID NO: 820646 - RNA, 22 nt, Human
gauaaugaugacaaugacaacc

SEQ ID NO: 820647 - RNA, 22 nt, Human
uuucauugcagagucugugugc

SEQ ID NO: 820648 - RNA, 22 nt, Human
caaguaaagaaucacauuucuu

SEQ ID NO: 820649 - RNA, 20 nt, Human
ugcugucguguuuucugcuu

SEQ ID NO: 820650 - RNA, 16 nt, Human
cuuccucuucacuggc

SEQ ID NO: 820651 - RNA, 22 nt, Human
agggagugguuaagaaggugca

SEQ ID NO: 820652 - RNA, 22 nt, Human
caggcagcccugcaccaagugu

SEQ ID NO: 820653 - RNA, 22 nt, Human
gggcagcuggcuuauagguuug

SEQ ID NO: 820654 - RNA, 22 nt, Human
gaggcauggccugaggcuagga

SEQ ID NO: 820655 - RNA, 20 nt, Human
guugaaaguaauaugaugcu

SEQ ID NO: 820656 - RNA, 22 nt, Human
ggcagcuuucaauaggguuaug

SEQ ID NO: 820657 - RNA, 22 nt, Human
ucagugugaggucuuccacccg

SEQ ID NO: 820658 - RNA, 22 nt, Human
gcagcugcuggagggaggcagg

SEQ ID NO: 820659 - RNA, 22 nt, Human
ugaggcagguggauuacaaggu

SEQ ID NO: 820660 - RNA, 22 nt, Human
cuguuaaucugcuugcaugaug

SEQ ID NO: 820661 - RNA, 22 nt, Human
agcagagguuuguuggaaaccu

SEQ ID NO: 820662 - RNA, 22 nt, Human
gaggcagcucuucugaaugggg

SEQ ID NO: 820663 - RNA, 22 nt, Human
ucauucuugaucacuaguuagu

SEQ ID NO: 820664 - RNA, 22 nt, Human
uucaggaucauuuguuuuaucu

SEQ ID NO: 820665 - RNA, 22 nt, Human
uaugaaacauucauacaaauaa

SEQ ID NO: 820666 - RNA, 22 nt, Human
ucacccuugauaauguucuucu

SEQ ID NO: 820667 - RNA, 22 nt, Human
agcccaggugagggguucgaaa

SEQ ID NO: 820668 - RNA, 22 nt, Human
cccaggaugucgaggcugcagu

SEQ ID NO: 820669 - RNA, 22 nt, Human
uugcagcugcaguaaauguuca

SEQ ID NO: 820670 - RNA, 22 nt, Human
ugaggcagaguaagauacauga

SEQ ID NO: 820671 - RNA, 22 nt, Human
agauggagaaugacaauuaagg

SEQ ID NO: 820672 - RNA, 22 nt, Human
uucccucucacuuaaagcuugg

SEQ ID NO: 820673 - RNA, 22 nt, Human
uugaacugguaguuggaaaucu

SEQ ID NO: 820674 - RNA, 22 nt, Human
aggcagcuuuaacugguaguag

SEQ ID NO: 820675 - RNA, 22 nt, Human
uugcugugucauuuguuuaauc

SEQ ID NO: 820676 - RNA, 22 nt, Human
gaggcagcaauaaaaagaauuu

SEQ ID NO: 820677 - RNA, 22 nt, Human
ggcagaggagcuggaaacaugg

SEQ ID NO: 820678 - RNA, 22 nt, Human
uugcaucuaccauaucaaagau

SEQ ID NO: 820679 - RNA, 22 nt, Human
uuugcauaagucauguccagug

SEQ ID NO: 820680 - RNA, 22 nt, Human
ccaggagacuguacugauauuu

SEQ ID NO: 820681 - RNA, 22 nt, Human
aucaggaugcugucaguuacca

SEQ ID NO: 820682 - RNA, 22 nt, Human
uuucucugcugccugugucgau

SEQ ID NO: 820683 - RNA, 20 nt, Human
aggcucagcugagcucuugg

SEQ ID NO: 820684 - RNA, 22 nt, Human
aaaguauuugugauuuuuacca

SEQ ID NO: 820685 - RNA, 19 nt, Human
ugcauaaauuauauacuuu

SEQ ID NO: 820686 - RNA, 22 nt, Human
augcuguguggucaaguuaauu

SEQ ID NO: 820687 - RNA, 19 nt, Human
accaggagacagugagcuu

SEQ ID NO: 820688 - RNA, 22 nt, Human
caaggccaagguuuugugaacu

SEQ ID NO: 820689 - RNA, 22 nt, Human
ccagugcuucuuugcuagcugg

SEQ ID NO: 820690 - RNA, 22 nt, Human
uucaggauccccuugaugggcu

SEQ ID NO: 820691 - RNA, 22 nt, Human
caggauggagaguuguugguug

SEQ ID NO: 820692 - RNA, 22 nt, Human
gauuucuuuagguguaauagug

SEQ ID NO: 820693 - RNA, 22 nt, Human
ccucacugcuauguguuugcuc

SEQ ID NO: 820694 - RNA, 22 nt, Human
aggcaguguguagcuggaagag

SEQ ID NO: 820695 - RNA, 22 nt, Human
aaagcagaacugagagagcugg

SEQ ID NO: 820696 - RNA, 22 nt, Human
ucuaaagaagaggguucugcgg

SEQ ID NO: 820697 - RNA, 22 nt, Human
uuucaugagauuccuccacauc

SEQ ID NO: 820698 - RNA, 22 nt, Human
aaggcagcccuggcucagccug

SEQ ID NO: 820699 - RNA, 22 nt, Human
cucaggauccaucuccugcccu

SEQ ID NO: 820700 - RNA, 22 nt, Human
ucucaggaagauuagggcuaag

SEQ ID NO: 820701 - RNA, 22 nt, Human
ucagugcacagagauuuuuguu

SEQ ID NO: 820702 - RNA, 21 nt, Human
gcugcaucaaucuacccaggg

SEQ ID NO: 820703 - RNA, 20 nt, Human
uaggcagcuugacccuuggu

SEQ ID NO: 820704 - RNA, 22 nt, Human
uuuugaauaauucagaaacagc

SEQ ID NO: 820705 - RNA, 22 nt, Human
aggcugcugccuuggagagugu

SEQ ID NO: 820706 - RNA, 22 nt, Human
cagauggaacacagaaaggaga

SEQ ID NO: 820707 - RNA, 22 nt, Human
ucacuucacacccacuaucaug

SEQ ID NO: 820708 - RNA, 22 nt, Human
ucuuugaaagcuguucuagagu

SEQ ID NO: 820709 - RNA, 22 nt, Human
gcugaaugaauguauuuuaaaa

SEQ ID NO: 820710 - RNA, 22 nt, Human
gucuauauauugcuugaauaau

SEQ ID NO: 820711 - RNA, 22 nt, Human
acccaggagacagguugcagug

SEQ ID NO: 820712 - RNA, 22 nt, Human
ugaaucaguauaaauucucaaa

SEQ ID NO: 820713 - RNA, 22 nt, Human
uauuucagcaagaagaaugugg

SEQ ID NO: 820714 - RNA, 22 nt, Human
guucuucaggcugugcucuaga

SEQ ID NO: 820715 - RNA, 22 nt, Human
agcuacccgaggacaggcuaag

SEQ ID NO: 820716 - RNA, 22 nt, Human
ucccaggaugaagacaguguug

SEQ ID NO: 820717 - RNA, 22 nt, Human
uuuguuuacucauucauugaug

SEQ ID NO: 820718 - RNA, 22 nt, Human
ggugagaggcagaggacagcuu

SEQ ID NO: 820719 - RNA, 22 nt, Human
uugauacauuuuuaggauaaac

SEQ ID NO: 820720 - RNA, 22 nt, Human
ugaagggggagauauaugugug

SEQ ID NO: 820721 - RNA, 22 nt, Human
cucaggauuuacuaauuucaag

SEQ ID NO: 820722 - RNA, 22 nt, Human
ccuggagauuucuucaagcuuu

SEQ ID NO: 820723 - RNA, 23 nt, Human
uuugaaguugacugccuuccaga

SEQ ID NO: 820724 - RNA, 22 nt, Human
gauuucuugaccccugucucag

SEQ ID NO: 820725 - RNA, 22 nt, Human
agcagcauuaugauauaucuua

SEQ ID NO: 820726 - RNA, 22 nt, Human
aaauuagucgguuuaggaauuu

SEQ ID NO: 820727 - RNA, 22 nt, Human
gaaaggccauuucugaggguuu

SEQ ID NO: 820728 - RNA, 20 nt, Human
acaggagaucugaggaaagg

SEQ ID NO: 820729 - RNA, 22 nt, Human
ucuucagacuccaaauguuuua

SEQ ID NO: 820730 - RNA, 22 nt, Human
acccaggaggugacacagggcu

SEQ ID NO: 820731 - RNA, 20 nt, Human
aaacauucauguacaaguga

SEQ ID NO: 820732 - RNA, 21 nt, Human
aaucauacaaaacaugucagg

SEQ ID NO: 820733 - RNA, 18 nt, Human
aauuuccauaugaauugc

SEQ ID NO: 820734 - RNA, 22 nt, Human
agcaccuguugcacuucauaau

SEQ ID NO: 820735 - RNA, 22 nt, Human
cccagcaguaaccaguggaaau

SEQ ID NO: 820736 - RNA, 22 nt, Human
cccaugagaccugguuuaaggc

SEQ ID NO: 820737 - RNA, 22 nt, Human
auccaugaucaauuuauuacua

SEQ ID NO: 820738 - RNA, 22 nt, Human
ggauggcaggacaaggacccag

SEQ ID NO: 820739 - RNA, 22 nt, Human
cugcuuugauuagaagaguaca

SEQ ID NO: 820740 - RNA, 22 nt, Human
aggaugaggcuggcaggucuug

SEQ ID NO: 820741 - RNA, 22 nt, Human
auacaaagacaaaucucaaucu

SEQ ID NO: 820742 - RNA, 23 nt, Human
ucccaggaaucugcauuuuuaac

SEQ ID NO: 820743 - RNA, 22 nt, Human
caaggccacuccagagacuggu

SEQ ID NO: 820744 - RNA, 22 nt, Human
ucugaaggugcuagagaaagcu

SEQ ID NO: 820745 - RNA, 23 nt, Human
gugcugugagccccuuggccucc

SEQ ID NO: 820746 - RNA, 22 nt, Human
caaggccagggaauuuuucugg

SEQ ID NO: 820747 - RNA, 22 nt, Human
uaucuguugucuuuuacaugua

SEQ ID NO: 820748 - RNA, 22 nt, Human
uucuucuugucugcccucacau

SEQ ID NO: 820749 - RNA, 22 nt, Human
cuucuucaucuguaaaacuugg

SEQ ID NO: 820750 - RNA, 22 nt, Human
gaaggucaccuccccucucugg

SEQ ID NO: 820751 - RNA, 22 nt, Human
agucucuuuguggacucugccu

SEQ ID NO: 820752 - RNA, 19 nt, Human
ugcccaggccagguugggc

SEQ ID NO: 820753 - RNA, 22 nt, Human
cagaggcacaagaaagcaaggc

SEQ ID NO: 820754 - RNA, 22 nt, Human
uuucaguuuuugcucgauguau

SEQ ID NO: 820755 - RNA, 22 nt, Human
cugcuucuccaaaguaggacuu

SEQ ID NO: 820756 - RNA, 22 nt, Human
uucacagacauugcagacugaa

SEQ ID NO: 820757 - RNA, 17 nt, Human
aagagaggcugagcugg

SEQ ID NO: 820758 - RNA, 22 nt, Human
ucagagaguuacacaaauuguu

SEQ ID NO: 820759 - RNA, 22 nt, Human
caggacagcucaacaccuccuc

SEQ ID NO: 820760 - RNA, 22 nt, Human
ggcacagagcccagcuuccuag

SEQ ID NO: 820761 - RNA, 22 nt, Human
cugagacuuucaugugcuuuua

SEQ ID NO: 820762 - RNA, 22 nt, Human
ucagucucaucaacucuauucc

SEQ ID NO: 820763 - RNA, 22 nt, Human
uagaaauaaaucugcagcuggg

SEQ ID NO: 820764 - RNA, 22 nt, Human
uaaaaugaucucucauguucuu

SEQ ID NO: 820765 - RNA, 22 nt, Human
uuugaaguguuauuucuaucac

SEQ ID NO: 820766 - RNA, 22 nt, Human
cucacugugaccucagcagaca

SEQ ID NO: 820767 - RNA, 22 nt, Human
uggcagcuggagggcaauggcc

SEQ ID NO: 820768 - RNA, 22 nt, Human
ccaggagauaagcugaguuuau

SEQ ID NO: 820769 - RNA, 22 nt, Human
cagaggcauacucccagucuug

SEQ ID NO: 820770 - RNA, 20 nt, Human
gaguuccccauuucuccugg

SEQ ID NO: 820771 - RNA, 22 nt, Human
agggcagcagcggcccaggccu

SEQ ID NO: 820772 - RNA, 22 nt, Human
gcggagggcgagcccgcggagc

SEQ ID NO: 820773 - RNA, 22 nt, Human
ugcccaggcuggaaugcagugg

SEQ ID NO: 820774 - RNA, 18 nt, Human
cugcccagagcauuucau

SEQ ID NO: 820775 - RNA, 22 nt, Human
gcccaggaagccaccgggaagu

SEQ ID NO: 820776 - RNA, 19 nt, Human
uuagccauccacagugaaa

SEQ ID NO: 820777 - RNA, 22 nt, Human
aggccagaaauuuggaguaugu

SEQ ID NO: 820778 - RNA, 22 nt, Human
uuuggacuuagccugcagaauu

SEQ ID NO: 820779 - RNA, 22 nt, Human
agacagcugggaaauggagugu

SEQ ID NO: 820780 - RNA, 22 nt, Human
ucauuucaaugauacuacuaag

SEQ ID NO: 820781 - RNA, 22 nt, Human
accuugaugccuuuccaagaug

SEQ ID NO: 820782 - RNA, 22 nt, Human
cagcucccgccaucgggaggca

SEQ ID NO: 820783 - RNA, 22 nt, Human
acccaggauagagugcugcagu

SEQ ID NO: 820784 - RNA, 19 nt, Human
cuucuggcccugagccacc

SEQ ID NO: 820785 - RNA, 22 nt, Human
gaggcagcugggauacaaggga

SEQ ID NO: 820786 - RNA, 19 nt, Human
cccaggagcaguauugaug

SEQ ID NO: 820787 - RNA, 22 nt, Human
ucaggauaaaauguaauggcaa

SEQ ID NO: 820788 - RNA, 22 nt, Human
uuagccauuaaauuacaaggug

SEQ ID NO: 820789 - RNA, 22 nt, Human
acucagaaccauuuacucugag

SEQ ID NO: 820790 - RNA, 22 nt, Human
uuauccuggauuauauauguga

SEQ ID NO: 820791 - RNA, 22 nt, Human
uuagccauuaauguccugugca

SEQ ID NO: 820792 - RNA, 22 nt, Human
gaucauuugcaggaaacauuaa

SEQ ID NO: 820793 - RNA, 22 nt, Human
agggggugucucugauuggguu

SEQ ID NO: 820794 - RNA, 20 nt, Human
uccaggagguuaguguggcu

SEQ ID NO: 820795 - RNA, 22 nt, Human
ccaugagcuucaacugacacag

SEQ ID NO: 820796 - RNA, 22 nt, Human
cuggguaaguuccuaaggcuca

SEQ ID NO: 820797 - RNA, 22 nt, Human
uucucagagugaccaagucuuu

SEQ ID NO: 820798 - RNA, 22 nt, Human
aggccagaaaugucagggagug

SEQ ID NO: 820799 - RNA, 22 nt, Human
aggagacauaacuaugaugaga

SEQ ID NO: 820800 - RNA, 22 nt, Human
uauuucuaagagauaucuguac

SEQ ID NO: 820801 - RNA, 22 nt, Human
uuugcaauuugugcugcaaaug

SEQ ID NO: 820802 - RNA, 22 nt, Human
gaaauauuguacuggagauguu

SEQ ID NO: 820803 - RNA, 22 nt, Human
aggcagugcugugcccugaacc

SEQ ID NO: 820804 - RNA, 21 nt, Human
ggcagccucuguggaagggga

SEQ ID NO: 820805 - RNA, 21 nt, Human
uuugaaagugggugauucuuu

SEQ ID NO: 820806 - RNA, 23 nt, Human
gagugcagaauagacaugcagug

SEQ ID NO: 820807 - RNA, 20 nt, Human
ggcagcuugggcagcaguua

SEQ ID NO: 820808 - RNA, 19 nt, Human
uccaggagcaaagccaguu

SEQ ID NO: 820809 - RNA, 22 nt, Human
aaggcagcagugcacgacugau

SEQ ID NO: 820810 - RNA, 22 nt, Human
uuuauuuggcauccagggagaa

SEQ ID NO: 820811 - RNA, 22 nt, Human
gggcagcucagccaccaugcag

SEQ ID NO: 820812 - RNA, 22 nt, Human
acagucuugcuguauggucagg

SEQ ID NO: 820813 - RNA, 22 nt, Human
ggaagagggaaccacgacugua

SEQ ID NO: 820814 - RNA, 22 nt, Human
uugcauuugacaaauuauuuaa

SEQ ID NO: 820815 - RNA, 22 nt, Human
uauuuccauguuagaacuaagu

SEQ ID NO: 820816 - RNA, 22 nt, Human
cuugaaagucagcagaguggau

SEQ ID NO: 820817 - RNA, 22 nt, Human
auguuuuugagauacaaacaga

SEQ ID NO: 820818 - RNA, 22 nt, Human
uuuaaauucugucugccgcuua

SEQ ID NO: 820819 - RNA, 22 nt, Human
gcucaggaucagccaccucuuu

SEQ ID NO: 820820 - RNA, 22 nt, Human
ugaguuuuuucaacauaugaag

SEQ ID NO: 820821 - RNA, 22 nt, Human
agauggcagggguaccuggaag

SEQ ID NO: 820822 - RNA, 22 nt, Human
uucuucuugaaacuuuagguug

SEQ ID NO: 820823 - RNA, 22 nt, Human
aaagccauugaacuguacuuua

SEQ ID NO: 820824 - RNA, 18 nt, Human
aguaaagcuuauuacaug

SEQ ID NO: 820825 - RNA, 22 nt, Human
ucauuauuuuggacuggagugu

SEQ ID NO: 820826 - RNA, 22 nt, Human
ucuuugaacuuggcugaucucu

SEQ ID NO: 820827 - RNA, 23 nt, Human
cagaaaacccagagcucaguccc

SEQ ID NO: 820828 - RNA, 22 nt, Human
auuuaaaugcuuaagaggguuu

SEQ ID NO: 820829 - RNA, 22 nt, Human
caggauagaaaggccauggagu

SEQ ID NO: 820830 - RNA, 22 nt, Human
agugcuguuagguuaauauagu

SEQ ID NO: 820831 - RNA, 22 nt, Human
aggcagcaugggcccagagucc

SEQ ID NO: 820832 - RNA, 22 nt, Human
auucuuauuuaaauagagucug

SEQ ID NO: 820833 - RNA, 22 nt, Human
cagcugcaguucaaugcuugcu

SEQ ID NO: 820834 - RNA, 22 nt, Human
ugcaugcugcacacaugcguag

SEQ ID NO: 820835 - RNA, 22 nt, Human
uaaauuauggcuggcagagcag

SEQ ID NO: 820836 - RNA, 22 nt, Human
aggaaagguagcgugccagcag

SEQ ID NO: 820837 - RNA, 22 nt, Human
uuugaaauaugaggcauuauga

SEQ ID NO: 820838 - RNA, 22 nt, Human
gccaggagggaaaggacaauuu

SEQ ID NO: 820839 - RNA, 23 nt, Human
uagggcagcugggagggacaugc

SEQ ID NO: 820840 - RNA, 22 nt, Human
aggcagauuuaggagaaaagaa

SEQ ID NO: 820841 - RNA, 22 nt, Human
accaggaguugggggugggacc

SEQ ID NO: 820842 - RNA, 22 nt, Human
uuuggaauguaguuuaaucauc

SEQ ID NO: 820843 - RNA, 22 nt, Human
aaauguuuugcucccauguggu

SEQ ID NO: 820844 - RNA, 22 nt, Human
cuggcugggagcgagcugcuca

SEQ ID NO: 820845 - RNA, 22 nt, Human
auucuucacauaagugcuguac

SEQ ID NO: 820846 - RNA, 22 nt, Human
gggagagguuacccgagcaacu

SEQ ID NO: 820847 - RNA, 22 nt, Human
caggggaguuuuaugcaacaga

SEQ ID NO: 820848 - RNA, 22 nt, Human
cugcugugucagaguccagggg

SEQ ID NO: 820849 - RNA, 22 nt, Human
agaccaagugcaggugccacua

SEQ ID NO: 820850 - RNA, 22 nt, Human
aggaagcuccuggagagccagu

SEQ ID NO: 820851 - RNA, 17 nt, Human
agaacuguaguagcucc

SEQ ID NO: 820852 - RNA, 22 nt, Human
uuagaaagaacuuuagauauca

SEQ ID NO: 820853 - RNA, 22 nt, Human
cuuuuccacugagccucacaaa

SEQ ID NO: 820854 - RNA, 22 nt, Human
ccagaagaccccguccaccucc

SEQ ID NO: 820855 - RNA, 22 nt, Human
auaaaugauucagcaggaaaua

SEQ ID NO: 820856 - RNA, 22 nt, Human
gauuucuuuaugaaguacagaa

SEQ ID NO: 820857 - RNA, 22 nt, Human
uugauacaggcucuauuucauc

SEQ ID NO: 820858 - RNA, 22 nt, Human
agucucugggcaugguugugac

SEQ ID NO: 820859 - RNA, 22 nt, Human
ucuuugaauccuuuacaucuga

SEQ ID NO: 820860 - RNA, 20 nt, Human
cccaggagcugugccccauc

SEQ ID NO: 820861 - RNA, 22 nt, Human
cugcuguguuccuccugcaucu

SEQ ID NO: 820862 - RNA, 22 nt, Human
ucauuuguaccauuuuuuaaga

SEQ ID NO: 820863 - RNA, 22 nt, Human
aggcagcuuucagugucucuca

SEQ ID NO: 820864 - RNA, 22 nt, Human
uuuacuuuugguaaggucauuu

SEQ ID NO: 820865 - RNA, 22 nt, Human
uuugaaagggacaaagucacug

SEQ ID NO: 820866 - RNA, 22 nt, Human
gaucuucuagcagaaguaauuu

SEQ ID NO: 820867 - RNA, 22 nt, Human
cucccaggcacagggaggagcc

SEQ ID NO: 820868 - RNA, 22 nt, Human
uucuccaacacaagcaugaugu

SEQ ID NO: 820869 - RNA, 22 nt, Human
agugcuuugaacgaaaggcuga

SEQ ID NO: 820870 - RNA, 20 nt, Human
ucacuaguaaccaucugcuu

SEQ ID NO: 820871 - RNA, 23 nt, Human
uuuauccaacucuguaaucucuc

SEQ ID NO: 820872 - RNA, 23 nt, Human
gugagucuugccuuugcugugga

SEQ ID NO: 820873 - RNA, 22 nt, Human
aaaauacuguggaguguugaaa

SEQ ID NO: 820874 - RNA, 22 nt, Human
uggagaggaaagugcaguuuug

SEQ ID NO: 820875 - RNA, 22 nt, Human
uugaacauuggcaauuucauau

SEQ ID NO: 820876 - RNA, 22 nt, Human
acuugcauuauauuuaucacaa

SEQ ID NO: 820877 - RNA, 22 nt, Human
cccaggagaauauaauguucuu

SEQ ID NO: 820878 - RNA, 22 nt, Human
aaacauuugcaacucgguuugg

SEQ ID NO: 820879 - RNA, 22 nt, Human
guuuucugauuagcaaaucuga

SEQ ID NO: 820880 - RNA, 22 nt, Human
uugcucagcacuggagccagcu

SEQ ID NO: 820881 - RNA, 22 nt, Human
aacaugauggggaagaacaaga

SEQ ID NO: 820882 - RNA, 22 nt, Human
uguguucuggaaagcucacuga

SEQ ID NO: 820883 - RNA, 22 nt, Human
aauuuuaaucaguggugcugag

SEQ ID NO: 820884 - RNA, 22 nt, Human
guucuucaaagugacaacuaaa

SEQ ID NO: 820885 - RNA, 22 nt, Human
acacauuucuaaauuuuuaccg

SEQ ID NO: 820886 - RNA, 22 nt, Human
ucugucuccucugaggugccag

SEQ ID NO: 820887 - RNA, 20 nt, Human
auuuggcaugaaguauugau

SEQ ID NO: 820888 - RNA, 22 nt, Human
acuguugucaggcugcuuugga

SEQ ID NO: 820889 - RNA, 22 nt, Human
uucaggaugacaccauguccag

SEQ ID NO: 820890 - RNA, 22 nt, Human
uuggcaguaaaagaaaaugcuu

SEQ ID NO: 820891 - RNA, 22 nt, Human
ggagugggaacaaugacauggu

SEQ ID NO: 820892 - RNA, 22 nt, Human
gcaucuaaauaaacgugggagu

SEQ ID NO: 820893 - RNA, 22 nt, Human
aagcaccucuaugauugcuuuu

SEQ ID NO: 820894 - RNA, 22 nt, Human
agaggagguccuuuucugaugu

SEQ ID NO: 820895 - RNA, 22 nt, Human
aagaacuuccuaauauauuuuc

SEQ ID NO: 820896 - RNA, 22 nt, Human
auuggcagaaacagcagggcca

SEQ ID NO: 820897 - RNA, 22 nt, Human
cauuugcagagggugacacucu

SEQ ID NO: 820898 - RNA, 22 nt, Human
aauggccagcugggagaguuga

SEQ ID NO: 820899 - RNA, 22 nt, Human
aaggcaguacuuuauguccaua

SEQ ID NO: 820900 - RNA, 22 nt, Human
aggagaggcaucaagaaaaucg

SEQ ID NO: 820901 - RNA, 22 nt, Human
agauggaguuaguaccagaguc

SEQ ID NO: 820902 - RNA, 22 nt, Human
ugcuguggcaguuuauguauag

SEQ ID NO: 820903 - RNA, 22 nt, Human
aggucagcaugaguagaaggua

SEQ ID NO: 820904 - RNA, 21 nt, Human
cucaggauggcggccuggugg

SEQ ID NO: 820905 - RNA, 20 nt, Human
uuuacauuuugaaacaguga

SEQ ID NO: 820906 - RNA, 22 nt, Human
ggcagucuuaucagcauuggac

SEQ ID NO: 820907 - RNA, 20 nt, Human
ugaggcaggagaauggcaug

SEQ ID NO: 820908 - RNA, 22 nt, Human
uuccaugaaggagacugagaag

SEQ ID NO: 820909 - RNA, 22 nt, Human
acuugcugguggcauuuacagu

SEQ ID NO: 820910 - RNA, 22 nt, Human
gcccaggaucugcucagaucau

SEQ ID NO: 820911 - RNA, 22 nt, Human
uuuuuaguagagguggguuuca

SEQ ID NO: 820912 - RNA, 22 nt, Human
cauuuguuggucagauuguagu

SEQ ID NO: 820913 - RNA, 22 nt, Human
cugacagucucauugauuugcu

SEQ ID NO: 820914 - RNA, 22 nt, Human
uaucuguuguaguacagaugau

SEQ ID NO: 820915 - RNA, 22 nt, Human
uggcuguguuaccacuucaugu

SEQ ID NO: 820916 - RNA, 22 nt, Human
cccuggaggucagaggccuggg

SEQ ID NO: 820917 - RNA, 19 nt, Human
aggcagcaggccagggaug

SEQ ID NO: 820918 - RNA, 22 nt, Human
cuggaggcacccuuagagaggc

SEQ ID NO: 820919 - RNA, 22 nt, Human
ugaggcaggaguucaggcugcg

SEQ ID NO: 820920 - RNA, 21 nt, Human
aggcagcucaggcccagagag

SEQ ID NO: 820921 - RNA, 21 nt, Human
ggacagcugcgcgcagggcuc

SEQ ID NO: 820922 - RNA, 22 nt, Human
gaacuguaguuaauacuacaca

SEQ ID NO: 820923 - RNA, 22 nt, Human
cgaggcagacaaaaguuggaag

SEQ ID NO: 820924 - RNA, 22 nt, Human
uccaggagaggccugaccaggu

SEQ ID NO: 820925 - RNA, 22 nt, Human
agaggccaggcugcagagggau

SEQ ID NO: 820926 - RNA, 22 nt, Human
gcagaagucagaccaucugaau

SEQ ID NO: 820927 - RNA, 19 nt, Human
agaaguuagacauugcaau

SEQ ID NO: 820928 - RNA, 23 nt, Human
agacaguggccgagagguacuag

SEQ ID NO: 820929 - RNA, 22 nt, Human
uucuucaacaaggacacuguua

SEQ ID NO: 820930 - RNA, 22 nt, Human
gauggcagcagcagccagggau

SEQ ID NO: 820931 - RNA, 21 nt, Human
uucugggaaaugagcuggggc

SEQ ID NO: 820932 - RNA, 22 nt, Human
ugcuucuggaaacaguggcugu

SEQ ID NO: 820933 - RNA, 22 nt, Human
acccaggacucucuuccaguag

SEQ ID NO: 820934 - RNA, 22 nt, Human
uauugaugcuuggauugggcca

SEQ ID NO: 820935 - RNA, 22 nt, Human
ggugaagggccuuaggagacag

SEQ ID NO: 820936 - RNA, 22 nt, Human
aacaugcucuguuucuuggaug

SEQ ID NO: 820937 - RNA, 22 nt, Human
aaauauagugacacuuauaguc

SEQ ID NO: 820938 - RNA, 22 nt, Human
agagugcaaccgaaacaagcag

SEQ ID NO: 820939 - RNA, 22 nt, Human
gaggacaggagacucacuguuu

SEQ ID NO: 820940 - RNA, 22 nt, Human
uggcagcugucagaaugcaaau

SEQ ID NO: 820941 - RNA, 19 nt, Human
ucuuucauuucuagcucug

SEQ ID NO: 820942 - RNA, 20 nt, Human
gggcagcuccccucauucug

SEQ ID NO: 820943 - RNA, 22 nt, Human
ugaggcaggacauggacaacug

SEQ ID NO: 820944 - RNA, 22 nt, Human
uuaaauuagucaagcuucucug

SEQ ID NO: 820945 - RNA, 22 nt, Human
gaagcagcuggugagauggagc

SEQ ID NO: 820946 - RNA, 21 nt, Human
agccuguugguuuacugcuca

SEQ ID NO: 820947 - RNA, 22 nt, Human
ugcugaaauuagaacauugagg

SEQ ID NO: 820948 - RNA, 22 nt, Human
uuauuugcccauguuuagcaga

SEQ ID NO: 820949 - RNA, 22 nt, Human
ggcucagacucccaggcccucu

SEQ ID NO: 820950 - RNA, 22 nt, Human
cccagcaggaggagguugcagu

SEQ ID NO: 820951 - RNA, 22 nt, Human
ugcauaguucuccuuccuccuc

SEQ ID NO: 820952 - RNA, 22 nt, Human
cagggagggaggaaaauuugcu

SEQ ID NO: 820953 - RNA, 22 nt, Human
ucauuuauaaggaugcaauuaa

SEQ ID NO: 820954 - RNA, 22 nt, Human
aaggagaguacaggaguuggua

SEQ ID NO: 820955 - RNA, 22 nt, Human
auuuccauagagcgucucacag

SEQ ID NO: 820956 - RNA, 22 nt, Human
acauuuaaauaccuauguuucu

SEQ ID NO: 820957 - RNA, 22 nt, Human
agugagaguauuaaugugaacu

SEQ ID NO: 820958 - RNA, 22 nt, Human
uaaggccagccagcaaaucugu

SEQ ID NO: 820959 - RNA, 22 nt, Human
cauuuguacagaacagcuuuau

SEQ ID NO: 820960 - RNA, 22 nt, Human
aggagggagcuuaagccaggca

SEQ ID NO: 820961 - RNA, 22 nt, Human
augauguuaccaguacuuagag

SEQ ID NO: 820962 - RNA, 22 nt, Human
aacauucuauuuugcuaaaaca

SEQ ID NO: 820963 - RNA, 22 nt, Human
uggaaggagacugggaagugug

SEQ ID NO: 820964 - RNA, 22 nt, Human
cagacaggaauucuggcguggu

SEQ ID NO: 820965 - RNA, 22 nt, Human
agcagccuuugaucaucuggga

SEQ ID NO: 820966 - RNA, 22 nt, Human
uugaacuguaagcaugucugcc

SEQ ID NO: 820967 - RNA, 21 nt, Human
ggcagcguguggacaggaagg

SEQ ID NO: 820968 - RNA, 22 nt, Human
ugaaggcccagccacagaaugg

SEQ ID NO: 820969 - RNA, 22 nt, Human
ucucugaguauccugaacugcc

SEQ ID NO: 820970 - RNA, 22 nt, Human
ggauguugauugaauggccauu

SEQ ID NO: 820971 - RNA, 22 nt, Human
caguuucuuggaugccaauuuc

SEQ ID NO: 820972 - RNA, 22 nt, Human
uugcugaagugaagguauguuu

SEQ ID NO: 820973 - RNA, 22 nt, Human
uuccaugacaccgagggaaguc

SEQ ID NO: 820974 - RNA, 22 nt, Human
agaggcaggaagagcugauuuu

SEQ ID NO: 820975 - RNA, 22 nt, Human
gugcugugugauccaugcuggc

SEQ ID NO: 820976 - RNA, 23 nt, Human
uugcauagacauccucauagauu

SEQ ID NO: 820977 - RNA, 22 nt, Human
ucccaggacaggccacauggaa

SEQ ID NO: 820978 - RNA, 22 nt, Human
uuucaguuacugcuauaucauu

SEQ ID NO: 820979 - RNA, 22 nt, Human
aaggcaguuaauuuggcuagaa

SEQ ID NO: 820980 - RNA, 22 nt, Human
auuucucuuagcaagacauuac

SEQ ID NO: 820981 - RNA, 22 nt, Human
uuaacaauagaguuucuucagg

SEQ ID NO: 820982 - RNA, 20 nt, Human
ccagaagagaugaucaucca

SEQ ID NO: 820983 - RNA, 22 nt, Human
cugcccaggaaggagaggaugg

SEQ ID NO: 820984 - RNA, 22 nt, Human
cacaaaugugcagaaaugugag

SEQ ID NO: 820985 - RNA, 22 nt, Human
cuguaguugaugauuucugaua

SEQ ID NO: 820986 - RNA, 17 nt, Human
cauuuguugaucaguug

SEQ ID NO: 820987 - RNA, 22 nt, Human
cccaggaggguggccucugccc

SEQ ID NO: 820988 - RNA, 22 nt, Human
gugcauuugacgaauacucacu

SEQ ID NO: 820989 - RNA, 23 nt, Human
agggugagcaagcuauggagacc

SEQ ID NO: 820990 - RNA, 22 nt, Human
uuuugugagcccauaaaugcca

SEQ ID NO: 820991 - RNA, 22 nt, Human
ccaagaugaucuuuacaguguu

SEQ ID NO: 820992 - RNA, 22 nt, Human
auacaacuuuaucuguaaugag

SEQ ID NO: 820993 - RNA, 22 nt, Human
gccagagguucaacaacugucu

SEQ ID NO: 820994 - RNA, 23 nt, Human
uacaugcuauaauuucacccuca

SEQ ID NO: 820995 - RNA, 22 nt, Human
augcuguguggccaccuccaug

SEQ ID NO: 820996 - RNA, 22 nt, Human
ugcccaggauugugaggucagg

SEQ ID NO: 820997 - RNA, 22 nt, Human
ugcugcuguauccuuaguguca

SEQ ID NO: 820998 - RNA, 22 nt, Human
gugguuuugccauuacaaguaa

SEQ ID NO: 820999 - RNA, 22 nt, Human
aaggcagccucugccagccggg

SEQ ID NO: 821000 - RNA, 22 nt, Human
uccugucuaaagaccugcaggc

SEQ ID NO: 821001 - RNA, 22 nt, Human
ugaggcaggaauggggaaaagu

SEQ ID NO: 821002 - RNA, 22 nt, Human
uuuccuaguucuaagaaaugua

SEQ ID NO: 821003 - RNA, 19 nt, Human
uccucagugacaaccucag

SEQ ID NO: 821004 - RNA, 22 nt, Human
uaaaacuuaacuauccagauua

SEQ ID NO: 821005 - RNA, 22 nt, Human
acuggcaggcugcuggccggcg

SEQ ID NO: 821006 - RNA, 18 nt, Human
acugugugaauuagcucc

SEQ ID NO: 821007 - RNA, 19 nt, Human
agccuggcuuugcucugcu

SEQ ID NO: 821008 - RNA, 22 nt, Human
cacugagcugauagaauuccag

SEQ ID NO: 821009 - RNA, 22 nt, Human
ugguaaauauguccauucucuu

SEQ ID NO: 821010 - RNA, 22 nt, Human
gcugaaauucagauuccuaggc

SEQ ID NO: 821011 - RNA, 22 nt, Human
cuuaacagagagaaguguugcu

SEQ ID NO: 821012 - RNA, 22 nt, Human
gcaaauauucaagacuuuucca

SEQ ID NO: 821013 - RNA, 19 nt, Human
uggcaucuguaaaauggug

SEQ ID NO: 821014 - RNA, 22 nt, Human
gaaggaggcguuagcccuagga

SEQ ID NO: 821015 - RNA, 22 nt, Human
cucaggauuuaaaggggcacuc

SEQ ID NO: 821016 - RNA, 22 nt, Human
gcuccucugucaaaugagagug

SEQ ID NO: 821017 - RNA, 22 nt, Human
ucccaggaaaacacucgaggac

SEQ ID NO: 821018 - RNA, 19 nt, Human
aaggcagcaguagcaucca

SEQ ID NO: 821019 - RNA, 22 nt, Human
aaggcaguuugggccaccaucu

SEQ ID NO: 821020 - RNA, 22 nt, Human
cuugcugggguaagucugugcu

SEQ ID NO: 821021 - RNA, 22 nt, Human
caggcagcguccugcuuccugu

SEQ ID NO: 821022 - RNA, 22 nt, Human
agauggagaccuuggaugaacu

SEQ ID NO: 821023 - RNA, 22 nt, Human
agggcagcucucaccucuggcc

SEQ ID NO: 821024 - RNA, 22 nt, Human
cugacccauauaagaguggagg

SEQ ID NO: 821025 - RNA, 17 nt, Human
agcugaaauugcugaag

SEQ ID NO: 821026 - RNA, 22 nt, Human
agcccagguucuaaagccaaac

SEQ ID NO: 821027 - RNA, 22 nt, Human
acaacauucuuaaauacacuga

SEQ ID NO: 821028 - RNA, 22 nt, Human
uucauucugcaguucucagcuc

SEQ ID NO: 821029 - RNA, 22 nt, Human
gcucaggaucccaggggugugc

SEQ ID NO: 821030 - RNA, 22 nt, Human
auuucagauucagaaauguagg

SEQ ID NO: 821031 - RNA, 22 nt, Human
uuaaauauuauguugucugcaa

SEQ ID NO: 821032 - RNA, 22 nt, Human
gaucuguuucauucacagucug

SEQ ID NO: 821033 - RNA, 22 nt, Human
ggaggacaggggcugcagcaca

SEQ ID NO: 821034 - RNA, 22 nt, Human
uuuuuauaugaaggauagugcg

SEQ ID NO: 821035 - RNA, 22 nt, Human
ggagcagggcagugaauucugg

SEQ ID NO: 821036 - RNA, 22 nt, Human
augaaggcuguguagauggaug

SEQ ID NO: 821037 - RNA, 22 nt, Human
acagucuugagcaucagccaga

SEQ ID NO: 821038 - RNA, 22 nt, Human
agacccagaaagcagcugcauu

SEQ ID NO: 821039 - RNA, 22 nt, Human
caagauggagaagcagcaaggg

SEQ ID NO: 821040 - RNA, 22 nt, Human
cagagggcacaugguuuccuca

SEQ ID NO: 821041 - RNA, 22 nt, Human
aauggccagcaacaggagugaa

SEQ ID NO: 821042 - RNA, 22 nt, Human
gaagcagcgaaguggaagggac

SEQ ID NO: 821043 - RNA, 20 nt, Human
agcauuugaaauaugacuau

SEQ ID NO: 821044 - RNA, 18 nt, Human
cugcugugucgucugggc

SEQ ID NO: 821045 - RNA, 22 nt, Human
uugcauuugagaaaguucuccu

SEQ ID NO: 821046 - RNA, 22 nt, Human
auuggcaggaaccgaggagggg

SEQ ID NO: 821047 - RNA, 22 nt, Human
aaaggugacugcagcagcuauu

SEQ ID NO: 821048 - RNA, 22 nt, Human
auacacauauguguguauaugu

SEQ ID NO: 821049 - RNA, 22 nt, Human
cucccagggucuaggcugcugg

SEQ ID NO: 821050 - RNA, 22 nt, Human
uuaaauauuuucagcaggguca

SEQ ID NO: 821051 - RNA, 22 nt, Human
aaggcagcuuuaaaaaagaugc

SEQ ID NO: 821052 - RNA, 22 nt, Human
uuggaaagcaagcuggacauac

SEQ ID NO: 821053 - RNA, 22 nt, Human
uauagccauuuccaguggcauc

SEQ ID NO: 821054 - RNA, 22 nt, Human
ugucucaguacacuccgauguu

SEQ ID NO: 821055 - RNA, 22 nt, Human
gucuuuaugguaugaaaacuga

SEQ ID NO: 821056 - RNA, 20 nt, Human
caggaugauuggacacgaug

SEQ ID NO: 821057 - RNA, 22 nt, Human
uucagaaugugaccuuauuugg

SEQ ID NO: 821058 - RNA, 22 nt, Human
cccuugcaucccauguguggcc

SEQ ID NO: 821059 - RNA, 21 nt, Human
cagcagaguaaugcauucgua

SEQ ID NO: 821060 - RNA, 22 nt, Human
uuuaagauucaguaaggcaaac

SEQ ID NO: 821061 - RNA, 21 nt, Human
uucuucaaagaagaaggcaca

SEQ ID NO: 821062 - RNA, 22 nt, Human
uuugaaaguccuaggagagucc

SEQ ID NO: 821063 - RNA, 19 nt, Human
caggaaggggcgaaucugg

SEQ ID NO: 821064 - RNA, 21 nt, Human
gggugggaggacacagcaggc

SEQ ID NO: 821065 - RNA, 22 nt, Human
cugcuguguggugaaacucagu

SEQ ID NO: 821066 - RNA, 22 nt, Human
agggcagcccuucugggagggc

SEQ ID NO: 821067 - RNA, 22 nt, Human
aagauuauggcagauaacaauu

SEQ ID NO: 821068 - RNA, 22 nt, Human
uccucagacuucccuuugugua

SEQ ID NO: 821069 - RNA, 22 nt, Human
acacaaguucuaaagauugcgc

SEQ ID NO: 821070 - RNA, 22 nt, Human
cucugcaugccuugcucagaca

SEQ ID NO: 821071 - RNA, 21 nt, Human
uccaggaguucuaauaggugu

SEQ ID NO: 821072 - RNA, 22 nt, Human
uccaggaguggggcagaggucu

SEQ ID NO: 821073 - RNA, 22 nt, Human
cucaggaucgcuugcccuaggg

SEQ ID NO: 821074 - RNA, 22 nt, Human
cccaggaagagugaguggcauu

SEQ ID NO: 821075 - RNA, 22 nt, Human
caaaugauaccuauuacuaggc

SEQ ID NO: 821076 - RNA, 22 nt, Human
aaauuauuaugccccucuauaa

SEQ ID NO: 821077 - RNA, 22 nt, Human
ucucuucuaauuaggguccaug

SEQ ID NO: 821078 - RNA, 22 nt, Human
ugaggcagcaauuguauuguau

SEQ ID NO: 821079 - RNA, 22 nt, Human
auuugcaaagucguaucuguga

SEQ ID NO: 821080 - RNA, 22 nt, Human
caggguggcacucagcgcaucu

SEQ ID NO: 821081 - RNA, 22 nt, Human
auuaaaauuccaagguaugcca

SEQ ID NO: 821082 - RNA, 22 nt, Human
aaagauaauguuuccuuauucu

SEQ ID NO: 821083 - RNA, 22 nt, Human
uccaggagguugagugaguucc

SEQ ID NO: 821084 - RNA, 22 nt, Human
cucagagaggcaguggaaguca

SEQ ID NO: 821085 - RNA, 22 nt, Human
gaggaacccagcugggguugcc

SEQ ID NO: 821086 - RNA, 22 nt, Human
agucucugcaugccugcugugc

SEQ ID NO: 821087 - RNA, 22 nt, Human
ccaggacagugaacauguaaga

SEQ ID NO: 821088 - RNA, 22 nt, Human
gcuggcaggagccuuucccuuu

SEQ ID NO: 821089 - RNA, 18 nt, Human
ugaauagggguuugcaga

SEQ ID NO: 821090 - RNA, 22 nt, Human
uccaugagaacccuuggagaua

SEQ ID NO: 821091 - RNA, 22 nt, Human
augaggcaucugcagucacuag

SEQ ID NO: 821092 - RNA, 22 nt, Human
uguugaagauaaaguucucauu

SEQ ID NO: 821093 - RNA, 18 nt, Human
uggcagcaggaagccauu

SEQ ID NO: 821094 - RNA, 22 nt, Human
uaaggccaggcuguggucggca

SEQ ID NO: 821095 - RNA, 22 nt, Human
uccaggagacacccuugugugu

SEQ ID NO: 821096 - RNA, 22 nt, Human
aggcuagcuuuggcucaguaaa

SEQ ID NO: 821097 - RNA, 22 nt, Human
gaggggaagacuucuggacagu

SEQ ID NO: 821098 - RNA, 22 nt, Human
aggaagcuaaccagggagugag

SEQ ID NO: 821099 - RNA, 22 nt, Human
gauggcaggcaggugaguagag

SEQ ID NO: 821100 - RNA, 22 nt, Human
uuauucuucuucucuugccagg

SEQ ID NO: 821101 - RNA, 22 nt, Human
ugaggcaggagaaucacaugaa

SEQ ID NO: 821102 - RNA, 23 nt, Human
cuugcaggaagcagauggcacac

SEQ ID NO: 821103 - RNA, 22 nt, Human
agugcuuuagcauccaacuguc

SEQ ID NO: 821104 - RNA, 16 nt, Human
aggaggggaauuagga

SEQ ID NO: 821105 - RNA, 22 nt, Human
gugauuuucuccuccuagaagu

SEQ ID NO: 821106 - RNA, 22 nt, Human
gcuguggucugugagcuccaaa

SEQ ID NO: 821107 - RNA, 22 nt, Human
uuugcauaaaggagcauuucuc

SEQ ID NO: 821108 - RNA, 22 nt, Human
caaauacuggguaaguuaauuu

SEQ ID NO: 821109 - RNA, 22 nt, Human
aagacauugucauuuuauaauu

SEQ ID NO: 821110 - RNA, 22 nt, Human
cccuguacagucucuguggcac

SEQ ID NO: 821111 - RNA, 23 nt, Human
aaugauuucaugaugauagcagc

SEQ ID NO: 821112 - RNA, 22 nt, Human
ggaggugggauuaggaccuaaa

SEQ ID NO: 821113 - RNA, 20 nt, Human
gcagcuacucugucucgcuc

SEQ ID NO: 821114 - RNA, 22 nt, Human
aauauaaugcuguuuuaugcca

SEQ ID NO: 821115 - RNA, 22 nt, Human
uuuaaauggcauuuucccagau

SEQ ID NO: 821116 - RNA, 22 nt, Human
cagcucugaggaacacuccuuu

SEQ ID NO: 821117 - RNA, 22 nt, Human
cucuucuugccugaugaggcag

SEQ ID NO: 821118 - RNA, 22 nt, Human
caggaugagguagaggcagaua

SEQ ID NO: 821119 - RNA, 22 nt, Human
aagauauucaaagauuuauuag

SEQ ID NO: 821120 - RNA, 22 nt, Human
caggaggaagaacucugcaaca

SEQ ID NO: 821121 - RNA, 22 nt, Human
aggccagacagcuagaaacagg

SEQ ID NO: 821122 - RNA, 22 nt, Human
cagaggcaggauaagaacugcg

SEQ ID NO: 821123 - RNA, 22 nt, Human
cccaggagaccuagaucuguuu

SEQ ID NO: 821124 - RNA, 22 nt, Human
auucuucagcaggggacacuau

SEQ ID NO: 821125 - RNA, 22 nt, Human
ucugcugugggucuauauuuua

SEQ ID NO: 821126 - RNA, 22 nt, Human
aucugcaggaaugugugcagag

SEQ ID NO: 821127 - RNA, 22 nt, Human
aauuuccaaauuucugucacac

SEQ ID NO: 821128 - RNA, 22 nt, Human
acagaauugaaaguauaaucug

SEQ ID NO: 821129 - RNA, 22 nt, Human
ugaaggccucugguacaugcca

SEQ ID NO: 821130 - RNA, 22 nt, Human
ggcagcacugcagcuuguuggg

SEQ ID NO: 821131 - RNA, 22 nt, Human
agaccuggauuccaauccuacc

SEQ ID NO: 821132 - RNA, 22 nt, Human
uugaaaggaauacagaggccua

SEQ ID NO: 821133 - RNA, 22 nt, Human
uucuacagacuauaacugugau

SEQ ID NO: 821134 - RNA, 22 nt, Human
cuagccugggauuugaacuuau

SEQ ID NO: 821135 - RNA, 23 nt, Human
acauacauggagauaaagugaug

SEQ ID NO: 821136 - RNA, 22 nt, Human
cuucagaggggacucaaaguca

SEQ ID NO: 821137 - RNA, 22 nt, Human
ggaagaggaggagccaggcuuu

SEQ ID NO: 821138 - RNA, 19 nt, Human
ugaggggcucacagucuca

SEQ ID NO: 821139 - RNA, 22 nt, Human
augcugagcagagcugacaugc

SEQ ID NO: 821140 - RNA, 22 nt, Human
agugcuuucuugcuccaucagu

SEQ ID NO: 821141 - RNA, 20 nt, Human
uacagaaugcaauaaaaugg

SEQ ID NO: 821142 - RNA, 22 nt, Human
uucaugugauaaaugugugacu

SEQ ID NO: 821143 - RNA, 22 nt, Human
gcacaauuauuuaugcaguaug

SEQ ID NO: 821144 - RNA, 22 nt, Human
cccaggaguaagugacauuguu

SEQ ID NO: 821145 - RNA, 22 nt, Human
ugagauguaagguaugcuuacu

SEQ ID NO: 821146 - RNA, 22 nt, Human
ugaggcagggagaguggauaug

SEQ ID NO: 821147 - RNA, 22 nt, Human
caggaugggauguagugggccc

SEQ ID NO: 821148 - RNA, 22 nt, Human
uuccuuaggcuguuugcagugc

SEQ ID NO: 821149 - RNA, 22 nt, Human
ucuuuccauggccacacagucu

SEQ ID NO: 821150 - RNA, 22 nt, Human
aucacaaaggcugcuucaugau

SEQ ID NO: 821151 - RNA, 22 nt, Human
agaggucagauuucuccuggug

SEQ ID NO: 821152 - RNA, 22 nt, Human
uguuuucagucauauagcaggu

SEQ ID NO: 821153 - RNA, 19 nt, Human
uuugaaagaguuuuauugg

SEQ ID NO: 821154 - RNA, 20 nt, Human
cugcugugugugccucagcc

SEQ ID NO: 821155 - RNA, 22 nt, Human
gaggcaguguugaaaaggagag

SEQ ID NO: 821156 - RNA, 22 nt, Human
ucuacccagagcuaugaccuga

SEQ ID NO: 821157 - RNA, 22 nt, Human
uagagcugggcagugcucugag

SEQ ID NO: 821158 - RNA, 22 nt, Human
aagccgaggccacacagcagga

SEQ ID NO: 821159 - RNA, 21 nt, Human
acaggagaccgccuggcaguc

SEQ ID NO: 821160 - RNA, 22 nt, Human
cacaauguauauguauaucaaa

SEQ ID NO: 821161 - RNA, 22 nt, Human
uuagccauugucagcacauggc

SEQ ID NO: 821162 - RNA, 20 nt, Human
guaaaauauggucuuugggu

SEQ ID NO: 821163 - RNA, 22 nt, Human
ugaggggagcuagcaugccuug

SEQ ID NO: 821164 - RNA, 22 nt, Human
cuccaugaauuugagcuuugug

SEQ ID NO: 821165 - RNA, 22 nt, Human
aggcagagcuggguuuugaaau

SEQ ID NO: 821166 - RNA, 22 nt, Human
uguguuauugccacugaagacc

SEQ ID NO: 821167 - RNA, 21 nt, Human
uucucagaucgaguagugaga

SEQ ID NO: 821168 - RNA, 22 nt, Human
gagagcaggaggcagcgggacg

SEQ ID NO: 821169 - RNA, 22 nt, Human
auugaaagguuuugagcagaua

SEQ ID NO: 821170 - RNA, 22 nt, Human
gcuuuggagccuguguucugcc

SEQ ID NO: 821171 - RNA, 22 nt, Human
ucugcagguguuggaaggguca

SEQ ID NO: 821172 - RNA, 22 nt, Human
aggaggggcaaugauagucugg

SEQ ID NO: 821173 - RNA, 23 nt, Human
aguaaagcaauuguuggcgagag

SEQ ID NO: 821174 - RNA, 22 nt, Human
caucaucaaaacaaauggaguc

SEQ ID NO: 821175 - RNA, 22 nt, Human
acagcauugcuccaucucaaga

SEQ ID NO: 821176 - RNA, 22 nt, Human
ucuugcuaaagaccaacacauu

SEQ ID NO: 821177 - RNA, 22 nt, Human
gcaggagaacaaagcaagcugc

SEQ ID NO: 821178 - RNA, 22 nt, Human
gagggaggugauacugaacgua

SEQ ID NO: 821179 - RNA, 22 nt, Human
guuguuuuuguucucuauagcu

SEQ ID NO: 821180 - RNA, 22 nt, Human
aacaguaaagacagaauuuauc

SEQ ID NO: 821181 - RNA, 22 nt, Human
ugaggggaaggcaugauaaaua

SEQ ID NO: 821182 - RNA, 22 nt, Human
gucaggauuugaacucaggucu

SEQ ID NO: 821183 - RNA, 22 nt, Human
aagacaauuugauacuaguugc

SEQ ID NO: 821184 - RNA, 21 nt, Human
uuucacaaaaguaugugacaa

SEQ ID NO: 821185 - RNA, 22 nt, Human
ucaccgccuugcccggccgggc

SEQ ID NO: 821186 - RNA, 22 nt, Human
uuugcacuagcauuuguccaug

SEQ ID NO: 821187 - RNA, 22 nt, Human
cugcuguguuggcauuggauag

SEQ ID NO: 821188 - RNA, 22 nt, Human
guucuucagucacaucacagaa

SEQ ID NO: 821189 - RNA, 22 nt, Human
cugcugugcagacagacucucu

SEQ ID NO: 821190 - RNA, 22 nt, Human
cuucucagaggccagaagcuau

SEQ ID NO: 821191 - RNA, 22 nt, Human
gagggccagcagccucagcaug

SEQ ID NO: 821192 - RNA, 20 nt, Human
gggcaguucaaugccacucu

SEQ ID NO: 821193 - RNA, 22 nt, Human
ugggagcccaagggagcugccg

SEQ ID NO: 821194 - RNA, 22 nt, Human
ucuucagauaaagggagaguau

SEQ ID NO: 821195 - RNA, 22 nt, Human
cccucuacagggaagcgcuuuc

SEQ ID NO: 821196 - RNA, 22 nt, Human
ucgagcucuggagccaaggaug

SEQ ID NO: 821197 - RNA, 22 nt, Human
caaggccauauugccuguaugu

SEQ ID NO: 821198 - RNA, 22 nt, Human
uuuauuguuaucaugggugagu

SEQ ID NO: 821199 - RNA, 17 nt, Human
cccacggaggugugaaa

SEQ ID NO: 821200 - RNA, 22 nt, Human
augcugugucaccuuaggauuu

SEQ ID NO: 821201 - RNA, 21 nt, Human
cugcuguggcccccgacaugc

SEQ ID NO: 821202 - RNA, 22 nt, Human
ucucuuucuauaugugagucuu

SEQ ID NO: 821203 - RNA, 22 nt, Human
cuuaagaugaggucaugcuaua

SEQ ID NO: 821204 - RNA, 19 nt, Human
uguguguuuauauauguau

SEQ ID NO: 821205 - RNA, 22 nt, Human
uuugacaugcaaagcacuuuag

SEQ ID NO: 821206 - RNA, 22 nt, Human
aaggcaguaggaucuuccacag

SEQ ID NO: 821207 - RNA, 22 nt, Human
uucugaaccauugagcacugcc

SEQ ID NO: 821208 - RNA, 18 nt, Human
ucuuccaacacugacacc

SEQ ID NO: 821209 - RNA, 22 nt, Human
gcagaggagcaaguugcuacag

SEQ ID NO: 821210 - RNA, 17 nt, Human
aggcagcucagaacauc

SEQ ID NO: 821211 - RNA, 22 nt, Human
gcccaggaguugguggcugcag

SEQ ID NO: 821212 - RNA, 23 nt, Human
agaggggagcaucugcuggcuga

SEQ ID NO: 821213 - RNA, 22 nt, Human
uagcacauuguugaccagaagg

SEQ ID NO: 821214 - RNA, 22 nt, Human
uugcacuaggaaaaggcagcca

SEQ ID NO: 821215 - RNA, 22 nt, Human
uguucucacuggaugcuucaca

SEQ ID NO: 821216 - RNA, 22 nt, Human
cacauauuugaugaagcuuugu

SEQ ID NO: 821217 - RNA, 23 nt, Human
aucauucuccaaucuggagcagg

SEQ ID NO: 821218 - RNA, 22 nt, Human
uucuucaaacaaaaguggcaug

SEQ ID NO: 821219 - RNA, 22 nt, Human
ucugucucaaguucuugcacuc

SEQ ID NO: 821220 - RNA, 20 nt, Human
gaagcagcuucauguagaca

SEQ ID NO: 821221 - RNA, 22 nt, Human
aauccugugugacucuggggag

SEQ ID NO: 821222 - RNA, 22 nt, Human
auugaaagaguuuucugcugca

SEQ ID NO: 821223 - RNA, 22 nt, Human
cuugaacucaaugugaggaaga

SEQ ID NO: 821224 - RNA, 22 nt, Human
uaucuaaaggauuuaauuuagu

SEQ ID NO: 821225 - RNA, 19 nt, Human
ugaaauggcaguugcuaaa

SEQ ID NO: 821226 - RNA, 22 nt, Human
uuucaguuuccagcuuugucau

SEQ ID NO: 821227 - RNA, 22 nt, Human
uaugaacuuuugaugugacaug

SEQ ID NO: 821228 - RNA, 22 nt, Human
auugucuuuccacugagaaguu

SEQ ID NO: 821229 - RNA, 22 nt, Human
cagucucucugaaguauuaaga

SEQ ID NO: 821230 - RNA, 22 nt, Human
uagaaaugaauguuuaaaaguc

SEQ ID NO: 821231 - RNA, 22 nt, Human
aguggcaggcggagauguagga

SEQ ID NO: 821232 - RNA, 22 nt, Human
gaaggccaguuuugagauaggu

SEQ ID NO: 821233 - RNA, 22 nt, Human
uggaggggcaauggagcgcgga

SEQ ID NO: 821234 - RNA, 22 nt, Human
auguuuccauuuucuuguauca

SEQ ID NO: 821235 - RNA, 22 nt, Human
cagcugugaauugucuuaucua

SEQ ID NO: 821236 - RNA, 22 nt, Human
ucagagagugcaaaauauagcu

SEQ ID NO: 821237 - RNA, 22 nt, Human
guaggcagugguuggaagagaa

SEQ ID NO: 821238 - RNA, 20 nt, Human
ugaaggccagcagcauaggg

SEQ ID NO: 821239 - RNA, 22 nt, Human
caggcagcucgaugccuuguug

SEQ ID NO: 821240 - RNA, 22 nt, Human
uguagaaagaauauguuucaua

SEQ ID NO: 821241 - RNA, 22 nt, Human
agaaggggagaagcuaccagga

SEQ ID NO: 821242 - RNA, 22 nt, Human
agaggggaggcgaaccagaguc

SEQ ID NO: 821243 - RNA, 17 nt, Human
ucccaggaacagggaau

SEQ ID NO: 821244 - RNA, 22 nt, Human
ucacaguaaaagcauggaagag

SEQ ID NO: 821245 - RNA, 22 nt, Human
cccaggaggcagagguugcagu

SEQ ID NO: 821246 - RNA, 22 nt, Human
ucaggaugaccacgagccucua

SEQ ID NO: 821247 - RNA, 22 nt, Human
ggcagcuggggcagugcccugu

SEQ ID NO: 821248 - RNA, 22 nt, Human
ggaggcugagaaguccaagauc

SEQ ID NO: 821249 - RNA, 22 nt, Human
uccaggagaaggccauccagcg

SEQ ID NO: 821250 - RNA, 22 nt, Human
aucugccugagucuagguuuuc

SEQ ID NO: 821251 - RNA, 22 nt, Human
gccaggaguguguggcuauguu

SEQ ID NO: 821252 - RNA, 18 nt, Human
ugaggcagucagugaugg

SEQ ID NO: 821253 - RNA, 22 nt, Human
uggcaaggccacaggugcaguu

SEQ ID NO: 821254 - RNA, 22 nt, Human
cagggaggcugucuuaugccug

SEQ ID NO: 821255 - RNA, 22 nt, Human
ggcaagaaggcuucagguagcu

SEQ ID NO: 821256 - RNA, 19 nt, Human
gaggagcuaucggagacag

SEQ ID NO: 821257 - RNA, 22 nt, Human
gcaugucaugucauguaggaau

SEQ ID NO: 821258 - RNA, 22 nt, Human
cauuuucagcacccaucugaaa

SEQ ID NO: 821259 - RNA, 22 nt, Human
cuguauuuguccucuauuuauu

SEQ ID NO: 821260 - RNA, 22 nt, Human
aucuucucaagcagcauccugu

SEQ ID NO: 821261 - RNA, 22 nt, Human
cugcugugcaacauugcaccua

SEQ ID NO: 821262 - RNA, 22 nt, Human
gcugcugugccuggcguccugu

SEQ ID NO: 821263 - RNA, 23 nt, Human
ucucaggacacacaugucuauca

SEQ ID NO: 821264 - RNA, 22 nt, Human
uuugaaagaauuuauguacuuu

SEQ ID NO: 821265 - RNA, 22 nt, Human
gcagcugccuucagcuggaugg

SEQ ID NO: 821266 - RNA, 22 nt, Human
ugucccucugaggcuucccugg

SEQ ID NO: 821267 - RNA, 22 nt, Human
cauauaaauacaacauguguua

SEQ ID NO: 821268 - RNA, 22 nt, Human
acugugugacuguuauuacugu

SEQ ID NO: 821269 - RNA, 22 nt, Human
gccaucacauccaggcuaccuc

SEQ ID NO: 821270 - RNA, 22 nt, Human
agguccagcuguugcagccucc

SEQ ID NO: 821271 - RNA, 22 nt, Human
agcuggcaguaugacuggugac

SEQ ID NO: 821272 - RNA, 22 nt, Human
ugaggcagcuuuuucugugugu

SEQ ID NO: 821273 - RNA, 17 nt, Human
ggcagccucaggcguuu

SEQ ID NO: 821274 - RNA, 22 nt, Human
ggcagcugcaaaucugcucugu

SEQ ID NO: 821275 - RNA, 22 nt, Human
uuugaagucaggcuuucuaccc

SEQ ID NO: 821276 - RNA, 22 nt, Human
uccaggagguaugaguggcccc

SEQ ID NO: 821277 - RNA, 22 nt, Human
uuugcauaggauggacauuuua

SEQ ID NO: 821278 - RNA, 22 nt, Human
aggagagcuggugucuggaauc

SEQ ID NO: 821279 - RNA, 22 nt, Human
auuguucaaagugcuuugcaug

SEQ ID NO: 821280 - RNA, 22 nt, Human
uuauuauagauuaugcaagauu

SEQ ID NO: 821281 - RNA, 22 nt, Human
aggcacaguggcucacaccugu

SEQ ID NO: 821282 - RNA, 22 nt, Human
gugcagcugcaggagucagguc

SEQ ID NO: 821283 - RNA, 22 nt, Human
gcuuugaagacuuuuccagggu

SEQ ID NO: 821284 - RNA, 22 nt, Human
aggccagcucuacccuuggacu

SEQ ID NO: 821285 - RNA, 20 nt, Human
uucacagaggacucagguca

SEQ ID NO: 821286 - RNA, 22 nt, Human
cagaggauucccuagugaccug

SEQ ID NO: 821287 - RNA, 22 nt, Human
agcugcccugggcuggagaugg

SEQ ID NO: 821288 - RNA, 22 nt, Human
aggccagcccugggcugagaga

SEQ ID NO: 821289 - RNA, 22 nt, Human
gcaucuaaacuugcaucauugu

SEQ ID NO: 821290 - RNA, 22 nt, Human
ucagagagccucaggcacugcc

SEQ ID NO: 821291 - RNA, 22 nt, Human
cuccaggaaaauagggaaugag

SEQ ID NO: 821292 - RNA, 22 nt, Human
auucuucacuguuucagaauga

SEQ ID NO: 821293 - RNA, 22 nt, Human
aggagaggucucccuuccccag

SEQ ID NO: 821294 - RNA, 22 nt, Human
ucaggauggcuucugcaucaaa

SEQ ID NO: 821295 - RNA, 22 nt, Human
uuaacaugucuugacuucaucu

SEQ ID NO: 821296 - RNA, 22 nt, Human
uggcagcugaauggcuggaugg

SEQ ID NO: 821297 - RNA, 22 nt, Human
uuucauggcuaggacuagagug

SEQ ID NO: 821298 - RNA, 22 nt, Human
ugcauauuguccuugauauuau

SEQ ID NO: 821299 - RNA, 22 nt, Human
cagaaggcuuuguggaguagac

SEQ ID NO: 821300 - RNA, 19 nt, Human
ucugccucuggucaggcuc

SEQ ID NO: 821301 - RNA, 22 nt, Human
cucaggauucucgacacucaca

SEQ ID NO: 821302 - RNA, 22 nt, Human
ucugaacuccagcccugcucuc

SEQ ID NO: 821303 - RNA, 22 nt, Human
caggguggcacaucacagcauu

SEQ ID NO: 821304 - RNA, 21 nt, Human
agcaccuuacagcuauaaugg

SEQ ID NO: 821305 - RNA, 22 nt, Human
guuauacauauguguuaacaaa

SEQ ID NO: 821306 - RNA, 22 nt, Human
uuuuaguguagucaccgugggu

SEQ ID NO: 821307 - RNA, 22 nt, Human
gcaguucuacuuauccauagac

SEQ ID NO: 821308 - RNA, 22 nt, Human
ugucugugaccucuuaggcaag

SEQ ID NO: 821309 - RNA, 22 nt, Human
caaggccaguucaccaagggca

SEQ ID NO: 821310 - RNA, 22 nt, Human
ucauuuguacuugugugcuugu

SEQ ID NO: 821311 - RNA, 22 nt, Human
uccaggagcucauccacgucaa

SEQ ID NO: 821312 - RNA, 22 nt, Human
gggaagcaggugcagcucgccu

SEQ ID NO: 821313 - RNA, 22 nt, Human
aucauucugauggucaaugcua

SEQ ID NO: 821314 - RNA, 22 nt, Human
gugguaauuuaauccuacacug

SEQ ID NO: 821315 - RNA, 22 nt, Human
acuguguggaccacucugaggc

SEQ ID NO: 821316 - RNA, 22 nt, Human
cuucccagaccuuagagugcag

SEQ ID NO: 821317 - RNA, 22 nt, Human
acuaagugauucuaagcaucuu

SEQ ID NO: 821318 - RNA, 22 nt, Human
ugaaggccagcagagugaaggc

SEQ ID NO: 821319 - RNA, 22 nt, Human
uuucacauaugguuguugauug

SEQ ID NO: 821320 - RNA, 22 nt, Human
ucuuuggaucccaacuggcugg

SEQ ID NO: 821321 - RNA, 22 nt, Human
ugauugaacugagcuucaagau

SEQ ID NO: 821322 - RNA, 22 nt, Human
aaguauuucguucugaaaaagu

SEQ ID NO: 821323 - RNA, 22 nt, Human
cccaggagguagagguugcagu

SEQ ID NO: 821324 - RNA, 22 nt, Human
cucaugucuucacccauucuaa

SEQ ID NO: 821325 - RNA, 22 nt, Human
cugaaugaggaaaagagugagg

SEQ ID NO: 821326 - RNA, 22 nt, Human
uggcagcugguacagugggucu

SEQ ID NO: 821327 - RNA, 22 nt, Human
cccaggaguuugaguucagcau

SEQ ID NO: 821328 - RNA, 20 nt, Human
gggagucuggaugaaagaug

SEQ ID NO: 821329 - RNA, 22 nt, Human
uaguuaaaauaauggagauguu

SEQ ID NO: 821330 - RNA, 22 nt, Human
ucuggcaggcaaucggcucugg

SEQ ID NO: 821331 - RNA, 22 nt, Human
cacaggagagcugggaggugcc

SEQ ID NO: 821332 - RNA, 21 nt, Human
aggcagcaggauccagggaca

SEQ ID NO: 821333 - RNA, 22 nt, Human
uccaugagggacacuggaugcu

SEQ ID NO: 821334 - RNA, 18 nt, Human
cgaggcaggcggaucacg

SEQ ID NO: 821335 - RNA, 22 nt, Human
cuuuggcacagucucauuugau

SEQ ID NO: 821336 - RNA, 22 nt, Human
caaaucuauauguugauauucu

SEQ ID NO: 821337 - RNA, 22 nt, Human
uuguuugaggucacugauauuu

SEQ ID NO: 821338 - RNA, 22 nt, Human
uauuuguugaguuguuaugucu

SEQ ID NO: 821339 - RNA, 23 nt, Human
cugcccugaucuugaucuauugu

SEQ ID NO: 821340 - RNA, 22 nt, Human
aauaauuagugggacagagaac

SEQ ID NO: 821341 - RNA, 22 nt, Human
cuacuucuaaguacauggugau

SEQ ID NO: 821342 - RNA, 22 nt, Human
uacaaaguagaaauucaguaaa

SEQ ID NO: 821343 - RNA, 22 nt, Human
cugcccaggcugaaggaacauc

SEQ ID NO: 821344 - RNA, 22 nt, Human
aagcuggaacaucuugaggaag

SEQ ID NO: 821345 - RNA, 22 nt, Human
cuggaaauuggagaugauguuu

SEQ ID NO: 821346 - RNA, 20 nt, Human
uugauucaagggcugaugga

SEQ ID NO: 821347 - RNA, 22 nt, Human
uccaugaggaccaaauucguag

SEQ ID NO: 821348 - RNA, 22 nt, Human
cuucucagaucucagcuuugag

SEQ ID NO: 821349 - RNA, 22 nt, Human
agucaauuaucucuaggucauc

SEQ ID NO: 821350 - RNA, 22 nt, Human
gucugucuguuguugagaagca

SEQ ID NO: 821351 - RNA, 22 nt, Human
uuggaauucaaguuguagcuua

SEQ ID NO: 821352 - RNA, 22 nt, Human
aaggcagcuucaccacagcauu

SEQ ID NO: 821353 - RNA, 22 nt, Human
uuucagcugguaaaggaguagc

SEQ ID NO: 821354 - RNA, 22 nt, Human
ugcauggacucaucagacaaga

SEQ ID NO: 821355 - RNA, 21 nt, Human
gauuugcagaaacuagacagg

SEQ ID NO: 821356 - RNA, 19 nt, Human
ggcagcuggacgcuguuca

SEQ ID NO: 821357 - RNA, 22 nt, Human
gcccaggagguggaggugcagu

SEQ ID NO: 821358 - RNA, 22 nt, Human
augaaggcuguguggagccccc

SEQ ID NO: 821359 - RNA, 22 nt, Human
agaggcagaaguguucaaaccc

SEQ ID NO: 821360 - RNA, 22 nt, Human
ugaggcagaaaauagcaguuca

SEQ ID NO: 821361 - RNA, 22 nt, Human
ucaucugucccaggcuuuuuuc

SEQ ID NO: 821362 - RNA, 22 nt, Human
cauuuuaagaugaccugguuuc

SEQ ID NO: 821363 - RNA, 22 nt, Human
cuucuucacacuggucugaagc

SEQ ID NO: 821364 - RNA, 22 nt, Human
uucacagucacccuucuccaug

SEQ ID NO: 821365 - RNA, 22 nt, Human
ucaggagaaagccaauuagagu

SEQ ID NO: 821366 - RNA, 21 nt, Human
uucucagagucuauuacaguu

SEQ ID NO: 821367 - RNA, 21 nt, Human
uuccagagauuguuucaccug

SEQ ID NO: 821368 - RNA, 22 nt, Human
auguuuccagguucuuccuaug

SEQ ID NO: 821369 - RNA, 22 nt, Human
uagugcuuuaggccugaguguc

SEQ ID NO: 821370 - RNA, 20 nt, Human
ucaggaugugcugagugaag

SEQ ID NO: 821371 - RNA, 19 nt, Human
ugcuagaaauucugugacu

SEQ ID NO: 821372 - RNA, 19 nt, Human
guugaaaguaggugagggu

SEQ ID NO: 821373 - RNA, 22 nt, Human
ccccaggacguggcccucauag

SEQ ID NO: 821374 - RNA, 22 nt, Human
cuggccagcugacagcagggcu

SEQ ID NO: 821375 - RNA, 22 nt, Human
cugagagugcucuuugauguca

SEQ ID NO: 821376 - RNA, 19 nt, Human
uucuccagccugaccugag

SEQ ID NO: 821377 - RNA, 22 nt, Human
aucaggaugacuauaaggcugc

SEQ ID NO: 821378 - RNA, 22 nt, Human
cuucucaguugcaagugucaga

SEQ ID NO: 821379 - RNA, 20 nt, Human
cccaggaguuugcucuuacu

SEQ ID NO: 821380 - RNA, 22 nt, Human
cucagaagccuucagucuuggc

SEQ ID NO: 821381 - RNA, 17 nt, Human
uucucugagcuguauug

SEQ ID NO: 821382 - RNA, 22 nt, Human
augacaguucuacacuuaaucu

SEQ ID NO: 821383 - RNA, 18 nt, Human
acucaggaaaugaugaca

SEQ ID NO: 821384 - RNA, 22 nt, Human
uucauucuugggaucagagagu

SEQ ID NO: 821385 - RNA, 22 nt, Human
augcugugucuagcaggaacac

SEQ ID NO: 821386 - RNA, 22 nt, Human
cagaaccaggaacugauggaga

SEQ ID NO: 821387 - RNA, 19 nt, Human
uuucuuaggccuuuggccu

SEQ ID NO: 821388 - RNA, 22 nt, Human
aaggcagcagaggaaaggugcu

SEQ ID NO: 821389 - RNA, 22 nt, Human
uacuuuuagccuauuugauucu

SEQ ID NO: 821390 - RNA, 22 nt, Human
uggcagcugcguuguguuucug

SEQ ID NO: 821391 - RNA, 22 nt, Human
uggcagcuguguccagguagaa

SEQ ID NO: 821392 - RNA, 22 nt, Human
aaacugcuuuccacaguggcua

SEQ ID NO: 821393 - RNA, 23 nt, Human
gggcaguuauguuguccuuggcu

SEQ ID NO: 821394 - RNA, 22 nt, Human
augcugagugagugaaacccag

SEQ ID NO: 821395 - RNA, 22 nt, Human
ucucuucuaacacuagaaauuc

SEQ ID NO: 821396 - RNA, 22 nt, Human
gcagcugccccgacugugaguc

SEQ ID NO: 821397 - RNA, 22 nt, Human
ggugaaggcacaagagggcaag

SEQ ID NO: 821398 - RNA, 22 nt, Human
agcuggcagcucucagggguac

SEQ ID NO: 821399 - RNA, 22 nt, Human
uguauuuuuagaccuuuagacc

SEQ ID NO: 821400 - RNA, 22 nt, Human
ugacccauggucugaucauagg

SEQ ID NO: 821401 - RNA, 22 nt, Human
aaaggaagaugccaggacucug

SEQ ID NO: 821402 - RNA, 22 nt, Human
gaaggccauugcguccugggau

SEQ ID NO: 821403 - RNA, 22 nt, Human
cagcugacccagugaggaggca

SEQ ID NO: 821404 - RNA, 22 nt, Human
gcaaagcauucuguggagucua

SEQ ID NO: 821405 - RNA, 22 nt, Human
ggaggcgauccugggaaacacc

SEQ ID NO: 821406 - RNA, 22 nt, Human
acccaggacaaaauaaccaggu

SEQ ID NO: 821407 - RNA, 22 nt, Human
cccaucacagacacuggguuau

SEQ ID NO: 821408 - RNA, 22 nt, Human
accaggaggaaguguuaaugau

SEQ ID NO: 821409 - RNA, 22 nt, Human
agggacuuguguccuauguaug

SEQ ID NO: 821410 - RNA, 22 nt, Human
uuucuagggcucuugucuucug

SEQ ID NO: 821411 - RNA, 22 nt, Human
uaaugucaaggugauagauuug

SEQ ID NO: 821412 - RNA, 22 nt, Human
uaaugucagcauaguuuauuuu

SEQ ID NO: 821413 - RNA, 22 nt, Human
gaggggaaaguucugcacaagg

SEQ ID NO: 821414 - RNA, 22 nt, Human
ggaggagguggguuaaguugua

SEQ ID NO: 821415 - RNA, 22 nt, Human
aaucauucuuauuucacagcaa

SEQ ID NO: 821416 - RNA, 22 nt, Human
ucugcagggaugugagggguga

SEQ ID NO: 821417 - RNA, 22 nt, Human
cuucuucaagagaaugggagac

SEQ ID NO: 821418 - RNA, 22 nt, Human
ugagccugguugcagugucugg

SEQ ID NO: 821419 - RNA, 22 nt, Human
ucaaauaccagcaauuucaugu

SEQ ID NO: 821420 - RNA, 17 nt, Human
agagggaaaaugcgguu

SEQ ID NO: 821421 - RNA, 22 nt, Human
agcccagggaaccaggaagugg

SEQ ID NO: 821422 - RNA, 22 nt, Human
aacauauaaacucuuaaguuca

SEQ ID NO: 821423 - RNA, 22 nt, Human
uccacauccauugcuugacuuu

SEQ ID NO: 821424 - RNA, 22 nt, Human
ucucacuuuccagacuuuucaa

SEQ ID NO: 821425 - RNA, 23 nt, Human
uccugaggguuucccagccuugg

SEQ ID NO: 821426 - RNA, 22 nt, Human
acuuggcaaguaucuauaaagu

SEQ ID NO: 821427 - RNA, 22 nt, Human
ucuucacauggaacaugaagcu

SEQ ID NO: 821428 - RNA, 17 nt, Human
aaggccauuuccaccca

SEQ ID NO: 821429 - RNA, 22 nt, Human
aaugucugagucucuguauccc

SEQ ID NO: 821430 - RNA, 22 nt, Human
guccaugauucuguguaguaga

SEQ ID NO: 821431 - RNA, 22 nt, Human
ugauuuccccagucuugcugcu

SEQ ID NO: 821432 - RNA, 22 nt, Human
agcaccuugcucuuggccuucc

SEQ ID NO: 821433 - RNA, 22 nt, Human
cuuaaagaaauugaggagagga

SEQ ID NO: 821434 - RNA, 22 nt, Human
accaggaggccuggagcacaaa

SEQ ID NO: 821435 - RNA, 22 nt, Human
ugaggcaggaguuaaugugcuc

SEQ ID NO: 821436 - RNA, 22 nt, Human
ugcuucugggcaaaugugugug

SEQ ID NO: 821437 - RNA, 22 nt, Human
ucccaggaauugaagccagugu

SEQ ID NO: 821438 - RNA, 17 nt, Human
gagagcugcugcuuccg

SEQ ID NO: 821439 - RNA, 22 nt, Human
guuguuuugcaggauccuuaca

SEQ ID NO: 821440 - RNA, 22 nt, Human
gagaggagguggcuaugacagc

SEQ ID NO: 821441 - RNA, 22 nt, Human
cuguaaauaugaagaauauaug

SEQ ID NO: 821442 - RNA, 22 nt, Human
augcagcuucaggauuaugaug

SEQ ID NO: 821443 - RNA, 23 nt, Human
uugauuucaaaugcagagaacac

SEQ ID NO: 821444 - RNA, 22 nt, Human
gcccaggacucagggugucgcg

SEQ ID NO: 821445 - RNA, 22 nt, Human
aucuuucuauuucuaaaaacua

SEQ ID NO: 821446 - RNA, 22 nt, Human
ugaaaugacaaagguuuuucuu

SEQ ID NO: 821447 - RNA, 22 nt, Human
uugagaagaaauaguuugcaau

SEQ ID NO: 821448 - RNA, 22 nt, Human
ccaggcugggcuacaaguugag

SEQ ID NO: 821449 - RNA, 21 nt, Human
ccauaccuaccucaccugguu

SEQ ID NO: 821450 - RNA, 22 nt, Human
aggcaggcugcuauggaguaga

SEQ ID NO: 821451 - RNA, 18 nt, Human
augggaggggccaagaga

SEQ ID NO: 821452 - RNA, 22 nt, Human
acaagcaugggcuuugacauca

SEQ ID NO: 821453 - RNA, 20 nt, Human
ugugcaggagagugaggcug

SEQ ID NO: 821454 - RNA, 22 nt, Human
cagucuuuguucccauuacuga

SEQ ID NO: 821455 - RNA, 22 nt, Human
uguccucagauaugucuacucu

SEQ ID NO: 821456 - RNA, 22 nt, Human
agggugguucuuuuaguggaag

SEQ ID NO: 821457 - RNA, 22 nt, Human
acuucaugcagaagagagcugu

SEQ ID NO: 821458 - RNA, 22 nt, Human
ggaggggagauguuugggcuca

SEQ ID NO: 821459 - RNA, 22 nt, Human
ugucaaauuuuuauugcaguau

SEQ ID NO: 821460 - RNA, 22 nt, Human
gaucuucucuuuaguagaaaca

SEQ ID NO: 821461 - RNA, 22 nt, Human
cugcuguguuucugcuagaaaa

SEQ ID NO: 821462 - RNA, 22 nt, Human
auguuucaccagcaaauuaccu

SEQ ID NO: 821463 - RNA, 22 nt, Human
ggcaugcugcguacagaugaac

SEQ ID NO: 821464 - RNA, 22 nt, Human
uggcagcuauuacaaggaaguc

SEQ ID NO: 821465 - RNA, 22 nt, Human
gcagcugcagacccucagugcu

SEQ ID NO: 821466 - RNA, 22 nt, Human
ggaggaggggcgcuuugucuau

SEQ ID NO: 821467 - RNA, 22 nt, Human
uuccaugaagggcagccucuca

SEQ ID NO: 821468 - RNA, 22 nt, Human
agaaaugaagagagucaagguu

SEQ ID NO: 821469 - RNA, 22 nt, Human
uuucaaagaguuguaaauuacu

SEQ ID NO: 821470 - RNA, 22 nt, Human
ccucacugaagaggugacauuu

SEQ ID NO: 821471 - RNA, 22 nt, Human
ggacagcugcuuucaggccaca

SEQ ID NO: 821472 - RNA, 22 nt, Human
aucaggauggguuuggcuuagg

SEQ ID NO: 821473 - RNA, 22 nt, Human
uagugcuugagucucuccguac

SEQ ID NO: 821474 - RNA, 22 nt, Human
caugcuguguguuuuagcucca

SEQ ID NO: 821475 - RNA, 22 nt, Human
guguguuuagcauuagcagggg

SEQ ID NO: 821476 - RNA, 22 nt, Human
uaggcagcugcaaacuucgguc

SEQ ID NO: 821477 - RNA, 22 nt, Human
cgccucagccguggucaucuuc

SEQ ID NO: 821478 - RNA, 22 nt, Human
ugaaggaaugaguauacuguuu

SEQ ID NO: 821479 - RNA, 22 nt, Human
uuucaucuuccuuggcauaggu

SEQ ID NO: 821480 - RNA, 22 nt, Human
guuuuaguggguggccacugau

SEQ ID NO: 821481 - RNA, 22 nt, Human
aagaggaggacgguucccagaa

SEQ ID NO: 821482 - RNA, 23 nt, Human
uugcacauuggagcuggucuucu

SEQ ID NO: 821483 - RNA, 22 nt, Human
uugcaucuagggcaacccagag

SEQ ID NO: 821484 - RNA, 22 nt, Human
uuucuaggucuuccauacugcc

SEQ ID NO: 821485 - RNA, 22 nt, Human
ccuggauucaagucuuucuuuc

SEQ ID NO: 821486 - RNA, 22 nt, Human
gugcugugucuaucaggaauaa

SEQ ID NO: 821487 - RNA, 22 nt, Human
ggccaggaagggaagaucagca

SEQ ID NO: 821488 - RNA, 22 nt, Human
aggcugcuucaauggauaagau

SEQ ID NO: 821489 - RNA, 20 nt, Human
ggggcugcaugcagagaaga

SEQ ID NO: 821490 - RNA, 22 nt, Human
auucuucacaccuguuccuguu

SEQ ID NO: 821491 - RNA, 22 nt, Human
uuaaauuccagccucauaauag

SEQ ID NO: 821492 - RNA, 22 nt, Human
cugagcugggaguagagacucu

SEQ ID NO: 821493 - RNA, 22 nt, Human
aaucuucuuucuuaacaguaca

SEQ ID NO: 821494 - RNA, 19 nt, Human
aucugccuguuaucacaua

SEQ ID NO: 821495 - RNA, 22 nt, Human
gcuuggcauugaccauuaucau

SEQ ID NO: 821496 - RNA, 22 nt, Human
uuguuauaaagacuaaauaugu

SEQ ID NO: 821497 - RNA, 22 nt, Human
gacagcugugcaggagaagggg

SEQ ID NO: 821498 - RNA, 22 nt, Human
aagugagugguaaggagcaugg

SEQ ID NO: 821499 - RNA, 22 nt, Human
cacucaggcugugucaggagga

SEQ ID NO: 821500 - RNA, 22 nt, Human
uuucacauuuaggcgugaauug

SEQ ID NO: 821501 - RNA, 22 nt, Human
aggcagguccccuggaaggcac

SEQ ID NO: 821502 - RNA, 22 nt, Human
gaaaggcaguacagcugagccu

SEQ ID NO: 821503 - RNA, 22 nt, Human
acaccauacucauguugguucc

SEQ ID NO: 821504 - RNA, 22 nt, Human
aucuuguuauaagagauaaugg

SEQ ID NO: 821505 - RNA, 22 nt, Human
aguaaaaauugaggugcaaaau

SEQ ID NO: 821506 - RNA, 22 nt, Human
uaugauuuguagacauuugauu

SEQ ID NO: 821507 - RNA, 22 nt, Human
ugcugagguuucgucugcuugc

SEQ ID NO: 821508 - RNA, 22 nt, Human
aagcagcuuuugaagagugagg

SEQ ID NO: 821509 - RNA, 22 nt, Human
cugcugugcaggugccuaugau

SEQ ID NO: 821510 - RNA, 22 nt, Human
cagcagagggagccauugaaau

SEQ ID NO: 821511 - RNA, 22 nt, Human
gugacagucaaagacaugacuu

SEQ ID NO: 821512 - RNA, 22 nt, Human
uugcugugaaaccaugggaagu

SEQ ID NO: 821513 - RNA, 22 nt, Human
caacauuucaaggucuuuagga

SEQ ID NO: 821514 - RNA, 22 nt, Human
ccaggaaauggcuugcuucuuu

SEQ ID NO: 821515 - RNA, 22 nt, Human
gagagaggccuccauguacuga

SEQ ID NO: 821516 - RNA, 22 nt, Human
cagaaauguacugacaugcagu

SEQ ID NO: 821517 - RNA, 22 nt, Human
uuuucauuguuccucgagcauu

SEQ ID NO: 821518 - RNA, 22 nt, Human
uucagaaguagcuaagcaguca

SEQ ID NO: 821519 - RNA, 22 nt, Human
cuagccaugggcauuaaaggua

SEQ ID NO: 821520 - RNA, 22 nt, Human
gauuuuauauggcauacugugg

SEQ ID NO: 821521 - RNA, 22 nt, Human
ggggcagccuccaggaaagcug

SEQ ID NO: 821522 - RNA, 22 nt, Human
guugaaagaugucuugguuccc

SEQ ID NO: 821523 - RNA, 22 nt, Human
acccaggagguggaggcugcag

SEQ ID NO: 821524 - RNA, 22 nt, Human
uugcccagaguccacagcguac

SEQ ID NO: 821525 - RNA, 22 nt, Human
auucacaaaaugauauagauac

SEQ ID NO: 821526 - RNA, 21 nt, Human
agggagcuggccacacagccu

SEQ ID NO: 821527 - RNA, 22 nt, Human
uuuuccagauuggacuuagucc

SEQ ID NO: 821528 - RNA, 23 nt, Human
auguauuuaaauuucagugauga

SEQ ID NO: 821529 - RNA, 22 nt, Human
auuaaauuagcaaacugugaaa

SEQ ID NO: 821530 - RNA, 22 nt, Human
cugcuuuguaaaauagacauaa

SEQ ID NO: 821531 - RNA, 22 nt, Human
uucaacuagauuuauacaauuc

SEQ ID NO: 821532 - RNA, 22 nt, Human
uagaaaugauugguugagcucu

SEQ ID NO: 821533 - RNA, 22 nt, Human
cagcugccugucuggaggcaau

SEQ ID NO: 821534 - RNA, 22 nt, Human
caacugagcaguagcgucugga

SEQ ID NO: 821535 - RNA, 22 nt, Human
cagacaggcaggugcugcuuug

SEQ ID NO: 821536 - RNA, 22 nt, Human
gagguagcgaguggacagugca

SEQ ID NO: 821537 - RNA, 22 nt, Human
uucuucuucaagugcugcauuc

SEQ ID NO: 821538 - RNA, 22 nt, Human
gcccaggaguucaagucuagug

SEQ ID NO: 821539 - RNA, 22 nt, Human
uucugugaaucuuuuuucccac

SEQ ID NO: 821540 - RNA, 22 nt, Human
ucucacugcaaauauuauguau

SEQ ID NO: 821541 - RNA, 22 nt, Human
cugagccagcuggcaugugcua

SEQ ID NO: 821542 - RNA, 22 nt, Human
guggaaugaauagauuugcauu

SEQ ID NO: 821543 - RNA, 17 nt, Human
uuugaaaggaugucagu

SEQ ID NO: 821544 - RNA, 22 nt, Human
uuggcagugucugcaaaaugga

SEQ ID NO: 821545 - RNA, 22 nt, Human
ucucccaggcugcccuguggac

SEQ ID NO: 821546 - RNA, 22 nt, Human
cccaggaacagggcucagaccc

SEQ ID NO: 821547 - RNA, 23 nt, Human
ugaguucucaucuuggcuucuau

SEQ ID NO: 821548 - RNA, 22 nt, Human
cucuuaguaaugccaugaagca

SEQ ID NO: 821549 - RNA, 22 nt, Human
ucugaaagaagggcagucuuuu

SEQ ID NO: 821550 - RNA, 22 nt, Human
gagagaaaugugcaguuugggc

SEQ ID NO: 821551 - RNA, 22 nt, Human
uuagccauuuuauacaagugua

SEQ ID NO: 821552 - RNA, 22 nt, Human
agaaaauauucauugagaggcu

SEQ ID NO: 821553 - RNA, 22 nt, Human
gaggacagagccgccuggcaag

SEQ ID NO: 821554 - RNA, 22 nt, Human
ugaaucauggauaaauagcuua

SEQ ID NO: 821555 - RNA, 22 nt, Human
agucacuguucugucaugucaa

SEQ ID NO: 821556 - RNA, 22 nt, Human
uucaauucuaaacuaauauucu

SEQ ID NO: 821557 - RNA, 22 nt, Human
ucccaggauguuggcggcaggu

SEQ ID NO: 821558 - RNA, 22 nt, Human
gaaacugugaggaucuuaacuu

SEQ ID NO: 821559 - RNA, 22 nt, Human
uauuuuaaagacugccagccua

SEQ ID NO: 821560 - RNA, 22 nt, Human
aggaaaacacaguauugaugga

SEQ ID NO: 821561 - RNA, 22 nt, Human
ccauccugcauugcuauucaga

SEQ ID NO: 821562 - RNA, 22 nt, Human
cauuuguaucugggcugcugug

SEQ ID NO: 821563 - RNA, 22 nt, Human
gcuagaaaucgacuucagaauu

SEQ ID NO: 821564 - RNA, 22 nt, Human
agcugcccuuuaugaugcugaa

SEQ ID NO: 821565 - RNA, 22 nt, Human
uuugaaagcaggugugggaggg

SEQ ID NO: 821566 - RNA, 22 nt, Human
uuucuuaguccuagagugauuu

SEQ ID NO: 821567 - RNA, 22 nt, Human
cugcgcagggguggcgccagaa

SEQ ID NO: 821568 - RNA, 22 nt, Human
uucaugugaucacagauuguaa

SEQ ID NO: 821569 - RNA, 22 nt, Human
augcugugguagacagcauucc

SEQ ID NO: 821570 - RNA, 22 nt, Human
gucuucuuguguugccugucuu

SEQ ID NO: 821571 - RNA, 22 nt, Human
uucaggauucucucccauuuac

SEQ ID NO: 821572 - RNA, 22 nt, Human
caauacuuccuuguuagaggca

SEQ ID NO: 821573 - RNA, 22 nt, Human
uggaguuccuuugaaaggcucu

SEQ ID NO: 821574 - RNA, 22 nt, Human
cuguucucuggcgguggcuguu

SEQ ID NO: 821575 - RNA, 22 nt, Human
aagcaccugcaguugacaaaaa

SEQ ID NO: 821576 - RNA, 18 nt, Human
gugcugugggcaguggcc

SEQ ID NO: 821577 - RNA, 22 nt, Human
caggcagcugaggacuuugcua

SEQ ID NO: 821578 - RNA, 22 nt, Human
uaucaauacauguuaucagugu

SEQ ID NO: 821579 - RNA, 21 nt, Human
ccugcugugaucuuagugagu

SEQ ID NO: 821580 - RNA, 22 nt, Human
uaaauuguuuucuagaaguugu

SEQ ID NO: 821581 - RNA, 22 nt, Human
aucugccuggcuccaggugagc

SEQ ID NO: 821582 - RNA, 20 nt, Human
ugcguguguauuuauuuucu

SEQ ID NO: 821583 - RNA, 22 nt, Human
ccaggagaugggaaaguagcag

SEQ ID NO: 821584 - RNA, 22 nt, Human
augcuguggaaguuccugaagc

SEQ ID NO: 821585 - RNA, 22 nt, Human
uuugaaaggaauuaggaugaca

SEQ ID NO: 821586 - RNA, 20 nt, Human
augauuuugcacuaacuuca

SEQ ID NO: 821587 - RNA, 22 nt, Human
cugccaucugagccaaaagugc

SEQ ID NO: 821588 - RNA, 22 nt, Human
gaggcagcaugguaccuuggag

SEQ ID NO: 821589 - RNA, 22 nt, Human
aaaugaugcucacagauuagug

SEQ ID NO: 821590 - RNA, 19 nt, Human
agacagagcucaguggguu

SEQ ID NO: 821591 - RNA, 22 nt, Human
gggacgggcaguccaagggguc

SEQ ID NO: 821592 - RNA, 22 nt, Human
auguucuuguucaaaugucagu

SEQ ID NO: 821593 - RNA, 22 nt, Human
aggguggcuggaggaaucagaa

SEQ ID NO: 821594 - RNA, 22 nt, Human
cggagaggaccugcaacucgcu

SEQ ID NO: 821595 - RNA, 22 nt, Human
uucugaaagccaauucauugaa

SEQ ID NO: 821596 - RNA, 22 nt, Human
gaggccagaguuccccgaguca

SEQ ID NO: 821597 - RNA, 23 nt, Human
uaugaacugcauugcuggugugu

SEQ ID NO: 821598 - RNA, 22 nt, Human
uacacacagaggccaugggauu

SEQ ID NO: 821599 - RNA, 22 nt, Human
auguuuccgugagcauccuuga

SEQ ID NO: 821600 - RNA, 22 nt, Human
ccagguaggagagagggauccu

SEQ ID NO: 821601 - RNA, 22 nt, Human
aagcagaggaccgacggaggga

SEQ ID NO: 821602 - RNA, 22 nt, Human
ucuucuucccaucccucaaaug

SEQ ID NO: 821603 - RNA, 22 nt, Human
cccaggaaaguggaggcggcug

SEQ ID NO: 821604 - RNA, 22 nt, Human
uuucuucucgacaccuuauccc

SEQ ID NO: 821605 - RNA, 22 nt, Human
cauuuguuaauuacuauuaucu

SEQ ID NO: 821606 - RNA, 22 nt, Human
ugccuguguccccuucuuggca

SEQ ID NO: 821607 - RNA, 21 nt, Human
aggcaucuaaagagaguagac

SEQ ID NO: 821608 - RNA, 22 nt, Human
uaagaacuucggacauguuauc

SEQ ID NO: 821609 - RNA, 22 nt, Human
gggagcugaauggcaauggaga

SEQ ID NO: 821610 - RNA, 22 nt, Human
aaagccauuacaaaauuucaua

SEQ ID NO: 821611 - RNA, 22 nt, Human
gggagucugggcuagacuccuu

SEQ ID NO: 821612 - RNA, 22 nt, Human
uugcuuuguggugguucuucca

SEQ ID NO: 821613 - RNA, 22 nt, Human
cuugaaagaagggucuuuuaau

SEQ ID NO: 821614 - RNA, 22 nt, Human
ccuugcugcgugcuagcacaga

SEQ ID NO: 821615 - RNA, 22 nt, Human
auguucuuucagccagugcauc

SEQ ID NO: 821616 - RNA, 22 nt, Human
cugcugugaguuuggaggucua

SEQ ID NO: 821617 - RNA, 22 nt, Human
gucugucucccugugacugaga

SEQ ID NO: 821618 - RNA, 22 nt, Human
cagucccuaguggagcucacag

SEQ ID NO: 821619 - RNA, 22 nt, Human
auugaaagagaauguagcucuu

SEQ ID NO: 821620 - RNA, 22 nt, Human
cuugaaagcacuccuuugacug

SEQ ID NO: 821621 - RNA, 22 nt, Human
aggagggacaccaauauauguu

SEQ ID NO: 821622 - RNA, 22 nt, Human
uugaaaguuuauggagucugca

SEQ ID NO: 821623 - RNA, 22 nt, Human
augcaucuauucccaagggcag

SEQ ID NO: 821624 - RNA, 15 nt, Human
cuccaugauuuugca

SEQ ID NO: 821625 - RNA, 22 nt, Human
cuucuucaauagcaagcgcaua

SEQ ID NO: 821626 - RNA, 22 nt, Human
agaccauagggaccucagguug

SEQ ID NO: 821627 - RNA, 22 nt, Human
ccucaggaaccacauugcugcu

SEQ ID NO: 821628 - RNA, 22 nt, Human
uuuauuguuuagaagggggcug

SEQ ID NO: 821629 - RNA, 21 nt, Human
uucaaaaugguguguuugucu

SEQ ID NO: 821630 - RNA, 22 nt, Human
caggagagauaugaguccccac

SEQ ID NO: 821631 - RNA, 20 nt, Human
aggcagcuggccaggcaggu

SEQ ID NO: 821632 - RNA, 22 nt, Human
cccaggcagccugcagggaagg

SEQ ID NO: 821633 - RNA, 22 nt, Human
auuucaaggcuauuaauauaaa

SEQ ID NO: 821634 - RNA, 22 nt, Human
uggagacucugcaucugugaca

SEQ ID NO: 821635 - RNA, 22 nt, Human
auugaaagcauggauuuggauu

SEQ ID NO: 821636 - RNA, 20 nt, Human
ucuggcaggugaacgagcug

SEQ ID NO: 821637 - RNA, 22 nt, Human
uuauacauguguuuugagauga

SEQ ID NO: 821638 - RNA, 22 nt, Human
ccuggagagagaggccaacugc

SEQ ID NO: 821639 - RNA, 22 nt, Human
caggagaaauguggcugcuacc

SEQ ID NO: 821640 - RNA, 22 nt, Human
ugaggggagaagcagcagccug

SEQ ID NO: 821641 - RNA, 22 nt, Human
ugugaacuggcagguggacggg

SEQ ID NO: 821642 - RNA, 22 nt, Human
ugaggcaguucuuacuuguauu

SEQ ID NO: 821643 - RNA, 22 nt, Human
ucaggagauggucuuuauaggc

SEQ ID NO: 821644 - RNA, 22 nt, Human
uauuuucuguggaggaccagau

SEQ ID NO: 821645 - RNA, 22 nt, Human
ugauuuuuagcuauucugaaga

SEQ ID NO: 821646 - RNA, 22 nt, Human
acucaggaaaugaagacugguu

SEQ ID NO: 821647 - RNA, 22 nt, Human
ucaucugucauccacaaagcug

SEQ ID NO: 821648 - RNA, 22 nt, Human
uacagcuaggcaaaaaugacau

SEQ ID NO: 821649 - RNA, 22 nt, Human
uucucugaguacguuucagugu

SEQ ID NO: 821650 - RNA, 22 nt, Human
cccaggaaacccgaaggcgacc

SEQ ID NO: 821651 - RNA, 22 nt, Human
guaggcagggcuguggggagaa

SEQ ID NO: 821652 - RNA, 22 nt, Human
uguccucuuccagugcuccuuc

SEQ ID NO: 821653 - RNA, 22 nt, Human
ucugggaaccagugcggcuggg

SEQ ID NO: 821654 - RNA, 22 nt, Human
ccaggagacaaagaugacugcu

SEQ ID NO: 821655 - RNA, 22 nt, Human
cauugcuguuaauugucucuag

SEQ ID NO: 821656 - RNA, 19 nt, Human
agcauuuggaauucuacac

SEQ ID NO: 821657 - RNA, 22 nt, Human
ccaggauggggagcagauagaa

SEQ ID NO: 821658 - RNA, 22 nt, Human
ucacugcugcugccaugaugga

SEQ ID NO: 821659 - RNA, 17 nt, Human
gcuguaguuugauaaga

SEQ ID NO: 821660 - RNA, 22 nt, Human
acagucuacuugagcuuguaua

SEQ ID NO: 821661 - RNA, 23 nt, Human
cuugcagggcuggaggcuuagaa

SEQ ID NO: 821662 - RNA, 22 nt, Human
augcagcugugggcaagaaaug

SEQ ID NO: 821663 - RNA, 22 nt, Human
cucagugugaaugcucaguaaa

SEQ ID NO: 821664 - RNA, 22 nt, Human
aggcaggcucaaugcccagucu

SEQ ID NO: 821665 - RNA, 22 nt, Human
uucagcaaacacgaugcuuguu

SEQ ID NO: 821666 - RNA, 22 nt, Human
guucuucagauuccauuucagu

SEQ ID NO: 821667 - RNA, 22 nt, Human
gggcagcuccuguggaauccac

SEQ ID NO: 821668 - RNA, 22 nt, Human
uugaauaguguuuucaguauac

SEQ ID NO: 821669 - RNA, 22 nt, Human
cccuuagcuccaagggguuugg

SEQ ID NO: 821670 - RNA, 22 nt, Human
cuucagaauccagaaucagaau

SEQ ID NO: 821671 - RNA, 22 nt, Human
augcugugucaggaauuugaua

SEQ ID NO: 821672 - RNA, 22 nt, Human
uugcaauagccuuauuuccaaa

SEQ ID NO: 821673 - RNA, 22 nt, Human
agacagugcaagaagagcaggc

SEQ ID NO: 821674 - RNA, 22 nt, Human
auuuugaugcuaucuaaugaau

SEQ ID NO: 821675 - RNA, 22 nt, Human
acaaaugugucuaauugugccu

SEQ ID NO: 821676 - RNA, 22 nt, Human
ccaggagagcaaaggucacucu

SEQ ID NO: 821677 - RNA, 22 nt, Human
gcuugaaaauucauagguauuu

SEQ ID NO: 821678 - RNA, 22 nt, Human
aaaagucugcucucauuucaga

SEQ ID NO: 821679 - RNA, 23 nt, Human
aggcagcuggguagcaucuuucu

SEQ ID NO: 821680 - RNA, 22 nt, Human
cagagcucuauguucauggagg

SEQ ID NO: 821681 - RNA, 22 nt, Human
auuuggcaacauuaauugaauc

SEQ ID NO: 821682 - RNA, 22 nt, Human
uggcaggcagugugggagcugg

SEQ ID NO: 821683 - RNA, 22 nt, Human
cauuuccagcuccugcaucaug

SEQ ID NO: 821684 - RNA, 22 nt, Human
ccucaggauacaggagccacag

SEQ ID NO: 821685 - RNA, 22 nt, Human
uucauucuuauuugugaucugg

SEQ ID NO: 821686 - RNA, 22 nt, Human
aucuuucagggccauuuguauu

SEQ ID NO: 821687 - RNA, 22 nt, Human
aauagcucacugauuucucuuu

SEQ ID NO: 821688 - RNA, 22 nt, Human
gggcagcuggauaguuuuaaau

SEQ ID NO: 821689 - RNA, 22 nt, Human
uagggauguggugagaacugag

SEQ ID NO: 821690 - RNA, 22 nt, Human
uuagagucaaaauggcauguua

SEQ ID NO: 821691 - RNA, 22 nt, Human
auauaauacaaccugcuaagug

SEQ ID NO: 821692 - RNA, 22 nt, Human
uugcuuugccaccagaagucua

SEQ ID NO: 821693 - RNA, 22 nt, Human
aguguuugagacacauuucacu

SEQ ID NO: 821694 - RNA, 19 nt, Human
gcuuuggagggagguucua

SEQ ID NO: 821695 - RNA, 22 nt, Human
aaggccagaguacuagaggcug

SEQ ID NO: 821696 - RNA, 22 nt, Human
cuucugaggcagcuauucaguu

SEQ ID NO: 821697 - RNA, 22 nt, Human
aggcaggcacacuuccuccagg

SEQ ID NO: 821698 - RNA, 22 nt, Human
ucauuugugugagugauuugac

SEQ ID NO: 821699 - RNA, 22 nt, Human
gcugcccaggguggagccggcu

SEQ ID NO: 821700 - RNA, 22 nt, Human
agugcuuugagcguuugaaaag

SEQ ID NO: 821701 - RNA, 22 nt, Human
gaggcugauucggggaacagca

SEQ ID NO: 821702 - RNA, 22 nt, Human
gacccaggguggucaccugaaa

SEQ ID NO: 821703 - RNA, 22 nt, Human
aaaggccaccaacaugaagcau

SEQ ID NO: 821704 - RNA, 22 nt, Human
uugaaaggugaacaugaugcac

SEQ ID NO: 821705 - RNA, 22 nt, Human
agaagucauuuauguuagauga

SEQ ID NO: 821706 - RNA, 22 nt, Human
ccuugcugaccaucaccuuuga

SEQ ID NO: 821707 - RNA, 22 nt, Human
uggaggaaaaaaccaggcagag

SEQ ID NO: 821708 - RNA, 22 nt, Human
cacucaggguacaauggagggc

SEQ ID NO: 821709 - RNA, 21 nt, Human
auacacauacacauaaaugug

SEQ ID NO: 821710 - RNA, 22 nt, Human
acagucauuagauacaaugucu

SEQ ID NO: 821711 - RNA, 22 nt, Human
uccaugaggcagggaggcuggc

SEQ ID NO: 821712 - RNA, 22 nt, Human
aagauggagcacgagcagaagc

SEQ ID NO: 821713 - RNA, 22 nt, Human
agagcagcugugacauggacag

SEQ ID NO: 821714 - RNA, 22 nt, Human
gcucagagcuugaaguuccacu

SEQ ID NO: 821715 - RNA, 22 nt, Human
guuuuucuaggaccaugugauu

SEQ ID NO: 821716 - RNA, 22 nt, Human
uauuucagguauggugugaaau

SEQ ID NO: 821717 - RNA, 22 nt, Human
cugccaggcgauggauuggcug

SEQ ID NO: 821718 - RNA, 22 nt, Human
ucuccucuauuucuguauguau

SEQ ID NO: 821719 - RNA, 22 nt, Human
cagcagagcugggcuuugaauu

SEQ ID NO: 821720 - RNA, 22 nt, Human
guuuucaaggggauuuaacuga

SEQ ID NO: 821721 - RNA, 22 nt, Human
ugcugaaacaauaacauacugg

SEQ ID NO: 821722 - RNA, 22 nt, Human
ugaggcagcauucuucaagaca

SEQ ID NO: 821723 - RNA, 22 nt, Human
gagaggauccacaaaccaggaa

SEQ ID NO: 821724 - RNA, 22 nt, Human
cucaggauagcugcgcagccug

SEQ ID NO: 821725 - RNA, 22 nt, Human
gagugcagaugccagccccagu

SEQ ID NO: 821726 - RNA, 22 nt, Human
gagagggauacugaguuuuggu

SEQ ID NO: 821727 - RNA, 22 nt, Human
acccaggaaaacauggugcaga

SEQ ID NO: 821728 - RNA, 22 nt, Human
guuuuauaggugaaauauuacu

SEQ ID NO: 821729 - RNA, 22 nt, Human
cucaggauagauuguccucuca

SEQ ID NO: 821730 - RNA, 22 nt, Human
guuuuauaauugcuucauaaga

SEQ ID NO: 821731 - RNA, 22 nt, Human
uugacacagaucaauauucaac

SEQ ID NO: 821732 - RNA, 22 nt, Human
auacuuucugaccaauuaauug

SEQ ID NO: 821733 - RNA, 22 nt, Human
gaggcugcuuugaugacaggag

SEQ ID NO: 821734 - RNA, 22 nt, Human
gaggcugcccaacuggagugga

SEQ ID NO: 821735 - RNA, 22 nt, Human
uauuucuucgggauucaagcua

SEQ ID NO: 821736 - RNA, 20 nt, Human
cagaggcauuuucagacucu

SEQ ID NO: 821737 - RNA, 16 nt, Human
aaggagggaagagaau

SEQ ID NO: 821738 - RNA, 22 nt, Human
ugaauaguccuuggaauaacug

SEQ ID NO: 821739 - RNA, 17 nt, Human
agagagagcaugccacc

SEQ ID NO: 821740 - RNA, 22 nt, Human
agugcuuugugcucucacugca

SEQ ID NO: 821741 - RNA, 22 nt, Human
uacaguaagaugaaauagcaau

SEQ ID NO: 821742 - RNA, 22 nt, Human
uugguuuaggaacuggcuugga

SEQ ID NO: 821743 - RNA, 22 nt, Human
uacaaaguaauguauaauaucg

SEQ ID NO: 821744 - RNA, 22 nt, Human
uuauccaagcagaagcugcaca

SEQ ID NO: 821745 - RNA, 22 nt, Human
caaggccaugagcagcgagugu

SEQ ID NO: 821746 - RNA, 22 nt, Human
ugcauguguuugccacagugag

SEQ ID NO: 821747 - RNA, 22 nt, Human
ucuuagcacagcuauauaaguu

SEQ ID NO: 821748 - RNA, 22 nt, Human
uccaggaggcucugguugacgu

SEQ ID NO: 821749 - RNA, 22 nt, Human
gcccaggaaauaaaagugggcu

SEQ ID NO: 821750 - RNA, 23 nt, Human
acugucugauauguuuuccauca

SEQ ID NO: 821751 - RNA, 21 nt, Human
ucacuagugccuucugucauu

SEQ ID NO: 821752 - RNA, 22 nt, Human
uccugagagcagcugcuuugga

SEQ ID NO: 821753 - RNA, 22 nt, Human
uuugagauggagucuugcucug

SEQ ID NO: 821754 - RNA, 23 nt, Human
uccaggagcaugcuggcuggcga

SEQ ID NO: 821755 - RNA, 17 nt, Human
aaucuguuuacagucag

SEQ ID NO: 821756 - RNA, 22 nt, Human
ucugggaauuuauuggcacuuu

SEQ ID NO: 821757 - RNA, 22 nt, Human
gccucugcccuccugggacugc

SEQ ID NO: 821758 - RNA, 22 nt, Human
aaucuucuacuugacaguucuc

SEQ ID NO: 821759 - RNA, 22 nt, Human
cccaggaaccuaccagcucgag

SEQ ID NO: 821760 - RNA, 22 nt, Human
cauagagugauguaagguaugu

SEQ ID NO: 821761 - RNA, 22 nt, Human
ugucucugggugauucaguccu

SEQ ID NO: 821762 - RNA, 22 nt, Human
aagcaauagcaacaacuuuaca

SEQ ID NO: 821763 - RNA, 22 nt, Human
gugcagcugugguggagccagg

SEQ ID NO: 821764 - RNA, 22 nt, Human
ucauggauggccgggaggugau

SEQ ID NO: 821765 - RNA, 22 nt, Human
gguuauauaauucagugcuuuc

SEQ ID NO: 821766 - RNA, 22 nt, Human
caggaggggguggaguuucgcc

SEQ ID NO: 821767 - RNA, 22 nt, Human
cacaauuuccuugcuucacuuu

SEQ ID NO: 821768 - RNA, 22 nt, Human
ugcucuucggggccacugcuug

SEQ ID NO: 821769 - RNA, 22 nt, Human
gauggcagucaaccaggugagg

SEQ ID NO: 821770 - RNA, 22 nt, Human
uuuuguuguaauauaccuaucc

SEQ ID NO: 821771 - RNA, 22 nt, Human
caagauggguguugugaugguu

SEQ ID NO: 821772 - RNA, 22 nt, Human
aggacuuagaacauuauguacu

SEQ ID NO: 821773 - RNA, 22 nt, Human
cacugucuuuugugaagacaau

SEQ ID NO: 821774 - RNA, 22 nt, Human
agugcuuuagagaaauggugcu

SEQ ID NO: 821775 - RNA, 22 nt, Human
acugccauuggucaaaugagug

SEQ ID NO: 821776 - RNA, 22 nt, Human
uaacauuagguagacauaagcc

SEQ ID NO: 821777 - RNA, 22 nt, Human
cccaaggacacgggcagggaca

SEQ ID NO: 821778 - RNA, 22 nt, Human
aguccaugguucugacucaucu

SEQ ID NO: 821779 - RNA, 22 nt, Human
gauuucuuugcaagcuguguuc

SEQ ID NO: 821780 - RNA, 22 nt, Human
ucucaagaucucaagauggccc

SEQ ID NO: 821781 - RNA, 22 nt, Human
ugaggcagcccacuuuccuuag

SEQ ID NO: 821782 - RNA, 22 nt, Human
gcccaggaggcagagguugugg

SEQ ID NO: 821783 - RNA, 22 nt, Human
ugaaagcagcaccaauaccauu

SEQ ID NO: 821784 - RNA, 22 nt, Human
agaaaacuugucacagcucuca

SEQ ID NO: 821785 - RNA, 22 nt, Human
uuucacaucagagguagauuag

SEQ ID NO: 821786 - RNA, 22 nt, Human
uuguuuuaucuuucuacagacu

SEQ ID NO: 821787 - RNA, 22 nt, Human
gaccauuugcuaguaaauugca

SEQ ID NO: 821788 - RNA, 22 nt, Human
guugacagcuggugagcugcua

SEQ ID NO: 821789 - RNA, 22 nt, Human
ugcuucagaggaaaggcaaaag

SEQ ID NO: 821790 - RNA, 22 nt, Human
uucaaauacauucuuugccacu

SEQ ID NO: 821791 - RNA, 22 nt, Human
cccaggagacagaaacagaggu

SEQ ID NO: 821792 - RNA, 22 nt, Human
aguuauaugugaaaacacguau

SEQ ID NO: 821793 - RNA, 22 nt, Human
cucuccucugaaguggugaccc

SEQ ID NO: 821794 - RNA, 22 nt, Human
agugauggugagugagaagcuc

SEQ ID NO: 821795 - RNA, 22 nt, Human
ugaugaauaaacuugagaguca

SEQ ID NO: 821796 - RNA, 22 nt, Human
cugcuguguuucacaccucugg

SEQ ID NO: 821797 - RNA, 22 nt, Human
gccaggagaaaaggcgaaugau

SEQ ID NO: 821798 - RNA, 22 nt, Human
cagguaaaaauaaauuugugag

SEQ ID NO: 821799 - RNA, 22 nt, Human
aggcagccaucugcaggaagga

SEQ ID NO: 821800 - RNA, 22 nt, Human
gccaggaggggagaguguguca

SEQ ID NO: 821801 - RNA, 22 nt, Human
uggagagguugaauaacuuguc

SEQ ID NO: 821802 - RNA, 22 nt, Human
ugcugaaaacucaaccauugug

SEQ ID NO: 821803 - RNA, 22 nt, Human
uggcagcuacagacagagguga

SEQ ID NO: 821804 - RNA, 22 nt, Human
acccaggagcaggcugggcagu

SEQ ID NO: 821805 - RNA, 22 nt, Human
cauuuauucauuugcuagggcu

SEQ ID NO: 821806 - RNA, 22 nt, Human
aagcaccuggguuauaucuuag

SEQ ID NO: 821807 - RNA, 22 nt, Human
acucaggaaaugagaggcucuc

SEQ ID NO: 821808 - RNA, 22 nt, Human
cucaggaugaaagucaugguga

SEQ ID NO: 821809 - RNA, 22 nt, Human
guuugcauuuauuagucuucug

SEQ ID NO: 821810 - RNA, 22 nt, Human
cagcugcuguuacugcuuauua

SEQ ID NO: 821811 - RNA, 22 nt, Human
agacaggagagggaacugccgg

SEQ ID NO: 821812 - RNA, 22 nt, Human
gcccaggauggcuggaggugcu

SEQ ID NO: 821813 - RNA, 18 nt, Human
ugagaggcagguagagga

SEQ ID NO: 821814 - RNA, 22 nt, Human
uuugcagugucagcuucugugu

SEQ ID NO: 821815 - RNA, 22 nt, Human
uuuccagguauuaauacuguau

SEQ ID NO: 821816 - RNA, 17 nt, Human
ugaaggccaugaccacg

SEQ ID NO: 821817 - RNA, 22 nt, Human
aggcagguuggugagaagacug

SEQ ID NO: 821818 - RNA, 22 nt, Human
cccaggagaauauuuuuggguc

SEQ ID NO: 821819 - RNA, 22 nt, Human
acaugauuuuaguaucauaaua

SEQ ID NO: 821820 - RNA, 22 nt, Human
uuugcagugauucuugcaguga

SEQ ID NO: 821821 - RNA, 22 nt, Human
augcuuuuccaggagaaauaua

SEQ ID NO: 821822 - RNA, 22 nt, Human
aggagaggaaucauuauuacaa

SEQ ID NO: 821823 - RNA, 22 nt, Human
acaggagaauuaucuggaacaa

SEQ ID NO: 821824 - RNA, 22 nt, Human
caugcugugcaucuugaugacc

SEQ ID NO: 821825 - RNA, 22 nt, Human
cuggcugugcagucuuccagaa

SEQ ID NO: 821826 - RNA, 22 nt, Human
auuauauaggacuugcccuucc

SEQ ID NO: 821827 - RNA, 22 nt, Human
gaggcagagugcaccccaggag

SEQ ID NO: 821828 - RNA, 22 nt, Human
agaggccagguccagaguuugu

SEQ ID NO: 821829 - RNA, 22 nt, Human
augcugugccuggaaagcggcu

SEQ ID NO: 821830 - RNA, 22 nt, Human
ugaggcaguauucuccauucca

SEQ ID NO: 821831 - RNA, 22 nt, Human
gaggggaaagugugaggcugcg

SEQ ID NO: 821832 - RNA, 22 nt, Human
gucuucaauagagccucaauuu

SEQ ID NO: 821833 - RNA, 22 nt, Human
cuuacagagaagaaaauguagu

SEQ ID NO: 821834 - RNA, 22 nt, Human
uucuaugccauguucagcuacu

SEQ ID NO: 821835 - RNA, 22 nt, Human
gcugcugugaauuuuuuaaaug

SEQ ID NO: 821836 - RNA, 22 nt, Human
aucaggaucagggcuagcagag

SEQ ID NO: 821837 - RNA, 22 nt, Human
aaguugagaugucauaggagac

SEQ ID NO: 821838 - RNA, 22 nt, Human
cucagaagaacaaaggcucuac

SEQ ID NO: 821839 - RNA, 18 nt, Human
uuccaugauuccuuucac

SEQ ID NO: 821840 - RNA, 22 nt, Human
gaaggccauuuuuagguagaau

SEQ ID NO: 821841 - RNA, 22 nt, Human
cagaaggcuggcagauugagau

SEQ ID NO: 821842 - RNA, 22 nt, Human
gcagaggagaugaagauacuuu

SEQ ID NO: 821843 - RNA, 21 nt, Human
acagacagggccagugucccc

SEQ ID NO: 821844 - RNA, 22 nt, Human
ggccaggagaggagggcacuga

SEQ ID NO: 821845 - RNA, 22 nt, Human
cccaggaggucgaagcugcagu

SEQ ID NO: 821846 - RNA, 22 nt, Human
cccagaaggucgaggcugcagu

SEQ ID NO: 821847 - RNA, 22 nt, Human
uuucauuuugguuaugccauaa

SEQ ID NO: 821848 - RNA, 22 nt, Human
ugccugugguuccaguuuuuuc

SEQ ID NO: 821849 - RNA, 22 nt, Human
guucuucaucauuuuagauagg

SEQ ID NO: 821850 - RNA, 22 nt, Human
aacaaaugaccugauuucuucc

SEQ ID NO: 821851 - RNA, 22 nt, Human
gaggagcuugugagaagauguc

SEQ ID NO: 821852 - RNA, 22 nt, Human
aggcagcauccagaggagaaug

SEQ ID NO: 821853 - RNA, 22 nt, Human
cccuuagcucaauuucuugccc

SEQ ID NO: 821854 - RNA, 22 nt, Human
aggcaguuuaggcagcgauuua

SEQ ID NO: 821855 - RNA, 22 nt, Human
augaggcaaucaugguccaguu

SEQ ID NO: 821856 - RNA, 22 nt, Human
augcuguguuugagaaccuagg

SEQ ID NO: 821857 - RNA, 18 nt, Human
cugcccagagcacuugug

SEQ ID NO: 821858 - RNA, 22 nt, Human
gcccaggaaguugaggcugccg

SEQ ID NO: 821859 - RNA, 22 nt, Human
cuuccuucugaagcauagaagc

SEQ ID NO: 821860 - RNA, 22 nt, Human
ugcaugugcccacucuggcuua

SEQ ID NO: 821861 - RNA, 23 nt, Human
accaggagaaaagcuuugcggga

SEQ ID NO: 821862 - RNA, 22 nt, Human
uuucagaaagcugaacauauga

SEQ ID NO: 821863 - RNA, 22 nt, Human
ugccuguguugauuacuuuguc

SEQ ID NO: 821864 - RNA, 22 nt, Human
cucagaauuuagggcucugagg

SEQ ID NO: 821865 - RNA, 22 nt, Human
uuucccagagguaugaauaagu

SEQ ID NO: 821866 - RNA, 22 nt, Human
uugaaggacauccuauuucuag

SEQ ID NO: 821867 - RNA, 18 nt, Human
aggcaggcuggagugacu

SEQ ID NO: 821868 - RNA, 19 nt, Human
acauuuaaauucagaucuc

SEQ ID NO: 821869 - RNA, 22 nt, Human
cugaaaauguuacacaggaaga

SEQ ID NO: 821870 - RNA, 22 nt, Human
aucaggaugaagcuguagcgaa

SEQ ID NO: 821871 - RNA, 22 nt, Human
uuuauuugaaucaggggagaau

SEQ ID NO: 821872 - RNA, 22 nt, Human
caggagggcccgagacucuucc

SEQ ID NO: 821873 - RNA, 22 nt, Human
uuuguaugugauaagacuauuc

SEQ ID NO: 821874 - RNA, 22 nt, Human
cuucaggauuuaggaagaugaa

SEQ ID NO: 821875 - RNA, 22 nt, Human
ugaggcaggagaauggcgggaa

SEQ ID NO: 821876 - RNA, 22 nt, Human
uugaaauacugcauuguucagu

SEQ ID NO: 821877 - RNA, 22 nt, Human
gaagcagccacggggagacaga

SEQ ID NO: 821878 - RNA, 23 nt, Human
acagaaaucauuuguaagguacc

SEQ ID NO: 821879 - RNA, 22 nt, Human
ucugucuucaucagcaugugau

SEQ ID NO: 821880 - RNA, 22 nt, Human
agagggagcccagucauagcug

SEQ ID NO: 821881 - RNA, 22 nt, Human
acaaauauuuacugaauccacu

SEQ ID NO: 821882 - RNA, 23 nt, Human
auucuucauuaucuucuagaaaa

SEQ ID NO: 821883 - RNA, 22 nt, Human
aaagccagagcaagcugucaca

SEQ ID NO: 821884 - RNA, 22 nt, Human
cagcagagaaauuaaacuucug

SEQ ID NO: 821885 - RNA, 22 nt, Human
cuugggaaugcuaacagaugac

SEQ ID NO: 821886 - RNA, 22 nt, Human
aaggcagcaccgccuccugaaa

SEQ ID NO: 821887 - RNA, 22 nt, Human
gaaggccaagaggcuccaagau

SEQ ID NO: 821888 - RNA, 22 nt, Human
ugauugaagaggugaggaaguu

SEQ ID NO: 821889 - RNA, 21 nt, Human
ggcagcucagcagauggggac

SEQ ID NO: 821890 - RNA, 22 nt, Human
caggaugagaagggcucuuacg

SEQ ID NO: 821891 - RNA, 22 nt, Human
caaauguaaauucuuuugaagc

SEQ ID NO: 821892 - RNA, 22 nt, Human
cauggcugcgagaagagugggu

SEQ ID NO: 821893 - RNA, 22 nt, Human
cacaaauggccguguucaaaga

SEQ ID NO: 821894 - RNA, 22 nt, Human
acuuuugguucuguaacuguga

SEQ ID NO: 821895 - RNA, 21 nt, Human
uucuccccagcgaauccucgg

SEQ ID NO: 821896 - RNA, 22 nt, Human
uucugggacaucuggacaguuu

SEQ ID NO: 821897 - RNA, 22 nt, Human
ucccaggagcaccuuuugagcc

SEQ ID NO: 821898 - RNA, 22 nt, Human
cauuucacaaauggccacauca

SEQ ID NO: 821899 - RNA, 22 nt, Human
agggcagccucucagccuaggu

SEQ ID NO: 821900 - RNA, 22 nt, Human
cucaggaugucggugacuauug

SEQ ID NO: 821901 - RNA, 22 nt, Human
ugcugcugauggcaccuaggca

SEQ ID NO: 821902 - RNA, 19 nt, Human
uggcaggcccaggauggac

SEQ ID NO: 821903 - RNA, 22 nt, Human
aaauuuucagagcacuagagaa

SEQ ID NO: 821904 - RNA, 22 nt, Human
uugaaagucacaauggcauuaa

SEQ ID NO: 821905 - RNA, 22 nt, Human
gauggcagcauauugacagcau

SEQ ID NO: 821906 - RNA, 22 nt, Human
guggcagcaaaugccuggacua

SEQ ID NO: 821907 - RNA, 23 nt, Human
uucauuugucuacuucacuuguu

SEQ ID NO: 821908 - RNA, 22 nt, Human
uuucccaguucccugcucuaua

SEQ ID NO: 821909 - RNA, 22 nt, Human
uuagccauauagaaaaagagcu

SEQ ID NO: 821910 - RNA, 19 nt, Human
cuucuucuuggcagccaag

SEQ ID NO: 821911 - RNA, 20 nt, Human
agauuauuccuaagauuucu

SEQ ID NO: 821912 - RNA, 22 nt, Human
ucaggagacauucuuaaaguag

SEQ ID NO: 821913 - RNA, 19 nt, Human
uccaggaggcugccauuga

SEQ ID NO: 821914 - RNA, 22 nt, Human
aaauguauugcauaggauauuu

SEQ ID NO: 821915 - RNA, 22 nt, Human
gcaggagaaaugaagauugggu

SEQ ID NO: 821916 - RNA, 22 nt, Human
uugaaguuguaguucagugaag

SEQ ID NO: 821917 - RNA, 22 nt, Human
cuguauuucccacauucucuau

SEQ ID NO: 821918 - RNA, 21 nt, Human
agccagcuaucacacagcauu

SEQ ID NO: 821919 - RNA, 22 nt, Human
ugcugugagguugagaaggaag

SEQ ID NO: 821920 - RNA, 22 nt, Human
cauggagauaaacugaaauauu

SEQ ID NO: 821921 - RNA, 22 nt, Human
ucacaguaucacacaaggauua

SEQ ID NO: 821922 - RNA, 22 nt, Human
aaaccgcaauuacuuuugcguc

SEQ ID NO: 821923 - RNA, 22 nt, Human
aaguauaagcuauucuucauga

SEQ ID NO: 821924 - RNA, 22 nt, Human
caggcagcugcuggguucagcc

SEQ ID NO: 821925 - RNA, 21 nt, Human
uccuuccuugagguccuuucc

SEQ ID NO: 821926 - RNA, 20 nt, Human
cuguggaauuuuaccaugcg

SEQ ID NO: 821927 - RNA, 22 nt, Human
acccaggacacagagaugaccc

SEQ ID NO: 821928 - RNA, 22 nt, Human
ccaggaagcugucugauaugaa

SEQ ID NO: 821929 - RNA, 18 nt, Human
caugucugcgccacaagg

SEQ ID NO: 821930 - RNA, 22 nt, Human
gcugauguaagacuuuugguuu

SEQ ID NO: 821931 - RNA, 22 nt, Human
gagggcauaguuaaauaggagg

SEQ ID NO: 821932 - RNA, 22 nt, Human
agagggauaauauguauuguaa

SEQ ID NO: 821933 - RNA, 22 nt, Human
uggaggaaguggcuggccagaa

SEQ ID NO: 821934 - RNA, 17 nt, Human
uagcuguguuucagcua

SEQ ID NO: 821935 - RNA, 19 nt, Human
cuggccaggccaggggccc

SEQ ID NO: 821936 - RNA, 22 nt, Human
ggaggggagguccagcugaucu

SEQ ID NO: 821937 - RNA, 18 nt, Human
ccagguggugacagagau

SEQ ID NO: 821938 - RNA, 22 nt, Human
gagcgauguggguauguagaag

SEQ ID NO: 821939 - RNA, 22 nt, Human
auacauacauguaugcacauac

SEQ ID NO: 821940 - RNA, 22 nt, Human
gcagggaagaucuuggagcugc

SEQ ID NO: 821941 - RNA, 23 nt, Human
uaauucacauauacauugcuuca

SEQ ID NO: 821942 - RNA, 22 nt, Human
uaugccugauaacugugucucu

SEQ ID NO: 821943 - RNA, 22 nt, Human
gaaauauucuugucuuguuuuc

SEQ ID NO: 821944 - RNA, 22 nt, Human
cucugcauuuuaacagaugauu

SEQ ID NO: 821945 - RNA, 22 nt, Human
uaucuguuaggaucagagcugg

SEQ ID NO: 821946 - RNA, 21 nt, Human
uucuucuuggacuguuuuggc

SEQ ID NO: 821947 - RNA, 22 nt, Human
ugcuggguuaccuaagccuaaa

SEQ ID NO: 821948 - RNA, 22 nt, Human
agggagcucaguuggaagcggu

SEQ ID NO: 821949 - RNA, 22 nt, Human
gcugguuuccuuaucuauaaag

SEQ ID NO: 821950 - RNA, 22 nt, Human
aggcaccuugcgguccagugaa

SEQ ID NO: 821951 - RNA, 22 nt, Human
cgaggcaggcaggcggaggaua

SEQ ID NO: 821952 - RNA, 22 nt, Human
uuuaaauuuguguuuagagggu

SEQ ID NO: 821953 - RNA, 22 nt, Human
ugcccagggauaagccuagaga

SEQ ID NO: 821954 - RNA, 22 nt, Human
acccaggagacggaggugcagu

SEQ ID NO: 821955 - RNA, 22 nt, Human
accauuuuggguauuuucagag

SEQ ID NO: 821956 - RNA, 22 nt, Human
cauugcuuccuaugucccuucu

SEQ ID NO: 821957 - RNA, 22 nt, Human
aaguguauauaugacuuauaaa

SEQ ID NO: 821958 - RNA, 22 nt, Human
aggacaggauugagcugaacug

SEQ ID NO: 821959 - RNA, 22 nt, Human
gaagaggaugacaggagccggu

SEQ ID NO: 821960 - RNA, 22 nt, Human
caguugccuacuacauggcagg

SEQ ID NO: 821961 - RNA, 22 nt, Human
aauugcuaaagauuauguuuuc

SEQ ID NO: 821962 - RNA, 22 nt, Human
gcccaggaguucaaggcugcag

SEQ ID NO: 821963 - RNA, 20 nt, Human
uauuuguauuugggaaaguu

SEQ ID NO: 821964 - RNA, 22 nt, Human
cccaggagaucuggaucucguc

SEQ ID NO: 821965 - RNA, 22 nt, Human
uuagccauggacugaauugacu

SEQ ID NO: 821966 - RNA, 22 nt, Human
aguucuucauaaccuuacugug

SEQ ID NO: 821967 - RNA, 22 nt, Human
gagaggucaucucccaucagca

SEQ ID NO: 821968 - RNA, 22 nt, Human
uugaaagaagaagcugcgaugu

SEQ ID NO: 821969 - RNA, 22 nt, Human
gaucauuuugaugcccuuuuag

SEQ ID NO: 821970 - RNA, 22 nt, Human
gcccaggaggucaaguagcuau

SEQ ID NO: 821971 - RNA, 22 nt, Human
ggagagugggagcaacuguugc

SEQ ID NO: 821972 - RNA, 22 nt, Human
agucucagaaaagaagcaugga

SEQ ID NO: 821973 - RNA, 22 nt, Human
gugcauuuaggucacaugaugu

SEQ ID NO: 821974 - RNA, 22 nt, Human
ucccaggauuuuaggcucucag

SEQ ID NO: 821975 - RNA, 22 nt, Human
aguaaagcagaguugcaguaca

SEQ ID NO: 821976 - RNA, 22 nt, Human
ucaggagagaguuggguaggcu

SEQ ID NO: 821977 - RNA, 20 nt, Human
uugauaggcagcuugucagg

SEQ ID NO: 821978 - RNA, 22 nt, Human
cugccaggcagggagauggcug

SEQ ID NO: 821979 - RNA, 22 nt, Human
ucuuugaauucaaacuguucaa

SEQ ID NO: 821980 - RNA, 22 nt, Human
ggaggaggcggcagaaguuccu

SEQ ID NO: 821981 - RNA, 22 nt, Human
gccaugcuugguaugcugugag

SEQ ID NO: 821982 - RNA, 22 nt, Human
auucuucaucacuaccuuguga

SEQ ID NO: 821983 - RNA, 22 nt, Human
gaggcagcagggcugguuccuu

SEQ ID NO: 821984 - RNA, 22 nt, Human
uauuuccaccuauuauuuucug

SEQ ID NO: 821985 - RNA, 21 nt, Human
agagagggagaugaaacaucc

SEQ ID NO: 821986 - RNA, 22 nt, Human
ucugcaggcuguacaggaagca

SEQ ID NO: 821987 - RNA, 22 nt, Human
aggaagcuagagccaccggacu

SEQ ID NO: 821988 - RNA, 22 nt, Human
aggcagcuuaagcccuggccca

SEQ ID NO: 821989 - RNA, 22 nt, Human
ggcaggcucagcagccaaggag

SEQ ID NO: 821990 - RNA, 22 nt, Human
gucaggaugggcagccaaacua

SEQ ID NO: 821991 - RNA, 22 nt, Human
ucagguggcuuggagggggacg

SEQ ID NO: 821992 - RNA, 22 nt, Human
ggagccuggucagguuggcucc

SEQ ID NO: 821993 - RNA, 22 nt, Human
agcauccaacaggagggaaggg

SEQ ID NO: 821994 - RNA, 22 nt, Human
gcauguguuauuuuauguauga

SEQ ID NO: 821995 - RNA, 22 nt, Human
cuacccagcaccuaggcugccu

SEQ ID NO: 821996 - RNA, 22 nt, Human
aguuugaaaguauugacagaag

SEQ ID NO: 821997 - RNA, 22 nt, Human
gucccauaaguagugcaacuug

SEQ ID NO: 821998 - RNA, 21 nt, Human
ucuuccuccacagcgugccac

SEQ ID NO: 821999 - RNA, 23 nt, Human
uuucaacuccugccauuauuucu

SEQ ID NO: 822000 - RNA, 23 nt, Human
ucucuuucaagagcuuaaugugc

SEQ ID NO: 822001 - RNA, 22 nt, Human
gcaggggcuaaggacacagaga

SEQ ID NO: 822002 - RNA, 22 nt, Human
uaaggccauuauggugggcccg

SEQ ID NO: 822003 - RNA, 22 nt, Human
gauuuuaauuauaggagguccu

SEQ ID NO: 822004 - RNA, 20 nt, Human
uuugucuguuaaguguuucu

SEQ ID NO: 822005 - RNA, 22 nt, Human
aaggcagcacagcaacugcuca

SEQ ID NO: 822006 - RNA, 20 nt, Human
aggcagcugggaaaugaggg

SEQ ID NO: 822007 - RNA, 22 nt, Human
aagggaggaggauuuauuguac

SEQ ID NO: 822008 - RNA, 19 nt, Human
ugccuggacaaaugugggg

SEQ ID NO: 822009 - RNA, 22 nt, Human
gcagaggggaagcugaggaauu

SEQ ID NO: 822010 - RNA, 22 nt, Human
auguuucagauacagaucaaau

SEQ ID NO: 822011 - RNA, 22 nt, Human
caguaaagcauguaugucuuca

SEQ ID NO: 822012 - RNA, 22 nt, Human
auucaaauuaaguuaauucagc

SEQ ID NO: 822013 - RNA, 21 nt, Human
aaugaaguggcuauuuugagg

SEQ ID NO: 822014 - RNA, 22 nt, Human
uuacuuuggguccugcuuauaa

SEQ ID NO: 822015 - RNA, 22 nt, Human
ucaggagaaucagggcuguccu

SEQ ID NO: 822016 - RNA, 22 nt, Human
uugcaaaggggaauaaagcaau

SEQ ID NO: 822017 - RNA, 22 nt, Human
gucuucaacaauaacuaccacu

SEQ ID NO: 822018 - RNA, 22 nt, Human
agaccaagacuauaaugagagg

SEQ ID NO: 822019 - RNA, 22 nt, Human
gggcaguuuauucuagaugguu

SEQ ID NO: 822020 - RNA, 22 nt, Human
auuacaguaacagcuacaaugc

SEQ ID NO: 822021 - RNA, 22 nt, Human
uguucuucuagauugccuuuua

SEQ ID NO: 822022 - RNA, 23 nt, Human
accaggagccaagaucucccugg

SEQ ID NO: 822023 - RNA, 22 nt, Human
uugcauuuaaguagauguuaca

SEQ ID NO: 822024 - RNA, 22 nt, Human
uuugacaaaggaaaaaugcaca

SEQ ID NO: 822025 - RNA, 22 nt, Human
ugaggcagggaguuuaauuguc

SEQ ID NO: 822026 - RNA, 22 nt, Human
uaaggccaauuaacaaccaggg

SEQ ID NO: 822027 - RNA, 22 nt, Human
caggcagcucaaccuugggagc

SEQ ID NO: 822028 - RNA, 22 nt, Human
ggagugucagaaacaguguccu

SEQ ID NO: 822029 - RNA, 22 nt, Human
ccaggaaaauaccaagcuuuaa

SEQ ID NO: 822030 - RNA, 22 nt, Human
auuaguaaaacauuguauaugu

SEQ ID NO: 822031 - RNA, 22 nt, Human
uuaucacuuaugagcuuuuugc

SEQ ID NO: 822032 - RNA, 22 nt, Human
gucaggaugagggaugaggagu

SEQ ID NO: 822033 - RNA, 22 nt, Human
uucucagaggagucgggagcug

SEQ ID NO: 822034 - RNA, 22 nt, Human
caguugcuggaugugcagcucu

SEQ ID NO: 822035 - RNA, 23 nt, Human
agaugagccaacaccuccaugcc

SEQ ID NO: 822036 - RNA, 22 nt, Human
auuaaauuuucacuaggcuccc

SEQ ID NO: 822037 - RNA, 22 nt, Human
aguggacucuucccagugcuug

SEQ ID NO: 822038 - RNA, 22 nt, Human
ggcagcuuccuaggagagggca

SEQ ID NO: 822039 - RNA, 22 nt, Human
gagggcuccucacauucucuau

SEQ ID NO: 822040 - RNA, 22 nt, Human
augaaacacacacgcgcauacu

SEQ ID NO: 822041 - RNA, 23 nt, Human
acagaaaguucugcuggacagag

SEQ ID NO: 822042 - RNA, 20 nt, Human
aucaggauucuugcuuuguu

SEQ ID NO: 822043 - RNA, 22 nt, Human
auuucauugaaguuaauucuuc

SEQ ID NO: 822044 - RNA, 22 nt, Human
cagcuuccauaagagauggaga

SEQ ID NO: 822045 - RNA, 22 nt, Human
augcugugaaaaagaaggcuga

SEQ ID NO: 822046 - RNA, 22 nt, Human
aaaguauucuugacuguuuuuc

SEQ ID NO: 822047 - RNA, 22 nt, Human
ucuucucuccugcuuggcagaa

SEQ ID NO: 822048 - RNA, 22 nt, Human
ugaggcaggagaaucaccggaa

SEQ ID NO: 822049 - RNA, 23 nt, Human
auugaugacuugauuacacuuuu

SEQ ID NO: 822050 - RNA, 22 nt, Human
ugaaaugaagggcuuguucugg

SEQ ID NO: 822051 - RNA, 22 nt, Human
gcaggcagagguggaggagaca

SEQ ID NO: 822052 - RNA, 22 nt, Human
aggagcagaacugauucugacu

SEQ ID NO: 822053 - RNA, 22 nt, Human
auaagcauguuagaauauuuga

SEQ ID NO: 822054 - RNA, 17 nt, Human
gcugacccuggagaagu

SEQ ID NO: 822055 - RNA, 22 nt, Human
ucucaggaucuaauacauggua

SEQ ID NO: 822056 - RNA, 22 nt, Human
aggcaagcauuuaaccacucau

SEQ ID NO: 822057 - RNA, 22 nt, Human
auucuucauacagacaaguccu

SEQ ID NO: 822058 - RNA, 22 nt, Human
uucuuuuccuacacagcgauuu

SEQ ID NO: 822059 - RNA, 22 nt, Human
aggcagacaaggacacaguggg

SEQ ID NO: 822060 - RNA, 19 nt, Human
ggcagucucaagcagcaca

SEQ ID NO: 822061 - RNA, 22 nt, Human
gaggcagcuuggggcugugggu

SEQ ID NO: 822062 - RNA, 22 nt, Human
uuucaugaggggcaaaaucuca

SEQ ID NO: 822063 - RNA, 22 nt, Human
gagggagggacuagcauucucu

SEQ ID NO: 822064 - RNA, 22 nt, Human
aucaggaugacaacugcugggu

SEQ ID NO: 822065 - RNA, 22 nt, Human
caaauguauucucacuucaggg

SEQ ID NO: 822066 - RNA, 22 nt, Human
gaggcagcaggcugaggaggau

SEQ ID NO: 822067 - RNA, 22 nt, Human
ccuucuucuguguggcccaaga

SEQ ID NO: 822068 - RNA, 20 nt, Human
aagggcagagggaacagacu

SEQ ID NO: 822069 - RNA, 22 nt, Human
gagucuuugguaaagucugcug

SEQ ID NO: 822070 - RNA, 22 nt, Human
uagaagcaguaauagaaauagg

SEQ ID NO: 822071 - RNA, 22 nt, Human
cuuaaauucuuaaugcccucau

SEQ ID NO: 822072 - RNA, 19 nt, Human
aaagcagaggagcaucuga

SEQ ID NO: 822073 - RNA, 22 nt, Human
uccaggagacacaagguacaua

SEQ ID NO: 822074 - RNA, 17 nt, Human
acagagcacaucaagau

SEQ ID NO: 822075 - RNA, 22 nt, Human
uucuucaaaacaacacuggccu

SEQ ID NO: 822076 - RNA, 22 nt, Human
cauuuguaguaucuguuuauau

SEQ ID NO: 822077 - RNA, 22 nt, Human
uugaaagaggcaaaguuugauc

SEQ ID NO: 822078 - RNA, 22 nt, Human
gcucaggaccgaggggugggaa

SEQ ID NO: 822079 - RNA, 22 nt, Human
uggcagcuggaucccaaggcag

SEQ ID NO: 822080 - RNA, 22 nt, Human
gaggcugaggguuagagaguca

SEQ ID NO: 822081 - RNA, 22 nt, Human
aggcaguggaaggagaaagcaa

SEQ ID NO: 822082 - RNA, 22 nt, Human
uuaaaaugaauauugauuagca

SEQ ID NO: 822083 - RNA, 22 nt, Human
ggguggaguagaaagaugaauu

SEQ ID NO: 822084 - RNA, 22 nt, Human
ucacaucucccuggaggacaca

SEQ ID NO: 822085 - RNA, 22 nt, Human
aaugcauauguaggcaagcagu

SEQ ID NO: 822086 - RNA, 22 nt, Human
auuauuauauagggaaaguccc

SEQ ID NO: 822087 - RNA, 22 nt, Human
aucaggauagugguuaccuggg

SEQ ID NO: 822088 - RNA, 22 nt, Human
uccaggagucagacagauggug

SEQ ID NO: 822089 - RNA, 22 nt, Human
uuuccagagcaugucugcucag

SEQ ID NO: 822090 - RNA, 22 nt, Human
cagaugaggcaaccucauugcu

SEQ ID NO: 822091 - RNA, 22 nt, Human
ccagcagagcauggggaggaag

SEQ ID NO: 822092 - RNA, 19 nt, Human
cucucacucgccacauccu

SEQ ID NO: 822093 - RNA, 22 nt, Human
caugcugugugguuagaacugu

SEQ ID NO: 822094 - RNA, 22 nt, Human
ccacuguuuuucaguuaacuuu

SEQ ID NO: 822095 - RNA, 22 nt, Human
uaggcagcagugcuaugauucu

SEQ ID NO: 822096 - RNA, 22 nt, Human
agccuauuccaggaugagcuca

SEQ ID NO: 822097 - RNA, 22 nt, Human
ggacagaggguugacagaguau

SEQ ID NO: 822098 - RNA, 21 nt, Human
uuugaaagcccuauguuuuca

SEQ ID NO: 822099 - RNA, 22 nt, Human
acccaggaugauaauguucaca

SEQ ID NO: 822100 - RNA, 21 nt, Human
cccaggagaagaaaagaugca

SEQ ID NO: 822101 - RNA, 22 nt, Human
ucgcugugguuucuguacaugg

SEQ ID NO: 822102 - RNA, 22 nt, Human
uccaggaguuugaccugugggc

SEQ ID NO: 822103 - RNA, 22 nt, Human
accaggagcauuuuuuauuagu

SEQ ID NO: 822104 - RNA, 22 nt, Human
aacauucugguucuaaaaaccu

SEQ ID NO: 822105 - RNA, 21 nt, Human
acagucuccccagaucucucc

SEQ ID NO: 822106 - RNA, 22 nt, Human
acaucucaugaaugauaaauca

SEQ ID NO: 822107 - RNA, 22 nt, Human
ucugcuguaaagaauuucugcc

SEQ ID NO: 822108 - RNA, 22 nt, Human
aaaggccagguuggcugguauu

SEQ ID NO: 822109 - RNA, 22 nt, Human
uccauuuucaucucauguauaa

SEQ ID NO: 822110 - RNA, 22 nt, Human
uguugauuaguguuuagacuua

SEQ ID NO: 822111 - RNA, 22 nt, Human
aggagaggcucuaacucugugu

SEQ ID NO: 822112 - RNA, 22 nt, Human
augugucuuugagacucugcua

SEQ ID NO: 822113 - RNA, 22 nt, Human
acaggagacccugcugguucug

SEQ ID NO: 822114 - RNA, 21 nt, Human
gugcuuuuccuuaauguucuu

SEQ ID NO: 822115 - RNA, 22 nt, Human
ggaggaggggugacugaaugcu

SEQ ID NO: 822116 - RNA, 21 nt, Human
ugaaugaggaggauggcauuu

SEQ ID NO: 822117 - RNA, 22 nt, Human
ggcagcuguaagaugagugaau

SEQ ID NO: 822118 - RNA, 22 nt, Human
ggcagacuguaauaggagaauu

SEQ ID NO: 822119 - RNA, 22 nt, Human
gaugccucuuuuggcugaauua

SEQ ID NO: 822120 - RNA, 22 nt, Human
guuauaaaaugcacaguuguuu

SEQ ID NO: 822121 - RNA, 22 nt, Human
ccauuguaaauucuguggaagu

SEQ ID NO: 822122 - RNA, 22 nt, Human
augcagcugucagggagaacau

SEQ ID NO: 822123 - RNA, 22 nt, Human
ugaaaugagauagauaaucagg

SEQ ID NO: 822124 - RNA, 19 nt, Human
agaggcagucuccaacagg

SEQ ID NO: 822125 - RNA, 22 nt, Human
uuuucaguaaugucuacauaau

SEQ ID NO: 822126 - RNA, 22 nt, Human
aguauugugacucaaguauucu

SEQ ID NO: 822127 - RNA, 22 nt, Human
cugcuucugggaugauggagua

SEQ ID NO: 822128 - RNA, 22 nt, Human
ucuucauuccguagauauuuau

SEQ ID NO: 822129 - RNA, 22 nt, Human
ucuucaaguuccaaagugcagg

SEQ ID NO: 822130 - RNA, 22 nt, Human
cauuuguaggaugcuucuuguu

SEQ ID NO: 822131 - RNA, 22 nt, Human
agagcagcuggggcagagacca

SEQ ID NO: 822132 - RNA, 22 nt, Human
aguucucaagacaauuaccugu

SEQ ID NO: 822133 - RNA, 22 nt, Human
gcuggcagggacagcugcgugu

SEQ ID NO: 822134 - RNA, 22 nt, Human
uuugaaguggaaaaggauuuaa

SEQ ID NO: 822135 - RNA, 20 nt, Human
aagagaggaaguuauacuag

SEQ ID NO: 822136 - RNA, 22 nt, Human
augcugugauuguagaaauauu

SEQ ID NO: 822137 - RNA, 22 nt, Human
ggaggggucucuagcgaggaga

SEQ ID NO: 822138 - RNA, 22 nt, Human
uccaggagggauugggcugugg

SEQ ID NO: 822139 - RNA, 22 nt, Human
caggaaagggaugggcugccac

SEQ ID NO: 822140 - RNA, 22 nt, Human
ucauuuguucucauucucuacu

SEQ ID NO: 822141 - RNA, 22 nt, Human
cccuggaggcaaagguugcagu

SEQ ID NO: 822142 - RNA, 22 nt, Human
auuucccaugugaaucaauugg

SEQ ID NO: 822143 - RNA, 22 nt, Human
ucuacugugguccuuguaacca

SEQ ID NO: 822144 - RNA, 22 nt, Human
ccagggaguuuccaaucugaga

SEQ ID NO: 822145 - RNA, 22 nt, Human
accaggagguguuugcucaagu

SEQ ID NO: 822146 - RNA, 22 nt, Human
uuggcagugaugcagcuuguuc

SEQ ID NO: 822147 - RNA, 22 nt, Human
caggcagcugacugucagauau

SEQ ID NO: 822148 - RNA, 22 nt, Human
gccaggaggcugcuguguaggc

SEQ ID NO: 822149 - RNA, 22 nt, Human
agcaccaugaccuugccauuga

SEQ ID NO: 822150 - RNA, 22 nt, Human
cagugauggauauggagaaguc

SEQ ID NO: 822151 - RNA, 22 nt, Human
cuugcugucccuugguaugaac

SEQ ID NO: 822152 - RNA, 22 nt, Human
gaaacuguauguaguuuuuggg

SEQ ID NO: 822153 - RNA, 22 nt, Human
gagacagcacaggccacuggga

SEQ ID NO: 822154 - RNA, 22 nt, Human
cuuuuauuuugaauuaagggcu

SEQ ID NO: 822155 - RNA, 22 nt, Human
ccuggacucaggcugugggcac

SEQ ID NO: 822156 - RNA, 22 nt, Human
cagcugacccgugggaggcggg

SEQ ID NO: 822157 - RNA, 22 nt, Human
acacuaaugagaaaggaauuaa

SEQ ID NO: 822158 - RNA, 22 nt, Human
gaggagagccugcacuuugacc

SEQ ID NO: 822159 - RNA, 23 nt, Human
caguggagacucaugcuuccuua

SEQ ID NO: 822160 - RNA, 23 nt, Human
auguuauuauuagcagucuugcc

SEQ ID NO: 822161 - RNA, 22 nt, Human
augcugugagugugccgcagag

SEQ ID NO: 822162 - RNA, 17 nt, Human
guccuacccauggucua

SEQ ID NO: 822163 - RNA, 22 nt, Human
cuugaaagauuuggccucugug

SEQ ID NO: 822164 - RNA, 22 nt, Human
ugaacaaacugcauucuucacu

SEQ ID NO: 822165 - RNA, 22 nt, Human
gugcugugcgcuuuuucuguau

SEQ ID NO: 822166 - RNA, 22 nt, Human
aggcaagcugcagagaguccuu

SEQ ID NO: 822167 - RNA, 22 nt, Human
uuugaauaucacaaacuuucaa

SEQ ID NO: 822168 - RNA, 22 nt, Human
ucuacuguagugaugcugcagu

SEQ ID NO: 822169 - RNA, 22 nt, Human
gagggaggggagcuccacccuc

SEQ ID NO: 822170 - RNA, 22 nt, Human
cccaggaggcggagguuguggu

SEQ ID NO: 822171 - RNA, 22 nt, Human
aaaaugagauacaguuugaaag

SEQ ID NO: 822172 - RNA, 19 nt, Human
agucuuucccacucgucuu

SEQ ID NO: 822173 - RNA, 22 nt, Human
uuucacaaaugucuuuaacuug

SEQ ID NO: 822174 - RNA, 22 nt, Human
agagugcagauaagagaauguu

SEQ ID NO: 822175 - RNA, 22 nt, Human
uucuugcaggucacucacugag

SEQ ID NO: 822176 - RNA, 22 nt, Human
ucuucagauggccaguuguccc

SEQ ID NO: 822177 - RNA, 22 nt, Human
uggcagcuggcucugcgcaggc

SEQ ID NO: 822178 - RNA, 22 nt, Human
uaauaucuacuucauagaguuu

SEQ ID NO: 822179 - RNA, 22 nt, Human
ggcucagaccucccagcuccag

SEQ ID NO: 822180 - RNA, 22 nt, Human
agagggcugcugcacagugcuc

SEQ ID NO: 822181 - RNA, 22 nt, Human
cagaguucaaagccugcuggga

SEQ ID NO: 822182 - RNA, 22 nt, Human
cuuagaaaucgaacucagguua

SEQ ID NO: 822183 - RNA, 22 nt, Human
caaggccaagucucugugaaga

SEQ ID NO: 822184 - RNA, 22 nt, Human
cagcugacagugaggugggggc

SEQ ID NO: 822185 - RNA, 22 nt, Human
aucaggauuacacggggaugcu

SEQ ID NO: 822186 - RNA, 22 nt, Human
aggccagcuuccagaggggcag

SEQ ID NO: 822187 - RNA, 21 nt, Human
ucacagacuggucagugaggc

SEQ ID NO: 822188 - RNA, 22 nt, Human
ccuugcguuuuacagcuucuag

SEQ ID NO: 822189 - RNA, 22 nt, Human
uuucaguuuaugucuugaauua

SEQ ID NO: 822190 - RNA, 22 nt, Human
ggccagcucugcacagcagcug

SEQ ID NO: 822191 - RNA, 22 nt, Human
aaagcagaggugauaugacuua

SEQ ID NO: 822192 - RNA, 22 nt, Human
aaaauuauucauggcuuuugga

SEQ ID NO: 822193 - RNA, 22 nt, Human
acccaggagagagcuauaaaau

SEQ ID NO: 822194 - RNA, 22 nt, Human
caggagagcccggguccgggcu

SEQ ID NO: 822195 - RNA, 22 nt, Human
ucacaaauauuuuaacaguagg

SEQ ID NO: 822196 - RNA, 22 nt, Human
gugguaaucggauucuuaccgg

SEQ ID NO: 822197 - RNA, 22 nt, Human
ggaggacacuggcucugccuuc

SEQ ID NO: 822198 - RNA, 22 nt, Human
aaggaaccauuugugugcaugg

SEQ ID NO: 822199 - RNA, 22 nt, Human
agaaaugaagcaggaguuauua

SEQ ID NO: 822200 - RNA, 22 nt, Human
cuugaaagcacuuaguaaauua

SEQ ID NO: 822201 - RNA, 21 nt, Human
uucuucaugaugauuaauggc

SEQ ID NO: 822202 - RNA, 22 nt, Human
uuaaaugaggcugauguagauu

SEQ ID NO: 822203 - RNA, 22 nt, Human
uagcucuucaaucacugucucc

SEQ ID NO: 822204 - RNA, 22 nt, Human
gagcagcucugugccuggagac

SEQ ID NO: 822205 - RNA, 22 nt, Human
gggacuucauagcuaggcacuu

SEQ ID NO: 822206 - RNA, 22 nt, Human
agagagagggaaacugcuaaac

SEQ ID NO: 822207 - RNA, 22 nt, Human
uaaggccaaacuauuauaguuc

SEQ ID NO: 822208 - RNA, 22 nt, Human
uuuuuauaacucuuuugugaca

SEQ ID NO: 822209 - RNA, 22 nt, Human
cccaggagagaggccaguuggc

SEQ ID NO: 822210 - RNA, 22 nt, Human
cauuuguuuagaagucuuuaua

SEQ ID NO: 822211 - RNA, 22 nt, Human
uuucugugguggguaguucaga

SEQ ID NO: 822212 - RNA, 22 nt, Human
ggcagcugucucugaguuagca

SEQ ID NO: 822213 - RNA, 22 nt, Human
ucaaauaaugccauucaucauc

SEQ ID NO: 822214 - RNA, 22 nt, Human
uaaauuaugucacaugacucug

SEQ ID NO: 822215 - RNA, 22 nt, Human
aucugcuugaaugagcaacagg

SEQ ID NO: 822216 - RNA, 22 nt, Human
cauaauauacuacauugaugaa

SEQ ID NO: 822217 - RNA, 22 nt, Human
gagagucuaggaaccucauaua

SEQ ID NO: 822218 - RNA, 22 nt, Human
uagggcagagcuuguacacgau

SEQ ID NO: 822219 - RNA, 22 nt, Human
uucaggaucaaguugccaguag

SEQ ID NO: 822220 - RNA, 22 nt, Human
gacggcagaaacucaugagguc

SEQ ID NO: 822221 - RNA, 22 nt, Human
guaggcagauaggagugcagcc

SEQ ID NO: 822222 - RNA, 22 nt, Human
auucaaguccagcuucucuaca

SEQ ID NO: 822223 - RNA, 22 nt, Human
uggccaggcagguagaacggcc

SEQ ID NO: 822224 - RNA, 22 nt, Human
aucugcagaggacaggcgagga

SEQ ID NO: 822225 - RNA, 22 nt, Human
uuagccaugcccuagaagagga

SEQ ID NO: 822226 - RNA, 22 nt, Human
cauuuguaauacugacuugcag

SEQ ID NO: 822227 - RNA, 19 nt, Human
uaaggccaaaaguaagugu

SEQ ID NO: 822228 - RNA, 22 nt, Human
gagggucccugcucagggccag

SEQ ID NO: 822229 - RNA, 22 nt, Human
uuuaaauuuagaagaaacacug

SEQ ID NO: 822230 - RNA, 22 nt, Human
gaacccaggcuuuugaggcugu

SEQ ID NO: 822231 - RNA, 22 nt, Human
cuucugugauuugguuaggaua

SEQ ID NO: 822232 - RNA, 18 nt, Human
gucacuguguuucugagc

SEQ ID NO: 822233 - RNA, 22 nt, Human
uuugcaaauaccaugaaacuug

SEQ ID NO: 822234 - RNA, 18 nt, Human
gaugggagcaagagaaga

SEQ ID NO: 822235 - RNA, 22 nt, Human
guacauuucucuuguucuuauu

SEQ ID NO: 822236 - RNA, 22 nt, Human
acagugcuaaacacuucuugaa

SEQ ID NO: 822237 - RNA, 22 nt, Human
agucuucucauuucacaugcuu

SEQ ID NO: 822238 - RNA, 22 nt, Human
agugcagcaugcuggggaggcu

SEQ ID NO: 822239 - RNA, 20 nt, Human
cuucuucaguaguuuguucu

SEQ ID NO: 822240 - RNA, 22 nt, Human
ucuuuuggaaaugaugugcagg

SEQ ID NO: 822241 - RNA, 22 nt, Human
ugaggcagugugagauaauaaa

SEQ ID NO: 822242 - RNA, 22 nt, Human
gcccaggaguuggaggcugcag

SEQ ID NO: 822243 - RNA, 22 nt, Human
gccucugcaauuacauugugcc

SEQ ID NO: 822244 - RNA, 22 nt, Human
gucaggauuauuuuauuaaaag

SEQ ID NO: 822245 - RNA, 22 nt, Human
ucucuucuaauuuucccgagua

SEQ ID NO: 822246 - RNA, 22 nt, Human
aguccaaggagagacagcauuu

SEQ ID NO: 822247 - RNA, 22 nt, Human
gaaaggugccccauaggcagga

SEQ ID NO: 822248 - RNA, 22 nt, Human
uugaauaguuuuggauagcaua

SEQ ID NO: 822249 - RNA, 22 nt, Human
gaggaaccacucugagaagcca

SEQ ID NO: 822250 - RNA, 22 nt, Human
ugaacucgggaggaggcugcag

SEQ ID NO: 822251 - RNA, 22 nt, Human
ggcagaggaggggugaauuugc

SEQ ID NO: 822252 - RNA, 22 nt, Human
uauuucagcccuacuacuuggc

SEQ ID NO: 822253 - RNA, 22 nt, Human
auuucccagcuuugaucaguuu

SEQ ID NO: 822254 - RNA, 22 nt, Human
uugaaaggguuaaagugguaaa

SEQ ID NO: 822255 - RNA, 22 nt, Human
uguagggaggaaggguuggaaa

SEQ ID NO: 822256 - RNA, 19 nt, Human
ccaggagagcuuggagaag

SEQ ID NO: 822257 - RNA, 22 nt, Human
aaggaguuuggguagucauaca

SEQ ID NO: 822258 - RNA, 22 nt, Human
auggagggugucagagagcgaa

SEQ ID NO: 822259 - RNA, 22 nt, Human
uuuggaaugguaccuucaguug

SEQ ID NO: 822260 - RNA, 22 nt, Human
ucugggaacugagcuccccuag

SEQ ID NO: 822261 - RNA, 22 nt, Human
agucuccuuggccucaaugccu

SEQ ID NO: 822262 - RNA, 22 nt, Human
uaauacagaaguguauuaaaau

SEQ ID NO: 822263 - RNA, 22 nt, Human
aguggcagagccaaguagagcc

SEQ ID NO: 822264 - RNA, 22 nt, Human
gaggagcuugaggcuaggagcc

SEQ ID NO: 822265 - RNA, 22 nt, Human
aaugucugcucuacucaggagg

SEQ ID NO: 822266 - RNA, 22 nt, Human
gcccaggauucuuucuuccuua

SEQ ID NO: 822267 - RNA, 22 nt, Human
uguugagacugagggagucagc

SEQ ID NO: 822268 - RNA, 22 nt, Human
aaggcagccauagcaccaucca

SEQ ID NO: 822269 - RNA, 22 nt, Human
cagcuggcugcaugaugccaaa

SEQ ID NO: 822270 - RNA, 23 nt, Human
uccaugagaugugggcuucuagu

SEQ ID NO: 822271 - RNA, 22 nt, Human
ucagugaucuaaggguauggcc

SEQ ID NO: 822272 - RNA, 22 nt, Human
uuucuucagccuucacaaccug

SEQ ID NO: 822273 - RNA, 22 nt, Human
ucccaggacccaggcauucaca

SEQ ID NO: 822274 - RNA, 22 nt, Human
aaaggugacacucugccagcug

SEQ ID NO: 822275 - RNA, 22 nt, Human
aggcuagcaaugggagaugagu

SEQ ID NO: 822276 - RNA, 22 nt, Human
uggcagcugauuagauggugcc

SEQ ID NO: 822277 - RNA, 22 nt, Human
aucacuguguauguauaugcag

SEQ ID NO: 822278 - RNA, 22 nt, Human
agcccaggcagagggaugcuug

SEQ ID NO: 822279 - RNA, 18 nt, Human
ucaggagacacagacgca

SEQ ID NO: 822280 - RNA, 22 nt, Human
aagcuggcaugucaccugagaa

SEQ ID NO: 822281 - RNA, 22 nt, Human
ucaggagagagaaauuggggcu

SEQ ID NO: 822282 - RNA, 22 nt, Human
ccacagcugaccgcaggugagc

SEQ ID NO: 822283 - RNA, 22 nt, Human
gacagcuggcaguggaaaggug

SEQ ID NO: 822284 - RNA, 22 nt, Human
cccgggaggaggaaguugcagu

SEQ ID NO: 822285 - RNA, 22 nt, Human
gggaggugauggcaagcagcgg

SEQ ID NO: 822286 - RNA, 22 nt, Human
uucaggauaguggugaguggca

SEQ ID NO: 822287 - RNA, 17 nt, Human
ucauuuguugugacuag

SEQ ID NO: 822288 - RNA, 22 nt, Human
uugcauuuccuguacuguuuga

SEQ ID NO: 822289 - RNA, 22 nt, Human
agggggugcccagaugaaggau

SEQ ID NO: 822290 - RNA, 22 nt, Human
gcuucccagcagaggaaagacu

SEQ ID NO: 822291 - RNA, 22 nt, Human
cucucagacugaagggccugug

SEQ ID NO: 822292 - RNA, 22 nt, Human
uuuguaaaggccugaauuucag

SEQ ID NO: 822293 - RNA, 22 nt, Human
ugaggcaggaugcuugcacagg

SEQ ID NO: 822294 - RNA, 19 nt, Human
agggaguuuauauuugcac

SEQ ID NO: 822295 - RNA, 22 nt, Human
acauguaaaaggaacaugcaug

SEQ ID NO: 822296 - RNA, 22 nt, Human
ucacaguuauagucuguagaau

SEQ ID NO: 822297 - RNA, 22 nt, Human
auucuucacaaauauauagaag

SEQ ID NO: 822298 - RNA, 22 nt, Human
ugaggcaguugagcuuccugag

SEQ ID NO: 822299 - RNA, 19 nt, Human
gcagcugcuugaaaagaaa

SEQ ID NO: 822300 - RNA, 22 nt, Human
aggcagacugugcgggaagagu

SEQ ID NO: 822301 - RNA, 22 nt, Human
aauuuccagaccccauccacag

SEQ ID NO: 822302 - RNA, 22 nt, Human
aggcaccuugagagcaggagcu

SEQ ID NO: 822303 - RNA, 22 nt, Human
caggcagcgcucguggccuggc

SEQ ID NO: 822304 - RNA, 22 nt, Human
gcuguguuugacaguagcagac

SEQ ID NO: 822305 - RNA, 22 nt, Human
agcagaggaggauuuaguuagg

SEQ ID NO: 822306 - RNA, 22 nt, Human
aagcuggagaguuaggugaaua

SEQ ID NO: 822307 - RNA, 22 nt, Human
cagaagaggacuggguagcuca

SEQ ID NO: 822308 - RNA, 22 nt, Human
ugaugaaauguugaggcaguga

SEQ ID NO: 822309 - RNA, 21 nt, Human
agaggcaggcauuaaguacac

SEQ ID NO: 822310 - RNA, 22 nt, Human
ucuucagacccuuagcugugau

SEQ ID NO: 822311 - RNA, 22 nt, Human
ccucuucugcuucaggagcacu

SEQ ID NO: 822312 - RNA, 22 nt, Human
uuaauuuuaaccuguuuguguc

SEQ ID NO: 822313 - RNA, 22 nt, Human
uugauuucuauucagauguaga

SEQ ID NO: 822314 - RNA, 22 nt, Human
uuucaaaccuacuuguauguuu

SEQ ID NO: 822315 - RNA, 22 nt, Human
acacauauucauauguacuuac

SEQ ID NO: 822316 - RNA, 22 nt, Human
uggaaagucucuuuugacugua

SEQ ID NO: 822317 - RNA, 22 nt, Human
gagggcaguagccucguacccu

SEQ ID NO: 822318 - RNA, 22 nt, Human
uuaaagggccgauuuccaggcc

SEQ ID NO: 822319 - RNA, 22 nt, Human
aaucuguucuacucuauucaga

SEQ ID NO: 822320 - RNA, 22 nt, Human
gcaggagacaacuguaaggaga

SEQ ID NO: 822321 - RNA, 22 nt, Human
gagggaugguaguugacacuga

SEQ ID NO: 822322 - RNA, 22 nt, Human
gccaggaggucagccccucaac

SEQ ID NO: 822323 - RNA, 22 nt, Human
uacccaggagaaacagcagggc

SEQ ID NO: 822324 - RNA, 22 nt, Human
gcucucuugguggcuguccugg

SEQ ID NO: 822325 - RNA, 22 nt, Human
aguucuuuugugaacauaugcu

SEQ ID NO: 822326 - RNA, 22 nt, Human
ucuguggauuuuaguguucaug

SEQ ID NO: 822327 - RNA, 22 nt, Human
gucaggaugcuauuguuauuaa

SEQ ID NO: 822328 - RNA, 22 nt, Human
uuccaagaguaaauucaaauug

SEQ ID NO: 822329 - RNA, 21 nt, Human
ucuugaaaauuguagcaguuu

SEQ ID NO: 822330 - RNA, 22 nt, Human
aggcagcuuuguaguaaagcua

SEQ ID NO: 822331 - RNA, 22 nt, Human
ugaaaugaucaguuugguuacu

SEQ ID NO: 822332 - RNA, 20 nt, Human
cugcuguguuauuguagaac

SEQ ID NO: 822333 - RNA, 22 nt, Human
agggagcucacaguccaguaga

SEQ ID NO: 822334 - RNA, 22 nt, Human
ucugggaacagccuggcugugu

SEQ ID NO: 822335 - RNA, 22 nt, Human
agcugcccugguaagauugaug

SEQ ID NO: 822336 - RNA, 22 nt, Human
auauucuucuuguucagacuau

SEQ ID NO: 822337 - RNA, 22 nt, Human
aaaggaagauugagcuuuucca

SEQ ID NO: 822338 - RNA, 22 nt, Human
uggcagcuguuaauguuuuguu

SEQ ID NO: 822339 - RNA, 22 nt, Human
auauucuuccaaaacaucauuu

SEQ ID NO: 822340 - RNA, 17 nt, Human
cagacaggcugucaccc

SEQ ID NO: 822341 - RNA, 22 nt, Human
gaugagcauuguuucauguguu

SEQ ID NO: 822342 - RNA, 22 nt, Human
aggcagcuggaaaacuccaggc

SEQ ID NO: 822343 - RNA, 19 nt, Human
uggcagggagaguuugaag

SEQ ID NO: 822344 - RNA, 22 nt, Human
cacucuccagcacaccccauuu

SEQ ID NO: 822345 - RNA, 22 nt, Human
gucaggauuaaugggaguaugc

SEQ ID NO: 822346 - RNA, 22 nt, Human
cuucugugcuucacaguugcca

SEQ ID NO: 822347 - RNA, 22 nt, Human
gagaggaguagacacuuugguu

SEQ ID NO: 822348 - RNA, 22 nt, Human
aggcugcucaguagauggagcu

SEQ ID NO: 822349 - RNA, 22 nt, Human
guucuucaguaaaauuaaaugu

SEQ ID NO: 822350 - RNA, 22 nt, Human
gaggccagaagugccucgggcu

SEQ ID NO: 822351 - RNA, 22 nt, Human
aggggaugauccucccgcagcg

SEQ ID NO: 822352 - RNA, 22 nt, Human
cgaggcagaggcugaaacggcu

SEQ ID NO: 822353 - RNA, 22 nt, Human
cccaggagauggugcguggucu

SEQ ID NO: 822354 - RNA, 19 nt, Human
gccaggagggcucuggcug

SEQ ID NO: 822355 - RNA, 22 nt, Human
uuucaaagucaauaucauuacc

SEQ ID NO: 822356 - RNA, 19 nt, Human
uggggcuguguuuugaccc

SEQ ID NO: 822357 - RNA, 22 nt, Human
caaggccauaagagauacaaaa

SEQ ID NO: 822358 - RNA, 22 nt, Human
uuugaacuucuaccugucauau

SEQ ID NO: 822359 - RNA, 22 nt, Human
auguuucaaugcacuuuagccu

SEQ ID NO: 822360 - RNA, 22 nt, Human
gcagcugaauguccauugcugc

SEQ ID NO: 822361 - RNA, 22 nt, Human
auaucaguaucuauguauuugu

SEQ ID NO: 822362 - RNA, 22 nt, Human
auugugcaaauauuaucuguag

SEQ ID NO: 822363 - RNA, 22 nt, Human
ucuuaaagagcgcaauuugagg

SEQ ID NO: 822364 - RNA, 22 nt, Human
cuacccaggcuggagugcagua

SEQ ID NO: 822365 - RNA, 22 nt, Human
uuucuuguaagauguuuauuaa

SEQ ID NO: 822366 - RNA, 22 nt, Human
aaggccagccugagagcuaaca

SEQ ID NO: 822367 - RNA, 22 nt, Human
auuguuaugaaaauaagauguu

SEQ ID NO: 822368 - RNA, 22 nt, Human
cccaggaaagagacugcugggu

SEQ ID NO: 822369 - RNA, 22 nt, Human
auuuagaacuuuguuugccaau

SEQ ID NO: 822370 - RNA, 22 nt, Human
guagggagcccagagcccagug

SEQ ID NO: 822371 - RNA, 21 nt, Human
cucuugugucagagccagagg

SEQ ID NO: 822372 - RNA, 22 nt, Human
uauuugaaaguguacaaaaacu

SEQ ID NO: 822373 - RNA, 22 nt, Human
gaggagaggggcucccaagagc

SEQ ID NO: 822374 - RNA, 22 nt, Human
gaggcgagaagcuggagauggu

SEQ ID NO: 822375 - RNA, 22 nt, Human
ucaagugcuugugagguauuug

SEQ ID NO: 822376 - RNA, 22 nt, Human
aggccagcgcugcuagcucccg

SEQ ID NO: 822377 - RNA, 22 nt, Human
ggaggggaggauuaaugacaaa

SEQ ID NO: 822378 - RNA, 21 nt, Human
gggcagcucuguuuuauuuuc

SEQ ID NO: 822379 - RNA, 22 nt, Human
gaggcagcugaaggagugacag

SEQ ID NO: 822380 - RNA, 22 nt, Human
uugaaauggaagugaaaauucu

SEQ ID NO: 822381 - RNA, 22 nt, Human
uucauucugggcucuaaggaac

SEQ ID NO: 822382 - RNA, 22 nt, Human
aguacauauaguaauuuagcca

SEQ ID NO: 822383 - RNA, 20 nt, Human
cccagugaagcauggaagag

SEQ ID NO: 822384 - RNA, 21 nt, Human
auuucagagcacacaaguaaa

SEQ ID NO: 822385 - RNA, 22 nt, Human
caggagauguaagacuucuguu

SEQ ID NO: 822386 - RNA, 22 nt, Human
aacauuuaugauugagguaaau

SEQ ID NO: 822387 - RNA, 22 nt, Human
ucuuugcaggccaaauuguuaa

SEQ ID NO: 822388 - RNA, 22 nt, Human
gagccagcuauguagcaagagg

SEQ ID NO: 822389 - RNA, 22 nt, Human
cccaggaggcagauguugcagu

SEQ ID NO: 822390 - RNA, 22 nt, Human
ucauacaucuguccuggagcuc

SEQ ID NO: 822391 - RNA, 20 nt, Human
cauuuguuagcuuucuacug

SEQ ID NO: 822392 - RNA, 22 nt, Human
gggcagcugccacuccgcuugc

SEQ ID NO: 822393 - RNA, 22 nt, Human
ggaccuggcaauuugcaucucu

SEQ ID NO: 822394 - RNA, 20 nt, Human
uggcaucucucaauuguagg

SEQ ID NO: 822395 - RNA, 22 nt, Human
uuugacauuauccuguuacugg

SEQ ID NO: 822396 - RNA, 22 nt, Human
ugccaggauggccagggggcca

SEQ ID NO: 822397 - RNA, 22 nt, Human
cauuguuauagcauuacacacc

SEQ ID NO: 822398 - RNA, 22 nt, Human
agaccgagaaguucuccaggcc

SEQ ID NO: 822399 - RNA, 21 nt, Human
cccaggaggcugagaagagca

SEQ ID NO: 822400 - RNA, 22 nt, Human
gagccaggggucagcuccgagg

SEQ ID NO: 822401 - RNA, 22 nt, Human
agcugcccuuaauaggcauuca

SEQ ID NO: 822402 - RNA, 22 nt, Human
aggcaggcccucuggaaaggua

SEQ ID NO: 822403 - RNA, 22 nt, Human
aaggcagccuuuguuugauuga

SEQ ID NO: 822404 - RNA, 22 nt, Human
gaggcaucugggcacagaagug

SEQ ID NO: 822405 - RNA, 22 nt, Human
cugcugugagugguucuugccu

SEQ ID NO: 822406 - RNA, 22 nt, Human
acauugcugcauucuccuuccc

SEQ ID NO: 822407 - RNA, 22 nt, Human
cugcuuugacuguuaagaacca

SEQ ID NO: 822408 - RNA, 22 nt, Human
agcacauucugccuugcuuugc

SEQ ID NO: 822409 - RNA, 22 nt, Human
cucuucuuuaguccagaccauc

SEQ ID NO: 822410 - RNA, 22 nt, Human
cugaacucuuuaugacagcuug

SEQ ID NO: 822411 - RNA, 22 nt, Human
gcccaggaaaugccccguggug

SEQ ID NO: 822412 - RNA, 22 nt, Human
cagaggcagccgggggagaacg

SEQ ID NO: 822413 - RNA, 22 nt, Human
gaggcagcuuaggguacugacu

SEQ ID NO: 822414 - RNA, 22 nt, Human
aaaggagacuucagaucuccuu

SEQ ID NO: 822415 - RNA, 22 nt, Human
uggaguucucaggugagggcuu

SEQ ID NO: 822416 - RNA, 22 nt, Human
ugaggcagucacccccuccugc

SEQ ID NO: 822417 - RNA, 22 nt, Human
gaagcagcaaguauaggacagg

SEQ ID NO: 822418 - RNA, 22 nt, Human
ucucaggaauagaguggcagca

SEQ ID NO: 822419 - RNA, 22 nt, Human
cucacuguuuaauagcuggauc

SEQ ID NO: 822420 - RNA, 22 nt, Human
gacagugcauuuccuggcaugg

SEQ ID NO: 822421 - RNA, 22 nt, Human
gccugcagaacugugaggcaau

SEQ ID NO: 822422 - RNA, 22 nt, Human
auuugcuuaucuccacaguugu

SEQ ID NO: 822423 - RNA, 22 nt, Human
gauggcagguaguggucucauc

SEQ ID NO: 822424 - RNA, 22 nt, Human
uucuuauagaagcaaccauugu

SEQ ID NO: 822425 - RNA, 22 nt, Human
uucuucuuuaucucaguauccu

SEQ ID NO: 822426 - RNA, 22 nt, Human
cccaggaacagcacagaacagc

SEQ ID NO: 822427 - RNA, 22 nt, Human
cauuuguuaaccaguguggauu

SEQ ID NO: 822428 - RNA, 17 nt, Human
gccucugcuugugucau

SEQ ID NO: 822429 - RNA, 22 nt, Human
gaggcagccucaguggaccucg

SEQ ID NO: 822430 - RNA, 19 nt, Human
cccaggaggcggagguugc

SEQ ID NO: 822431 - RNA, 22 nt, Human
gggcagcugucuugguucucaa

SEQ ID NO: 822432 - RNA, 22 nt, Human
cagcgucucguugugggccucg

SEQ ID NO: 822433 - RNA, 20 nt, Human
cuucuucagccuaugcuuca

SEQ ID NO: 822434 - RNA, 22 nt, Human
ugaaagguagcuggccucauag

SEQ ID NO: 822435 - RNA, 22 nt, Human
acugcccucccaucuauugcaa

SEQ ID NO: 822436 - RNA, 22 nt, Human
uugcuagcugguguaugcauug

SEQ ID NO: 822437 - RNA, 22 nt, Human
aaauguuucuacuugugagcau

SEQ ID NO: 822438 - RNA, 22 nt, Human
ucagagaguuagugucuuagcu

SEQ ID NO: 822439 - RNA, 22 nt, Human
ucauuuguggaagugauugugg

SEQ ID NO: 822440 - RNA, 22 nt, Human
uucauugucucuguuugccuuc

SEQ ID NO: 822441 - RNA, 22 nt, Human
aaagcagagcagggcacuuaug

SEQ ID NO: 822442 - RNA, 23 nt, Human
uuagagaugauuaaaaaaucuug

SEQ ID NO: 822443 - RNA, 22 nt, Human
cugcauuagucaugcuuugcag

SEQ ID NO: 822444 - RNA, 22 nt, Human
aggcagcugcccucuccuuccu

SEQ ID NO: 822445 - RNA, 22 nt, Human
uuucuucauagaccuugucuug

SEQ ID NO: 822446 - RNA, 22 nt, Human
ucuucuccagugcuucugcaca

SEQ ID NO: 822447 - RNA, 22 nt, Human
uguucuuuggcuucacagcucu

SEQ ID NO: 822448 - RNA, 22 nt, Human
aggguagguguaagauagcccu

SEQ ID NO: 822449 - RNA, 23 nt, Human
cagcccuuccugcauguuuuugu

SEQ ID NO: 822450 - RNA, 17 nt, Human
uuucuccuuccaucuca

SEQ ID NO: 822451 - RNA, 22 nt, Human
gaaauauuacaguggaggggau

SEQ ID NO: 822452 - RNA, 22 nt, Human
ggugagggaguggaacgaggug

SEQ ID NO: 822453 - RNA, 22 nt, Human
gaaggccacuuuguguugagaa

SEQ ID NO: 822454 - RNA, 22 nt, Human
aaaggcaggcuuucacaucuca

SEQ ID NO: 822455 - RNA, 22 nt, Human
guggcagcggugugcaaggagg

SEQ ID NO: 822456 - RNA, 22 nt, Human
ggaaaugacuuggugcuucguu

SEQ ID NO: 822457 - RNA, 22 nt, Human
uucugagacaauugagagucua

SEQ ID NO: 822458 - RNA, 22 nt, Human
uugagaagaauguguugaguuu

SEQ ID NO: 822459 - RNA, 23 nt, Human
agggagcuaaaaggcuggagcag

SEQ ID NO: 822460 - RNA, 18 nt, Human
gagucuuuguuacugcug

SEQ ID NO: 822461 - RNA, 22 nt, Human
guaguucugcagugucaccuga

SEQ ID NO: 822462 - RNA, 22 nt, Human
ugaaagcacaaguucuaacagg

SEQ ID NO: 822463 - RNA, 22 nt, Human
ucucaggaaauaggauuugagu

SEQ ID NO: 822464 - RNA, 22 nt, Human
aucauucuagcuguuguguuga

SEQ ID NO: 822465 - RNA, 22 nt, Human
gauuuuauuagcccaaacuuug

SEQ ID NO: 822466 - RNA, 22 nt, Human
uuaagauagaacccaguagucu

SEQ ID NO: 822467 - RNA, 22 nt, Human
aauuuuaagcauaugacugguu

SEQ ID NO: 822468 - RNA, 22 nt, Human
ugaugaaacugagguuccaaga

SEQ ID NO: 822469 - RNA, 22 nt, Human
gcauuuccugugcuuggcauau

SEQ ID NO: 822470 - RNA, 22 nt, Human
uauuuuaucugccagaguggag

SEQ ID NO: 822471 - RNA, 22 nt, Human
guccucuguuagaaaugugcuu

SEQ ID NO: 822472 - RNA, 22 nt, Human
uucaggaugcucagaguagucu

SEQ ID NO: 822473 - RNA, 22 nt, Human
ugaggcaggacuugcauaaagu

SEQ ID NO: 822474 - RNA, 22 nt, Human
uucucugagauagacuaagugg

SEQ ID NO: 822475 - RNA, 22 nt, Human
gagaggaguuacuauuuccgag

SEQ ID NO: 822476 - RNA, 22 nt, Human
ggagguggcagggaacauaauu

SEQ ID NO: 822477 - RNA, 22 nt, Human
aaaauugaagugaucaggaacu

SEQ ID NO: 822478 - RNA, 22 nt, Human
auauuucaugggguuccauacu

SEQ ID NO: 822479 - RNA, 22 nt, Human
cccaggaguuagagguuguggu

SEQ ID NO: 822480 - RNA, 22 nt, Human
uucuacaugguugcucagaggg

SEQ ID NO: 822481 - RNA, 20 nt, Human
auccaugagagucuggauuc

SEQ ID NO: 822482 - RNA, 22 nt, Human
cugcuguguugccagugucacc

SEQ ID NO: 822483 - RNA, 22 nt, Human
agaggaugauuuuaaggacacu

SEQ ID NO: 822484 - RNA, 22 nt, Human
cauuuauuggcauguaguaggu

SEQ ID NO: 822485 - RNA, 22 nt, Human
agguaggggguuugggaacugc

SEQ ID NO: 822486 - RNA, 22 nt, Human
cucuuucugauucgcugggacc

SEQ ID NO: 822487 - RNA, 17 nt, Human
gcgcagcuccuggcgcg

SEQ ID NO: 822488 - RNA, 22 nt, Human
guguguuucagaagccaggugu

SEQ ID NO: 822489 - RNA, 23 nt, Human
uuucaaauuacucugcagaugac

SEQ ID NO: 822490 - RNA, 20 nt, Human
ccucaguguccuggacuggg

SEQ ID NO: 822491 - RNA, 22 nt, Human
ugagacaguuuuucuauuucca

SEQ ID NO: 822492 - RNA, 22 nt, Human
cucaucugauaaaucacucuua

SEQ ID NO: 822493 - RNA, 22 nt, Human
cagacagggaccucgcuccaga

SEQ ID NO: 822494 - RNA, 22 nt, Human
ggcagaagauaggacagggaau

SEQ ID NO: 822495 - RNA, 22 nt, Human
ugcacauucacuuagguauugu

SEQ ID NO: 822496 - RNA, 23 nt, Human
uggaaagcggaccuggggcagag

SEQ ID NO: 822497 - RNA, 22 nt, Human
uccagaaacuuuuccagucuca

SEQ ID NO: 822498 - RNA, 22 nt, Human
cugcuuccauaaauaaugugcu

SEQ ID NO: 822499 - RNA, 22 nt, Human
uaacaucuuuagcagcucgaac

SEQ ID NO: 822500 - RNA, 22 nt, Human
uggcagcugccauguccacgug

SEQ ID NO: 822501 - RNA, 22 nt, Human
uuucaucuaacacuacauaggg

SEQ ID NO: 822502 - RNA, 22 nt, Human
uuccaugaaauguguuaugcuu

SEQ ID NO: 822503 - RNA, 22 nt, Human
gcucaggacuggaggagcgggg

SEQ ID NO: 822504 - RNA, 21 nt, Human
cuugaaagguagagucuacag

SEQ ID NO: 822505 - RNA, 22 nt, Human
aucaggaucacagaaacuuuua

SEQ ID NO: 822506 - RNA, 22 nt, Human
auaaauaucacuguugucccuc

SEQ ID NO: 822507 - RNA, 22 nt, Human
cuggcuugcagcucaucauaaa

SEQ ID NO: 822508 - RNA, 22 nt, Human
uucuucagucccacuagccaca

SEQ ID NO: 822509 - RNA, 22 nt, Human
agcagagguguuuauuauggga

SEQ ID NO: 822510 - RNA, 22 nt, Human
guggcaggagagacacagccau

SEQ ID NO: 822511 - RNA, 22 nt, Human
augauguugauaaauuacuuua

SEQ ID NO: 822512 - RNA, 22 nt, Human
caaaugauacuguuuuuagucu

SEQ ID NO: 822513 - RNA, 22 nt, Human
ucagagaguuggaaagaauuaa

SEQ ID NO: 822514 - RNA, 22 nt, Human
guucuucaucauuaacacucug

SEQ ID NO: 822515 - RNA, 22 nt, Human
auggaaagugcauggaagucau

SEQ ID NO: 822516 - RNA, 22 nt, Human
aaaaacugcaauuacuuuuguc

SEQ ID NO: 822517 - RNA, 22 nt, Human
uagggaggcuacuucuuguagg

SEQ ID NO: 822518 - RNA, 22 nt, Human
uccaggaggcaccuuuggacca

SEQ ID NO: 822519 - RNA, 22 nt, Human
uaagcugugggagauuggcaua

SEQ ID NO: 822520 - RNA, 22 nt, Human
gaggaaccaaucugugauauuc

SEQ ID NO: 822521 - RNA, 22 nt, Human
uugcaggauuuuagagaugaca

SEQ ID NO: 822522 - RNA, 19 nt, Human
gugcuuuuuaagagcucag

SEQ ID NO: 822523 - RNA, 22 nt, Human
gggcagcucggaagugggaaag

SEQ ID NO: 822524 - RNA, 22 nt, Human
aagagggcugcaaucuuauugc

SEQ ID NO: 822525 - RNA, 22 nt, Human
gaggaaccaaaucagcuugcac

SEQ ID NO: 822526 - RNA, 22 nt, Human
gcuuuggaugugugccugaggu

SEQ ID NO: 822527 - RNA, 22 nt, Human
uuucuucacaggguauugggug

SEQ ID NO: 822528 - RNA, 22 nt, Human
uucuacaauaugaauaaugaag

SEQ ID NO: 822529 - RNA, 22 nt, Human
cccaggaggcgcagguugcggu

SEQ ID NO: 822530 - RNA, 22 nt, Human
ccccggaggcggagguugcagu

SEQ ID NO: 822531 - RNA, 22 nt, Human
aggcaguuucugggacagcaua

SEQ ID NO: 822532 - RNA, 20 nt, Human
agaggaggauuauuuuauuc

SEQ ID NO: 822533 - RNA, 22 nt, Human
acccaggagcucugggguccuc

SEQ ID NO: 822534 - RNA, 22 nt, Human
uaaauuauguuccauguccuuu

SEQ ID NO: 822535 - RNA, 22 nt, Human
cucaugauguagcgaaugagaa

SEQ ID NO: 822536 - RNA, 22 nt, Human
uaucuguuugcucacagguguu

SEQ ID NO: 822537 - RNA, 22 nt, Human
cagucucuaaaucaaucugaau

SEQ ID NO: 822538 - RNA, 22 nt, Human
uugaagaggacuuugcagcugu

SEQ ID NO: 822539 - RNA, 22 nt, Human
cugacuguaauucuguucuuaa

SEQ ID NO: 822540 - RNA, 22 nt, Human
caucaucaaaagugacagagaa

SEQ ID NO: 822541 - RNA, 22 nt, Human
aagcgccaugguuccugcgcag

SEQ ID NO: 822542 - RNA, 22 nt, Human
ugaaaugagauaauuuaagugc

SEQ ID NO: 822543 - RNA, 22 nt, Human
ucucuucuauuugagacuauuu

SEQ ID NO: 822544 - RNA, 22 nt, Human
uuccugagggacuuuugagauu

SEQ ID NO: 822545 - RNA, 22 nt, Human
ucuucucuacaccagcagcccc

SEQ ID NO: 822546 - RNA, 22 nt, Human
uucuucucggcugucagauagu

SEQ ID NO: 822547 - RNA, 21 nt, Human
gccaggaguagauuacauuua

SEQ ID NO: 822548 - RNA, 22 nt, Human
acucaggaaauugagauaaugg

SEQ ID NO: 822549 - RNA, 22 nt, Human
aucaggaucaugcuggguggga

SEQ ID NO: 822550 - RNA, 22 nt, Human
gcagcugaaagggaucucuaca

SEQ ID NO: 822551 - RNA, 22 nt, Human
uuuguuuagaaagagauuggug

SEQ ID NO: 822552 - RNA, 22 nt, Human
ccacaucucgguccccucuuug

SEQ ID NO: 822553 - RNA, 22 nt, Human
ucucuguacaguacaugccgug

SEQ ID NO: 822554 - RNA, 22 nt, Human
gccugcagauauauaggauggu

SEQ ID NO: 822555 - RNA, 21 nt, Human
gagacagcccagugccagggc

SEQ ID NO: 822556 - RNA, 22 nt, Human
gcaagcugaugugauagugaaa

SEQ ID NO: 822557 - RNA, 22 nt, Human
auucugauaucuuauucuagcu

SEQ ID NO: 822558 - RNA, 22 nt, Human
uaucuguuguccaugcagaaag

SEQ ID NO: 822559 - RNA, 22 nt, Human
gaaauauuucucuugagccccu

SEQ ID NO: 822560 - RNA, 22 nt, Human
caaauguauaaauguacuuucu

SEQ ID NO: 822561 - RNA, 18 nt, Human
aaacuggcuuggccugug

SEQ ID NO: 822562 - RNA, 22 nt, Human
gacagagaggcugagcaguaca

SEQ ID NO: 822563 - RNA, 22 nt, Human
gagggagggaaaguuuaacacu

SEQ ID NO: 822564 - RNA, 22 nt, Human
cucuggcuucuaccuugcaguu

SEQ ID NO: 822565 - RNA, 22 nt, Human
aauauuguuucaagaucacaga

SEQ ID NO: 822566 - RNA, 22 nt, Human
ucauuguuucugcuuuucauga

SEQ ID NO: 822567 - RNA, 22 nt, Human
gagaaaugcaugcaugucauca

SEQ ID NO: 822568 - RNA, 22 nt, Human
ucagucuuugcuuaugacaaua

SEQ ID NO: 822569 - RNA, 17 nt, Human
uccaggagaggcaaugg

SEQ ID NO: 822570 - RNA, 22 nt, Human
ugaaacauuugaugaucuuugg

SEQ ID NO: 822571 - RNA, 20 nt, Human
cccaggagugagcagcuuua

SEQ ID NO: 822572 - RNA, 22 nt, Human
uuauuauuggugaguuaaggaa

SEQ ID NO: 822573 - RNA, 22 nt, Human
ccauccuaucugaccuacuugu

SEQ ID NO: 822574 - RNA, 22 nt, Human
aggcagcagucaugaggaaaga

SEQ ID NO: 822575 - RNA, 22 nt, Human
aucugccugcaguggagguggg

SEQ ID NO: 822576 - RNA, 22 nt, Human
uucuucuuaauguccugggaac

SEQ ID NO: 822577 - RNA, 22 nt, Human
gugcaagguacauccuugaugu

SEQ ID NO: 822578 - RNA, 22 nt, Human
caagauggaguccgggaaugug

SEQ ID NO: 822579 - RNA, 23 nt, Human
gaggcagcuccugcagugcccug

SEQ ID NO: 822580 - RNA, 22 nt, Human
cccaggugcugcgugaagccuc

SEQ ID NO: 822581 - RNA, 22 nt, Human
aaugauuuccccuacacagaag

SEQ ID NO: 822582 - RNA, 18 nt, Human
gaggcagcuagcaauuuu

SEQ ID NO: 822583 - RNA, 22 nt, Human
cuguggaaauaaacaaugcuaa

SEQ ID NO: 822584 - RNA, 22 nt, Human
ggcagcuggguuggccagaaac

SEQ ID NO: 822585 - RNA, 22 nt, Human
uuuaaaauuuagaccucuccac

SEQ ID NO: 822586 - RNA, 20 nt, Human
gucaggauuaguaaacucug

SEQ ID NO: 822587 - RNA, 22 nt, Human
uuucuagucucgaucucuuaau

SEQ ID NO: 822588 - RNA, 22 nt, Human
uuucucaguuacuagcuguggu

SEQ ID NO: 822589 - RNA, 22 nt, Human
caggacagagcccagacugugu

SEQ ID NO: 822590 - RNA, 22 nt, Human
ugcuugugagaguuuuuucaga

SEQ ID NO: 822591 - RNA, 22 nt, Human
ucaguucuuuauuucacaguga

SEQ ID NO: 822592 - RNA, 22 nt, Human
aaugcuuuuugcgaaaugugca

SEQ ID NO: 822593 - RNA, 22 nt, Human
agugcuguaacaacuuauuugg

SEQ ID NO: 822594 - RNA, 22 nt, Human
uuggcaggaauauugcagaggu

SEQ ID NO: 822595 - RNA, 22 nt, Human
acucaggaaaaauguagugaua

SEQ ID NO: 822596 - RNA, 18 nt, Human
agaggggagguaagucug

SEQ ID NO: 822597 - RNA, 22 nt, Human
gcuguguuggugaagcuguagc

SEQ ID NO: 822598 - RNA, 22 nt, Human
ucucugaguaagugacaguuca

SEQ ID NO: 822599 - RNA, 22 nt, Human
gucaggauuggggucaugaguc

SEQ ID NO: 822600 - RNA, 22 nt, Human
uugcauuuuuagaugcuucugu

SEQ ID NO: 822601 - RNA, 22 nt, Human
agggagcuaggauccugaaggu

SEQ ID NO: 822602 - RNA, 22 nt, Human
uuucuucagccacuccaaacug

SEQ ID NO: 822603 - RNA, 22 nt, Human
uggggcucaccuaggcuggaag

SEQ ID NO: 822604 - RNA, 22 nt, Human
gccaggagcaugucauuguuga

SEQ ID NO: 822605 - RNA, 23 nt, Human
uugcuuucaucaugagaugcucc

SEQ ID NO: 822606 - RNA, 19 nt, Human
ugcaagcuuuuucuuguua

SEQ ID NO: 822607 - RNA, 23 nt, Human
ucucaagaggaagcagggcucau

SEQ ID NO: 822608 - RNA, 22 nt, Human
ccaggagagcauugcacagagg

SEQ ID NO: 822609 - RNA, 22 nt, Human
uucaggauggcggauguugggg

SEQ ID NO: 822610 - RNA, 22 nt, Human
ucagugugaguaccaugcucag

SEQ ID NO: 822611 - RNA, 22 nt, Human
uugcuguguaacuccuggccug

SEQ ID NO: 822612 - RNA, 15 nt, Human
uucaggauaugacuc

SEQ ID NO: 822613 - RNA, 22 nt, Human
uuugaaauuaagauauugucca

SEQ ID NO: 822614 - RNA, 22 nt, Human
gaggagagggcugcgggcccac

SEQ ID NO: 822615 - RNA, 19 nt, Human
uggagacugagagugagca

SEQ ID NO: 822616 - RNA, 23 nt, Human
uuucuucagaagccuugcgaggc

SEQ ID NO: 822617 - RNA, 22 nt, Human
caggcagcugcgacaagagagc

SEQ ID NO: 822618 - RNA, 22 nt, Human
gggcagcucuuugguauccuuc

SEQ ID NO: 822619 - RNA, 22 nt, Human
uauuucagucacuucuucucug

SEQ ID NO: 822620 - RNA, 22 nt, Human
caucucaugggcaugccaagcu

SEQ ID NO: 822621 - RNA, 22 nt, Human
gcucaggacccaggugugaccu

SEQ ID NO: 822622 - RNA, 22 nt, Human
gagguggucgaggagggguacc

SEQ ID NO: 822623 - RNA, 22 nt, Human
ccagagagauugcuucuaaaga

SEQ ID NO: 822624 - RNA, 22 nt, Human
uaucuguucaauggaagaugac

SEQ ID NO: 822625 - RNA, 22 nt, Human
gugauuuugagaccuauauagu

SEQ ID NO: 822626 - RNA, 22 nt, Human
uccaggagugauaaggccacug

SEQ ID NO: 822627 - RNA, 22 nt, Human
caguuucuauggcugggcucug

SEQ ID NO: 822628 - RNA, 22 nt, Human
gggcagcugcagggauggugac

SEQ ID NO: 822629 - RNA, 21 nt, Human
auucugaguugucagucuuca

SEQ ID NO: 822630 - RNA, 22 nt, Human
auguuauaguuauaaaaugagg

SEQ ID NO: 822631 - RNA, 22 nt, Human
gcucccagcaauugaggcagcc

SEQ ID NO: 822632 - RNA, 22 nt, Human
uucucuuuugugaugugagaug

SEQ ID NO: 822633 - RNA, 22 nt, Human
aaccauuugcaguuacugagac

SEQ ID NO: 822634 - RNA, 22 nt, Human
guuauauauaguauuucucuga

SEQ ID NO: 822635 - RNA, 22 nt, Human
uuugaaagaaaccagugaguga

SEQ ID NO: 822636 - RNA, 17 nt, Human
acucaggaucugggagu

SEQ ID NO: 822637 - RNA, 22 nt, Human
ucaggaugguccuuuaugagaa

SEQ ID NO: 822638 - RNA, 22 nt, Human
uucaggauucuuucagacuggg

SEQ ID NO: 822639 - RNA, 22 nt, Human
cuggcugugcugcaggcuuugg

SEQ ID NO: 822640 - RNA, 22 nt, Human
guagccauuggcaaugaagccu

SEQ ID NO: 822641 - RNA, 22 nt, Human
auacaacagaaaaugauuauuc

SEQ ID NO: 822642 - RNA, 20 nt, Human
cuucuucauuaacccuacug

SEQ ID NO: 822643 - RNA, 22 nt, Human
ucuuagaaguuuauggcacgga

SEQ ID NO: 822644 - RNA, 22 nt, Human
cauucauuagaauagauaugua

SEQ ID NO: 822645 - RNA, 22 nt, Human
caacugugaauuuuaugauacc

SEQ ID NO: 822646 - RNA, 22 nt, Human
agaggaggaagagcuuuaaaau

SEQ ID NO: 822647 - RNA, 22 nt, Human
ccaugagccaggcugaggaagc

SEQ ID NO: 822648 - RNA, 22 nt, Human
uaacaguguggacuugagaucu

SEQ ID NO: 822649 - RNA, 22 nt, Human
caaggccagagccagcgauaag

SEQ ID NO: 822650 - RNA, 22 nt, Human
uuccuuaguguuagauucugug

SEQ ID NO: 822651 - RNA, 22 nt, Human
uuuuuguagucauuagaagagg

SEQ ID NO: 822652 - RNA, 22 nt, Human
uuuuccagagcugucucuugca

SEQ ID NO: 822653 - RNA, 22 nt, Human
uggcagcuauggucuaagggcc

SEQ ID NO: 822654 - RNA, 22 nt, Human
ggcaggcaaugaggaugggaag

SEQ ID NO: 822655 - RNA, 20 nt, Human
ucagugauuuugaagaggaa

SEQ ID NO: 822656 - RNA, 22 nt, Human
gccaggagacuccauucauuug

SEQ ID NO: 822657 - RNA, 22 nt, Human
ggagaggagcuauugggggcuc

SEQ ID NO: 822658 - RNA, 18 nt, Human
gaaaggagagacaguagg

SEQ ID NO: 822659 - RNA, 22 nt, Human
ucuuuuggguucuuaugauuua

SEQ ID NO: 822660 - RNA, 22 nt, Human
uacacacaugcauuugccuuau

SEQ ID NO: 822661 - RNA, 22 nt, Human
aagcagagcaagcguauuuauu

SEQ ID NO: 822662 - RNA, 22 nt, Human
agacagugauguaagcaggagu

SEQ ID NO: 822663 - RNA, 22 nt, Human
uucaauucugcucugaucuuag

SEQ ID NO: 822664 - RNA, 20 nt, Human
ucauuguguugccaauuccc

SEQ ID NO: 822665 - RNA, 22 nt, Human
aucaggaucugcaucauaagaa

SEQ ID NO: 822666 - RNA, 22 nt, Human
uggcaaggcugugggggcagag

SEQ ID NO: 822667 - RNA, 22 nt, Human
aggcggcugguguccugcaggu

SEQ ID NO: 822668 - RNA, 22 nt, Human
uaggcagcauggauucugaaua

SEQ ID NO: 822669 - RNA, 22 nt, Human
gcuccucuucucccacugaaug

SEQ ID NO: 822670 - RNA, 22 nt, Human
cugcugugugaccauggacagg

SEQ ID NO: 822671 - RNA, 22 nt, Human
uccaggagagguguggggacug

SEQ ID NO: 822672 - RNA, 19 nt, Human
caugcugaccugcuguggu

SEQ ID NO: 822673 - RNA, 22 nt, Human
aaaggccaugguuggaguguuu

SEQ ID NO: 822674 - RNA, 22 nt, Human
ucugggaaugaauaagaccugu

SEQ ID NO: 822675 - RNA, 22 nt, Human
caggcgagugaacagacucuca

SEQ ID NO: 822676 - RNA, 20 nt, Human
cugcccagccacugagggau

SEQ ID NO: 822677 - RNA, 22 nt, Human
gaggccuggagccgccuaggcg

SEQ ID NO: 822678 - RNA, 19 nt, Human
cauuuuaagcauccccagu

SEQ ID NO: 822679 - RNA, 22 nt, Human
gaggcagugucgguggcaggau

SEQ ID NO: 822680 - RNA, 22 nt, Human
gucuuucuaugaugaacuguug

SEQ ID NO: 822681 - RNA, 23 nt, Human
uggcagcuguguaagagaaagca

SEQ ID NO: 822682 - RNA, 22 nt, Human
ucacaugaguauuauuuuccaa

SEQ ID NO: 822683 - RNA, 18 nt, Human
uggcagcuagguaaagaa

SEQ ID NO: 822684 - RNA, 22 nt, Human
ugaaaugauuauaugguguuug

SEQ ID NO: 822685 - RNA, 22 nt, Human
gcagcuaccacccaggaaggac

SEQ ID NO: 822686 - RNA, 20 nt, Human
aggaggcauagucuggaaag

SEQ ID NO: 822687 - RNA, 22 nt, Human
aggcucagaggugagcaucugc

SEQ ID NO: 822688 - RNA, 22 nt, Human
uggagaggagcaccauggccau

SEQ ID NO: 822689 - RNA, 20 nt, Human
gcccaggaauuugcauuucu

SEQ ID NO: 822690 - RNA, 17 nt, Human
acacagggagagggagc

SEQ ID NO: 822691 - RNA, 22 nt, Human
aggacagcaguuggugagguuc

SEQ ID NO: 822692 - RNA, 17 nt, Human
gucauucucagaaaaug

SEQ ID NO: 822693 - RNA, 22 nt, Human
cuucucagcauuuugucagucu

SEQ ID NO: 822694 - RNA, 22 nt, Human
uuucaaaguugggaauuguaau

SEQ ID NO: 822695 - RNA, 18 nt, Human
aggcagacacuagagguc

SEQ ID NO: 822696 - RNA, 22 nt, Human
auccagucaaaauuaguaaggu

SEQ ID NO: 822697 - RNA, 22 nt, Human
uucucagauccaucagaagucc

SEQ ID NO: 822698 - RNA, 22 nt, Human
aguggcaguagaugagcugguu

SEQ ID NO: 822699 - RNA, 22 nt, Human
ugcugcugaucauuuauagucu

SEQ ID NO: 822700 - RNA, 22 nt, Human
auaaagauuucuuuuucucuac

SEQ ID NO: 822701 - RNA, 22 nt, Human
agugcagccgagaucaggugcu

SEQ ID NO: 822702 - RNA, 22 nt, Human
ucucuucucuagugagcaacug

SEQ ID NO: 822703 - RNA, 22 nt, Human
uccauuuuguagguaugcuaca

SEQ ID NO: 822704 - RNA, 22 nt, Human
ccaggcugcagucaaggggcau

SEQ ID NO: 822705 - RNA, 22 nt, Human
ggcaggcagaggcugagacagg

SEQ ID NO: 822706 - RNA, 22 nt, Human
gagggagugccagagggccagc

SEQ ID NO: 822707 - RNA, 22 nt, Human
uauaucaccaaaaacaguucug

SEQ ID NO: 822708 - RNA, 22 nt, Human
augcuguguauuuuacucuuuc

SEQ ID NO: 822709 - RNA, 22 nt, Human
gacccaggagugcagagagugg

SEQ ID NO: 822710 - RNA, 22 nt, Human
cuguaugaggaucagacuggac

SEQ ID NO: 822711 - RNA, 20 nt, Human
aguuauaguaucuagccaug

SEQ ID NO: 822712 - RNA, 21 nt, Human
ugaggcaggggugcuuuuguc

SEQ ID NO: 822713 - RNA, 17 nt, Human
cagcucugcaucuuccu

SEQ ID NO: 822714 - RNA, 22 nt, Human
ugcauguguguguauuuauaaa

SEQ ID NO: 822715 - RNA, 22 nt, Human
ucccaggaggugcuuccuagga

SEQ ID NO: 822716 - RNA, 22 nt, Human
ucugcaggcucuagaugagguu

SEQ ID NO: 822717 - RNA, 22 nt, Human
ucauuuuucacacagggucacc

SEQ ID NO: 822718 - RNA, 22 nt, Human
cccaagagguggagguugcagu

SEQ ID NO: 822719 - RNA, 17 nt, Human
agauggcaggaggcaga

SEQ ID NO: 822720 - RNA, 22 nt, Human
cugccagucuaugcugcucggc

SEQ ID NO: 822721 - RNA, 21 nt, Human
gauugaaaccauggcagugag

SEQ ID NO: 822722 - RNA, 22 nt, Human
aggagaaggaagugcaucacua

SEQ ID NO: 822723 - RNA, 22 nt, Human
auucaaguggcugcuauguuaa

SEQ ID NO: 822724 - RNA, 22 nt, Human
uagggaugacgaaaggacagag

SEQ ID NO: 822725 - RNA, 22 nt, Human
acaggccacaguggagucucug

SEQ ID NO: 822726 - RNA, 23 nt, Human
uguugaaguaacuguuacauaga

SEQ ID NO: 822727 - RNA, 22 nt, Human
uggcagagugcagaagaggcau

SEQ ID NO: 822728 - RNA, 22 nt, Human
ugaaaugagagcacagaauaaa

SEQ ID NO: 822729 - RNA, 22 nt, Human
aggaagcuggugugaggaugaa

SEQ ID NO: 822730 - RNA, 21 nt, Human
ucauuugugaucugauuucca

SEQ ID NO: 822731 - RNA, 21 nt, Human
gcugcccaacccugcaucucc

SEQ ID NO: 822732 - RNA, 21 nt, Human
uaaggccaagucuauuucugu

SEQ ID NO: 822733 - RNA, 22 nt, Human
ucagauggguuuugaaggaugu

SEQ ID NO: 822734 - RNA, 22 nt, Human
cuugaaagcuuugcgucuucua

SEQ ID NO: 822735 - RNA, 22 nt, Human
aucaggauucaguaucuccagc

SEQ ID NO: 822736 - RNA, 22 nt, Human
ugccgcagugcggggagggccc

SEQ ID NO: 822737 - RNA, 22 nt, Human
agcagagccugggcuaggggug

SEQ ID NO: 822738 - RNA, 22 nt, Human
ugugaaggagaugaagggagug

SEQ ID NO: 822739 - RNA, 22 nt, Human
ucuuugcacugugcaagcagaa

SEQ ID NO: 822740 - RNA, 22 nt, Human
gacccaggcucgugggacggcu

SEQ ID NO: 822741 - RNA, 22 nt, Human
gaggcacugcaguacagugacu

SEQ ID NO: 822742 - RNA, 22 nt, Human
guggaauguccuugaucauaag

SEQ ID NO: 822743 - RNA, 22 nt, Human
aaaggccacuugaaggauuuuu

SEQ ID NO: 822744 - RNA, 22 nt, Human
uugcugaaaacaguggguauug

SEQ ID NO: 822745 - RNA, 22 nt, Human
caggcagcucuaauggaaagug

SEQ ID NO: 822746 - RNA, 22 nt, Human
auacuguuucucuucuacauga

SEQ ID NO: 822747 - RNA, 19 nt, Human
auacagauguauccaugau

SEQ ID NO: 822748 - RNA, 22 nt, Human
ucaauucaacacaugcacauug

SEQ ID NO: 822749 - RNA, 22 nt, Human
uucuucuccuaaggagaguccu

SEQ ID NO: 822750 - RNA, 19 nt, Human
uuucccagcccuugcugug

SEQ ID NO: 822751 - RNA, 22 nt, Human
ggagcuguuggcagcuaucuug

SEQ ID NO: 822752 - RNA, 22 nt, Human
uagcugcugcagcacagggagg

SEQ ID NO: 822753 - RNA, 22 nt, Human
ugauuuccuaggucuggagaag

SEQ ID NO: 822754 - RNA, 22 nt, Human
uuguugguggaauugaugcuag

SEQ ID NO: 822755 - RNA, 22 nt, Human
uuucaggguacauggagcaaau

SEQ ID NO: 822756 - RNA, 22 nt, Human
uucuagaugauaaaccagcagc

SEQ ID NO: 822757 - RNA, 22 nt, Human
augugaggaagaaagagguaag

SEQ ID NO: 822758 - RNA, 23 nt, Human
acagacaacacugaugagagaaa

SEQ ID NO: 822759 - RNA, 22 nt, Human
augcuguggccagaguucaacu

SEQ ID NO: 822760 - RNA, 22 nt, Human
aagaagagaacuggcauccuaa

SEQ ID NO: 822761 - RNA, 22 nt, Human
auggaguucuuuaaauucacag

SEQ ID NO: 822762 - RNA, 22 nt, Human
agaaaugaaaccaaagccuaga

SEQ ID NO: 822763 - RNA, 22 nt, Human
ggcaggcugcuugggucauguc

SEQ ID NO: 822764 - RNA, 22 nt, Human
caaauaguaugagcaaugauuc

SEQ ID NO: 822765 - RNA, 22 nt, Human
ugcacauuaguguuugagaugc

SEQ ID NO: 822766 - RNA, 22 nt, Human
ggcagcuuguccuggaggaugg

SEQ ID NO: 822767 - RNA, 22 nt, Human
gaggcagccagagguucucauu

SEQ ID NO: 822768 - RNA, 22 nt, Human
uagggaugagccaguggguagu

SEQ ID NO: 822769 - RNA, 22 nt, Human
gaggcagaaguugcagugagca

SEQ ID NO: 822770 - RNA, 22 nt, Human
ucaggagacaaagggugcggag

SEQ ID NO: 822771 - RNA, 21 nt, Human
aucauucuggaaaauucaagc

SEQ ID NO: 822772 - RNA, 22 nt, Human
uuugaagucagacacugcuuug

SEQ ID NO: 822773 - RNA, 22 nt, Human
uauuauuaaauggcagaauuuu

SEQ ID NO: 822774 - RNA, 22 nt, Human
acaauguguuuuuauacauuug

SEQ ID NO: 822775 - RNA, 22 nt, Human
uguuugaacugaauaacauagu

SEQ ID NO: 822776 - RNA, 22 nt, Human
gggauggggagcuggaaagggg

SEQ ID NO: 822777 - RNA, 22 nt, Human
cggcagcugauugcagagcacc

SEQ ID NO: 822778 - RNA, 22 nt, Human
uuuaacagguaaaguaaaugug

SEQ ID NO: 822779 - RNA, 22 nt, Human
agagagcauugaggaaaucuuc

SEQ ID NO: 822780 - RNA, 22 nt, Human
ugccuugcacauaauauacauu

SEQ ID NO: 822781 - RNA, 22 nt, Human
uuauuucauguaaaauuuaugu

SEQ ID NO: 822782 - RNA, 22 nt, Human
acaugcauaggagaagucuuua

SEQ ID NO: 822783 - RNA, 20 nt, Human
gggugggagagucugagggu

SEQ ID NO: 822784 - RNA, 22 nt, Human
aauuuccagaucagaugacuca

SEQ ID NO: 822785 - RNA, 22 nt, Human
gcucucuuuuuccagugguggu

SEQ ID NO: 822786 - RNA, 22 nt, Human
uggcagcucauuuggaaaugga

SEQ ID NO: 822787 - RNA, 22 nt, Human
aacaucuacuaagugccaggca

SEQ ID NO: 822788 - RNA, 22 nt, Human
uugagaagaggcuuuguaggaa

SEQ ID NO: 822789 - RNA, 23 nt, Human
cugcuguuuucuguaccugaagc

SEQ ID NO: 822790 - RNA, 22 nt, Human
accaggagccauagagucaggc

SEQ ID NO: 822791 - RNA, 22 nt, Human
guccaugacugugacucacaug

SEQ ID NO: 822792 - RNA, 22 nt, Human
agaggggaaggaugugauguga

SEQ ID NO: 822793 - RNA, 22 nt, Human
caggcagccaggggaccugucc

SEQ ID NO: 822794 - RNA, 22 nt, Human
uuuaaauuauaguuaaugucug

SEQ ID NO: 822795 - RNA, 22 nt, Human
gaaucucaguggaagcaggaag

SEQ ID NO: 822796 - RNA, 22 nt, Human
gggagggguugcauguuugagu

SEQ ID NO: 822797 - RNA, 22 nt, Human
aggguggcugaguagauggaag

SEQ ID NO: 822798 - RNA, 22 nt, Human
auuaaauuggacgcugggggaa

SEQ ID NO: 822799 - RNA, 22 nt, Human
gagccaaggguugccauggaga

SEQ ID NO: 822800 - RNA, 19 nt, Human
uugaaauuguuugauaugg

SEQ ID NO: 822801 - RNA, 22 nt, Human
cucccaggguagggagagacua

SEQ ID NO: 822802 - RNA, 22 nt, Human
cuucagaagaaaagcagugugu

SEQ ID NO: 822803 - RNA, 22 nt, Human
ggaggcagaauagagugugggu

SEQ ID NO: 822804 - RNA, 22 nt, Human
aaagauuauggcauugaaauac

SEQ ID NO: 822805 - RNA, 22 nt, Human
agacaaaugguaauuaugucua

SEQ ID NO: 822806 - RNA, 22 nt, Human
uuuuaucuucauuccuaucuac

SEQ ID NO: 822807 - RNA, 22 nt, Human
gaauagcuuccuuuuuuccaaa

SEQ ID NO: 822808 - RNA, 22 nt, Human
uacccaggggcugagcagaggu

SEQ ID NO: 822809 - RNA, 20 nt, Human
acuugcugggcuuuguuacc

SEQ ID NO: 822810 - RNA, 22 nt, Human
ugagggagagggcgaaaaugaa

SEQ ID NO: 822811 - RNA, 22 nt, Human
uucucagaauugacugggagca

SEQ ID NO: 822812 - RNA, 22 nt, Human
agcagacauaucucaugucaca

SEQ ID NO: 822813 - RNA, 17 nt, Human
aggccagaugaggcaag

SEQ ID NO: 822814 - RNA, 20 nt, Human
agaggccaguuaggagucua

SEQ ID NO: 822815 - RNA, 22 nt, Human
ucugguaaccuuuaucccuccu

SEQ ID NO: 822816 - RNA, 22 nt, Human
ugagagggcccagagcacacca

SEQ ID NO: 822817 - RNA, 22 nt, Human
ugaggcagguaagcaaguuuug

SEQ ID NO: 822818 - RNA, 22 nt, Human
cucaggauugugccuagggaga

SEQ ID NO: 822819 - RNA, 22 nt, Human
gcccaggagccuggagaugugu

SEQ ID NO: 822820 - RNA, 22 nt, Human
gaggcagcggcucacagagaaa

SEQ ID NO: 822821 - RNA, 22 nt, Human
uuucacagguacaaacacuccu

SEQ ID NO: 822822 - RNA, 22 nt, Human
aaucauaauuguauacauucau

SEQ ID NO: 822823 - RNA, 22 nt, Human
ucucucuuuuuaaucauguaau

SEQ ID NO: 822824 - RNA, 22 nt, Human
uguggaaaagaauaagggagau

SEQ ID NO: 822825 - RNA, 22 nt, Human
uccauuuucuaaguaucacuua

SEQ ID NO: 822826 - RNA, 22 nt, Human
uaggaggguuagagggaaauau

SEQ ID NO: 822827 - RNA, 22 nt, Human
guuuucaauuauaagauggcuu

SEQ ID NO: 822828 - RNA, 22 nt, Human
cgcagggauuucaaggggccuu

SEQ ID NO: 822829 - RNA, 22 nt, Human
gaggaggccaguggaaggaagc

SEQ ID NO: 822830 - RNA, 20 nt, Human
uuuuccagaaaguaucauug

SEQ ID NO: 822831 - RNA, 22 nt, Human
cuauuucaaggcccagauauga

SEQ ID NO: 822832 - RNA, 22 nt, Human
cagucucagaggugggaguggg

SEQ ID NO: 822833 - RNA, 22 nt, Human
uucaggaucacuaaacccucca

SEQ ID NO: 822834 - RNA, 22 nt, Human
agggaagcuuguuacugagaag

SEQ ID NO: 822835 - RNA, 22 nt, Human
cccaggagauggagguugcagu

SEQ ID NO: 822836 - RNA, 22 nt, Human
uaucaucuuguugucaugcagc

SEQ ID NO: 822837 - RNA, 22 nt, Human
uggaaauguauuugggcaugcc

SEQ ID NO: 822838 - RNA, 22 nt, Human
acccaggacuuggcaaccucau

SEQ ID NO: 822839 - RNA, 22 nt, Human
uauaucauggagauuaacauuc

SEQ ID NO: 822840 - RNA, 22 nt, Human
ugcugcuguuuccuacaucuca

SEQ ID NO: 822841 - RNA, 23 nt, Human
uuuggacuugugacucuucuccu

SEQ ID NO: 822842 - RNA, 22 nt, Human
auucaaguucuucugucuuugc

SEQ ID NO: 822843 - RNA, 22 nt, Human
cacagcuaggaggaaagcagag

SEQ ID NO: 822844 - RNA, 19 nt, Human
ugagaggcuuaaggcagcu

SEQ ID NO: 822845 - RNA, 22 nt, Human
uugguuuacuaggauucaaauu

SEQ ID NO: 822846 - RNA, 22 nt, Human
ugcuguguucuccugacucacc

SEQ ID NO: 822847 - RNA, 22 nt, Human
auucucuuuguauaacaucuug

SEQ ID NO: 822848 - RNA, 22 nt, Human
cccaugagguggagguugcagu

SEQ ID NO: 822849 - RNA, 22 nt, Human
auacuaaaguauagaacuuagu

SEQ ID NO: 822850 - RNA, 22 nt, Human
auuuguugcuagcagcacugau

SEQ ID NO: 822851 - RNA, 17 nt, Human
aagacagaagccaugag

SEQ ID NO: 822852 - RNA, 22 nt, Human
uguuuuaaagccauugccuuuc

SEQ ID NO: 822853 - RNA, 22 nt, Human
cugcugugugcuuacuuggguu

SEQ ID NO: 822854 - RNA, 22 nt, Human
uggcagcagccauggaaggccc

SEQ ID NO: 822855 - RNA, 22 nt, Human
cugccaggcacgugcagcauca

SEQ ID NO: 822856 - RNA, 22 nt, Human
caaugugguggcagaugucagu

SEQ ID NO: 822857 - RNA, 22 nt, Human
guuuuucuuugugugaagacaa

SEQ ID NO: 822858 - RNA, 22 nt, Human
uggcagucuggguuggcaguua

SEQ ID NO: 822859 - RNA, 22 nt, Human
aagagagggguugcauggaaau

SEQ ID NO: 822860 - RNA, 18 nt, Human
uaggagagaauuuauuua

SEQ ID NO: 822861 - RNA, 22 nt, Human
aggccagcagcaugacggcauc

SEQ ID NO: 822862 - RNA, 22 nt, Human
uuguaaaugaccuuuucuaauu

SEQ ID NO: 822863 - RNA, 22 nt, Human
gugucccaggccucuggaauua

SEQ ID NO: 822864 - RNA, 18 nt, Human
ucuuuggacaacuacugg

SEQ ID NO: 822865 - RNA, 22 nt, Human
aacuagucagugauucucagaa

SEQ ID NO: 822866 - RNA, 22 nt, Human
uccaggaguuugagacugcagu

SEQ ID NO: 822867 - RNA, 21 nt, Human
agcagaggggacauguuugau

SEQ ID NO: 822868 - RNA, 22 nt, Human
ugcacagugaccccuggugacu

SEQ ID NO: 822869 - RNA, 22 nt, Human
cagaggcaggaagaugggcagu

SEQ ID NO: 822870 - RNA, 22 nt, Human
ucuucacaugaccuucaugucu

SEQ ID NO: 822871 - RNA, 22 nt, Human
agaggggacagccaccugcccg

SEQ ID NO: 822872 - RNA, 22 nt, Human
augcuguggaugccuugcccca

SEQ ID NO: 822873 - RNA, 22 nt, Human
ggaggcaggaaagacagguuca

SEQ ID NO: 822874 - RNA, 23 nt, Human
ggagugcaauggcgccaucucgg

SEQ ID NO: 822875 - RNA, 22 nt, Human
uucucugaucuugcuagacuga

SEQ ID NO: 822876 - RNA, 22 nt, Human
aucacauucuuucaaagcaguc

SEQ ID NO: 822877 - RNA, 22 nt, Human
agugcuuuaccuagauaauguu

SEQ ID NO: 822878 - RNA, 22 nt, Human
cauguuuacuaccaggagaaug

SEQ ID NO: 822879 - RNA, 22 nt, Human
cugcuguguuagcagguuuagu

SEQ ID NO: 822880 - RNA, 22 nt, Human
ugcuguguggaugugaagaauc

SEQ ID NO: 822881 - RNA, 22 nt, Human
gcugggaagugcaagaucaagg

SEQ ID NO: 822882 - RNA, 22 nt, Human
aggucagcaggccaggggcgaa

SEQ ID NO: 822883 - RNA, 22 nt, Human
uggagucugugaugcucugggu

SEQ ID NO: 822884 - RNA, 22 nt, Human
gaggggagacagggaaaucagu

SEQ ID NO: 822885 - RNA, 22 nt, Human
aauacaguaauuuugaugaguu

SEQ ID NO: 822886 - RNA, 22 nt, Human
ggugaagggugucauggcauuu

SEQ ID NO: 822887 - RNA, 22 nt, Human
aagaggagacuucagcaacuug

SEQ ID NO: 822888 - RNA, 20 nt, Human
gcccaagguccagaaggggg

SEQ ID NO: 822889 - RNA, 22 nt, Human
gcccaggaguuugcauuuuaac

SEQ ID NO: 822890 - RNA, 17 nt, Human
gaggacagggaaguagg

SEQ ID NO: 822891 - RNA, 22 nt, Human
gaagcagcuuucuggugaggag

SEQ ID NO: 822892 - RNA, 22 nt, Human
uauuuccaaaagccuauuauga

SEQ ID NO: 822893 - RNA, 22 nt, Human
ggccagcagucacagggucaga

SEQ ID NO: 822894 - RNA, 22 nt, Human
ucacugucugaaagaaauggcc

SEQ ID NO: 822895 - RNA, 22 nt, Human
aggggcucaaagugugcaggga

SEQ ID NO: 822896 - RNA, 22 nt, Human
agggagcugagcugugagcagc

SEQ ID NO: 822897 - RNA, 22 nt, Human
aggcagaggagaaugaucuucc

SEQ ID NO: 822898 - RNA, 22 nt, Human
gagggaggcaucaugaauccag

SEQ ID NO: 822899 - RNA, 22 nt, Human
cccaggaaugggaaggaggaau

SEQ ID NO: 822900 - RNA, 22 nt, Human
uuuaucuuuaggacuuugcaga

SEQ ID NO: 822901 - RNA, 22 nt, Human
ggcagcuuucucacccaugacc

SEQ ID NO: 822902 - RNA, 22 nt, Human
uugcugaaaucuaugacauccu

SEQ ID NO: 822903 - RNA, 22 nt, Human
cuacccagagugaaucucuuaa

SEQ ID NO: 822904 - RNA, 22 nt, Human
gcuaugcaggagccuaaugaca

SEQ ID NO: 822905 - RNA, 22 nt, Human
aagagaggacauggugaaccug

SEQ ID NO: 822906 - RNA, 22 nt, Human
aaggcagccuuuugaguugauu

SEQ ID NO: 822907 - RNA, 22 nt, Human
aucacauugccagugauuaccc

SEQ ID NO: 822908 - RNA, 22 nt, Human
aggcagaucacuugaggccagg

SEQ ID NO: 822909 - RNA, 22 nt, Human
uucaggaugcagagguuguagu

SEQ ID NO: 822910 - RNA, 22 nt, Human
aggcagcuggcaaauucuagag

SEQ ID NO: 822911 - RNA, 19 nt, Human
augucuggguaacagcugc

SEQ ID NO: 822912 - RNA, 22 nt, Human
uucaauucaauucuaaauauau

SEQ ID NO: 822913 - RNA, 23 nt, Human
agaggcaggaguggcuugcccgg

SEQ ID NO: 822914 - RNA, 22 nt, Human
gagugcagaugaacagaagauu

SEQ ID NO: 822915 - RNA, 23 nt, Human
aggcgagcucuucuccagcacgu

SEQ ID NO: 822916 - RNA, 22 nt, Human
cucuucuugaaagaggaauuca

SEQ ID NO: 822917 - RNA, 22 nt, Human
gggcagcuggccagguauucug

SEQ ID NO: 822918 - RNA, 19 nt, Human
accaggaguaucagagcug

SEQ ID NO: 822919 - RNA, 22 nt, Human
auucauuuagguauucacuuac

SEQ ID NO: 822920 - RNA, 22 nt, Human
ugaaaugauguacaagaaggca

SEQ ID NO: 822921 - RNA, 21 nt, Human
aaugcauuaacauaaagcuga

SEQ ID NO: 822922 - RNA, 22 nt, Human
agugcuuuccuucuugugacau

SEQ ID NO: 822923 - RNA, 22 nt, Human
uucaggaugaaagugugcaaca

SEQ ID NO: 822924 - RNA, 22 nt, Human
gaaauaagaguccaugccaggu

SEQ ID NO: 822925 - RNA, 22 nt, Human
aaaggccacugcaagggaaggu

SEQ ID NO: 822926 - RNA, 22 nt, Human
uggcagcugugcuucauucuuu

SEQ ID NO: 822927 - RNA, 22 nt, Human
ugugcaggugcaggaagggggc

SEQ ID NO: 822928 - RNA, 22 nt, Human
auuccaguuggguucuaauaca

SEQ ID NO: 822929 - RNA, 22 nt, Human
uccaggagggguaggcaguaug

SEQ ID NO: 822930 - RNA, 22 nt, Human
uucuucucagggucccacaugg

SEQ ID NO: 822931 - RNA, 22 nt, Human
ggcucagagaccugcgaucuga

SEQ ID NO: 822932 - RNA, 22 nt, Human
ucaugcuuauugcauauuugga

SEQ ID NO: 822933 - RNA, 22 nt, Human
ugcuuagacgucaaguacagcc

SEQ ID NO: 822934 - RNA, 22 nt, Human
uccauuuucuugcucuagguaa

SEQ ID NO: 822935 - RNA, 22 nt, Human
uucuucucucauagauuaaggu

SEQ ID NO: 822936 - RNA, 22 nt, Human
cggagccugcuuguugcagcug

SEQ ID NO: 822937 - RNA, 22 nt, Human
uggcagcucuguucaacaugag

SEQ ID NO: 822938 - RNA, 22 nt, Human
ugcaggaacugggagggauagu

SEQ ID NO: 822939 - RNA, 22 nt, Human
uuacacaacaucuguauuauua

SEQ ID NO: 822940 - RNA, 22 nt, Human
uuucuucagagagagcuuuccc

SEQ ID NO: 822941 - RNA, 22 nt, Human
ugaggcaggaggauugcaggau

SEQ ID NO: 822942 - RNA, 23 nt, Human
gccaggaguggguagacuaaugc

SEQ ID NO: 822943 - RNA, 22 nt, Human
uuuguaaauagcaguacucaug

SEQ ID NO: 822944 - RNA, 22 nt, Human
ugaggcagugauguuuaagcac

SEQ ID NO: 822945 - RNA, 22 nt, Human
cucaggauuaaggaaucuaaau

SEQ ID NO: 822946 - RNA, 19 nt, Human
acuggcaguuucugcaugg

SEQ ID NO: 822947 - RNA, 22 nt, Human
gcagagcuucuguccuucagga

SEQ ID NO: 822948 - RNA, 23 nt, Human
ggcagcucucaucugaugacuga

SEQ ID NO: 822949 - RNA, 20 nt, Human
aggcaccugucacaggugag

SEQ ID NO: 822950 - RNA, 22 nt, Human
uugggcucaggaguuugagacc

SEQ ID NO: 822951 - RNA, 20 nt, Human
cagagccaagagcagcaucu

SEQ ID NO: 822952 - RNA, 22 nt, Human
cugcuguggugucaagcaucuc

SEQ ID NO: 822953 - RNA, 22 nt, Human
cugcccagaagccagaugggca

SEQ ID NO: 822954 - RNA, 22 nt, Human
ccucaggggucacugugaggag

SEQ ID NO: 822955 - RNA, 22 nt, Human
aucuacccacugaacacaauau

SEQ ID NO: 822956 - RNA, 22 nt, Human
caggcagcauuuacucugauga

SEQ ID NO: 822957 - RNA, 20 nt, Human
augcuuucuugugugcugcu

SEQ ID NO: 822958 - RNA, 22 nt, Human
cuuucauucuuagauauuagug

SEQ ID NO: 822959 - RNA, 22 nt, Human
cagcuuucaucagugacacuca

SEQ ID NO: 822960 - RNA, 22 nt, Human
ccaggcugagcaugauuggagc

SEQ ID NO: 822961 - RNA, 22 nt, Human
ugaacucucucaagugacagaa

SEQ ID NO: 822962 - RNA, 22 nt, Human
uucuucuuuccuauaauuaauu

SEQ ID NO: 822963 - RNA, 22 nt, Human
aggacagggauucaaacuccca

SEQ ID NO: 822964 - RNA, 23 nt, Human
cccagggacacgaugacaccucc

SEQ ID NO: 822965 - RNA, 22 nt, Human
acagugacguuuauuugagacg

SEQ ID NO: 822966 - RNA, 22 nt, Human
uucuucaaauagcagggaguca

SEQ ID NO: 822967 - RNA, 22 nt, Human
ggcaucuccaaaacaugaacuc

SEQ ID NO: 822968 - RNA, 22 nt, Human
gcagagaagaugcccaggcuuc

SEQ ID NO: 822969 - RNA, 22 nt, Human
auuugcuuucagguauaaaagg

SEQ ID NO: 822970 - RNA, 22 nt, Human
aaggagagguuguccguguugu

SEQ ID NO: 822971 - RNA, 22 nt, Human
uccaggagucuagccucaggcc

SEQ ID NO: 822972 - RNA, 22 nt, Human
ggccagaaguuggaaaagagcc

SEQ ID NO: 822973 - RNA, 20 nt, Human
ugaaggccauuuguuccaga

SEQ ID NO: 822974 - RNA, 22 nt, Human
ucuuccaagguugcacacuauc

SEQ ID NO: 822975 - RNA, 23 nt, Human
ggagaggggugugggcaucuuua

SEQ ID NO: 822976 - RNA, 22 nt, Human
agacgagggccuggcacacagu

SEQ ID NO: 822977 - RNA, 22 nt, Human
gcuccuucaggugguagcuguu

SEQ ID NO: 822978 - RNA, 22 nt, Human
guugaaagaucauguggcugcc

SEQ ID NO: 822979 - RNA, 22 nt, Human
gaggagaggccaucguuguuau

SEQ ID NO: 822980 - RNA, 22 nt, Human
cauuuguauagugcuuagacca

SEQ ID NO: 822981 - RNA, 22 nt, Human
caagauggacauaaggagagaa

SEQ ID NO: 822982 - RNA, 22 nt, Human
uuccucagaaaauacuguccaa

SEQ ID NO: 822983 - RNA, 22 nt, Human
ccugcuguucuguuuagugaac

SEQ ID NO: 822984 - RNA, 18 nt, Human
aagaggaggaaacccagg

SEQ ID NO: 822985 - RNA, 22 nt, Human
aagugggaauagaaaugaaggu

SEQ ID NO: 822986 - RNA, 22 nt, Human
cagagccauuauggagacuugc

SEQ ID NO: 822987 - RNA, 21 nt, Human
gauuuuaaagagacugccaca

SEQ ID NO: 822988 - RNA, 22 nt, Human
caagaugggcaccccagcaccu

SEQ ID NO: 822989 - RNA, 20 nt, Human
caguccaaucagaggccacc

SEQ ID NO: 822990 - RNA, 22 nt, Human
uccaggagguagugcuuaauuu

SEQ ID NO: 822991 - RNA, 22 nt, Human
aggcagugcucaagacagcagc

SEQ ID NO: 822992 - RNA, 22 nt, Human
acauuuuuuagagucccacauu

SEQ ID NO: 822993 - RNA, 21 nt, Human
ucacaucuauguuaagcaaac

SEQ ID NO: 822994 - RNA, 22 nt, Human
ggagggacccacucuagaggug

SEQ ID NO: 822995 - RNA, 22 nt, Human
ggauggcagucugcaugagaaa

SEQ ID NO: 822996 - RNA, 22 nt, Human
agaggcaguauacaauccgagc

SEQ ID NO: 822997 - RNA, 22 nt, Human
ucaauucugguccucaggaacu

SEQ ID NO: 822998 - RNA, 22 nt, Human
gucaggauuauaauccccaugg

SEQ ID NO: 822999 - RNA, 22 nt, Human
cuggcaguguccagcucgugau

SEQ ID NO: 823000 - RNA, 22 nt, Human
cggcagcuccgcgccguaggac

SEQ ID NO: 823001 - RNA, 22 nt, Human
agagggagugaaauggaauaga

SEQ ID NO: 823002 - RNA, 22 nt, Human
uacugcaugguggaguggagcu

SEQ ID NO: 823003 - RNA, 22 nt, Human
auuuccagugcacugaauagaa

SEQ ID NO: 823004 - RNA, 22 nt, Human
aagggcaggagaagacggauau

SEQ ID NO: 823005 - RNA, 22 nt, Human
cuagcaucagaugagaagcugu

SEQ ID NO: 823006 - RNA, 22 nt, Human
agggaagcccuggcugagaccc

SEQ ID NO: 823007 - RNA, 22 nt, Human
aaauacagaguugcuuaaaagc

SEQ ID NO: 823008 - RNA, 22 nt, Human
gagagggagccagccaggaacc

SEQ ID NO: 823009 - RNA, 22 nt, Human
agucucuuauucccuauugcug

SEQ ID NO: 823010 - RNA, 22 nt, Human
auucugagacaauugccgucag

SEQ ID NO: 823011 - RNA, 22 nt, Human
aagauuauuuaagacaggaacc

SEQ ID NO: 823012 - RNA, 22 nt, Human
uucaggauucugugucugacaa

SEQ ID NO: 823013 - RNA, 22 nt, Human
cagcaggaggugaguagcaggu

SEQ ID NO: 823014 - RNA, 22 nt, Human
uuucucuguucucuaacuguaa

SEQ ID NO: 823015 - RNA, 22 nt, Human
caaguaaacaauaugugauuca

SEQ ID NO: 823016 - RNA, 22 nt, Human
agggagcuucuggccucagccu

SEQ ID NO: 823017 - RNA, 22 nt, Human
aaguaaaauguuuccuuuauua

SEQ ID NO: 823018 - RNA, 20 nt, Human
ggaggguggaagaaagcaag

SEQ ID NO: 823019 - RNA, 22 nt, Human
uuauuuaaugugaucugaagag

SEQ ID NO: 823020 - RNA, 22 nt, Human
aggcagcguagcaaggcuagua

SEQ ID NO: 823021 - RNA, 22 nt, Human
uaugaacucuggagucugagug

SEQ ID NO: 823022 - RNA, 22 nt, Human
gagggagggccaggucccaacc

SEQ ID NO: 823023 - RNA, 22 nt, Human
uuugcagucaaauuugcuaaau

SEQ ID NO: 823024 - RNA, 22 nt, Human
ccacagagacaggguccuugcu

SEQ ID NO: 823025 - RNA, 22 nt, Human
aggcagcuaagauggauaauga

SEQ ID NO: 823026 - RNA, 22 nt, Human
aucauucuauuguugagcugcc

SEQ ID NO: 823027 - RNA, 20 nt, Human
uucuucucuaguuaucuuca

SEQ ID NO: 823028 - RNA, 22 nt, Human
cuguguuugaugagaagccacc

SEQ ID NO: 823029 - RNA, 22 nt, Human
cagcuggcuggucagugcacaa

SEQ ID NO: 823030 - RNA, 17 nt, Human
ccaggagagaugcuugu

SEQ ID NO: 823031 - RNA, 22 nt, Human
uaggagggcccugaaaauggca

SEQ ID NO: 823032 - RNA, 21 nt, Human
uggcaggcagcuggaagcuug

SEQ ID NO: 823033 - RNA, 22 nt, Human
cggagaggugggggcagcaucu

SEQ ID NO: 823034 - RNA, 22 nt, Human
gcugcccaggagagguggggcu

SEQ ID NO: 823035 - RNA, 22 nt, Human
caggaugaagggcaaaggcaag

SEQ ID NO: 823036 - RNA, 22 nt, Human
caggcagggagcuggaaaggau

SEQ ID NO: 823037 - RNA, 22 nt, Human
ugcuuuggaucuauuugcugag

SEQ ID NO: 823038 - RNA, 22 nt, Human
agagggcagucucagauuggga

SEQ ID NO: 823039 - RNA, 22 nt, Human
cagcuggccaaucagggcgccc

SEQ ID NO: 823040 - RNA, 22 nt, Human
auucuuaauugccaugcuguau

SEQ ID NO: 823041 - RNA, 22 nt, Human
ugccuugcgggcguuucuguug

SEQ ID NO: 823042 - RNA, 20 nt, Human
uauuuacaacuuagagccuc

SEQ ID NO: 823043 - RNA, 22 nt, Human
ucaggaugagcucauaacuaug

SEQ ID NO: 823044 - RNA, 22 nt, Human
agggcaguucaacuucauagug

SEQ ID NO: 823045 - RNA, 22 nt, Human
aagggagguaaagcuauuuaaa

SEQ ID NO: 823046 - RNA, 17 nt, Human
cccaugagcccacuccc

SEQ ID NO: 823047 - RNA, 22 nt, Human
ggcaggcugggugucauggagu

SEQ ID NO: 823048 - RNA, 22 nt, Human
gacccaggagagaggguugcau

SEQ ID NO: 823049 - RNA, 22 nt, Human
auagucuuagaucagauaaagu

SEQ ID NO: 823050 - RNA, 22 nt, Human
uuuguuaauucuuauguuagag

SEQ ID NO: 823051 - RNA, 22 nt, Human
uggcagcugaggggaggcuuug

SEQ ID NO: 823052 - RNA, 22 nt, Human
cugcaucacagcaggaggcaca

SEQ ID NO: 823053 - RNA, 22 nt, Human
cacaugaguccugccagguaug

SEQ ID NO: 823054 - RNA, 22 nt, Human
cugcuuugcauagcugccagag

SEQ ID NO: 823055 - RNA, 23 nt, Human
aaggccagaauuucaauggugcc

SEQ ID NO: 823056 - RNA, 22 nt, Human
aguccuuugggaaaaaugacua

SEQ ID NO: 823057 - RNA, 22 nt, Human
auaucaaacgaaguuauuuuaa

SEQ ID NO: 823058 - RNA, 22 nt, Human
aggguggccaugagggagagau

SEQ ID NO: 823059 - RNA, 22 nt, Human
cccaagagcuucuaggacgcug

SEQ ID NO: 823060 - RNA, 22 nt, Human
aggagagaauguuccaggcuug

SEQ ID NO: 823061 - RNA, 22 nt, Human
augggaggaugcucgggugcuc

SEQ ID NO: 823062 - RNA, 21 nt, Human
uucuucaguuuaauauaaaau

SEQ ID NO: 823063 - RNA, 15 nt, Human
caggagaggaagguu

SEQ ID NO: 823064 - RNA, 22 nt, Human
aagggaggccagagguuuugca

SEQ ID NO: 823065 - RNA, 22 nt, Human
ccugucacgaugacugcacucu

SEQ ID NO: 823066 - RNA, 22 nt, Human
accaggagagauuuuauugaga

SEQ ID NO: 823067 - RNA, 22 nt, Human
ucauucuuuaccaaguugucac

SEQ ID NO: 823068 - RNA, 22 nt, Human
agaccauggccauccuaggaaa

SEQ ID NO: 823069 - RNA, 22 nt, Human
uucacagauguauuggaacucc

SEQ ID NO: 823070 - RNA, 20 nt, Human
uguuaaaggacacuugcuuu

SEQ ID NO: 823071 - RNA, 22 nt, Human
cccaggagacugagcuguaacc

SEQ ID NO: 823072 - RNA, 18 nt, Human
cucaccauucugcccaau

SEQ ID NO: 823073 - RNA, 22 nt, Human
uugugaguagugccgcaauaaa

SEQ ID NO: 823074 - RNA, 22 nt, Human
uuguaaauaguaguaagaugcc

SEQ ID NO: 823075 - RNA, 22 nt, Human
aggcaggcacuccggaaguguc

SEQ ID NO: 823076 - RNA, 22 nt, Human
ccugcugugaagccaggccugu

SEQ ID NO: 823077 - RNA, 22 nt, Human
ucaggagacuggcagugcccac

SEQ ID NO: 823078 - RNA, 22 nt, Human
cccauugugguuguugaggaua

SEQ ID NO: 823079 - RNA, 22 nt, Human
agucucuuuaaucacagugucu

SEQ ID NO: 823080 - RNA, 22 nt, Human
aagggcagccugacucacgguc

SEQ ID NO: 823081 - RNA, 22 nt, Human
gcagcucccagcuugaaagguc

SEQ ID NO: 823082 - RNA, 22 nt, Human
cagcuucugcuaucgaacaucu

SEQ ID NO: 823083 - RNA, 22 nt, Human
uuucacaacugcuuauuugaga

SEQ ID NO: 823084 - RNA, 22 nt, Human
ccucaugguacuuacuguagcu

SEQ ID NO: 823085 - RNA, 22 nt, Human
agccuuguuggucugaguuugg

SEQ ID NO: 823086 - RNA, 22 nt, Human
aaaggccaagcaugagguggac

SEQ ID NO: 823087 - RNA, 21 nt, Human
uuucuucacuuugccccaugu

SEQ ID NO: 823088 - RNA, 19 nt, Human
uucauucucuuauuguugu

SEQ ID NO: 823089 - RNA, 22 nt, Human
ucuuugcaaaauacaacaaugg

SEQ ID NO: 823090 - RNA, 21 nt, Human
aaaggccauaaucacggagca

SEQ ID NO: 823091 - RNA, 22 nt, Human
gguggaaggccuggaaggaggc

SEQ ID NO: 823092 - RNA, 22 nt, Human
ucagucucuggggcuucuguuu

SEQ ID NO: 823093 - RNA, 20 nt, Human
ugugaaagcaguagaaugac

SEQ ID NO: 823094 - RNA, 22 nt, Human
cugcacaguuugauuucuugcu

SEQ ID NO: 823095 - RNA, 22 nt, Human
gaggccaggacaugaaagcuga

SEQ ID NO: 823096 - RNA, 22 nt, Human
ucugcugucacucauuugcuuc

SEQ ID NO: 823097 - RNA, 22 nt, Human
gaggcagcugaagcuucaaaga

SEQ ID NO: 823098 - RNA, 22 nt, Human
cugccuccugccgugcagcuuc

SEQ ID NO: 823099 - RNA, 20 nt, Human
cgugcugugaccuugagcau

SEQ ID NO: 823100 - RNA, 22 nt, Human
uuuuucagccaugaauuacacu

SEQ ID NO: 823101 - RNA, 22 nt, Human
caggaugagaggcccagggaag

SEQ ID NO: 823102 - RNA, 22 nt, Human
ugucuuuggaauauuuagcuga

SEQ ID NO: 823103 - RNA, 22 nt, Human
uuugaaagacagaauauuuuug

SEQ ID NO: 823104 - RNA, 22 nt, Human
uuuaacagaugugaaauuuuca

SEQ ID NO: 823105 - RNA, 15 nt, Human
cccaggaguucgaga

SEQ ID NO: 823106 - RNA, 22 nt, Human
caagagagaugcagcucacuca

SEQ ID NO: 823107 - RNA, 22 nt, Human
agugugagcccuggaguggugc

SEQ ID NO: 823108 - RNA, 22 nt, Human
agagacagaggcaauauagcuu

SEQ ID NO: 823109 - RNA, 22 nt, Human
gucacuguauccagguuccagc

SEQ ID NO: 823110 - RNA, 22 nt, Human
caggagaggaggcuacuucuua

SEQ ID NO: 823111 - RNA, 22 nt, Human
cucaggaaaggccaugcaaggg

SEQ ID NO: 823112 - RNA, 22 nt, Human
uuugaaagcuacuuucggguca

SEQ ID NO: 823113 - RNA, 22 nt, Human
acucuucuugcugcucauuaau

SEQ ID NO: 823114 - RNA, 22 nt, Human
aggaguggugcaggaccugcca

SEQ ID NO: 823115 - RNA, 22 nt, Human
cuucucagucaccugugagucu

SEQ ID NO: 823116 - RNA, 21 nt, Human
aggcagcuggaaggccuggcu

SEQ ID NO: 823117 - RNA, 22 nt, Human
gaggcagcaaaauauaucauaa

SEQ ID NO: 823118 - RNA, 22 nt, Human
ucccaggaugugcgugccgccg

SEQ ID NO: 823119 - RNA, 21 nt, Human
aggaggggucuuucccacuga

SEQ ID NO: 823120 - RNA, 22 nt, Human
uugcugugucugauggcugaga

SEQ ID NO: 823121 - RNA, 22 nt, Human
aauaugcauuaacuguguacau

SEQ ID NO: 823122 - RNA, 22 nt, Human
uaaaauagcaugugcagugaaa

SEQ ID NO: 823123 - RNA, 16 nt, Human
ucccaggaggcggaac

SEQ ID NO: 823124 - RNA, 22 nt, Human
ucucauugguauauacaugugu

SEQ ID NO: 823125 - RNA, 22 nt, Human
gaggagagaagcuaacggugcu

SEQ ID NO: 823126 - RNA, 22 nt, Human
uagaaauguugguauuaacauu

SEQ ID NO: 823127 - RNA, 22 nt, Human
caggaaaggugugucaugaugg

SEQ ID NO: 823128 - RNA, 22 nt, Human
acagagagaaacaaucagcagc

SEQ ID NO: 823129 - RNA, 22 nt, Human
ucugcaggaggcuggcugcagg

SEQ ID NO: 823130 - RNA, 22 nt, Human
aggcagucuaucucuggagccu

SEQ ID NO: 823131 - RNA, 22 nt, Human
acauuuaaccaaacuguuuaau

SEQ ID NO: 823132 - RNA, 22 nt, Human
auuuccuuugcaaagacugugc

SEQ ID NO: 823133 - RNA, 22 nt, Human
uuucaaacauaucuucauuacu

SEQ ID NO: 823134 - RNA, 22 nt, Human
agagggcaaguguaguccagua

SEQ ID NO: 823135 - RNA, 23 nt, Human
ucaggauauugugugccaaggug

SEQ ID NO: 823136 - RNA, 22 nt, Human
cccaggagacauauagaaggac

SEQ ID NO: 823137 - RNA, 21 nt, Human
ucaggagagcccaucuacaaa

SEQ ID NO: 823138 - RNA, 22 nt, Human
ugcuuggcuuucugagcuucug

SEQ ID NO: 823139 - RNA, 22 nt, Human
aggcaggcaaccaccugggaag

SEQ ID NO: 823140 - RNA, 22 nt, Human
ccuuaaauucuccauuugaaag

SEQ ID NO: 823141 - RNA, 22 nt, Human
aggcaguuguagagagggcucu

SEQ ID NO: 823142 - RNA, 20 nt, Human
uuucugugcccaggucuguu

SEQ ID NO: 823143 - RNA, 22 nt, Human
cuucagagugcagaagauuggg

SEQ ID NO: 823144 - RNA, 22 nt, Human
ugaggcagccugcauuaaagag

SEQ ID NO: 823145 - RNA, 22 nt, Human
agcuagaauguuccuuuucauu

SEQ ID NO: 823146 - RNA, 22 nt, Human
cuauuacauuucuggacauuca

SEQ ID NO: 823147 - RNA, 22 nt, Human
ugaggcaggagguugagaacug

SEQ ID NO: 823148 - RNA, 22 nt, Human
uugcagcuucgagucuaucugu

SEQ ID NO: 823149 - RNA, 22 nt, Human
uacaucauaauaauacuuagaa

SEQ ID NO: 823150 - RNA, 22 nt, Human
uucagaauauuuguuuuacaug

SEQ ID NO: 823151 - RNA, 22 nt, Human
gagaggugaauguggaugccac

SEQ ID NO: 823152 - RNA, 22 nt, Human
aggcaacuuuuggggaugaugg

SEQ ID NO: 823153 - RNA, 23 nt, Human
ucguugaauagcaauagcacaac

SEQ ID NO: 823154 - RNA, 22 nt, Human
uggcaucucaaacaggcagauu

SEQ ID NO: 823155 - RNA, 20 nt, Human
cugagagucugugcuuaguc

SEQ ID NO: 823156 - RNA, 22 nt, Human
uuugaaaggaaguuaauacuuu

SEQ ID NO: 823157 - RNA, 22 nt, Human
agaccaugggcucugaagagca

SEQ ID NO: 823158 - RNA, 20 nt, Human
agagcagcaguuggugaggu

SEQ ID NO: 823159 - RNA, 22 nt, Human
uauucaaaguaccuucauugcc

SEQ ID NO: 823160 - RNA, 22 nt, Human
aggagggagaugcccauccugg

SEQ ID NO: 823161 - RNA, 22 nt, Human
uuauagaaggagcauucacuua

SEQ ID NO: 823162 - RNA, 19 nt, Human
aggguggcaaaggagggug

SEQ ID NO: 823163 - RNA, 22 nt, Human
cagcaggaccauugaggcauca

SEQ ID NO: 823164 - RNA, 22 nt, Human
caggaaugaggucguaaguguc

SEQ ID NO: 823165 - RNA, 22 nt, Human
uuugaaguucccccauaucaga

SEQ ID NO: 823166 - RNA, 22 nt, Human
ucucagucuuugcaaggaugcu

SEQ ID NO: 823167 - RNA, 22 nt, Human
uuuuucaagacaaccugcaugu

SEQ ID NO: 823168 - RNA, 22 nt, Human
gcaaguuauuuccauuuaaagc

SEQ ID NO: 823169 - RNA, 22 nt, Human
gcugcugucagugguggcaguu

SEQ ID NO: 823170 - RNA, 19 nt, Human
aucugccuuagugcugcug

SEQ ID NO: 823171 - RNA, 22 nt, Human
cgaggcagggaagcugcaaaag

SEQ ID NO: 823172 - RNA, 22 nt, Human
ccaggcugccgaggaaagaaag

SEQ ID NO: 823173 - RNA, 22 nt, Human
uauuugcaacauaaaacucuga

SEQ ID NO: 823174 - RNA, 22 nt, Human
gagggcuccauuccccgugccc

SEQ ID NO: 823175 - RNA, 21 nt, Human
ggagggcagcccagacuggcu

SEQ ID NO: 823176 - RNA, 22 nt, Human
cuguguuggcuuuucucuugua

SEQ ID NO: 823177 - RNA, 22 nt, Human
caugauuuugucuuguguuaau

SEQ ID NO: 823178 - RNA, 22 nt, Human
gagugcaguuggggugagggga

SEQ ID NO: 823179 - RNA, 22 nt, Human
aaggcagccaugugcuuugggu

SEQ ID NO: 823180 - RNA, 22 nt, Human
ggccaggagcugcacagggcuc

SEQ ID NO: 823181 - RNA, 22 nt, Human
uagugcuuaacacaaagugauu

SEQ ID NO: 823182 - RNA, 22 nt, Human
gcugauguuuaguugauguuac

SEQ ID NO: 823183 - RNA, 22 nt, Human
aagaagagaaaugugcugcugg

SEQ ID NO: 823184 - RNA, 22 nt, Human
ggcagggaagcuggcaucacgg

SEQ ID NO: 823185 - RNA, 22 nt, Human
ugguuuugcuaaaauagaaaga

SEQ ID NO: 823186 - RNA, 22 nt, Human
cuugcugugugguguucucaga

SEQ ID NO: 823187 - RNA, 20 nt, Human
guggcaggcagugaaggagc

SEQ ID NO: 823188 - RNA, 22 nt, Human
ucuccucucuuaccugguacaa

SEQ ID NO: 823189 - RNA, 22 nt, Human
ccauggcaauggucagucuauu

SEQ ID NO: 823190 - RNA, 22 nt, Human
aauaucaacaguguccuucuaa

SEQ ID NO: 823191 - RNA, 17 nt, Human
caagagagaugacugga

SEQ ID NO: 823192 - RNA, 20 nt, Human
uugagcuuuuaguacagaca

SEQ ID NO: 823193 - RNA, 22 nt, Human
gggcagcucucacagcagccaa

SEQ ID NO: 823194 - RNA, 22 nt, Human
cagauccacccuuguagugaca

SEQ ID NO: 823195 - RNA, 22 nt, Human
uucagugucaauuuuuaaauau

SEQ ID NO: 823196 - RNA, 22 nt, Human
uugauuaaacaggcauauucaa

SEQ ID NO: 823197 - RNA, 22 nt, Human
aggaggcacucacucucagggu

SEQ ID NO: 823198 - RNA, 22 nt, Human
gcaagcugcucuuauguggagg

SEQ ID NO: 823199 - RNA, 22 nt, Human
ugcaggaaauuccaggguggcc

SEQ ID NO: 823200 - RNA, 22 nt, Human
auacagauguugaauguuauau

SEQ ID NO: 823201 - RNA, 22 nt, Human
cuuaagauuugagauaccuaau

SEQ ID NO: 823202 - RNA, 22 nt, Human
ugaggggaacugaugcccauug

SEQ ID NO: 823203 - RNA, 22 nt, Human
cagcugcuuuaguuuuccaucc

SEQ ID NO: 823204 - RNA, 22 nt, Human
gaggagaggcuggacgcgguga

SEQ ID NO: 823205 - RNA, 22 nt, Human
aggcacaggccucagcacccag

SEQ ID NO: 823206 - RNA, 22 nt, Human
ccacugaggcaggcaguaucua

SEQ ID NO: 823207 - RNA, 22 nt, Human
auucuucauuuacuguuacuug

SEQ ID NO: 823208 - RNA, 22 nt, Human
auucuucaguauguguggauug

SEQ ID NO: 823209 - RNA, 22 nt, Human
ccaggacaaguguggccauggc

SEQ ID NO: 823210 - RNA, 22 nt, Human
auugcuguacacuucuagaucu

SEQ ID NO: 823211 - RNA, 22 nt, Human
ggagcacuauaauagagauuuu

SEQ ID NO: 823212 - RNA, 22 nt, Human
uaaagcacauaucuuacaauaa

SEQ ID NO: 823213 - RNA, 20 nt, Human
agcuucuucugucuaauuuu

SEQ ID NO: 823214 - RNA, 22 nt, Human
aaaugauugucaaaguucuguu

SEQ ID NO: 823215 - RNA, 21 nt, Human
ccaggaaggacugagcucccu

SEQ ID NO: 823216 - RNA, 22 nt, Human
ucagucuucccuccagugcaac

SEQ ID NO: 823217 - RNA, 22 nt, Human
agucuugcucuugcaucugcuu

SEQ ID NO: 823218 - RNA, 22 nt, Human
uucuccucuguuggccuucccu

SEQ ID NO: 823219 - RNA, 22 nt, Human
ucucaggacuuugggaagcuca

SEQ ID NO: 823220 - RNA, 22 nt, Human
aguuugaauugaaaugcagaug

SEQ ID NO: 823221 - RNA, 22 nt, Human
gaaggccacggaauggagcugg

SEQ ID NO: 823222 - RNA, 22 nt, Human
ggugaagguggaacgcagagca

SEQ ID NO: 823223 - RNA, 22 nt, Human
uucaacuauuaugaauaaaauu

SEQ ID NO: 823224 - RNA, 22 nt, Human
acgagagguccuuagaaucugu

SEQ ID NO: 823225 - RNA, 18 nt, Human
ugcuggguaacuguaugg

SEQ ID NO: 823226 - RNA, 22 nt, Human
gaggcagcauucgcauagacag

SEQ ID NO: 823227 - RNA, 22 nt, Human
aagggaggggauguaagccugg

SEQ ID NO: 823228 - RNA, 22 nt, Human
uggcagcugcaggccuccugag

SEQ ID NO: 823229 - RNA, 17 nt, Human
aggcaggcagagcggga

SEQ ID NO: 823230 - RNA, 22 nt, Human
cccaggaguucgaggcuguagu

SEQ ID NO: 823231 - RNA, 22 nt, Human
ucauuucuccgaccugcugucc

SEQ ID NO: 823232 - RNA, 22 nt, Human
cuguggaaaauuuguauguaau

SEQ ID NO: 823233 - RNA, 22 nt, Human
guccucugaaguugugcaaugc

SEQ ID NO: 823234 - RNA, 17 nt, Human
ccuguguuugcuccuuc

SEQ ID NO: 823235 - RNA, 22 nt, Human
caguucuuaauaccaugugguu

SEQ ID NO: 823236 - RNA, 22 nt, Human
cucaagacugaucgcaguggaa

SEQ ID NO: 823237 - RNA, 22 nt, Human
uggcagcuccuggggccagcac

SEQ ID NO: 823238 - RNA, 22 nt, Human
ugaggggagguuggggcacauc

SEQ ID NO: 823239 - RNA, 22 nt, Human
ucauuguuauguuuugcugucu

SEQ ID NO: 823240 - RNA, 21 nt, Human
uccaggagcacgggacuagga

SEQ ID NO: 823241 - RNA, 19 nt, Human
cuugcugggugguuucugc

SEQ ID NO: 823242 - RNA, 22 nt, Human
cagaccagaaggaagccgacaa

SEQ ID NO: 823243 - RNA, 21 nt, Human
uguaaguuucaucugaauugg

SEQ ID NO: 823244 - RNA, 22 nt, Human
cucacugucuguacuagcugau

SEQ ID NO: 823245 - RNA, 22 nt, Human
ugcuagugcaggguuuucaguu

SEQ ID NO: 823246 - RNA, 19 nt, Human
aaaaacuuaguccagaaag

SEQ ID NO: 823247 - RNA, 22 nt, Human
agacucaagcagauaggaauua

SEQ ID NO: 823248 - RNA, 22 nt, Human
caggcagcaggagcccugcucg

SEQ ID NO: 823249 - RNA, 22 nt, Human
gagggugggccagauaugaggg

SEQ ID NO: 823250 - RNA, 22 nt, Human
auggagacgcaagggaccuagg

SEQ ID NO: 823251 - RNA, 22 nt, Human
accaggagggacccugguggcc

SEQ ID NO: 823252 - RNA, 22 nt, Human
aggcagcuagagagugaaacug

SEQ ID NO: 823253 - RNA, 22 nt, Human
uucauuaguucugaagaugucu

SEQ ID NO: 823254 - RNA, 22 nt, Human
ucuuagaaauuccccaguggcu

SEQ ID NO: 823255 - RNA, 22 nt, Human
cugcugugggcaggguagcugg

SEQ ID NO: 823256 - RNA, 17 nt, Human
uccaugagacaugaaga

SEQ ID NO: 823257 - RNA, 22 nt, Human
uuuuaacuuaaaauacauagau

SEQ ID NO: 823258 - RNA, 22 nt, Human
aaaaacuguaauuacuuuugca

SEQ ID NO: 823259 - RNA, 22 nt, Human
aggaagcucaaagccaugaugu

SEQ ID NO: 823260 - RNA, 22 nt, Human
aaguguagauuauggagugucu

SEQ ID NO: 823261 - RNA, 22 nt, Human
gcaggcaguuauuuaguagaau

SEQ ID NO: 823262 - RNA, 22 nt, Human
uuucaguguaucuuccaaaagc

SEQ ID NO: 823263 - RNA, 22 nt, Human
uagcccagaagagggaagcaac

SEQ ID NO: 823264 - RNA, 22 nt, Human
aacuuucuuggaugucucaaca

SEQ ID NO: 823265 - RNA, 22 nt, Human
auucauaacggcaaaugucacc

SEQ ID NO: 823266 - RNA, 22 nt, Human
gaccauuuguugaaaagauuau

SEQ ID NO: 823267 - RNA, 22 nt, Human
uuugaaaguguuuacuugggaa

SEQ ID NO: 823268 - RNA, 22 nt, Human
ucugcuguauuagguugaacug

SEQ ID NO: 823269 - RNA, 23 nt, Human
uugaaagguagcuggcagcuaga

SEQ ID NO: 823270 - RNA, 22 nt, Human
uccaggaguccuggguggcccc

SEQ ID NO: 823271 - RNA, 22 nt, Human
ucacaauuuggauacagcuaug

SEQ ID NO: 823272 - RNA, 22 nt, Human
uggcagcuaucuuuaaugagau

SEQ ID NO: 823273 - RNA, 22 nt, Human
cugcaucaguggauaugauggu

SEQ ID NO: 823274 - RNA, 22 nt, Human
uucaggauggaguaccuuuuau

SEQ ID NO: 823275 - RNA, 22 nt, Human
uccaggagguuuggaggaagca

SEQ ID NO: 823276 - RNA, 22 nt, Human
agugagggaugaagaacugcgg

SEQ ID NO: 823277 - RNA, 22 nt, Human
ucaugcuuaaaagacacuugag

SEQ ID NO: 823278 - RNA, 22 nt, Human
uauuucagcacaugggauaggu

SEQ ID NO: 823279 - RNA, 22 nt, Human
cucuucuugcuagacugagugc

SEQ ID NO: 823280 - RNA, 22 nt, Human
uccccagggcugcagagggugu

SEQ ID NO: 823281 - RNA, 22 nt, Human
cauuaaaauaucucaugguguu

SEQ ID NO: 823282 - RNA, 22 nt, Human
ccaggagaugauguuggggauu

SEQ ID NO: 823283 - RNA, 22 nt, Human
uuccuuaguugacugucuuagu

SEQ ID NO: 823284 - RNA, 22 nt, Human
ugaggcagaaauuccuguuuuc

SEQ ID NO: 823285 - RNA, 17 nt, Human
gcccaggaaggacggcc

SEQ ID NO: 823286 - RNA, 22 nt, Human
aggcaggcucaggcccaugcuu

SEQ ID NO: 823287 - RNA, 22 nt, Human
gaaucucaaggcuugugaggau

SEQ ID NO: 823288 - RNA, 22 nt, Human
gcuguguuuuauguuagguuaa

SEQ ID NO: 823289 - RNA, 22 nt, Human
gggcaguugauggaggucugga

SEQ ID NO: 823290 - RNA, 22 nt, Human
aaagccaugaauguuauagagg

SEQ ID NO: 823291 - RNA, 22 nt, Human
uuugaaagcaccauuugaguag

SEQ ID NO: 823292 - RNA, 22 nt, Human
augaaacaguguguauagcaaa

SEQ ID NO: 823293 - RNA, 22 nt, Human
gaaguacaguuuuaucuagcca

SEQ ID NO: 823294 - RNA, 22 nt, Human
uccauucauucauugaugaaca

SEQ ID NO: 823295 - RNA, 22 nt, Human
aggcaagcgcagaagcggagga

SEQ ID NO: 823296 - RNA, 22 nt, Human
uggcagcuccggguaggggcug

SEQ ID NO: 823297 - RNA, 22 nt, Human
cccaggaagaaauucugauuug

SEQ ID NO: 823298 - RNA, 22 nt, Human
cugcuaaaccucucugagagcu

SEQ ID NO: 823299 - RNA, 22 nt, Human
guuaaauucgaugauggauaaa

SEQ ID NO: 823300 - RNA, 22 nt, Human
cuuugcaauagaggcacacaug

SEQ ID NO: 823301 - RNA, 22 nt, Human
uugaaagacuucuccugugaaa

SEQ ID NO: 823302 - RNA, 22 nt, Human
ucuccuccuuuuuucaacauag

SEQ ID NO: 823303 - RNA, 22 nt, Human
cucaggauauugggcuggagca

SEQ ID NO: 823304 - RNA, 22 nt, Human
uccuucuuugacaaguggcaga

SEQ ID NO: 823305 - RNA, 22 nt, Human
aaugagacacgugaagcagaug

SEQ ID NO: 823306 - RNA, 20 nt, Human
augugagggguugaaguggg

SEQ ID NO: 823307 - RNA, 22 nt, Human
gaucauuuacuuguucuggacu

SEQ ID NO: 823308 - RNA, 22 nt, Human
agggcagcacaaggcauggacu

SEQ ID NO: 823309 - RNA, 22 nt, Human
aaaggccaauaaagacaagcug

SEQ ID NO: 823310 - RNA, 20 nt, Human
gaugggaaucggagcuggua

SEQ ID NO: 823311 - RNA, 20 nt, Human
uuucacagucccuguuuccu

SEQ ID NO: 823312 - RNA, 22 nt, Human
aacauuucagcaaauaagaaca

SEQ ID NO: 823313 - RNA, 22 nt, Human
gggaggugauuaggaccaugua

SEQ ID NO: 823314 - RNA, 22 nt, Human
uacuuuuuagcacagugugugc

SEQ ID NO: 823315 - RNA, 22 nt, Human
guucuucagaggggaaagaacc

SEQ ID NO: 823316 - RNA, 22 nt, Human
ugaacaguuucaagaaaacuuu

SEQ ID NO: 823317 - RNA, 22 nt, Human
gaauacauuggaaaucagaaua

SEQ ID NO: 823318 - RNA, 22 nt, Human
uagaaaugugauaauagcuuaa

SEQ ID NO: 823319 - RNA, 22 nt, Human
acaaaugucuccucuuuuguua

SEQ ID NO: 823320 - RNA, 22 nt, Human
uccauuuuagaagaaaauccac

SEQ ID NO: 823321 - RNA, 21 nt, Human
cccagggaagccgcagucacc

SEQ ID NO: 823322 - RNA, 22 nt, Human
uuucuaggcacagugucuuccc

SEQ ID NO: 823323 - RNA, 22 nt, Human
uccauguguuuuccuguccaca

SEQ ID NO: 823324 - RNA, 21 nt, Human
auacauucuauuaagcauuua

SEQ ID NO: 823325 - RNA, 18 nt, Human
gcagcugacacuggaguu

SEQ ID NO: 823326 - RNA, 19 nt, Human
agcuuccauauucucuagu

SEQ ID NO: 823327 - RNA, 22 nt, Human
ugccaggagucaggccaggcag

SEQ ID NO: 823328 - RNA, 22 nt, Human
uaggcagccagcaucaguuggg

SEQ ID NO: 823329 - RNA, 22 nt, Human
gugaaggacuagcauggagggc

SEQ ID NO: 823330 - RNA, 22 nt, Human
aaggcaguaaaaucuaccuugc

SEQ ID NO: 823331 - RNA, 22 nt, Human
uguuuuuaaauaaugauagaaa

SEQ ID NO: 823332 - RNA, 22 nt, Human
ugaaguuauauauguugaaaau

SEQ ID NO: 823333 - RNA, 22 nt, Human
augcugugccuucucugugcca

SEQ ID NO: 823334 - RNA, 22 nt, Human
ggguggagaggcuaaguccagu

SEQ ID NO: 823335 - RNA, 22 nt, Human
ggccagcugggccaccaggugc

SEQ ID NO: 823336 - RNA, 22 nt, Human
gagagcuguuuaucuucuucaa

SEQ ID NO: 823337 - RNA, 22 nt, Human
caugugguucaaguacuccaca

SEQ ID NO: 823338 - RNA, 20 nt, Human
cugcugugguccuuuauuuu

SEQ ID NO: 823339 - RNA, 22 nt, Human
auuuucaaaacaucugcugugu

SEQ ID NO: 823340 - RNA, 22 nt, Human
gauggacagccuggaaggaaag

SEQ ID NO: 823341 - RNA, 22 nt, Human
aagcaaaggcaggagcuuguga

SEQ ID NO: 823342 - RNA, 22 nt, Human
uagugcuuaauaaauuucagaa

SEQ ID NO: 823343 - RNA, 20 nt, Human
cucuccucacccgugucagg

SEQ ID NO: 823344 - RNA, 22 nt, Human
ugaggggauacgguacacauug

SEQ ID NO: 823345 - RNA, 22 nt, Human
caacugcugacaccaucacucc

SEQ ID NO: 823346 - RNA, 22 nt, Human
aaauuguugaucuacaguaagg

SEQ ID NO: 823347 - RNA, 22 nt, Human
cccaggagccaucugucuuggc

SEQ ID NO: 823348 - RNA, 22 nt, Human
gagacagugguugcagaagcuc

SEQ ID NO: 823349 - RNA, 22 nt, Human
uuuccucauuuaucugcuggga

SEQ ID NO: 823350 - RNA, 22 nt, Human
ucacuguugaccuggaaguggg

SEQ ID NO: 823351 - RNA, 18 nt, Human
aagaggaggagcagguug

SEQ ID NO: 823352 - RNA, 20 nt, Human
accaauguuagcuuaguacu

SEQ ID NO: 823353 - RNA, 22 nt, Human
ggcagcuaguuuaagaaagagg

SEQ ID NO: 823354 - RNA, 22 nt, Human
uaauuccaaguugagacaugca

SEQ ID NO: 823355 - RNA, 22 nt, Human
auuugcuuuaagguauaaaagg

SEQ ID NO: 823356 - RNA, 22 nt, Human
cagagagggcggcccuggcuuc

SEQ ID NO: 823357 - RNA, 22 nt, Human
ucagagaggcaauacuguuuaa

SEQ ID NO: 823358 - RNA, 22 nt, Human
accauguguuuuacacauggua

SEQ ID NO: 823359 - RNA, 22 nt, Human
cuugcaggauuuugcugcugua

SEQ ID NO: 823360 - RNA, 22 nt, Human
cuguuucaagugaagucagaca

SEQ ID NO: 823361 - RNA, 22 nt, Human
aucugccuccaaguccaugugu

SEQ ID NO: 823362 - RNA, 22 nt, Human
gauguagagggaagauuuuaaa

SEQ ID NO: 823363 - RNA, 22 nt, Human
cugcuguguggauucaauggcu

SEQ ID NO: 823364 - RNA, 22 nt, Human
aagggcaggaaaagauggaugu

SEQ ID NO: 823365 - RNA, 22 nt, Human
caacagcugaucuuugaugaag

SEQ ID NO: 823366 - RNA, 22 nt, Human
aaauaguucagcuuguaaaccc

SEQ ID NO: 823367 - RNA, 22 nt, Human
uugcuuuguuacugcaguuucc

SEQ ID NO: 823368 - RNA, 22 nt, Human
cagcugacgccagaguggaauu

SEQ ID NO: 823369 - RNA, 22 nt, Human
gaggcagcagaacauggaagag

SEQ ID NO: 823370 - RNA, 22 nt, Human
ggaagaggcugaggccaugcug

SEQ ID NO: 823371 - RNA, 22 nt, Human
uuugacaucaauacccuagaau

SEQ ID NO: 823372 - RNA, 22 nt, Human
cagaggaugaucuggccucucu

SEQ ID NO: 823373 - RNA, 22 nt, Human
agcccaggaaguugaggcuugc

SEQ ID NO: 823374 - RNA, 22 nt, Human
cucccagagaccaagcugagaa

SEQ ID NO: 823375 - RNA, 22 nt, Human
cugcuguggaugcaggaccuca

SEQ ID NO: 823376 - RNA, 23 nt, Human
ugcaugugaauucauacuuguuu

SEQ ID NO: 823377 - RNA, 22 nt, Human
uccaggaggugaggggaccaaa

SEQ ID NO: 823378 - RNA, 22 nt, Human
agcugccccaugagaggcaggu

SEQ ID NO: 823379 - RNA, 22 nt, Human
ggcagcuauuccaagcagcacu

SEQ ID NO: 823380 - RNA, 22 nt, Human
gcagcuccuccugggcuggaga

SEQ ID NO: 823381 - RNA, 22 nt, Human
uagaaacaucagcuaaccaaaa

SEQ ID NO: 823382 - RNA, 22 nt, Human
uugaaaguccuucuugaguuac

SEQ ID NO: 823383 - RNA, 22 nt, Human
auguauuucuauguagugaaga

SEQ ID NO: 823384 - RNA, 22 nt, Human
gcccaggagguugggcugugca

SEQ ID NO: 823385 - RNA, 22 nt, Human
cugcuguguaucauuuuagaug

SEQ ID NO: 823386 - RNA, 22 nt, Human
gaggccaggagugcuguaaguu

SEQ ID NO: 823387 - RNA, 20 nt, Human
caggagggacauuucagcau

SEQ ID NO: 823388 - RNA, 20 nt, Human
gccaggagggugugaugagc

SEQ ID NO: 823389 - RNA, 22 nt, Human
cuguggaauugaugcuuagugu

SEQ ID NO: 823390 - RNA, 22 nt, Human
uucaguaaaacacugcaauguc

SEQ ID NO: 823391 - RNA, 22 nt, Human
cagagggaaaaggggaguaaua

SEQ ID NO: 823392 - RNA, 22 nt, Human
aagauaaacucuugauuucuga

SEQ ID NO: 823393 - RNA, 22 nt, Human
acucagaagauauaaugacuca

SEQ ID NO: 823394 - RNA, 22 nt, Human
cugcgcagcaaucagagaggag

SEQ ID NO: 823395 - RNA, 22 nt, Human
uaggagagcugaacuauugucu

SEQ ID NO: 823396 - RNA, 22 nt, Human
uggugguuaugcgcuuuguggg

SEQ ID NO: 823397 - RNA, 22 nt, Human
agaggggagagcuaagcaauuc

SEQ ID NO: 823398 - RNA, 22 nt, Human
uaacaauaguguuugcuaguca

SEQ ID NO: 823399 - RNA, 22 nt, Human
gcucacugcaaccucugcuucc

SEQ ID NO: 823400 - RNA, 22 nt, Human
aggcaagcauugggaacagggc

SEQ ID NO: 823401 - RNA, 22 nt, Human
gcccaggauaaugcugucccug

SEQ ID NO: 823402 - RNA, 22 nt, Human
uggaaagcgaggaguuggcauu

SEQ ID NO: 823403 - RNA, 22 nt, Human
gagaggcagaggccugaaaccg

SEQ ID NO: 823404 - RNA, 23 nt, Human
ccacagagcugccaauuccugug

SEQ ID NO: 823405 - RNA, 22 nt, Human
ggcuuggaaauugcaggacaca

SEQ ID NO: 823406 - RNA, 22 nt, Human
ucauuuguucaucugcucuucu

SEQ ID NO: 823407 - RNA, 22 nt, Human
accaggagacaugaccaaugag

SEQ ID NO: 823408 - RNA, 23 nt, Human
uccuuccuuugagaggcuccauc

SEQ ID NO: 823409 - RNA, 19 nt, Human
agcagcuggagguggagug

SEQ ID NO: 823410 - RNA, 22 nt, Human
guggcaggagacuggaagaugg

SEQ ID NO: 823411 - RNA, 22 nt, Human
gcacagcucgagcucaggaggg

SEQ ID NO: 823412 - RNA, 22 nt, Human
gaaccucagugaaacuggaggu

SEQ ID NO: 823413 - RNA, 22 nt, Human
cagucucucagcuuucagcugu

SEQ ID NO: 823414 - RNA, 22 nt, Human
aaauauaauuucugccucaaua

SEQ ID NO: 823415 - RNA, 22 nt, Human
ucuuuccaaggacucuguagca

SEQ ID NO: 823416 - RNA, 22 nt, Human
aauacauauggaauuccauguu

SEQ ID NO: 823417 - RNA, 22 nt, Human
ggugaaggucagagcaggaaaa

SEQ ID NO: 823418 - RNA, 22 nt, Human
ccagcagaggggcggagugcag

SEQ ID NO: 823419 - RNA, 22 nt, Human
cuuaaauuggaugaguuaaguu

SEQ ID NO: 823420 - RNA, 22 nt, Human
ccaggagagcucuaaauggcug

SEQ ID NO: 823421 - RNA, 21 nt, Human
acagcauguuuguguguuugc

SEQ ID NO: 823422 - RNA, 19 nt, Human
gaggucagcaagaaguauu

SEQ ID NO: 823423 - RNA, 22 nt, Human
ggcaagcucaggccucaggugu

SEQ ID NO: 823424 - RNA, 22 nt, Human
uugauguacagaauuguucaca

SEQ ID NO: 823425 - RNA, 22 nt, Human
aagcagaguccccuucccaugg

SEQ ID NO: 823426 - RNA, 22 nt, Human
aggcagucuaguccccaggcaa

SEQ ID NO: 823427 - RNA, 22 nt, Human
auuucagaugaccaaauggaaa

SEQ ID NO: 823428 - RNA, 22 nt, Human
uuagcaucugcuguaagcuuau

SEQ ID NO: 823429 - RNA, 22 nt, Human
uuuggaauuggcauucuauucu

SEQ ID NO: 823430 - RNA, 22 nt, Human
ggaagaggcugagccagguccc

SEQ ID NO: 823431 - RNA, 22 nt, Human
aggcagcugaccacaguaugau

SEQ ID NO: 823432 - RNA, 19 nt, Human
gagcgcagagggcagggga

SEQ ID NO: 823433 - RNA, 22 nt, Human
cauucucaauaguagaugagua

SEQ ID NO: 823434 - RNA, 22 nt, Human
aaagacuuggcuuaugauuugc

SEQ ID NO: 823435 - RNA, 22 nt, Human
uuauuuacaacucuucucuucc

SEQ ID NO: 823436 - RNA, 22 nt, Human
aaacaugaauagauauuaaaca

SEQ ID NO: 823437 - RNA, 22 nt, Human
ugucuucagcaaaugccuuucu

SEQ ID NO: 823438 - RNA, 22 nt, Human
cagaguggcacucugcuggaug

SEQ ID NO: 823439 - RNA, 22 nt, Human
ccagacaggaacacacaucucc

SEQ ID NO: 823440 - RNA, 22 nt, Human
auucugagaaaugcauugucag

SEQ ID NO: 823441 - RNA, 21 nt, Human
gcucagaguauugcacuguuu

SEQ ID NO: 823442 - RNA, 22 nt, Human
uccaggaggcagggcugugccc

SEQ ID NO: 823443 - RNA, 22 nt, Human
cccaggagagagacuugaaucu

SEQ ID NO: 823444 - RNA, 22 nt, Human
aaugucugccagaacugaucau

SEQ ID NO: 823445 - RNA, 22 nt, Human
ggaugggagcagaggacgacca

SEQ ID NO: 823446 - RNA, 22 nt, Human
ggggcagcucccgagggcagga

SEQ ID NO: 823447 - RNA, 22 nt, Human
aaaggccacacugcucuuucuc

SEQ ID NO: 823448 - RNA, 21 nt, Human
gaacauuuggguuguuucuac

SEQ ID NO: 823449 - RNA, 22 nt, Human
gcucaggaaaacagucuaguaa

SEQ ID NO: 823450 - RNA, 22 nt, Human
aaggcagcaggauuuggugacu

SEQ ID NO: 823451 - RNA, 22 nt, Human
ggcagcuuccugagccagcagc

SEQ ID NO: 823452 - RNA, 20 nt, Human
aggaggggauagaaucaaag

SEQ ID NO: 823453 - RNA, 22 nt, Human
ucuuugcagaauuuaacuuugc

SEQ ID NO: 823454 - RNA, 22 nt, Human
gaccaaggaagaggggagccag

SEQ ID NO: 823455 - RNA, 22 nt, Human
gcccaguaguucaagguugcag

SEQ ID NO: 823456 - RNA, 22 nt, Human
uucuuuugggaauuacguaugc

SEQ ID NO: 823457 - RNA, 22 nt, Human
ucauuuaauaauuuuugaguag

SEQ ID NO: 823458 - RNA, 22 nt, Human
ugcugaugcuguucuguuagga

SEQ ID NO: 823459 - RNA, 22 nt, Human
uccaggaggacugagggggcug

SEQ ID NO: 823460 - RNA, 22 nt, Human
aaaaaucuaugacugcuucucc

SEQ ID NO: 823461 - RNA, 22 nt, Human
ugcauuuccagauuucuggagu

SEQ ID NO: 823462 - RNA, 22 nt, Human
acagauguacacucauauauaa

SEQ ID NO: 823463 - RNA, 22 nt, Human
gguggagcuggaccaggagagg

SEQ ID NO: 823464 - RNA, 22 nt, Human
uucaggauuguguuuuuccuga

SEQ ID NO: 823465 - RNA, 19 nt, Human
aauacaguguuauagaauu

SEQ ID NO: 823466 - RNA, 22 nt, Human
uagcacauacauaauagauaga

SEQ ID NO: 823467 - RNA, 22 nt, Human
uagcuaucuguguccagaucca

SEQ ID NO: 823468 - RNA, 22 nt, Human
ccagagagaaauggauuugagu

SEQ ID NO: 823469 - RNA, 22 nt, Human
ccccaggacacauggaccaagu

SEQ ID NO: 823470 - RNA, 16 nt, Human
auuuccagauuaugca

SEQ ID NO: 823471 - RNA, 23 nt, Human
cuuuuaacuugaucugagaccag

SEQ ID NO: 823472 - RNA, 22 nt, Human
ggaggggaugguuugacccugg

SEQ ID NO: 823473 - RNA, 22 nt, Human
uaggcagcuuagguuagaagug

SEQ ID NO: 823474 - RNA, 22 nt, Human
uugaacaguccuaagagacccu

SEQ ID NO: 823475 - RNA, 22 nt, Human
uagcuguguaagcuugguaaga

SEQ ID NO: 823476 - RNA, 22 nt, Human
uuauucuuuucuccagaauccc

SEQ ID NO: 823477 - RNA, 22 nt, Human
aaaauauuuuagggccaggaga

SEQ ID NO: 823478 - RNA, 22 nt, Human
aggcagaugggagcuggaaguu

SEQ ID NO: 823479 - RNA, 22 nt, Human
uuagagucaagcugcauguucu

SEQ ID NO: 823480 - RNA, 15 nt, Human
uggcagcuuguuaag

SEQ ID NO: 823481 - RNA, 22 nt, Human
aggagcagcuucugaaccaugu

SEQ ID NO: 823482 - RNA, 22 nt, Human
cuucucagcaugguuacuguga

SEQ ID NO: 823483 - RNA, 22 nt, Human
gaggagcuggcugucgggaggc

SEQ ID NO: 823484 - RNA, 22 nt, Human
uuacaguuuaguccaagccaga

SEQ ID NO: 823485 - RNA, 22 nt, Human
caguucuuuguggggaguucuc

SEQ ID NO: 823486 - RNA, 20 nt, Human
uuucaguugguuaauggcau

SEQ ID NO: 823487 - RNA, 22 nt, Human
aggaagcugccugggaugggaa

SEQ ID NO: 823488 - RNA, 22 nt, Human
gcugcuguugauuuaguccaau

SEQ ID NO: 823489 - RNA, 22 nt, Human
auuuuacuacuccaauuaauga

SEQ ID NO: 823490 - RNA, 22 nt, Human
gcccaggagaggccagggcuga

SEQ ID NO: 823491 - RNA, 22 nt, Human
caaauagugucacauugugagg

SEQ ID NO: 823492 - RNA, 22 nt, Human
aggcagcccacaggacacagga

SEQ ID NO: 823493 - RNA, 22 nt, Human
aucuuucuccauauacaucuuu

SEQ ID NO: 823494 - RNA, 22 nt, Human
aaauuauuacaagcuaguuggc

SEQ ID NO: 823495 - RNA, 22 nt, Human
ggcuuugccuggaauuuccuug

SEQ ID NO: 823496 - RNA, 22 nt, Human
aggcacagcacaccuggccccc

SEQ ID NO: 823497 - RNA, 22 nt, Human
cagcuuccgaccgggggcugca

SEQ ID NO: 823498 - RNA, 22 nt, Human
gcaggagacuggcugugguagu

SEQ ID NO: 823499 - RNA, 22 nt, Human
ucaggaugguguggaggaaaua

SEQ ID NO: 823500 - RNA, 18 nt, Human
ggcagcuugacuagcaac

SEQ ID NO: 823501 - RNA, 22 nt, Human
gaaggccacaaaaaaugucaua

SEQ ID NO: 823502 - RNA, 22 nt, Human
uuuccaagagcuuauuucugaa

SEQ ID NO: 823503 - RNA, 20 nt, Human
uuucaagucagcaauucuca

SEQ ID NO: 823504 - RNA, 22 nt, Human
ugcccacauggugccauggcca

SEQ ID NO: 823505 - RNA, 22 nt, Human
gagcagcuccagccgcaugacu

SEQ ID NO: 823506 - RNA, 22 nt, Human
ucuucaucucagauuaacagga

SEQ ID NO: 823507 - RNA, 22 nt, Human
acugcuuuaucugagaaguccu

SEQ ID NO: 823508 - RNA, 22 nt, Human
aucuccaggcauuucaagagac

SEQ ID NO: 823509 - RNA, 22 nt, Human
uuccaugagcucugaguucaca

SEQ ID NO: 823510 - RNA, 22 nt, Human
auuaucuauguagaaugauuuu

SEQ ID NO: 823511 - RNA, 22 nt, Human
agaaaugacacacaugagacau

SEQ ID NO: 823512 - RNA, 22 nt, Human
uaggagaggugaauggcacacu

SEQ ID NO: 823513 - RNA, 22 nt, Human
ucaggagacuuaugucacagug

SEQ ID NO: 823514 - RNA, 22 nt, Human
auugcuaggaacagguugcacc

SEQ ID NO: 823515 - RNA, 22 nt, Human
ucuuuguaacugucuauugaga

SEQ ID NO: 823516 - RNA, 22 nt, Human
aacugcuguggccuaguacuua

SEQ ID NO: 823517 - RNA, 22 nt, Human
accaggaguuuugaccaggggc

SEQ ID NO: 823518 - RNA, 22 nt, Human
caaauauuccagguacaucccu

SEQ ID NO: 823519 - RNA, 22 nt, Human
uagcccagcaugagcagagcug

SEQ ID NO: 823520 - RNA, 22 nt, Human
cauaauaucuccgauuacuugc

SEQ ID NO: 823521 - RNA, 22 nt, Human
ucuucacaggagccugccugcc

SEQ ID NO: 823522 - RNA, 22 nt, Human
gcugcccauuccacuggauggu

SEQ ID NO: 823523 - RNA, 19 nt, Human
ucaucucacagggccuggc

SEQ ID NO: 823524 - RNA, 22 nt, Human
uugcucaggcuggugugcagug

SEQ ID NO: 823525 - RNA, 22 nt, Human
uucugugauugacauguggcuu

SEQ ID NO: 823526 - RNA, 22 nt, Human
gucaggaucaaauugaaguuau

SEQ ID NO: 823527 - RNA, 22 nt, Human
ccaggagacccagggaaggagc

SEQ ID NO: 823528 - RNA, 22 nt, Human
ucacacagguuugcaaugauuu

SEQ ID NO: 823529 - RNA, 22 nt, Human
uggaggaaguugcuggaaguca

SEQ ID NO: 823530 - RNA, 22 nt, Human
cccaggaagaggggucaggugu

SEQ ID NO: 823531 - RNA, 22 nt, Human
acucagaaugacugaugcugug

SEQ ID NO: 823532 - RNA, 22 nt, Human
cagaccagcucuaugaacccaa

SEQ ID NO: 823533 - RNA, 22 nt, Human
acaugcauacacguacauaccu

SEQ ID NO: 823534 - RNA, 18 nt, Human
cugcuugggagacgucag

SEQ ID NO: 823535 - RNA, 19 nt, Human
ugugaaagcuaguguucuu

SEQ ID NO: 823536 - RNA, 22 nt, Human
acacauauauacauauuugugc

SEQ ID NO: 823537 - RNA, 22 nt, Human
gcccaggaguugaagggcugac

SEQ ID NO: 823538 - RNA, 22 nt, Human
guuaucaugcuucaucaucacu

SEQ ID NO: 823539 - RNA, 22 nt, Human
uagggcagaguccaggaugggc

SEQ ID NO: 823540 - RNA, 22 nt, Human
gcuuccuaaaugcacagggcag

SEQ ID NO: 823541 - RNA, 22 nt, Human
ccagaccacccuggccaugcac

SEQ ID NO: 823542 - RNA, 22 nt, Human
uuuccuaggagauugaucacau

SEQ ID NO: 823543 - RNA, 22 nt, Human
cuuaacauccugcauuuuucuu

SEQ ID NO: 823544 - RNA, 22 nt, Human
gaggccaggggccuggagauga

SEQ ID NO: 823545 - RNA, 19 nt, Human
aggcaggugcagagguccc

SEQ ID NO: 823546 - RNA, 22 nt, Human
cugcuguggccagccaggucaa

SEQ ID NO: 823547 - RNA, 22 nt, Human
uucugggagagaaagggccuug

SEQ ID NO: 823548 - RNA, 22 nt, Human
uucuucuccgaggagggcuggu

SEQ ID NO: 823549 - RNA, 22 nt, Human
gaugccuccaaaugagggcaga

SEQ ID NO: 823550 - RNA, 22 nt, Human
cccaggagagggaaccaaaugu

SEQ ID NO: 823551 - RNA, 23 nt, Human
cagggaggagauacuguguaucu

SEQ ID NO: 823552 - RNA, 22 nt, Human
ucaguagcagaaagcaaugagu

SEQ ID NO: 823553 - RNA, 23 nt, Human
cccaggagccugaguccucucug

SEQ ID NO: 823554 - RNA, 22 nt, Human
gguuugaacagcuuuggagaag

SEQ ID NO: 823555 - RNA, 22 nt, Human
cagacaggguccuguccgucac

SEQ ID NO: 823556 - RNA, 22 nt, Human
caagaugugccuaaucagaccu

SEQ ID NO: 823557 - RNA, 22 nt, Human
aggguggcaccuggaagggaug

SEQ ID NO: 823558 - RNA, 22 nt, Human
ugcauggaggaagaugaaugca

SEQ ID NO: 823559 - RNA, 22 nt, Human
ucuuuguaaaugccuagcauaa

SEQ ID NO: 823560 - RNA, 22 nt, Human
ucaggauguccaaaauccagcc

SEQ ID NO: 823561 - RNA, 22 nt, Human
auccaugauuaguaggauaaag

SEQ ID NO: 823562 - RNA, 22 nt, Human
gcagcuucaguaggugaagaca

SEQ ID NO: 823563 - RNA, 22 nt, Human
acaguacauaauccugagucug

SEQ ID NO: 823564 - RNA, 22 nt, Human
gcgcaggagccgcggagggccg

SEQ ID NO: 823565 - RNA, 22 nt, Human
cauucuuacacaauauuuuaau

SEQ ID NO: 823566 - RNA, 22 nt, Human
uagcacaucuggcgcuuauagg

SEQ ID NO: 823567 - RNA, 22 nt, Human
cagugguuauacuuacuguuuc

SEQ ID NO: 823568 - RNA, 22 nt, Human
uacccaggaggaaacugaggcu

SEQ ID NO: 823569 - RNA, 22 nt, Human
aaacugcugguugcuggccagc

SEQ ID NO: 823570 - RNA, 21 nt, Human
agucuguuaggaugacucuga

SEQ ID NO: 823571 - RNA, 22 nt, Human
guugaaagcuuuucauuuaguu

SEQ ID NO: 823572 - RNA, 22 nt, Human
auucuucaccauggauaauuug

SEQ ID NO: 823573 - RNA, 22 nt, Human
agcugccgaugcccagcugcau

SEQ ID NO: 823574 - RNA, 22 nt, Human
augcuguguccuagugaaagaa

SEQ ID NO: 823575 - RNA, 22 nt, Human
auuuucaucauggguuuaacau

SEQ ID NO: 823576 - RNA, 22 nt, Human
uucucuuugacauuauucaggu

SEQ ID NO: 823577 - RNA, 22 nt, Human
aaggagaaaugguagaugugca

SEQ ID NO: 823578 - RNA, 22 nt, Human
agaggacagguuuuccaugggc

SEQ ID NO: 823579 - RNA, 21 nt, Human
agcagaggcagaauguaugca

SEQ ID NO: 823580 - RNA, 19 nt, Human
ggcagcuugggaagguagc

SEQ ID NO: 823581 - RNA, 22 nt, Human
gcugcccacaaugauuacaugg

SEQ ID NO: 823582 - RNA, 22 nt, Human
gagaggggcgcgcagcucgcga

SEQ ID NO: 823583 - RNA, 22 nt, Human
ucccaggaagaucccagggacc

SEQ ID NO: 823584 - RNA, 22 nt, Human
uagugcuuggcccuaccagaua

SEQ ID NO: 823585 - RNA, 22 nt, Human
auucugaguccaugggggcagg

SEQ ID NO: 823586 - RNA, 22 nt, Human
ugguaauuaauuugauagguuc

SEQ ID NO: 823587 - RNA, 22 nt, Human
gagcagcugagcuggaaugaga

SEQ ID NO: 823588 - RNA, 22 nt, Human
aaguggacuaauacaaggacua

SEQ ID NO: 823589 - RNA, 22 nt, Human
uucuucaugcuguugcugcuug

SEQ ID NO: 823590 - RNA, 17 nt, Human
gccaggagguuugagcu

SEQ ID NO: 823591 - RNA, 22 nt, Human
agccagcucccuccccugcagg

SEQ ID NO: 823592 - RNA, 22 nt, Human
guuuauaaggcccaauauuucu

SEQ ID NO: 823593 - RNA, 22 nt, Human
cucacugugccuuuucccaaac

SEQ ID NO: 823594 - RNA, 22 nt, Human
ucucaggagccacagcgggagu

SEQ ID NO: 823595 - RNA, 22 nt, Human
auugaaagcacaaagaacaagu

SEQ ID NO: 823596 - RNA, 22 nt, Human
ugcuggguagaaguauuagucu

SEQ ID NO: 823597 - RNA, 22 nt, Human
agucugucuacuuaaagucugu

SEQ ID NO: 823598 - RNA, 22 nt, Human
auuuuacuuugugaauauugac

SEQ ID NO: 823599 - RNA, 22 nt, Human
gucacuguuuccuauuauauuu

SEQ ID NO: 823600 - RNA, 22 nt, Human
aggcagcuggacauaacuaacc

SEQ ID NO: 823601 - RNA, 22 nt, Human
uucuuuucuuuaggcauugugu

SEQ ID NO: 823602 - RNA, 22 nt, Human
aggagggaccuaggaauauugc

SEQ ID NO: 823603 - RNA, 22 nt, Human
agugcuuucccugaaaccuucc

SEQ ID NO: 823604 - RNA, 22 nt, Human
gugcuuuuaaaggcaauuagua

SEQ ID NO: 823605 - RNA, 22 nt, Human
uagcacaucuucuuggccugca

SEQ ID NO: 823606 - RNA, 22 nt, Human
uugugguuaaccgcacauuuuu

SEQ ID NO: 823607 - RNA, 22 nt, Human
ucaggagauguaaccuuagcug

SEQ ID NO: 823608 - RNA, 22 nt, Human
cucucuguuaugcuuucaugaa

SEQ ID NO: 823609 - RNA, 23 nt, Human
ugaaggccuggaggacgcguugu

SEQ ID NO: 823610 - RNA, 22 nt, Human
uggcaguccccugugccuggaa

SEQ ID NO: 823611 - RNA, 22 nt, Human
caggcagcucugcuuuuccuaa

SEQ ID NO: 823612 - RNA, 22 nt, Human
uuuacauuucccucugucaguu

SEQ ID NO: 823613 - RNA, 22 nt, Human
cuuugcaaacgauuaccacaug

SEQ ID NO: 823614 - RNA, 22 nt, Human
guguuuuaagaaagaagcucag

SEQ ID NO: 823615 - RNA, 22 nt, Human
gccaggagagcuccuucagguu

SEQ ID NO: 823616 - RNA, 22 nt, Human
agaggcaggagguugacuugag

SEQ ID NO: 823617 - RNA, 22 nt, Human
cucccagagagcaggugggccg

SEQ ID NO: 823618 - RNA, 22 nt, Human
cuugauguauaaguugauaugu

SEQ ID NO: 823619 - RNA, 22 nt, Human
aaaaugaugcuguaauuuggca

SEQ ID NO: 823620 - RNA, 21 nt, Human
cuguggaagggaacuagaggg

SEQ ID NO: 823621 - RNA, 22 nt, Human
uccaggagugcugguuagagua

SEQ ID NO: 823622 - RNA, 22 nt, Human
uacuaucucuucuaacuucaga

SEQ ID NO: 823623 - RNA, 22 nt, Human
ccagaggaggggggucuuucug

SEQ ID NO: 823624 - RNA, 22 nt, Human
uuucagggagccuagaagagcu

SEQ ID NO: 823625 - RNA, 22 nt, Human
uggaaugacagagagucugaau

SEQ ID NO: 823626 - RNA, 22 nt, Human
uuagccaugugggaaaaacagc

SEQ ID NO: 823627 - RNA, 22 nt, Human
gucaggauguuuauucuccagu

SEQ ID NO: 823628 - RNA, 22 nt, Human
uucuucaguuugguaaauguaa

SEQ ID NO: 823629 - RNA, 19 nt, Human
ucccaggaaccuuuuauuu

SEQ ID NO: 823630 - RNA, 22 nt, Human
cugguacaaaaugcugauauca

SEQ ID NO: 823631 - RNA, 22 nt, Human
auugaaaguccuaucuaaggga

SEQ ID NO: 823632 - RNA, 22 nt, Human
uucucuuuucaccaguugcuaa

SEQ ID NO: 823633 - RNA, 22 nt, Human
ucaggagagaaagaauacaauu

SEQ ID NO: 823634 - RNA, 22 nt, Human
agcccaggucucaaaguacagg

SEQ ID NO: 823635 - RNA, 22 nt, Human
auagcuguuagauuggggucga

SEQ ID NO: 823636 - RNA, 22 nt, Human
ccccaggaagccucagauuugc

SEQ ID NO: 823637 - RNA, 20 nt, Human
agcugccccugggcacugcc

SEQ ID NO: 823638 - RNA, 22 nt, Human
cagcuagcuaagaaggccagag

SEQ ID NO: 823639 - RNA, 22 nt, Human
gauguguuuccaggauuuguuu

SEQ ID NO: 823640 - RNA, 22 nt, Human
aggguccugggugcaguugcuu

SEQ ID NO: 823641 - RNA, 17 nt, Human
ggcagcugugugcaugc

SEQ ID NO: 823642 - RNA, 22 nt, Human
gaggggcagagguagagaacaa

SEQ ID NO: 823643 - RNA, 22 nt, Human
gauuucuugauaauucaaaucc

SEQ ID NO: 823644 - RNA, 22 nt, Human
uuagaaagcuuuccauagucaa

SEQ ID NO: 823645 - RNA, 20 nt, Human
accaggagauggaggcaggg

SEQ ID NO: 823646 - RNA, 22 nt, Human
uaucuguuggcuccuaguugua

SEQ ID NO: 823647 - RNA, 22 nt, Human
aaguuugcauagauuaagcauu

SEQ ID NO: 823648 - RNA, 20 nt, Human
ccacaggaguccagucgacc

SEQ ID NO: 823649 - RNA, 22 nt, Human
aggcagcuuucuguaggggugu

SEQ ID NO: 823650 - RNA, 22 nt, Human
augcuuccaaggcuaagacaag

SEQ ID NO: 823651 - RNA, 22 nt, Human
gaggguggguuucuugcacguc

SEQ ID NO: 823652 - RNA, 22 nt, Human
agcccaggaaucugcaucuuga

SEQ ID NO: 823653 - RNA, 22 nt, Human
guccucuggaagaugaguucuu

SEQ ID NO: 823654 - RNA, 22 nt, Human
guucuucaucuuaaccaucugu

SEQ ID NO: 823655 - RNA, 22 nt, Human
uuuguuaaauauuuauugagug

SEQ ID NO: 823656 - RNA, 22 nt, Human
cagagggcucuuggcugccugc

SEQ ID NO: 823657 - RNA, 22 nt, Human
cuggccagaguuggagggugug

SEQ ID NO: 823658 - RNA, 22 nt, Human
aucacugucgucaucugagauu

SEQ ID NO: 823659 - RNA, 22 nt, Human
uuccucagcuggccugauuggg

SEQ ID NO: 823660 - RNA, 23 nt, Human
uggagcugacagucagagggagg

SEQ ID NO: 823661 - RNA, 22 nt, Human
aguguguccagaaaucuguauu

SEQ ID NO: 823662 - RNA, 22 nt, Human
uucucagagcucacuguaguaa

SEQ ID NO: 823663 - RNA, 22 nt, Human
cuucuucaguugcauguauugg

SEQ ID NO: 823664 - RNA, 22 nt, Human
ucaucuugcugccauugcuuua

SEQ ID NO: 823665 - RNA, 22 nt, Human
agacaaauggaguaugagcaac

SEQ ID NO: 823666 - RNA, 22 nt, Human
ggagauggaauagauucugacu

SEQ ID NO: 823667 - RNA, 22 nt, Human
uuugacauuggcuuauucuguu

SEQ ID NO: 823668 - RNA, 22 nt, Human
agucauaugacccuucacaaac

SEQ ID NO: 823669 - RNA, 22 nt, Human
gaccauuucuaggaaucagacu

SEQ ID NO: 823670 - RNA, 22 nt, Human
guaggcagguggaggagugaag

SEQ ID NO: 823671 - RNA, 19 nt, Human
uauggcaggccgaggcacu

SEQ ID NO: 823672 - RNA, 22 nt, Human
uucuucuucuggcugcaccugg

SEQ ID NO: 823673 - RNA, 22 nt, Human
cugcuguggguuaagacacugu

SEQ ID NO: 823674 - RNA, 22 nt, Human
cugcugucauagccaucccucc

SEQ ID NO: 823675 - RNA, 22 nt, Human
uauuuucuggacagucuugcuu

SEQ ID NO: 823676 - RNA, 22 nt, Human
gugguuuucuccaacccagaac

SEQ ID NO: 823677 - RNA, 22 nt, Human
uucagggagagcgggacgggug

SEQ ID NO: 823678 - RNA, 22 nt, Human
cagaggcaaaagagguggaggu

SEQ ID NO: 823679 - RNA, 22 nt, Human
agaccaagaaaggaugaggauc

SEQ ID NO: 823680 - RNA, 22 nt, Human
gagugcaggccugagcaccauc

SEQ ID NO: 823681 - RNA, 23 nt, Human
aaauuauugcucuucaauugccu

SEQ ID NO: 823682 - RNA, 22 nt, Human
uccaggagaccagauguaggcc

SEQ ID NO: 823683 - RNA, 22 nt, Human
gucuucuuuaaccuacuaaagc

SEQ ID NO: 823684 - RNA, 22 nt, Human
uucccucuccuacucaggaaag

SEQ ID NO: 823685 - RNA, 22 nt, Human
uuuguuuagaugguaaaucagu

SEQ ID NO: 823686 - RNA, 22 nt, Human
cuucuucauaggcaguccuguu

SEQ ID NO: 823687 - RNA, 22 nt, Human
uuugcaaagaaauuauugcugu

SEQ ID NO: 823688 - RNA, 22 nt, Human
auacauauaugguacuuccugg

SEQ ID NO: 823689 - RNA, 18 nt, Human
agggagagaccgcggguc

SEQ ID NO: 823690 - RNA, 22 nt, Human
uuaaaauagccagugccccucu

SEQ ID NO: 823691 - RNA, 22 nt, Human
ggagguggcagagggacauucu

SEQ ID NO: 823692 - RNA, 22 nt, Human
uguuuuaagagcgcacuuuaua

SEQ ID NO: 823693 - RNA, 22 nt, Human
ucaggaggccaccaggaccugu

SEQ ID NO: 823694 - RNA, 22 nt, Human
acauacauauguuuaaaugcau

SEQ ID NO: 823695 - RNA, 22 nt, Human
gagcagcucgagaaggaagcag

SEQ ID NO: 823696 - RNA, 22 nt, Human
gaccauuuuuacagagcauuca

SEQ ID NO: 823697 - RNA, 23 nt, Human
gcagaggagcaagcuggacacca

SEQ ID NO: 823698 - RNA, 22 nt, Human
uuugcaguagacaucuuauuuu

SEQ ID NO: 823699 - RNA, 22 nt, Human
aaaggccacacagagcagggag

SEQ ID NO: 823700 - RNA, 22 nt, Human
cugcugugauugggagaaaccg

SEQ ID NO: 823701 - RNA, 22 nt, Human
auugaaagauauacuguucuca

SEQ ID NO: 823702 - RNA, 22 nt, Human
uuucacauuagauaugucauuu

SEQ ID NO: 823703 - RNA, 22 nt, Human
cucaggauguacuacagaaggc

SEQ ID NO: 823704 - RNA, 22 nt, Human
aagacugucuuuucugagugac

SEQ ID NO: 823705 - RNA, 22 nt, Human
uugcagcuucuaccacuguuuc

SEQ ID NO: 823706 - RNA, 22 nt, Human
gcugcccagacauugaaucagg

SEQ ID NO: 823707 - RNA, 22 nt, Human
aggcagcucuguggccucccag

SEQ ID NO: 823708 - RNA, 22 nt, Human
ugcuuugggucucucuaguuuc

SEQ ID NO: 823709 - RNA, 22 nt, Human
ggagaggagauuguggcauuuu

SEQ ID NO: 823710 - RNA, 22 nt, Human
auggaguugagcucuguugucc

SEQ ID NO: 823711 - RNA, 22 nt, Human
ucaugucccguugcuggcugcc

SEQ ID NO: 823712 - RNA, 23 nt, Human
ugucuggauucgacugugguugg

SEQ ID NO: 823713 - RNA, 22 nt, Human
aauguuaaguuuagauuauaac

SEQ ID NO: 823714 - RNA, 22 nt, Human
auguccagaguaaagcacauuc

SEQ ID NO: 823715 - RNA, 22 nt, Human
uugagcugccuggcuguggcuc

SEQ ID NO: 823716 - RNA, 22 nt, Human
ucugagugggaacucucaugac

SEQ ID NO: 823717 - RNA, 22 nt, Human
ggcagcugaagaggaacuuugg

SEQ ID NO: 823718 - RNA, 22 nt, Human
ucuuauugguaaugauggcauu

SEQ ID NO: 823719 - RNA, 22 nt, Human
augcaguuagguaauagucuca

SEQ ID NO: 823720 - RNA, 22 nt, Human
aaauacaguggcagcagauaau

SEQ ID NO: 823721 - RNA, 22 nt, Human
guggcagcggcccaggccgucu

SEQ ID NO: 823722 - RNA, 22 nt, Human
uuguugcugcucaaccucuaua

SEQ ID NO: 823723 - RNA, 22 nt, Human
ccuuuguucacuggagagugga

SEQ ID NO: 823724 - RNA, 20 nt, Human
uaugauaauuacaaaauagu

SEQ ID NO: 823725 - RNA, 22 nt, Human
uugagcagaucgggcugugggg

SEQ ID NO: 823726 - RNA, 22 nt, Human
caguaaauguccucgcagggaa

SEQ ID NO: 823727 - RNA, 22 nt, Human
ggucuggagcuaaucuuguugg

SEQ ID NO: 823728 - RNA, 22 nt, Human
gucauuuuugacuuugaaguga

SEQ ID NO: 823729 - RNA, 22 nt, Human
uaaaacuagugguugggacuaa

SEQ ID NO: 823730 - RNA, 22 nt, Human
ugaggucuguccugucuuugga

SEQ ID NO: 823731 - RNA, 23 nt, Human
aaacuacauuuauaguuuuucuc

SEQ ID NO: 823732 - RNA, 22 nt, Human
cucuauucuaauggauucuggg

SEQ ID NO: 823733 - RNA, 22 nt, Human
aaugauguuuuuaaagaacaua

SEQ ID NO: 823734 - RNA, 22 nt, Human
ggcuguggucauuaggagguug

SEQ ID NO: 823735 - RNA, 21 nt, Human
aucuuaaaaggucuuaacuuu

SEQ ID NO: 823736 - RNA, 22 nt, Human
agugugaguuacaaagugugaa

SEQ ID NO: 823737 - RNA, 22 nt, Human
uuaguuuccuguggugugaagu

SEQ ID NO: 823738 - RNA, 22 nt, Human
uguccagcugaaggcagccuca

SEQ ID NO: 823739 - RNA, 22 nt, Human
caucaguuccugccccugcccc

SEQ ID NO: 823740 - RNA, 22 nt, Human
aguggcaguagaugagcugguu

SEQ ID NO: 823741 - RNA, 22 nt, Human
guugcagcaucacugcugagug

SEQ ID NO: 823742 - RNA, 22 nt, Human
augagugcuuagagaguaaucc

SEQ ID NO: 823743 - RNA, 22 nt, Human
gguguuguacauucuguggauu

SEQ ID NO: 823744 - RNA, 22 nt, Human
uuuuccuucugauacuccauuu

SEQ ID NO: 823745 - RNA, 22 nt, Human
ugcugugagaccauuuguugag

SEQ ID NO: 823746 - RNA, 22 nt, Human
aggcuuaacuacaauuuuugcc

SEQ ID NO: 823747 - RNA, 22 nt, Human
uaaauacuuuuacuccacugau

SEQ ID NO: 823748 - RNA, 22 nt, Human
ucuuauugugaugaugaagaac

SEQ ID NO: 823749 - RNA, 22 nt, Human
guucuuaaagauucaucaagca

SEQ ID NO: 823750 - RNA, 22 nt, Human
ugugacguuguucuggauuccc

SEQ ID NO: 823751 - RNA, 22 nt, Human
ugcauguuucuguauguuaaug

SEQ ID NO: 823752 - RNA, 23 nt, Human
uacagccaugucgcugauuuaac

SEQ ID NO: 823753 - RNA, 22 nt, Human
ucugaaauuuuaguuauagaaa

SEQ ID NO: 823754 - RNA, 22 nt, Human
uggaucuugaugcuccaagagu

SEQ ID NO: 823755 - RNA, 22 nt, Human
auuguugacuugauuacucaac

SEQ ID NO: 823756 - RNA, 21 nt, Human
aguuagcagauuucugucucc

SEQ ID NO: 823757 - RNA, 22 nt, Human
cagucauuaugggaguuaaucc

SEQ ID NO: 823758 - RNA, 22 nt, Human
acucuguuugcagguagcucag

SEQ ID NO: 823759 - RNA, 22 nt, Human
agagaauuaacauuccauggcu

SEQ ID NO: 823760 - RNA, 22 nt, Human
aaugaaacuaguagaaucuuug

SEQ ID NO: 823761 - RNA, 22 nt, Human
uuucuuggucuucccgaccugg

SEQ ID NO: 823762 - RNA, 22 nt, Human
ccugugguuuacucuguggcua

SEQ ID NO: 823763 - RNA, 22 nt, Human
ugugagauuuuauuugauaugc

SEQ ID NO: 823764 - RNA, 22 nt, Human
ucuuagaaacuguaucgauuag

SEQ ID NO: 823765 - RNA, 22 nt, Human
ucaugcagauaagaauaaguaa

SEQ ID NO: 823766 - RNA, 22 nt, Human
ggagucugugucuugaagcagu

SEQ ID NO: 823767 - RNA, 22 nt, Human
ugcaugguguaauucuaaugcu

SEQ ID NO: 823768 - RNA, 22 nt, Human
auuguacucuagccucugggca

SEQ ID NO: 823769 - RNA, 22 nt, Human
aucugguuuggggauccuugug

SEQ ID NO: 823770 - RNA, 22 nt, Human
uuggaaguucuuagccuuuuca

SEQ ID NO: 823771 - RNA, 22 nt, Human
uuggauggagguucaagcacua

SEQ ID NO: 823772 - RNA, 22 nt, Human
aagucauugguagcuugauagg

SEQ ID NO: 823773 - RNA, 22 nt, Human
ucucugagaucagccacugacu

SEQ ID NO: 823774 - RNA, 22 nt, Human
guuguuuuugaacggugguggc

SEQ ID NO: 823775 - RNA, 22 nt, Human
aaugaguuuguucuauuauuug

SEQ ID NO: 823776 - RNA, 22 nt, Human
aacacuaaaggucaguuagaag

SEQ ID NO: 823777 - RNA, 17 nt, Human
aguuggcagccguugcu

SEQ ID NO: 823778 - RNA, 22 nt, Human
cugggacacguugugcuuuaac

SEQ ID NO: 823779 - RNA, 22 nt, Human
uagugucucuuccuguuugaaa

SEQ ID NO: 823780 - RNA, 22 nt, Human
agaaucugcauuuuaacaagau

SEQ ID NO: 823781 - RNA, 22 nt, Human
acauucuacaguuaaccauuag

SEQ ID NO: 823782 - RNA, 17 nt, Human
cauucuguaaucuuucu

SEQ ID NO: 823783 - RNA, 22 nt, Human
gaaguucugguguaugugauaa

SEQ ID NO: 823784 - RNA, 19 nt, Human
ggaggcuucuuggggucgg

SEQ ID NO: 823785 - RNA, 22 nt, Human
cucugaguagauagggaaccug

SEQ ID NO: 823786 - RNA, 23 nt, Human
agugaugucacccacagacaagg

SEQ ID NO: 823787 - RNA, 22 nt, Human
aucauugaguaaaaugaauaca

SEQ ID NO: 823788 - RNA, 19 nt, Human
gcagcugugggaagagcca

SEQ ID NO: 823789 - RNA, 22 nt, Human
ugccuguguccccuucuuggca

SEQ ID NO: 823790 - RNA, 22 nt, Human
guuucuuauuucaacuggaaca

SEQ ID NO: 823791 - RNA, 22 nt, Human
auuguauacaagcuuaauuguu

SEQ ID NO: 823792 - RNA, 22 nt, Human
uaucacauacuucucauccagg

SEQ ID NO: 823793 - RNA, 22 nt, Human
guaguucuuucucaauguucaa

SEQ ID NO: 823794 - RNA, 22 nt, Human
guguuuggucagacguccgggg

SEQ ID NO: 823795 - RNA, 22 nt, Human
ucaguaaaugagcaaaaauuuc

SEQ ID NO: 823796 - RNA, 22 nt, Human
uucuaagaaauggaaaacgauu

SEQ ID NO: 823797 - RNA, 22 nt, Human
gagugugucggucagcguggcg

SEQ ID NO: 823798 - RNA, 20 nt, Human
uuugauugccccucugacuu

SEQ ID NO: 823799 - RNA, 22 nt, Human
gaacugcauugugguauauguu

SEQ ID NO: 823800 - RNA, 22 nt, Human
agucuggagugauuauguggga

SEQ ID NO: 823801 - RNA, 22 nt, Human
ucaguguccuucguucuuguug

SEQ ID NO: 823802 - RNA, 22 nt, Human
agcugugaccuucaagagcuac

SEQ ID NO: 823803 - RNA, 22 nt, Human
ugucuggauagagccuaggccc

SEQ ID NO: 823804 - RNA, 22 nt, Human
gaugaguucuuucuauucuauu

SEQ ID NO: 823805 - RNA, 22 nt, Human
uuuguguuguacuucugugcau

SEQ ID NO: 823806 - RNA, 18 nt, Human
aguaaauguuaaauauug

SEQ ID NO: 823807 - RNA, 22 nt, Human
auuaaauuggacgcugggggaa

SEQ ID NO: 823808 - RNA, 22 nt, Human
uucuuucugggguccuucggcu

SEQ ID NO: 823809 - RNA, 22 nt, Human
uaaguauuggccuauagcuaga

SEQ ID NO: 823810 - RNA, 22 nt, Human
ugugucuuuggcgaugucugga

SEQ ID NO: 823811 - RNA, 22 nt, Human
aguggcagggacuucauauaaa

SEQ ID NO: 823812 - RNA, 21 nt, Human
ucaauuauggaugugugcaaa

SEQ ID NO: 823813 - RNA, 17 nt, Human
ucuggaugucauggaag

SEQ ID NO: 823814 - RNA, 22 nt, Human
gauuugucuauauucaaauaug

SEQ ID NO: 823815 - RNA, 22 nt, Human
gucauggaggauugugaguggu

SEQ ID NO: 823816 - RNA, 22 nt, Human
ucuggauggucagcucuuccug

SEQ ID NO: 823817 - RNA, 22 nt, Human
uuuaaacuaacaguacacguug

SEQ ID NO: 823818 - RNA, 22 nt, Human
guuuauuggguauuguggagcc

SEQ ID NO: 823819 - RNA, 22 nt, Human
uauaaacuccucuugcauuccu

SEQ ID NO: 823820 - RNA, 22 nt, Human
cgucauuuguaaaugaucaaga

SEQ ID NO: 823821 - RNA, 22 nt, Human
ucucugagguuguuuccagcac

SEQ ID NO: 823822 - RNA, 22 nt, Human
agugauguagguggauucuggc

SEQ ID NO: 823823 - RNA, 22 nt, Human
ugcauguuuuauaccaaagcuu

SEQ ID NO: 823824 - RNA, 20 nt, Human
aaaaacaguaaugcugaaga

SEQ ID NO: 823825 - RNA, 22 nt, Human
ugucuucuaccuugacagcauu

SEQ ID NO: 823826 - RNA, 22 nt, Human
acagccaacgucuuucuuacuu

SEQ ID NO: 823827 - RNA, 22 nt, Human
uuucaugauuaacuuagugaau

SEQ ID NO: 823828 - RNA, 19 nt, Human
uugcuucaugucuuuugcu

SEQ ID NO: 823829 - RNA, 22 nt, Human
agaugacuaacauaguauugcu

SEQ ID NO: 823830 - RNA, 22 nt, Human
uugcuucacuacuucuaggcuc

SEQ ID NO: 823831 - RNA, 22 nt, Human
cuuguauuaggaagaaugcuuu

SEQ ID NO: 823832 - RNA, 22 nt, Human
gcuucauagcauucauugccug

SEQ ID NO: 823833 - RNA, 22 nt, Human
uuuucuuggaguggcuguccuu

SEQ ID NO: 823834 - RNA, 21 nt, Human
ccuguggugccagaucgccag

SEQ ID NO: 823835 - RNA, 22 nt, Human
uuugcagagugcagaagcaucu

SEQ ID NO: 823836 - RNA, 22 nt, Human
aaauugaauuugggaaacauug

SEQ ID NO: 823837 - RNA, 22 nt, Human
uuuaauuuucugggcccagcag

SEQ ID NO: 823838 - RNA, 22 nt, Human
cauaacauccuugcuacuuuga

SEQ ID NO: 823839 - RNA, 22 nt, Human
cuggagucggcgccccaacaga

SEQ ID NO: 823840 - RNA, 22 nt, Human
aaagcuauuuuauugcagcucu

SEQ ID NO: 823841 - RNA, 22 nt, Human
auguccaggaagucuuaacuca

SEQ ID NO: 823842 - RNA, 22 nt, Human parainfluenza virus 2
acaagggaugcuuucucugcuc

SEQ ID NO: 823843 - RNA, 22 nt, Human parainfluenza virus 2
auugaauugaagaugcaagauu

SEQ ID NO: 823844 - RNA, 22 nt, Human
gccagagguucaacaacugucu

SEQ ID NO: 823845 - RNA, 22 nt, Human
ucaggagaaagccaauuagagu

SEQ ID NO: 823846 - RNA, 22 nt, Human
cagugguuauacuuacuguuuc

SEQ ID NO: 823847 - RNA, 22 nt, Human
ugaggcagaaaauagcaguuca

SEQ ID NO: 823848 - RNA, 22 nt, Human
gcaggcagagguggaggagaca

SEQ ID NO: 823849 - RNA, 22 nt, Human
cucaggaugucggugacuauug

SEQ ID NO: 823850 - RNA, 22 nt, Human
agaggcagaaguguucaaaccc

SEQ ID NO: 823851 - RNA, 22 nt, Human
agacagcugggaaauggagugu

SEQ ID NO: 823852 - RNA, 22 nt, Human
acccaggagacggaggugcagu

SEQ ID NO: 823853 - RNA, 22 nt, Human
cccaggaaaguggaggcggcug

SEQ ID NO: 823854 - RNA, 22 nt, Human
uaaauuauggcuggcagagcag

SEQ ID NO: 823855 - RNA, 22 nt, Human
caggcagccugagggaucuggg

SEQ ID NO: 823856 - RNA, 22 nt, Human
uggcagcuguguccagguagaa

SEQ ID NO: 823857 - RNA, 22 nt, Human
uuagaaagcuuuccauagucaa

SEQ ID NO: 823858 - RNA, 22 nt, Human
cccaggauggggcugcaguuau

SEQ ID NO: 823859 - RNA, 22 nt, Human
gauggcagguaguggucucauc

SEQ ID NO: 823860 - RNA, 22 nt, Human
cuggaguuagaguagacacuga

SEQ ID NO: 823861 - RNA, 22 nt, Human
guguguuucagaagccaggugu

SEQ ID NO: 823862 - RNA, 23 nt, Human
uggaaagcggaccuggggcagag

SEQ ID NO: 823863 - RNA, 22 nt, Human
gcccaggagguggaggugcagu

SEQ ID NO: 823864 - RNA, 22 nt, Human
aagggcaggaaaagauggaugu

SEQ ID NO: 823865 - RNA, 22 nt, Human
gcugaaugaauguauuuuaaaa

SEQ ID NO: 823866 - RNA, 22 nt, Human
aaaggccaagcaugagguggac

SEQ ID NO: 823867 - RNA, 22 nt, Human
uguucucacuggaugcuucaca

SEQ ID NO: 823868 - RNA, 22 nt, Human
acccaggacacagagaugaccc

SEQ ID NO: 823869 - RNA, 22 nt, Human
caggcagcgcucguggccuggc

SEQ ID NO: 823870 - RNA, 22 nt, Human
acauuuuuauucaucaaagcag

SEQ ID NO: 823871 - RNA, 22 nt, Human
aacauuucagcaaauaagaaca

SEQ ID NO: 823872 - RNA, 22 nt, Human
aaggcagucugguuucaaagca

SEQ ID NO: 823873 - RNA, 22 nt, Human
gaggagaggggcucccaagagc

SEQ ID NO: 823874 - RNA, 22 nt, Human
uugauuucuauucagauguaga

SEQ ID NO: 823875 - RNA, 22 nt, Human
caugcuguguguuuuagcucca

SEQ ID NO: 823876 - RNA, 22 nt, Human
uagggaugagccaguggguagu

SEQ ID NO: 823877 - RNA, 22 nt, Human
aaggagaguacaggaguuggua

SEQ ID NO: 823878 - RNA, 22 nt, Human
uuaacaugucuugacuucaucu

SEQ ID NO: 823879 - RNA, 22 nt, Human
caaauguauucucacuucaggg

SEQ ID NO: 823880 - RNA, 23 nt, Human
cccagggacacgaugacaccucc

SEQ ID NO: 823881 - RNA, 22 nt, Human
caggcgagugaacagacucuca

SEQ ID NO: 823882 - RNA, 23 nt, Human
cuuugccacccagagccugacag

SEQ ID NO: 823883 - RNA, 22 nt, Human
gcccaggaugguguguaguggu

SEQ ID NO: 823884 - RNA, 22 nt, Human
cugucccuucauuauucacuac

SEQ ID NO: 823885 - RNA, 22 nt, Human
agggagcuucuggccucagccu

SEQ ID NO: 823886 - RNA, 19 nt, Human
gacagugcaguuguaguac

SEQ ID NO: 823887 - RNA, 22 nt, Human
aaaggccaccaacaugaagcau

SEQ ID NO: 823888 - RNA, 22 nt, Human
gccauuuucugucuuguuuauu

SEQ ID NO: 823889 - RNA, 22 nt, Human
aacauucuauuuugcuaaaaca

SEQ ID NO: 823890 - RNA, 22 nt, Human
agggcagcucucaccucuggcc

SEQ ID NO: 823891 - RNA, 22 nt, Human
uagggauguaaacauaguaauu

SEQ ID NO: 823892 - RNA, 22 nt, Human
agaccaagaaaggaugaggauc

SEQ ID NO: 823893 - RNA, 22 nt, Human
uuugaauagcauaggauuacau

SEQ ID NO: 823894 - RNA, 22 nt, Human
cugagagugcucuuugauguca

SEQ ID NO: 823895 - RNA, 22 nt, Human
ggcagcacugcagcuuguuggg

SEQ ID NO: 823896 - RNA, 22 nt, Human
acaacauucuuaaauacacuga

SEQ ID NO: 823897 - RNA, 22 nt, Human
uuagagucaaaauggcauguua

SEQ ID NO: 823898 - RNA, 22 nt, Human
aaggcagcaccgccuccugaaa

SEQ ID NO: 823899 - RNA, 22 nt, Human
aucauucuaguccuuauggucu

SEQ ID NO: 823900 - RNA, 22 nt, Human
agacaggcagaggcugcagagg

SEQ ID NO: 823901 - RNA, 22 nt, Human
gggcagcuggcuuauagguuug

SEQ ID NO: 823902 - RNA, 22 nt, Human
ugagccuguccugugcauguga

SEQ ID NO: 823903 - RNA, 21 nt, Human
uccaggaguggcugggcaggg

SEQ ID NO: 823904 - RNA, 22 nt, Human
ucuuugaauucaaacuguucaa

SEQ ID NO: 823905 - RNA, 22 nt, Human
ggugaagggugucauggcauuu

SEQ ID NO: 823906 - RNA, 22 nt, Human
cuugaaagaagggucuuuuaau

SEQ ID NO: 823907 - RNA, 22 nt, Human
uugacacaguuuucucauuaag

SEQ ID NO: 823908 - RNA, 22 nt, Human
uccaggagaaggccauccagcg

SEQ ID NO: 823909 - RNA, 18 nt, Human
gagagggaucccucagga

SEQ ID NO: 823910 - RNA, 22 nt, Human
ugauugaacugagcuucaagau

SEQ ID NO: 823911 - RNA, 22 nt, Human
auucugaguccaugggggcagg

SEQ ID NO: 823912 - RNA, 22 nt, Human
augcuguguggucaaguuaauu

SEQ ID NO: 823913 - RNA, 22 nt, Human
uccauguguuuuccuguccaca

SEQ ID NO: 823914 - RNA, 22 nt, Human
aauauaauuuuauuccuagagu

SEQ ID NO: 823915 - RNA, 22 nt, Human
aauacaguaauuuugaugaguu

SEQ ID NO: 823916 - RNA, 22 nt, Human
ccaggagagcucucguucagug

SEQ ID NO: 823917 - RNA, 22 nt, Human
aucauuucccuuuagaucacaa

SEQ ID NO: 823918 - RNA, 22 nt, Human
uauuucuaagagauaucuguac

SEQ ID NO: 823919 - RNA, 22 nt, Human
aagggcagagggaaucccacau

SEQ ID NO: 823920 - RNA, 22 nt, Human
uuucaaagaccauuaacuauca

SEQ ID NO: 823921 - RNA, 22 nt, Human
cagagagagucaaaucuuugcu

SEQ ID NO: 823922 - RNA, 22 nt, Human
uugaagaggacuuugcagcugu

SEQ ID NO: 823923 - RNA, 22 nt, Human
cggcagcucgagggccacccgu

SEQ ID NO: 823924 - RNA, 22 nt, Human
uuuaacagguaaaguaaaugug

SEQ ID NO: 823925 - RNA, 22 nt, Human
uuaaauuuuagaaacagacucu

SEQ ID NO: 823926 - RNA, 22 nt, Human
ugaaaugaagggcuuguucugg

SEQ ID NO: 823927 - RNA, 22 nt, Human
gauuuuauuagcccaaacuuug

SEQ ID NO: 823928 - RNA, 22 nt, Human
cuucaggauuuaggaagaugaa

SEQ ID NO: 823929 - RNA, 23 nt, Human
uuagagaugauuaaaaaaucuug

SEQ ID NO: 823930 - RNA, 18 nt, Human
ggcagcuugacuagcaac

SEQ ID NO: 823931 - RNA, 22 nt, Human
ccucaggauccgcaggugcagu

SEQ ID NO: 823932 - RNA, 22 nt, Human
agccagcucccuccccugcagg

SEQ ID NO: 823933 - RNA, 22 nt, Human
uuuccaagacuccaguucuccc

SEQ ID NO: 823934 - RNA, 22 nt, Human
ucaggaugguguggaggaaaua

SEQ ID NO: 823935 - RNA, 20 nt, Human
augauuuugcacuaacuuca

SEQ ID NO: 823936 - RNA, 22 nt, Human
ccagugcuuccaggaauacggu

SEQ ID NO: 823937 - RNA, 22 nt, Human
aucuuucaaucaggaaaaaucu

SEQ ID NO: 823938 - RNA, 22 nt, Human
gaggucagucagaccaggguuu

SEQ ID NO: 823939 - RNA, 22 nt, Human
caaggccacguucugcaugcgg

SEQ ID NO: 823940 - RNA, 22 nt, Human
agucucuuccuucaaggcuggu

SEQ ID NO: 823941 - RNA, 22 nt, Human
auucuucaccugagucagucua

SEQ ID NO: 823942 - RNA, 22 nt, Human
auucuuaauugccaugcuguau

SEQ ID NO: 823943 - RNA, 22 nt, Human
cagacagggaccucgcuccaga

SEQ ID NO: 823944 - RNA, 19 nt, Human
aauacaguguuauagaauu

SEQ ID NO: 823945 - RNA, 22 nt, Human
agagggcaaguguaguccagua

SEQ ID NO: 823946 - RNA, 22 nt, Human
ucuuaaagagcgcaauuugagg

SEQ ID NO: 823947 - RNA, 22 nt, Human
uaaggccaaguucauauacaac

SEQ ID NO: 823948 - RNA, 22 nt, Human
agaggccggccgagcccauggg

SEQ ID NO: 823949 - RNA, 19 nt, Human
aggguggcaaaggagggug

SEQ ID NO: 823950 - RNA, 22 nt, Human
uucuucaugcuguugcugcuug

SEQ ID NO: 823951 - RNA, 22 nt, Human
uucuucaguguagcaacuguau

SEQ ID NO: 823952 - RNA, 21 nt, Human
uuagaaagcucacuacaguua

SEQ ID NO: 823953 - RNA, 22 nt, Human
uuucacagcuggguggcagagu

SEQ ID NO: 823954 - RNA, 22 nt, Human
uugugguuaaccgcacauuuuu

SEQ ID NO: 823955 - RNA, 22 nt, Human
ugaaaugauguacaagaaggca

SEQ ID NO: 823956 - RNA, 22 nt, Human
cagaugaggcaaccucauugcu

SEQ ID NO: 823957 - RNA, 22 nt, Human
cuucucaguugcaagugucaga

SEQ ID NO: 823958 - RNA, 17 nt, Human
caaggccagcaucuuca

SEQ ID NO: 823959 - RNA, 21 nt, Human
uagggcaggcauuggaagaga

SEQ ID NO: 823960 - RNA, 22 nt, Human
ucauuuguugaacuuuagugcg

SEQ ID NO: 823961 - RNA, 22 nt, Human
auucauuugcuauuguguaugg

SEQ ID NO: 823962 - RNA, 22 nt, Human
gcucccagcaauugaggcagcc

SEQ ID NO: 823963 - RNA, 22 nt, Human
cccaucacagacacuggguuau

SEQ ID NO: 823964 - RNA, 22 nt, Human
cagagccauuauggagacuugc

SEQ ID NO: 823965 - RNA, 22 nt, Human
uucucagagcacugcugacaaa

SEQ ID NO: 823966 - RNA, 22 nt, Human
auacuaaaguauagaacuuagu

SEQ ID NO: 823967 - RNA, 22 nt, Human
gcuuugaagacuuuuccagggu

SEQ ID NO: 823968 - RNA, 22 nt, Human
cugccuccugccgugcagcuuc

SEQ ID NO: 823969 - RNA, 22 nt, Human
uuggcagugucugcaaaaugga

SEQ ID NO: 823970 - RNA, 20 nt, Human
gaugggaaucggagcuggua

SEQ ID NO: 823971 - RNA, 21 nt, Human
ugcugaugucagagaagcaag

SEQ ID NO: 823972 - RNA, 22 nt, Human
cugagcugggaguagagacucu

SEQ ID NO: 823973 - RNA, 22 nt, Human
cccaggaggcagauguugcagu

SEQ ID NO: 823974 - RNA, 22 nt, Human
auacuguuucucuucuacauga

SEQ ID NO: 823975 - RNA, 22 nt, Human
gucugucuguuguugagaagca

SEQ ID NO: 823976 - RNA, 22 nt, Human
gaggagcuugaggcuaggagcc

SEQ ID NO: 823977 - RNA, 22 nt, Human
uuugcagucuggccugcuuugg

SEQ ID NO: 823978 - RNA, 22 nt, Human
uagaaauguugguauuaacauu

SEQ ID NO: 823979 - RNA, 22 nt, Human
uuccaagaguaaauucaaauug

SEQ ID NO: 823980 - RNA, 22 nt, Human
cggaggggauacauuuucugaa

SEQ ID NO: 823981 - RNA, 22 nt, Human
cuuuguagcugcuucugauuua

SEQ ID NO: 823982 - RNA, 22 nt, Human
cauucuuacacaauauuuuaau

SEQ ID NO: 823983 - RNA, 22 nt, Human
gggauggggagcuggaaagggg

SEQ ID NO: 823984 - RNA, 20 nt, Human
uugauaggcagcuugucagg

SEQ ID NO: 823985 - RNA, 22 nt, Human
guucuucagcauuagaagucau

SEQ ID NO: 823986 - RNA, 22 nt, Human
caggggaguuuuaugcaacaga

SEQ ID NO: 823987 - RNA, 22 nt, Human
gaggccaggggccuggagauga

SEQ ID NO: 823988 - RNA, 22 nt, Human
ggugaguugggguucacagguc

SEQ ID NO: 823989 - RNA, 21 nt, Human
auugaaagucaacaaucaguu

SEQ ID NO: 823990 - RNA, 22 nt, Human
aggcagcugaggucuggcgccc

SEQ ID NO: 823991 - RNA, 22 nt, Human
uuugaacuucuaccugucauau

SEQ ID NO: 823992 - RNA, 22 nt, Human
cuagccugggauuugaacuuau

SEQ ID NO: 823993 - RNA, 22 nt, Human
cccaggagaccugugaaaggac

SEQ ID NO: 823994 - RNA, 22 nt, Human
uucucugaguacguuucagugu

SEQ ID NO: 823995 - RNA, 22 nt, Human
uuugaaaggaauuaggaugaca

SEQ ID NO: 823996 - RNA, 22 nt, Human
aaauaguucagcuuguaaaccc

SEQ ID NO: 823997 - RNA, 23 nt, Human
aggauguaggauguauggcagag

SEQ ID NO: 823998 - RNA, 22 nt, Human
ugcuggaauaauuucauguuaa

SEQ ID NO: 823999 - RNA, 22 nt, Human
uugauacaggcucuauuucauc

SEQ ID NO: 824000 - RNA, 22 nt, Human
uucaggauggaguaccuuuuau

SEQ ID NO: 824001 - RNA, 22 nt, Human
ucucuguaguugggcagcugcu

SEQ ID NO: 824002 - RNA, 22 nt, Human
caguucuuaauaccaugugguu

SEQ ID NO: 824003 - RNA, 22 nt, Human
ccacuguuuuucaguuaacuuu

SEQ ID NO: 824004 - RNA, 22 nt, Human
aaggcaguacuuuauguccaua

SEQ ID NO: 824005 - RNA, 19 nt, Human
uguguguuuauauauguau

SEQ ID NO: 824006 - RNA, 22 nt, Human
gauaaugaugacaaugacaacc

SEQ ID NO: 824007 - RNA, 22 nt, Human
ucucaggaucuaauacauggua

SEQ ID NO: 824008 - RNA, 22 nt, Human
aguguguccagaaaucuguauu

SEQ ID NO: 824009 - RNA, 22 nt, Human
uuuugaauaauucagaaacagc

SEQ ID NO: 824010 - RNA, 22 nt, Human
auucaaguccagcuucucuaca

SEQ ID NO: 824011 - RNA, 17 nt, Human
agaggcagauacuugga

SEQ ID NO: 824012 - RNA, 22 nt, Human
gaggauggaggugugagcuaug

SEQ ID NO: 824013 - RNA, 22 nt, Human
ucuucaucucagauuaacagga

SEQ ID NO: 824014 - RNA, 22 nt, Human
ugucugugaccucuuaggcaag

SEQ ID NO: 824015 - RNA, 22 nt, Human
aggagcagaauuuaaugugcag

SEQ ID NO: 824016 - RNA, 22 nt, Human
aucuccaggcauuucaagagac

SEQ ID NO: 824017 - RNA, 22 nt, Human
gcagggaagaucuuggagcugc

SEQ ID NO: 824018 - RNA, 22 nt, Human
gaggaggccaguggaaggaagc

SEQ ID NO: 824019 - RNA, 22 nt, Human
aagugaagaaauacaugagaau

SEQ ID NO: 824020 - RNA, 22 nt, Human
ccuggacucaggcugugggcac

SEQ ID NO: 824021 - RNA, 22 nt, Human
caauacuuccuuguuagaggca

SEQ ID NO: 824022 - RNA, 22 nt, Human
ugaguucuaguggcugcagauu

SEQ ID NO: 824023 - RNA, 22 nt, Human
uuagccauggacugaauugacu

SEQ ID NO: 824024 - RNA, 22 nt, Human
agugcuuuagagaaauggugcu

SEQ ID NO: 824025 - RNA, 22 nt, Human
ucaugcuuaaaagacacuugag

SEQ ID NO: 824026 - RNA, 23 nt, Human
ucagagagcuguugagagcugcc

SEQ ID NO: 824027 - RNA, 22 nt, Human
gugcaagguacauccuugaugu

SEQ ID NO: 824028 - RNA, 21 nt, Human
gauuuuaaagagacugccaca

SEQ ID NO: 824029 - RNA, 22 nt, Human
ucucuucucuagugagcaacug

SEQ ID NO: 824030 - RNA, 22 nt, Human
ucagaaaagguagcugugacaa

SEQ ID NO: 824031 - RNA, 20 nt, Human
agcaagaguaaggacagcga

SEQ ID NO: 824032 - RNA, 22 nt, Human
acagcagcuugcgugucugguc

SEQ ID NO: 824033 - RNA, 21 nt, Human
uggcaggcagcuggaagcuug

SEQ ID NO: 824034 - RNA, 22 nt, Human
ccucagaugucuuaaggcacug

SEQ ID NO: 824035 - RNA, 22 nt, Human
ucccaggacaggccacauggaa

SEQ ID NO: 824036 - RNA, 22 nt, Human
uucagcaaauggacuguucagg

SEQ ID NO: 824037 - RNA, 22 nt, Human
acauuucuaguuguucaucucc

SEQ ID NO: 824038 - RNA, 22 nt, Human
cugcaucaguggauaugauggu

SEQ ID NO: 824039 - RNA, 22 nt, Human
ggccagcuuugagcugcaggaa

SEQ ID NO: 824040 - RNA, 22 nt, Human
gcauguguggaggagaugugcu

SEQ ID NO: 824041 - RNA, 22 nt, Human
agucucuuauucccuauugcug

SEQ ID NO: 824042 - RNA, 22 nt, Human
ucugucuucaucagcaugugau

SEQ ID NO: 824043 - RNA, 22 nt, Human
cagcagagaaauuaaacuucug

SEQ ID NO: 824044 - RNA, 22 nt, Human
uauuucagucacuucuucucug

SEQ ID NO: 824045 - RNA, 22 nt, Human
ucaucugucauccacaaagcug

SEQ ID NO: 824046 - RNA, 18 nt, Human
cugcccagagcauuucau

SEQ ID NO: 824047 - RNA, 22 nt, Human
cccaggagacauauagaaggac

SEQ ID NO: 824048 - RNA, 22 nt, Human
augauguuauuuucagaaacau

SEQ ID NO: 824049 - RNA, 22 nt, Human
auguagagcaguguuguccaau

SEQ ID NO: 824050 - RNA, 22 nt, Human
ucaggagacauucuuaaaguag

SEQ ID NO: 824051 - RNA, 22 nt, Human
ugcuuggccuacuuguccuuug

SEQ ID NO: 824052 - RNA, 22 nt, Human
cuucuucaguugcauguauugg

SEQ ID NO: 824053 - RNA, 23 nt, Human
gaggcacucaggaaaugugagug

SEQ ID NO: 824054 - RNA, 22 nt, Human
uaaguucauaagcuuauucuua

SEQ ID NO: 824055 - RNA, 22 nt, Human
uaucuaaauggaauauuccaga

SEQ ID NO: 824056 - RNA, 22 nt, Human
uaucuguugucuuuuacaugua

SEQ ID NO: 824057 - RNA, 22 nt, Human
augugaggcagcacggagauua

SEQ ID NO: 824058 - RNA, 22 nt, Human
cagcuggccaaucagggcgccc

SEQ ID NO: 824059 - RNA, 22 nt, Human
agugcuuugaacgaaaggcuga

SEQ ID NO: 824060 - RNA, 22 nt, Human
ggcaggcugcuugggucauguc

SEQ ID NO: 824061 - RNA, 22 nt, Human
ggcagcucugcuccacaugagu

SEQ ID NO: 824062 - RNA, 22 nt, Human
uggaggaaguugcuggaaguca

SEQ ID NO: 824063 - RNA, 22 nt, Human
cuauuucaaggcccagauauga

SEQ ID NO: 824064 - RNA, 22 nt, Human
aggagaggaaucauuauuacaa

SEQ ID NO: 824065 - RNA, 22 nt, Human
ucaggagggugacaggcccugg

SEQ ID NO: 824066 - RNA, 22 nt, Human
auccaugaucaauuuauuacua

SEQ ID NO: 824067 - RNA, 22 nt, Human
ucugcagggaugugagggguga

SEQ ID NO: 824068 - RNA, 22 nt, Human
cagcugccccuccagggcuggg

SEQ ID NO: 824069 - RNA, 21 nt, Human
agccagcuaucacacagcauu

SEQ ID NO: 824070 - RNA, 22 nt, Human
ggaagagggaaccacgacugua

SEQ ID NO: 824071 - RNA, 22 nt, Human
cccaggaggcagagguuggagc

SEQ ID NO: 824072 - RNA, 22 nt, Human
gaggccagcuaguccaggaagu

SEQ ID NO: 824073 - RNA, 22 nt, Human
ccugcuguucuguuuagugaac

SEQ ID NO: 824074 - RNA, 23 nt, Human
acacauuuuucccguucugaggu

SEQ ID NO: 824075 - RNA, 22 nt, Human
aggagagaauguuccaggcuug

SEQ ID NO: 824076 - RNA, 22 nt, Human
aaauuaguacauugcaaagucc

SEQ ID NO: 824077 - RNA, 22 nt, Human
uucacagacauugcagacugaa

SEQ ID NO: 824078 - RNA, 22 nt, Human
auuauucuuaugucaucauggc

SEQ ID NO: 824079 - RNA, 22 nt, Human
cugcugugccuuaaaaugcaag

SEQ ID NO: 824080 - RNA, 22 nt, Human
cagcugacuucauaggaagaca

SEQ ID NO: 824081 - RNA, 22 nt, Human
ucaagugcuugugagguauuug

SEQ ID NO: 824082 - RNA, 21 nt, Human
gggcagcucuguuuuauuuuc

SEQ ID NO: 824083 - RNA, 22 nt, Human
uucuucuucaagugcugcauuc

SEQ ID NO: 824084 - RNA, 21 nt, Human
uuugaaagcuacaucuauagc

SEQ ID NO: 824085 - RNA, 22 nt, Human
uucauucugggcucuaaggaac

SEQ ID NO: 824086 - RNA, 22 nt, Human
uguagaaagaauauguuucaua

SEQ ID NO: 824087 - RNA, 22 nt, Human
aguaaagcagaguugcaguaca

SEQ ID NO: 824088 - RNA, 22 nt, Human
aggccagccucaggcagggacc

SEQ ID NO: 824089 - RNA, 22 nt, Human
uucuucuccuaaggagaguccu

SEQ ID NO: 824090 - RNA, 22 nt, Human
cugcugugaguuuggaggucua

SEQ ID NO: 824091 - RNA, 22 nt, Human
ggagugucagaaacaguguccu

SEQ ID NO: 824092 - RNA, 22 nt, Human
gaucuguuauaaucucuuuuau

SEQ ID NO: 824093 - RNA, 22 nt, Human
gaggcugaggguuagagaguca

SEQ ID NO: 824094 - RNA, 22 nt, Human
cuuuuccacugagccucacaaa

SEQ ID NO: 824095 - RNA, 22 nt, Human
ucuucacaggagccugccugcc

SEQ ID NO: 824096 - RNA, 22 nt, Human
agagagggcauagaaaaaggga

SEQ ID NO: 824097 - RNA, 22 nt, Human
ucucuucuaacacuagaaauuc

SEQ ID NO: 824098 - RNA, 22 nt, Human
aaaagucugcucucauuucaga

SEQ ID NO: 824099 - RNA, 22 nt, Human
aaaggugacugcagcagcuauu

SEQ ID NO: 824100 - RNA, 22 nt, Human
caaggccaagguuuugugaacu

SEQ ID NO: 824101 - RNA, 22 nt, Human
uuugacauuggcuuauucuguu

SEQ ID NO: 824102 - RNA, 22 nt, Human
cagcgucucguugugggccucg

SEQ ID NO: 824103 - RNA, 21 nt, Human
ccugcugugaucuuagugagu

SEQ ID NO: 824104 - RNA, 21 nt, Human
cucuugugucagagccagagg

SEQ ID NO: 824105 - RNA, 21 nt, Human
aggaggggucuuucccacuga

SEQ ID NO: 824106 - RNA, 22 nt, Human
aggaaagguagcgugccagcag

SEQ ID NO: 824107 - RNA, 22 nt, Human
aauguauuccucaugcaagagu

SEQ ID NO: 824108 - RNA, 22 nt, Human
cccaggaggacauuccauaccc

SEQ ID NO: 824109 - RNA, 22 nt, Human
aguggcaggcggagauguagga

SEQ ID NO: 824110 - RNA, 22 nt, Human
ggagaggguguggaaaguuauc

SEQ ID NO: 824111 - RNA, 22 nt, Human
agcagccuuugaucaucuggga

SEQ ID NO: 824112 - RNA, 22 nt, Human
guagggagcccagagcccagug

SEQ ID NO: 824113 - RNA, 22 nt, Human
uuucuucagccuucacaaccug

SEQ ID NO: 824114 - RNA, 22 nt, Human
uggcagcugauuagauggugcc

SEQ ID NO: 824115 - RNA, 22 nt, Human
ugaagggggagauauaugugug

SEQ ID NO: 824116 - RNA, 22 nt, Human
gggaggugauggcaagcagcgg

SEQ ID NO: 824117 - RNA, 18 nt, Human
uaggagagaauuuauuua

SEQ ID NO: 824118 - RNA, 22 nt, Human
accauccugaaaccuucaugcu

SEQ ID NO: 824119 - RNA, 17 nt, Human
gagagcugcugcuuccg

SEQ ID NO: 824120 - RNA, 22 nt, Human
uugacaauguccuuugaauuuc

SEQ ID NO: 824121 - RNA, 22 nt, Human
uucaggauccccaccgcguuua

SEQ ID NO: 824122 - RNA, 22 nt, Human
uuugaaaucuaaucaaggaaca

SEQ ID NO: 824123 - RNA, 22 nt, Human
aggguagggcccggagacagac

SEQ ID NO: 824124 - RNA, 22 nt, Human
gggcagcuggccagguauucug

SEQ ID NO: 824125 - RNA, 22 nt, Human
ggaggccagggacccagucagc

SEQ ID NO: 824126 - RNA, 22 nt, Human
ucuugcuaaagaccaacacauu

SEQ ID NO: 824127 - RNA, 22 nt, Human
ccuggauucaagucuuucuuuc

SEQ ID NO: 824128 - RNA, 22 nt, Human
ucuucagaggaagucagucuuu

SEQ ID NO: 824129 - RNA, 22 nt, Human
aguugcagacgcagagauguug

SEQ ID NO: 824130 - RNA, 22 nt, Human
ucacagacauggugagguaaca

SEQ ID NO: 824131 - RNA, 22 nt, Human
ugaaggccagcagagugaaggc

SEQ ID NO: 824132 - RNA, 22 nt, Human
auaagcauguuagaauauuuga

SEQ ID NO: 824133 - RNA, 21 nt, Human
gauugaaaccauggcagugag

SEQ ID NO: 824134 - RNA, 22 nt, Human
cuguauuuguccucuauuuauu

SEQ ID NO: 824135 - RNA, 22 nt, Human
aaauacagaguugcuuaaaagc

SEQ ID NO: 824136 - RNA, 22 nt, Human
gucauauacacugcauguaauc

SEQ ID NO: 824137 - RNA, 22 nt, Human
uggaaagcgaggaguuggcauu

SEQ ID NO: 824138 - RNA, 22 nt, Human
uuucugcugugcuuucuugcgu

SEQ ID NO: 824139 - RNA, 22 nt, Human
cccaggaguaagugacauuguu

SEQ ID NO: 824140 - RNA, 22 nt, Human
uuauggcauauuccucauugua

SEQ ID NO: 824141 - RNA, 22 nt, Human
cuggcugugcugcaggcuuugg

SEQ ID NO: 824142 - RNA, 22 nt, Human
agaaguuguagguuugcauauu

SEQ ID NO: 824143 - RNA, 22 nt, Human
aauaugcauuaacuguguacau

SEQ ID NO: 824144 - RNA, 22 nt, Human
ucuuagaaguuuauggcacgga

SEQ ID NO: 824145 - RNA, 22 nt, Human
auauauuugagaauauucauga

SEQ ID NO: 824146 - RNA, 22 nt, Human
uuucuaggucuuccauacugcc

SEQ ID NO: 824147 - RNA, 22 nt, Human
ggcagcuucuuaauauggagac

SEQ ID NO: 824148 - RNA, 22 nt, Human
aagcagagcaagcguauuuauu

SEQ ID NO: 824149 - RNA, 23 nt, Human
aucauucuccaaucuggagcagg

SEQ ID NO: 824150 - RNA, 22 nt, Human
ucccaggaagaucccagggacc

SEQ ID NO: 824151 - RNA, 22 nt, Human
agucuccuuggccucaaugccu

SEQ ID NO: 824152 - RNA, 21 nt, Human
uucucagaucgaguagugaga

SEQ ID NO: 824153 - RNA, 22 nt, Human
aagagggcagcacagguggguc

SEQ ID NO: 824154 - RNA, 18 nt, Human
ccagguggugacagagau

SEQ ID NO: 824155 - RNA, 22 nt, Human
ggcagcucacgggcauggggug

SEQ ID NO: 824156 - RNA, 20 nt, Human
agggcagcuugaggagccgg

SEQ ID NO: 824157 - RNA, 22 nt, Human
ugaggcaguucuuacuuguauu

SEQ ID NO: 824158 - RNA, 22 nt, Human
caggcagcucuaauggaaagug

SEQ ID NO: 824159 - RNA, 22 nt, Human
ugaggcaggacugagcgggaug

SEQ ID NO: 824160 - RNA, 22 nt, Human
uucaggauucuuucagacuggg

SEQ ID NO: 824161 - RNA, 22 nt, Human
gaagcagcagcuggggacaguu

SEQ ID NO: 824162 - RNA, 22 nt, Human
aggcagcuuucuguaggggugu

SEQ ID NO: 824163 - RNA, 22 nt, Human
uaugaacuuuugaugugacaug

SEQ ID NO: 824164 - RNA, 22 nt, Human
agggagcucacaguccaguaga

SEQ ID NO: 824165 - RNA, 22 nt, Human
ggaggggaacuaaucccgugac

SEQ ID NO: 824166 - RNA, 22 nt, Human
augugucuuugagacucugcua

SEQ ID NO: 824167 - RNA, 22 nt, Human
uuugaaaggugucgagaugugu

SEQ ID NO: 824168 - RNA, 22 nt, Human
gauggcagcauauugacagcau

SEQ ID NO: 824169 - RNA, 22 nt, Human
uccaugagaacccuuggagaua

SEQ ID NO: 824170 - RNA, 22 nt, Human
ggccaggagcugcacagggcuc

SEQ ID NO: 824171 - RNA, 22 nt, Human
acucaggaaaugaagacugguu

SEQ ID NO: 824172 - RNA, 22 nt, Human
uucucuuuugugaugugagaug

SEQ ID NO: 824173 - RNA, 22 nt, Human
gcauguguugguuuaugcaugu

SEQ ID NO: 824174 - RNA, 22 nt, Human
cccauucauccucgcuuccuuc

SEQ ID NO: 824175 - RNA, 22 nt, Human
uaauuauuaugacaacaauugc

SEQ ID NO: 824176 - RNA, 22 nt, Human
cucugcaugccuugcucagaca

SEQ ID NO: 824177 - RNA, 22 nt, Human
cagcugacccagugaggaggca

SEQ ID NO: 824178 - RNA, 22 nt, Human
cccaggagauggagguugcagu

SEQ ID NO: 824179 - RNA, 22 nt, Human
uaaacauuuguuauucuuguuu

SEQ ID NO: 824180 - RNA, 22 nt, Human
gugcugugugauccaugcuggc

SEQ ID NO: 824181 - RNA, 22 nt, Human
gcaggagacuggcugugguagu

SEQ ID NO: 824182 - RNA, 22 nt, Human
aagggcagaauagagaagaugg

SEQ ID NO: 824183 - RNA, 17 nt, Human
cccaugagcccacuccc

SEQ ID NO: 824184 - RNA, 22 nt, Human
ccccaggacacauggaccaagu

SEQ ID NO: 824185 - RNA, 22 nt, Human
caaggccaguuucuccuaguca

SEQ ID NO: 824186 - RNA, 22 nt, Human
ucucaguguguuuucucucaga

SEQ ID NO: 824187 - RNA, 22 nt, Human
auucuucacuguuucagaauga

SEQ ID NO: 824188 - RNA, 22 nt, Human
aguccaugguucugacucaucu

SEQ ID NO: 824189 - RNA, 22 nt, Human
uaggagaggugaauggcacacu

SEQ ID NO: 824190 - RNA, 22 nt, Human
gaggcugauucggggaacagca

SEQ ID NO: 824191 - RNA, 22 nt, Human
uuccagcaggcagacaggagau

SEQ ID NO: 824192 - RNA, 22 nt, Human
cucccaggggaacuaucaagua

SEQ ID NO: 824193 - RNA, 22 nt, Human
uuugacaugcaaagcacuuuag

SEQ ID NO: 824194 - RNA, 22 nt, Human
aggcacaguuucauccccgggc

SEQ ID NO: 824195 - RNA, 22 nt, Human
ugcuucugggcaaaugugugug

SEQ ID NO: 824196 - RNA, 23 nt, Human
gccaggaguggguagacuaaugc

SEQ ID NO: 824197 - RNA, 22 nt, Human
ccaggagaugggagcaucuaaa

SEQ ID NO: 824198 - RNA, 22 nt, Human
gcucagagcuugaaguuccacu

SEQ ID NO: 824199 - RNA, 22 nt, Human
uucagaaugugaccuuauuugg

SEQ ID NO: 824200 - RNA, 22 nt, Human
ucacuguugaccuggaaguggg

SEQ ID NO: 824201 - RNA, 21 nt, Human
uaauaauuccacuacagagua

SEQ ID NO: 824202 - RNA, 22 nt, Human
guucuucaucuuaaccaucugu

SEQ ID NO: 824203 - RNA, 22 nt, Human
agcccaggugagggguucgaaa

SEQ ID NO: 824204 - RNA, 23 nt, Human
acugucugauauguuuuccauca

SEQ ID NO: 824205 - RNA, 19 nt, Human
accaggaguaucagagcug

SEQ ID NO: 824206 - RNA, 22 nt, Human
agcagcauuaugauauaucuua

SEQ ID NO: 824207 - RNA, 20 nt, Human
aucaggauucuugcuuuguu

SEQ ID NO: 824208 - RNA, 22 nt, Human
ucugucccugagagcucaggag

SEQ ID NO: 824209 - RNA, 22 nt, Human
gauggcaggcaggugaguagag

SEQ ID NO: 824210 - RNA, 22 nt, Human
cccaggaagaaauucugauuug

SEQ ID NO: 824211 - RNA, 22 nt, Human
uuuauuugaaucaggggagaau

SEQ ID NO: 824212 - RNA, 22 nt, Human
ccagaggaggggggucuuucug

SEQ ID NO: 824213 - RNA, 19 nt, Human
ucuuucauuucuagcucug

SEQ ID NO: 824214 - RNA, 22 nt, Human
uccaggagggguaggcaguaug

SEQ ID NO: 824215 - RNA, 22 nt, Human
ugccaggagucaggccaggcag

SEQ ID NO: 824216 - RNA, 21 nt, Human
cucaaagaccaaaaguguaga

SEQ ID NO: 824217 - RNA, 22 nt, Human
auucuucauuguugauucaugu

SEQ ID NO: 824218 - RNA, 22 nt, Human
auucuucaguauguguggauug

SEQ ID NO: 824219 - RNA, 20 nt, Human
caggagggacauuucagcau

SEQ ID NO: 824220 - RNA, 22 nt, Human
cagaguucaaagccugcuggga

SEQ ID NO: 824221 - RNA, 22 nt, Human
uguauuuuuagaccuuuagacc

SEQ ID NO: 824222 - RNA, 22 nt, Human
gcauugaguccacucugucuuu

SEQ ID NO: 824223 - RNA, 22 nt, Human
cucaugucuucacccauucuaa

SEQ ID NO: 824224 - RNA, 22 nt, Human
uucuuuucuuuaggcauugugu

SEQ ID NO: 824225 - RNA, 22 nt, Human
uugaacuguaagcaugucugcc

SEQ ID NO: 824226 - RNA, 20 nt, Human
augcuuucuugugugcugcu

SEQ ID NO: 824227 - RNA, 22 nt, Human
uuucaugagauuccuccacauc

SEQ ID NO: 824228 - RNA, 22 nt, Human
uugcugugucauuuguuuaauc

SEQ ID NO: 824229 - RNA, 22 nt, Human
ggccagcagucacagggucaga

SEQ ID NO: 824230 - RNA, 22 nt, Human
cccaggcagugugugcaugcgu

SEQ ID NO: 824231 - RNA, 22 nt, Human
uuugcaaauaccaugaaacuug

SEQ ID NO: 824232 - RNA, 22 nt, Human
uaauuccaaguugagacaugca

SEQ ID NO: 824233 - RNA, 22 nt, Human
uuggcaggaauauugcagaggu

SEQ ID NO: 824234 - RNA, 22 nt, Human
cuucugaggcagcuauucaguu

SEQ ID NO: 824235 - RNA, 22 nt, Human
cccaaggacacgggcagggaca

SEQ ID NO: 824236 - RNA, 22 nt, Human
aggcagcuuuaacugguaguag

SEQ ID NO: 824237 - RNA, 22 nt, Human
cucaggaugcaggucacaggac

SEQ ID NO: 824238 - RNA, 22 nt, Human
cuucagaaugggacuguguuug

SEQ ID NO: 824239 - RNA, 22 nt, Human
auucaaguggcugcuauguuaa

SEQ ID NO: 824240 - RNA, 22 nt, Human
auuacaaaagaagggagaaggu

SEQ ID NO: 824241 - RNA, 22 nt, Human
ugcugaaagucccaaaucucau

SEQ ID NO: 824242 - RNA, 22 nt, Human
ccagugcuaagguagccucugc

SEQ ID NO: 824243 - RNA, 22 nt, Human
cugcccagaagccagaugggca

SEQ ID NO: 824244 - RNA, 23 nt, Human
auuugagaaaguauuuuuaagac

SEQ ID NO: 824245 - RNA, 22 nt, Human
ugaggggauacgguacacauug

SEQ ID NO: 824246 - RNA, 22 nt, Human
cuuagaaaugcagauucucagg

SEQ ID NO: 824247 - RNA, 22 nt, Human
uagaaacaucagcuaaccaaaa

SEQ ID NO: 824248 - RNA, 22 nt, Human
augcugugagugugccgcagag

SEQ ID NO: 824249 - RNA, 19 nt, Human
ugcaagcuuuuucuuguua

SEQ ID NO: 824250 - RNA, 22 nt, Human
caggcagcucaaccuugggagc

SEQ ID NO: 824251 - RNA, 22 nt, Human
cuugcacacauguacaugugua

SEQ ID NO: 824252 - RNA, 22 nt, Human
ucacacagauugguagagcuga

SEQ ID NO: 824253 - RNA, 22 nt, Human
ucucugaguauccugaacugcc

SEQ ID NO: 824254 - RNA, 22 nt, Human
uagggaggaggguuuucaaauc

SEQ ID NO: 824255 - RNA, 22 nt, Human
cccaggagacagaaacagaggu

SEQ ID NO: 824256 - RNA, 22 nt, Human
ggcagcuaguuuaagaaagagg

SEQ ID NO: 824257 - RNA, 22 nt, Human
auuuguugcuagcagcacugau

SEQ ID NO: 824258 - RNA, 22 nt, Human
aaaggccacacugcucuuucuc

SEQ ID NO: 824259 - RNA, 22 nt, Human
ucaggagagagaaauuggggcu

SEQ ID NO: 824260 - RNA, 22 nt, Human
caggcagcugcgacaagagagc

SEQ ID NO: 824261 - RNA, 22 nt, Human
aucaggauuauuaaaucuggau

SEQ ID NO: 824262 - RNA, 22 nt, Human
ugaggggagcccgcccuggacg

SEQ ID NO: 824263 - RNA, 22 nt, Human
gcagcugcagacccucagugcu

SEQ ID NO: 824264 - RNA, 22 nt, Human
ggaggaugagcuacgaggagcu

SEQ ID NO: 824265 - RNA, 22 nt, Human
gggcagcugccagaggccaugg

SEQ ID NO: 824266 - RNA, 22 nt, Human
aaggcagccaugugcuuugggu

SEQ ID NO: 824267 - RNA, 22 nt, Human
cuguuucaagugaagucagaca

SEQ ID NO: 824268 - RNA, 22 nt, Human
aggcaguuuauccccagagccu

SEQ ID NO: 824269 - RNA, 22 nt, Human
acccaggacaaaauaaccaggu

SEQ ID NO: 824270 - RNA, 22 nt, Human
ucagucuuugcuuaugacaaua

SEQ ID NO: 824271 - RNA, 22 nt, Human
uuguaaaugaccuuuucuaauu

SEQ ID NO: 824272 - RNA, 22 nt, Human
ugaugaaaauaugauucugagg

SEQ ID NO: 824273 - RNA, 22 nt, Human
uccaggagauucauuaggucau

SEQ ID NO: 824274 - RNA, 22 nt, Human
uuuccuaguucuaagaaaugua

SEQ ID NO: 824275 - RNA, 22 nt, Human
ugcuuagacgucaaguacagcc

SEQ ID NO: 824276 - RNA, 22 nt, Human
agggcagcacaaggcauggacu

SEQ ID NO: 824277 - RNA, 22 nt, Human
aucaggaucugcaucauaagaa

SEQ ID NO: 824278 - RNA, 22 nt, Human
uuuaaaauuuagaccucuccac

SEQ ID NO: 824279 - RNA, 22 nt, Human
gggcagcucugcccaucagagg

SEQ ID NO: 824280 - RNA, 22 nt, Human
acccaggaggcaagguugcagu

SEQ ID NO: 824281 - RNA, 22 nt, Human
auacaaagacaaaucucaaucu

SEQ ID NO: 824282 - RNA, 22 nt, Human
gcagagaagaugcccaggcuuc

SEQ ID NO: 824283 - RNA, 22 nt, Human
aguaccaugcuuccugacuggu

SEQ ID NO: 824284 - RNA, 19 nt, Human
uagaggagaagggaagugg

SEQ ID NO: 824285 - RNA, 22 nt, Human
uacuaaauaguuuaauuccuca

SEQ ID NO: 824286 - RNA, 22 nt, Human
aauccugugugacucuggggag

SEQ ID NO: 824287 - RNA, 22 nt, Human
gggcagcuguaucugagcuuau

SEQ ID NO: 824288 - RNA, 22 nt, Human
ugaaagguuaaaaguaguauug

SEQ ID NO: 824289 - RNA, 22 nt, Human
uccaggaguggggcagaggucu

SEQ ID NO: 824290 - RNA, 22 nt, Human
guggaauguccuugaucauaag

SEQ ID NO: 824291 - RNA, 22 nt, Human
gcaggagagccagcaggcuucc

SEQ ID NO: 824292 - RNA, 22 nt, Human
guucuucaggcugugcucuaga

SEQ ID NO: 824293 - RNA, 22 nt, Human
aaaugauugucaaaguucuguu

SEQ ID NO: 824294 - RNA, 22 nt, Human
uuucacaucagagguagauuag

SEQ ID NO: 824295 - RNA, 22 nt, Human
ugaggcagguaagcaaguuuug

SEQ ID NO: 824296 - RNA, 22 nt, Human
uggcagcugugcuucauucuuu

SEQ ID NO: 824297 - RNA, 22 nt, Human
cagcucugaggaacacuccuuu

SEQ ID NO: 824298 - RNA, 22 nt, Human
gaugccucuuuuggcugaauua

SEQ ID NO: 824299 - RNA, 22 nt, Human
augcugugaaaaagaaggcuga

SEQ ID NO: 824300 - RNA, 22 nt, Human
uccaugagcuagggauucauca

SEQ ID NO: 824301 - RNA, 22 nt, Human
aggccagcaagaaagagagucu

SEQ ID NO: 824302 - RNA, 18 nt, Human
ggcagggaaaagauaggg

SEQ ID NO: 824303 - RNA, 22 nt, Human
uccaggagacacccuugugugu

SEQ ID NO: 824304 - RNA, 22 nt, Human
uccauuuucuaaguaucacuua

SEQ ID NO: 824305 - RNA, 21 nt, Human
gagugcagcaagguagagucu

SEQ ID NO: 824306 - RNA, 20 nt, Human
ggcagcuugggcagcaguua

SEQ ID NO: 824307 - RNA, 22 nt, Human
gagcagcugagcuggaaugaga

SEQ ID NO: 824308 - RNA, 17 nt, Human
uuucaucugggaccacc

SEQ ID NO: 824309 - RNA, 22 nt, Human
aucauuacuccuguaaaauugu

SEQ ID NO: 824310 - RNA, 22 nt, Human
cugccagucuaugcugcucggc

SEQ ID NO: 824311 - RNA, 22 nt, Human
uugcuuuguuacugcaguuucc

SEQ ID NO: 824312 - RNA, 21 nt, Human
gugcuuuuccuuaauguucuu

SEQ ID NO: 824313 - RNA, 17 nt, Human
gcccaggaaggacggcc

SEQ ID NO: 824314 - RNA, 22 nt, Human
cccaggagaucuggaucucguc

SEQ ID NO: 824315 - RNA, 22 nt, Human
uucuucaaauagcagggaguca

SEQ ID NO: 824316 - RNA, 22 nt, Human
aggacaggauugagcugaacug

SEQ ID NO: 824317 - RNA, 23 nt, Human
aggcccaacucugugagggcugc

SEQ ID NO: 824318 - RNA, 18 nt, Human
ucuuuggacaacuacugg

SEQ ID NO: 824319 - RNA, 22 nt, Human
gugacagucaaagacaugacuu

SEQ ID NO: 824320 - RNA, 22 nt, Human
uauuucuucgggauucaagcua

SEQ ID NO: 824321 - RNA, 22 nt, Human
aggcaguggaaggagaaagcaa

SEQ ID NO: 824322 - RNA, 22 nt, Human
auuaguaaaacauuguauaugu

SEQ ID NO: 824323 - RNA, 19 nt, Human
caggaaugagguaauggcu

SEQ ID NO: 824324 - RNA, 22 nt, Human
aaaaugagauacaguuugaaag

SEQ ID NO: 824325 - RNA, 19 nt, Human
acaaaugauguugcacuga

SEQ ID NO: 824326 - RNA, 20 nt, Human
uugagcuuuuaguacagaca

SEQ ID NO: 824327 - RNA, 22 nt, Human
aaagccauugaacuguacuuua

SEQ ID NO: 824328 - RNA, 22 nt, Human
aaguauuucguucugaaaaagu

SEQ ID NO: 824329 - RNA, 22 nt, Human
gauuucuuuaugaaguacagaa

SEQ ID NO: 824330 - RNA, 22 nt, Human
caaaucuauauguugauauucu

SEQ ID NO: 824331 - RNA, 22 nt, Human
ugaguaauaaacugucuugcuc

SEQ ID NO: 824332 - RNA, 22 nt, Human
aggugagggugccagugcaugg

SEQ ID NO: 824333 - RNA, 22 nt, Human
gaagcagcuggugagauggagc

SEQ ID NO: 824334 - RNA, 22 nt, Human
cugcugugcaacauugcaccua

SEQ ID NO: 824335 - RNA, 22 nt, Human
guaggcagguggaggagugaag

SEQ ID NO: 824336 - RNA, 22 nt, Human
gaggccaggaagcccaagauca

SEQ ID NO: 824337 - RNA, 22 nt, Human
uuugcauaggauggacauuuua

SEQ ID NO: 824338 - RNA, 22 nt, Human
uccaggagcucauccacgucaa

SEQ ID NO: 824339 - RNA, 22 nt, Human
auauucuugugauuauaaagua

SEQ ID NO: 824340 - RNA, 22 nt, Human
cccaggaacuccagagcuccuc

SEQ ID NO: 824341 - RNA, 22 nt, Human
ggagaagggacagacucagcuu

SEQ ID NO: 824342 - RNA, 22 nt, Human
ggcaugcucuuuguccacagua

SEQ ID NO: 824343 - RNA, 19 nt, Human
acuggcaguuucugcaugg

SEQ ID NO: 824344 - RNA, 21 nt, Human
acagcaagccuucacaugagu

SEQ ID NO: 824345 - RNA, 22 nt, Human
gaggcaguuccugagugacaag

SEQ ID NO: 824346 - RNA, 20 nt, Human
ccucaguguccuggacuggg

SEQ ID NO: 824347 - RNA, 22 nt, Human
ugcaugugcccacucuggcuua

SEQ ID NO: 824348 - RNA, 22 nt, Human
cgaggcagaggcugaaacggcu

SEQ ID NO: 824349 - RNA, 21 nt, Human
cucaggauggcggccuggugg

SEQ ID NO: 824350 - RNA, 19 nt, Human
aaagcagaggagcaucuga

SEQ ID NO: 824351 - RNA, 22 nt, Human
uggcaaggccacaggugcaguu

SEQ ID NO: 824352 - RNA, 20 nt, Human
uugauucaagggcugaugga

SEQ ID NO: 824353 - RNA, 22 nt, Human
uuugacaucuaagaauucuuac

SEQ ID NO: 824354 - RNA, 22 nt, Human
ucaggagacuuaugucacagug

SEQ ID NO: 824355 - RNA, 22 nt, Human
auguucuguuuuguaauucaua

SEQ ID NO: 824356 - RNA, 22 nt, Human
auuuccauagagcgucucacag

SEQ ID NO: 824357 - RNA, 22 nt, Human
uuucacauaugguuguugauug

SEQ ID NO: 824358 - RNA, 22 nt, Human
aggccagcccugggcugagaga

SEQ ID NO: 824359 - RNA, 22 nt, Human
augcuguguccuagugaaagaa

SEQ ID NO: 824360 - RNA, 22 nt, Human
uggcagcugcguuguguuucug

SEQ ID NO: 824361 - RNA, 22 nt, Human
gaggagaggcuggacgcgguga

SEQ ID NO: 824362 - RNA, 22 nt, Human
aucuuucuccauauacaucuuu

SEQ ID NO: 824363 - RNA, 22 nt, Human
aaauuauuacaagcuaguuggc

SEQ ID NO: 824364 - RNA, 22 nt, Human
aggguggcaccuggaagggaug

SEQ ID NO: 824365 - RNA, 22 nt, Human
cugcuuccauaaauaaugugcu

SEQ ID NO: 824366 - RNA, 22 nt, Human
gaaauauugggacucagagcuu

SEQ ID NO: 824367 - RNA, 22 nt, Human
cugcuuugggcagcuuuguggc

SEQ ID NO: 824368 - RNA, 22 nt, Human
gggcagcucucacagcagccaa

SEQ ID NO: 824369 - RNA, 22 nt, Human
aucaggaucacagaaacuuuua

SEQ ID NO: 824370 - RNA, 22 nt, Human
ggaaaugacuuggugcuucguu

SEQ ID NO: 824371 - RNA, 22 nt, Human
aaaggccagguuggcugguauu

SEQ ID NO: 824372 - RNA, 22 nt, Human
uauuuccaagcugaauccaaug

SEQ ID NO: 824373 - RNA, 22 nt, Human
acccaggacucucuuccaguag

SEQ ID NO: 824374 - RNA, 21 nt, Human
agucuguuaggaugacucuga

SEQ ID NO: 824375 - RNA, 22 nt, Human
ccacaucucgguccccucuuug

SEQ ID NO: 824376 - RNA, 22 nt, Human
cugcuguggccagccaggucaa

SEQ ID NO: 824377 - RNA, 22 nt, Human
cccaggagauaacguucccaag

SEQ ID NO: 824378 - RNA, 22 nt, Human
cuguauuucccacauucucuau

SEQ ID NO: 824379 - RNA, 22 nt, Human
agggcagccucucagccuaggu

SEQ ID NO: 824380 - RNA, 22 nt, Human
uuauuauuggugaguuaaggaa

SEQ ID NO: 824381 - RNA, 17 nt, Human
ggcagccucaggcguuu

SEQ ID NO: 824382 - RNA, 22 nt, Human
cuggcagucugccucuucacug

SEQ ID NO: 824383 - RNA, 22 nt, Human
agacagugcaagaagagcaggc

SEQ ID NO: 824384 - RNA, 22 nt, Human
ugcccaggguuucuaagagcag

SEQ ID NO: 824385 - RNA, 22 nt, Human
gcagcuucaguaggugaagaca

SEQ ID NO: 824386 - RNA, 22 nt, Human
uaacaucuuuagcagcucgaac

SEQ ID NO: 824387 - RNA, 22 nt, Human
cacaaaugguuguagacauuaa

SEQ ID NO: 824388 - RNA, 22 nt, Human
uauuuuaaagugaagggucuug

SEQ ID NO: 824389 - RNA, 19 nt, Human
agaaguuagacauugcaau

SEQ ID NO: 824390 - RNA, 22 nt, Human
gucaggauuauaauccccaugg

SEQ ID NO: 824391 - RNA, 22 nt, Human
aggcagauuacuugaggccagg

SEQ ID NO: 824392 - RNA, 22 nt, Human
agacgagggccuggcacacagu

SEQ ID NO: 824393 - RNA, 22 nt, Human
aucugcaggaaugugugcagag

SEQ ID NO: 824394 - RNA, 22 nt, Human
cagagaaaaaauccugcucuca

SEQ ID NO: 824395 - RNA, 22 nt, Human
ggagaggaaaugccagcacuuc

SEQ ID NO: 824396 - RNA, 22 nt, Human
caaggccauaagagauacaaaa

SEQ ID NO: 824397 - RNA, 22 nt, Human
gcccaggagguugggcugugca

SEQ ID NO: 824398 - RNA, 22 nt, Human
cauauaaauacaacauguguua

SEQ ID NO: 824399 - RNA, 20 nt, Human
ccucaggaugagggugagca

SEQ ID NO: 824400 - RNA, 20 nt, Human
cuguggaauuuuaccaugcg

SEQ ID NO: 824401 - RNA, 23 nt, Human
caguggagacucaugcuuccuua

SEQ ID NO: 824402 - RNA, 19 nt, Human
cuuugucagaacaugcuuc

SEQ ID NO: 824403 - RNA, 22 nt, Human
uuacaagauaaccugaugcugu

SEQ ID NO: 824404 - RNA, 22 nt, Human
aagggaggccagagguuuugca

SEQ ID NO: 824405 - RNA, 22 nt, Human
cccaagagcuucuaggacgcug

SEQ ID NO: 824406 - RNA, 22 nt, Human
uacacacaugcauuugccuuau

SEQ ID NO: 824407 - RNA, 22 nt, Human
augcuguggaaguuccugaagc

SEQ ID NO: 824408 - RNA, 22 nt, Human
aggccagcacgacagccgcagg

SEQ ID NO: 824409 - RNA, 22 nt, Human
caggauggagaguuguugguug

SEQ ID NO: 824410 - RNA, 22 nt, Human
uggcagcugaggggaggcuuug

SEQ ID NO: 824411 - RNA, 22 nt, Human
ugauuuccuaggucuggagaag

SEQ ID NO: 824412 - RNA, 22 nt, Human
guaguucugcagugucaccuga

SEQ ID NO: 824413 - RNA, 22 nt, Human
gcagaggagaugaagauacuuu

SEQ ID NO: 824414 - RNA, 16 nt, Human
ucccaggaggcggaac

SEQ ID NO: 824415 - RNA, 23 nt, Human
acagaaaguucugcuggacagag

SEQ ID NO: 824416 - RNA, 22 nt, Human
auguuucagauacagaucaaau

SEQ ID NO: 824417 - RNA, 22 nt, Human
cagagccacuuggagaugagaa

SEQ ID NO: 824418 - RNA, 22 nt, Human
acuuuugguucuguaacuguga

SEQ ID NO: 824419 - RNA, 22 nt, Human
gacccaggagagaggguugcau

SEQ ID NO: 824420 - RNA, 22 nt, Human
aggaguggugcaggaccugcca

SEQ ID NO: 824421 - RNA, 22 nt, Human
gcaggagaaaugaagauugggu

SEQ ID NO: 824422 - RNA, 22 nt, Human
aagcaccuggguuauaucuuag

SEQ ID NO: 824423 - RNA, 22 nt, Human
gugcugugucuaucaggaauaa

SEQ ID NO: 824424 - RNA, 22 nt, Human
cuugaacucaaugugaggaaga

SEQ ID NO: 824425 - RNA, 22 nt, Human
gcuuggcauugaccauuaucau

SEQ ID NO: 824426 - RNA, 22 nt, Human
aggcaguggaugucaggaaugg

SEQ ID NO: 824427 - RNA, 22 nt, Human
cagggagggaggaaaauuugcu

SEQ ID NO: 824428 - RNA, 22 nt, Human
gcccaggauucuuucuuccuua

SEQ ID NO: 824429 - RNA, 22 nt, Human
aggaugagaagauuggaaucuu

SEQ ID NO: 824430 - RNA, 22 nt, Human
uggaggaaguggcuggccagaa

SEQ ID NO: 824431 - RNA, 22 nt, Human
auugcuaggaacagguugcacc

SEQ ID NO: 824432 - RNA, 22 nt, Human
cuuugaagagauuacugugcuc

SEQ ID NO: 824433 - RNA, 19 nt, Human
accaggagacagugagcuu

SEQ ID NO: 824434 - RNA, 20 nt, Human
gggcaguucaaugccacucu

SEQ ID NO: 824435 - RNA, 22 nt, Human
gaaggccacuuuguguugagaa

SEQ ID NO: 824436 - RNA, 22 nt, Human
uaaagcacauaucuuacaauaa

SEQ ID NO: 824437 - RNA, 20 nt, Human
gccaggagggugugaugagc

SEQ ID NO: 824438 - RNA, 22 nt, Human
aucauucuauuguugagcugcc

SEQ ID NO: 824439 - RNA, 22 nt, Human
uccucagaaaccccugugaggu

SEQ ID NO: 824440 - RNA, 22 nt, Human
aaagccauuacaaaauuucaua

SEQ ID NO: 824441 - RNA, 22 nt, Human
auuuagaacuuuguuugccaau

SEQ ID NO: 824442 - RNA, 22 nt, Human
agcgagggaggucugaggacag

SEQ ID NO: 824443 - RNA, 22 nt, Human
uugaaagaggcaaaguuugauc

SEQ ID NO: 824444 - RNA, 22 nt, Human
augauguugauaaauuacuuua

SEQ ID NO: 824445 - RNA, 22 nt, Human
gaggggaaagugugaggcugcg

SEQ ID NO: 824446 - RNA, 22 nt, Human
aggcagagcuggguuuugaaau

SEQ ID NO: 824447 - RNA, 22 nt, Human
ggaagaggcugaggccaugcug

SEQ ID NO: 824448 - RNA, 22 nt, Human
cucuucuugccugaugaggcag

SEQ ID NO: 824449 - RNA, 22 nt, Human
aagcagaguccccuucccaugg

SEQ ID NO: 824450 - RNA, 22 nt, Human
acauugcugcauucuccuuccc

SEQ ID NO: 824451 - RNA, 22 nt, Human
cccaggaguuggaggcuacggu

SEQ ID NO: 824452 - RNA, 22 nt, Human
gaggagcugggcugagaggguc

SEQ ID NO: 824453 - RNA, 22 nt, Human
aguuauaaucugcuacugauau

SEQ ID NO: 824454 - RNA, 22 nt, Human
agucucuuuaaucacagugucu

SEQ ID NO: 824455 - RNA, 22 nt, Human
aggcagacugugcgggaagagu

SEQ ID NO: 824456 - RNA, 22 nt, Human
agugagggaugaagaacugcgg

SEQ ID NO: 824457 - RNA, 22 nt, Human
ccccaggagauuugggagcaca

SEQ ID NO: 824458 - RNA, 22 nt, Human
uggugguuaugcgcuuuguggg

SEQ ID NO: 824459 - RNA, 22 nt, Human
uagggaggcuacuucuuguagg

SEQ ID NO: 824460 - RNA, 22 nt, Human
gugggagcuuuggcaucaggcu

SEQ ID NO: 824461 - RNA, 22 nt, Human
ugaaguuauauauguugaaaau

SEQ ID NO: 824462 - RNA, 22 nt, Human
gauauuuugagaaauccuauga

SEQ ID NO: 824463 - RNA, 22 nt, Human
cccaggagaccuagaucuguuu

SEQ ID NO: 824464 - RNA, 22 nt, Human
uuucagcugguaaaggaguagc

SEQ ID NO: 824465 - RNA, 22 nt, Human
ggcaagcucaggccucaggugu

SEQ ID NO: 824466 - RNA, 22 nt, Human
uuuguuuacucauucauugaug

SEQ ID NO: 824467 - RNA, 22 nt, Human
cccuugcacauuugucuuuaau

SEQ ID NO: 824468 - RNA, 22 nt, Human
cagcuccugaggacugcuggga

SEQ ID NO: 824469 - RNA, 22 nt, Human
cccaggaggucgaagcugcagu

SEQ ID NO: 824470 - RNA, 22 nt, Human
cccagaaggucgaggcugcagu

SEQ ID NO: 824471 - RNA, 22 nt, Human
ucugcaggcuguacaggaagca

SEQ ID NO: 824472 - RNA, 22 nt, Human
uagggcaggggaggaaucugaa

SEQ ID NO: 824473 - RNA, 17 nt, Human
gccaggagguuugagcu

SEQ ID NO: 824474 - RNA, 22 nt, Human
gaggccagaagugccucgggcu

SEQ ID NO: 824475 - RNA, 22 nt, Human
aagacauugucauuuuauaauu

SEQ ID NO: 824476 - RNA, 22 nt, Human
caggaugggauguagugggccc

SEQ ID NO: 824477 - RNA, 22 nt, Human
aguucucagcuuaguaugcugu

SEQ ID NO: 824478 - RNA, 22 nt, Human
cuuguccccagcagguugguuu

SEQ ID NO: 824479 - RNA, 22 nt, Human
ugccuguguccccuucuuggca

SEQ ID NO: 824480 - RNA, 22 nt, Human
gaggagcugggucagggagaca

SEQ ID NO: 824481 - RNA, 22 nt, Human
caguucuuuguggggaguucuc

SEQ ID NO: 824482 - RNA, 23 nt, Human
cagggaggagauacuguguaucu

SEQ ID NO: 824483 - RNA, 22 nt, Human
gcacaauuauuuaugcaguaug

SEQ ID NO: 824484 - RNA, 22 nt, Human
cuuuccaaugcauuuccaaugu

SEQ ID NO: 824485 - RNA, 19 nt, Human
uggcagggagaguuugaag

SEQ ID NO: 824486 - RNA, 22 nt, Human
agaaaugaagcaggaguuauua

SEQ ID NO: 824487 - RNA, 22 nt, Human
gaaggccacggaauggagcugg

SEQ ID NO: 824488 - RNA, 22 nt, Human
agaggaggaagagcuuuaaaau

SEQ ID NO: 824489 - RNA, 22 nt, Human
guucuucaucauuaacacucug

SEQ ID NO: 824490 - RNA, 22 nt, Human
ugcuuuggaucuauuugcugag

SEQ ID NO: 824491 - RNA, 22 nt, Human
agacagugauguaagcaggagu

SEQ ID NO: 824492 - RNA, 22 nt, Human
caggcagcugacugucagauau

SEQ ID NO: 824493 - RNA, 19 nt, Human
agccuggcuuugcucugcu

SEQ ID NO: 824494 - RNA, 22 nt, Human
uuugacaucaauacccuagaau

SEQ ID NO: 824495 - RNA, 22 nt, Human
acucaggaaaugagaggcucuc

SEQ ID NO: 824496 - RNA, 23 nt, Human
ggcagcucucaucugaugacuga

SEQ ID NO: 824497 - RNA, 22 nt, Human
uugaagagugccuuccagacau

SEQ ID NO: 824498 - RNA, 21 nt, Human
aggcaucuaaagagaguagac

SEQ ID NO: 824499 - RNA, 22 nt, Human
cccuuagcucaauuucuugccc

SEQ ID NO: 824500 - RNA, 22 nt, Human
cagaggcaggauaagaacugcg

SEQ ID NO: 824501 - RNA, 22 nt, Human
agugauggugagugagaagcuc

SEQ ID NO: 824502 - RNA, 22 nt, Human
gagaggggcgcgcagcucgcga

SEQ ID NO: 824503 - RNA, 20 nt, Human
aggcaccugucacaggugag

SEQ ID NO: 824504 - RNA, 22 nt, Human
uuugaauagaggccccucagaa

SEQ ID NO: 824505 - RNA, 20 nt, Human
cuucuucauuaacccuacug

SEQ ID NO: 824506 - RNA, 19 nt, Human
acauuuaaauucagaucuc

SEQ ID NO: 824507 - RNA, 22 nt, Human
ggagcugugcagugacuacaga

SEQ ID NO: 824508 - RNA, 22 nt, Human
ucccaggacuuccaguuggagg

SEQ ID NO: 824509 - RNA, 22 nt, Human
ggucagagggugggcugccugu

SEQ ID NO: 824510 - RNA, 22 nt, Human
gcaaguuauuuccauuuaaagc

SEQ ID NO: 824511 - RNA, 22 nt, Human
gcucaggaaaacagucuaguaa

SEQ ID NO: 824512 - RNA, 22 nt, Human
ucagauggcacacagagccugc

SEQ ID NO: 824513 - RNA, 22 nt, Human
uaaugcuuaacagcuggcuuuu

SEQ ID NO: 824514 - RNA, 22 nt, Human
uggaguuccuuugaaaggcucu

SEQ ID NO: 824515 - RNA, 22 nt, Human
auucuucacaaauauauagaag

SEQ ID NO: 824516 - RNA, 22 nt, Human
caaguaaacaauaugugauuca

SEQ ID NO: 824517 - RNA, 21 nt, Human
ggcagccucuguggaagggga

SEQ ID NO: 824518 - RNA, 22 nt, Human
cucaggaugcaauuccaucaag

SEQ ID NO: 824519 - RNA, 22 nt, Human
uuaguuuucccaucuuuauggu

SEQ ID NO: 824520 - RNA, 22 nt, Human
ucuacagacagagcagguggga

SEQ ID NO: 824521 - RNA, 22 nt, Human
guucuugccagcauccucaggu

SEQ ID NO: 824522 - RNA, 22 nt, Human
caggcagcuagauuuauaacaa

SEQ ID NO: 824523 - RNA, 20 nt, Human
ugaaggccagcagcauaggg

SEQ ID NO: 824524 - RNA, 22 nt, Human
ggauggcauguugggcucuguu

SEQ ID NO: 824525 - RNA, 22 nt, Human
auugucuuuccacugagaaguu

SEQ ID NO: 824526 - RNA, 22 nt, Human
gaggaggcuuccgggaggcacg

SEQ ID NO: 824527 - RNA, 22 nt, Human
aaauuauuaugccccucuauaa

SEQ ID NO: 824528 - RNA, 22 nt, Human
ugucucaguacacuccgauguu

SEQ ID NO: 824529 - RNA, 22 nt, Human
gaggggaagacuucuggacagu

SEQ ID NO: 824530 - RNA, 22 nt, Human
aucaggaucagggcuagcagag

SEQ ID NO: 824531 - RNA, 22 nt, Human
uuuguaugugauaagacuauuc

SEQ ID NO: 824532 - RNA, 19 nt, Human
uaucuguuuccugcuuguc

SEQ ID NO: 824533 - RNA, 22 nt, Human
aaguaaaauguuuccuuuauua

SEQ ID NO: 824534 - RNA, 22 nt, Human
uuuguaaauagcaguacucaug

SEQ ID NO: 824535 - RNA, 22 nt, Human
uugaaaggaauacagaggccua

SEQ ID NO: 824536 - RNA, 22 nt, Human
ggccagcugggccaccaggugc

SEQ ID NO: 824537 - RNA, 22 nt, Human
aucaggaugacaacugcugggu

SEQ ID NO: 824538 - RNA, 22 nt, Human
uuaaaauagccagugccccucu

SEQ ID NO: 824539 - RNA, 22 nt, Human
gcagaggccaggccaccagcaa

SEQ ID NO: 824540 - RNA, 17 nt, Human
guccuacccauggucua

SEQ ID NO: 824541 - RNA, 22 nt, Human
uaacauuagguagacauaagcc

SEQ ID NO: 824542 - RNA, 22 nt, Human
aucuuucagggccauuuguauu

SEQ ID NO: 824543 - RNA, 22 nt, Human
ccucuucuaggacguccuugug

SEQ ID NO: 824544 - RNA, 22 nt, Human
uugcauuuuuagaugcuucugu

SEQ ID NO: 824545 - RNA, 22 nt, Human
ucuccucucuuaccugguacaa

SEQ ID NO: 824546 - RNA, 22 nt, Human
ucccaggacaugggcucugcuc

SEQ ID NO: 824547 - RNA, 22 nt, Human
cccuguacagucucuguggcac

SEQ ID NO: 824548 - RNA, 22 nt, Human
cccaggagagaggggauaaagc

SEQ ID NO: 824549 - RNA, 22 nt, Human
cugcuaaaccucucugagagcu

SEQ ID NO: 824550 - RNA, 22 nt, Human
cuugaaagauuuggccucugug

SEQ ID NO: 824551 - RNA, 17 nt, Human
aaucuguuuacagucag

SEQ ID NO: 824552 - RNA, 22 nt, Human
gaaggccacaagagaaguuaag

SEQ ID NO: 824553 - RNA, 22 nt, Human
acccaggaaaacauggugcaga

SEQ ID NO: 824554 - RNA, 22 nt, Human
aaaacaguuuaggcaucacagu

SEQ ID NO: 824555 - RNA, 22 nt, Human
uuuccucauuuaucugcuggga

SEQ ID NO: 824556 - RNA, 22 nt, Human
cuggcuguauuaguuugauccu

SEQ ID NO: 824557 - RNA, 22 nt, Human
gaggcagcagaacauggaagag

SEQ ID NO: 824558 - RNA, 22 nt, Human
uugcugaauugaauccuuuggu

SEQ ID NO: 824559 - RNA, 22 nt, Human
ugaaggccucugguacaugcca

SEQ ID NO: 824560 - RNA, 22 nt, Human
aggagaggcaucaagaaaaucg

SEQ ID NO: 824561 - RNA, 22 nt, Human
gcagcuccuccugggcuggaga

SEQ ID NO: 824562 - RNA, 22 nt, Human
uucuucaaccaucuacauaaac

SEQ ID NO: 824563 - RNA, 22 nt, Human
gauuuuauauggcauacugugg

SEQ ID NO: 824564 - RNA, 22 nt, Human
ccaugagacagcaacugaaagu

SEQ ID NO: 824565 - RNA, 22 nt, Human
guuuucugauuagcaaaucuga

SEQ ID NO: 824566 - RNA, 22 nt, Human
gcagcugcaauaggcaucaagc

SEQ ID NO: 824567 - RNA, 22 nt, Human
gaggaacccagcugggguugcc

SEQ ID NO: 824568 - RNA, 22 nt, Human
ucucaggacuuugggaagcuca

SEQ ID NO: 824569 - RNA, 22 nt, Human
agcucccagagcucgagaguaa

SEQ ID NO: 824570 - RNA, 22 nt, Human
caggcagccuucucgucucaca

SEQ ID NO: 824571 - RNA, 22 nt, Human
ugaaaugagauagauaaucagg

SEQ ID NO: 824572 - RNA, 22 nt, Human
ucucauugguauauacaugugu

SEQ ID NO: 824573 - RNA, 22 nt, Human
ggccagcucuuguccacggagg

SEQ ID NO: 824574 - RNA, 22 nt, Human
ggaggggagucucccaaagccg

SEQ ID NO: 824575 - RNA, 22 nt, Human
uggggcucaccuaggcuggaag

SEQ ID NO: 824576 - RNA, 22 nt, Human
gcauguguuauuuuauguauga

SEQ ID NO: 824577 - RNA, 22 nt, Human
aggcuagcaaugggagaugagu

SEQ ID NO: 824578 - RNA, 22 nt, Human
uauuuccaaaagccuauuauga

SEQ ID NO: 824579 - RNA, 20 nt, Human
uaggcagcuugacccuuggu

SEQ ID NO: 824580 - RNA, 18 nt, Human
gcaggagauggguggggu

SEQ ID NO: 824581 - RNA, 22 nt, Human
ucuuccucuagaucugaggccc

SEQ ID NO: 824582 - RNA, 23 nt, Human
agaugagccaacaccuccaugcc

SEQ ID NO: 824583 - RNA, 22 nt, Human
caugcugugcaucuugaugacc

SEQ ID NO: 824584 - RNA, 22 nt, Human
ucugagaggcaucugcacuucu

SEQ ID NO: 824585 - RNA, 21 nt, Human
agcagaggggacauguuugau

SEQ ID NO: 824586 - RNA, 22 nt, Human
guugacagcuggugagcugcua

SEQ ID NO: 824587 - RNA, 22 nt, Human
gcucaggaaauaguuuaguguu

SEQ ID NO: 824588 - RNA, 22 nt, Human
cccaggaaugggaaggaggaau

SEQ ID NO: 824589 - RNA, 22 nt, Human
gaccuggaggauccucuucuug

SEQ ID NO: 824590 - RNA, 22 nt, Human
uuauuugcccauguuuagcaga

SEQ ID NO: 824591 - RNA, 22 nt, Human
gugucccaggccucuggaauua

SEQ ID NO: 824592 - RNA, 23 nt, Human
uggaggaaacacaucagaagacc

SEQ ID NO: 824593 - RNA, 22 nt, Human
ccaggagauaagcugaguuuau

SEQ ID NO: 824594 - RNA, 18 nt, Human
gucacuguguuucugagc

SEQ ID NO: 824595 - RNA, 22 nt, Human
cuguaaauaugaagaauauaug

SEQ ID NO: 824596 - RNA, 22 nt, Human
uuaaaugaggcugauguagauu

SEQ ID NO: 824597 - RNA, 22 nt, Human
uuucaugaggggcaaaaucuca

SEQ ID NO: 824598 - RNA, 22 nt, Human
agucuuuccugcuugacuguuc

SEQ ID NO: 824599 - RNA, 21 nt, Human
auucugaguugucagucuuca

SEQ ID NO: 824600 - RNA, 22 nt, Human
ggaagaggaggagccaggcuuu

SEQ ID NO: 824601 - RNA, 20 nt, Human
guggcaggcagugaaggagc

SEQ ID NO: 824602 - RNA, 22 nt, Human
ugaggcagaguaagauacauga

SEQ ID NO: 824603 - RNA, 22 nt, Human
uuccaugacaccgagggaaguc

SEQ ID NO: 824604 - RNA, 22 nt, Human
uccaugagagguaacuuuacaa

SEQ ID NO: 824605 - RNA, 23 nt, Human
accaggagccaagaucucccugg

SEQ ID NO: 824606 - RNA, 20 nt, Human
cuucuucaguaguuuguucu

SEQ ID NO: 824607 - RNA, 22 nt, Human
uucucagaggagucgggagcug

SEQ ID NO: 824608 - RNA, 22 nt, Human
cagcagaggcacgucugugaau

SEQ ID NO: 824609 - RNA, 22 nt, Human
uccaggagaggccugaccaggu

SEQ ID NO: 824610 - RNA, 22 nt, Human
ugaggcaguugagcuuccugag

SEQ ID NO: 824611 - RNA, 22 nt, Human
uccaggaguuugagacugcagu

SEQ ID NO: 824612 - RNA, 22 nt, Human
auuuccaggagaaaggauuuua

SEQ ID NO: 824613 - RNA, 22 nt, Human
cucaggauuuaaaggggcacuc

SEQ ID NO: 824614 - RNA, 22 nt, Human
uauagccauuuccaguggcauc

SEQ ID NO: 824615 - RNA, 22 nt, Human
ccaggauggggagcagauagaa

SEQ ID NO: 824616 - RNA, 22 nt, Human
uuugaaguucccccauaucaga

SEQ ID NO: 824617 - RNA, 22 nt, Human
uggcagcuccggguaggggcug

SEQ ID NO: 824618 - RNA, 22 nt, Human
uacugcaugguggaguggagcu

SEQ ID NO: 824619 - RNA, 22 nt, Human
acagugcuaaacacuucuugaa

SEQ ID NO: 824620 - RNA, 22 nt, Human
gcugcccaggagagguggggcu

SEQ ID NO: 824621 - RNA, 22 nt, Human
augcugugauuguagaaauauu

SEQ ID NO: 824622 - RNA, 18 nt, Human
cugcugugucgucugggc

SEQ ID NO: 824623 - RNA, 22 nt, Human
acacauauucauauguacuuac

SEQ ID NO: 824624 - RNA, 22 nt, Human
gcccaggacucagggugucgcg

SEQ ID NO: 824625 - RNA, 20 nt, Human
gagauggacagaugaagggg

SEQ ID NO: 824626 - RNA, 21 nt, Human
uucuucaaagaagaaggcaca

SEQ ID NO: 824627 - RNA, 22 nt, Human
ggagggaaugucuagcauucuu

SEQ ID NO: 824628 - RNA, 22 nt, Human
gcugauguuuaguugauguuac

SEQ ID NO: 824629 - RNA, 22 nt, Human
ccaugagcuucaacugacacag

SEQ ID NO: 824630 - RNA, 22 nt, Human
cauuuguaauacugacuugcag

SEQ ID NO: 824631 - RNA, 22 nt, Human
gaaggccauuuuuagguagaau

SEQ ID NO: 824632 - RNA, 22 nt, Human
aagaacuuccuaauauauuuuc

SEQ ID NO: 824633 - RNA, 22 nt, Human
ucucugaguaagugacaguuca

SEQ ID NO: 824634 - RNA, 22 nt, Human
uaaggccaauuacauauguuca

SEQ ID NO: 824635 - RNA, 20 nt, Human
ugugcaggagagugaggcug

SEQ ID NO: 824636 - RNA, 22 nt, Human
cuucuucauguauugauagucu

SEQ ID NO: 824637 - RNA, 22 nt, Human
uuaacauuguccuuagcagauu

SEQ ID NO: 824638 - RNA, 22 nt, Human
aggaaaacacaguauugaugga

SEQ ID NO: 824639 - RNA, 22 nt, Human
aggaagcuggugugaggaugaa

SEQ ID NO: 824640 - RNA, 22 nt, Human
cagcuccugggccaucuccuag

SEQ ID NO: 824641 - RNA, 22 nt, Human
ggauggcagucugcaugagaaa

SEQ ID NO: 824642 - RNA, 22 nt, Human
cugcuguguuucugcuagaaaa

SEQ ID NO: 824643 - RNA, 19 nt, Human
agggaguuuauauuugcac

SEQ ID NO: 824644 - RNA, 22 nt, Human
uuaauuaaauucaugagcauug

SEQ ID NO: 824645 - RNA, 22 nt, Human
aaaggccauuacuugcuuuuag

SEQ ID NO: 824646 - RNA, 22 nt, Human
acuugcugguggcauuuacagu

SEQ ID NO: 824647 - RNA, 22 nt, Human
uuugacauggaauaacucauuu

SEQ ID NO: 824648 - RNA, 22 nt, Human
cuacccaggcuuagagggcugg

SEQ ID NO: 824649 - RNA, 22 nt, Human
cuuaaauuuucaucuacaagaa

SEQ ID NO: 824650 - RNA, 22 nt, Human
uuucacuagaacguucuuguuu

SEQ ID NO: 824651 - RNA, 22 nt, Human
aggcaggcugcuauggaguaga

SEQ ID NO: 824652 - RNA, 22 nt, Human
aauuuccagaucagaugacuca

SEQ ID NO: 824653 - RNA, 22 nt, Human
aaaguauuugugauuuuuacca

SEQ ID NO: 824654 - RNA, 19 nt, Human
uggggcuguguuuugaccc

SEQ ID NO: 824655 - RNA, 20 nt, Human
ccagaagagaugaucaucca

SEQ ID NO: 824656 - RNA, 19 nt, Human
cccaggagucuggcugguu

SEQ ID NO: 824657 - RNA, 21 nt, Human
ucaggagagcccaucuacaaa

SEQ ID NO: 824658 - RNA, 22 nt, Human
auguuucaccagcaaauuaccu

SEQ ID NO: 824659 - RNA, 22 nt, Human
ugaggcaggaguucaggcugcg

SEQ ID NO: 824660 - RNA, 22 nt, Human
gggcagcucuuugguauccuuc

SEQ ID NO: 824661 - RNA, 22 nt, Human
uuuccagagcaugucugcucag

SEQ ID NO: 824662 - RNA, 22 nt, Human
aaggagaaaugguagaugugca

SEQ ID NO: 824663 - RNA, 22 nt, Human
cagcugccccgcuggcugacca

SEQ ID NO: 824664 - RNA, 22 nt, Human
ucaggauggcuucugcaucaaa

SEQ ID NO: 824665 - RNA, 22 nt, Human
aaauuauaggugccaccuugga

SEQ ID NO: 824666 - RNA, 21 nt, Human
cccaggaguccuauuuaaaug

SEQ ID NO: 824667 - RNA, 22 nt, Human
cagcaggaccauugaggcauca

SEQ ID NO: 824668 - RNA, 19 nt, Human
ggcagcuggacgcuguuca

SEQ ID NO: 824669 - RNA, 22 nt, Human
aucugccucuucuucauugcga

SEQ ID NO: 824670 - RNA, 22 nt, Human
uuuggaauauuaaaaugucuca

SEQ ID NO: 824671 - RNA, 22 nt, Human
uuucacauuuaggcgugaauug

SEQ ID NO: 824672 - RNA, 22 nt, Human
ggcagcuauuccaagcagcacu

SEQ ID NO: 824673 - RNA, 22 nt, Human
agccagcuguucuggggcagca

SEQ ID NO: 824674 - RNA, 22 nt, Human
uucucugaucuugcuagacuga

SEQ ID NO: 824675 - RNA, 22 nt, Human
cugcuguggaugcaggaccuca

SEQ ID NO: 824676 - RNA, 22 nt, Human
cagagacauuaagugccaugau

SEQ ID NO: 824677 - RNA, 22 nt, Human
ggaggcagaacuucccgucagu

SEQ ID NO: 824678 - RNA, 22 nt, Human
uuccaagagcuuuaauuguuga

SEQ ID NO: 824679 - RNA, 22 nt, Human
cccaggaguucgaggcuguagu

SEQ ID NO: 824680 - RNA, 22 nt, Human
ugagccugguugcagugucugg

SEQ ID NO: 824681 - RNA, 18 nt, Human
acugugugaauuagcucc

SEQ ID NO: 824682 - RNA, 22 nt, Human
ggaggcgauccugggaaacacc

SEQ ID NO: 824683 - RNA, 23 nt, Human
aggcagcuggguagcaucuuucu

SEQ ID NO: 824684 - RNA, 22 nt, Human
gaggcagccucaguggaccucg

SEQ ID NO: 824685 - RNA, 22 nt, Human
caguucuuauuuggccaguguc

SEQ ID NO: 824686 - RNA, 22 nt, Human
ggagaggagauuguggcauuuu

SEQ ID NO: 824687 - RNA, 22 nt, Human
uuugaaagggaaauaaacuccu

SEQ ID NO: 824688 - RNA, 22 nt, Human
uucaauucugcucugaucuuag

SEQ ID NO: 824689 - RNA, 22 nt, Human
gucuucuuuucagucugcuugu

SEQ ID NO: 824690 - RNA, 22 nt, Human
auugaggcagcauaguucaggg

SEQ ID NO: 824691 - RNA, 22 nt, Human
acaauacaggcuucuggacuua

SEQ ID NO: 824692 - RNA, 22 nt, Human
acagucuugagcaucagccaga

SEQ ID NO: 824693 - RNA, 22 nt, Human
aggaugaggcuggcaggucuug

SEQ ID NO: 824694 - RNA, 22 nt, Human
ccaggcugggcuacaaguugag

SEQ ID NO: 824695 - RNA, 22 nt, Human
cagaaccaggaacugauggaga

SEQ ID NO: 824696 - RNA, 22 nt, Human
ugccuguguugauuacuuuguc

SEQ ID NO: 824697 - RNA, 22 nt, Human
uuagcaucugcuguaagcuuau

SEQ ID NO: 824698 - RNA, 23 nt, Human
acuuuauugaccccaggucaguu

SEQ ID NO: 824699 - RNA, 22 nt, Human
aaaaugaugcuguaauuuggca

SEQ ID NO: 824700 - RNA, 22 nt, Human
cucuuaguaaugccaugaagca

SEQ ID NO: 824701 - RNA, 22 nt, Human
uugaacauuggcaauuucauau

SEQ ID NO: 824702 - RNA, 22 nt, Human
caggcagcaucagucugcugua

SEQ ID NO: 824703 - RNA, 22 nt, Human
uucauguguauggaacauuuuu

SEQ ID NO: 824704 - RNA, 22 nt, Human
ccagcagaggggcggagugcag

SEQ ID NO: 824705 - RNA, 22 nt, Human
ccucaggaaccacauugcugcu

SEQ ID NO: 824706 - RNA, 22 nt, Human
agacaaaugguaauuaugucua

SEQ ID NO: 824707 - RNA, 22 nt, Human
auucugauaucuuauucuagcu

SEQ ID NO: 824708 - RNA, 22 nt, Human
aaucauaauuguauacauucau

SEQ ID NO: 824709 - RNA, 22 nt, Human
gagcgauguggguauguagaag

SEQ ID NO: 824710 - RNA, 22 nt, Human
agccagcugugggcucaggcgg

SEQ ID NO: 824711 - RNA, 22 nt, Human
cagaggauucccuagugaccug

SEQ ID NO: 824712 - RNA, 22 nt, Human
uguuuuaagagcgcacuuuaua

SEQ ID NO: 824713 - RNA, 22 nt, Human
aaggcagcaggauuuggugacu

SEQ ID NO: 824714 - RNA, 22 nt, Human
agcugcccagcuaggaagaagg

SEQ ID NO: 824715 - RNA, 22 nt, Human
ucugggaacugagcuccccuag

SEQ ID NO: 824716 - RNA, 22 nt, Human
gucauucuuaacaacucaguag

SEQ ID NO: 824717 - RNA, 23 nt, Human
ucucaggacacacaugucuauca

SEQ ID NO: 824718 - RNA, 22 nt, Human
ugaugaauaaacuugagaguca

SEQ ID NO: 824719 - RNA, 22 nt, Human
ucauuuguaccauuuuuuaaga

SEQ ID NO: 824720 - RNA, 22 nt, Human
caggaaagggaugggcugccac

SEQ ID NO: 824721 - RNA, 18 nt, Human
aggcagacacuagagguc

SEQ ID NO: 824722 - RNA, 19 nt, Human
gagcgcagagggcagggga

SEQ ID NO: 824723 - RNA, 22 nt, Human
auuugcuuaucuccacaguugu

SEQ ID NO: 824724 - RNA, 22 nt, Human
agugcuuugguauagaacuauu

SEQ ID NO: 824725 - RNA, 22 nt, Human
cauuuucagcacccaucugaaa

SEQ ID NO: 824726 - RNA, 22 nt, Human
auacauacauguaugcacauac

SEQ ID NO: 824727 - RNA, 22 nt, Human
ugcacauucacuuagguauugu

SEQ ID NO: 824728 - RNA, 22 nt, Human
ucugcagguguuggaaggguca

SEQ ID NO: 824729 - RNA, 22 nt, Human
cagaguggcacucugcuggaug

SEQ ID NO: 824730 - RNA, 22 nt, Human
caagaugugccuaaucagaccu

SEQ ID NO: 824731 - RNA, 22 nt, Human
caagagagaugcagcucacuca

SEQ ID NO: 824732 - RNA, 19 nt, Human
ccaggagagcuuggagaag

SEQ ID NO: 824733 - RNA, 22 nt, Human
uugcagcuucgagucuaucugu

SEQ ID NO: 824734 - RNA, 22 nt, Human
uucuucucucauagauuaaggu

SEQ ID NO: 824735 - RNA, 22 nt, Human
uggcagcuaucuuuaaugagau

SEQ ID NO: 824736 - RNA, 22 nt, Human
gggcagcucagccaccaugcag

SEQ ID NO: 824737 - RNA, 22 nt, Human
gccaggaguucagaugcauguu

SEQ ID NO: 824738 - RNA, 23 nt, Human
acagacaacacugaugagagaaa

SEQ ID NO: 824739 - RNA, 22 nt, Human
gggaagcaggugcagcucgccu

SEQ ID NO: 824740 - RNA, 22 nt, Human
auucauaacggcaaaugucacc

SEQ ID NO: 824741 - RNA, 16 nt, Human
auuuccagauuaugca

SEQ ID NO: 824742 - RNA, 22 nt, Human
agacaguguguguauauauggu

SEQ ID NO: 824743 - RNA, 22 nt, Human
uggggcuccuccuggcaggagg

SEQ ID NO: 824744 - RNA, 23 nt, Human
uuugaaaguaucaacucgccuga

SEQ ID NO: 824745 - RNA, 19 nt, Human
agucuuucccacucgucuu

SEQ ID NO: 824746 - RNA, 22 nt, Human
acuggcaggcugcuggccggcg

SEQ ID NO: 824747 - RNA, 22 nt, Human
uuauuuaaugugaucugaagag

SEQ ID NO: 824748 - RNA, 22 nt, Human
gagagucuagugcaccuaguuu

SEQ ID NO: 824749 - RNA, 22 nt, Human
auuguucaaagugcuuugcaug

SEQ ID NO: 824750 - RNA, 22 nt, Human
agaccaugggcucugaagagca

SEQ ID NO: 824751 - RNA, 22 nt, Human
gcaggagacaacuguaaggaga

SEQ ID NO: 824752 - RNA, 22 nt, Human
cccuggaggcuggaggcaguag

SEQ ID NO: 824753 - RNA, 22 nt, Human
auucuuauuuaaauagagucug

SEQ ID NO: 824754 - RNA, 22 nt, Human
agaggggacagccaccugcccg

SEQ ID NO: 824755 - RNA, 22 nt, Human
caggauggagggagggcuguua

SEQ ID NO: 824756 - RNA, 22 nt, Human
uuccaugaaauguguuaugcuu

SEQ ID NO: 824757 - RNA, 22 nt, Human
augcugugucaccuuaggauuu

SEQ ID NO: 824758 - RNA, 22 nt, Human
uaaggccaccguuauagaacca

SEQ ID NO: 824759 - RNA, 22 nt, Human
agucucugcaugccugcugugc

SEQ ID NO: 824760 - RNA, 22 nt, Human
agcugcccuguggggaggguug

SEQ ID NO: 824761 - RNA, 22 nt, Human
accaggagggacccugguggcc

SEQ ID NO: 824762 - RNA, 22 nt, Human
guuugcauuuauuagucuucug

SEQ ID NO: 824763 - RNA, 22 nt, Human
uuucaguuuccagcuuugucau

SEQ ID NO: 824764 - RNA, 22 nt, Human
uggaguucucaggugagggcuu

SEQ ID NO: 824765 - RNA, 18 nt, Human
agggaguuuuagggaagg

SEQ ID NO: 824766 - RNA, 22 nt, Human
agaggaggcagcuuaacucagu

SEQ ID NO: 824767 - RNA, 22 nt, Human
uucuuacagaguuuacagagcc

SEQ ID NO: 824768 - RNA, 22 nt, Human
uucaggaugacaccauguccag

SEQ ID NO: 824769 - RNA, 22 nt, Human
ccucaggauacaggagccacag

SEQ ID NO: 824770 - RNA, 22 nt, Human
cauucuuauauuuacucauuca

SEQ ID NO: 824771 - RNA, 22 nt, Human
uccaggagaccagauguaggcc

SEQ ID NO: 824772 - RNA, 22 nt, Human
aggguggcuggaggaaucagaa

SEQ ID NO: 824773 - RNA, 22 nt, Human
aaggcagccuuuugaguugauu

SEQ ID NO: 824774 - RNA, 22 nt, Human
uggcuucuugggaugggucauu

SEQ ID NO: 824775 - RNA, 19 nt, Human
gaggagcuaucggagacag

SEQ ID NO: 824776 - RNA, 22 nt, Human
uuugaaagacagaauauuuuug

SEQ ID NO: 824777 - RNA, 22 nt, Human
ugcacauuaguguuugagaugc

SEQ ID NO: 824778 - RNA, 22 nt, Human
cuuaaagaaauugaggagagga

SEQ ID NO: 824779 - RNA, 22 nt, Human
ugcauguggaccccuggugccu

SEQ ID NO: 824780 - RNA, 22 nt, Human
uuucuuauacuauauugucauc

SEQ ID NO: 824781 - RNA, 22 nt, Human
ucuuugaaagcuguucuagagu

SEQ ID NO: 824782 - RNA, 22 nt, Human
ucaggagagaguuggguaggcu

SEQ ID NO: 824783 - RNA, 22 nt, Human
cagugaaaucacaacuuuaguu

SEQ ID NO: 824784 - RNA, 22 nt, Human
ugcuucagaggaaaggcaaaag

SEQ ID NO: 824785 - RNA, 22 nt, Human
uugaauaggacucagcagugau

SEQ ID NO: 824786 - RNA, 22 nt, Human
cagaggcagugggguugcuccu

SEQ ID NO: 824787 - RNA, 22 nt, Human
uacagcuaggcaaaaaugacau

SEQ ID NO: 824788 - RNA, 19 nt, Human
ugagaggcuuaaggcagcu

SEQ ID NO: 824789 - RNA, 18 nt, Human
agaggggagguaagucug

SEQ ID NO: 824790 - RNA, 22 nt, Human
caugugguucaaguacuccaca

SEQ ID NO: 824791 - RNA, 22 nt, Human
agucuucucauuucacaugcuu

SEQ ID NO: 824792 - RNA, 20 nt, Human
aggacagcagcugccacuug

SEQ ID NO: 824793 - RNA, 18 nt, Human
uugagggaggggcagagu

SEQ ID NO: 824794 - RNA, 22 nt, Human
gacccaggaagcuacuucuggu

SEQ ID NO: 824795 - RNA, 22 nt, Human
aggucagcaggccaggggcgaa

SEQ ID NO: 824796 - RNA, 22 nt, Human
uucaugugaauauauuugucuu

SEQ ID NO: 824797 - RNA, 22 nt, Human
uaauaucuacuucauagaguuu

SEQ ID NO: 824798 - RNA, 22 nt, Human
aggcaggcuggucugaagagug

SEQ ID NO: 824799 - RNA, 22 nt, Human
uuauacuaaaacgcauugaauu

SEQ ID NO: 824800 - RNA, 19 nt, Human
uucaggauugacccuacug

SEQ ID NO: 824801 - RNA, 22 nt, Human
uuuuagcacuaagugauaugcu

SEQ ID NO: 824802 - RNA, 22 nt, Human
agaaaugaagagagucaagguu

SEQ ID NO: 824803 - RNA, 22 nt, Human
uccaggagguugagugaguucc

SEQ ID NO: 824804 - RNA, 22 nt, Human
cagcugcuguuacugcuuauua

SEQ ID NO: 824805 - RNA, 22 nt, Human
ccaggcugcagucaaggggcau

SEQ ID NO: 824806 - RNA, 22 nt, Human
ugaaagguuauuuaggucugcu

SEQ ID NO: 824807 - RNA, 22 nt, Human
ugaggcagguggauuacaaggu

SEQ ID NO: 824808 - RNA, 22 nt, Human
cuagccaugggcauuaaaggua

SEQ ID NO: 824809 - RNA, 22 nt, Human
ccaggaaauggcuugcuucuuu

SEQ ID NO: 824810 - RNA, 22 nt, Human
uuugaagugggcauuagaaccu

SEQ ID NO: 824811 - RNA, 22 nt, Human
cauuuccugucuggaggucaaa

SEQ ID NO: 824812 - RNA, 18 nt, Human
gagaggagccagaauuuu

SEQ ID NO: 824813 - RNA, 18 nt, Human
ugaggcagucagugaugg

SEQ ID NO: 824814 - RNA, 20 nt, Human
cugcugugauucccuccucc

SEQ ID NO: 824815 - RNA, 22 nt, Human
auguuauaguuauaaaaugagg

SEQ ID NO: 824816 - RNA, 22 nt, Human
uggaguucauccaugacagcuu

SEQ ID NO: 824817 - RNA, 22 nt, Human
agggaggucuuugaggggcuua

SEQ ID NO: 824818 - RNA, 22 nt, Human
cauuuguagcuauuuacuguau

SEQ ID NO: 824819 - RNA, 22 nt, Human
cagcagagcugggcuuugaauu

SEQ ID NO: 824820 - RNA, 22 nt, Human
cauuuguaucugggcugcugug

SEQ ID NO: 824821 - RNA, 22 nt, Human
acucuucuugcugcucauuaau

SEQ ID NO: 824822 - RNA, 22 nt, Human
agcuucccaagguuggaagguu

SEQ ID NO: 824823 - RNA, 22 nt, Human
acccaggaugauaauguucaca

SEQ ID NO: 824824 - RNA, 22 nt, Human
cuugauguauaaguugauaugu

SEQ ID NO: 824825 - RNA, 22 nt, Human
uuagccaugugggaaaaacagc

SEQ ID NO: 824826 - RNA, 22 nt, Human
accauuuuggguauuuucagag

SEQ ID NO: 824827 - RNA, 21 nt, Human
gccaggaguagauuacauuua

SEQ ID NO: 824828 - RNA, 22 nt, Human
uccaggagugcugguuagagua

SEQ ID NO: 824829 - RNA, 22 nt, Human
aggcaggcaaccaccugggaag

SEQ ID NO: 824830 - RNA, 22 nt, Human
gggcaguuuauucuagaugguu

SEQ ID NO: 824831 - RNA, 22 nt, Human
uggucuuuaagguagcugucau

SEQ ID NO: 824832 - RNA, 22 nt, Human
uucauucuugggaucagagagu

SEQ ID NO: 824833 - RNA, 22 nt, Human
aaauauagugacacuuauaguc

SEQ ID NO: 824834 - RNA, 22 nt, Human
cccaggagguggagcuugcagu

SEQ ID NO: 824835 - RNA, 22 nt, Human
uacuuucuguccuucuguuaaa

SEQ ID NO: 824836 - RNA, 22 nt, Human
uagggcagaguccaggaugggc

SEQ ID NO: 824837 - RNA, 22 nt, Human
uuauuuaaaagugguaagauuc

SEQ ID NO: 824838 - RNA, 17 nt, Human
acagagcacaucaagau

SEQ ID NO: 824839 - RNA, 23 nt, Human
uccugaggguuucccagccuugg

SEQ ID NO: 824840 - RNA, 22 nt, Human
ucagccucucugaguccagacc

SEQ ID NO: 824841 - RNA, 22 nt, Human
gagguggugguggaggcauagc

SEQ ID NO: 824842 - RNA, 22 nt, Human
aacaugcucuguuucuuggaug

SEQ ID NO: 824843 - RNA, 20 nt, Human
agcugccccugggcacugcc

SEQ ID NO: 824844 - RNA, 17 nt, Human
agagggaaaaugcgguu

SEQ ID NO: 824845 - RNA, 22 nt, Human
gcagcugccuucagcuggaugg

SEQ ID NO: 824846 - RNA, 22 nt, Human
ugccaggauauaagagugcgau

SEQ ID NO: 824847 - RNA, 22 nt, Human
cagagggaaaaggggaguaaua

SEQ ID NO: 824848 - RNA, 22 nt, Human
ugcauguguguguauuuauaaa

SEQ ID NO: 824849 - RNA, 22 nt, Human
uuauagaaggagcauucacuua

SEQ ID NO: 824850 - RNA, 22 nt, Human
agcugcccugggcuggagaugg

SEQ ID NO: 824851 - RNA, 22 nt, Human
ugaggcagggagaguggauaug

SEQ ID NO: 824852 - RNA, 22 nt, Human
gagggagggaaaguuuaacacu

SEQ ID NO: 824853 - RNA, 22 nt, Human
aucugccugcaguggagguggg

SEQ ID NO: 824854 - RNA, 22 nt, Human
uugcugaaaacaguggguauug

SEQ ID NO: 824855 - RNA, 22 nt, Human
aggaaaggccuuugcauuuggu

SEQ ID NO: 824856 - RNA, 22 nt, Human
auauucuucuuguucagacuau

SEQ ID NO: 824857 - RNA, 22 nt, Human
agucuugcucuugcaucugcuu

SEQ ID NO: 824858 - RNA, 22 nt, Human
ucucuucuauuugagacuauuu

SEQ ID NO: 824859 - RNA, 22 nt, Human
ucugggaagcugguccuguucu

SEQ ID NO: 824860 - RNA, 22 nt, Human
ugcuuccuauccacacaaugcc

SEQ ID NO: 824861 - RNA, 17 nt, Human
uucucugagcuguauug

SEQ ID NO: 824862 - RNA, 22 nt, Human
caaauaguuuuucauguauuau

SEQ ID NO: 824863 - RNA, 22 nt, Human
gcaguucuacuuauccauagac

SEQ ID NO: 824864 - RNA, 22 nt, Human
acagagagaaacaaucagcagc

SEQ ID NO: 824865 - RNA, 22 nt, Human
uuucauggcuaggacuagagug

SEQ ID NO: 824866 - RNA, 22 nt, Human
uuuggaaugguaccuucaguug

SEQ ID NO: 824867 - RNA, 22 nt, Human
uuugaagucaggcuuucuaccc

SEQ ID NO: 824868 - RNA, 22 nt, Human
ccccaggagcuuguuuuagaga

SEQ ID NO: 824869 - RNA, 22 nt, Human
agaggggaaggaugugauguga

SEQ ID NO: 824870 - RNA, 22 nt, Human
auuucaaggcuauuaauauaaa

SEQ ID NO: 824871 - RNA, 22 nt, Human
accgaaggaaacuggaaccguu

SEQ ID NO: 824872 - RNA, 22 nt, Human
cucuucucugcagccuuugaag

SEQ ID NO: 824873 - RNA, 22 nt, Human
uucuucucggcugucagauagu

SEQ ID NO: 824874 - RNA, 23 nt, Human
cuugcagggcuggaggcuuagaa

SEQ ID NO: 824875 - RNA, 22 nt, Human
ggagcuguucaggacugcuuca

SEQ ID NO: 824876 - RNA, 23 nt, Human
ggagaggggugugggcaucuuua

SEQ ID NO: 824877 - RNA, 22 nt, Human
accaggagucuagccuagucaa

SEQ ID NO: 824878 - RNA, 22 nt, Human
uuuugcuugagugcacaaaaug

SEQ ID NO: 824879 - RNA, 22 nt, Human
ucuucuucccaucccucaaaug

SEQ ID NO: 824880 - RNA, 22 nt, Human
gcaucuaaacuugcaucauugu

SEQ ID NO: 824881 - RNA, 17 nt, Human
agaacuguaguagcucc

SEQ ID NO: 824882 - RNA, 22 nt, Human
acuaagugauucuaagcaucuu

SEQ ID NO: 824883 - RNA, 23 nt, Human
cagcccuuccugcauguuuuugu

SEQ ID NO: 824884 - RNA, 22 nt, Human
uagugcuuuaggccugaguguc

SEQ ID NO: 824885 - RNA, 22 nt, Human
uaaauuauguuccauguccuuu

SEQ ID NO: 824886 - RNA, 22 nt, Human
aucuacccacugaacacaauau

SEQ ID NO: 824887 - RNA, 22 nt, Human
aaacugcugguugcuggccagc

SEQ ID NO: 824888 - RNA, 22 nt, Human
gacuucuauuaauaccucuacu

SEQ ID NO: 824889 - RNA, 22 nt, Human
cugcuuugauuagaagaguaca

SEQ ID NO: 824890 - RNA, 22 nt, Human
ugaaagguagcuggccucauag

SEQ ID NO: 824891 - RNA, 23 nt, Human
gugagucuugccuuugcugugga

SEQ ID NO: 824892 - RNA, 22 nt, Human
aaggcagccagauccuuugggu

SEQ ID NO: 824893 - RNA, 22 nt, Human
uuuucagaggccuaagagguuu

SEQ ID NO: 824894 - RNA, 22 nt, Human
aauuuccagaccccauccacag

SEQ ID NO: 824895 - RNA, 22 nt, Human
aaauguuucuacuugugagcau

SEQ ID NO: 824896 - RNA, 22 nt, Human
ccagcagagcauggggaggaag

SEQ ID NO: 824897 - RNA, 20 nt, Human
uuucugugagaaacacuguu

SEQ ID NO: 824898 - RNA, 23 nt, Human
uggcaaggaaugggauggagacu

SEQ ID NO: 824899 - RNA, 22 nt, Human
gcuccuucaggugguagcuguu

SEQ ID NO: 824900 - RNA, 22 nt, Human
ucccaggaucugagggcagaga

SEQ ID NO: 824901 - RNA, 22 nt, Human
gggcagcugucuugguucucaa

SEQ ID NO: 824902 - RNA, 23 nt, Human
uuucaaauuacucugcagaugac

SEQ ID NO: 824903 - RNA, 22 nt, Human
cauuuguaguaucuguuuauau

SEQ ID NO: 824904 - RNA, 22 nt, Human
augcuuccaaggcuaagacaag

SEQ ID NO: 824905 - RNA, 20 nt, Human
auaaaauaacugccacaaga

SEQ ID NO: 824906 - RNA, 22 nt, Human
aucacuguguauguauaugcag

SEQ ID NO: 824907 - RNA, 22 nt, Human
uacugccuggagcauuggugcu

SEQ ID NO: 824908 - RNA, 22 nt, Human
uucuuuugggaauuacguaugc

SEQ ID NO: 824909 - RNA, 22 nt, Human
uugcauuuccuguacuguuuga

SEQ ID NO: 824910 - RNA, 22 nt, Human
ugaaaugaaugugauucgauag

SEQ ID NO: 824911 - RNA, 22 nt, Human
cuucugagcagaccuccugggg

SEQ ID NO: 824912 - RNA, 22 nt, Human
uucaggaugcucagaguagucu

SEQ ID NO: 824913 - RNA, 22 nt, Human
uaaggccaauuaacaaccaggg

SEQ ID NO: 824914 - RNA, 22 nt, Human
auuaucuauguagaaugauuuu

SEQ ID NO: 824915 - RNA, 22 nt, Human
aggaagcuccuggagagccagu

SEQ ID NO: 824916 - RNA, 22 nt, Human
ggguacuuaauauuuacggggu

SEQ ID NO: 824917 - RNA, 22 nt, Human
ucuuuguaacugucuauugaga

SEQ ID NO: 824918 - RNA, 22 nt, Human
aguaaaaauugaggugcaaaau

SEQ ID NO: 824919 - RNA, 22 nt, Human
caguuucuauggcugggcucug

SEQ ID NO: 824920 - RNA, 22 nt, Human
agagugucugguagcugcucug

SEQ ID NO: 824921 - RNA, 22 nt, Human
gaagcagcaaguauaggacagg

SEQ ID NO: 824922 - RNA, 22 nt, Human
aagcagcuuuugaagagugagg

SEQ ID NO: 824923 - RNA, 22 nt, Human
uggaaauguauuugggcaugcc

SEQ ID NO: 824924 - RNA, 22 nt, Human
ugaaaugacagucuuaagcucu

SEQ ID NO: 824925 - RNA, 22 nt, Human
cucacuguuuaauagcuggauc

SEQ ID NO: 824926 - RNA, 23 nt, Human
uacaugcuauaauuucacccuca

SEQ ID NO: 824927 - RNA, 22 nt, Human
cccaggagguguagcugcgugg

SEQ ID NO: 824928 - RNA, 22 nt, Human
aggaaacuccccuacaucucaa

SEQ ID NO: 824929 - RNA, 22 nt, Human
aaugauuuccccuacacagaag

SEQ ID NO: 824930 - RNA, 22 nt, Human
uaucuguuguaguacagaugau

SEQ ID NO: 824931 - RNA, 20 nt, Human
aggaggcauagucuggaaag

SEQ ID NO: 824932 - RNA, 22 nt, Human
acccaggauagagugcugcagu

SEQ ID NO: 824933 - RNA, 19 nt, Human
uuagccauccacagugaaa

SEQ ID NO: 824934 - RNA, 22 nt, Human
agcagagccugggcuaggggug

SEQ ID NO: 824935 - RNA, 22 nt, Human
ccaggagaugauguuggggauu

SEQ ID NO: 824936 - RNA, 22 nt, Human
cccaggaaaagcagugccagca

SEQ ID NO: 824937 - RNA, 22 nt, Human
uagcucuucaaucacugucucc

SEQ ID NO: 824938 - RNA, 22 nt, Human
ucuucagauggccaguuguccc

SEQ ID NO: 824939 - RNA, 22 nt, Human
aggacagcaguuggugagguuc

SEQ ID NO: 824940 - RNA, 22 nt, Human
uacaucauaauaauacuuagaa

SEQ ID NO: 824941 - RNA, 22 nt, Human
ugccuggauucgguuguuguca

SEQ ID NO: 824942 - RNA, 22 nt, Human
cucacuguccaacaggcuuuac

SEQ ID NO: 824943 - RNA, 21 nt, Human
acagacagggccagugucccc

SEQ ID NO: 824944 - RNA, 22 nt, Human
cuggcaaguacugggccagcuc

SEQ ID NO: 824945 - RNA, 22 nt, Human
gagaggaguagacacuuugguu

SEQ ID NO: 824946 - RNA, 22 nt, Human
gaggaaccacucugagaagcca

SEQ ID NO: 824947 - RNA, 22 nt, Human
uccacauccauugcuugacuuu

SEQ ID NO: 824948 - RNA, 21 nt, Human
ucuugaaaauuguagcaguuu

SEQ ID NO: 824949 - RNA, 22 nt, Human
cagcugugaauugucuuaucua

SEQ ID NO: 824950 - RNA, 22 nt, Human
aagauggagcacgagcagaagc

SEQ ID NO: 824951 - RNA, 22 nt, Human
ucucugguuauuaacuaacucc

SEQ ID NO: 824952 - RNA, 21 nt, Human
cucaggaucuuauauauuagu

SEQ ID NO: 824953 - RNA, 22 nt, Human
cauuuuaaaugauuuaagccaa

SEQ ID NO: 824954 - RNA, 22 nt, Human
cugagacuuucaugugcuuuua

SEQ ID NO: 824955 - RNA, 22 nt, Human
uuggcagugaugcagcuuguuc

SEQ ID NO: 824956 - RNA, 22 nt, Human
gucugucucccugugacugaga

SEQ ID NO: 824957 - RNA, 22 nt, Human
ucaggagacuggcagugcccac

SEQ ID NO: 824958 - RNA, 22 nt, Human
guguguuuagcauuagcagggg

SEQ ID NO: 824959 - RNA, 22 nt, Human
gaaauaagaguccaugccaggu

SEQ ID NO: 824960 - RNA, 22 nt, Human
gaucuucuagcagaaguaauuu

SEQ ID NO: 824961 - RNA, 22 nt, Human
guccaugauucugugacacccu

SEQ ID NO: 824962 - RNA, 22 nt, Human
agagcagcugugacauggacag

SEQ ID NO: 824963 - RNA, 22 nt, Human
gaggcugccccuuccucagcug

SEQ ID NO: 824964 - RNA, 22 nt, Human
cuucagagugcagaagauuggg

SEQ ID NO: 824965 - RNA, 22 nt, Human
uaugauuuguagacauuugauu

SEQ ID NO: 824966 - RNA, 22 nt, Human
uuugaaaguguuuacuugggaa

SEQ ID NO: 824967 - RNA, 22 nt, Human
aaguauaagcuauucuucauga

SEQ ID NO: 824968 - RNA, 22 nt, Human
ccuugcugaccaucaccuuuga

SEQ ID NO: 824969 - RNA, 22 nt, Human
uugcauuucccauugaguaaug

SEQ ID NO: 824970 - RNA, 22 nt, Human
ccauggcaauggucagucuauu

SEQ ID NO: 824971 - RNA, 22 nt, Human
agcuggcaguaugacuggugac

SEQ ID NO: 824972 - RNA, 22 nt, Human
ugugaaggagaugaagggagug

SEQ ID NO: 824973 - RNA, 22 nt, Human
ugucucugggugauucaguccu

SEQ ID NO: 824974 - RNA, 22 nt, Human
guccucugaaguugugcaaugc

SEQ ID NO: 824975 - RNA, 22 nt, Human
agcugcccagauaggaggaggc

SEQ ID NO: 824976 - RNA, 22 nt, Human
ucugcugugauuugcuaccugu

SEQ ID NO: 824977 - RNA, 22 nt, Human
cuuaacauccugcauuuuucuu

SEQ ID NO: 824978 - RNA, 22 nt, Human
cuucagaauccagaaucagaau

SEQ ID NO: 824979 - RNA, 22 nt, Human
uggcaggcagugugggagcugg

SEQ ID NO: 824980 - RNA, 22 nt, Human
ucauuuguucucauucucuacu

SEQ ID NO: 824981 - RNA, 22 nt, Human
uaaaugaagaaauggagauugu

SEQ ID NO: 824982 - RNA, 22 nt, Human
cuacuucuaaguacauggugau

SEQ ID NO: 824983 - RNA, 22 nt, Human
caggauggugugagugugagga

SEQ ID NO: 824984 - RNA, 22 nt, Human
gaggcagcgggucaggaccgug

SEQ ID NO: 824985 - RNA, 22 nt, Human
gcccaggauggagaauaguggu

SEQ ID NO: 824986 - RNA, 22 nt, Human
uucccaugccuggccccuaucc

SEQ ID NO: 824987 - RNA, 22 nt, Human
ugaguucucacccauucuucuu

SEQ ID NO: 824988 - RNA, 22 nt, Human
aucugccuggcuccaggugagc

SEQ ID NO: 824989 - RNA, 22 nt, Human
aggcaggcccucuggaaaggua

SEQ ID NO: 824990 - RNA, 22 nt, Human
uggagaggaaagugcaguuuug

SEQ ID NO: 824991 - RNA, 22 nt, Human
ugguuuugcuaaaauagaaaga

SEQ ID NO: 824992 - RNA, 22 nt, Human
cccaggaaagagacugcugggu

SEQ ID NO: 824993 - RNA, 22 nt, Human
ucacacagguuugcaaugauuu

SEQ ID NO: 824994 - RNA, 22 nt, Human
gccaggagacuccauucauuug

SEQ ID NO: 824995 - RNA, 22 nt, Human
cagcuguggcugccacugcucc

SEQ ID NO: 824996 - RNA, 22 nt, Human
uuuuuguagucauuagaagagg

SEQ ID NO: 824997 - RNA, 22 nt, Human
ugccaggauggccagggggcca

SEQ ID NO: 824998 - RNA, 22 nt, Human
aagauuauggcagauaacaauu

SEQ ID NO: 824999 - RNA, 23 nt, Human
gggcagcuuaagcuuguuuuucu

SEQ ID NO: 825000 - RNA, 22 nt, Human
ugaggcaggaguuaaugugcuc

SEQ ID NO: 825001 - RNA, 22 nt, Human
aggguagguguaagauagcccu

SEQ ID NO: 825002 - RNA, 22 nt, Human
guugaaagaugucuugguuccc

SEQ ID NO: 825003 - RNA, 19 nt, Human
ugcauaaauuauauacuuu

SEQ ID NO: 825004 - RNA, 22 nt, Human
aaauguauugcauaggauauuu

SEQ ID NO: 825005 - RNA, 22 nt, Human
ggaggcugagaaguccaagauc

SEQ ID NO: 825006 - RNA, 22 nt, Human
ccaggagagcgcccucccggcc

SEQ ID NO: 825007 - RNA, 22 nt, Human
ucauuuauaaggaugcaauuaa

SEQ ID NO: 825008 - RNA, 22 nt, Human
uguugauuaguguuuagacuua

SEQ ID NO: 825009 - RNA, 22 nt, Human
gaggccagaguuccccgaguca

SEQ ID NO: 825010 - RNA, 22 nt, Human
cuuagcaugugguguccuugua

SEQ ID NO: 825011 - RNA, 22 nt, Human
ucacugcucuccaauguggagu

SEQ ID NO: 825012 - RNA, 22 nt, Human
uggcagcuagauaguguguuua

SEQ ID NO: 825013 - RNA, 22 nt, Human
gaggcugcuuugaugacaggag

SEQ ID NO: 825014 - RNA, 22 nt, Human
uaauuauucuagucacauagca

SEQ ID NO: 825015 - RNA, 22 nt, Human
ucaauucaacacaugcacauug

SEQ ID NO: 825016 - RNA, 22 nt, Human
uucaucaauguguuuaauaaug

SEQ ID NO: 825017 - RNA, 21 nt, Human
ugcuggaaaaagugguucuag

SEQ ID NO: 825018 - RNA, 22 nt, Human
ugccgcagugcggggagggccc

SEQ ID NO: 825019 - RNA, 23 nt, Human
uaauucacauauacauugcuuca

SEQ ID NO: 825020 - RNA, 22 nt, Human
aggagggagaugcccauccugg

SEQ ID NO: 825021 - RNA, 22 nt, Human
aggagagcuggugucuggaauc

SEQ ID NO: 825022 - RNA, 22 nt, Human
ccugcugugaccggggagcagg

SEQ ID NO: 825023 - RNA, 22 nt, Human
gagaggcaggcgcugcaauggu

SEQ ID NO: 825024 - RNA, 22 nt, Human
uucugggagagaaagggccuug

SEQ ID NO: 825025 - RNA, 22 nt, Human
ggcagaggaaggaugaauucac

SEQ ID NO: 825026 - RNA, 22 nt, Human
ugaggggaacugaugcccauug

SEQ ID NO: 825027 - RNA, 20 nt, Human
uuucaagucagcaauucuca

SEQ ID NO: 825028 - RNA, 22 nt, Human
cagcagagaccaagugauuuga

SEQ ID NO: 825029 - RNA, 22 nt, Human
aagcagaggaccgacggaggga

SEQ ID NO: 825030 - RNA, 22 nt, Human
acacuaaugagaaaggaauuaa

SEQ ID NO: 825031 - RNA, 22 nt, Human
aguucuucauaaccuuacugug

SEQ ID NO: 825032 - RNA, 22 nt, Human
ucauucuuuaccaaguugucac

SEQ ID NO: 825033 - RNA, 22 nt, Human
uggcagcucauuuggaaaugga

SEQ ID NO: 825034 - RNA, 22 nt, Human
caaggccacuccagagacuggu

SEQ ID NO: 825035 - RNA, 22 nt, Human
agcagagguguuuauuauggga

SEQ ID NO: 825036 - RNA, 22 nt, Human
uucaacuaauguuuauuuuaug

SEQ ID NO: 825037 - RNA, 20 nt, Human
uggcaucucucaauuguagg

SEQ ID NO: 825038 - RNA, 22 nt, Human
accaggagcauuuuuuauuagu

SEQ ID NO: 825039 - RNA, 22 nt, Human
uugaaguuguaguucagugaag

SEQ ID NO: 825040 - RNA, 22 nt, Human
aauggccagcugggagaguuga

SEQ ID NO: 825041 - RNA, 22 nt, Human
ucaccgccuugcccggccgggc

SEQ ID NO: 825042 - RNA, 19 nt, Human
caagugaagccugggaugg

SEQ ID NO: 825043 - RNA, 22 nt, Human
ugcucccagggacucuggcugg

SEQ ID NO: 825044 - RNA, 22 nt, Human
ugagagggcccagagcacacca

SEQ ID NO: 825045 - RNA, 22 nt, Human
cuucuucaucuguaaaacuugg

SEQ ID NO: 825046 - RNA, 22 nt, Human
cugacuguaauucuguucuuaa

SEQ ID NO: 825047 - RNA, 22 nt, Human
aggcacagcacaccuggccccc

SEQ ID NO: 825048 - RNA, 22 nt, Human
gcuuuggaugugugccugaggu

SEQ ID NO: 825049 - RNA, 20 nt, Human
uauuuguauuugggaaaguu

SEQ ID NO: 825050 - RNA, 17 nt, Human
uuucuccuuccaucuca

SEQ ID NO: 825051 - RNA, 22 nt, Human
gugcagcugcaggagucagguc

SEQ ID NO: 825052 - RNA, 22 nt, Human
uucugaaagccaauucauugaa

SEQ ID NO: 825053 - RNA, 22 nt, Human
uuuguuaaauauuuauugagug

SEQ ID NO: 825054 - RNA, 22 nt, Human
cucuucuuauggccguggcuga

SEQ ID NO: 825055 - RNA, 22 nt, Human
agcugaaagugcuuugaggacu

SEQ ID NO: 825056 - RNA, 22 nt, Human
caaggccagggaauuuuucugg

SEQ ID NO: 825057 - RNA, 22 nt, Human
uguucuuuggcuucacagcucu

SEQ ID NO: 825058 - RNA, 22 nt, Human
ugaaggccagcucuuuaucagc

SEQ ID NO: 825059 - RNA, 22 nt, Human
aggaagcugccugggaugggaa

SEQ ID NO: 825060 - RNA, 22 nt, Human
aggaugagccgcgcaagcugac

SEQ ID NO: 825061 - RNA, 22 nt, Human
cauuucacaaauggccacauca

SEQ ID NO: 825062 - RNA, 22 nt, Human
gaagcagcuuucuggugaggag

SEQ ID NO: 825063 - RNA, 22 nt, Human
gagggaggcaucaugaauccag

SEQ ID NO: 825064 - RNA, 21 nt, Human
ucugagagcaacugcccuuua

SEQ ID NO: 825065 - RNA, 22 nt, Human
cuggcuugcagcucaucauaaa

SEQ ID NO: 825066 - RNA, 22 nt, Human
ugcaggaacugggagggauagu

SEQ ID NO: 825067 - RNA, 22 nt, Human
ggagguggcagggaacauaauu

SEQ ID NO: 825068 - RNA, 21 nt, Human
gacaaagugaagcaggcagga

SEQ ID NO: 825069 - RNA, 22 nt, Human
gaggcagcugggcuggugguuu

SEQ ID NO: 825070 - RNA, 22 nt, Human
auugcuguaaauuaucuuauua

SEQ ID NO: 825071 - RNA, 22 nt, Human
agucugucugucacuucugcag

SEQ ID NO: 825072 - RNA, 19 nt, Human
aucugccuguuaucacaua

SEQ ID NO: 825073 - RNA, 22 nt, Human
ggcagaggagcuggaaacaugg

SEQ ID NO: 825074 - RNA, 22 nt, Human
uauuucagggagaauaaauuug

SEQ ID NO: 825075 - RNA, 21 nt, Human
uccuuccuugagguccuuucc

SEQ ID NO: 825076 - RNA, 22 nt, Human
uucugagguccaugcaguacug

SEQ ID NO: 825077 - RNA, 17 nt, Human
gagacagcaggagcccc

SEQ ID NO: 825078 - RNA, 22 nt, Human
cugcccaggaaggagaggaugg

SEQ ID NO: 825079 - RNA, 22 nt, Human
acauaccauacauggugagaug

SEQ ID NO: 825080 - RNA, 22 nt, Human
uagugcuuaauaaauuucagaa

SEQ ID NO: 825081 - RNA, 22 nt, Human
ggaggacacuggcucugccuuc

SEQ ID NO: 825082 - RNA, 22 nt, Human
auuucauugaaguuaauucuuc

SEQ ID NO: 825083 - RNA, 20 nt, Human
gaguuccccauuucuccugg

SEQ ID NO: 825084 - RNA, 22 nt, Human
uucucuuuucaccaguugcuaa

SEQ ID NO: 825085 - RNA, 22 nt, Human
cugcugugcuuguggccacccg

SEQ ID NO: 825086 - RNA, 22 nt, Human
aggcagacaaggucccuggucu

SEQ ID NO: 825087 - RNA, 22 nt, Human
ucauuuguugcuguuaccugag

SEQ ID NO: 825088 - RNA, 22 nt, Human
acuggcagagacccugauggcc

SEQ ID NO: 825089 - RNA, 22 nt, Human
gcuuuggagccuguguucugcc

SEQ ID NO: 825090 - RNA, 22 nt, Human
aguucuuuugugaacauaugcu

SEQ ID NO: 825091 - RNA, 17 nt, Human
caggcagacauguaagc

SEQ ID NO: 825092 - RNA, 22 nt, Human
caucaucaaaacaaauggaguc

SEQ ID NO: 825093 - RNA, 22 nt, Human
uugauguacagaauuguucaca

SEQ ID NO: 825094 - RNA, 19 nt, Human
ggcagucucaagcagcaca

SEQ ID NO: 825095 - RNA, 22 nt, Human
gcagaagucagaccaucugaau

SEQ ID NO: 825096 - RNA, 22 nt, Human
uuagccauugucagcacauggc

SEQ ID NO: 825097 - RNA, 22 nt, Human
cauuuccacuucugaaaacugg

SEQ ID NO: 825098 - RNA, 19 nt, Human
uggagacugagagugagca

SEQ ID NO: 825099 - RNA, 22 nt, Human
uggcaucucaaacaggcagauu

SEQ ID NO: 825100 - RNA, 22 nt, Human
auuuggcaacauuaauugaauc

SEQ ID NO: 825101 - RNA, 22 nt, Human
ucauuucaaugauacuacuaag

SEQ ID NO: 825102 - RNA, 22 nt, Human
aagcaccugcaguugacaaaaa

SEQ ID NO: 825103 - RNA, 20 nt, Human
aagagaggaaguuauacuag

SEQ ID NO: 825104 - RNA, 22 nt, Human
auuucagaugaccaaauggaaa

SEQ ID NO: 825105 - RNA, 22 nt, Human
aagaagagaaaugugcugcugg

SEQ ID NO: 825106 - RNA, 22 nt, Human
agaggagugggaagcagugcaa

SEQ ID NO: 825107 - RNA, 22 nt, Human
caaauaguaugagcaaugauuc

SEQ ID NO: 825108 - RNA, 22 nt, Human
caggcagcucgaugccuuguug

SEQ ID NO: 825109 - RNA, 22 nt, Human
guuauaaaaugcacaguuguuu

SEQ ID NO: 825110 - RNA, 22 nt, Human
cagcugcaguucaaugcuugcu

SEQ ID NO: 825111 - RNA, 23 nt, Human
uucauuugucuacuucacuuguu

SEQ ID NO: 825112 - RNA, 23 nt, Human
uagggcagcugggagggacaugc

SEQ ID NO: 825113 - RNA, 22 nt, Human
ccucuucuagguuucagccugc

SEQ ID NO: 825114 - RNA, 20 nt, Human
cccagugaagcauggaagag

SEQ ID NO: 825115 - RNA, 21 nt, Human
ucacaucuauguuaagcaaac

SEQ ID NO: 825116 - RNA, 22 nt, Human
gcugugcuugggaagaaucucu

SEQ ID NO: 825117 - RNA, 22 nt, Human
aacaucuacuaagugccaggca

SEQ ID NO: 825118 - RNA, 22 nt, Human
uuacaagcagcuacauaucaca

SEQ ID NO: 825119 - RNA, 22 nt, Human
aggcagcaugggcccagagucc

SEQ ID NO: 825120 - RNA, 22 nt, Human
cagucccuaguggagcucacag

SEQ ID NO: 825121 - RNA, 19 nt, Human
cauuuuaagcauccccagu

SEQ ID NO: 825122 - RNA, 22 nt, Human
aaaggccacuugaaggauuuuu

SEQ ID NO: 825123 - RNA, 22 nt, Human
auguuuuugagauacaaacaga

SEQ ID NO: 825124 - RNA, 22 nt, Human
augcaucuauucccaagggcag

SEQ ID NO: 825125 - RNA, 22 nt, Human
ugcuuggcuuucugagcuucug

SEQ ID NO: 825126 - RNA, 22 nt, Human
ucuucucuacaccagcagcccc

SEQ ID NO: 825127 - RNA, 22 nt, Human
caggcagcugcuggguucagcc

SEQ ID NO: 825128 - RNA, 21 nt, Human
gauuugcagaaacuagacagg

SEQ ID NO: 825129 - RNA, 22 nt, Human
auucaaauuaaguuaauucagc

SEQ ID NO: 825130 - RNA, 22 nt, Human
caggaugagguagaggcagaua

SEQ ID NO: 825131 - RNA, 22 nt, Human
gccaggagagcuccuucagguu

SEQ ID NO: 825132 - RNA, 22 nt, Human
ugaggcaggaauggggaaaagu

SEQ ID NO: 825133 - RNA, 22 nt, Human
uuacuuuggguccugcuuauaa

SEQ ID NO: 825134 - RNA, 22 nt, Human
agucucugggcaugguugugac

SEQ ID NO: 825135 - RNA, 22 nt, Human
aggagaggucucccuuccccag

SEQ ID NO: 825136 - RNA, 17 nt, Human
ugaaggccaugaccacg

SEQ ID NO: 825137 - RNA, 22 nt, Human
ugaggcagggaguuuaauuguc

SEQ ID NO: 825138 - RNA, 22 nt, Human
cugcuguguugccagugucacc

SEQ ID NO: 825139 - RNA, 22 nt, Human
gagggagggccaggucccaacc

SEQ ID NO: 825140 - RNA, 22 nt, Human
ccaagaugaucuuuacaguguu

SEQ ID NO: 825141 - RNA, 19 nt, Human
uuugcagugguuccuuugu

SEQ ID NO: 825142 - RNA, 22 nt, Human
cucaggauauugggcuggagca

SEQ ID NO: 825143 - RNA, 22 nt, Human
uugaauaguuuuggauagcaua

SEQ ID NO: 825144 - RNA, 20 nt, Human
guugaaaguaauaugaugcu

SEQ ID NO: 825145 - RNA, 22 nt, Human
gagccaggggucagcuccgagg

SEQ ID NO: 825146 - RNA, 23 nt, Human
cuugcaggaagcagauggcacac

SEQ ID NO: 825147 - RNA, 22 nt, Human
gaugccuccaaaugagggcaga

SEQ ID NO: 825148 - RNA, 22 nt, Human
gcccaggaguugguggcugcag

SEQ ID NO: 825149 - RNA, 22 nt, Human
aucauucugauggucaaugcua

SEQ ID NO: 825150 - RNA, 22 nt, Human
agcugcccuuuaugaugcugaa

SEQ ID NO: 825151 - RNA, 22 nt, Human
gaggcagcaaaauauaucauaa

SEQ ID NO: 825152 - RNA, 22 nt, Human
aucacauuguuagcauagacug

SEQ ID NO: 825153 - RNA, 22 nt, Human
gcuccucuauuccccacauuuu

SEQ ID NO: 825154 - RNA, 22 nt, Human
aaucuguucuacucuauucaga

SEQ ID NO: 825155 - RNA, 22 nt, Human
gcuguggucugugagcuccaaa

SEQ ID NO: 825156 - RNA, 22 nt, Human
uugaaaggugaacaugaugcac

SEQ ID NO: 825157 - RNA, 22 nt, Human
cuaauacacccuauugcuuguu

SEQ ID NO: 825158 - RNA, 23 nt, Human
uccaggagcaugcuggcuggcga

SEQ ID NO: 825159 - RNA, 22 nt, Human
ugaguuuuuucaacauaugaag

SEQ ID NO: 825160 - RNA, 22 nt, Human
uucacauuggugauauguuucu

SEQ ID NO: 825161 - RNA, 22 nt, Human
uuucuagggcucuugucuucug

SEQ ID NO: 825162 - RNA, 22 nt, Human
ccugcuguaaugugucuuuauu

SEQ ID NO: 825163 - RNA, 22 nt, Human
gcccaggaguucaagucuagug

SEQ ID NO: 825164 - RNA, 20 nt, Human
auccaugagagucuggauuc

SEQ ID NO: 825165 - RNA, 22 nt, Human
aacugcuguggccuaguacuua

SEQ ID NO: 825166 - RNA, 22 nt, Human
ccaggagaaugggauuacccua

SEQ ID NO: 825167 - RNA, 22 nt, Human
acccaggacuuggcaaccucau

SEQ ID NO: 825168 - RNA, 22 nt, Human
aacaguaaagacagaauuuauc

SEQ ID NO: 825169 - RNA, 22 nt, Human
cagggaggaugggcuguuuugc

SEQ ID NO: 825170 - RNA, 22 nt, Human
augcuguggggagugaggguag

SEQ ID NO: 825171 - RNA, 22 nt, Human
ugaggcagauauuuauuggguu

SEQ ID NO: 825172 - RNA, 22 nt, Human
ucacaguaucacacaaggauua

SEQ ID NO: 825173 - RNA, 22 nt, Human
aagggaggaggauuuauuguac

SEQ ID NO: 825174 - RNA, 22 nt, Human
gacagugcauuuccuggcaugg

SEQ ID NO: 825175 - RNA, 22 nt, Human
auaguuugaaggcuguucuacu

SEQ ID NO: 825176 - RNA, 23 nt, Human
gugcugugagccccuuggccucc

SEQ ID NO: 825177 - RNA, 22 nt, Human
uuuauauuucccaggauuggcc

SEQ ID NO: 825178 - RNA, 22 nt, Human
ccacugaggcaggcaguaucua

SEQ ID NO: 825179 - RNA, 22 nt, Human
auuuucaucauggguuuaacau

SEQ ID NO: 825180 - RNA, 22 nt, Human
ucuuuggaucccaacuggcugg

SEQ ID NO: 825181 - RNA, 22 nt, Human
aguuucuuuagauagaaaguuc

SEQ ID NO: 825182 - RNA, 22 nt, Human
uagcuguguaagcuugguaaga

SEQ ID NO: 825183 - RNA, 22 nt, Human
cccagcaguaaccaguggaaau

SEQ ID NO: 825184 - RNA, 18 nt, Human
cucaccauucugcccaau

SEQ ID NO: 825185 - RNA, 22 nt, Human
cugcugucauagccaucccucc

SEQ ID NO: 825186 - RNA, 20 nt, Human
agaggccaguuaggagucua

SEQ ID NO: 825187 - RNA, 22 nt, Human
ucaggauaaaauguaauggcaa

SEQ ID NO: 825188 - RNA, 22 nt, Human
cugcugugagugguucuugccu

SEQ ID NO: 825189 - RNA, 22 nt, Human
cccaggaacagcacagaacagc

SEQ ID NO: 825190 - RNA, 22 nt, Human
uuuguagaggguaauugacaga

SEQ ID NO: 825191 - RNA, 22 nt, Human
agcugcccuuaauaggcauuca

SEQ ID NO: 825192 - RNA, 22 nt, Human
uauuauuaaauggcagaauuuu

SEQ ID NO: 825193 - RNA, 22 nt, Human
ggauggagguucucagaugcuc

SEQ ID NO: 825194 - RNA, 22 nt, Human
gacccaggcccaaggcugccag

SEQ ID NO: 825195 - RNA, 23 nt, Human
aaggccagaauuucaauggugcc

SEQ ID NO: 825196 - RNA, 22 nt, Human
agaggccacuuugccugugaug

SEQ ID NO: 825197 - RNA, 22 nt, Human
cgucuuccucuuacgaugcgcu

SEQ ID NO: 825198 - RNA, 22 nt, Human
cgccucagccguggucaucuuc

SEQ ID NO: 825199 - RNA, 22 nt, Human
ucaggagaguguucaguggagg

SEQ ID NO: 825200 - RNA, 22 nt, Human
caguggagagacuuuuacucuu

SEQ ID NO: 825201 - RNA, 22 nt, Human
ucccaggaaaacacucgaggac

SEQ ID NO: 825202 - RNA, 22 nt, Human
aaaauauuuuagggccaggaga

SEQ ID NO: 825203 - RNA, 22 nt, Human
ugcauuuccagauuucuggagu

SEQ ID NO: 825204 - RNA, 19 nt, Human
ugaguucugugguucucaa

SEQ ID NO: 825205 - RNA, 22 nt, Human
ugggagcccaagggagcugccg

SEQ ID NO: 825206 - RNA, 22 nt, Human
cucccaggguagggagagacua

SEQ ID NO: 825207 - RNA, 22 nt, Human
gguggagcuggaccaggagagg

SEQ ID NO: 825208 - RNA, 22 nt, Human
uuauucuuuucuccagaauccc

SEQ ID NO: 825209 - RNA, 22 nt, Human
ucccaggaugugcgugccgccg

SEQ ID NO: 825210 - RNA, 22 nt, Human
caggaugagaggcccagggaag

SEQ ID NO: 825211 - RNA, 22 nt, Human
cucuccucugaaguggugaccc

SEQ ID NO: 825212 - RNA, 22 nt, Human
agaggggaguccuaaucugauu

SEQ ID NO: 825213 - RNA, 22 nt, Human
agaccauggccauccuaggaaa

SEQ ID NO: 825214 - RNA, 15 nt, Human
caggagaggaagguu

SEQ ID NO: 825215 - RNA, 22 nt, Human
auugaaagauauacuguucuca

SEQ ID NO: 825216 - RNA, 22 nt, Human
uuugaaagucaaccuuccaguu

SEQ ID NO: 825217 - RNA, 22 nt, Human
uaggcagcuuagguuagaagug

SEQ ID NO: 825218 - RNA, 22 nt, Human
ucuuugaacuuggcugaucucu

SEQ ID NO: 825219 - RNA, 22 nt, Human
aucuuguuauaagagauaaugg

SEQ ID NO: 825220 - RNA, 22 nt, Human
aucaggauggguuuggcuuagg

SEQ ID NO: 825221 - RNA, 22 nt, Human
uuuuccagauuggacuuagucc

SEQ ID NO: 825222 - RNA, 22 nt, Human
cauuuguaucauauguaucuua

SEQ ID NO: 825223 - RNA, 22 nt, Human
ccaggagacccagggaaggagc

SEQ ID NO: 825224 - RNA, 22 nt, Human
gcagcugccccgacugugaguc

SEQ ID NO: 825225 - RNA, 22 nt, Human
ucuucagacccuuagcugugau

SEQ ID NO: 825226 - RNA, 22 nt, Human
aagggcagccugacucacgguc

SEQ ID NO: 825227 - RNA, 20 nt, Human
cccagguaggugccaugagu

SEQ ID NO: 825228 - RNA, 22 nt, Human
gugguuuugccauuacaaguaa

SEQ ID NO: 825229 - RNA, 22 nt, Human
ccucaugguacuuacuguagcu

SEQ ID NO: 825230 - RNA, 22 nt, Human
gauugaaacauaggcagucgag

SEQ ID NO: 825231 - RNA, 22 nt, Human
ugaggcagcuuuuucugugugu

SEQ ID NO: 825232 - RNA, 20 nt, Human
aagcacauuucuacaauaau

SEQ ID NO: 825233 - RNA, 22 nt, Human
cagaggcagccgggggagaacg

SEQ ID NO: 825234 - RNA, 22 nt, Human
ugcugaugaguccuucuaucgc

SEQ ID NO: 825235 - RNA, 22 nt, Human
gaggcaguuugccaugccagga

SEQ ID NO: 825236 - RNA, 22 nt, Human
uuuauuuggcauccagggagaa

SEQ ID NO: 825237 - RNA, 17 nt, Human
uucaaagcuuaucaagg

SEQ ID NO: 825238 - RNA, 22 nt, Human
ucuucuccagugcuucugcaca

SEQ ID NO: 825239 - RNA, 21 nt, Human
ccauaccuaccucaccugguu

SEQ ID NO: 825240 - RNA, 22 nt, Human
uucuacagacuauaacugugau

SEQ ID NO: 825241 - RNA, 22 nt, Human
uggcagcuguuaauguuuuguu

SEQ ID NO: 825242 - RNA, 22 nt, Human
uagcucuucauuucaucugauu

SEQ ID NO: 825243 - RNA, 22 nt, Human
uuguuauaaagacuaaauaugu

SEQ ID NO: 825244 - RNA, 22 nt, Human
aaggccagccugagagcuaaca

SEQ ID NO: 825245 - RNA, 23 nt, Human
uaugaacugcauugcuggugugu

SEQ ID NO: 825246 - RNA, 22 nt, Human
aggcagucuaucucuggagccu

SEQ ID NO: 825247 - RNA, 22 nt, Human
ucaacugcaaguuugcuuaguu

SEQ ID NO: 825248 - RNA, 22 nt, Human
auacuuucugaccaauuaauug

SEQ ID NO: 825249 - RNA, 22 nt, Human
ccagcagagucuaggaaggagg

SEQ ID NO: 825250 - RNA, 22 nt, Human
aggcagguccccuggaaggcac

SEQ ID NO: 825251 - RNA, 22 nt, Human
ugaaucugauuucccuggaggc

SEQ ID NO: 825252 - RNA, 22 nt, Human
gaggcgagaagcuggagauggu

SEQ ID NO: 825253 - RNA, 22 nt, Human
uugaaagaagaagcugcgaugu

SEQ ID NO: 825254 - RNA, 22 nt, Human
cagacaggguccuguccgucac

SEQ ID NO: 825255 - RNA, 22 nt, Human
accaggaguugggggugggacc

SEQ ID NO: 825256 - RNA, 22 nt, Human
gaucuguuucauucacagucug

SEQ ID NO: 825257 - RNA, 22 nt, Human
caggaugagaagggcucuuacg

SEQ ID NO: 825258 - RNA, 22 nt, Human
ugcugaugcuguucuguuagga

SEQ ID NO: 825259 - RNA, 22 nt, Human
uugcugugucugauggcugaga

SEQ ID NO: 825260 - RNA, 22 nt, Human
acaugcauacacguacauaccu

SEQ ID NO: 825261 - RNA, 22 nt, Human
uuugcaauuugugcugcaaaug

SEQ ID NO: 825262 - RNA, 22 nt, Human
uggaaauggaucugaugagucu

SEQ ID NO: 825263 - RNA, 22 nt, Human
ugaaaugauuauaugguguuug

SEQ ID NO: 825264 - RNA, 22 nt, Human
aaauguuuugcucccauguggu

SEQ ID NO: 825265 - RNA, 22 nt, Human
gcagcugcuggagggaggcagg

SEQ ID NO: 825266 - RNA, 22 nt, Human
ugcuuugggucucucuaguuuc

SEQ ID NO: 825267 - RNA, 22 nt, Human
cucacugugaccucagcagaca

SEQ ID NO: 825268 - RNA, 22 nt, Human
auggagggugguaagacagaga

SEQ ID NO: 825269 - RNA, 22 nt, Human
augcuguggccagaguucaacu

SEQ ID NO: 825270 - RNA, 21 nt, Human
aaaggccauaaucacggagca

SEQ ID NO: 825271 - RNA, 22 nt, Human
cuucucagaucucagcuuugag

SEQ ID NO: 825272 - RNA, 22 nt, Human
cacaugugugcugaggacugug

SEQ ID NO: 825273 - RNA, 22 nt, Human
caguugcuggaugugcagcucu

SEQ ID NO: 825274 - RNA, 23 nt, Human
cccuggaguaaauucuuggaagg

SEQ ID NO: 825275 - RNA, 22 nt, Human
aaggcagcccuggcucagccug

SEQ ID NO: 825276 - RNA, 22 nt, Human
aaggcagcaagaauuccagguu

SEQ ID NO: 825277 - RNA, 22 nt, Human
cugcugugagcacuccagccug

SEQ ID NO: 825278 - RNA, 22 nt, Human
cauuuguaguuaaaaaugucuc

SEQ ID NO: 825279 - RNA, 22 nt, Human
gccaggaguguguggcuauguu

SEQ ID NO: 825280 - RNA, 22 nt, Human
cagcuggcugcaugaugccaaa

SEQ ID NO: 825281 - RNA, 22 nt, Human
gggacgggcaguccaagggguc

SEQ ID NO: 825282 - RNA, 22 nt, Human
uccagaaacuuuuccagucuca

SEQ ID NO: 825283 - RNA, 22 nt, Human
uccaggagggggagccgugccg

SEQ ID NO: 825284 - RNA, 22 nt, Human
guccaugacugugacucacaug

SEQ ID NO: 825285 - RNA, 22 nt, Human
aucccaugagaccacguuggcu

SEQ ID NO: 825286 - RNA, 22 nt, Human
augaguucaauuguuucaguca

SEQ ID NO: 825287 - RNA, 22 nt, Human
caggaaugaggucguaaguguc

SEQ ID NO: 825288 - RNA, 23 nt, Human
uugcuuucaucaugagaugcucc

SEQ ID NO: 825289 - RNA, 22 nt, Human
aggccagaugucgggcuagaag

SEQ ID NO: 825290 - RNA, 22 nt, Human
ucccuucacagaugcgauguuu

SEQ ID NO: 825291 - RNA, 22 nt, Human
ucacaguuauagucuguagaau

SEQ ID NO: 825292 - RNA, 22 nt, Human
gucaggaucaaauugaaguuau

SEQ ID NO: 825293 - RNA, 22 nt, Human
cucaggaaaggccaugcaaggg

SEQ ID NO: 825294 - RNA, 21 nt, Human
ggcagcguguggacaggaagg

SEQ ID NO: 825295 - RNA, 22 nt, Human
aggcagucuaguccccaggcaa

SEQ ID NO: 825296 - RNA, 22 nt, Human
cauuuguacagaacagcuuuau

SEQ ID NO: 825297 - RNA, 22 nt, Human
ucugcaucauuuuucagagccg

SEQ ID NO: 825298 - RNA, 18 nt, Human
ucuuccaacacugacacc

SEQ ID NO: 825299 - RNA, 22 nt, Human
uaucuguuaugggcugaauugc

SEQ ID NO: 825300 - RNA, 22 nt, Human
aaacaugaauagauauuaaaca

SEQ ID NO: 825301 - RNA, 22 nt, Human
uauuucagcacaugggauaggu

SEQ ID NO: 825302 - RNA, 21 nt, Human
ucuuccuccacagcgugccac

SEQ ID NO: 825303 - RNA, 22 nt, Human
uccaugucuucaugugucuaac

SEQ ID NO: 825304 - RNA, 22 nt, Human
uuguaaauaguaguaagaugcc

SEQ ID NO: 825305 - RNA, 22 nt, Human
ccuucauugcaucuuuaagaga

SEQ ID NO: 825306 - RNA, 22 nt, Human
aggcaagcauuuaaccacucau

SEQ ID NO: 825307 - RNA, 22 nt, Human
ggauguugauugaauggccauu

SEQ ID NO: 825308 - RNA, 22 nt, Human
uaucaucuuguugucaugcagc

SEQ ID NO: 825309 - RNA, 22 nt, Human
uagaaaugugauaauagcuuaa

SEQ ID NO: 825310 - RNA, 20 nt, Human
ucaggaugugcugagugaag

SEQ ID NO: 825311 - RNA, 22 nt, Human
cucaggauuuacuaauuucaag

SEQ ID NO: 825312 - RNA, 15 nt, Human
uucaggauaugacuc

SEQ ID NO: 825313 - RNA, 22 nt, Human
uaaauuaugucacaugacucug

SEQ ID NO: 825314 - RNA, 22 nt, Human
ggcugaaggaugaaagcugcag

SEQ ID NO: 825315 - RNA, 22 nt, Human
auucucuuuguauaacaucuug

SEQ ID NO: 825316 - RNA, 22 nt, Human
ucucgacagccuggcacagugg

SEQ ID NO: 825317 - RNA, 22 nt, Human
ucuacugcacuggugucucauc

SEQ ID NO: 825318 - RNA, 22 nt, Human
gacagcuguggagaggcaugug

SEQ ID NO: 825319 - RNA, 22 nt, Human
aggcagcauccagaggagaaug

SEQ ID NO: 825320 - RNA, 22 nt, Human
uaaggccaggcuguggucggca

SEQ ID NO: 825321 - RNA, 22 nt, Human
uggagucugugaugcucugggu

SEQ ID NO: 825322 - RNA, 22 nt, Human
gagugucugaauuagagcacaa

SEQ ID NO: 825323 - RNA, 22 nt, Human
aaaggcaggcuuucacaucuca

SEQ ID NO: 825324 - RNA, 22 nt, Human
cugcuguguggugaaacucagu

SEQ ID NO: 825325 - RNA, 22 nt, Human
ggaggugggauuaggaccuaaa

SEQ ID NO: 825326 - RNA, 22 nt, Human
gcgucugaguugcgggggcuca

SEQ ID NO: 825327 - RNA, 22 nt, Human
ugaggcagugauguuuaagcac

SEQ ID NO: 825328 - RNA, 22 nt, Human
agacaaauggaguaugagcaac

SEQ ID NO: 825329 - RNA, 22 nt, Human
uccaggaggcucugguugacgu

SEQ ID NO: 825330 - RNA, 22 nt, Human
acaggacuguggaaggaucucu

SEQ ID NO: 825331 - RNA, 22 nt, Human
aacauucugguucuaaaaaccu

SEQ ID NO: 825332 - RNA, 22 nt, Human
uuauuacacugaaagaauugcg

SEQ ID NO: 825333 - RNA, 22 nt, Human
aauauccacacugugucccugc

SEQ ID NO: 825334 - RNA, 22 nt, Human
aucaggauagugguuaccuggg

SEQ ID NO: 825335 - RNA, 22 nt, Human
agagggcagucucagauuggga

SEQ ID NO: 825336 - RNA, 22 nt, Human
ugcuggguuaccuaagccuaaa

SEQ ID NO: 825337 - RNA, 22 nt, Human
ggguggagaggcuaaguccagu

SEQ ID NO: 825338 - RNA, 16 nt, Human
cuuccucuucacuggc

SEQ ID NO: 825339 - RNA, 22 nt, Human
aaucauucuuauuucacagcaa

SEQ ID NO: 825340 - RNA, 22 nt, Human
acauuguuugagaauacagaug

SEQ ID NO: 825341 - RNA, 22 nt, Human
guuguuuuuguucucuauagcu

SEQ ID NO: 825342 - RNA, 22 nt, Human
uucuucuuuaucucaguauccu

SEQ ID NO: 825343 - RNA, 21 nt, Human
augucaaaugcuuuauuuuau

SEQ ID NO: 825344 - RNA, 20 nt, Human
gaagcagcuucauguagaca

SEQ ID NO: 825345 - RNA, 22 nt, Human
guucuucagauuccauuucagu

SEQ ID NO: 825346 - RNA, 22 nt, Human
uugaauaguguuuucaguauac

SEQ ID NO: 825347 - RNA, 18 nt, Human
cgaggcaggcggaucacg

SEQ ID NO: 825348 - RNA, 22 nt, Human
uuauucuuuaaacauauauguu

SEQ ID NO: 825349 - RNA, 22 nt, Human
cugcugugugcuuacuuggguu

SEQ ID NO: 825350 - RNA, 22 nt, Human
aaggaguuuggguagucauaca

SEQ ID NO: 825351 - RNA, 22 nt, Human
cccaggaaccuaccagcucgag

SEQ ID NO: 825352 - RNA, 22 nt, Human
gcucaggagcucuugguggcgc

SEQ ID NO: 825353 - RNA, 22 nt, Human
gauuucuuuagguguaauagug

SEQ ID NO: 825354 - RNA, 22 nt, Human
ccagagagauugcuucuaaaga

SEQ ID NO: 825355 - RNA, 22 nt, Human
cccaggcagccugcagggaagg

SEQ ID NO: 825356 - RNA, 22 nt, Human
aucaggauuacacggggaugcu

SEQ ID NO: 825357 - RNA, 22 nt, Human
uugcuguguaacuccuggccug

SEQ ID NO: 825358 - RNA, 22 nt, Human
caagauggguguugugaugguu

SEQ ID NO: 825359 - RNA, 22 nt, Human
caaugugguggcagaugucagu

SEQ ID NO: 825360 - RNA, 22 nt, Human
gccaggaggcugcuguguaggc

SEQ ID NO: 825361 - RNA, 22 nt, Human
uccaggaggugaggggaccaaa

SEQ ID NO: 825362 - RNA, 22 nt, Human
ccagggaguuuccaaucugaga

SEQ ID NO: 825363 - RNA, 22 nt, Human
cauaauauacuacauugaugaa

SEQ ID NO: 825364 - RNA, 22 nt, Human
uuauacauguguuuugagauga

SEQ ID NO: 825365 - RNA, 22 nt, Human
uuucuucagagagagcuuuccc

SEQ ID NO: 825366 - RNA, 22 nt, Human
ugccugugguuccaguuuuuuc

SEQ ID NO: 825367 - RNA, 22 nt, Human
uuuccucacuucaugagaguuu

SEQ ID NO: 825368 - RNA, 22 nt, Human
ucagugugaggucuuccacccg

SEQ ID NO: 825369 - RNA, 22 nt, Human
cagcugacccgugggaggcggg

SEQ ID NO: 825370 - RNA, 22 nt, Human
ggaggaggcggcagaaguuccu

SEQ ID NO: 825371 - RNA, 22 nt, Human
agcaccuugcucuuggccuucc

SEQ ID NO: 825372 - RNA, 22 nt, Human
cuugcuggugguguuuucuaug

SEQ ID NO: 825373 - RNA, 22 nt, Human
ccccaggagaaaucuuaaacua

SEQ ID NO: 825374 - RNA, 22 nt, Human
cccaggaggcggagguuguggu

SEQ ID NO: 825375 - RNA, 22 nt, Human
ugcauggacucaucagacaaga

SEQ ID NO: 825376 - RNA, 22 nt, Human
aguuugaaaguauugacagaag

SEQ ID NO: 825377 - RNA, 22 nt, Human
cuugaaguugcaaaacauuaau

SEQ ID NO: 825378 - RNA, 22 nt, Human
cuggcaguguccagcucgugau

SEQ ID NO: 825379 - RNA, 21 nt, Human
aggucagcccagcucuggaag

SEQ ID NO: 825380 - RNA, 22 nt, Human
ucugggaagcugcgugccuguu

SEQ ID NO: 825381 - RNA, 22 nt, Human
gaggcaguguugaaaaggagag

SEQ ID NO: 825382 - RNA, 22 nt, Human
cuuccuucugaagcauagaagc

SEQ ID NO: 825383 - RNA, 22 nt, Human
uucaacuagauuuauacaauuc

SEQ ID NO: 825384 - RNA, 22 nt, Human
uaaggccauuauggugggcccg

SEQ ID NO: 825385 - RNA, 22 nt, Human
uuucaaagaguuguaaauuacu

SEQ ID NO: 825386 - RNA, 22 nt, Human
ugagauguaagguaugcuuacu

SEQ ID NO: 825387 - RNA, 22 nt, Human
ugaaucaguauaaauucucaaa

SEQ ID NO: 825388 - RNA, 22 nt, Human
caagaugggcaccccagcaccu

SEQ ID NO: 825389 - RNA, 22 nt, Human
ugcugcugaucauuuauagucu

SEQ ID NO: 825390 - RNA, 22 nt, Human
caggagaggaggcuacuucuua

SEQ ID NO: 825391 - RNA, 22 nt, Human
acccaggagacagguugcagug

SEQ ID NO: 825392 - RNA, 23 nt, Human
agaggcaggaguggcuugcccgg

SEQ ID NO: 825393 - RNA, 22 nt, Human
aggcagugcaugcaaaggucgg

SEQ ID NO: 825394 - RNA, 22 nt, Human
aggagaggcucuaacucugugu

SEQ ID NO: 825395 - RNA, 22 nt, Human
ggagcagggcagugaauucugg

SEQ ID NO: 825396 - RNA, 22 nt, Human
uguccucagauaugucuacucu

SEQ ID NO: 825397 - RNA, 22 nt, Human
agaggcagcagucauacuacag

SEQ ID NO: 825398 - RNA, 21 nt, Human
acagucuccccagaucucucc

SEQ ID NO: 825399 - RNA, 22 nt, Human
cucccaggacucagaggagaag

SEQ ID NO: 825400 - RNA, 22 nt, Human
ccaugagccaggcugaggaagc

SEQ ID NO: 825401 - RNA, 22 nt, Human
acccaggagagagcuauaaaau

SEQ ID NO: 825402 - RNA, 22 nt, Human
uuugcagugauucuugcaguga

SEQ ID NO: 825403 - RNA, 22 nt, Human
ugaggcaggagguugagaacug

SEQ ID NO: 825404 - RNA, 22 nt, Human
cacaauguauauguauaucaaa

SEQ ID NO: 825405 - RNA, 18 nt, Human
ugcuggguaacuguaugg

SEQ ID NO: 825406 - RNA, 20 nt, Human
ucauuguguugccaauuccc

SEQ ID NO: 825407 - RNA, 22 nt, Human
gcugucccgcugacuuccagcu

SEQ ID NO: 825408 - RNA, 22 nt, Human
aucacauugccagugauuaccc

SEQ ID NO: 825409 - RNA, 22 nt, Human
caggcagccugcggucugcaca

SEQ ID NO: 825410 - RNA, 22 nt, Human
cccuggaguccuggcaguugau

SEQ ID NO: 825411 - RNA, 22 nt, Human
uggcagcugcaggccuccugag

SEQ ID NO: 825412 - RNA, 22 nt, Human
cugccaggcacgugcagcauca

SEQ ID NO: 825413 - RNA, 22 nt, Human
uguguuauugccacugaagacc

SEQ ID NO: 825414 - RNA, 22 nt, Human
cuguggaaaauuuguauguaau

SEQ ID NO: 825415 - RNA, 23 nt, Human
uugauuucaaaugcagagaacac

SEQ ID NO: 825416 - RNA, 22 nt, Human
agugagaguauuaaugugaacu

SEQ ID NO: 825417 - RNA, 22 nt, Human
uuugcaaagaaauuauugcugu

SEQ ID NO: 825418 - RNA, 22 nt, Human
uucccucucacuuaaagcuugg

SEQ ID NO: 825419 - RNA, 22 nt, Human
aagacugucuuuucugagugac

SEQ ID NO: 825420 - RNA, 20 nt, Human
accaauguuagcuuaguacu

SEQ ID NO: 825421 - RNA, 22 nt, Human
ggccagaaguuggaaaagagcc

SEQ ID NO: 825422 - RNA, 22 nt, Human
uugcagcugcaguaaauguuca

SEQ ID NO: 825423 - RNA, 22 nt, Human
cagugauguuucugcaucagag

SEQ ID NO: 825424 - RNA, 22 nt, Human
ugcauguguuugccacagugag

SEQ ID NO: 825425 - RNA, 22 nt, Human
uccaggaguccuggguggcccc

SEQ ID NO: 825426 - RNA, 22 nt, Human
aaacugcuuuccacaguggcua

SEQ ID NO: 825427 - RNA, 22 nt, Human
accaggaggccuggagcacaaa

SEQ ID NO: 825428 - RNA, 22 nt, Human
uuggaaagcaagcuggacauac

SEQ ID NO: 825429 - RNA, 22 nt, Human
caaguaaagaaucacauuucuu

SEQ ID NO: 825430 - RNA, 22 nt, Human
uucaugugaucacagauuguaa

SEQ ID NO: 825431 - RNA, 22 nt, Human
aggcagccaaucagaggcugac

SEQ ID NO: 825432 - RNA, 22 nt, Human
auguuuccagguucuuccuaug

SEQ ID NO: 825433 - RNA, 22 nt, Human
gagaggucaucucccaucagca

SEQ ID NO: 825434 - RNA, 22 nt, Human
ggcucagagaccugcgaucuga

SEQ ID NO: 825435 - RNA, 22 nt, Human
auuguauaacagcauguauuuu

SEQ ID NO: 825436 - RNA, 22 nt, Human
ucuucauuuuauagcaucugug

SEQ ID NO: 825437 - RNA, 22 nt, Human
gagugcaguuggggugagggga

SEQ ID NO: 825438 - RNA, 22 nt, Human
uucccucuccuacucaggaaag

SEQ ID NO: 825439 - RNA, 22 nt, Human
accuugaugccuuuccaagaug

SEQ ID NO: 825440 - RNA, 22 nt, Human
uugaaagacuucuccugugaaa

SEQ ID NO: 825441 - RNA, 22 nt, Human
agacgagggcccccaggacagc

SEQ ID NO: 825442 - RNA, 22 nt, Human
uccauuuuguagguaugcuaca

SEQ ID NO: 825443 - RNA, 22 nt, Human
cugcugugacagcugccguguu

SEQ ID NO: 825444 - RNA, 22 nt, Human
uaaaaugaucucucauguucuu

SEQ ID NO: 825445 - RNA, 22 nt, Human
gauggcagucaaccaggugagg

SEQ ID NO: 825446 - RNA, 22 nt, Human
gagaggugaauguggaugccac

SEQ ID NO: 825447 - RNA, 22 nt, Human
cccaggagguggagguugcagu

SEQ ID NO: 825448 - RNA, 22 nt, Human
agggagcuaggauccugaaggu

SEQ ID NO: 825449 - RNA, 22 nt, Human
ucucaggaagauuagggcuaag

SEQ ID NO: 825450 - RNA, 22 nt, Human
caggauggucagaugcauuguc

SEQ ID NO: 825451 - RNA, 22 nt, Human
gcauucuuuuuaggagguuccu

SEQ ID NO: 825452 - RNA, 22 nt, Human
uuucugugguggguaguucaga

SEQ ID NO: 825453 - RNA, 22 nt, Human
auuuguagugaagugaaaauaa

SEQ ID NO: 825454 - RNA, 22 nt, Human
uuugcacuagcauuuguccaug

SEQ ID NO: 825455 - RNA, 22 nt, Human
ucacagacacagggagaagcau

SEQ ID NO: 825456 - RNA, 22 nt, Human
uagcccagaagagggaagcaac

SEQ ID NO: 825457 - RNA, 22 nt, Human
ucauuuuucacacagggucacc

SEQ ID NO: 825458 - RNA, 22 nt, Human
cuguggaaauaaacaaugcuaa

SEQ ID NO: 825459 - RNA, 22 nt, Human
ucugucucaaguucuugcacuc

SEQ ID NO: 825460 - RNA, 22 nt, Human
gcucaggacccaggugugaccu

SEQ ID NO: 825461 - RNA, 22 nt, Human
accaggaguaacagugaguggu

SEQ ID NO: 825462 - RNA, 22 nt, Human
cauggcugcgagaagagugggu

SEQ ID NO: 825463 - RNA, 22 nt, Human
cccaggaggugugcccaacucg

SEQ ID NO: 825464 - RNA, 22 nt, Human
acccaggagcaggcugggcagu

SEQ ID NO: 825465 - RNA, 22 nt, Human
gcagcugagagaagaacagggc

SEQ ID NO: 825466 - RNA, 22 nt, Human
gcagcucccagcuugaaagguc

SEQ ID NO: 825467 - RNA, 22 nt, Human
uuucaaagucaauaucauuacc

SEQ ID NO: 825468 - RNA, 22 nt, Human
gagcaccucaauuugcuauuug

SEQ ID NO: 825469 - RNA, 22 nt, Human
acaggccacaguggagucucug

SEQ ID NO: 825470 - RNA, 22 nt, Human
ucauuuaauaauuuuugaguag

SEQ ID NO: 825471 - RNA, 22 nt, Human
guugaaaguagaugcuauuugg

SEQ ID NO: 825472 - RNA, 22 nt, Human
aaaaaucuaugacugcuucucc

SEQ ID NO: 825473 - RNA, 22 nt, Human
ggugaagggccuuaggagacag

SEQ ID NO: 825474 - RNA, 22 nt, Human
uucucugagauagacuaagugg

SEQ ID NO: 825475 - RNA, 23 nt, Human
agacaguggccgagagguacuag

SEQ ID NO: 825476 - RNA, 22 nt, Human
uugaaagucacaauggcauuaa

SEQ ID NO: 825477 - RNA, 22 nt, Human
cccaggaccgcgcggcugagcg

SEQ ID NO: 825478 - RNA, 22 nt, Human
ccuggagagagaggccaacugc

SEQ ID NO: 825479 - RNA, 22 nt, Human
acauuuaaauaccuauguuucu

SEQ ID NO: 825480 - RNA, 22 nt, Human
agcccaggaaucugcaucuuga

SEQ ID NO: 825481 - RNA, 22 nt, Human
gaggcagugucgguggcaggau

SEQ ID NO: 825482 - RNA, 22 nt, Human
ccaggcagcaaauuuucugaau

SEQ ID NO: 825483 - RNA, 22 nt, Human
ugaaucauggauaaauagcuua

SEQ ID NO: 825484 - RNA, 22 nt, Human
ugagggagagggcgaaaaugaa

SEQ ID NO: 825485 - RNA, 22 nt, Human
cauaauaucuccgauuacuugc

SEQ ID NO: 825486 - RNA, 20 nt, Human
uccaggagaacugggagccg

SEQ ID NO: 825487 - RNA, 22 nt, Human
gaaauauuguacuggagauguu

SEQ ID NO: 825488 - RNA, 20 nt, Human
uuucaguugguuaauggcau

SEQ ID NO: 825489 - RNA, 22 nt, Human
ugaggggaaggcaugauaaaua

SEQ ID NO: 825490 - RNA, 22 nt, Human
aggguggccaugagggagagau

SEQ ID NO: 825491 - RNA, 22 nt, Human
gagggccagcagccucagcaug

SEQ ID NO: 825492 - RNA, 22 nt, Human
agagggauaauauguauuguaa

SEQ ID NO: 825493 - RNA, 22 nt, Human
acucaggagggaucagcuauca

SEQ ID NO: 825494 - RNA, 22 nt, Human
gaggcaguguuuacugcccugu

SEQ ID NO: 825495 - RNA, 22 nt, Human
aauauaaugcuguuuuaugcca

SEQ ID NO: 825496 - RNA, 22 nt, Human
ucucaggaauagaguggcagca

SEQ ID NO: 825497 - RNA, 22 nt, Human
cagucuuuguucccauuacuga

SEQ ID NO: 825498 - RNA, 22 nt, Human
ucgagcucuggagccaaggaug

SEQ ID NO: 825499 - RNA, 22 nt, Human
auacaacuuuacaugcaauucc

SEQ ID NO: 825500 - RNA, 22 nt, Human
cgaggcagacaaaaguuggaag

SEQ ID NO: 825501 - RNA, 22 nt, Human
caacugagcaguagcgucugga

SEQ ID NO: 825502 - RNA, 22 nt, Human
uaccauuucauucuuuccucau

SEQ ID NO: 825503 - RNA, 22 nt, Human
agacccagaaagcagcugcauu

SEQ ID NO: 825504 - RNA, 20 nt, Human
cauuuguuagcuuucuacug

SEQ ID NO: 825505 - RNA, 22 nt, Human
ucuuugcaaaauacaacaaugg

SEQ ID NO: 825506 - RNA, 23 nt, Human
ccacuagcaccuguucaacuucu

SEQ ID NO: 825507 - RNA, 22 nt, Human
ucaggagaaaauaucaggaagu

SEQ ID NO: 825508 - RNA, 22 nt, Human
uacuuuuagccuauuugauucu

SEQ ID NO: 825509 - RNA, 22 nt, Human
auuaaauuaaguggcuaauuua

SEQ ID NO: 825510 - RNA, 22 nt, Human
uuaagauagaacccaguagucu

SEQ ID NO: 825511 - RNA, 22 nt, Human
cccaggagagggaaccaaaugu

SEQ ID NO: 825512 - RNA, 22 nt, Human
gaagaggaugacaggagccggu

SEQ ID NO: 825513 - RNA, 22 nt, Human
gauuucuuugcaagcuguguuc

SEQ ID NO: 825514 - RNA, 22 nt, Human
agaaaauauucauugagaggcu

SEQ ID NO: 825515 - RNA, 22 nt, Human
acacaaauuguaggauaauugc

SEQ ID NO: 825516 - RNA, 22 nt, Human
gaggccuggagccgccuaggcg

SEQ ID NO: 825517 - RNA, 22 nt, Human
uacccaggaggaaacugaggcu

SEQ ID NO: 825518 - RNA, 22 nt, Human
aaggcagcucagcucauggcag

SEQ ID NO: 825519 - RNA, 22 nt, Human
caggcagcugaggacuuugcua

SEQ ID NO: 825520 - RNA, 22 nt, Human
agaggaugauuuuaaggacacu

SEQ ID NO: 825521 - RNA, 22 nt, Human
uucucagagugaccaagucuuu

SEQ ID NO: 825522 - RNA, 22 nt, Human
agucucugcugguugugccuau

SEQ ID NO: 825523 - RNA, 22 nt, Human
uucaggauucucucccauuuac

SEQ ID NO: 825524 - RNA, 22 nt, Human
acugcuuuaucugagaaguccu

SEQ ID NO: 825525 - RNA, 15 nt, Human
cccaggaguucgaga

SEQ ID NO: 825526 - RNA, 22 nt, Human
agacucaagacugcagaagacg

SEQ ID NO: 825527 - RNA, 22 nt, Human
uguccauggauagagcugcucg

SEQ ID NO: 825528 - RNA, 22 nt, Human
guguuuuaagaaagaagcucag

SEQ ID NO: 825529 - RNA, 22 nt, Human
cucaggauggaagccuacagga

SEQ ID NO: 825530 - RNA, 22 nt, Human
uaagaacuucggacauguuauc

SEQ ID NO: 825531 - RNA, 22 nt, Human
gaaacugugaggaucuuaacuu

SEQ ID NO: 825532 - RNA, 21 nt, Human
ucucugugucuuuaagcugga

SEQ ID NO: 825533 - RNA, 22 nt, Human
gggagcugaauggcaauggaga

SEQ ID NO: 825534 - RNA, 22 nt, Human
uuuucauuguuccucgagcauu

SEQ ID NO: 825535 - RNA, 22 nt, Human
ucugcaggaggcuggcugcagg

SEQ ID NO: 825536 - RNA, 22 nt, Human
accaggaguuuugaccaggggc

SEQ ID NO: 825537 - RNA, 22 nt, Human
gucuccugagacugcagucacc

SEQ ID NO: 825538 - RNA, 19 nt, Human
gaggucagcaagaaguauu

SEQ ID NO: 825539 - RNA, 21 nt, Human
aggcagcaggauccagggaca

SEQ ID NO: 825540 - RNA, 22 nt, Human
uucugugauugacauguggcuu

SEQ ID NO: 825541 - RNA, 22 nt, Human
uuugacauugccaauuugcuca

SEQ ID NO: 825542 - RNA, 22 nt, Human
uagauuuuacuucugucauuac

SEQ ID NO: 825543 - RNA, 22 nt, Human
uuuuuuaguuaggucagaaugu

SEQ ID NO: 825544 - RNA, 19 nt, Human
aggcaggugcagagguccc

SEQ ID NO: 825545 - RNA, 22 nt, Human
auuuucagagacaucuggacuu

SEQ ID NO: 825546 - RNA, 22 nt, Human
uuugaaauaugaggcauuauga

SEQ ID NO: 825547 - RNA, 22 nt, Human
uuaugauuugccacagauuggu

SEQ ID NO: 825548 - RNA, 22 nt, Human
auuucagguaccugugggaucc

SEQ ID NO: 825549 - RNA, 22 nt, Human
ucccaggaauccguccucuaga

SEQ ID NO: 825550 - RNA, 21 nt, Human
cgcagagcgaacuugcggcgc

SEQ ID NO: 825551 - RNA, 22 nt, Human
uuuuaucuucauuccuaucuac

SEQ ID NO: 825552 - RNA, 22 nt, Human
aggcagcccacaggacacagga

SEQ ID NO: 825553 - RNA, 20 nt, Human
guaaaauauggucuuugggu

SEQ ID NO: 825554 - RNA, 22 nt, Human
aggcagugcugugcccugaacc

SEQ ID NO: 825555 - RNA, 20 nt, Human
acaggagaucugaggaaagg

SEQ ID NO: 825556 - RNA, 22 nt, Human
gucaggauuugaacucaggucu

SEQ ID NO: 825557 - RNA, 22 nt, Human
cuuacagagaagaaaauguagu

SEQ ID NO: 825558 - RNA, 22 nt, Human
ugugaaagcaagucuaguucuc

SEQ ID NO: 825559 - RNA, 22 nt, Human
gaauacauuggaaaucagaaua

SEQ ID NO: 825560 - RNA, 22 nt, Human
ucugcugugggucuauauuuua

SEQ ID NO: 825561 - RNA, 22 nt, Human
uccaggagaaaacugacggugg

SEQ ID NO: 825562 - RNA, 22 nt, Human
aagcuggcaugucaccugagaa

SEQ ID NO: 825563 - RNA, 22 nt, Human
agggggugcccagaugaaggau

SEQ ID NO: 825564 - RNA, 22 nt, Human
uaucuaaaggauuuaauuuagu

SEQ ID NO: 825565 - RNA, 22 nt, Human
cagcugacgccagaguggaauu

SEQ ID NO: 825566 - RNA, 22 nt, Human
ggugagaggcagaggacagcuu

SEQ ID NO: 825567 - RNA, 22 nt, Human
uggaggaaaaaaccaggcagag

SEQ ID NO: 825568 - RNA, 22 nt, Human
cccuggaggucagaggccuggg

SEQ ID NO: 825569 - RNA, 22 nt, Human
cagucucuugcuucauuaguug

SEQ ID NO: 825570 - RNA, 22 nt, Human
uuuuucaagacaaccugcaugu

SEQ ID NO: 825571 - RNA, 22 nt, Human
uuuguaaaggccugaauuucag

SEQ ID NO: 825572 - RNA, 22 nt, Human
agaggucagauuucuccuggug

SEQ ID NO: 825573 - RNA, 22 nt, Human
ucuuugcagaauuuaacuuugc

SEQ ID NO: 825574 - RNA, 22 nt, Human
uggcagagcaaaaagauagaau

SEQ ID NO: 825575 - RNA, 22 nt, Human
guuuauaaggcccaauauuucu

SEQ ID NO: 825576 - RNA, 22 nt, Human
uacccaggagaaacagcagggc

SEQ ID NO: 825577 - RNA, 22 nt, Human
uugauagguuuuauguauaguu

SEQ ID NO: 825578 - RNA, 19 nt, Human
agcagcuggagguggagug

SEQ ID NO: 825579 - RNA, 17 nt, Human
aagagaggcugagcugg

SEQ ID NO: 825580 - RNA, 22 nt, Human
ggcuuggaaauugcaggacaca

SEQ ID NO: 825581 - RNA, 22 nt, Human
cugucauugagccugucagggc

SEQ ID NO: 825582 - RNA, 22 nt, Human
cuggaggcacccuuagagaggc

SEQ ID NO: 825583 - RNA, 22 nt, Human
aggcaguguguagcuggaagag

SEQ ID NO: 825584 - RNA, 21 nt, Human
agggagcuuuagguagaaguu

SEQ ID NO: 825585 - RNA, 22 nt, Human
acaugcauaggagaagucuuua

SEQ ID NO: 825586 - RNA, 22 nt, Human
ggagugggaacaaugacauggu

SEQ ID NO: 825587 - RNA, 22 nt, Human
cauucucaauaguagaugagua

SEQ ID NO: 825588 - RNA, 22 nt, Human
uaggcagcauggauucugaaua

SEQ ID NO: 825589 - RNA, 22 nt, Human
uuugaaaguccuaggagagucc

SEQ ID NO: 825590 - RNA, 22 nt, Human
ugaggggagcuagcaugccuug

SEQ ID NO: 825591 - RNA, 22 nt, Human
ugaggcagccugcauuaaagag

SEQ ID NO: 825592 - RNA, 22 nt, Human
uacaaaguaauguauaauaucg

SEQ ID NO: 825593 - RNA, 22 nt, Human
aaaggccacugcaagggaaggu

SEQ ID NO: 825594 - RNA, 22 nt, Human
gaaucucaguggaagcaggaag

SEQ ID NO: 825595 - RNA, 20 nt, Human
uuucacagucccuguuuccu

SEQ ID NO: 825596 - RNA, 18 nt, Human
aggcaggugcuggaaguc

SEQ ID NO: 825597 - RNA, 20 nt, Human
augugagggguugaaguggg

SEQ ID NO: 825598 - RNA, 22 nt, Human
cuugaaagucacaugcagcccu

SEQ ID NO: 825599 - RNA, 22 nt, Human
ugaggcaggaugcuugcacagg

SEQ ID NO: 825600 - RNA, 22 nt, Human
auucuucaccauggauaauuug

SEQ ID NO: 825601 - RNA, 22 nt, Human
agggagcucaguuggaagcggu

SEQ ID NO: 825602 - RNA, 22 nt, Human
gaggcaacacauuuggaaagca

SEQ ID NO: 825603 - RNA, 20 nt, Human
aggagggaccuggauuggcg

SEQ ID NO: 825604 - RNA, 22 nt, Human
aaagauuauggcauugaaauac

SEQ ID NO: 825605 - RNA, 22 nt, Human
aguggcagagccaaguagagcc

SEQ ID NO: 825606 - RNA, 22 nt, Human
agagggagugaaauggaauaga

SEQ ID NO: 825607 - RNA, 22 nt, Human
accaggagguguuugcucaagu

SEQ ID NO: 825608 - RNA, 22 nt, Human
cauuguuaccaucuuuuaccua

SEQ ID NO: 825609 - RNA, 22 nt, Human
gucuuucuaugaugaacuguug

SEQ ID NO: 825610 - RNA, 22 nt, Human
ugaggcagcaauugauuauuca

SEQ ID NO: 825611 - RNA, 22 nt, Human
cugggaaauggcuucgagcuca

SEQ ID NO: 825612 - RNA, 17 nt, Human
ucccaggaacagggaau

SEQ ID NO: 825613 - RNA, 22 nt, Human
cagucucucugaaguauuaaga

SEQ ID NO: 825614 - RNA, 22 nt, Human
ggcacagagcccagcuuccuag

SEQ ID NO: 825615 - RNA, 19 nt, Human
ugaaauggcaguugcuaaa

SEQ ID NO: 825616 - RNA, 22 nt, Human
ggaggcaggaaagacagguuca

SEQ ID NO: 825617 - RNA, 22 nt, Human
uccaggagauacacugcaccag

SEQ ID NO: 825618 - RNA, 22 nt, Human
uggagcugggguuugaaucugg

SEQ ID NO: 825619 - RNA, 22 nt, Human
ugagaacugaggauuugaauuc

SEQ ID NO: 825620 - RNA, 22 nt, Human
uuagccauuaauguccugugca

SEQ ID NO: 825621 - RNA, 22 nt, Human
aggcaagcccccagugaggcuc

SEQ ID NO: 825622 - RNA, 22 nt, Human
auuugcaaagucguaucuguga

SEQ ID NO: 825623 - RNA, 22 nt, Human
acugugugacuguuauuacugu

SEQ ID NO: 825624 - RNA, 21 nt, Human
uccaggaguucuaauaggugu

SEQ ID NO: 825625 - RNA, 22 nt, Human
aggccagcucuacccuuggacu

SEQ ID NO: 825626 - RNA, 22 nt, Human
cagugguugguagauacuugag

SEQ ID NO: 825627 - RNA, 22 nt, Human
gaauacaugauacaugaacugc

SEQ ID NO: 825628 - RNA, 19 nt, Human
gccaggagggcucuggcug

SEQ ID NO: 825629 - RNA, 22 nt, Human
gcuucccacagcuggacugggg

SEQ ID NO: 825630 - RNA, 22 nt, Human
acaauucugaugguuucccagu

SEQ ID NO: 825631 - RNA, 22 nt, Human
auuuucaaaacaucugcugugu

SEQ ID NO: 825632 - RNA, 22 nt, Human
uuucagaaagcugaacauauga

SEQ ID NO: 825633 - RNA, 22 nt, Human
gcagaggccuagguggaaggcc

SEQ ID NO: 825634 - RNA, 22 nt, Human
cccaggaaugaggggcggaggc

SEQ ID NO: 825635 - RNA, 22 nt, Human
cccaggagauggugcguggucu

SEQ ID NO: 825636 - RNA, 22 nt, Human
aagccgaggccacacagcagga

SEQ ID NO: 825637 - RNA, 17 nt, Human
ggcagcugugugcaugc

SEQ ID NO: 825638 - RNA, 21 nt, Human
ggcagcucagcagauggggac

SEQ ID NO: 825639 - RNA, 22 nt, Human
uguugaagauaaaguucucauu

SEQ ID NO: 825640 - RNA, 22 nt, Human
uuugaaagccuggcuuuucucu

SEQ ID NO: 825641 - RNA, 22 nt, Human
uggcagcucuguucaacaugag

SEQ ID NO: 825642 - RNA, 22 nt, Human
auauuguugacuauaagaguaa

SEQ ID NO: 825643 - RNA, 22 nt, Human
uuagagucaagcugcauguucu

SEQ ID NO: 825644 - RNA, 22 nt, Human
gaaggucaccuccccucucugg

SEQ ID NO: 825645 - RNA, 22 nt, Human
cuucuucacacuggucugaagc

SEQ ID NO: 825646 - RNA, 22 nt, Human
cuucagaagccugcagccuuug

SEQ ID NO: 825647 - RNA, 22 nt, Human
aaggcaguuugggccaccaucu

SEQ ID NO: 825648 - RNA, 22 nt, Human
uauaucaccaaaaacaguucug

SEQ ID NO: 825649 - RNA, 22 nt, Human
uccuucuuucccccuagucauu

SEQ ID NO: 825650 - RNA, 22 nt, Human
acagucauuagauacaaugucu

SEQ ID NO: 825651 - RNA, 22 nt, Human
cagucucagaggugggaguggg

SEQ ID NO: 825652 - RNA, 22 nt, Human
guaggcagggcuguggggagaa

SEQ ID NO: 825653 - RNA, 22 nt, Human
gagagggauacugaguuuuggu

SEQ ID NO: 825654 - RNA, 22 nt, Human
gggaggugauuaggaccaugua

SEQ ID NO: 825655 - RNA, 18 nt, Human
ugcuuggagcauuuacca

SEQ ID NO: 825656 - RNA, 22 nt, Human
agcagagguuuguuggaaaccu

SEQ ID NO: 825657 - RNA, 18 nt, Human
aagaggaggagcagguug

SEQ ID NO: 825658 - RNA, 22 nt, Human
gcuguguuuuauguuagguuaa

SEQ ID NO: 825659 - RNA, 22 nt, Human
gugguaaucggauucuuaccgg

SEQ ID NO: 825660 - RNA, 22 nt, Human
uuuuccagagcugucucuugca

SEQ ID NO: 825661 - RNA, 22 nt, Human
guuaaauucgaugauggauaaa

SEQ ID NO: 825662 - RNA, 22 nt, Human
aggaggggcauagaaauguaau

SEQ ID NO: 825663 - RNA, 22 nt, Human
cacucaggguacaauggagggc

SEQ ID NO: 825664 - RNA, 22 nt, Human
ugaacucgggaggaggcugcag

SEQ ID NO: 825665 - RNA, 22 nt, Human
gugcugugcgcuuuuucuguau

SEQ ID NO: 825666 - RNA, 22 nt, Human
aguggcagagguugacugcagu

SEQ ID NO: 825667 - RNA, 22 nt, Human
ucucacuggguauaaaugagua

SEQ ID NO: 825668 - RNA, 22 nt, Human
gccaggagcaugucauuguuga

SEQ ID NO: 825669 - RNA, 22 nt, Human
caggagaggcuguacguuucuc

SEQ ID NO: 825670 - RNA, 22 nt, Human
cccaggagccaucugucuuggc

SEQ ID NO: 825671 - RNA, 22 nt, Human
aacaugauggggaagaacaaga

SEQ ID NO: 825672 - RNA, 22 nt, Human
aaaguauucuugacuguuuuuc

SEQ ID NO: 825673 - RNA, 22 nt, Human
guuugcauauuugcacaggaau

SEQ ID NO: 825674 - RNA, 22 nt, Human
gucaggauuauuuuauuaaaag

SEQ ID NO: 825675 - RNA, 22 nt, Human
cagcagaggugguucacauugu

SEQ ID NO: 825676 - RNA, 22 nt, Human
cagugcugggcagaggagagcg

SEQ ID NO: 825677 - RNA, 22 nt, Human
auuggcagaaacagcagggcca

SEQ ID NO: 825678 - RNA, 20 nt, Human
cagaggcaaggagacuugga

SEQ ID NO: 825679 - RNA, 22 nt, Human
auucuucagcaggggacacuau

SEQ ID NO: 825680 - RNA, 22 nt, Human
uaacaauaguguuugcuaguca

SEQ ID NO: 825681 - RNA, 22 nt, Human
gauggacagccuggaaggaaag

SEQ ID NO: 825682 - RNA, 22 nt, Human
ggcagucuuaucagcauuggac

SEQ ID NO: 825683 - RNA, 22 nt, Human
ggagguggcagagggacauucu

SEQ ID NO: 825684 - RNA, 22 nt, Human
ccaugagcuuccuauauagggu

SEQ ID NO: 825685 - RNA, 22 nt, Human
aggcagcuggcagcacccaggg

SEQ ID NO: 825686 - RNA, 23 nt, Human
uuuggacuugugacucuucuccu

SEQ ID NO: 825687 - RNA, 22 nt, Human
ccucacugcuauguguuugcuc

SEQ ID NO: 825688 - RNA, 18 nt, Human
uggcagcaggaagccauu

SEQ ID NO: 825689 - RNA, 22 nt, Human
auauaauacaaccugcuaagug

SEQ ID NO: 825690 - RNA, 22 nt, Human
uaaggccaaacuauuauaguuc

SEQ ID NO: 825691 - RNA, 22 nt, Human
uauucaaaguaccuucauugcc

SEQ ID NO: 825692 - RNA, 19 nt, Human
caaggccaccauuucuccg

SEQ ID NO: 825693 - RNA, 22 nt, Human
uugaaagugccaaguccuagug

SEQ ID NO: 825694 - RNA, 22 nt, Human
uguucuucuagauugccuuuua

SEQ ID NO: 825695 - RNA, 22 nt, Human
agaggacagacggaaagugcca

SEQ ID NO: 825696 - RNA, 19 nt, Human
ggcaggcuggauagagagg

SEQ ID NO: 825697 - RNA, 22 nt, Human
uuuaagauucaguaaggcaaac

SEQ ID NO: 825698 - RNA, 22 nt, Human
ugcuugugagaguuuuuucaga

SEQ ID NO: 825699 - RNA, 22 nt, Human
acuggcagcagcagcccuuggg

SEQ ID NO: 825700 - RNA, 22 nt, Human
cuugcaggauuuugcugcugua

SEQ ID NO: 825701 - RNA, 17 nt, Human
gaggagcuccaguaggu

SEQ ID NO: 825702 - RNA, 22 nt, Human
gaggucaggggagaggcugaug

SEQ ID NO: 825703 - RNA, 22 nt, Human
ucauucuugaucacuaguuagu

SEQ ID NO: 825704 - RNA, 22 nt, Human
cccaggaaacccgaaggcgacc

SEQ ID NO: 825705 - RNA, 22 nt, Human
ucuacuguagugaugcugcagu

SEQ ID NO: 825706 - RNA, 22 nt, Human
gucuucuuuaaccuacuaaagc

SEQ ID NO: 825707 - RNA, 22 nt, Human
auuucccagcuuugaucaguuu

SEQ ID NO: 825708 - RNA, 20 nt, Human
uccaugaguuagagacuaua

SEQ ID NO: 825709 - RNA, 22 nt, Human
cucagaauuuagggcucugagg

SEQ ID NO: 825710 - RNA, 22 nt, Human
uucauucuuauuugugaucugg

SEQ ID NO: 825711 - RNA, 22 nt, Human
aaaauuauggaguaucccaaag

SEQ ID NO: 825712 - RNA, 22 nt, Human
uucaggauaguggugaguggca

SEQ ID NO: 825713 - RNA, 22 nt, Human
ucugucuccucugaggugccag

SEQ ID NO: 825714 - RNA, 22 nt, Human
augcugugccuucucugugcca

SEQ ID NO: 825715 - RNA, 22 nt, Human
ucagagaggcaauacuguuuaa

SEQ ID NO: 825716 - RNA, 20 nt, Human
uacagaaugcaauaaaaugg

SEQ ID NO: 825717 - RNA, 22 nt, Human
uuucuucagccacuccaaacug

SEQ ID NO: 825718 - RNA, 22 nt, Human
uuugaaguggaaaaggauuuaa

SEQ ID NO: 825719 - RNA, 22 nt, Human
gaggucaggcuugcagcagggu

SEQ ID NO: 825720 - RNA, 22 nt, Human
aacaaaugaccugauuucuucc

SEQ ID NO: 825721 - RNA, 22 nt, Human
gccaggaggucagccccucaac

SEQ ID NO: 825722 - RNA, 22 nt, Human
uaggagagcugaacuauugucu

SEQ ID NO: 825723 - RNA, 22 nt, Human
gugcauuuaggucacaugaugu

SEQ ID NO: 825724 - RNA, 22 nt, Human
aagacuguacauuuuccagucu

SEQ ID NO: 825725 - RNA, 17 nt, Human
gaggacagggaaguagg

SEQ ID NO: 825726 - RNA, 22 nt, Human
gaggcugcccaacuggagugga

SEQ ID NO: 825727 - RNA, 22 nt, Human
gagucuuugguaaagucugcug

SEQ ID NO: 825728 - RNA, 22 nt, Human
cucuucuugcuagacugagugc

SEQ ID NO: 825729 - RNA, 22 nt, Human
ggggcagccuccaggaaagcug

SEQ ID NO: 825730 - RNA, 22 nt, Human
gagggaugguaguugacacuga

SEQ ID NO: 825731 - RNA, 22 nt, Human
acacauuucucuuuuuguaagu

SEQ ID NO: 825732 - RNA, 22 nt, Human
guuuuucuuugugugaagacaa

SEQ ID NO: 825733 - RNA, 22 nt, Human
agcuaccuggcuuaucacuguc

SEQ ID NO: 825734 - RNA, 22 nt, Human
uugguuuacuaggauucaaauu

SEQ ID NO: 825735 - RNA, 22 nt, Human
uucugugaaucuuuuuucccac

SEQ ID NO: 825736 - RNA, 22 nt, Human
uguccucuuccagugcuccuuc

SEQ ID NO: 825737 - RNA, 22 nt, Human
ugugcaggugcaggaagggggc

SEQ ID NO: 825738 - RNA, 22 nt, Human
ggagccuggucagguuggcucc

SEQ ID NO: 825739 - RNA, 22 nt, Human
ggcagcauauauucagugggca

SEQ ID NO: 825740 - RNA, 22 nt, Human
agggagcuuccgaacuacagcu

SEQ ID NO: 825741 - RNA, 22 nt, Human
cccaggaaaugggcucuugccu

SEQ ID NO: 825742 - RNA, 22 nt, Human
gcaagcugaugugauagugaaa

SEQ ID NO: 825743 - RNA, 22 nt, Human
aucaggaugcugucaguuacca

SEQ ID NO: 825744 - RNA, 22 nt, Human
aaggccaacuaggaugagcuag

SEQ ID NO: 825745 - RNA, 22 nt, Human
uuucaguucaguuuauuauauc

SEQ ID NO: 825746 - RNA, 22 nt, Human
gcuagaaaucgacuucagaauu

SEQ ID NO: 825747 - RNA, 22 nt, Human
uuagccauuaaauuacaaggug

SEQ ID NO: 825748 - RNA, 22 nt, Human
agagcagcacguuguccccaca

SEQ ID NO: 825749 - RNA, 17 nt, Human
gcgcagcuccuggcgcg

SEQ ID NO: 825750 - RNA, 21 nt, Human
ucacagacuggucagugaggc

SEQ ID NO: 825751 - RNA, 22 nt, Human
aggcagugcucaagacagcagc

SEQ ID NO: 825752 - RNA, 22 nt, Human
caaauacuggguaaguuaauuu

SEQ ID NO: 825753 - RNA, 22 nt, Human
auacacauguguaugugcaugc

SEQ ID NO: 825754 - RNA, 22 nt, Human
gcuccucugucaaaugagagug

SEQ ID NO: 825755 - RNA, 22 nt, Human
agucugucuacuuaaagucugu

SEQ ID NO: 825756 - RNA, 22 nt, Human
acucaggaaauugagauaaugg

SEQ ID NO: 825757 - RNA, 22 nt, Human
uacaaaguagaaauucaguaaa

SEQ ID NO: 825758 - RNA, 22 nt, Human
ggacagcugcuuucaggccaca

SEQ ID NO: 825759 - RNA, 22 nt, Human
uuuucagugggcaaugauguga

SEQ ID NO: 825760 - RNA, 22 nt, Human
uugguuuaggaacuggcuugga

SEQ ID NO: 825761 - RNA, 22 nt, Human
auuucucuuagcaagacauuac

SEQ ID NO: 825762 - RNA, 19 nt, Human
ggcagcuugggaagguagc

SEQ ID NO: 825763 - RNA, 22 nt, Human
ccaaaugugccuguuucaacaa

SEQ ID NO: 825764 - RNA, 22 nt, Human
aguacauauaguaauuuagcca

SEQ ID NO: 825765 - RNA, 22 nt, Human
aauaucaacaguguccuucuaa

SEQ ID NO: 825766 - RNA, 22 nt, Human
cccaugagguggagguugcagu

SEQ ID NO: 825767 - RNA, 19 nt, Human
guugaaaguaggugagggu

SEQ ID NO: 825768 - RNA, 22 nt, Human
agucucugccagcuuguccucu

SEQ ID NO: 825769 - RNA, 22 nt, Human
acagucuacuugagcuuguaua

SEQ ID NO: 825770 - RNA, 22 nt, Human
agcccaggaaguugaggcuugc

SEQ ID NO: 825771 - RNA, 22 nt, Human
cauuuguuggucagauuguagu

SEQ ID NO: 825772 - RNA, 22 nt, Human
uugcaggaaacugagugugagc

SEQ ID NO: 825773 - RNA, 22 nt, Human
uagugcuuggcccuaccagaua

SEQ ID NO: 825774 - RNA, 22 nt, Human
gcuguucucuguaacaugcauu

SEQ ID NO: 825775 - RNA, 21 nt, Human
aggcagcuggaaggccuggcu

SEQ ID NO: 825776 - RNA, 22 nt, Human
auucugagaaaugcauugucag

SEQ ID NO: 825777 - RNA, 22 nt, Human
guaaaauagaauaacguggcua

SEQ ID NO: 825778 - RNA, 22 nt, Human
acaaauauuuacugaauccacu

SEQ ID NO: 825779 - RNA, 22 nt, Human
gcucccagacugaccagaggug

SEQ ID NO: 825780 - RNA, 22 nt, Human
acuuucugcaguguuggaaaug

SEQ ID NO: 825781 - RNA, 22 nt, Human
aaucuucuuucuuaacaguaca

SEQ ID NO: 825782 - RNA, 22 nt, Human
aggcagugccuggaccccagcu

SEQ ID NO: 825783 - RNA, 22 nt, Human
guuaucaugcuucaucaucacu

SEQ ID NO: 825784 - RNA, 22 nt, Human
cccaggagaugcacuccauugg

SEQ ID NO: 825785 - RNA, 22 nt, Human
uauuuccauguuagaacuaagu

SEQ ID NO: 825786 - RNA, 21 nt, Human
uucuucaguuuaauauaaaau

SEQ ID NO: 825787 - RNA, 22 nt, Human
cuugcugggguaagucugugcu

SEQ ID NO: 825788 - RNA, 22 nt, Human
uuuaaauuuguguuuagagggu

SEQ ID NO: 825789 - RNA, 22 nt, Human
auuuccuuugcaaagacugugc

SEQ ID NO: 825790 - RNA, 22 nt, Human
aggcaccuugagagcaggagcu

SEQ ID NO: 825791 - RNA, 22 nt, Human
uuugaaaggaaguuaauacuuu

SEQ ID NO: 825792 - RNA, 22 nt, Human
gggcagcuagcccucuagccca

SEQ ID NO: 825793 - RNA, 22 nt, Human
gagaggugaaggcugcccuggg

SEQ ID NO: 825794 - RNA, 22 nt, Human
guucuucaguaaaauuaaaugu

SEQ ID NO: 825795 - RNA, 22 nt, Human
gaaggccaagaggcuccaagau

SEQ ID NO: 825796 - RNA, 22 nt, Human
gaggagagccugcacuuugacc

SEQ ID NO: 825797 - RNA, 22 nt, Human
gaggcagcuuaggguacugacu

SEQ ID NO: 825798 - RNA, 22 nt, Human
cacaauuuguuuuaucaguauu

SEQ ID NO: 825799 - RNA, 18 nt, Human
agcuucccucugagaggg

SEQ ID NO: 825800 - RNA, 22 nt, Human
ucaggagaacuuccuucuaccc

SEQ ID NO: 825801 - RNA, 22 nt, Human
cugccaucugagccaaaagugc

SEQ ID NO: 825802 - RNA, 21 nt, Human
uggagacucugguucuuugug

SEQ ID NO: 825803 - RNA, 22 nt, Human
aaccauuugccauuaucuuaag

SEQ ID NO: 825804 - RNA, 22 nt, Human
uuuaacagaugugaaauuuuca

SEQ ID NO: 825805 - RNA, 20 nt, Human
cucaggauacugcaaaguug

SEQ ID NO: 825806 - RNA, 20 nt, Human
cugcccagccacugagggau

SEQ ID NO: 825807 - RNA, 22 nt, Human
cacucaggcugugucaggagga

SEQ ID NO: 825808 - RNA, 22 nt, Human
gagggcuccauuccccgugccc

SEQ ID NO: 825809 - RNA, 22 nt, Human
aaaggagacuucagaucuccuu

SEQ ID NO: 825810 - RNA, 22 nt, Human
uggcagcagacaaaaggccauu

SEQ ID NO: 825811 - RNA, 22 nt, Human
gaaggccacaaaaaaugucaua

SEQ ID NO: 825812 - RNA, 22 nt, Human
auuggcaguuagugacgaggcu

SEQ ID NO: 825813 - RNA, 22 nt, Human
aaagacuuggcuuaugauuugc

SEQ ID NO: 825814 - RNA, 19 nt, Human
ugugaaagcuaguguucuu

SEQ ID NO: 825815 - RNA, 22 nt, Human
augcuguguuuuaaauggaaau

SEQ ID NO: 825816 - RNA, 22 nt, Human
gaggcagcaugguaccuuggag

SEQ ID NO: 825817 - RNA, 22 nt, Human
acaaaugucuccucuuuuguua

SEQ ID NO: 825818 - RNA, 22 nt, Human
cuacccagcaccuaggcugccu

SEQ ID NO: 825819 - RNA, 22 nt, Human
ucagguggcuuggagggggacg

SEQ ID NO: 825820 - RNA, 19 nt, Human
uuacuuggcaaagucaguc

SEQ ID NO: 825821 - RNA, 22 nt, Human
gcccaggaguucaaggcugcag

SEQ ID NO: 825822 - RNA, 21 nt, Human
ggcagccugacccccagagag

SEQ ID NO: 825823 - RNA, 22 nt, Human
ugauugaagaggugaggaaguu

SEQ ID NO: 825824 - RNA, 22 nt, Human
agaccaagacuauaaugagagg

SEQ ID NO: 825825 - RNA, 22 nt, Human
ggaggagggguuuacauuggaa

SEQ ID NO: 825826 - RNA, 22 nt, Human
uggcagcuccuggggccagcac

SEQ ID NO: 825827 - RNA, 22 nt, Human
aggcucagaggugagcaucugc

SEQ ID NO: 825828 - RNA, 22 nt, Human
cugcuuuguaaaauagacauaa

SEQ ID NO: 825829 - RNA, 22 nt, Human
uugcauuugaucuuggguucuc

SEQ ID NO: 825830 - RNA, 22 nt, Human
auacaacuuuaucuguaaugag

SEQ ID NO: 825831 - RNA, 22 nt, Human
cuucucagcaugguuacuguga

SEQ ID NO: 825832 - RNA, 21 nt, Human
ggacagcugcgcgcagggcuc

SEQ ID NO: 825833 - RNA, 23 nt, Human
uguugaaguaacuguuacauaga

SEQ ID NO: 825834 - RNA, 22 nt, Human
ggcagccuugagggaggccugg

SEQ ID NO: 825835 - RNA, 22 nt, Human
aggcagcuuuguaguaaagcua

SEQ ID NO: 825836 - RNA, 22 nt, Human
auccagucaaaauuaguaaggu

SEQ ID NO: 825837 - RNA, 22 nt, Human
cacagacccagaagggaugaag

SEQ ID NO: 825838 - RNA, 22 nt, Human
gcuucccagcagaggaaagacu

SEQ ID NO: 825839 - RNA, 22 nt, Human
cagaccucaguccucaguagga

SEQ ID NO: 825840 - RNA, 22 nt, Human
uagagcugggcagugcucugag

SEQ ID NO: 825841 - RNA, 22 nt, Human
cucuccucagaacaggcccucu

SEQ ID NO: 825842 - RNA, 22 nt, Human
uagggcaggugaagaaaagcua

SEQ ID NO: 825843 - RNA, 22 nt, Human
gcccaggaguuugcauuuuaac

SEQ ID NO: 825844 - RNA, 20 nt, Human
agcuucuucugucuaauuuu

SEQ ID NO: 825845 - RNA, 22 nt, Human
aggcagcuuaagcccuggccca

SEQ ID NO: 825846 - RNA, 22 nt, Human
cucaggauguacuacagaaggc

SEQ ID NO: 825847 - RNA, 22 nt, Human
caaggccaugagcagcgagugu

SEQ ID NO: 825848 - RNA, 22 nt, Human
gcccaggaaagauagggccuca

SEQ ID NO: 825849 - RNA, 22 nt, Human
uggcagcuuccugcucauagga

SEQ ID NO: 825850 - RNA, 22 nt, Human
gugaaggacuagcauggagggc

SEQ ID NO: 825851 - RNA, 21 nt, Human
agagagggagaugaaacaucc

SEQ ID NO: 825852 - RNA, 22 nt, Human
agaggggagagcuaagcaauuc

SEQ ID NO: 825853 - RNA, 23 nt, Human
agggagcuaaaaggcuggagcag

SEQ ID NO: 825854 - RNA, 22 nt, Human
caguuucuacgaaggucaaccc

SEQ ID NO: 825855 - RNA, 22 nt, Human
caaauagugucacauugugagg

SEQ ID NO: 825856 - RNA, 22 nt, Human
aacauauaaacucuuaaguuca

SEQ ID NO: 825857 - RNA, 22 nt, Human
guggcaggagacuggaagaugg

SEQ ID NO: 825858 - RNA, 22 nt, Human
cccuggaggcaaagguugcagu

SEQ ID NO: 825859 - RNA, 22 nt, Human
gguuauauaauucagugcuuuc

SEQ ID NO: 825860 - RNA, 19 nt, Human
agcauuuggaauucuacac

SEQ ID NO: 825861 - RNA, 22 nt, Human
gaggcagcauucgcauagacag

SEQ ID NO: 825862 - RNA, 23 nt, Human
auguuauuauuagcagucuugcc

SEQ ID NO: 825863 - RNA, 22 nt, Human
ugaggcaggagaaucacaugaa

SEQ ID NO: 825864 - RNA, 22 nt, Human
aaagcagagguugcagugagcu

SEQ ID NO: 825865 - RNA, 22 nt, Human
gcccaggaucugcucagaucau

SEQ ID NO: 825866 - RNA, 22 nt, Human
auuuugaugcuaucuaaugaau

SEQ ID NO: 825867 - RNA, 22 nt, Human
uccauuuuagaagaaaauccac

SEQ ID NO: 825868 - RNA, 22 nt, Human
accaggaguagaauaucuguga

SEQ ID NO: 825869 - RNA, 22 nt, Human
cuguggaaggccuguccugaaa

SEQ ID NO: 825870 - RNA, 22 nt, Human
aauaucaguauauuguaucagu

SEQ ID NO: 825871 - RNA, 22 nt, Human
aaggcagccucugccagccggg

SEQ ID NO: 825872 - RNA, 22 nt, Human
guaggcagugguuggaagagaa

SEQ ID NO: 825873 - RNA, 22 nt, Human
gccucugcaauuacauugugcc

SEQ ID NO: 825874 - RNA, 22 nt, Human
aggacuuagaacauuauguacu

SEQ ID NO: 825875 - RNA, 17 nt, Human
agagagagcaugccacc

SEQ ID NO: 825876 - RNA, 22 nt, Human
aggcaguuguagagagggcucu

SEQ ID NO: 825877 - RNA, 22 nt, Human
cagagagggcggcccuggcuuc

SEQ ID NO: 825878 - RNA, 22 nt, Human
aguuugaaauguuggcaauauu

SEQ ID NO: 825879 - RNA, 23 nt, Human
aggcagcagguuguccaggguga

SEQ ID NO: 825880 - RNA, 22 nt, Human
ggcucagaccucccagcuccag

SEQ ID NO: 825881 - RNA, 22 nt, Human
agaggauguucuaggcacucau

SEQ ID NO: 825882 - RNA, 22 nt, Human
cacccugggcugggccuguuaa

SEQ ID NO: 825883 - RNA, 22 nt, Human
gugcuuucugcugcauuccucu

SEQ ID NO: 825884 - RNA, 22 nt, Human
ccaggagagcaggcgugcagcu

SEQ ID NO: 825885 - RNA, 22 nt, Human
auguggaggaaaugaguguaca

SEQ ID NO: 825886 - RNA, 22 nt, Human
caugauuuugucuuguguuaau

SEQ ID NO: 825887 - RNA, 22 nt, Human
gggcaguugauggaggucugga

SEQ ID NO: 825888 - RNA, 22 nt, Human
ccaggagaauaauggcagauua

SEQ ID NO: 825889 - RNA, 22 nt, Human
auuugcuuuaagguauaaaagg

SEQ ID NO: 825890 - RNA, 22 nt, Human
agcccagguucuaaagccaaac

SEQ ID NO: 825891 - RNA, 22 nt, Human
uuuuaucuaccuaugcucauuu

SEQ ID NO: 825892 - RNA, 22 nt, Human
acucaggaagaaagcagcuggu

SEQ ID NO: 825893 - RNA, 22 nt, Human
augaggcaucugcagucacuag

SEQ ID NO: 825894 - RNA, 22 nt, Human
cugcugugauugggagaaaccg

SEQ ID NO: 825895 - RNA, 22 nt, Human
cucccagagaccaagcugagaa

SEQ ID NO: 825896 - RNA, 22 nt, Human
uccaggagugugugcuaauggg

SEQ ID NO: 825897 - RNA, 22 nt, Human
ucccaggaggugcuuccuagga

SEQ ID NO: 825898 - RNA, 18 nt, Human
gcagcugacacuggaguu

SEQ ID NO: 825899 - RNA, 22 nt, Human
aggccagcuuccagaggggcag

SEQ ID NO: 825900 - RNA, 22 nt, Human
augaaggcuguguagauggaug

SEQ ID NO: 825901 - RNA, 22 nt, Human
ucuccuccuuuuuucaacauag

SEQ ID NO: 825902 - RNA, 20 nt, Human
aggcaguuagaaggagauga

SEQ ID NO: 825903 - RNA, 22 nt, Human
aaggcaguaaaaucuaccuugc

SEQ ID NO: 825904 - RNA, 20 nt, Human
cucaggauugucuagccccu

SEQ ID NO: 825905 - RNA, 18 nt, Human
agggagagaccgcggguc

SEQ ID NO: 825906 - RNA, 18 nt, Human
ccucagggagagagacgc

SEQ ID NO: 825907 - RNA, 22 nt, Human
ggcuuggaccagucacaguggu

SEQ ID NO: 825908 - RNA, 22 nt, Human
ugcuugaaagggguuucccagu

SEQ ID NO: 825909 - RNA, 22 nt, Human
caggauagaaaggccauggagu

SEQ ID NO: 825910 - RNA, 22 nt, Human
uccugaggcucacuuugaaugu

SEQ ID NO: 825911 - RNA, 22 nt, Human
gugcagcugugguggagccagg

SEQ ID NO: 825912 - RNA, 22 nt, Human
caucacccggaacugugucugc

SEQ ID NO: 825913 - RNA, 22 nt, Human
uuugaaagagcugauacaugaa

SEQ ID NO: 825914 - RNA, 22 nt, Human
gaggacagagccgccuggcaag

SEQ ID NO: 825915 - RNA, 22 nt, Human
cagagccaggucuaggagucuc

SEQ ID NO: 825916 - RNA, 22 nt, Human
aaaacuaaauacgcuuugccuc

SEQ ID NO: 825917 - RNA, 22 nt, Human
ccaggaugacccccacuuuccu

SEQ ID NO: 825918 - RNA, 22 nt, Human
ucugggaaugaauaagaccugu

SEQ ID NO: 825919 - RNA, 17 nt, Human
uggcagcugaaagcucu

SEQ ID NO: 825920 - RNA, 22 nt, Human
uuuaaaaucagaugggaguugg

SEQ ID NO: 825921 - RNA, 22 nt, Human
ggggggugcugaucaguggagc

SEQ ID NO: 825922 - RNA, 19 nt, Human
uggagaggaaaugcugcuc

SEQ ID NO: 825923 - RNA, 22 nt, Human
caaggccaaagggccacuguca

SEQ ID NO: 825924 - RNA, 22 nt, Human
ccaggagacaaagaugacugcu

SEQ ID NO: 825925 - RNA, 22 nt, Human
ucaucucaaaacccaaggggca

SEQ ID NO: 825926 - RNA, 22 nt, Human
ucuggcaggucaaucauucuuu

SEQ ID NO: 825927 - RNA, 22 nt, Human
uucauucuugucuuuguauagu

SEQ ID NO: 825928 - RNA, 22 nt, Human
uuccaugaaggagacugagaag

SEQ ID NO: 825929 - RNA, 22 nt, Human
gaucuucucuuuaguagaaaca

SEQ ID NO: 825930 - RNA, 22 nt, Human
aggcaacuuuuggggaugaugg

SEQ ID NO: 825931 - RNA, 22 nt, Human
uugugaguagugccgcaauaaa

SEQ ID NO: 825932 - RNA, 22 nt, Human
cggcagcugauugcagagcacc

SEQ ID NO: 825933 - RNA, 22 nt, Human
uugcuuuguggugguucuucca

SEQ ID NO: 825934 - RNA, 22 nt, Human
ggagagugggagcaacuguugc

SEQ ID NO: 825935 - RNA, 22 nt, Human
agaggcaggagguugacuugag

SEQ ID NO: 825936 - RNA, 22 nt, Human
cccaggaugucgaggcugcagu

SEQ ID NO: 825937 - RNA, 22 nt, Human
uggaaugacagagagucugaau

SEQ ID NO: 825938 - RNA, 20 nt, Human
uucaggauucuagaccacac

SEQ ID NO: 825939 - RNA, 22 nt, Human
aaagauuugaguucugcuuaua

SEQ ID NO: 825940 - RNA, 22 nt, Human
uuuuuaguagagguggguuuca

SEQ ID NO: 825941 - RNA, 22 nt, Human
gaggaaccaaucugugauauuc

SEQ ID NO: 825942 - RNA, 20 nt, Human
auuuggcaugaaguauugau

SEQ ID NO: 825943 - RNA, 22 nt, Human
uucuucuucuggcugcaccugg

SEQ ID NO: 825944 - RNA, 20 nt, Human
acuugcugggcuuuguuacc

SEQ ID NO: 825945 - RNA, 22 nt, Human
ucaucugucccaggcuuuuuuc

SEQ ID NO: 825946 - RNA, 22 nt, Human
uuuaaauucugucugccgcuua

SEQ ID NO: 825947 - RNA, 22 nt, Human
gcagcugaaagggaucucuaca

SEQ ID NO: 825948 - RNA, 22 nt, Human
ucauuucccuccuacaaagagg

SEQ ID NO: 825949 - RNA, 22 nt, Human
agugcuuucccugaaaccuucc

SEQ ID NO: 825950 - RNA, 21 nt, Human
cuguggaagggaacuagaggg

SEQ ID NO: 825951 - RNA, 22 nt, Human
gagguggaaggcaggaacaaau

SEQ ID NO: 825952 - RNA, 22 nt, Human
acuucuucuucagcugggggau

SEQ ID NO: 825953 - RNA, 22 nt, Human
uccaggagacacaagguacaua

SEQ ID NO: 825954 - RNA, 22 nt, Human
ggcagacuguaauaggagaauu

SEQ ID NO: 825955 - RNA, 22 nt, Human
gucacuguuuccuauuauauuu

SEQ ID NO: 825956 - RNA, 22 nt, Human
uacuaucucuucuaacuucaga

SEQ ID NO: 825957 - RNA, 22 nt, Human
ggcuuggaaaugguaaugagcu

SEQ ID NO: 825958 - RNA, 22 nt, Human
auucacaaaaugauauagauac

SEQ ID NO: 825959 - RNA, 21 nt, Human
auuucagagcacacaaguaaa

SEQ ID NO: 825960 - RNA, 22 nt, Human
acuguguggaccacucugaggc

SEQ ID NO: 825961 - RNA, 17 nt, Human
ucauuuguugugacuag

SEQ ID NO: 825962 - RNA, 22 nt, Human
uccaggaguuugaccugugggc

SEQ ID NO: 825963 - RNA, 21 nt, Human
uaaggccaagucuauuucugu

SEQ ID NO: 825964 - RNA, 21 nt, Human
ugaggcaggggugcuuuuguc

SEQ ID NO: 825965 - RNA, 22 nt, Human
cugcccaggcugaaggaacauc

SEQ ID NO: 825966 - RNA, 23 nt, Human
aggucagcaggcaaggaaauggc

SEQ ID NO: 825967 - RNA, 22 nt, Human
ggaggagguggguuaaguugua

SEQ ID NO: 825968 - RNA, 22 nt, Human
auuauuauuguugauguuaggg

SEQ ID NO: 825969 - RNA, 22 nt, Human
gaaggccauuagagccugugcc

SEQ ID NO: 825970 - RNA, 20 nt, Human
aucuucuuggccagcuugcu

SEQ ID NO: 825971 - RNA, 22 nt, Human
aaagcagauucugaugcaguag

SEQ ID NO: 825972 - RNA, 22 nt, Human
aggcagcagucaugaggaaaga

SEQ ID NO: 825973 - RNA, 22 nt, Human
auuugcuuucagguauaaaagg

SEQ ID NO: 825974 - RNA, 18 nt, Human
aaacuggcuuggccugug

SEQ ID NO: 825975 - RNA, 22 nt, Human
aggguccugggugcaguugcuu

SEQ ID NO: 825976 - RNA, 22 nt, Human
gaccauuuguugaaaagauuau

SEQ ID NO: 825977 - RNA, 17 nt, Human
uccaugagacaugaaga

SEQ ID NO: 825978 - RNA, 17 nt, Human
cagcucugcaucuuccu

SEQ ID NO: 825979 - RNA, 22 nt, Human
ucucuguacaguacaugccgug

SEQ ID NO: 825980 - RNA, 22 nt, Human
uuucuucacaggguauugggug

SEQ ID NO: 825981 - RNA, 22 nt, Human
gcucaggaucagccaccucuuu

SEQ ID NO: 825982 - RNA, 22 nt, Human
acuugcauuauauuuaucacaa

SEQ ID NO: 825983 - RNA, 22 nt, Human
cuucuucagcacaauauugaug

SEQ ID NO: 825984 - RNA, 22 nt, Human
cccaggaggcagaaguugcagu

SEQ ID NO: 825985 - RNA, 22 nt, Human
ggcagaagauaggacagggaau

SEQ ID NO: 825986 - RNA, 22 nt, Human
uuccuuaguguuagauucugug

SEQ ID NO: 825987 - RNA, 20 nt, Human
uuuuccagaaaguaucauug

SEQ ID NO: 825988 - RNA, 22 nt, Human
cucccagagagcaggugggccg

SEQ ID NO: 825989 - RNA, 22 nt, Human
caguugccuacuacauggcagg

SEQ ID NO: 825990 - RNA, 22 nt, Human
uagaaaugauugguugagcucu

SEQ ID NO: 825991 - RNA, 19 nt, Human
ugcccaggccagguugggc

SEQ ID NO: 825992 - RNA, 22 nt, Human
ucauuguuauguuuugcugucu

SEQ ID NO: 825993 - RNA, 22 nt, Human
uuauuuacaacucuucucuucc

SEQ ID NO: 825994 - RNA, 22 nt, Human
cuccaugaauuugagcuuugug

SEQ ID NO: 825995 - RNA, 22 nt, Human
cugcauuagucaugcuuugcag

SEQ ID NO: 825996 - RNA, 22 nt, Human
ucagagaguuagugucuuagcu

SEQ ID NO: 825997 - RNA, 22 nt, Human
cuggcugugcagucuuccagaa

SEQ ID NO: 825998 - RNA, 22 nt, Human
aggccagacagcuagaaacagg

SEQ ID NO: 825999 - RNA, 22 nt, Human
uugcuucaguagcucuuuaaag

SEQ ID NO: 826000 - RNA, 22 nt, Human
auccaugaagguacuucucagg

SEQ ID NO: 826001 - RNA, 22 nt, Human
ccuggagaccagaggauacuuc

SEQ ID NO: 826002 - RNA, 23 nt, Human
uuccagaguccacaucugccacc

SEQ ID NO: 826003 - RNA, 22 nt, Human
auuaaauuuucacuaggcuccc

SEQ ID NO: 826004 - RNA, 22 nt, Human
uuucacagguacaaacacuccu

SEQ ID NO: 826005 - RNA, 22 nt, Human
ucucucuuuuuaaucauguaau

SEQ ID NO: 826006 - RNA, 22 nt, Human
cugguacaaaaugcugauauca

SEQ ID NO: 826007 - RNA, 22 nt, Human
cagcaggauaugguggagagag

SEQ ID NO: 826008 - RNA, 22 nt, Human
uaacaguguggacuugagaucu

SEQ ID NO: 826009 - RNA, 22 nt, Human
ccucuucugcuucaggagcacu

SEQ ID NO: 826010 - RNA, 18 nt, Human
acucaggaaaugaugaca

SEQ ID NO: 826011 - RNA, 22 nt, Human
gagaggcagaggccugaaaccg

SEQ ID NO: 826012 - RNA, 23 nt, Human
cagaaaacccagagcucaguccc

SEQ ID NO: 826013 - RNA, 22 nt, Human
cagcuuccgaccgggggcugca

SEQ ID NO: 826014 - RNA, 22 nt, Human
aaggcagcaacuaauggaucuc

SEQ ID NO: 826015 - RNA, 22 nt, Human
augcugagcagagcugacaugc

SEQ ID NO: 826016 - RNA, 22 nt, Human
aaugucugagucucuguauccc

SEQ ID NO: 826017 - RNA, 22 nt, Human
ucccaggaaggauucggcauuu

SEQ ID NO: 826018 - RNA, 22 nt, Human
augaaggcaguuaaacgucauc

SEQ ID NO: 826019 - RNA, 22 nt, Human
uuuuaucugcuucauuaguuga

SEQ ID NO: 826020 - RNA, 22 nt, Human
gucuucuuguuuugaaggaaau

SEQ ID NO: 826021 - RNA, 22 nt, Human
agcccaggucucaaaguacagg

SEQ ID NO: 826022 - RNA, 22 nt, Human
aaggcagcagaggaaaggugcu

SEQ ID NO: 826023 - RNA, 22 nt, Human
aauauaugugguauugaccagc

SEQ ID NO: 826024 - RNA, 22 nt, Human
aggcacagagaaugcccuccau

SEQ ID NO: 826025 - RNA, 22 nt, Human
uagggauguggugagaacugag

SEQ ID NO: 826026 - RNA, 22 nt, Human
uggaaagucucuuuugacugua

SEQ ID NO: 826027 - RNA, 22 nt, Human
uccuuagagauacugucuugaa

SEQ ID NO: 826028 - RNA, 22 nt, Human
aggcagcugaccacaguaugau

SEQ ID NO: 826029 - RNA, 22 nt, Human
uugcugugaaaccaugggaagu

SEQ ID NO: 826030 - RNA, 22 nt, Human
auucugagacaauugccgucag

SEQ ID NO: 826031 - RNA, 22 nt, Human
caggaaaggugugucaugaugg

SEQ ID NO: 826032 - RNA, 22 nt, Human
auugaaagcacaaagaacaagu

SEQ ID NO: 826033 - RNA, 22 nt, Human
uuuggaauuggaaagugcugug

SEQ ID NO: 826034 - RNA, 22 nt, Human
gagguagccacagauagagacu

SEQ ID NO: 826035 - RNA, 22 nt, Human
ggcagcuuccugagccagcagc

SEQ ID NO: 826036 - RNA, 22 nt, Human
guuuucaaggggauuuaacuga

SEQ ID NO: 826037 - RNA, 22 nt, Human
uuuccaagagcuuauuucugaa

SEQ ID NO: 826038 - RNA, 22 nt, Human
gaaacugugaucguguucuggg

SEQ ID NO: 826039 - RNA, 22 nt, Human
aacauuuaugauugagguaaau

SEQ ID NO: 826040 - RNA, 22 nt, Human
uuucuuguaagauguuuauuaa

SEQ ID NO: 826041 - RNA, 20 nt, Human
acaggggcagcacaauaaug

SEQ ID NO: 826042 - RNA, 22 nt, Human
ugaaggaaugaguauacuguuu

SEQ ID NO: 826043 - RNA, 22 nt, Human
aagagggcugcaaucuuauugc

SEQ ID NO: 826044 - RNA, 22 nt, Human
uuaaaaugaauauugauuagca

SEQ ID NO: 826045 - RNA, 22 nt, Human
uuucuucauagaccuugucuug

SEQ ID NO: 826046 - RNA, 22 nt, Human
guggcaggagagacacagccau

SEQ ID NO: 826047 - RNA, 22 nt, Human
uauuuguugaguuguuaugucu

SEQ ID NO: 826048 - RNA, 22 nt, Human
acaaauaugguacucggagaaa

SEQ ID NO: 826049 - RNA, 22 nt, Human
ccaggcugccgaggaaagaaag

SEQ ID NO: 826050 - RNA, 22 nt, Human
gagggugggccagauaugaggg

SEQ ID NO: 826051 - RNA, 22 nt, Human
uguuuuaaucucccauugcucu

SEQ ID NO: 826052 - RNA, 22 nt, Human
cuuaagaugaggucaugcuaua

SEQ ID NO: 826053 - RNA, 22 nt, Human
uucuuaacuggaaaaugucaga

SEQ ID NO: 826054 - RNA, 22 nt, Human
gcuacugauugaccuuggagag

SEQ ID NO: 826055 - RNA, 22 nt, Human
cauuuguaggaugcuucuuguu

SEQ ID NO: 826056 - RNA, 22 nt, Human
cagucucuaaaucaaucugaau

SEQ ID NO: 826057 - RNA, 22 nt, Human
cucuucuugaaagaggaauuca

SEQ ID NO: 826058 - RNA, 22 nt, Human
ucacuucacacccacuaucaug

SEQ ID NO: 826059 - RNA, 22 nt, Human
uggcaaggcugugggggcagag

SEQ ID NO: 826060 - RNA, 22 nt, Human
aucuuucaguuucauaccaauu

SEQ ID NO: 826061 - RNA, 22 nt, Human
ugcuucuggaaacaguggcugu

SEQ ID NO: 826062 - RNA, 22 nt, Human
agaccaagugcaggugccacua

SEQ ID NO: 826063 - RNA, 22 nt, Human
uauuuucuggacagucuugcuu

SEQ ID NO: 826064 - RNA, 22 nt, Human
auggaguucuuuaaauucacag

SEQ ID NO: 826065 - RNA, 22 nt, Human
uucacagucacccuucuccaug

SEQ ID NO: 826066 - RNA, 22 nt, Human
ggccaggagaggagggcacuga

SEQ ID NO: 826067 - RNA, 22 nt, Human
ucauuuaauagcuuuugucuuu

SEQ ID NO: 826068 - RNA, 20 nt, Human
aaacauucauguacaaguga

SEQ ID NO: 826069 - RNA, 21 nt, Human
acagcauguuuguguguuugc

SEQ ID NO: 826070 - RNA, 22 nt, Human
ucagagaguuacacaaauuguu

SEQ ID NO: 826071 - RNA, 22 nt, Human
uucuuucucaacaugaauguuu

SEQ ID NO: 826072 - RNA, 22 nt, Human
uuucccaguucccugcucuaua

SEQ ID NO: 826073 - RNA, 22 nt, Human
ugaaggccacuuccugugagcu

SEQ ID NO: 826074 - RNA, 22 nt, Human
gaauagcuuccuuuuuuccaaa

SEQ ID NO: 826075 - RNA, 22 nt, Human
ugaggcaguauuuuagugacuu

SEQ ID NO: 826076 - RNA, 22 nt, Human
ugacauaauaauccaaacauac

SEQ ID NO: 826077 - RNA, 22 nt, Human
cugcugugucagaguccagggg

SEQ ID NO: 826078 - RNA, 22 nt, Human
cccaugagaccugguuuaaggc

SEQ ID NO: 826079 - RNA, 22 nt, Human
cagcuccucacgagucuugaaa

SEQ ID NO: 826080 - RNA, 22 nt, Human
agaggccaggcugcagagggau

SEQ ID NO: 826081 - RNA, 22 nt, Human
aggcacaggccucagcacccag

SEQ ID NO: 826082 - RNA, 22 nt, Human
agaaaacuugucacagcucuca

SEQ ID NO: 826083 - RNA, 22 nt, Human
acccaggacaugggcacccgug

SEQ ID NO: 826084 - RNA, 22 nt, Human
uuuuuauaacucuuuugugaca

SEQ ID NO: 826085 - RNA, 22 nt, Human
auuggcaggaaccgaggagggg

SEQ ID NO: 826086 - RNA, 22 nt, Human
cauuuauucauuugcuagggcu

SEQ ID NO: 826087 - RNA, 22 nt, Human
gcuaugcaggagccuaaugaca

SEQ ID NO: 826088 - RNA, 22 nt, Human
guggcagcaaaugccuggacua

SEQ ID NO: 826089 - RNA, 22 nt, Human
uuucacaaaugucuuuaacuug

SEQ ID NO: 826090 - RNA, 22 nt, Human
agagugcaaccgaaacaagcag

SEQ ID NO: 826091 - RNA, 22 nt, Human
agucucugucguagaucagcgu

SEQ ID NO: 826092 - RNA, 17 nt, Human
aaggccauuuccaccca

SEQ ID NO: 826093 - RNA, 22 nt, Human
uauuuccaggccccacucuaga

SEQ ID NO: 826094 - RNA, 22 nt, Human
gcccaggaggcagagguugugg

SEQ ID NO: 826095 - RNA, 23 nt, Human
agaugaggcuucuccauguuggu

SEQ ID NO: 826096 - RNA, 22 nt, Human
gaggguggguuucuugcacguc

SEQ ID NO: 826097 - RNA, 18 nt, Human
ugaauagggguuugcaga

SEQ ID NO: 826098 - RNA, 21 nt, Human
uucuucuuggacuguuuuggc

SEQ ID NO: 826099 - RNA, 22 nt, Human
uuuguuuagaaagagauuggug

SEQ ID NO: 826100 - RNA, 22 nt, Human
agcuggcagcucucagggguac

SEQ ID NO: 826101 - RNA, 22 nt, Human
uucuucucagggucccacaugg

SEQ ID NO: 826102 - RNA, 22 nt, Human
uucuucuuucccccugugguac

SEQ ID NO: 826103 - RNA, 22 nt, Human
uggcagcuacagacagagguga

SEQ ID NO: 826104 - RNA, 23 nt, Human
agaggggagcaucugcuggcuga

SEQ ID NO: 826105 - RNA, 22 nt, Human
agaggcaguauacaauccgagc

SEQ ID NO: 826106 - RNA, 22 nt, Human
uccaggaguccugggagugauu

SEQ ID NO: 826107 - RNA, 22 nt, Human
gaccauuucuaggaaucagacu

SEQ ID NO: 826108 - RNA, 18 nt, Human
augggaggggccaagaga

SEQ ID NO: 826109 - RNA, 22 nt, Human
ccagguaggagagagggauccu

SEQ ID NO: 826110 - RNA, 22 nt, Human
uacccagggcuuuucugaugca

SEQ ID NO: 826111 - RNA, 22 nt, Human
cuagcaucagaugagaagcugu

SEQ ID NO: 826112 - RNA, 21 nt, Human
acaggagaccgccuggcaguc

SEQ ID NO: 826113 - RNA, 22 nt, Human
caaggccauauugccuguaugu

SEQ ID NO: 826114 - RNA, 22 nt, Human
ugaacucucucaagugacagaa

SEQ ID NO: 826115 - RNA, 22 nt, Human
ugcuguguucuccugacucacc

SEQ ID NO: 826116 - RNA, 22 nt, Human
agugugucugaucacuugugag

SEQ ID NO: 826117 - RNA, 22 nt, Human
caggaugaagggcaaaggcaag

SEQ ID NO: 826118 - RNA, 22 nt, Human
gaaccucagugaaacuggaggu

SEQ ID NO: 826119 - RNA, 22 nt, Human
ugaaugaguuuggcugcuguuc

SEQ ID NO: 826120 - RNA, 22 nt, Human
ucaguucugcuagaaaaacagu

SEQ ID NO: 826121 - RNA, 22 nt, Human
aggcagcuucugauuagcagcg

SEQ ID NO: 826122 - RNA, 22 nt, Human
augaggcaaucaugguccaguu

SEQ ID NO: 826123 - RNA, 22 nt, Human
acaugauuuuaguaucauaaua

SEQ ID NO: 826124 - RNA, 22 nt, Human
uuucacauuagauaugucauuu

SEQ ID NO: 826125 - RNA, 22 nt, Human
gcagaggggaagcugaggaauu

SEQ ID NO: 826126 - RNA, 22 nt, Human
cuccaggagggggauggcugua

SEQ ID NO: 826127 - RNA, 22 nt, Human
cagggaggcugucuuaugccug

SEQ ID NO: 826128 - RNA, 19 nt, Human
uccucagugacaaccucag

SEQ ID NO: 826129 - RNA, 22 nt, Human
ugcugugagguugagaaggaag

SEQ ID NO: 826130 - RNA, 19 nt, Human
gaggcgaggcgugcaggag

SEQ ID NO: 826131 - RNA, 22 nt, Human
gaggcagcugaaggagugacag

SEQ ID NO: 826132 - RNA, 22 nt, Human
ggcagcuggggcagugcccugu

SEQ ID NO: 826133 - RNA, 22 nt, Human
guuauacauauguguuaacaaa

SEQ ID NO: 826134 - RNA, 22 nt, Human
ugccuugcgggcguuucuguug

SEQ ID NO: 826135 - RNA, 20 nt, Human
gucaggauuaguaaacucug

SEQ ID NO: 826136 - RNA, 22 nt, Human
gggcagcugccacuccgcuugc

SEQ ID NO: 826137 - RNA, 22 nt, Human
cccaggaagaggggucaggugu

SEQ ID NO: 826138 - RNA, 22 nt, Human
uguuuuaaagccauugccuuuc

SEQ ID NO: 826139 - RNA, 22 nt, Human
caaaugauacuguuuuuagucu

SEQ ID NO: 826140 - RNA, 23 nt, Human
guaaaauacgcagugcaguguga

SEQ ID NO: 826141 - RNA, 22 nt, Human
uauuugaaaguguacaaaaacu

SEQ ID NO: 826142 - RNA, 22 nt, Human
uaucaauacauguuaucagugu

SEQ ID NO: 826143 - RNA, 22 nt, Human
ucuucccuaaucaccaucuuca

SEQ ID NO: 826144 - RNA, 22 nt, Human
cauuaaaauaucucaugguguu

SEQ ID NO: 826145 - RNA, 21 nt, Human
uucuucaugaugauuaauggc

SEQ ID NO: 826146 - RNA, 22 nt, Human
uugcacuaggaaaaggcagcca

SEQ ID NO: 826147 - RNA, 19 nt, Human
agaggcagucuccaacagg

SEQ ID NO: 826148 - RNA, 22 nt, Human
cuggguaaguuccuaaggcuca

SEQ ID NO: 826149 - RNA, 22 nt, Human
gcacagcucgagcucaggaggg

SEQ ID NO: 826150 - RNA, 22 nt, Human
gaagcagccacggggagacaga

SEQ ID NO: 826151 - RNA, 22 nt, Human
ccugccugcaccuucucugggg

SEQ ID NO: 826152 - RNA, 22 nt, Human
cagcaggagcagucagacuccu

SEQ ID NO: 826153 - RNA, 22 nt, Human
gagagguccauuccccugucag

SEQ ID NO: 826154 - RNA, 22 nt, Human
uucuccagagggcucugcagga

SEQ ID NO: 826155 - RNA, 22 nt, Human
uucucagaauugacugggagca

SEQ ID NO: 826156 - RNA, 22 nt, Human
aauugcuaaagauuauguuuuc

SEQ ID NO: 826157 - RNA, 22 nt, Human
acccaggauaaucuguguaucu

SEQ ID NO: 826158 - RNA, 22 nt, Human
uccaugagcuagcuuuccaaag

SEQ ID NO: 826159 - RNA, 22 nt, Human
aaaauugaagugaucaggaacu

SEQ ID NO: 826160 - RNA, 22 nt, Human
agggcagcccuucugggagggc

SEQ ID NO: 826161 - RNA, 22 nt, Human
cccaggagcuucucucugccuc

SEQ ID NO: 826162 - RNA, 22 nt, Human
augaggcaguacacacaaagcc

SEQ ID NO: 826163 - RNA, 22 nt, Human
cgcagggauuucaaggggccuu

SEQ ID NO: 826164 - RNA, 22 nt, Human
uucuuuuccuacacagcgauuu

SEQ ID NO: 826165 - RNA, 22 nt, Human
gcaugucaugucauguaggaau

SEQ ID NO: 826166 - RNA, 22 nt, Human
caggcagcguccugcuuccugu

SEQ ID NO: 826167 - RNA, 22 nt, Human
ucugggaacucugucauuuccc

SEQ ID NO: 826168 - RNA, 18 nt, Human
gaugggagcaagagaaga

SEQ ID NO: 826169 - RNA, 22 nt, Human
ucaggauguuaauauagcauua

SEQ ID NO: 826170 - RNA, 22 nt, Human
acauauauuacuaguaaagaca

SEQ ID NO: 826171 - RNA, 22 nt, Human
cuauuacauuucuggacauuca

SEQ ID NO: 826172 - RNA, 22 nt, Human
auugaaaguccuaucuaaggga

SEQ ID NO: 826173 - RNA, 22 nt, Human
ccagagagaaauggauuugagu

SEQ ID NO: 826174 - RNA, 22 nt, Human
acagaaauugggcaaauggaag

SEQ ID NO: 826175 - RNA, 22 nt, Human
cuuuggcacagucucauuugau

SEQ ID NO: 826176 - RNA, 22 nt, Human
cucccagggucuaggcugcugg

SEQ ID NO: 826177 - RNA, 18 nt, Human
aagaggaggaaacccagg

SEQ ID NO: 826178 - RNA, 22 nt, Human
gaggggagacagggaaaucagu

SEQ ID NO: 826179 - RNA, 22 nt, Human
cucuucuugucucugguuagaa

SEQ ID NO: 826180 - RNA, 22 nt, Human
aggaagcucaaagccaugaugu

SEQ ID NO: 826181 - RNA, 22 nt, Human
gucuccugagccuugacugcaa

SEQ ID NO: 826182 - RNA, 22 nt, Human
auagucuuagaucagauaaagu

SEQ ID NO: 826183 - RNA, 22 nt, Human
gcaucuaaauaaacgugggagu

SEQ ID NO: 826184 - RNA, 19 nt, Human
uauggcaggccgaggcacu

SEQ ID NO: 826185 - RNA, 22 nt, Human
aggacagcccuugagagcacau

SEQ ID NO: 826186 - RNA, 22 nt, Human
cugcuguguaucauuuuagaug

SEQ ID NO: 826187 - RNA, 22 nt, Human
cuggccagcugacagcagggcu

SEQ ID NO: 826188 - RNA, 22 nt, Human
ccauccuaucugaccuacuugu

SEQ ID NO: 826189 - RNA, 22 nt, Human
caucaucaaaagugacagagaa

SEQ ID NO: 826190 - RNA, 20 nt, Human
aggcagcugggaaaugaggg

SEQ ID NO: 826191 - RNA, 22 nt, Human
ucagucuucccuccagugcaac

SEQ ID NO: 826192 - RNA, 22 nt, Human
ggaggacaggggcugcagcaca

SEQ ID NO: 826193 - RNA, 22 nt, Human
acacauuucuaaauuuuuaccg

SEQ ID NO: 826194 - RNA, 22 nt, Human
gaaauauuucucuugagccccu

SEQ ID NO: 826195 - RNA, 22 nt, Human
uugaaauggaagugaaaauucu

SEQ ID NO: 826196 - RNA, 19 nt, Human
ccauggagagagaugcauu

SEQ ID NO: 826197 - RNA, 22 nt, Human
cuucuucaauagcaagcgcaua

SEQ ID NO: 826198 - RNA, 22 nt, Human
aggagacaucuaacuguagguu

SEQ ID NO: 826199 - RNA, 22 nt, Human
cuccccagguucaggagguggg

SEQ ID NO: 826200 - RNA, 22 nt, Human
uucuccagaccuugugacuaug

SEQ ID NO: 826201 - RNA, 22 nt, Human
cacaaaugugcagaaaugugag

SEQ ID NO: 826202 - RNA, 22 nt, Human
cuccaggaaaauagggaaugag

SEQ ID NO: 826203 - RNA, 22 nt, Human
ggagaggacauggcucccacag

SEQ ID NO: 826204 - RNA, 22 nt, Human
uggagagguuuaaacaaaaguu

SEQ ID NO: 826205 - RNA, 22 nt, Human
acaucucaugaaugauaaauca

SEQ ID NO: 826206 - RNA, 22 nt, Human
gcugcuguugauuuaguccaau

SEQ ID NO: 826207 - RNA, 22 nt, Human
agcccagggacagggcggaugu

SEQ ID NO: 826208 - RNA, 22 nt, Human
ggcagcuuccuaggagagggca

SEQ ID NO: 826209 - RNA, 22 nt, Human
uagcugcugcagcacagggagg

SEQ ID NO: 826210 - RNA, 22 nt, Human
uuucucaguuacuagcuguggu

SEQ ID NO: 826211 - RNA, 22 nt, Human
cccaggugcugcgugaagccuc

SEQ ID NO: 826212 - RNA, 22 nt, Human
uuagccauauagaaaaagagcu

SEQ ID NO: 826213 - RNA, 22 nt, Human
uuugaaaguucuucugacacua

SEQ ID NO: 826214 - RNA, 22 nt, Human
accaggaggaaguguuaaugau

SEQ ID NO: 826215 - RNA, 22 nt, Human
uuaggaguccagaugucuuggg

SEQ ID NO: 826216 - RNA, 22 nt, Human
caggcagcagaggaguguggga

SEQ ID NO: 826217 - RNA, 22 nt, Human
aggcaggcacuccggaaguguc

SEQ ID NO: 826218 - RNA, 22 nt, Human
gagccagcuauguagcaagagg

SEQ ID NO: 826219 - RNA, 22 nt, Human
uuugacauuauccuguuacugg

SEQ ID NO: 826220 - RNA, 22 nt, Human
auucuucacauaagugcuguac

SEQ ID NO: 826221 - RNA, 22 nt, Human
uucuucaaacaaaaguggcaug

SEQ ID NO: 826222 - RNA, 22 nt, Human
ucuaaccuuugaaacugcuuuc

SEQ ID NO: 826223 - RNA, 22 nt, Human
gggcagcuccuguggaauccac

SEQ ID NO: 826224 - RNA, 22 nt, Human
aggaagcuagagccaccggacu

SEQ ID NO: 826225 - RNA, 22 nt, Human
uuuacaaccucauauucugaug

SEQ ID NO: 826226 - RNA, 22 nt, Human
aaacauuugcaacucgguuugg

SEQ ID NO: 826227 - RNA, 22 nt, Human
cccaggaaaucaggcuuucuag

SEQ ID NO: 826228 - RNA, 22 nt, Human
ucauuuguucaucugcucuucu

SEQ ID NO: 826229 - RNA, 22 nt, Human
cagagggcucuuggcugccugc

SEQ ID NO: 826230 - RNA, 23 nt, Human
ucucaagaggaagcagggcucau

SEQ ID NO: 826231 - RNA, 22 nt, Human
cgaggcaggcaggcggaggaua

SEQ ID NO: 826232 - RNA, 22 nt, Human
cggagaggugggggcagcaucu

SEQ ID NO: 826233 - RNA, 22 nt, Human
uguacauacauagauauacaca

SEQ ID NO: 826234 - RNA, 22 nt, Human
aagaagagaacuggcauccuaa

SEQ ID NO: 826235 - RNA, 22 nt, Human
uaguuuuacuugcgaugauaau

SEQ ID NO: 826236 - RNA, 20 nt, Human
gggcagcuccccucauucug

SEQ ID NO: 826237 - RNA, 22 nt, Human
acucagaaugacugaugcugug

SEQ ID NO: 826238 - RNA, 22 nt, Human
cccaugagauucugaauuuggc

SEQ ID NO: 826239 - RNA, 23 nt, Human
aaacugcuuccaauuccugccau

SEQ ID NO: 826240 - RNA, 22 nt, Human
ucugggaauuuauuggcacuuu

SEQ ID NO: 826241 - RNA, 22 nt, Human
cuggcuuucucugugguguuca

SEQ ID NO: 826242 - RNA, 22 nt, Human
ucugcaggcucuagaugagguu

SEQ ID NO: 826243 - RNA, 22 nt, Human
gcaggagagucugugccagguu

SEQ ID NO: 826244 - RNA, 22 nt, Human
cugaaugaggaaaagagugagg

SEQ ID NO: 826245 - RNA, 22 nt, Human
ucauuuguacuugugugcuugu

SEQ ID NO: 826246 - RNA, 22 nt, Human
caggcagaguuagagcaacugg

SEQ ID NO: 826247 - RNA, 18 nt, Human
uuccaugauuccuuucac

SEQ ID NO: 826248 - RNA, 22 nt, Human
cagaaggcuggcagauugagau

SEQ ID NO: 826249 - RNA, 22 nt, Human
uaucuguuugcucacagguguu

SEQ ID NO: 826250 - RNA, 22 nt, Human
gcaggaagcauagaagaaugcc

SEQ ID NO: 826251 - RNA, 22 nt, Human
gugcuuuuaaaggcaauuagua

SEQ ID NO: 826252 - RNA, 22 nt, Human
aggccagaaauuuggaguaugu

SEQ ID NO: 826253 - RNA, 21 nt, Human
uuccagagauuguuucaccug

SEQ ID NO: 826254 - RNA, 22 nt, Human
uuccuuaguugacugucuuagu

SEQ ID NO: 826255 - RNA, 22 nt, Human
ccacagagcauuagauuucaga

SEQ ID NO: 826256 - RNA, 22 nt, Human
gcccaguaguucaagguugcag

SEQ ID NO: 826257 - RNA, 22 nt, Human
auaguuugugaaacacagcagu

SEQ ID NO: 826258 - RNA, 22 nt, Human
gcaucuaauccaguccagcauc

SEQ ID NO: 826259 - RNA, 22 nt, Human
gucuucuguaagaugagguccc

SEQ ID NO: 826260 - RNA, 22 nt, Human
auauuucaugggguuccauacu

SEQ ID NO: 826261 - RNA, 22 nt, Human
caggguggcacaucacagcauu

SEQ ID NO: 826262 - RNA, 22 nt, Human
gucaggauguuuauucuccagu

SEQ ID NO: 826263 - RNA, 22 nt, Human
acagugcuggcuacaacccugg

SEQ ID NO: 826264 - RNA, 22 nt, Human
uauugaugcuuggauugggcca

SEQ ID NO: 826265 - RNA, 22 nt, Human
augcuuuuccaggagaaauaua

SEQ ID NO: 826266 - RNA, 22 nt, Human
cauggagauaaacugaaauauu

SEQ ID NO: 826267 - RNA, 22 nt, Human
ugcccaggcuggaaugcagugg

SEQ ID NO: 826268 - RNA, 22 nt, Human
agugugagcccuggaguggugc

SEQ ID NO: 826269 - RNA, 22 nt, Human
uuccucagcuggccugauuggg

SEQ ID NO: 826270 - RNA, 22 nt, Human
cugcugugggcaggguagcugg

SEQ ID NO: 826271 - RNA, 22 nt, Human
uacaaagagguaauugcauaua

SEQ ID NO: 826272 - RNA, 22 nt, Human
ucccaggauuuuaggcucucag

SEQ ID NO: 826273 - RNA, 22 nt, Human
ccugucacgaugacugcacucu

SEQ ID NO: 826274 - RNA, 22 nt, Human
cucaggauucucgacacucaca

SEQ ID NO: 826275 - RNA, 22 nt, Human
uucucuuugacauuauucaggu

SEQ ID NO: 826276 - RNA, 19 nt, Human
cuucuucuuggcagccaag

SEQ ID NO: 826277 - RNA, 22 nt, Human
ugcaggaaucagaggggaagcg

SEQ ID NO: 826278 - RNA, 22 nt, Human
uuucaguuguccuguuaauagc

SEQ ID NO: 826279 - RNA, 22 nt, Human
ggccaggaagggaagaucagca

SEQ ID NO: 826280 - RNA, 22 nt, Human
ggcagcuggguuggccagaaac

SEQ ID NO: 826281 - RNA, 22 nt, Human
uggcagcugguacagugggucu

SEQ ID NO: 826282 - RNA, 22 nt, Human
agucuugcauuuucugaagaug

SEQ ID NO: 826283 - RNA, 22 nt, Human
cuucucaaaguugugaaucagg

SEQ ID NO: 826284 - RNA, 22 nt, Human
gaggacaggagacucacuguuu

SEQ ID NO: 826285 - RNA, 22 nt, Human
agggcagcagcuccuccuagcu

SEQ ID NO: 826286 - RNA, 23 nt, Human
gagugcagaauagacaugcagug

SEQ ID NO: 826287 - RNA, 22 nt, Human
aggcagcugugaggacuggauu

SEQ ID NO: 826288 - RNA, 22 nt, Human
ggagcuguuggcagcuaucuug

SEQ ID NO: 826289 - RNA, 22 nt, Human
ugccuugcacauaauauacauu

SEQ ID NO: 826290 - RNA, 22 nt, Human
ggugaaggcacaagagggcaag

SEQ ID NO: 826291 - RNA, 22 nt, Human
aggagggagcuuaagccaggca

SEQ ID NO: 826292 - RNA, 22 nt, Human
uuugcagucaaauuugcuaaau

SEQ ID NO: 826293 - RNA, 22 nt, Human
ccaggaagcugucugauaugaa

SEQ ID NO: 826294 - RNA, 22 nt, Human
gauggcagcagcagccagggau

SEQ ID NO: 826295 - RNA, 22 nt, Human
caggaggaagaacucugcaaca

SEQ ID NO: 826296 - RNA, 22 nt, Human
aggccagaaaugucagggagug

SEQ ID NO: 826297 - RNA, 22 nt, Human
aagggagguaaagcuauuuaaa

SEQ ID NO: 826298 - RNA, 22 nt, Human
gaggcaucugggcacagaagug

SEQ ID NO: 826299 - RNA, 22 nt, Human
aaugcuuuuugcgaaaugugca

SEQ ID NO: 826300 - RNA, 22 nt, Human
aucaggaugacuauaaggcugc

SEQ ID NO: 826301 - RNA, 17 nt, Human
agauggcaggaggcaga

SEQ ID NO: 826302 - RNA, 22 nt, Human
caagauggaguccgggaaugug

SEQ ID NO: 826303 - RNA, 22 nt, Human
ggaccuggcaauuugcaucucu

SEQ ID NO: 826304 - RNA, 22 nt, Human
cccaggagguggaguucacagu

SEQ ID NO: 826305 - RNA, 22 nt, Human
caggagauguaagacuucuguu

SEQ ID NO: 826306 - RNA, 18 nt, Human
gugcugugggcaguggcc

SEQ ID NO: 826307 - RNA, 22 nt, Human
cccaggaguuugaguucagcau

SEQ ID NO: 826308 - RNA, 22 nt, Human
uucacagaugccugaugugugg

SEQ ID NO: 826309 - RNA, 22 nt, Human
cuacccaggcuggagugcagua

SEQ ID NO: 826310 - RNA, 22 nt, Human
gccaggagggaaaggacaauuu

SEQ ID NO: 826311 - RNA, 22 nt, Human
aggcagacucaauggcuagaua

SEQ ID NO: 826312 - RNA, 22 nt, Human
cugugauuguuaguuccuauac

SEQ ID NO: 826313 - RNA, 22 nt, Human
aacacugcugcuggguucugug

SEQ ID NO: 826314 - RNA, 22 nt, Human
cuucaugcugauauccucgaug

SEQ ID NO: 826315 - RNA, 20 nt, Human
ugugaaagcaguagaaugac

SEQ ID NO: 826316 - RNA, 22 nt, Human
acaauguguuuuuauacauuug

SEQ ID NO: 826317 - RNA, 22 nt, Human
ucugaaagaagggcagucuuuu

SEQ ID NO: 826318 - RNA, 22 nt, Human
uugaaaguuuauggagucugca

SEQ ID NO: 826319 - RNA, 22 nt, Human
acccaggagguggaggcugcag

SEQ ID NO: 826320 - RNA, 17 nt, Human
uccaggagaggcaaugg

SEQ ID NO: 826321 - RNA, 22 nt, Human
uuuguuaauucuuauguuagag

SEQ ID NO: 826322 - RNA, 22 nt, Human
gaggcagccagagguucucauu

SEQ ID NO: 826323 - RNA, 21 nt, Human
aucauucuggaaaauucaagc

SEQ ID NO: 826324 - RNA, 22 nt, Human
ucagcugcucaaauuuauguca

SEQ ID NO: 826325 - RNA, 22 nt, Human
gcuccucuucucccacugaaug

SEQ ID NO: 826326 - RNA, 22 nt, Human
cccaggagagagacuugaaucu

SEQ ID NO: 826327 - RNA, 22 nt, Human
aauuuccaaauuucugucacac

SEQ ID NO: 826328 - RNA, 22 nt, Human
uuguuugaggucacugauauuu

SEQ ID NO: 826329 - RNA, 22 nt, Human
cagaggcauacucccagucuug

SEQ ID NO: 826330 - RNA, 22 nt, Human
auuuuacuacuccaauuaauga

SEQ ID NO: 826331 - RNA, 17 nt, Human
acucaggaucugggagu

SEQ ID NO: 826332 - RNA, 21 nt, Human
ccaggaaggacugagcucccu

SEQ ID NO: 826333 - RNA, 22 nt, Human
uauaucauggagauuaacauuc

SEQ ID NO: 826334 - RNA, 22 nt, Human
aggcagcuaagauggauaauga

SEQ ID NO: 826335 - RNA, 22 nt, Human
cuuuuauuuugaauuaagggcu

SEQ ID NO: 826336 - RNA, 22 nt, Human
uuuggaauguaguuuaaucauc

SEQ ID NO: 826337 - RNA, 22 nt, Human
uggaaggagacugggaagugug

SEQ ID NO: 826338 - RNA, 22 nt, Human
uggaggggcaauggagcgcgga

SEQ ID NO: 826339 - RNA, 22 nt, Human
gucaggaugcuauuguuauuaa

SEQ ID NO: 826340 - RNA, 22 nt, Human
gggagagguuacccgagcaacu

SEQ ID NO: 826341 - RNA, 22 nt, Human
ggaugggagcagaggacgacca

SEQ ID NO: 826342 - RNA, 22 nt, Human
uccauucauucauugaugaaca

SEQ ID NO: 826343 - RNA, 22 nt, Human
uuugaaagaauuuauguacuuu

SEQ ID NO: 826344 - RNA, 22 nt, Human
gaggcacugcaguacagugacu

SEQ ID NO: 826345 - RNA, 22 nt, Human
aaggcagcuuuaaaaaagaugc

SEQ ID NO: 826346 - RNA, 22 nt, Human
uugggcucaggaguuugagacc

SEQ ID NO: 826347 - RNA, 22 nt, Human
ucacaaauagcuauauuaagga

SEQ ID NO: 826348 - RNA, 22 nt, Human
uuucucuguucucuaacuguaa

SEQ ID NO: 826349 - RNA, 22 nt, Human
acacagaguauuuagaaggggu

SEQ ID NO: 826350 - RNA, 22 nt, Human
uuucaguuuuugcucgauguau

SEQ ID NO: 826351 - RNA, 22 nt, Human
cagcaggaggugaguagcaggu

SEQ ID NO: 826352 - RNA, 20 nt, Human
ggaggguggaagaaagcaag

SEQ ID NO: 826353 - RNA, 22 nt, Human
acacauauauacauauuugugc

SEQ ID NO: 826354 - RNA, 22 nt, Human
gccugcagaacugugaggcaau

SEQ ID NO: 826355 - RNA, 22 nt, Human
ucugcugucacucauuugcuuc

SEQ ID NO: 826356 - RNA, 22 nt, Human
auuguuaugaaaauaagauguu

SEQ ID NO: 826357 - RNA, 20 nt, Human
ucagugauuuugaagaggaa

SEQ ID NO: 826358 - RNA, 22 nt, Human
ugcugcuguuuccuacaucuca

SEQ ID NO: 826359 - RNA, 22 nt, Human
caggguggcacucagcgcaucu

SEQ ID NO: 826360 - RNA, 22 nt, Human
agggagcucuaaguagagggac

SEQ ID NO: 826361 - RNA, 17 nt, Human
uuugaaaggaugucagu

SEQ ID NO: 826362 - RNA, 19 nt, Human
ucccaggaagcaaauguca

SEQ ID NO: 826363 - RNA, 22 nt, Human
ucuucucuccugcuuggcagaa

SEQ ID NO: 826364 - RNA, 22 nt, Human
uuaauuuuaaccuguuuguguc

SEQ ID NO: 826365 - RNA, 22 nt, Human
uguuuuuaaauaaugauagaaa

SEQ ID NO: 826366 - RNA, 22 nt, Human
uuuuaacuuaaaauacauagau

SEQ ID NO: 826367 - RNA, 22 nt, Human
uguuguuuucucauggagaaua

SEQ ID NO: 826368 - RNA, 22 nt, Human
ucuucaauuagauuuaccaauu

SEQ ID NO: 826369 - RNA, 22 nt, Human
uguuugaauuuugcuaacgugu

SEQ ID NO: 826370 - RNA, 22 nt, Human
ggagcggagggagggccacugu

SEQ ID NO: 826371 - RNA, 22 nt, Human
ggaggugggcuaaggacucucu

SEQ ID NO: 826372 - RNA, 22 nt, Human
aaggcagccgugugacugcaug

SEQ ID NO: 826373 - RNA, 22 nt, Human
aucaggaucacugggagucuug

SEQ ID NO: 826374 - RNA, 22 nt, Human
ugguaauuaauuugauagguuc

SEQ ID NO: 826375 - RNA, 21 nt, Human
cccacggaaugaugaggcacu

SEQ ID NO: 826376 - RNA, 22 nt, Human
ucacaaaugaggaaaucgagca

SEQ ID NO: 826377 - RNA, 22 nt, Human
ggcaagaaggcuucagguagcu

SEQ ID NO: 826378 - RNA, 22 nt, Human
uucuucaauuuuccauauacug

SEQ ID NO: 826379 - RNA, 22 nt, Human
aguaaaucagaccucauuaugu

SEQ ID NO: 826380 - RNA, 22 nt, Human
ugaggcagaaauuccuguuuuc

SEQ ID NO: 826381 - RNA, 21 nt, Human
cagcagaguaaugcauucgua

SEQ ID NO: 826382 - RNA, 22 nt, Human
uuagaaagaacuuuagauauca

SEQ ID NO: 826383 - RNA, 22 nt, Human
cacaaugugguuugucaucuuu

SEQ ID NO: 826384 - RNA, 22 nt, Human
accaggagagauuuuauugaga

SEQ ID NO: 826385 - RNA, 22 nt, Human
cuggccaggcuugggacagaca

SEQ ID NO: 826386 - RNA, 23 nt, Human
uugaaagguagcuggcagcuaga

SEQ ID NO: 826387 - RNA, 20 nt, Human
aagggcagagggaacagacu

SEQ ID NO: 826388 - RNA, 22 nt, Human
ggguggagcuuggacaccagua

SEQ ID NO: 826389 - RNA, 20 nt, Human
cugcugugguccuuuauuuu

SEQ ID NO: 826390 - RNA, 22 nt, Human
ucaguagcagaaagcaaugagu

SEQ ID NO: 826391 - RNA, 17 nt, Human
ccuguguuugcuccuuc

SEQ ID NO: 826392 - RNA, 22 nt, Human
cugcugugugaccauggacagg

SEQ ID NO: 826393 - RNA, 23 nt, Human
cuuuuaacuugaucugagaccag

SEQ ID NO: 826394 - RNA, 22 nt, Human
uaaaacuuaacuauccagauua

SEQ ID NO: 826395 - RNA, 22 nt, Human
aaaccgcaauuacuuuugcguc

SEQ ID NO: 826396 - RNA, 22 nt, Human
guccucuggaagaugaguucuu

SEQ ID NO: 826397 - RNA, 22 nt, Human
agacagcuaauaaaugagugug

SEQ ID NO: 826398 - RNA, 22 nt, Human
ggcagcaucucuggcagcagcu

SEQ ID NO: 826399 - RNA, 22 nt, Human
agaggaugguugaggaagaccu

SEQ ID NO: 826400 - RNA, 22 nt, Human
ggagcaggagucucuugaauuu

SEQ ID NO: 826401 - RNA, 22 nt, Human
ucuuuucaucauuuaauaggua

SEQ ID NO: 826402 - RNA, 22 nt, Human
uuuaaauuauaguuaaugucug

SEQ ID NO: 826403 - RNA, 22 nt, Human
aauggccagcaacaggagugaa

SEQ ID NO: 826404 - RNA, 22 nt, Human
ucacaauuuggauacagcuaug

SEQ ID NO: 826405 - RNA, 18 nt, Human
ucauuuguuuugcaugaa

SEQ ID NO: 826406 - RNA, 17 nt, Human
acacagggagagggagc

SEQ ID NO: 826407 - RNA, 22 nt, Human
uucuagaugauaaaccagcagc

SEQ ID NO: 826408 - RNA, 19 nt, Human
cuggccaggccaggggccc

SEQ ID NO: 826409 - RNA, 22 nt, Human
aaggccagacaggaccacaucu

SEQ ID NO: 826410 - RNA, 22 nt, Human
uucagcaaacacgaugcuuguu

SEQ ID NO: 826411 - RNA, 22 nt, Human
aggcagcguagcaaggcuagua

SEQ ID NO: 826412 - RNA, 22 nt, Human
ucaugcuuauugcauauuugga

SEQ ID NO: 826413 - RNA, 22 nt, Human
uuaaauauuuucagcaggguca

SEQ ID NO: 826414 - RNA, 22 nt, Human
aaggcaguuaauuuggcuagaa

SEQ ID NO: 826415 - RNA, 22 nt, Human
uucagggagagcgggacgggug

SEQ ID NO: 826416 - RNA, 22 nt, Human
uagaagcaguaauagaaauagg

SEQ ID NO: 826417 - RNA, 22 nt, Human
agcugaugccauguggaacagu

SEQ ID NO: 826418 - RNA, 22 nt, Human
gcuguguuugacaguagcagac

SEQ ID NO: 826419 - RNA, 17 nt, Human
cagacaggcugucaccc

SEQ ID NO: 826420 - RNA, 22 nt, Human
ugaaagcacaaguucuaacagg

SEQ ID NO: 826421 - RNA, 22 nt, Human
aggcaguggagcuggaauaggc

SEQ ID NO: 826422 - RNA, 22 nt, Human
uucugggacaucuggacaguuu

SEQ ID NO: 826423 - RNA, 22 nt, Human
ccuccucugggaagauucagag

SEQ ID NO: 826424 - RNA, 22 nt, Human
aggagagggguaggauuaauuu

SEQ ID NO: 826425 - RNA, 22 nt, Human
acccaggagcucugggguccuc

SEQ ID NO: 826426 - RNA, 22 nt, Human
uaugaacucuggagucugagug

SEQ ID NO: 826427 - RNA, 22 nt, Human
ggguggaguagaaagaugaauu

SEQ ID NO: 826428 - RNA, 22 nt, Human
cucaggauagcugcgcagccug

SEQ ID NO: 826429 - RNA, 22 nt, Human
gagguggucgaggagggguacc

SEQ ID NO: 826430 - RNA, 22 nt, Human
ugcacagugaccccuggugacu

SEQ ID NO: 826431 - RNA, 22 nt, Human
uucuucuucauuucugacgaug

SEQ ID NO: 826432 - RNA, 22 nt, Human
uugauuaaacaggcauauucaa

SEQ ID NO: 826433 - RNA, 22 nt, Human
gaccauuuuuacagagcauuca

SEQ ID NO: 826434 - RNA, 22 nt, Human
uagaaauaaaucugcagcuggg

SEQ ID NO: 826435 - RNA, 22 nt, Human
ggcagcuuucaauaggguuaug

SEQ ID NO: 826436 - RNA, 22 nt, Human
gaggcagcggcucacagagaaa

SEQ ID NO: 826437 - RNA, 22 nt, Human
auucuucacaccuguuccuguu

SEQ ID NO: 826438 - RNA, 22 nt, Human
acaggagaaaucuggucaaaag

SEQ ID NO: 826439 - RNA, 22 nt, Human
caacugcugacaccaucacucc

SEQ ID NO: 826440 - RNA, 22 nt, Human
caggauggucucgaucuccuga

SEQ ID NO: 826441 - RNA, 22 nt, Human
uuaaauuccagccucauaauag

SEQ ID NO: 826442 - RNA, 22 nt, Human
cccucuacagggaagcgcuuuc

SEQ ID NO: 826443 - RNA, 22 nt, Human
uuuucaguuccaucucugcucu

SEQ ID NO: 826444 - RNA, 22 nt, Human
gaggcaugcagagcuggagcag

SEQ ID NO: 826445 - RNA, 22 nt, Human
guucuucaucauuuuagauagg

SEQ ID NO: 826446 - RNA, 22 nt, Human
aggccagcgcugcuagcucccg

SEQ ID NO: 826447 - RNA, 22 nt, Human
agaggcaggaagagcugauuuu

SEQ ID NO: 826448 - RNA, 22 nt, Human
aggcaccuugcgguccagugaa

SEQ ID NO: 826449 - RNA, 22 nt, Human
aggagacauaacuaugaugaga

SEQ ID NO: 826450 - RNA, 22 nt, Human
ucauuauccuaguaucuugaau

SEQ ID NO: 826451 - RNA, 22 nt, Human
ggcagcuuucucacccaugacc

SEQ ID NO: 826452 - RNA, 22 nt, Human
cccaggaaugagcaggcagggg

SEQ ID NO: 826453 - RNA, 22 nt, Human
augauauuugcaaugugcuugc

SEQ ID NO: 826454 - RNA, 22 nt, Human
uucaaauacauucuuugccacu

SEQ ID NO: 826455 - RNA, 22 nt, Human
gagcagcucugugccuggagac

SEQ ID NO: 826456 - RNA, 22 nt, Human
ggcaucuccaaaacaugaacuc

SEQ ID NO: 826457 - RNA, 22 nt, Human
ggcagaggaggggugaauuugc

SEQ ID NO: 826458 - RNA, 19 nt, Human
aguggcagaucuggaagua

SEQ ID NO: 826459 - RNA, 22 nt, Human
auuuccaguccuaaugaucugg

SEQ ID NO: 826460 - RNA, 22 nt, Human
uccaggagugauaaggccacug

SEQ ID NO: 826461 - RNA, 22 nt, Human
ugcugaaacaauaacauacugg

SEQ ID NO: 826462 - RNA, 22 nt, Human
gggcagcuggauaguuuuaaau

SEQ ID NO: 826463 - RNA, 22 nt, Human
agugcuuugugcucucacugca

SEQ ID NO: 826464 - RNA, 22 nt, Human
ccucacugaagaggugacauuu

SEQ ID NO: 826465 - RNA, 22 nt, Human
agggaguuagaaauccaggaua

SEQ ID NO: 826466 - RNA, 22 nt, Human
cuuaagauuugcgauaccuaau

SEQ ID NO: 826467 - RNA, 22 nt, Human
acaggagaauuaucuggaacaa

SEQ ID NO: 826468 - RNA, 22 nt, Human
acuguugucaggcugcuuugga

SEQ ID NO: 826469 - RNA, 22 nt, Human
cauugcuguuaauugucucuag

SEQ ID NO: 826470 - RNA, 22 nt, Human
gaggagagggcugcgggcccac

SEQ ID NO: 826471 - RNA, 22 nt, Human
aucugccuccaaguccaugugu

SEQ ID NO: 826472 - RNA, 22 nt, Human
uagggcagagcuuguacacgau

SEQ ID NO: 826473 - RNA, 23 nt, Human
ucucuuucaagagcuuaaugugc

SEQ ID NO: 826474 - RNA, 22 nt, Human
aggcagacaaggacacaguggg

SEQ ID NO: 826475 - RNA, 22 nt, Human
uggagagguugaauaacuuguc

SEQ ID NO: 826476 - RNA, 22 nt, Human
gagagcuguuuaucuucuucaa

SEQ ID NO: 826477 - RNA, 22 nt, Human
uuuguuuagaugguaaaucagu

SEQ ID NO: 826478 - RNA, 22 nt, Human
cuucuucauaggcaguccuguu

SEQ ID NO: 826479 - RNA, 22 nt, Human
gcccaggauaaugcugucccug

SEQ ID NO: 826480 - RNA, 22 nt, Human
ggagaggagcuauugggggcuc

SEQ ID NO: 826481 - RNA, 22 nt, Human
uugacacagaucaauauucaac

SEQ ID NO: 826482 - RNA, 23 nt, Human
ucaggauauugugugccaaggug

SEQ ID NO: 826483 - RNA, 22 nt, Human
gcuugaaaauucauagguauuu

SEQ ID NO: 826484 - RNA, 22 nt, Human
uggccaggcagguagaacggcc

SEQ ID NO: 826485 - RNA, 22 nt, Human
uaaguggaagguuauaugcuaa

SEQ ID NO: 826486 - RNA, 21 nt, Human
aaugaaguggcuauuuugagg

SEQ ID NO: 826487 - RNA, 22 nt, Human
cagagcagucuggagauccagc

SEQ ID NO: 826488 - RNA, 22 nt, Human
ucucuucuagcuucuugugguu

SEQ ID NO: 826489 - RNA, 19 nt, Human
gcuuuggagggagguucua

SEQ ID NO: 826490 - RNA, 22 nt, Human
aaaggugacacucugccagcug

SEQ ID NO: 826491 - RNA, 22 nt, Human
ugaaaugauaucugauaacaaa

SEQ ID NO: 826492 - RNA, 22 nt, Human
aaggagagguuguccguguugu

SEQ ID NO: 826493 - RNA, 22 nt, Human
gcagcugagcgugaggaagagu

SEQ ID NO: 826494 - RNA, 22 nt, Human
ucagagaguuggaaagaauuaa

SEQ ID NO: 826495 - RNA, 22 nt, Human
aggcacaggaaugucauccagu

SEQ ID NO: 826496 - RNA, 22 nt, Human
acuuaaaaagaaucuuuucacg

SEQ ID NO: 826497 - RNA, 22 nt, Human
augaggcauuccacucaaacuc

SEQ ID NO: 826498 - RNA, 22 nt, Human
gaccauuugcuaguaaauugca

SEQ ID NO: 826499 - RNA, 22 nt, Human
cauagagugauguaagguaugu

SEQ ID NO: 826500 - RNA, 22 nt, Human
gaggcugcuguuagcccugggc

SEQ ID NO: 826501 - RNA, 22 nt, Human
cuuuggcaaggguuuuaauugu

SEQ ID NO: 826502 - RNA, 21 nt, Human
uucucagagucuauuacaguu

SEQ ID NO: 826503 - RNA, 22 nt, Human
gaggagagaugguagauugggu

SEQ ID NO: 826504 - RNA, 20 nt, Human
uuucaguuaucuugaccuuc

SEQ ID NO: 826505 - RNA, 22 nt, Human
cuuguaauuauaauguacuguu

SEQ ID NO: 826506 - RNA, 22 nt, Human
uccauuuuucaugacuccucaa

SEQ ID NO: 826507 - RNA, 21 nt, Human
cacucaggguaugugccaggc

SEQ ID NO: 826508 - RNA, 23 nt, Human
ucagucuucccugucaguaauag

SEQ ID NO: 826509 - RNA, 22 nt, Human
agccuauuccaggaugagcuca

SEQ ID NO: 826510 - RNA, 22 nt, Human
uagggaugacgaaaggacagag

SEQ ID NO: 826511 - RNA, 22 nt, Human
gagagaaaugugcaguuugggc

SEQ ID NO: 826512 - RNA, 22 nt, Human
aggagaaggaagugcaucacua

SEQ ID NO: 826513 - RNA, 22 nt, Human
cagaaauguacugacaugcagu

SEQ ID NO: 826514 - RNA, 22 nt, Human
cggagaggaccugcaacucgcu

SEQ ID NO: 826515 - RNA, 22 nt, Human
ccucaggggucacugugaggag

SEQ ID NO: 826516 - RNA, 22 nt, Human
acuguagcugccacuggaugca

SEQ ID NO: 826517 - RNA, 22 nt, Human
uccugagagcagcugcuuugga

SEQ ID NO: 826518 - RNA, 22 nt, Human
augcugagugagugaaacccag

SEQ ID NO: 826519 - RNA, 22 nt, Human
uuauuucauugauuucuaagac

SEQ ID NO: 826520 - RNA, 22 nt, Human
cauuugcagagggugacacucu

SEQ ID NO: 826521 - RNA, 22 nt, Human
agcaccugucacaagcagaagg

SEQ ID NO: 826522 - RNA, 22 nt, Human
caggaugguggcaugaucagaa

SEQ ID NO: 826523 - RNA, 22 nt, Human
ucuucacaugaccuucaugucu

SEQ ID NO: 826524 - RNA, 22 nt, Human
ucucaagaucucaagauggccc

SEQ ID NO: 826525 - RNA, 22 nt, Human
aggggcucaaagugugcaggga

SEQ ID NO: 826526 - RNA, 22 nt, Human
cugccaggcagcagagggagaa

SEQ ID NO: 826527 - RNA, 22 nt, Human
ugucuucagcaaaugccuuucu

SEQ ID NO: 826528 - RNA, 22 nt, Human
cuuuggcagccucugcuauuga

SEQ ID NO: 826529 - RNA, 22 nt, Human
uccaggagguuuggaggaagca

SEQ ID NO: 826530 - RNA, 22 nt, Human
uucaggauucugugucugacaa

SEQ ID NO: 826531 - RNA, 22 nt, Human
uuauuucauguaaaauuuaugu

SEQ ID NO: 826532 - RNA, 22 nt, Human
cccaagagguggagguugcagu

SEQ ID NO: 826533 - RNA, 22 nt, Human
gggcagcugccccucucugggc

SEQ ID NO: 826534 - RNA, 23 nt, Human
ucuugaaaagccuacagcaguuc

SEQ ID NO: 826535 - RNA, 22 nt, Human
auuauauaggacuugcccuucc

SEQ ID NO: 826536 - RNA, 22 nt, Human
ucuucuuccucauuuauacaua

SEQ ID NO: 826537 - RNA, 22 nt, Human
uuuccuaggagauugaucacau

SEQ ID NO: 826538 - RNA, 22 nt, Human
gcuguguuggugaagcuguagc

SEQ ID NO: 826539 - RNA, 22 nt, Human
cccauugugguuguugaggaua

SEQ ID NO: 826540 - RNA, 22 nt, Human
aucuucucauguguaaugaggu

SEQ ID NO: 826541 - RNA, 22 nt, Human
aggcggcuccgggagugugggc

SEQ ID NO: 826542 - RNA, 22 nt, Human
uucagaaguagcuaagcaguca

SEQ ID NO: 826543 - RNA, 22 nt, Human
cuucucagcauuuugucagucu

SEQ ID NO: 826544 - RNA, 22 nt, Human
ggaggaggggcgcuuugucuau

SEQ ID NO: 826545 - RNA, 22 nt, Human
cacagcuaggaggaaagcagag

SEQ ID NO: 826546 - RNA, 20 nt, Human
caguccaaucagaggccacc

SEQ ID NO: 826547 - RNA, 22 nt, Human
cugagggugcuauucuugccuu

SEQ ID NO: 826548 - RNA, 22 nt, Human
uuugaaauuaagauauugucca

SEQ ID NO: 826549 - RNA, 23 nt, Human
uggacgccgacuuuggaggcgcu

SEQ ID NO: 826550 - RNA, 22 nt, Human
uaggcagcagugcuaugauucu

SEQ ID NO: 826551 - RNA, 22 nt, Human
cuuaaauuggaugaguuaaguu

SEQ ID NO: 826552 - RNA, 22 nt, Human
agaggacaaaaugagaagugcu

SEQ ID NO: 826553 - RNA, 22 nt, Human
ucacauucucagcaucuauaca

SEQ ID NO: 826554 - RNA, 22 nt, Human
uacaacauuguguugcuucaua

SEQ ID NO: 826555 - RNA, 22 nt, Human
ucuccucuauuucuguauguau

SEQ ID NO: 826556 - RNA, 22 nt, Human
gagaggauccacaaaccaggaa

SEQ ID NO: 826557 - RNA, 20 nt, Human
uucuucucuaguuaucuuca

SEQ ID NO: 826558 - RNA, 22 nt, Human
ccucaggaaaugaauaaauggc

SEQ ID NO: 826559 - RNA, 23 nt, Human
uuucuucagaagccuugcgaggc

SEQ ID NO: 826560 - RNA, 21 nt, Human
gcaaauguucaggaaaaaaga

SEQ ID NO: 826561 - RNA, 22 nt, Human
ugaggggagaagcagcagccug

SEQ ID NO: 826562 - RNA, 22 nt, Human
ccaggacagugaacauguaaga

SEQ ID NO: 826563 - RNA, 22 nt, Human
acccaggagccgugagagguua

SEQ ID NO: 826564 - RNA, 22 nt, Human
uucaggaugaaagugugcaaca

SEQ ID NO: 826565 - RNA, 22 nt, Human
uucaaacaguguagaauauaug

SEQ ID NO: 826566 - RNA, 22 nt, Human
uccaugaggcagggaggcuggc

SEQ ID NO: 826567 - RNA, 18 nt, Human
ugagaggcagguagagga

SEQ ID NO: 826568 - RNA, 22 nt, Human
uuuucaguaaugucuacauaau

SEQ ID NO: 826569 - RNA, 22 nt, Human
agaaaugaauauguagugguua

SEQ ID NO: 826570 - RNA, 22 nt, Human
aagaggaggacgguucccagaa

SEQ ID NO: 826571 - RNA, 22 nt, Human
gauuucuugauaaguaguguga

SEQ ID NO: 826572 - RNA, 22 nt, Human
uuucacaacugcuuauuugaga

SEQ ID NO: 826573 - RNA, 22 nt, Human
aucuugcauuugcuaaaaugca

SEQ ID NO: 826574 - RNA, 22 nt, Human
gcugcugucagugguggcaguu

SEQ ID NO: 826575 - RNA, 22 nt, Human
uauuuuaucugccagaguggag

SEQ ID NO: 826576 - RNA, 22 nt, Human
auguucuuguucaaaugucagu

SEQ ID NO: 826577 - RNA, 18 nt, Human
cugcuugggagacgucag

SEQ ID NO: 826578 - RNA, 22 nt, Human
aguggcagagugcacucaggca

SEQ ID NO: 826579 - RNA, 22 nt, Human
aaagcagagcagggcacuuaug

SEQ ID NO: 826580 - RNA, 18 nt, Human
caugucugcgccacaagg

SEQ ID NO: 826581 - RNA, 22 nt, Human
aauuuuaagcauaugacugguu

SEQ ID NO: 826582 - RNA, 22 nt, Human
cccaggaggcagagauagcagu

SEQ ID NO: 826583 - RNA, 22 nt, Human
uuccucagaaaauacuguccaa

SEQ ID NO: 826584 - RNA, 22 nt, Human
uugaacugguaguuggaaaucu

SEQ ID NO: 826585 - RNA, 22 nt, Human
acugcccucccaucuauugcaa

SEQ ID NO: 826586 - RNA, 22 nt, Human
ucugggaaguccucugucaugc

SEQ ID NO: 826587 - RNA, 21 nt, Human
auaagcaugcugauuacauuu

SEQ ID NO: 826588 - RNA, 22 nt, Human
acaguuaucuuugaaauagaga

SEQ ID NO: 826589 - RNA, 22 nt, Human
ccaggagaagcaucugagugua

SEQ ID NO: 826590 - RNA, 22 nt, Human
gccaggagaaaaggcgaaugau

SEQ ID NO: 826591 - RNA, 19 nt, Human
uucccaggaaaggggugca

SEQ ID NO: 826592 - RNA, 22 nt, Human
gcugcugugccuggcguccugu

SEQ ID NO: 826593 - RNA, 22 nt, Human
gcagaggauagcauaugaaccu

SEQ ID NO: 826594 - RNA, 22 nt, Human
uugcugaaguuaaugcuugcaa

SEQ ID NO: 826595 - RNA, 22 nt, Human
uuuggaauuggcauucuauucu

SEQ ID NO: 826596 - RNA, 18 nt, Human
gaggcagcuagcaauuuu

SEQ ID NO: 826597 - RNA, 22 nt, Human
acugccauuggucaaaugagug

SEQ ID NO: 826598 - RNA, 22 nt, Human
auguucuuccaaaucuguaaca

SEQ ID NO: 826599 - RNA, 22 nt, Human
cuaaucaucuuucucuuaaagc

SEQ ID NO: 826600 - RNA, 22 nt, Human
uacuuccuguuuccaugucugu

SEQ ID NO: 826601 - RNA, 21 nt, Human
agccuguugguuuacugcuca

SEQ ID NO: 826602 - RNA, 22 nt, Human
uacugcauaacuggcauguggg

SEQ ID NO: 826603 - RNA, 22 nt, Human
uucucacuauguauguagauug

SEQ ID NO: 826604 - RNA, 22 nt, Human
uugcauuugagaaaguucuccu

SEQ ID NO: 826605 - RNA, 22 nt, Human
gcccaggaggucaaguagcuau

SEQ ID NO: 826606 - RNA, 22 nt, Human
gaggagcuggcugucgggaggc

SEQ ID NO: 826607 - RNA, 22 nt, Human
gagaggggcccaagccacauag

SEQ ID NO: 826608 - RNA, 22 nt, Human
gcagagcuucuguccuucagga

SEQ ID NO: 826609 - RNA, 22 nt, Human
acacaaugcauauuuuuccaga

SEQ ID NO: 826610 - RNA, 23 nt, Human
uuuuccagaaucgacucuguaga

SEQ ID NO: 826611 - RNA, 22 nt, Human
auucuucauuuacuguuacuug

SEQ ID NO: 826612 - RNA, 22 nt, Human
aagugagugguaaggagcaugg

SEQ ID NO: 826613 - RNA, 22 nt, Human
ccuugcugcgugcuagcacaga

SEQ ID NO: 826614 - RNA, 22 nt, Human
cuacagacccaccuuggaagaa

SEQ ID NO: 826615 - RNA, 22 nt, Human
uuuacauuucccucugucaguu

SEQ ID NO: 826616 - RNA, 22 nt, Human
ugcauggaggaagaugaaugca

SEQ ID NO: 826617 - RNA, 22 nt, Human
guuuuaguggguggccacugau

SEQ ID NO: 826618 - RNA, 20 nt, Human
uguuaaaggacacuugcuuu

SEQ ID NO: 826619 - RNA, 22 nt, Human
cucaugauguagcgaaugagaa

SEQ ID NO: 826620 - RNA, 23 nt, Human
uggcagcuguguaagagaaagca

SEQ ID NO: 826621 - RNA, 22 nt, Human
cuucagaagaaaagcagugugu

SEQ ID NO: 826622 - RNA, 22 nt, Human
auuaaauuggaucugcauaguu

SEQ ID NO: 826623 - RNA, 22 nt, Human
uugaacaguccuaagagacccu

SEQ ID NO: 826624 - RNA, 22 nt, Human
ucuuuguaaaugccuagcauaa

SEQ ID NO: 826625 - RNA, 22 nt, Human
aaguuugcauagauuaagcauu

SEQ ID NO: 826626 - RNA, 23 nt, Human
cugcccugaucuugaucuauugu

SEQ ID NO: 826627 - RNA, 22 nt, Human
uggcaguccccugugccuggaa

SEQ ID NO: 826628 - RNA, 22 nt, Human
ggugaagguggaacgcagagca

SEQ ID NO: 826629 - RNA, 22 nt, Human
ugcuagugcaggguuuucaguu

SEQ ID NO: 826630 - RNA, 22 nt, Human
ccaggcugugguuuagauagag

SEQ ID NO: 826631 - RNA, 19 nt, Human
ucccaggaaccuuuuauuu

SEQ ID NO: 826632 - RNA, 22 nt, Human
agcaccuguugcacuucauaau

SEQ ID NO: 826633 - RNA, 22 nt, Human
agaggccaugcuagaggccugg

SEQ ID NO: 826634 - RNA, 22 nt, Human
uggagacugugcuaagggaguu

SEQ ID NO: 826635 - RNA, 22 nt, Human
ucuucacauggaacaugaagcu

SEQ ID NO: 826636 - RNA, 22 nt, Human
gggagucugggcuagacuccuu

SEQ ID NO: 826637 - RNA, 17 nt, Human
aggccagaugaggcaag

SEQ ID NO: 826638 - RNA, 22 nt, Human
ccaggaaaauaccaagcuuuaa

SEQ ID NO: 826639 - RNA, 22 nt, Human
auuaaauuggacgcugggggaa

SEQ ID NO: 826640 - RNA, 22 nt, Human
agaccgagaaguucuccaggcc

SEQ ID NO: 826641 - RNA, 22 nt, Human
cacaugaguccugccagguaug

SEQ ID NO: 826642 - RNA, 22 nt, Human
gagggaauggugugcaagaggu

SEQ ID NO: 826643 - RNA, 20 nt, Human
agauuauuccuaagauuucu

SEQ ID NO: 826644 - RNA, 22 nt, Human
aagauauucaaagauuuauuag

SEQ ID NO: 826645 - RNA, 22 nt, Human
aaaggccaugguuggaguguuu

SEQ ID NO: 826646 - RNA, 22 nt, Human
uugcuagcugguguaugcauug

SEQ ID NO: 826647 - RNA, 22 nt, Human
caagauggagaagcagcaaggg

SEQ ID NO: 826648 - RNA, 22 nt, Human
ggaggggagauguuugggcuca

SEQ ID NO: 826649 - RNA, 22 nt, Human
gaaauauucuugucuuguuuuc

SEQ ID NO: 826650 - RNA, 22 nt, Human
cugcuguggugucaagcaucuc

SEQ ID NO: 826651 - RNA, 22 nt, Human
cccaggaaaugaacuucugauu

SEQ ID NO: 826652 - RNA, 22 nt, Human
cucugcauuuuaacagaugauu

SEQ ID NO: 826653 - RNA, 22 nt, Human
auuucacucauucauguuacuu

SEQ ID NO: 826654 - RNA, 22 nt, Human
uaauuauuugaagacauuagag

SEQ ID NO: 826655 - RNA, 22 nt, Human
ucauuauuuuggacuggagugu

SEQ ID NO: 826656 - RNA, 22 nt, Human
cuguucucuggcgguggcuguu

SEQ ID NO: 826657 - RNA, 22 nt, Human
gagccaaggguugccauggaga

SEQ ID NO: 826658 - RNA, 22 nt, Human
uauuuucuguggaggaccagau

SEQ ID NO: 826659 - RNA, 22 nt, Human
gaggcagcaucuauggugggaa

SEQ ID NO: 826660 - RNA, 22 nt, Human
gcagcugaauguccauugcugc

SEQ ID NO: 826661 - RNA, 22 nt, Human
agcaccauugcaaauauggcag

SEQ ID NO: 826662 - RNA, 20 nt, Human
cugagagucugugcuuaguc

SEQ ID NO: 826663 - RNA, 22 nt, Human
ucauuuguggaagugauugugg

SEQ ID NO: 826664 - RNA, 17 nt, Human
uagcuguguuucagcua

SEQ ID NO: 826665 - RNA, 22 nt, Human
ucucagucagccuugauguccc

SEQ ID NO: 826666 - RNA, 22 nt, Human
agccuuguuggucugaguuugg

SEQ ID NO: 826667 - RNA, 22 nt, Human
gaaaggcaguacagcugagccu

SEQ ID NO: 826668 - RNA, 22 nt, Human
auguauuucuauguagugaaga

SEQ ID NO: 826669 - RNA, 22 nt, Human
uuuuauagcugaauaguauucc

SEQ ID NO: 826670 - RNA, 22 nt, Human
gagguagcgaguggacagugca

SEQ ID NO: 826671 - RNA, 22 nt, Human
ccaggcugagcaugauuggagc

SEQ ID NO: 826672 - RNA, 22 nt, Human
ucuuuccauggccacacagucu

SEQ ID NO: 826673 - RNA, 22 nt, Human
ccccggaggcggagguugcagu

SEQ ID NO: 826674 - RNA, 22 nt, Human
cccaggaggcgcagguugcggu

SEQ ID NO: 826675 - RNA, 22 nt, Human
cagaggaugaucuggccucucu

SEQ ID NO: 826676 - RNA, 22 nt, Human
cauucauuuaugaaauaucuau

SEQ ID NO: 826677 - RNA, 22 nt, Human
gaggcaccucgcgggaggaggc

SEQ ID NO: 826678 - RNA, 22 nt, Human
ccagaccacccuggccaugcac

SEQ ID NO: 826679 - RNA, 22 nt, Human
cugucauuuaagacauucugga

SEQ ID NO: 826680 - RNA, 22 nt, Human
guaggcagucucucaggugauc

SEQ ID NO: 826681 - RNA, 22 nt, Human
uggcagagugcagaagaggcau

SEQ ID NO: 826682 - RNA, 22 nt, Human
aaauuagucgguuuaggaauuu

SEQ ID NO: 826683 - RNA, 22 nt, Human
ugaaaugagcauuuauucuuua

SEQ ID NO: 826684 - RNA, 21 nt, Human
uuucuucacuuugccccaugu

SEQ ID NO: 826685 - RNA, 21 nt, Human
uuucuuaggcucuaaaaugac

SEQ ID NO: 826686 - RNA, 22 nt, Human
caggcagcauuuacucugauga

SEQ ID NO: 826687 - RNA, 22 nt, Human
uggcagcuugaaugcagucuuu

SEQ ID NO: 826688 - RNA, 22 nt, Human
cagcuacuccucccaugacuuc

SEQ ID NO: 826689 - RNA, 22 nt, Human
ggugaaggucagagcaggaaaa

SEQ ID NO: 826690 - RNA, 22 nt, Human
gugagggguggcugagcaguuu

SEQ ID NO: 826691 - RNA, 22 nt, Human
uugcucaggcuggugugcagug

SEQ ID NO: 826692 - RNA, 22 nt, Human
ucucuuucuauaugugagucuu

SEQ ID NO: 826693 - RNA, 22 nt, Human
cuucugugcuucacaguugcca

SEQ ID NO: 826694 - RNA, 22 nt, Human
agauggcagggguaccuggaag

SEQ ID NO: 826695 - RNA, 22 nt, Human
agaggcggagguugcagugagc

SEQ ID NO: 826696 - RNA, 22 nt, Human
gucaggauuuacaaacuucagu

SEQ ID NO: 826697 - RNA, 22 nt, Human
agcaccugccugcauuggcuau

SEQ ID NO: 826698 - RNA, 22 nt, Human
uuugcauaaaggagcauuucuc

SEQ ID NO: 826699 - RNA, 20 nt, Human
ggcaggcuuuauauggaggg

SEQ ID NO: 826700 - RNA, 22 nt, Human
uauuuccagcaguaagaagaca

SEQ ID NO: 826701 - RNA, 22 nt, Human
uugauacauuuuuaggauaaac

SEQ ID NO: 826702 - RNA, 22 nt, Human
uaaaugagggcugacaugauug

SEQ ID NO: 826703 - RNA, 22 nt, Human
uuuaaauggcauuuucccagau

SEQ ID NO: 826704 - RNA, 22 nt, Human
cucccaggcacagggaggagcc

SEQ ID NO: 826705 - RNA, 22 nt, Human
gagggagucugugcaaagaauu

SEQ ID NO: 826706 - RNA, 22 nt, Human
caggauggccccggggcugugc

SEQ ID NO: 826707 - RNA, 22 nt, Human
uggcagcucccagagcuuccaa

SEQ ID NO: 826708 - RNA, 19 nt, Human
uugaaagauuagcuuucua

SEQ ID NO: 826709 - RNA, 19 nt, Human
uucuccagccugaccugag

SEQ ID NO: 826710 - RNA, 22 nt, Human
uccaugagacagauacuguaag

SEQ ID NO: 826711 - RNA, 22 nt, Human
aggagcagcuucugaaccaugu

SEQ ID NO: 826712 - RNA, 22 nt, Human
aguggcaguagaugagcugguu

SEQ ID NO: 826713 - RNA, 22 nt, Human
gagggcaguagccucguacccu

SEQ ID NO: 826714 - RNA, 22 nt, Human
cccaguuucaacuuuccagugg

SEQ ID NO: 826715 - RNA, 22 nt, Human
gaagcacauggcuauagcuauu

SEQ ID NO: 826716 - RNA, 22 nt, Human
uuaacauacaucaugaacaaug

SEQ ID NO: 826717 - RNA, 22 nt, Human
cugcugugcaggugccuaugau

SEQ ID NO: 826718 - RNA, 22 nt, Human
gcuuugaagucugugucuuuug

SEQ ID NO: 826719 - RNA, 22 nt, Human
uggagaggagcaccauggccau

SEQ ID NO: 826720 - RNA, 22 nt, Human
uuugcaaagugacuauuauaug

SEQ ID NO: 826721 - RNA, 22 nt, Human
cagcuuccauaagagauggaga

SEQ ID NO: 826722 - RNA, 22 nt, Human
uaagcugugggagauuggcaua

SEQ ID NO: 826723 - RNA, 23 nt, Human
cugcuguuuucuguaccugaagc

SEQ ID NO: 826724 - RNA, 22 nt, Human
guucuucagaggggaaagaacc

SEQ ID NO: 826725 - RNA, 22 nt, Human
cccaggaggcagagguugcagu

SEQ ID NO: 826726 - RNA, 22 nt, Human
uagcacauacauaauagauaga

SEQ ID NO: 826727 - RNA, 22 nt, Human
gacagcugugcaggagaagggg

SEQ ID NO: 826728 - RNA, 22 nt, Human
gagggucccugcucagggccag

SEQ ID NO: 826729 - RNA, 22 nt, Human
augcuguggaugccuugcccca

SEQ ID NO: 826730 - RNA, 22 nt, Human
ucugaaaugcaaauuugacuga

SEQ ID NO: 826731 - RNA, 22 nt, Human
cuugaaagcacuuaguaaauua

SEQ ID NO: 826732 - RNA, 22 nt, Human
ucacccuugauaauguucuucu

SEQ ID NO: 826733 - RNA, 22 nt, Human
ucucuucuaauuuucccgagua

SEQ ID NO: 826734 - RNA, 22 nt, Human
cuugcaggccuuucuagcucua

SEQ ID NO: 826735 - RNA, 22 nt, Human
auaucaguaucuauguauuugu

SEQ ID NO: 826736 - RNA, 22 nt, Human
gaaaggugccccauaggcagga

SEQ ID NO: 826737 - RNA, 22 nt, Human
gcagagcuccccaagacaccaa

SEQ ID NO: 826738 - RNA, 22 nt, Human
uucaggaucaaguugccaguag

SEQ ID NO: 826739 - RNA, 22 nt, Human
guucuucaggccauccucccag

SEQ ID NO: 826740 - RNA, 22 nt, Human
gaggcagcaauaaaaagaauuu

SEQ ID NO: 826741 - RNA, 23 nt, Human
ggagugcaauggcgccaucucgg

SEQ ID NO: 826742 - RNA, 22 nt, Human
gaaggaggcguuagcccuagga

SEQ ID NO: 826743 - RNA, 19 nt, Human
uuucuuaggccuuuggccu

SEQ ID NO: 826744 - RNA, 22 nt, Human
ucuucagauaaagggagaguau

SEQ ID NO: 826745 - RNA, 22 nt, Human
cucaacagcucugccauacucc

SEQ ID NO: 826746 - RNA, 17 nt, Human
aggcagcucagaacauc

SEQ ID NO: 826747 - RNA, 22 nt, Human
cccaggagagaggccaguuggc

SEQ ID NO: 826748 - RNA, 22 nt, Human
guucuucagucacaucacagaa

SEQ ID NO: 826749 - RNA, 22 nt, Human
uuuaaauuuagaagaaacacug

SEQ ID NO: 826750 - RNA, 22 nt, Human
uucuucaacaaggacacuguua

SEQ ID NO: 826751 - RNA, 22 nt, Human
caaauguauaaauguacuuucu

SEQ ID NO: 826752 - RNA, 22 nt, Human
ggggcagcucccgagggcagga

SEQ ID NO: 826753 - RNA, 22 nt, Human
auggagacgcaagggaccuagg

SEQ ID NO: 826754 - RNA, 22 nt, Human
aggaggggcaaugauagucugg

SEQ ID NO: 826755 - RNA, 23 nt, Human
aguaaagcaauuguuggcgagag

SEQ ID NO: 826756 - RNA, 22 nt, Human
acucagaaccauuuacucugag

SEQ ID NO: 826757 - RNA, 22 nt, Human
aagcagcuggaagaguaagaug

SEQ ID NO: 826758 - RNA, 22 nt, Human
caggacagcucaacaccuccuc

SEQ ID NO: 826759 - RNA, 22 nt, Human
uaggcagcugcaaacuucgguc

SEQ ID NO: 826760 - RNA, 22 nt, Human
ucccaggacccaggcauucaca

SEQ ID NO: 826761 - RNA, 22 nt, Human
aacaugcugccuuucuacgagu

SEQ ID NO: 826762 - RNA, 22 nt, Human
gcugaaauucagauuccuaggc

SEQ ID NO: 826763 - RNA, 22 nt, Human
ccaggagagcaaaggucacucu

SEQ ID NO: 826764 - RNA, 22 nt, Human
accauguguuuuacacauggua

SEQ ID NO: 826765 - RNA, 22 nt, Human
uuuuguuguaauauaccuaucc

SEQ ID NO: 826766 - RNA, 22 nt, Human
gaggcagcucuucugaaugggg

SEQ ID NO: 826767 - RNA, 22 nt, Human
caggcagcaggagcccugcucg

SEQ ID NO: 826768 - RNA, 22 nt, Human
uuaucacuuaugagcuuuuugc

SEQ ID NO: 826769 - RNA, 22 nt, Human
ggaggggucucuagcgaggaga

SEQ ID NO: 826770 - RNA, 22 nt, Human
ucuucauuccguagauauuuau

SEQ ID NO: 826771 - RNA, 22 nt, Human
auuauuauauagggaaaguccc

SEQ ID NO: 826772 - RNA, 22 nt, Human
gauguagagggaagauuuuaaa

SEQ ID NO: 826773 - RNA, 22 nt, Human
cagcuggcgggcagagccgcca

SEQ ID NO: 826774 - RNA, 22 nt, Human
aaaggccacacagagcagggag

SEQ ID NO: 826775 - RNA, 22 nt, Human
ucauuucucccggccaaaaacu

SEQ ID NO: 826776 - RNA, 22 nt, Human
uugcucagcacuggagccagcu

SEQ ID NO: 826777 - RNA, 22 nt, Human
ucauggauggccgggaggugau

SEQ ID NO: 826778 - RNA, 22 nt, Human
cccgggaggaggaaguugcagu

SEQ ID NO: 826779 - RNA, 22 nt, Human
caucucaugggcaugccaagcu

SEQ ID NO: 826780 - RNA, 22 nt, Human
ugaguuuugucuugcuagaagu

SEQ ID NO: 826781 - RNA, 22 nt, Human
ccucugcucugguccaugugcu

SEQ ID NO: 826782 - RNA, 22 nt, Human
ucaaauaaugccauucaucauc

SEQ ID NO: 826783 - RNA, 22 nt, Human
guugaaagaucauguggcugcc

SEQ ID NO: 826784 - RNA, 22 nt, Human
aggcagcauuugaauccagguc

SEQ ID NO: 826785 - RNA, 23 nt, Human
aaugauuucaugaugauagcagc

SEQ ID NO: 826786 - RNA, 22 nt, Human
uauuucagcccuacuacuuggc

SEQ ID NO: 826787 - RNA, 22 nt, Human
uggcagcuauuacaaggaaguc

SEQ ID NO: 826788 - RNA, 22 nt, Human
cagacaggaauucuggcguggu

SEQ ID NO: 826789 - RNA, 22 nt, Human
gugauuuugagaccuauauagu

SEQ ID NO: 826790 - RNA, 22 nt, Human
cuccaggaaagccugaggcccg

SEQ ID NO: 826791 - RNA, 22 nt, Human
aggcaggcacacuuccuccagg

SEQ ID NO: 826792 - RNA, 22 nt, Human
uucauucugcaguucucagcuc

SEQ ID NO: 826793 - RNA, 22 nt, Human
gggcagcucuggcugugggaag

SEQ ID NO: 826794 - RNA, 22 nt, Human
uucaggaugcagagguuguagu

SEQ ID NO: 826795 - RNA, 22 nt, Human
uggcagcuggaucccaaggcag

SEQ ID NO: 826796 - RNA, 22 nt, Human
auuucagauucagaaauguagg

SEQ ID NO: 826797 - RNA, 20 nt, Human
aguuauaguaucuagccaug

SEQ ID NO: 826798 - RNA, 19 nt, Human
ugaggggaggagaggccug

SEQ ID NO: 826799 - RNA, 22 nt, Human
uggcagcuuuuuguuucaggcu

SEQ ID NO: 826800 - RNA, 22 nt, Human
ccaggaaauagugcugugaucu

SEQ ID NO: 826801 - RNA, 22 nt, Human
accaggaggccuugguucugag

SEQ ID NO: 826802 - RNA, 22 nt, Human
cuugcugucccuugguaugaac

SEQ ID NO: 826803 - RNA, 22 nt, Human
aaggcaguaggaucuuccacag

SEQ ID NO: 826804 - RNA, 21 nt, Human
uucaaaaugguguguuugucu

SEQ ID NO: 826805 - RNA, 22 nt, Human
uguguucuggaaagcucacuga

SEQ ID NO: 826806 - RNA, 20 nt, Human
ucuggcaggugaacgagcug

SEQ ID NO: 826807 - RNA, 22 nt, Human
uuugaaaggguuaugagacuga

SEQ ID NO: 826808 - RNA, 22 nt, Human
uugcagcuucuaccacuguuuc

SEQ ID NO: 826809 - RNA, 22 nt, Human
uuugcauaagucauguccagug

SEQ ID NO: 826810 - RNA, 22 nt, Human
uaggcagcgcuuggcugugcuu

SEQ ID NO: 826811 - RNA, 19 nt, Human
ucucacaguuuccuugccu

SEQ ID NO: 826812 - RNA, 22 nt, Human
ugcauaaagugccauaguauua

SEQ ID NO: 826813 - RNA, 22 nt, Human
uucagugucaauuuuuaaauau

SEQ ID NO: 826814 - RNA, 22 nt, Human
acuggcaguagagggagcgcau

SEQ ID NO: 826815 - RNA, 22 nt, Human
accaggagacaugaccaaugag

SEQ ID NO: 826816 - RNA, 22 nt, Human
uuccaugaagggcagccucuca

SEQ ID NO: 826817 - RNA, 22 nt, Human
auuucccaugugaaucaauugg

SEQ ID NO: 826818 - RNA, 17 nt, Human
agcugaccagauggacu

SEQ ID NO: 826819 - RNA, 22 nt, Human
auggagggugucagagagcgaa

SEQ ID NO: 826820 - RNA, 22 nt, Human
guguugaugacauuuuagaaac

SEQ ID NO: 826821 - RNA, 21 nt, Human
auacacauacacauaaaugug

SEQ ID NO: 826822 - RNA, 22 nt, Human
ucucucuugucaccccaucugc

SEQ ID NO: 826823 - RNA, 22 nt, Human
cugcugugccucuuuucacgug

SEQ ID NO: 826824 - RNA, 22 nt, Human
caagauggacauaaggagagaa

SEQ ID NO: 826825 - RNA, 22 nt, Human
caggcagcugggucaccguccc

SEQ ID NO: 826826 - RNA, 22 nt, Human
gacagaggcuggagcaccuccu

SEQ ID NO: 826827 - RNA, 22 nt, Human
aaagauaauguuuccuuauucu

SEQ ID NO: 826828 - RNA, 22 nt, Human
ugcugaaauuagaacauugagg

SEQ ID NO: 826829 - RNA, 22 nt, Human
caaggccagagccagcgauaag

SEQ ID NO: 826830 - RNA, 23 nt, Human
gcagaggagcaagcuggacacca

SEQ ID NO: 826831 - RNA, 22 nt, Human
ucugcaggcuuauaggaugggu

SEQ ID NO: 826832 - RNA, 22 nt, Human
gacagcuggcaguggaaaggug

SEQ ID NO: 826833 - RNA, 22 nt, Human
aucugcagaggacaggcgagga

SEQ ID NO: 826834 - RNA, 22 nt, Human
agacucaagcagauaggaauua

SEQ ID NO: 826835 - RNA, 22 nt, Human
ugaaggcccagccacagaaugg

SEQ ID NO: 826836 - RNA, 19 nt, Human
ucucugcuucucuuggcau

SEQ ID NO: 826837 - RNA, 22 nt, Human
gagagggagccagccaggaacc

SEQ ID NO: 826838 - RNA, 22 nt, Human
cugcuuuggacaacuauucuug

SEQ ID NO: 826839 - RNA, 16 nt, Human
aaggagggaagagaau

SEQ ID NO: 826840 - RNA, 22 nt, Human
aaggccagaguacuagaggcug

SEQ ID NO: 826841 - RNA, 22 nt, Human
agucucuuuguggacucugccu

SEQ ID NO: 826842 - RNA, 22 nt, Human
cagauggaacacagaaaggaga

SEQ ID NO: 826843 - RNA, 22 nt, Human
gagcagcucgagaaggaagcag

SEQ ID NO: 826844 - RNA, 22 nt, Human
aaauauaguaaaugcauaguuc

SEQ ID NO: 826845 - RNA, 22 nt, Human
cucagugugaaugcucaguaaa

SEQ ID NO: 826846 - RNA, 22 nt, Human
ugcuuuggccacuagaauucag

SEQ ID NO: 826847 - RNA, 22 nt, Human
gaggcagaaguugcagugagca

SEQ ID NO: 826848 - RNA, 22 nt, Human
auuccaguuggguucuaauaca

SEQ ID NO: 826849 - RNA, 22 nt, Human
agauggagaccuuggaugaacu

SEQ ID NO: 826850 - RNA, 22 nt, Human
cuugcuucauuagugucuuagu

SEQ ID NO: 826851 - RNA, 22 nt, Human
aaaauuauucauggcuuuugga

SEQ ID NO: 826852 - RNA, 22 nt, Human
gcugccagccaacuugcugugc

SEQ ID NO: 826853 - RNA, 22 nt, Human
gccaugcuugguaugcugugag

SEQ ID NO: 826854 - RNA, 22 nt, Human
guucuucaaagugacaacuaaa

SEQ ID NO: 826855 - RNA, 22 nt, Human
uccucagacuucccuuugugua

SEQ ID NO: 826856 - RNA, 22 nt, Human
gacccaggguauccagagcugc

SEQ ID NO: 826857 - RNA, 22 nt, Human
agggaagcccuggcugagaccc

SEQ ID NO: 826858 - RNA, 22 nt, Human
ucaguucuuuauuucacaguga

SEQ ID NO: 826859 - RNA, 22 nt, Human
cagcugacagugaggugggggc

SEQ ID NO: 826860 - RNA, 22 nt, Human
uguaggccuauguccagcaauu

SEQ ID NO: 826861 - RNA, 22 nt, Human
auucuucauaccuacugagguu

SEQ ID NO: 826862 - RNA, 21 nt, Human
gggugggaggacacagcaggc

SEQ ID NO: 826863 - RNA, 22 nt, Human
aggcuagcuuuggcucaguaaa

SEQ ID NO: 826864 - RNA, 22 nt, Human
uuucuucucgacaccuuauccc

SEQ ID NO: 826865 - RNA, 21 nt, Human
cccaggagaagaaaagaugca

SEQ ID NO: 826866 - RNA, 22 nt, Human
gauguuucaugcuagcaugugu

SEQ ID NO: 826867 - RNA, 22 nt, Human
cggcagcuccgcgccguaggac

SEQ ID NO: 826868 - RNA, 22 nt, Human
uuucagggagccuagaagagcu

SEQ ID NO: 826869 - RNA, 22 nt, Human
uugcaaaggggaauaaagcaau

SEQ ID NO: 826870 - RNA, 22 nt, Human
ucucacugcaaauauuauguau

SEQ ID NO: 826871 - RNA, 22 nt, Human
uacaguaagaugaaauagcaau

SEQ ID NO: 826872 - RNA, 23 nt, Human
cuucucagaagucugugccagga

SEQ ID NO: 826873 - RNA, 22 nt, Human
ggcucagacucccaggcccucu

SEQ ID NO: 826874 - RNA, 22 nt, Human
auucaaguucuucugucuuugc

SEQ ID NO: 826875 - RNA, 20 nt, Human
aggcagcuggccaggcaggu

SEQ ID NO: 826876 - RNA, 22 nt, Human
acauucuuaacaguuaaaaacu

SEQ ID NO: 826877 - RNA, 22 nt, Human
cugccaggcgauggauuggcug

SEQ ID NO: 826878 - RNA, 22 nt, Human
agacaggagagggaacugccgg

SEQ ID NO: 826879 - RNA, 22 nt, Human
uauuuguauguguguacauaua

SEQ ID NO: 826880 - RNA, 22 nt, Human
cuuugcaaacgauuaccacaug

SEQ ID NO: 826881 - RNA, 22 nt, Human
agggacuuguguccuauguaug

SEQ ID NO: 826882 - RNA, 22 nt, Human
uuugaaagcaccauuugaguag

SEQ ID NO: 826883 - RNA, 22 nt, Human
gccaggagugucccacucauuu

SEQ ID NO: 826884 - RNA, 22 nt, Human
ugaacaaacugcauucuucacu

SEQ ID NO: 826885 - RNA, 22 nt, Human
ggaggggauuuaguagaugcua

SEQ ID NO: 826886 - RNA, 22 nt, Human
agcccaggagguggagguugca

SEQ ID NO: 826887 - RNA, 22 nt, Human
uuugagauggagucuugcucug

SEQ ID NO: 826888 - RNA, 22 nt, Human
agcuagaauguuccuuuucauu

SEQ ID NO: 826889 - RNA, 22 nt, Human
uugcaggauuuuagagaugaca

SEQ ID NO: 826890 - RNA, 19 nt, Human
ugcugcuguccuugcaggg

SEQ ID NO: 826891 - RNA, 22 nt, Human
ugcuguguggaugugaagaauc

SEQ ID NO: 826892 - RNA, 22 nt, Human
gacccaggcucgugggacggcu

SEQ ID NO: 826893 - RNA, 22 nt, Human
uuucuucauucaccuucacccc

SEQ ID NO: 826894 - RNA, 22 nt, Human
uuugaaaggagcuuuauccaga

SEQ ID NO: 826895 - RNA, 22 nt, Human
gcuuccuaaaugcacagggcag

SEQ ID NO: 826896 - RNA, 22 nt, Human
uucauugucucuguuugccuuc

SEQ ID NO: 826897 - RNA, 22 nt, Human
uccaggagagguguggggacug

SEQ ID NO: 826898 - RNA, 22 nt, Human
uucaugcuuuuaccgcuguuaa

SEQ ID NO: 826899 - RNA, 22 nt, Human
auucauuuagguauucacuuac

SEQ ID NO: 826900 - RNA, 23 nt, Human
cugcugugaaacaugguuuuggu

SEQ ID NO: 826901 - RNA, 22 nt, Human
uagcacauuguugaccagaagg

SEQ ID NO: 826902 - RNA, 22 nt, Human
cuuugcaaacugucacacuuuc

SEQ ID NO: 826903 - RNA, 22 nt, Human
aagcagaggguauggccagguu

SEQ ID NO: 826904 - RNA, 22 nt, Human
augcugugccuggaaagcggcu

SEQ ID NO: 826905 - RNA, 22 nt, Human
cagaagaguagcugaacaaguu

SEQ ID NO: 826906 - RNA, 23 nt, Human
ucguugaauagcaauagcacaac

SEQ ID NO: 826907 - RNA, 22 nt, Human
agagcagcuggggcagagacca

SEQ ID NO: 826908 - RNA, 20 nt, Human
agagcagcaguuggugaggu

SEQ ID NO: 826909 - RNA, 22 nt, Human
ggggcagcuaccggaaguaggg

SEQ ID NO: 826910 - RNA, 22 nt, Human
gauuucuugaccccugucucag

SEQ ID NO: 826911 - RNA, 22 nt, Human
gccaggaggcuuaacuggacag

SEQ ID NO: 826912 - RNA, 22 nt, Human
ugaggcaggaggauugcaggau

SEQ ID NO: 826913 - RNA, 22 nt, Human
ccucagggaaugggaggcuggg

SEQ ID NO: 826914 - RNA, 22 nt, Human
uguucauuuggcccuuuuguau

SEQ ID NO: 826915 - RNA, 22 nt, Human
gaggccaggacaugaaagcuga

SEQ ID NO: 826916 - RNA, 22 nt, Human
aaagccaugggucuuuggcaua

SEQ ID NO: 826917 - RNA, 22 nt, Human
gcugcccaggguggagccggcu

SEQ ID NO: 826918 - RNA, 22 nt, Human
uguuuucagucauauagcaggu

SEQ ID NO: 826919 - RNA, 22 nt, Human
aucaggauguuuggcugucaua

SEQ ID NO: 826920 - RNA, 22 nt, Human
gaagcagcugccagagaugucu

SEQ ID NO: 826921 - RNA, 22 nt, Human
caggcagccaggggaccugucc

SEQ ID NO: 826922 - RNA, 22 nt, Human
gugcauuugugcaugcacaugu

SEQ ID NO: 826923 - RNA, 22 nt, Human
aggguagggccguagggccaug

SEQ ID NO: 826924 - RNA, 22 nt, Human
ggcaggcugggugucauggagu

SEQ ID NO: 826925 - RNA, 22 nt, Human
aagcuggagaguuaggugaaua

SEQ ID NO: 826926 - RNA, 22 nt, Human
ucugggaacagccuggcugugu

SEQ ID NO: 826927 - RNA, 19 nt, Human
caugcugaccugcuguggu

SEQ ID NO: 826928 - RNA, 22 nt, Human
gcugggaagugcaagaucaagg

SEQ ID NO: 826929 - RNA, 22 nt, Human
aaaggccaauaaagacaagcug

SEQ ID NO: 826930 - RNA, 22 nt, Human
cagcuucugcuaucgaacaucu

SEQ ID NO: 826931 - RNA, 22 nt, Human
uucaggauaugugauaucugaa

SEQ ID NO: 826932 - RNA, 22 nt, Human
uuuugugagcccauaaaugcca

SEQ ID NO: 826933 - RNA, 22 nt, Human
ucauuguuucugcuuuucauga

SEQ ID NO: 826934 - RNA, 22 nt, Human
aggcaagcugcagagaguccuu

SEQ ID NO: 826935 - RNA, 22 nt, Human
uucuucuugaaacuuuagguug

SEQ ID NO: 826936 - RNA, 22 nt, Human
uugagaagaauguguugaguuu

SEQ ID NO: 826937 - RNA, 22 nt, Human
ucuggcuuucauuuguuuaaag

SEQ ID NO: 826938 - RNA, 22 nt, Human
aggagcagaacugauucugacu

SEQ ID NO: 826939 - RNA, 22 nt, Human
uucaauucuaaacuaauauucu

SEQ ID NO: 826940 - RNA, 22 nt, Human
gaagcagcgaaguggaagggac

SEQ ID NO: 826941 - RNA, 22 nt, Human
uugcaucuaccauaucaaagau

SEQ ID NO: 826942 - RNA, 22 nt, Human
uggcagcuggcucugcgcaggc

SEQ ID NO: 826943 - RNA, 22 nt, Human
cagcuggcaaguggagcagggu

SEQ ID NO: 826944 - RNA, 22 nt, Human
uuuagaaguucacacauuuaaa

SEQ ID NO: 826945 - RNA, 22 nt, Human
gagacagcacaggccacuggga

SEQ ID NO: 826946 - RNA, 22 nt, Human
uucacagaauggcaaguuaugg

SEQ ID NO: 826947 - RNA, 22 nt, Human
uuucaaacauaucuucauuacu

SEQ ID NO: 826948 - RNA, 22 nt, Human
uugcaauagccuuauuuccaaa

SEQ ID NO: 826949 - RNA, 22 nt, Human
aauagcucacugauuucucuuu

SEQ ID NO: 826950 - RNA, 22 nt, Human
uuauccaagcagaagcugcaca

SEQ ID NO: 826951 - RNA, 22 nt, Human
cugacccauauaagaguggagg

SEQ ID NO: 826952 - RNA, 22 nt, Human
cccagcaggaggagguugcagu

SEQ ID NO: 826953 - RNA, 22 nt, Human
uugcagcuuagugauguuaucu

SEQ ID NO: 826954 - RNA, 22 nt, Human
ggcuuugccuggaauuuccuug

SEQ ID NO: 826955 - RNA, 22 nt, Human
ucaggagaaucagggcuguccu

SEQ ID NO: 826956 - RNA, 23 nt, Human
auucuucauuaucuucuagaaaa

SEQ ID NO: 826957 - RNA, 22 nt, Human
cuucucagaggccagaagcuau

SEQ ID NO: 826958 - RNA, 22 nt, Human
uaaugucagcauaguuuauuuu

SEQ ID NO: 826959 - RNA, 22 nt, Human
aaaauacuguggaguguugaaa

SEQ ID NO: 826960 - RNA, 21 nt, Human
auggagggaccagggaagcag

SEQ ID NO: 826961 - RNA, 23 nt, Human
cuccccaguguccucaugcaucu

SEQ ID NO: 826962 - RNA, 22 nt, Human
gcaccugauugauuucacugcu

SEQ ID NO: 826963 - RNA, 22 nt, Human
uuucuuaguccuagagugauuu

SEQ ID NO: 826964 - RNA, 22 nt, Human
aguguuugagacacauuucacu

SEQ ID NO: 826965 - RNA, 20 nt, Human
cugcuguguuauuguagaac

SEQ ID NO: 826966 - RNA, 22 nt, Human
cuuagaaaucgaacucagguua

SEQ ID NO: 826967 - RNA, 22 nt, Human
aggcagcucuguggccucccag

SEQ ID NO: 826968 - RNA, 19 nt, Human
ugcuagaaauucugugacu

SEQ ID NO: 826969 - RNA, 21 nt, Human
uggaggaauaaagcacagaag

SEQ ID NO: 826970 - RNA, 22 nt, Human
gauuuuaauuauaggagguccu

SEQ ID NO: 826971 - RNA, 23 nt, Human
uuugaaguugacugccuuccaga

SEQ ID NO: 826972 - RNA, 22 nt, Human
uuagccaugcccuagaagagga

SEQ ID NO: 826973 - RNA, 22 nt, Human
gaaggaggugucaguuggacug

SEQ ID NO: 826974 - RNA, 22 nt, Human
guucucucugcuuccaagaugg

SEQ ID NO: 826975 - RNA, 22 nt, Human
uucauuaguucugaagaugucu

SEQ ID NO: 826976 - RNA, 20 nt, Human
uucacagaggacucagguca

SEQ ID NO: 826977 - RNA, 22 nt, Human
agugcuuucuugcuccaucagu

SEQ ID NO: 826978 - RNA, 22 nt, Human
cucaggauagauuguccucuca

SEQ ID NO: 826979 - RNA, 22 nt, Human
gaucauuuacuuguucuggacu

SEQ ID NO: 826980 - RNA, 18 nt, Human
aggcaggcuggagugacu

SEQ ID NO: 826981 - RNA, 22 nt, Human
ucagucucaucaacucuauucc

SEQ ID NO: 826982 - RNA, 22 nt, Human
cagcagagggagccauugaaau

SEQ ID NO: 826983 - RNA, 22 nt, Human
uccccagggcugcagagggugu

SEQ ID NO: 826984 - RNA, 22 nt, Human
cagugauggauauggagaaguc

SEQ ID NO: 826985 - RNA, 22 nt, Human
guccaugauucuguguaguaga

SEQ ID NO: 826986 - RNA, 22 nt, Human
uggcagucuggguuggcaguua

SEQ ID NO: 826987 - RNA, 22 nt, Human
ucauuucuccgaccugcugucc

SEQ ID NO: 826988 - RNA, 22 nt, Human
cccuugcaucccauguguggcc

SEQ ID NO: 826989 - RNA, 22 nt, Human
cccaggaggccaagguugcagu

SEQ ID NO: 826990 - RNA, 23 nt, Human
auuucuaggggauuuucuggugc

SEQ ID NO: 826991 - RNA, 22 nt, Human
gcucaggaucccaggggugugc

SEQ ID NO: 826992 - RNA, 22 nt, Human
gcucacugccauucucuagaug

SEQ ID NO: 826993 - RNA, 22 nt, Human
aggaagcuuagugaaaggacca

SEQ ID NO: 826994 - RNA, 17 nt, Human
agcugaaauugcugaag

SEQ ID NO: 826995 - RNA, 22 nt, Human
aaggcagcagugcacgacugau

SEQ ID NO: 826996 - RNA, 22 nt, Human
gcaaauauucaagacuuuucca

SEQ ID NO: 826997 - RNA, 22 nt, Human
uucuuugaguuaguacagucca

SEQ ID NO: 826998 - RNA, 22 nt, Human
uaaugucaaggugauagauuug

SEQ ID NO: 826999 - RNA, 23 nt, Human
agggugagcaagcuauggagacc

SEQ ID NO: 827000 - RNA, 21 nt, Human
agacaguaacucuucuacucc

SEQ ID NO: 827001 - RNA, 22 nt, Human
gagcagcucugggugacccagu

SEQ ID NO: 827002 - RNA, 22 nt, Human
ggcagccuugacuagugacuua

SEQ ID NO: 827003 - RNA, 22 nt, Human
cucaggaucgcuugcccuaggg

SEQ ID NO: 827004 - RNA, 19 nt, Human
uaaggccaaaaguaagugu

SEQ ID NO: 827005 - RNA, 22 nt, Human
aaaaacuguaauuacuuuugca

SEQ ID NO: 827006 - RNA, 22 nt, Human
gggacuucauagcuaggcacuu

SEQ ID NO: 827007 - RNA, 22 nt, Human
aggacagggauucaaacuccca

SEQ ID NO: 827008 - RNA, 20 nt, Human
aggaggggauagaaucaaag

SEQ ID NO: 827009 - RNA, 16 nt, Human
aggaggggaauuagga

SEQ ID NO: 827010 - RNA, 22 nt, Human
uccaggagggauugggcugugg

SEQ ID NO: 827011 - RNA, 22 nt, Human
uagggauguccugagacuuggc

SEQ ID NO: 827012 - RNA, 22 nt, Human
augcugugguagacagcauucc

SEQ ID NO: 827013 - RNA, 22 nt, Human
agagggcugcugcacagugcuc

SEQ ID NO: 827014 - RNA, 23 nt, Human
uccaggagaaccccugucugucc

SEQ ID NO: 827015 - RNA, 22 nt, Human
aggcaagcgcagaagcggagga

SEQ ID NO: 827016 - RNA, 22 nt, Human
aguuauuacucuuuaacauauu

SEQ ID NO: 827017 - RNA, 22 nt, Human
cuuugcaauagaggcacacaug

SEQ ID NO: 827018 - RNA, 22 nt, Human
cuucugugauuugguuaggaua

SEQ ID NO: 827019 - RNA, 22 nt, Human
ccaggaguggcuggugaccuuc

SEQ ID NO: 827020 - RNA, 22 nt, Human
cauuuguuuagaagucuuuaua

SEQ ID NO: 827021 - RNA, 22 nt, Human
ucuuugcacugugcaagcagaa

SEQ ID NO: 827022 - RNA, 22 nt, Human
acaacauuauacauagaaagcu

SEQ ID NO: 827023 - RNA, 22 nt, Human
gucaggauuggggucaugaguc

SEQ ID NO: 827024 - RNA, 23 nt, Human
gaggcagcuccugcagugcccug

SEQ ID NO: 827025 - RNA, 22 nt, Human
aucaggaugaagcuguagcgaa

SEQ ID NO: 827026 - RNA, 22 nt, Human
uucaggauuauacucucuuccc

SEQ ID NO: 827027 - RNA, 22 nt, Human
aggcagaucacuugaggccagg

SEQ ID NO: 827028 - RNA, 22 nt, Human
cugcuucuccaaaguaggacuu

SEQ ID NO: 827029 - RNA, 22 nt, Human
cucucuguuaugcuuucaugaa

SEQ ID NO: 827030 - RNA, 22 nt, Human
ggagaggauguuuuaguaacuu

SEQ ID NO: 827031 - RNA, 17 nt, Human
gcugacccuggagaagu

SEQ ID NO: 827032 - RNA, 22 nt, Human
ugaggggagacagaguggacuc

SEQ ID NO: 827033 - RNA, 21 nt, Human
uguaaguuucaucugaauugg

SEQ ID NO: 827034 - RNA, 22 nt, Human
uaucuguuguccaugcagaaag

SEQ ID NO: 827035 - RNA, 22 nt, Human
aucacauucuuucaaagcaguc

SEQ ID NO: 827036 - RNA, 22 nt, Human
guuuuauaauugcuucauaaga

SEQ ID NO: 827037 - RNA, 20 nt, Human
ugaaggccauuuguuccaga

SEQ ID NO: 827038 - RNA, 22 nt, Human
cagagggcacaugguuuccuca

SEQ ID NO: 827039 - RNA, 22 nt, Human
guuuuucuaggaccaugugauu

SEQ ID NO: 827040 - RNA, 22 nt, Human
agaggcagccguauuucaaagg

SEQ ID NO: 827041 - RNA, 20 nt, Human
agcauuugaaauaugacuau

SEQ ID NO: 827042 - RNA, 22 nt, Human
aagcaauauacugauaugauua

SEQ ID NO: 827043 - RNA, 22 nt, Human
ugcugcugauggcaccuaggca

SEQ ID NO: 827044 - RNA, 22 nt, Human
aauacaguagguaauaguucau

SEQ ID NO: 827045 - RNA, 22 nt, Human
gaaaggccagcucacagaugag

SEQ ID NO: 827046 - RNA, 22 nt, Human
auucuucaaagagugucaaagu

SEQ ID NO: 827047 - RNA, 22 nt, Human
ccauccugcauugcuauucaga

SEQ ID NO: 827048 - RNA, 22 nt, Human
cuugaaagcacuccuuugacug

SEQ ID NO: 827049 - RNA, 22 nt, Human
aaauacuagaauucagaguuga

SEQ ID NO: 827050 - RNA, 19 nt, Human
cccaggaggcggagguugc

SEQ ID NO: 827051 - RNA, 22 nt, Human
acagucucuccacacugcaggg

SEQ ID NO: 827052 - RNA, 19 nt, Human
aucugccuuagugcugcug

SEQ ID NO: 827053 - RNA, 22 nt, Human
aacuuucuuggaugucucaaca

SEQ ID NO: 827054 - RNA, 22 nt, Human
uucaggaucauuuguuuuaucu

SEQ ID NO: 827055 - RNA, 22 nt, Human
aggcagcuggacauaacuaacc

SEQ ID NO: 827056 - RNA, 22 nt, Human
cucacugucuguacuagcugau

SEQ ID NO: 827057 - RNA, 22 nt, Human
ugaaaugagauaauuuaagugc

SEQ ID NO: 827058 - RNA, 22 nt, Human
gacagagaggcugagcaguaca

SEQ ID NO: 827059 - RNA, 22 nt, Human
agcccagggaaccaggaagugg

SEQ ID NO: 827060 - RNA, 22 nt, Human
caggagagauaugaguccccac

SEQ ID NO: 827061 - RNA, 22 nt, Human
cccuggagguggagguugcagg

SEQ ID NO: 827062 - RNA, 22 nt, Human
auagcuguuagauuggggucga

SEQ ID NO: 827063 - RNA, 22 nt, Human
uggcagcuagcuguuuucaugc

SEQ ID NO: 827064 - RNA, 22 nt, Human
ucaaucacguguuccauguucu

SEQ ID NO: 827065 - RNA, 22 nt, Human
uucuacaauaugaauaaugaag

SEQ ID NO: 827066 - RNA, 22 nt, Human
auacuguuuugugacuuaucuu

SEQ ID NO: 827067 - RNA, 20 nt, Human
ccacaggaguccagucgacc

SEQ ID NO: 827068 - RNA, 22 nt, Human
ccagaagaccccguccaccucc

SEQ ID NO: 827069 - RNA, 22 nt, Human
aggcagcuuucagugucucuca

SEQ ID NO: 827070 - RNA, 22 nt, Human
aaaugaugcucacagauuagug

SEQ ID NO: 827071 - RNA, 22 nt, Human
cucagaagccuucagucuuggc

SEQ ID NO: 827072 - RNA, 22 nt, Human
uugcaucuagggcaacccagag

SEQ ID NO: 827073 - RNA, 19 nt, Human
auacagauguauccaugau

SEQ ID NO: 827074 - RNA, 20 nt, Human
accaggagauggaggcaggg

SEQ ID NO: 827075 - RNA, 22 nt, Human
uucucagaugauucagauaaac

SEQ ID NO: 827076 - RNA, 22 nt, Human
aggagggaccuaggaauauugc

SEQ ID NO: 827077 - RNA, 22 nt, Human
uguugagacugagggagucagc

SEQ ID NO: 827078 - RNA, 22 nt, Human
cuggaaauuggagaugauguuu

SEQ ID NO: 827079 - RNA, 21 nt, Human
uuugaaagcccuauguuuuca

SEQ ID NO: 827080 - RNA, 22 nt, Human
caggcaggucagugaagaagga

SEQ ID NO: 827081 - RNA, 22 nt, Human
cagaguggcgacccccucagcu

SEQ ID NO: 827082 - RNA, 22 nt, Human
acccaggaggcagagguugcag

SEQ ID NO: 827083 - RNA, 22 nt, Human
cuugcugugugguguucucaga

SEQ ID NO: 827084 - RNA, 20 nt, Human
cagaggcauuuucagacucu

SEQ ID NO: 827085 - RNA, 22 nt, Human
uagugcuuuaaguuuacagaga

SEQ ID NO: 827086 - RNA, 22 nt, Human
gcccaggaagccaccgggaagu

SEQ ID NO: 827087 - RNA, 22 nt, Human
uuugaaagcaggugugggaggg

SEQ ID NO: 827088 - RNA, 22 nt, Human
uaguuaaaauaauggagauguu

SEQ ID NO: 827089 - RNA, 21 nt, Human
gaacauuuggguuguuucuac

SEQ ID NO: 827090 - RNA, 22 nt, Human
auggcagccugagcagaggaau

SEQ ID NO: 827091 - RNA, 22 nt, Human
acucaggaauggggcugggacu

SEQ ID NO: 827092 - RNA, 20 nt, Human
ucacuaguaaccaucugcuu

SEQ ID NO: 827093 - RNA, 22 nt, Human
uucuucagucccacuagccaca

SEQ ID NO: 827094 - RNA, 23 nt, Human
ugaguucucaucuuggcuucuau

SEQ ID NO: 827095 - RNA, 23 nt, Human
accaggagaaaagcuuugcggga

SEQ ID NO: 827096 - RNA, 22 nt, Human
gcccaggaguugaagggcugac

SEQ ID NO: 827097 - RNA, 22 nt, Human
gcagaggacagggauuuagauu

SEQ ID NO: 827098 - RNA, 22 nt, Human
uuucuucaauugcuaacaagga

SEQ ID NO: 827099 - RNA, 22 nt, Human
cagggagggacaauugucaccu

SEQ ID NO: 827100 - RNA, 20 nt, Human
gcccaggaucucugaggcau

SEQ ID NO: 827101 - RNA, 22 nt, Human
gauuucuugauaauucaaaucc

SEQ ID NO: 827102 - RNA, 22 nt, Human
gccugcagauauauaggauggu

SEQ ID NO: 827103 - RNA, 22 nt, Human
auauucuuccaaaacaucauuu

SEQ ID NO: 827104 - RNA, 22 nt, Human
agauggaguuaguaccagaguc

SEQ ID NO: 827105 - RNA, 18 nt, Human
uggcagcuagguaaagaa

SEQ ID NO: 827106 - RNA, 22 nt, Human
ugaaaggugacauuucuuggau

SEQ ID NO: 827107 - RNA, 22 nt, Human
ugaugaaauguugaggcaguga

SEQ ID NO: 827108 - RNA, 18 nt, Human
uugcuuuguaagcuugca

SEQ ID NO: 827109 - RNA, 22 nt, Human
caaauauuccagguacaucccu

SEQ ID NO: 827110 - RNA, 23 nt, Human
uugcacauuggagcuggucuucu

SEQ ID NO: 827111 - RNA, 22 nt, Human
gaggagagaagcuaacggugcu

SEQ ID NO: 827112 - RNA, 22 nt, Human
agcugcccugguaagauugaug

SEQ ID NO: 827113 - RNA, 22 nt, Human
uucuucuuaauguccugggaac

SEQ ID NO: 827114 - RNA, 22 nt, Human
aggagggacaccaauauauguu

SEQ ID NO: 827115 - RNA, 22 nt, Human
auuuaaaugcuuaagaggguuu

SEQ ID NO: 827116 - RNA, 22 nt, Human
cccaggagguggagguugcagc

SEQ ID NO: 827117 - RNA, 22 nt, Human
ucacugucugaaagaaauggcc

SEQ ID NO: 827118 - RNA, 22 nt, Human
uuucaguguaucuuccaaaagc

SEQ ID NO: 827119 - RNA, 22 nt, Human
guccucuguuagaaaugugcuu

SEQ ID NO: 827120 - RNA, 22 nt, Human
uauuuccaccuauuauuuucug

SEQ ID NO: 827121 - RNA, 20 nt, Human
cuucuucagccuaugcuuca

SEQ ID NO: 827122 - RNA, 22 nt, Human
ggcaggcagaggcugagacagg

SEQ ID NO: 827123 - RNA, 22 nt, Human
aucuucucaagcagcauccugu

SEQ ID NO: 827124 - RNA, 22 nt, Human
uuuccauguuggugaaaugagg

SEQ ID NO: 827125 - RNA, 22 nt, Human
gcccaggaagugacucagaugu

SEQ ID NO: 827126 - RNA, 22 nt, Human
ggccagagaauaugccuuacgu

SEQ ID NO: 827127 - RNA, 22 nt, Human
gcauuuccugugcuuggcauau

SEQ ID NO: 827128 - RNA, 22 nt, Human
aguuggagugaacaugagauug

SEQ ID NO: 827129 - RNA, 22 nt, Human
gguggaaggccuggaaggaggc

SEQ ID NO: 827130 - RNA, 22 nt, Human
ugaggcaggaaguuauauaaug

SEQ ID NO: 827131 - RNA, 22 nt, Human
cagcugccuucugcgggaaguc

SEQ ID NO: 827132 - RNA, 22 nt, Human
agaaaugacacacaugagacau

SEQ ID NO: 827133 - RNA, 21 nt, Human
aucacauuggcuguuauuauu

SEQ ID NO: 827134 - RNA, 22 nt, Human
ugaggcaguauucuccauucca

SEQ ID NO: 827135 - RNA, 21 nt, Human
ugaaaugagaaugcugagcac

SEQ ID NO: 827136 - RNA, 22 nt, Human
aagcuggaacaucuugaggaag

SEQ ID NO: 827137 - RNA, 22 nt, Human
agaggggaaguaaugaaugaua

SEQ ID NO: 827138 - RNA, 22 nt, Human
auuuuacuuugugaauauugac

SEQ ID NO: 827139 - RNA, 22 nt, Human
augcuguguuugagaaccuagg

SEQ ID NO: 827140 - RNA, 19 nt, Human
ucugccucuggucaggcuc

SEQ ID NO: 827141 - RNA, 22 nt, Human
aauacauauggaauuccauguu

SEQ ID NO: 827142 - RNA, 22 nt, Human
acucagaagauauaaugacuca

SEQ ID NO: 827143 - RNA, 22 nt, Human
caguaaagcauguaugucuuca

SEQ ID NO: 827144 - RNA, 22 nt, Human
caggguggggaaauagcgcccu

SEQ ID NO: 827145 - RNA, 22 nt, Human
aaggcagcuucaccacagcauu

SEQ ID NO: 827146 - RNA, 22 nt, Human
gcgcaggagccgcggagggccg

SEQ ID NO: 827147 - RNA, 22 nt, Human
uggagacucugcaucugugaca

SEQ ID NO: 827148 - RNA, 22 nt, Human
gccaggagaaugcuagcagagg

SEQ ID NO: 827149 - RNA, 22 nt, Human
gggcagcucggaagugggaaag

SEQ ID NO: 827150 - RNA, 22 nt, Human
ugaggcagcccacuuuccuuag

SEQ ID NO: 827151 - RNA, 19 nt, Human
augucuggguaacagcugc

SEQ ID NO: 827152 - RNA, 22 nt, Human
guugaaagagcauggacuugaa

SEQ ID NO: 827153 - RNA, 22 nt, Human
gagagcuggguucaaguagcug

SEQ ID NO: 827154 - RNA, 22 nt, Human
uugaaauacugcauuguucagu

SEQ ID NO: 827155 - RNA, 22 nt, Human
caggcagcccugcaccaagugu

SEQ ID NO: 827156 - RNA, 22 nt, Human
uccaggagucuagccucaggcc

SEQ ID NO: 827157 - RNA, 21 nt, Human
agcagaggcugccuggugacu

SEQ ID NO: 827158 - RNA, 22 nt, Human
augaaggcuguguggagccccc

SEQ ID NO: 827159 - RNA, 22 nt, Human
uaggaggguuagagggaaauau

SEQ ID NO: 827160 - RNA, 22 nt, Human
auugaaagaguuuucugcugca

SEQ ID NO: 827161 - RNA, 22 nt, Human
aagggcaggagaagacggauau

SEQ ID NO: 827162 - RNA, 22 nt, Human
uccaggaggcaccuuuggacca

SEQ ID NO: 827163 - RNA, 22 nt, Human
auuuccagugcacugaauagaa

SEQ ID NO: 827164 - RNA, 22 nt, Human
ucaggagaaggcaauguggaaa

SEQ ID NO: 827165 - RNA, 22 nt, Human
ucacaugaguauuauuuuccaa

SEQ ID NO: 827166 - RNA, 22 nt, Human
ucauacaucuguccuggagcuc

SEQ ID NO: 827167 - RNA, 22 nt, Human
ccuugcguuuuacagcuucuag

SEQ ID NO: 827168 - RNA, 21 nt, Human
aggcagcucaggcccagagag

SEQ ID NO: 827169 - RNA, 21 nt, Human
aaucauacaaaacaugucagg

SEQ ID NO: 827170 - RNA, 22 nt, Human
uucuucuccgaggagggcuggu

SEQ ID NO: 827171 - RNA, 22 nt, Human
uuugaauguuuuagguacuuaa

SEQ ID NO: 827172 - RNA, 22 nt, Human
gcagcugcagagaccggguggg

SEQ ID NO: 827173 - RNA, 22 nt, Human
gucaggaugagggaugaggagu

SEQ ID NO: 827174 - RNA, 22 nt, Human
cccaggaaguggagguugcagu

SEQ ID NO: 827175 - RNA, 20 nt, Human
uauuuacaacuuagagccuc

SEQ ID NO: 827176 - RNA, 22 nt, Human
uuccaugagcucugaguucaca

SEQ ID NO: 827177 - RNA, 22 nt, Human
caacugugaauuuuaugauacc

SEQ ID NO: 827178 - RNA, 22 nt, Human
cagucucucagcuuucagcugu

SEQ ID NO: 827179 - RNA, 22 nt, Human
ucuacugugguccuuguaacca

SEQ ID NO: 827180 - RNA, 22 nt, Human
auucuucauacagacaaguccu

SEQ ID NO: 827181 - RNA, 22 nt, Human
uuuuagauaguuuaacugcacu

SEQ ID NO: 827182 - RNA, 19 nt, Human
caggaugaucccaugacac

SEQ ID NO: 827183 - RNA, 17 nt, Human
gucauucucagaaaaug

SEQ ID NO: 827184 - RNA, 22 nt, Human
augacaguucuacacuuaaucu

SEQ ID NO: 827185 - RNA, 22 nt, Human
cccaggagaauauuuuuggguc

SEQ ID NO: 827186 - RNA, 22 nt, Human
aaagccagagcaagcugucaca

SEQ ID NO: 827187 - RNA, 22 nt, Human
acagugacguuuauuugagacg

SEQ ID NO: 827188 - RNA, 22 nt, Human
cggagggguuugaacagaggag

SEQ ID NO: 827189 - RNA, 22 nt, Human
uccuuagagacaagaccaguuu

SEQ ID NO: 827190 - RNA, 22 nt, Human
cuggccagaguuggagggugug

SEQ ID NO: 827191 - RNA, 22 nt, Human
uaugaaacauucauacaaauaa

SEQ ID NO: 827192 - RNA, 22 nt, Human
cacauuuaauccuuuauaagua

SEQ ID NO: 827193 - RNA, 22 nt, Human
agugcuuuauguuguugugcaa

SEQ ID NO: 827194 - RNA, 22 nt, Human
gcccaggagaggccagggcuga

SEQ ID NO: 827195 - RNA, 22 nt, Human
uccaggaggccucauuuccugu

SEQ ID NO: 827196 - RNA, 22 nt, Human
caggcagcucugcuuuuccuaa

SEQ ID NO: 827197 - RNA, 22 nt, Human
ggagaggggcaaguuuaucuag

SEQ ID NO: 827198 - RNA, 20 nt, Human
cagagccaagagcagcaucu

SEQ ID NO: 827199 - RNA, 22 nt, Human
auaaauaucacuguugucccuc

SEQ ID NO: 827200 - RNA, 16 nt, Human
ccccaggacuuggcac

SEQ ID NO: 827201 - RNA, 20 nt, Human
gcccaggaauuugcauuucu

SEQ ID NO: 827202 - RNA, 22 nt, Human
cuuaacagagagaaguguugcu

SEQ ID NO: 827203 - RNA, 22 nt, Human
ucccaggaauugaagccagugu

SEQ ID NO: 827204 - RNA, 22 nt, Human
uuuauucaucaucuguucauau

SEQ ID NO: 827205 - RNA, 22 nt, Human
accaggagccacaggaggagcc

SEQ ID NO: 827206 - RNA, 22 nt, Human
uccaggagcauccaggugaagc

SEQ ID NO: 827207 - RNA, 22 nt, Human
uucucagauauuuacugagcau

SEQ ID NO: 827208 - RNA, 22 nt, Human
uccaggagguagugcuuaauuu

SEQ ID NO: 827209 - RNA, 22 nt, Human
aucaggauccaccuugagccug

SEQ ID NO: 827210 - RNA, 22 nt, Human
ugcaugcugcacacaugcguag

SEQ ID NO: 827211 - RNA, 22 nt, Human
gaggcagcagggcugguuccuu

SEQ ID NO: 827212 - RNA, 22 nt, Human
cucaggauuaaggaaucuaaau

SEQ ID NO: 827213 - RNA, 19 nt, Human
agauggcaaaaugcaaaga

SEQ ID NO: 827214 - RNA, 22 nt, Human
cauuguuauagcauuacacacc

SEQ ID NO: 827215 - RNA, 22 nt, Human
aggcagcugcccucuccuuccu

SEQ ID NO: 827216 - RNA, 22 nt, Human
ugucccucugaggcuucccugg

SEQ ID NO: 827217 - RNA, 22 nt, Human
aguuuucacacucaccaaaagg

SEQ ID NO: 827218 - RNA, 22 nt, Human
uaagauaaguggguugagaugg

SEQ ID NO: 827219 - RNA, 22 nt, Human
ugcccagggauaagccuagaga

SEQ ID NO: 827220 - RNA, 22 nt, Human
aggcaguuucugggacagcaua

SEQ ID NO: 827221 - RNA, 22 nt, Human
ugaaacauuugaugaucuuugg

SEQ ID NO: 827222 - RNA, 22 nt, Human
uccaugagggacacuggaugcu

SEQ ID NO: 827223 - RNA, 22 nt, Human
caggagaucuuaggaauucuua

SEQ ID NO: 827224 - RNA, 22 nt, Human
augcagcugugggcaagaaaug

SEQ ID NO: 827225 - RNA, 22 nt, Human
ugucugugaccucuuuggagcc

SEQ ID NO: 827226 - RNA, 22 nt, Human
ucuuuccaaggacucuguagca

SEQ ID NO: 827227 - RNA, 22 nt, Human
ucccaggauguuuauggcuggu

SEQ ID NO: 827228 - RNA, 22 nt, Human
uuuuaguguagucaccgugggu

SEQ ID NO: 827229 - RNA, 18 nt, Human
ugugaacacauuuuucug

SEQ ID NO: 827230 - RNA, 22 nt, Human
cucaggaugaaagucaugguga

SEQ ID NO: 827231 - RNA, 22 nt, Human
uaucuguuaggaucagagcugg

SEQ ID NO: 827232 - RNA, 22 nt, Human
auugcuguggaaauauaagaug

SEQ ID NO: 827233 - RNA, 22 nt, Human
cugcuucugggaugauggagua

SEQ ID NO: 827234 - RNA, 22 nt, Human
aauaauuagugggacagagaac

SEQ ID NO: 827235 - RNA, 22 nt, Human
ccuuaaauucuccauuugaaag

SEQ ID NO: 827236 - RNA, 22 nt, Human
uuucaaaauuuugcagugguaa

SEQ ID NO: 827237 - RNA, 22 nt, Human
aagagagggguugcauggaaau

SEQ ID NO: 827238 - RNA, 22 nt, Human
uuggaugaagucuagcuuuagu

SEQ ID NO: 827239 - RNA, 22 nt, Human
cccaggagaauauaauguucuu

SEQ ID NO: 827240 - RNA, 19 nt, Human
caggaaggggcgaaucugg

SEQ ID NO: 827241 - RNA, 22 nt, Human
agggcagcagcggcccaggccu

SEQ ID NO: 827242 - RNA, 22 nt, Human
aaguccaugaucaagauguggc

SEQ ID NO: 827243 - RNA, 22 nt, Human
uaaaauagcaugugcagugaaa

SEQ ID NO: 827244 - RNA, 22 nt, Human
ucuuagcacagcuauauaaguu

SEQ ID NO: 827245 - RNA, 22 nt, Human
aggucagcaugaguagaaggua

SEQ ID NO: 827246 - RNA, 22 nt, Human
uuucaaaccuacuuguauguuu

SEQ ID NO: 827247 - RNA, 22 nt, Human
uuucaucuaacacuacauaggg

SEQ ID NO: 827248 - RNA, 22 nt, Human
uaaggccagccagcaaaucugu

SEQ ID NO: 827249 - RNA, 22 nt, Human
aggcagcuagagagugaaacug

SEQ ID NO: 827250 - RNA, 22 nt, Human
ccaggagagcucuaaauggcug

SEQ ID NO: 827251 - RNA, 23 nt, Human
accaggaguugucucaggaaaca

SEQ ID NO: 827252 - RNA, 22 nt, Human
uuuuuauaugaaggauagugcg

SEQ ID NO: 827253 - RNA, 22 nt, Human
cagaggcaaaagagguggaggu

SEQ ID NO: 827254 - RNA, 18 nt, Human
agucuucugauccauuuu

SEQ ID NO: 827255 - RNA, 22 nt, Human
ucaggaugaccacgagccucua

SEQ ID NO: 827256 - RNA, 22 nt, Human
gccacaggcacuuaagggcugg

SEQ ID NO: 827257 - RNA, 22 nt, Human
agaaaugaaaccaaagccuaga

SEQ ID NO: 827258 - RNA, 22 nt, Human
uaucuuguaauagguccacuug

SEQ ID NO: 827259 - RNA, 22 nt, Human
cccaggaggaggaaaaagcucg

SEQ ID NO: 827260 - RNA, 22 nt, Human
uucacagauguauuggaacucc

SEQ ID NO: 827261 - RNA, 21 nt, Human
uugaaaguaaauucagcagcu

SEQ ID NO: 827262 - RNA, 22 nt, Human
acagucuugcuguauggucagg

SEQ ID NO: 827263 - RNA, 20 nt, Human
agaggaggauuauuuuauuc

SEQ ID NO: 827264 - RNA, 22 nt, Human
ugaggcagucacccccuccugc

SEQ ID NO: 827265 - RNA, 22 nt, Human
ucuuagaaauuccccaguggcu

SEQ ID NO: 827266 - RNA, 22 nt, Human
ugaggcaggacuugcauaaagu

SEQ ID NO: 827267 - RNA, 22 nt, Human
cagcuuucaucagugacacuca

SEQ ID NO: 827268 - RNA, 22 nt, Human
gaggcagugcauugucuagggg

SEQ ID NO: 827269 - RNA, 22 nt, Human
agaccuggauuccaauccuacc

SEQ ID NO: 827270 - RNA, 22 nt, Human
ccuccuuuccuguuuuccugag

SEQ ID NO: 827271 - RNA, 22 nt, Human
cccaggaguuagagguuguggu

SEQ ID NO: 827272 - RNA, 19 nt, Human
gugcuuuuuaagagcucag

SEQ ID NO: 827273 - RNA, 22 nt, Human
ucuuagcauuucauaacaacug

SEQ ID NO: 827274 - RNA, 17 nt, Human
ccaggagagaugcuugu

SEQ ID NO: 827275 - RNA, 22 nt, Human
gaaggccauugcguccugggau

SEQ ID NO: 827276 - RNA, 22 nt, Human
uuucauugcagagucugugugc

SEQ ID NO: 827277 - RNA, 22 nt, Human
gugcauuugacgaauacucacu

SEQ ID NO: 827278 - RNA, 22 nt, Human
auuaaaauuccaagguaugcca

SEQ ID NO: 827279 - RNA, 21 nt, Human
ugaaugaggaggauggcauuu

SEQ ID NO: 827280 - RNA, 23 nt, Human
cccaggaguuucacugcaaaggu

SEQ ID NO: 827281 - RNA, 22 nt, Human
auguucuuucagccagugcauc

SEQ ID NO: 827282 - RNA, 22 nt, Human
gagggcauaguuaaauaggagg

SEQ ID NO: 827283 - RNA, 22 nt, Human
cuugaaagucagcagaguggau

SEQ ID NO: 827284 - RNA, 22 nt, Human
cugcuuugcauagcugccagag

SEQ ID NO: 827285 - RNA, 22 nt, Human
ggagggacccacucuagaggug

SEQ ID NO: 827286 - RNA, 22 nt, Human
gaaauauuacaguggaggggau

SEQ ID NO: 827287 - RNA, 22 nt, Human
ugaugaaacugagguuccaaga

SEQ ID NO: 827288 - RNA, 22 nt, Human
cagagcucuauguucauggagg

SEQ ID NO: 827289 - RNA, 22 nt, Human
ggcagcuuguccuggaggaugg

SEQ ID NO: 827290 - RNA, 22 nt, Human
ggcagcuaggggcagggaauuc

SEQ ID NO: 827291 - RNA, 22 nt, Human
uggaagggagugacagucagag

SEQ ID NO: 827292 - RNA, 22 nt, Human
ugaaagggguugaguuacagcu

SEQ ID NO: 827293 - RNA, 21 nt, Human
cccaggaggcugagaagagca

SEQ ID NO: 827294 - RNA, 22 nt, Human
uccagccuaggggaacagcugc

SEQ ID NO: 827295 - RNA, 22 nt, Human
agcuagccuaggcagagugcau

SEQ ID NO: 827296 - RNA, 22 nt, Human
agggugguucuuuuaguggaag

SEQ ID NO: 827297 - RNA, 22 nt, Human
cuagggaguggcagagcuggga

SEQ ID NO: 827298 - RNA, 22 nt, Human
ugucucugaggugagggucagc

SEQ ID NO: 827299 - RNA, 22 nt, Human
uugcauuugacaaauuauuuaa

SEQ ID NO: 827300 - RNA, 22 nt, Human
auugcuguacacuucuagaucu

SEQ ID NO: 827301 - RNA, 22 nt, Human
auugaaagcauggauuuggauu

SEQ ID NO: 827302 - RNA, 22 nt, Human
ggcaggcaaugaggaugggaag

SEQ ID NO: 827303 - RNA, 22 nt, Human
agcccaggcagagggaugcuug

SEQ ID NO: 827304 - RNA, 19 nt, Human
uggagggguuugaaugugg

SEQ ID NO: 827305 - RNA, 22 nt, Human
uucauugugauucuuggcuagc

SEQ ID NO: 827306 - RNA, 22 nt, Human
auuacaguaacagcuacaaugc

SEQ ID NO: 827307 - RNA, 22 nt, Human
ccccaggaagccucagauuugc

SEQ ID NO: 827308 - RNA, 22 nt, Human
cugcuguguuccuccugcaucu

SEQ ID NO: 827309 - RNA, 22 nt, Human
gcccaggagccuggagaugugu

SEQ ID NO: 827310 - RNA, 22 nt, Human
gaggcagagaccuucaggaccu

SEQ ID NO: 827311 - RNA, 23 nt, Human
uucuuucaagaaguucacagugc

SEQ ID NO: 827312 - RNA, 22 nt, Human
cauugcuuccuaugucccuucu

SEQ ID NO: 827313 - RNA, 22 nt, Human
ggcagcugcaaaucugcucugu

SEQ ID NO: 827314 - RNA, 21 nt, Human
gacaggacuagaccagagcuc

SEQ ID NO: 827315 - RNA, 22 nt, Human
ugaggcagcauucuucaagaca

SEQ ID NO: 827316 - RNA, 22 nt, Human
aauuuuaaucaguggugcugag

SEQ ID NO: 827317 - RNA, 22 nt, Human
cagcuucugucugauuagcaag

SEQ ID NO: 827318 - RNA, 22 nt, Human
gcggagggcgagcccgcggagc

SEQ ID NO: 827319 - RNA, 22 nt, Human
ccugcucagagcgucuugugug

SEQ ID NO: 827320 - RNA, 22 nt, Human
augugaggaagaaagagguaag

SEQ ID NO: 827321 - RNA, 22 nt, Human
uuauuauagauuaugcaagauu

SEQ ID NO: 827322 - RNA, 22 nt, Human
agacagguaaauagagaugcug

SEQ ID NO: 827323 - RNA, 22 nt, Human
aaaggaagaugccaggacucug

SEQ ID NO: 827324 - RNA, 22 nt, Human
aggcagauuuaggagaaaagaa

SEQ ID NO: 827325 - RNA, 22 nt, Human
uuucccagagguaugaauaagu

SEQ ID NO: 827326 - RNA, 22 nt, Human
acaaaugugucuaauugugccu

SEQ ID NO: 827327 - RNA, 22 nt, Human
uucauugugaacacauucugcc

SEQ ID NO: 827328 - RNA, 20 nt, Human
ugcguguguauuuauuuucu

SEQ ID NO: 827329 - RNA, 22 nt, Human
uugaaaguccuucuugaguuac

SEQ ID NO: 827330 - RNA, 22 nt, Human
cagaggaguucaguacacagcc

SEQ ID NO: 827331 - RNA, 22 nt, Human
ccaggagagcagaagcccaggc

SEQ ID NO: 827332 - RNA, 22 nt, Human
acagaauugaaaguauaaucug

SEQ ID NO: 827333 - RNA, 22 nt, Human
gagggaggggagcuccacccuc

SEQ ID NO: 827334 - RNA, 22 nt, Human
ucagucucuggggcuucuguuu

SEQ ID NO: 827335 - RNA, 22 nt, Human
agucacuguucugucaugucaa

SEQ ID NO: 827336 - RNA, 22 nt, Human
gucacuguauccagguuccagc

SEQ ID NO: 827337 - RNA, 22 nt, Human
cagaauggcuuuuauggcucag

SEQ ID NO: 827338 - RNA, 22 nt, Human
uacacacagaggccaugggauu

SEQ ID NO: 827339 - RNA, 22 nt, Human
cuucugcaauaaguuuuggucc

SEQ ID NO: 827340 - RNA, 22 nt, Human
ucuuugcaaauguuauuaucuu

SEQ ID NO: 827341 - RNA, 22 nt, Human
uugagaagaggcuuuguaggaa

SEQ ID NO: 827342 - RNA, 22 nt, Human
ugcauauuguccuugauauuau

SEQ ID NO: 827343 - RNA, 22 nt, Human
aauuuguuaaaagugagugaca

SEQ ID NO: 827344 - RNA, 22 nt, Human
ucugggaacacacgucacuuca

SEQ ID NO: 827345 - RNA, 22 nt, Human
uuugaaagaaaccagugaguga

SEQ ID NO: 827346 - RNA, 22 nt, Human
ucucaggaagugauauugagac

SEQ ID NO: 827347 - RNA, 22 nt, Human
cugcaucacagcaggaggcaca

SEQ ID NO: 827348 - RNA, 22 nt, Human
ccccaggacguggcccucauag

SEQ ID NO: 827349 - RNA, 22 nt, Human
ugugauauuugaguauugucaa

SEQ ID NO: 827350 - RNA, 22 nt, Human
uucuuaacucaaauauauaucc

SEQ ID NO: 827351 - RNA, 22 nt, Human
uuucauuuugguuaugccauaa

SEQ ID NO: 827352 - RNA, 22 nt, Human
gagguagcaugcuggaagggac

SEQ ID NO: 827353 - RNA, 22 nt, Human
agugcagccgagaucaggugcu

SEQ ID NO: 827354 - RNA, 22 nt, Human
gucuuuaugguaugaaaacuga

SEQ ID NO: 827355 - RNA, 22 nt, Human
uugaaggacauccuauuucuag

SEQ ID NO: 827356 - RNA, 22 nt, Human
aggcagcuggcaaauucuagag

SEQ ID NO: 827357 - RNA, 22 nt, Human
gccaucacauccaggcuaccuc

SEQ ID NO: 827358 - RNA, 22 nt, Human
gagacagugguugcagaagcuc

SEQ ID NO: 827359 - RNA, 22 nt, Human
uucagaauauuuguuuuacaug

SEQ ID NO: 827360 - RNA, 22 nt, Human
uuucuaggcacagugucuuccc

SEQ ID NO: 827361 - RNA, 22 nt, Human
ucuucaaguuccaaagugcagg

SEQ ID NO: 827362 - RNA, 15 nt, Human
uggcagcuuguuaag

SEQ ID NO: 827363 - RNA, 22 nt, Human
cccaggaagagugaguggcauu

SEQ ID NO: 827364 - RNA, 22 nt, Human
uucucagguagugcugaugcug

SEQ ID NO: 827365 - RNA, 20 nt, Human
aggaagcugagauguagagg

SEQ ID NO: 827366 - RNA, 22 nt, Human
gagcagcuccagccgcaugacu

SEQ ID NO: 827367 - RNA, 22 nt, Human
cuuuccaagaaugcagauaccu

SEQ ID NO: 827368 - RNA, 22 nt, Human
ugaggcagugcugggaagccug

SEQ ID NO: 827369 - RNA, 22 nt, Human
aagauuauuuaagacaggaacc

SEQ ID NO: 827370 - RNA, 23 nt, Human
ucuccuccuagauacagucaugg

SEQ ID NO: 827371 - RNA, 22 nt, Human
gcucaggacuggaggagcgggg

SEQ ID NO: 827372 - RNA, 21 nt, Human
uacugagaccucacagugugc

SEQ ID NO: 827373 - RNA, 19 nt, Human
aggcagcaggccagggaug

SEQ ID NO: 827374 - RNA, 22 nt, Human
agucucagaaaagaagcaugga

SEQ ID NO: 827375 - RNA, 22 nt, Human
agggaagcuuguuacugagaag

SEQ ID NO: 827376 - RNA, 22 nt, Human
ggaggggaugguuugacccugg

SEQ ID NO: 827377 - RNA, 22 nt, Human
auguuuccgugagcauccuuga

SEQ ID NO: 827378 - RNA, 22 nt, Human
uuaacaauagaguuucuucagg

SEQ ID NO: 827379 - RNA, 19 nt, Human
cccaggagcaguauugaug

SEQ ID NO: 827380 - RNA, 20 nt, Human
gcucccagccugcagucccc

SEQ ID NO: 827381 - RNA, 22 nt, Human
ccaggagacuguacugauauuu

SEQ ID NO: 827382 - RNA, 22 nt, Human
gcaaagcauucuguggagucua

SEQ ID NO: 827383 - RNA, 22 nt, Human
guugaaaguggagaaccugguu

SEQ ID NO: 827384 - RNA, 22 nt, Human
aaauugcauuuuaaagguagau

SEQ ID NO: 827385 - RNA, 22 nt, Human
ucagagagccucaggcacugcc

SEQ ID NO: 827386 - RNA, 22 nt, Human
aggcagccaucugcaggaagga

SEQ ID NO: 827387 - RNA, 22 nt, Human
ugguaaauauguccauucucuu

SEQ ID NO: 827388 - RNA, 22 nt, Human
uccauuuuagagaugaagaaac

SEQ ID NO: 827389 - RNA, 22 nt, Human
agucaauucuuuucaacucaag

SEQ ID NO: 827390 - RNA, 22 nt, Human
aggccagcagcaugacggcauc

SEQ ID NO: 827391 - RNA, 22 nt, Human
uccaggagagguagaggguucc

SEQ ID NO: 827392 - RNA, 23 nt, Human
gggcaguuauguuguccuuggcu

SEQ ID NO: 827393 - RNA, 22 nt, Human
aaggcagccuuuguuugauuga

SEQ ID NO: 827394 - RNA, 22 nt, Human
guugaaugaaucauucuaugua

SEQ ID NO: 827395 - RNA, 22 nt, Human
cagguaaaaauaaauuugugag

SEQ ID NO: 827396 - RNA, 22 nt, Human
ugacccauggucugaucauagg

SEQ ID NO: 827397 - RNA, 22 nt, Human
agucauaugacccuucacaaac

SEQ ID NO: 827398 - RNA, 22 nt, Human
ucucucagaggaagaggcagug

SEQ ID NO: 827399 - RNA, 22 nt, Human
uauguuauuuucauacaacaga

SEQ ID NO: 827400 - RNA, 22 nt, Human
aaggagagagcuuugcuggaac

SEQ ID NO: 827401 - RNA, 22 nt, Human
cagacaggcaggugcugcuuug

SEQ ID NO: 827402 - RNA, 22 nt, Human
aaauuuucagagcacuagagaa

SEQ ID NO: 827403 - RNA, 22 nt, Human
uuucucugcugccugugucgau

SEQ ID NO: 827404 - RNA, 20 nt, Human
ucagaugggagugagccauc

SEQ ID NO: 827405 - RNA, 23 nt, Human
agcacacuuguacaaugcccuag

SEQ ID NO: 827406 - RNA, 22 nt, Human
cccuuagcuccaagggguuugg

SEQ ID NO: 827407 - RNA, 22 nt, Human
uccaggaggacugagggggcug

SEQ ID NO: 827408 - RNA, 22 nt, Human
uagugcuugagucucuccguac

SEQ ID NO: 827409 - RNA, 22 nt, Human
cugcuguguuggcauuggauag

SEQ ID NO: 827410 - RNA, 22 nt, Human
caggagaaauguggcugcuacc

SEQ ID NO: 827411 - RNA, 22 nt, Human
caaauguaaauucuuuugaagc

SEQ ID NO: 827412 - RNA, 22 nt, Human
agaggggaggcgaaccagaguc

SEQ ID NO: 827413 - RNA, 22 nt, Human
uuugaaagcuacuuucggguca

SEQ ID NO: 827414 - RNA, 22 nt, Human
aggaugaauaacugaaauggug

SEQ ID NO: 827415 - RNA, 21 nt, Human
uucuccccagcgaauccucgg

SEQ ID NO: 827416 - RNA, 22 nt, Human
agagggauggccccguaacuca

SEQ ID NO: 827417 - RNA, 22 nt, Human
agguccagcuguugcagccucc

SEQ ID NO: 827418 - RNA, 20 nt, Human
ucacaucuggcagcugauga

SEQ ID NO: 827419 - RNA, 22 nt, Human
ucuuugaauccuuuacaucuga

SEQ ID NO: 827420 - RNA, 22 nt, Human
ucaggagacaaagggugcggag

SEQ ID NO: 827421 - RNA, 22 nt, Human
ucccaggagcaccuuuugagcc

SEQ ID NO: 827422 - RNA, 22 nt, Human
aggcagguuggugagaagacug

SEQ ID NO: 827423 - RNA, 22 nt, Human
gaggggaaaguucugcacaagg

SEQ ID NO: 827424 - RNA, 18 nt, Human
gcagcuagccaggggggc

SEQ ID NO: 827425 - RNA, 22 nt, Human
ccaggagaugggaaaguagcag

SEQ ID NO: 827426 - RNA, 22 nt, Human
aagcaccucuaugauugcuuuu

SEQ ID NO: 827427 - RNA, 22 nt, Human
cagauccacccuuguagugaca

SEQ ID NO: 827428 - RNA, 22 nt, Human
aggaggcacucacucucagggu

SEQ ID NO: 827429 - RNA, 22 nt, Human
uucauucuuugaaucugaggua

SEQ ID NO: 827430 - RNA, 22 nt, Human
ggagauggaauagauucugacu

SEQ ID NO: 827431 - RNA, 22 nt, Human
cagcaggauuugaaaggaagag

SEQ ID NO: 827432 - RNA, 22 nt, Human
ucaggaauccagacagggcaca

SEQ ID NO: 827433 - RNA, 22 nt, Human
cugcugugcagacagacucucu

SEQ ID NO: 827434 - RNA, 22 nt, Human
aggguaggaacugaguggaagg

SEQ ID NO: 827435 - RNA, 22 nt, Human
cccaaggaagacgcuugugaua

SEQ ID NO: 827436 - RNA, 22 nt, Human
aaagcagacugauuugcaucac

SEQ ID NO: 827437 - RNA, 21 nt, Human
aaauacagaaacuuguuuuca

SEQ ID NO: 827438 - RNA, 22 nt, Human
aagggaggggauguaagccugg

SEQ ID NO: 827439 - RNA, 22 nt, Human
ugaggcaggagaauggcgggaa

SEQ ID NO: 827440 - RNA, 22 nt, Human
aguggacucuucccagugcuug

SEQ ID NO: 827441 - RNA, 22 nt, Human
cccaggagacugagcuguaacc

SEQ ID NO: 827442 - RNA, 22 nt, Human
uucucagagcucacuguaguaa

SEQ ID NO: 827443 - RNA, 22 nt, Human
acauuuuuuagagucccacauu

SEQ ID NO: 827444 - RNA, 22 nt, Human
uaaauuguuuucuagaaguugu

SEQ ID NO: 827445 - RNA, 22 nt, Human
aaggcagccauagcaccaucca

SEQ ID NO: 827446 - RNA, 22 nt, Human
uuguugguggaauugaugcuag

SEQ ID NO: 827447 - RNA, 22 nt, Human
ucagagagugcaaaauauagcu

SEQ ID NO: 827448 - RNA, 22 nt, Human
gaggcagcuuggggcugugggu

SEQ ID NO: 827449 - RNA, 22 nt, Human
agaggccagguccagaguuugu

SEQ ID NO: 827450 - RNA, 22 nt, Human
uggcagcagccauggaaggccc

SEQ ID NO: 827451 - RNA, 22 nt, Human
gcugguuuccuuaucuauaaag

SEQ ID NO: 827452 - RNA, 22 nt, Human
agcuggcagucauccuagugag

SEQ ID NO: 827453 - RNA, 23 nt, Human
ucccaggaaucugcauuuuuaac

SEQ ID NO: 827454 - RNA, 19 nt, Human
agacagagcucaguggguu

SEQ ID NO: 827455 - RNA, 22 nt, Human
gaggagcuugugagaagauguc

SEQ ID NO: 827456 - RNA, 22 nt, Human
ucugguaaccuuuaucccuccu

SEQ ID NO: 827457 - RNA, 22 nt, Human
ugugccagccucuggcuguguc

SEQ ID NO: 827458 - RNA, 23 nt, Human
uggagcugacagucagagggagg

SEQ ID NO: 827459 - RNA, 22 nt, Human
cauuguuaauugguaucuuaca

SEQ ID NO: 827460 - RNA, 23 nt, Human
cuuuuaacuagaguaucagcugc

SEQ ID NO: 827461 - RNA, 22 nt, Human
uuccaugaaagugaaauggagc

SEQ ID NO: 827462 - RNA, 22 nt, Human
uacauaguauucacauuguuuu

SEQ ID NO: 827463 - RNA, 21 nt, Human
uacagaaugcgcuucagucug

SEQ ID NO: 827464 - RNA, 22 nt, Human
cacauauuguaguucaccagga

SEQ ID NO: 827465 - RNA, 22 nt, Human
ucuacccagagcuaugaccuga

SEQ ID NO: 827466 - RNA, 22 nt, Human
uagaaaugaauguuuaaaaguc

SEQ ID NO: 827467 - RNA, 19 nt, Human
uucauucucuuauuguugu

SEQ ID NO: 827468 - RNA, 22 nt, Human
aagauaaacucuugauuucuga

SEQ ID NO: 827469 - RNA, 22 nt, Human
ucuucucucauguaggagggaa

SEQ ID NO: 827470 - RNA, 22 nt, Human
gcccaggaaguugaggcugccg

SEQ ID NO: 827471 - RNA, 22 nt, Human
cugacagucucauugauuugcu

SEQ ID NO: 827472 - RNA, 20 nt, Human
cgugcugugaccuugagcau

SEQ ID NO: 827473 - RNA, 20 nt, Human
ucauuucuugggguuccaag

SEQ ID NO: 827474 - RNA, 22 nt, Human
accaggagaggcacuugcaaug

SEQ ID NO: 827475 - RNA, 20 nt, Human
caucaucacaugagccaauu

SEQ ID NO: 827476 - RNA, 22 nt, Human
cugcgcagcaaucagagaggag

SEQ ID NO: 827477 - RNA, 19 nt, Human
ugaggggcucacagucuca

SEQ ID NO: 827478 - RNA, 22 nt, Human
ugcuguggcaguuuauguauag

SEQ ID NO: 827479 - RNA, 22 nt, Human
uggcagcugucagaaugcaaau

SEQ ID NO: 827480 - RNA, 22 nt, Human
ugaaaugagagcacagaauaaa

SEQ ID NO: 827481 - RNA, 22 nt, Human
cugcuguguuucacaccucugg

SEQ ID NO: 827482 - RNA, 22 nt, Human
aucauucuagcuguuguguuga

SEQ ID NO: 827483 - RNA, 22 nt, Human
acagauguacacucauauauaa

SEQ ID NO: 827484 - RNA, 22 nt, Human
ugaaggcccuaucuccauauac

SEQ ID NO: 827485 - RNA, 22 nt, Human
uuugaauaucacaaacuuucaa

SEQ ID NO: 827486 - RNA, 22 nt, Human
ccaggagauuuuuccauagcac

SEQ ID NO: 827487 - RNA, 22 nt, Human
uucucagauccaucagaagucc

SEQ ID NO: 827488 - RNA, 22 nt, Human
cucucagacugaagggccugug

SEQ ID NO: 827489 - RNA, 22 nt, Human
gucagagagggcacgugcacac

SEQ ID NO: 827490 - RNA, 22 nt, Human
aagagaggacauggugaaccug

SEQ ID NO: 827491 - RNA, 23 nt, Human
acagaaaucauuuguaagguacc

SEQ ID NO: 827492 - RNA, 22 nt, Human
cauguuuacuaccaggagaaug

SEQ ID NO: 827493 - RNA, 22 nt, Human
ucaggagauggucuuuauaggc

SEQ ID NO: 827494 - RNA, 22 nt, Human
aguccuuugggaaaaaugacua

SEQ ID NO: 827495 - RNA, 22 nt, Human
aggcagcagugauaagauagga

SEQ ID NO: 827496 - RNA, 22 nt, Human
uccaggaggguuuucugccuuc

SEQ ID NO: 827497 - RNA, 22 nt, Human
gauggcaggugauagccgaguc

SEQ ID NO: 827498 - RNA, 22 nt, Human
aaguguagauuauggagugucu

SEQ ID NO: 827499 - RNA, 18 nt, Human
aauuuccauaugaauugc

SEQ ID NO: 827500 - RNA, 22 nt, Human
cacagcauaaugaaauauacuu

SEQ ID NO: 827501 - RNA, 22 nt, Human
aggcaggccccugagaauagac

SEQ ID NO: 827502 - RNA, 22 nt, Human
cuuugaauugccguuucaucug

SEQ ID NO: 827503 - RNA, 22 nt, Human
uacuuuuuagcacagugugugc

SEQ ID NO: 827504 - RNA, 22 nt, Human
guuauauauaguauuucucuga

SEQ ID NO: 827505 - RNA, 15 nt, Human
cuccaugauuuugca

SEQ ID NO: 827506 - RNA, 22 nt, Human
uucuuauagaagcaaccauugu

SEQ ID NO: 827507 - RNA, 22 nt, Human
aggcaagcauugggaacagggc

SEQ ID NO: 827508 - RNA, 22 nt, Human
cuucccagaccuuagagugcag

SEQ ID NO: 827509 - RNA, 22 nt, Human
ucagugaucuaaggguauggcc

SEQ ID NO: 827510 - RNA, 18 nt, Human
gaaaggagagacaguagg

SEQ ID NO: 827511 - RNA, 22 nt, Human
ggaagaggcugagccagguccc

SEQ ID NO: 827512 - RNA, 22 nt, Human
aggcagcuggaaaacuccaggc

SEQ ID NO: 827513 - RNA, 22 nt, Human
uaauacagaaguguauuaaaau

SEQ ID NO: 827514 - RNA, 22 nt, Human
cuguguuugaugagaagccacc

SEQ ID NO: 827515 - RNA, 22 nt, Human
aaccauuugcaguuacugagac

SEQ ID NO: 827516 - RNA, 22 nt, Human
agugcuuuccuucuugugacau

SEQ ID NO: 827517 - RNA, 22 nt, Human
uaggagggcccugaaaauggca

SEQ ID NO: 827518 - RNA, 23 nt, Human
auguauuuaaauuucagugauga

SEQ ID NO: 827519 - RNA, 22 nt, Human
ugauuuuuagcuauucugaaga

SEQ ID NO: 827520 - RNA, 23 nt, Human
aggcgagcucuucuccagcacgu

SEQ ID NO: 827521 - RNA, 22 nt, Human
gaccaaggaagaggggagccag

SEQ ID NO: 827522 - RNA, 22 nt, Human
ugaacuccaaauacugcugauu

SEQ ID NO: 827523 - RNA, 22 nt, Human
agggagcugagcugugagcagc

SEQ ID NO: 827524 - RNA, 22 nt, Human
cugcuguggguuaagacacugu

SEQ ID NO: 827525 - RNA, 20 nt, Human
cucuccucacccgugucagg

SEQ ID NO: 827526 - RNA, 22 nt, Human
ccuugcauauauuauaucuuug

SEQ ID NO: 827527 - RNA, 20 nt, Human
uuuacauuuugaaacaguga

SEQ ID NO: 827528 - RNA, 23 nt, Human
uccaggagaauuccagggcccgg

SEQ ID NO: 827529 - RNA, 22 nt, Human
augcagcuucaggauuaugaug

SEQ ID NO: 827530 - RNA, 22 nt, Human
acauacauauguuuaaaugcau

SEQ ID NO: 827531 - RNA, 19 nt, Human
agcuuccauauucucuagu

SEQ ID NO: 827532 - RNA, 22 nt, Human
ggauggcaggacaaggacccag

SEQ ID NO: 827533 - RNA, 22 nt, Human
cauuuccagcuccugcaucaug

SEQ ID NO: 827534 - RNA, 22 nt, Human
uuggcaguaaaagaaaaugcuu

SEQ ID NO: 827535 - RNA, 22 nt, Human
gccaggaggggagaguguguca

SEQ ID NO: 827536 - RNA, 22 nt, Human
caaggccacugcucagguuucc

SEQ ID NO: 827537 - RNA, 22 nt, Human
guucuucacauuucauugagga

SEQ ID NO: 827538 - RNA, 22 nt, Human
ucacaaauauuuuaacaguagg

SEQ ID NO: 827539 - RNA, 22 nt, Human
ugaaaugaucaguuugguuacu

SEQ ID NO: 827540 - RNA, 22 nt, Human
ggaggggaggauuaaugacaaa

SEQ ID NO: 827541 - RNA, 22 nt, Human
aaaaacugcaauuacuuuuguc

SEQ ID NO: 827542 - RNA, 17 nt, Human
aggcaggcagagcggga

SEQ ID NO: 827543 - RNA, 22 nt, Human
cagcugcuuuaguuuuccaucc

SEQ ID NO: 827544 - RNA, 22 nt, Human
uuucuagucucgaucucuuaau

SEQ ID NO: 827545 - RNA, 22 nt, Human
agaagucauuuauguuagauga

SEQ ID NO: 827546 - RNA, 22 nt, Human
gaggcagcaggcugaggaggau

SEQ ID NO: 827547 - RNA, 22 nt, Human
gucaggaugacaagugcuuuca

SEQ ID NO: 827548 - RNA, 22 nt, Human
gucuucaauagagccucaauuu

SEQ ID NO: 827549 - RNA, 22 nt, Human
agcaccaugaccuugccauuga

SEQ ID NO: 827550 - RNA, 22 nt, Human
guaucacuuuugagagugagaa

SEQ ID NO: 827551 - RNA, 22 nt, Human
gccaggagcccugggcaaguuc

SEQ ID NO: 827552 - RNA, 22 nt, Human
aaauuauucucauguguuucuu

SEQ ID NO: 827553 - RNA, 22 nt, Human
auucuucaucagagaugcacua

SEQ ID NO: 827554 - RNA, 22 nt, Human
ucucaggaaauaggauuugagu

SEQ ID NO: 827555 - RNA, 22 nt, Human
ucucccaggcugcccuguggac

SEQ ID NO: 827556 - RNA, 22 nt, Human
ugaggcagcaauuguauuguau

SEQ ID NO: 827557 - RNA, 22 nt, Human
aggcugcugaggccaccacgcu

SEQ ID NO: 827558 - RNA, 22 nt, Human
gccucugcccuccugggacugc

SEQ ID NO: 827559 - RNA, 22 nt, Human
agugcuguuagguuaauauagu

SEQ ID NO: 827560 - RNA, 22 nt, Human
ucacaucucccuggaggacaca

SEQ ID NO: 827561 - RNA, 22 nt, Human
auugugcaaauauuaucuguag

SEQ ID NO: 827562 - RNA, 22 nt, Human
auguuucaaugcacuuuagccu

SEQ ID NO: 827563 - RNA, 22 nt, Human
ggaggugguggcagugacaauu

SEQ ID NO: 827564 - RNA, 22 nt, Human
cacucuccagcacaccccauuu

SEQ ID NO: 827565 - RNA, 22 nt, Human
uuuauuguuaucaugggugagu

SEQ ID NO: 827566 - RNA, 22 nt, Human
acaagcaugggcuuugacauca

SEQ ID NO: 827567 - RNA, 19 nt, Human
uggcaggcccaggauggac

SEQ ID NO: 827568 - RNA, 22 nt, Human
uuugaaguguuauuucuaucac

SEQ ID NO: 827569 - RNA, 22 nt, Human
gcccaggaguugaaugcagcag

SEQ ID NO: 827570 - RNA, 22 nt, Human
ucuucagacuccaaauguuuua

SEQ ID NO: 827571 - RNA, 22 nt, Human
gaggagaggccaucguuguuau

SEQ ID NO: 827572 - RNA, 22 nt, Human
cugaacuuauugagugcuugcu

SEQ ID NO: 827573 - RNA, 22 nt, Human
auuaaauuagcaaacugugaaa

SEQ ID NO: 827574 - RNA, 22 nt, Human
gaacuguaguuaauacuacaca

SEQ ID NO: 827575 - RNA, 22 nt, Human
uuuccagguauuaauacuguau

SEQ ID NO: 827576 - RNA, 20 nt, Human
ucucagcauaagaacccuuc

SEQ ID NO: 827577 - RNA, 22 nt, Human
ucuaaagaagaggguucugcgg

SEQ ID NO: 827578 - RNA, 22 nt, Human
uucuugcaggucacucacugag

SEQ ID NO: 827579 - RNA, 22 nt, Human
uguuugaacugaauaacauagu

SEQ ID NO: 827580 - RNA, 20 nt, Human
uuucugugcccaggucuguu

SEQ ID NO: 827581 - RNA, 21 nt, Human
ggauggauagggaagagauuu

SEQ ID NO: 827582 - RNA, 22 nt, Human
gcaggcaguuauuuaguagaau

SEQ ID NO: 827583 - RNA, 22 nt, Human
cagaaggcuuuguggaguagac

SEQ ID NO: 827584 - RNA, 22 nt, Human
cccaggaauuggaggcugcagu

SEQ ID NO: 827585 - RNA, 22 nt, Human
aggcaggcucaaugcccagucu

SEQ ID NO: 827586 - RNA, 22 nt, Human
augcugugcuggcuaaccaugg

SEQ ID NO: 827587 - RNA, 22 nt, Human
gggugggacugaagucugaggg

SEQ ID NO: 827588 - RNA, 22 nt, Human
uuucaucuucccagagaccuug

SEQ ID NO: 827589 - RNA, 22 nt, Human
guaggcagauaggagugcagcc

SEQ ID NO: 827590 - RNA, 22 nt, Human
uugaaaggguuaaagugguaaa

SEQ ID NO: 827591 - RNA, 22 nt, Human
caguuuuugccauuaagaguaa

SEQ ID NO: 827592 - RNA, 22 nt, Human
guuguuuugcaggauccuuaca

SEQ ID NO: 827593 - RNA, 18 nt, Human
guaggucaguaccaagca

SEQ ID NO: 827594 - RNA, 22 nt, Human
caggacagagcccagacugugu

SEQ ID NO: 827595 - RNA, 22 nt, Human
uguagggaggaaggguuggaaa

SEQ ID NO: 827596 - RNA, 22 nt, Human
caaggccaagucucugugaaga

SEQ ID NO: 827597 - RNA, 22 nt, Human
ucaggauguccaaaauccagcc

SEQ ID NO: 827598 - RNA, 21 nt, Human
agggagcuggccacacagccu

SEQ ID NO: 827599 - RNA, 20 nt, Human
ugcugucguguuuucugcuu

SEQ ID NO: 827600 - RNA, 22 nt, Human
aaagccaugaauguuauagagg

SEQ ID NO: 827601 - RNA, 21 nt, Human
gcugcaucaaucuacccaggg

SEQ ID NO: 827602 - RNA, 22 nt, Human
gacggcagaaacucaugagguc

SEQ ID NO: 827603 - RNA, 23 nt, Human
uuucaacuccugccauuauuucu

SEQ ID NO: 827604 - RNA, 22 nt, Human
ucccaggaaugucugaaaguga

SEQ ID NO: 827605 - RNA, 22 nt, Human
augcuguguauuuuacucuuuc

SEQ ID NO: 827606 - RNA, 19 nt, Human
aaggcagcaguagcaucca

SEQ ID NO: 827607 - RNA, 22 nt, Human
acauuuaaccaaacuguuuaau

SEQ ID NO: 827608 - RNA, 22 nt, Human
uuucaguuacugcuauaucauu

SEQ ID NO: 827609 - RNA, 22 nt, Human
auucuuauuauaguaaaacagu

SEQ ID NO: 827610 - RNA, 22 nt, Human
uucucugaaggccaugcucacu

SEQ ID NO: 827611 - RNA, 22 nt, Human
cuguuaaucugcuugcaugaug

SEQ ID NO: 827612 - RNA, 20 nt, Human
gcccaagguccagaaggggg

SEQ ID NO: 827613 - RNA, 22 nt, Human
gcagaggagcaaguugcuacag

SEQ ID NO: 827614 - RNA, 22 nt, Human
auacagauguugaauguuauau

SEQ ID NO: 827615 - RNA, 22 nt, Human
aaggaaccuggaguagagggag

SEQ ID NO: 827616 - RNA, 22 nt, Human
ggagcacuauaauagagauuuu

SEQ ID NO: 827617 - RNA, 22 nt, Human
ucauuucaaguucugacagcua

SEQ ID NO: 827618 - RNA, 22 nt, Human
auccaugauuaguaggauaaag

SEQ ID NO: 827619 - RNA, 22 nt, Human
ugcugaaaacucaaccauugug

SEQ ID NO: 827620 - RNA, 22 nt, Human
gugguuuucuccaacccagaac

SEQ ID NO: 827621 - RNA, 22 nt, Human
uggcagcugccauguccacgug

SEQ ID NO: 827622 - RNA, 22 nt, Human
caaaugauagagccgauuauca

SEQ ID NO: 827623 - RNA, 22 nt, Human
caggaggggguggaguuucgcc

SEQ ID NO: 827624 - RNA, 22 nt, Human
gggcagcugcagggauggugac

SEQ ID NO: 827625 - RNA, 22 nt, Human
gcagcuaccacccaggaaggac

SEQ ID NO: 827626 - RNA, 22 nt, Human
aguucucaagacaauuaccugu

SEQ ID NO: 827627 - RNA, 22 nt, Human
aucacugucgucaucugagauu

SEQ ID NO: 827628 - RNA, 22 nt, Human
cauuuguauagugcuuagacca

SEQ ID NO: 827629 - RNA, 22 nt, Human
ugcauaguucuccuuccuccuc

SEQ ID NO: 827630 - RNA, 22 nt, Human
aggcagcccugugcuggaugcu

SEQ ID NO: 827631 - RNA, 22 nt, Human
agagguagagguugcagugagc

SEQ ID NO: 827632 - RNA, 22 nt, Human
cagaggcaggaagaugggcagu

SEQ ID NO: 827633 - RNA, 17 nt, Human
aagacagaagccaugag

SEQ ID NO: 827634 - RNA, 22 nt, Human
aaugcauauguaggcaagcagu

SEQ ID NO: 827635 - RNA, 22 nt, Human
ucagggugaaccaggcaggaau

SEQ ID NO: 827636 - RNA, 20 nt, Human
caggaugauuggacacgaug

SEQ ID NO: 827637 - RNA, 22 nt, Human
caugcugugugguuagaacugu

SEQ ID NO: 827638 - RNA, 22 nt, Human
ugccuggaaggcccaugggaag

SEQ ID NO: 827639 - RNA, 22 nt, Human
agaguucugcucuucucaguga

SEQ ID NO: 827640 - RNA, 22 nt, Human
agggagugguuaagaaggugca

SEQ ID NO: 827641 - RNA, 21 nt, Human
cccagggaagccgcagucacc

SEQ ID NO: 827642 - RNA, 22 nt, Human
aauauuuguuaguguuuuaaug

SEQ ID NO: 827643 - RNA, 22 nt, Human
uucuaugccauguucagcuacu

SEQ ID NO: 827644 - RNA, 22 nt, Human
gcucucuuuuuccagugguggu

SEQ ID NO: 827645 - RNA, 22 nt, Human
uucuccucuguuggccuucccu

SEQ ID NO: 827646 - RNA, 22 nt, Human
ucucagaguuuagagcugagcc

SEQ ID NO: 827647 - RNA, 22 nt, Human
cuacccagagugaaucucuuaa

SEQ ID NO: 827648 - RNA, 22 nt, Human
ucuuucaaugagcauucuuucc

SEQ ID NO: 827649 - RNA, 22 nt, Human
gagggagggacuagcauucucu

SEQ ID NO: 827650 - RNA, 22 nt, Human
uucaauucaauucuaaauauau

SEQ ID NO: 827651 - RNA, 22 nt, Human
aguuugaauugaaaugcagaug

SEQ ID NO: 827652 - RNA, 21 nt, Human
uuugaaagugggugauucuuu

SEQ ID NO: 827653 - RNA, 22 nt, Human
uucuucaguuugguaaauguaa

SEQ ID NO: 827654 - RNA, 22 nt, Human
aaaauuauagaucuagugccug

SEQ ID NO: 827655 - RNA, 22 nt, Human
aggcacaguggcucacaccugu

SEQ ID NO: 827656 - RNA, 22 nt, Human
uggcuguguuaccacuucaugu

SEQ ID NO: 827657 - RNA, 22 nt, Human
uuucaggguacauggagcaaau

SEQ ID NO: 827658 - RNA, 22 nt, Human
auugaaagagaauguagcucuu

SEQ ID NO: 827659 - RNA, 22 nt, Human
auacaacagaaaaugauuauuc

SEQ ID NO: 827660 - RNA, 22 nt, Human
gagaaggaguagcugaccuggg

SEQ ID NO: 827661 - RNA, 22 nt, Human
ucagugugaguaccaugcucag

SEQ ID NO: 827662 - RNA, 22 nt, Human
gcccaggaaauaaaagugggcu

SEQ ID NO: 827663 - RNA, 22 nt, Human
ggaguaggaguagaacucauca

SEQ ID NO: 827664 - RNA, 22 nt, Human
uuuaacagaugcuaugucuacc

SEQ ID NO: 827665 - RNA, 22 nt, Human
agggggugucucugauuggguu

SEQ ID NO: 827666 - RNA, 22 nt, Human
cggagccugcuuguugcagcug

SEQ ID NO: 827667 - RNA, 22 nt, Human
uagugcuuaacacaaagugauu

SEQ ID NO: 827668 - RNA, 22 nt, Human
agcauccaacaggagggaaggg

SEQ ID NO: 827669 - RNA, 21 nt, Human
aaugcauuaacauaaagcuga

SEQ ID NO: 827670 - RNA, 22 nt, Human
ucugcuguaaagaauuucugcc

SEQ ID NO: 827671 - RNA, 22 nt, Human
ugauuuccccagucuugcugcu

SEQ ID NO: 827672 - RNA, 22 nt, Human
agauggagaaugacaauuaagg

SEQ ID NO: 827673 - RNA, 22 nt, Human
gcagagaacccagcagauuggc

SEQ ID NO: 827674 - RNA, 22 nt, Human
cauuuguuaauuacuauuaucu

SEQ ID NO: 827675 - RNA, 20 nt, Human
uccaggagguuaguguggcu

SEQ ID NO: 827676 - RNA, 22 nt, Human
acuucaugcagaagagagcugu

SEQ ID NO: 827677 - RNA, 22 nt, Human
agagugcagauaagagaauguu

SEQ ID NO: 827678 - RNA, 22 nt, Human
uuuauuguuuagaagggggcug

SEQ ID NO: 827679 - RNA, 22 nt, Human
gucccauaaguagugcaacuug

SEQ ID NO: 827680 - RNA, 22 nt, Human
cuggcugggagcgagcugcuca

SEQ ID NO: 827681 - RNA, 22 nt, Human
gugguaauagagcuccaaacua

SEQ ID NO: 827682 - RNA, 22 nt, Human
cugcgcagggguggcgccagaa

SEQ ID NO: 827683 - RNA, 22 nt, Human
uaucuguucaauggaagaugac

SEQ ID NO: 827684 - RNA, 22 nt, Human
aggcagauauuggggugaugug

SEQ ID NO: 827685 - RNA, 22 nt, Human
uugcuuugccaccagaagucua

SEQ ID NO: 827686 - RNA, 22 nt, Human
gagugcagaugaacagaagauu

SEQ ID NO: 827687 - RNA, 22 nt, Human
aauaucagcacuuuugugguau

SEQ ID NO: 827688 - RNA, 22 nt, Human
ugucaaauuuuuauugcaguau

SEQ ID NO: 827689 - RNA, 22 nt, Human
ccuucuucuguguggcccaaga

SEQ ID NO: 827690 - RNA, 22 nt, Human
uucaggauccccuugaugggcu

SEQ ID NO: 827691 - RNA, 20 nt, Human
gcagcuacucugucucgcuc

SEQ ID NO: 827692 - RNA, 22 nt, Human
uuugaaugcaggacauacagaa

SEQ ID NO: 827693 - RNA, 22 nt, Human
augcagcugucagggagaacau

SEQ ID NO: 827694 - RNA, 22 nt, Human
uuagccauuuuauacaagugua

SEQ ID NO: 827695 - RNA, 22 nt, Human
cuuaaauucuuaaugcccucau

SEQ ID NO: 827696 - RNA, 22 nt, Human
aagauggaguaguguaaugguu

SEQ ID NO: 827697 - RNA, 22 nt, Human
gaggcauggccugaggcuagga

SEQ ID NO: 827698 - RNA, 22 nt, Human
uggcagcugaauggcuggaugg

SEQ ID NO: 827699 - RNA, 22 nt, Human
cucaucugauaaaucacucuua

SEQ ID NO: 827700 - RNA, 22 nt, Human
augaaacacacacgcgcauacu

SEQ ID NO: 827701 - RNA, 22 nt, Human
aucaggauucaccccagagcug

SEQ ID NO: 827702 - RNA, 23 nt, Human
acuauaaaguuguucugauuuac

SEQ ID NO: 827703 - RNA, 18 nt, Human
cauuguacaaugcuuuau

SEQ ID NO: 827704 - RNA, 22 nt, Human
uuacuuugcuuucucauuacag

SEQ ID NO: 827705 - RNA, 22 nt, Human
uucuccaacacaagcaugaugu

SEQ ID NO: 827706 - RNA, 22 nt, Human
ucuggcaggcaaucggcucugg

SEQ ID NO: 827707 - RNA, 22 nt, Human
agagacagaggcaauauagcuu

SEQ ID NO: 827708 - RNA, 22 nt, Human
gagggagugccagagggccagc

SEQ ID NO: 827709 - RNA, 22 nt, Human
aaggcaguagguguuucaaacu

SEQ ID NO: 827710 - RNA, 22 nt, Human
agucaauuaucucuaggucauc

SEQ ID NO: 827711 - RNA, 22 nt, Human
agguaggggguuugggaacugc

SEQ ID NO: 827712 - RNA, 22 nt, Human
cucuuucugauucgcugggacc

SEQ ID NO: 827713 - RNA, 22 nt, Human
gagggcuccucacauucucuau

SEQ ID NO: 827714 - RNA, 22 nt, Human
cucaggauugugccuagggaga

SEQ ID NO: 827715 - RNA, 21 nt, Human
gagacagcccagugccagggc

SEQ ID NO: 827716 - RNA, 22 nt, Human
auugaaagauaggcuacugugg

SEQ ID NO: 827717 - RNA, 20 nt, Human
gggagucuggaugaaagaug

SEQ ID NO: 827718 - RNA, 22 nt, Human
uuugaaagggacaaagucacug

SEQ ID NO: 827719 - RNA, 21 nt, Human
agcaccuuacagcuauaaugg

SEQ ID NO: 827720 - RNA, 22 nt, Human
gugguaauuuaauccuacacug

SEQ ID NO: 827721 - RNA, 22 nt, Human
guggcagcggugugcaaggagg

SEQ ID NO: 827722 - RNA, 21 nt, Human
agcagaggcagaauguaugca

SEQ ID NO: 827723 - RNA, 22 nt, Human
cagaccagaaggaagccgacaa

SEQ ID NO: 827724 - RNA, 22 nt, Human
cacaggagagcugggaggugcc

SEQ ID NO: 827725 - RNA, 22 nt, Human
ugaaggccagggauuugcagcc

SEQ ID NO: 827726 - RNA, 22 nt, Human
gguuugaacagcuuuggagaag

SEQ ID NO: 827727 - RNA, 22 nt, Human
uguacauagaucuugaaaauua

SEQ ID NO: 827728 - RNA, 22 nt, Human
aaguguauauaugacuuauaaa

SEQ ID NO: 827729 - RNA, 22 nt, Human
ucuucagagugaaagucuguga

SEQ ID NO: 827730 - RNA, 22 nt, Human
ugcccaggaucuggcgaugcuc

SEQ ID NO: 827731 - RNA, 21 nt, Human
acucaggagacuaacuauguc

SEQ ID NO: 827732 - RNA, 22 nt, Human
ugcucuucggggccacugcuug

SEQ ID NO: 827733 - RNA, 22 nt, Human
aaucuuucccuauuaaaugugg

SEQ ID NO: 827734 - RNA, 16 nt, Human
gcccaggacgggaggc

SEQ ID NO: 827735 - RNA, 22 nt, Human
cugaacucuuuaugacagcuug

SEQ ID NO: 827736 - RNA, 22 nt, Human
aguggaccagaagacugaagcu

SEQ ID NO: 827737 - RNA, 22 nt, Human
ugaaagcagcaccaauaccauu

SEQ ID NO: 827738 - RNA, 21 nt, Human
cugcuguggcccccgacaugc

SEQ ID NO: 827739 - RNA, 22 nt, Human
ggacuucuaagugccagacacu

SEQ ID NO: 827740 - RNA, 22 nt, Human
uccaggaggcagggcugugccc

SEQ ID NO: 827741 - RNA, 22 nt, Human
uuguuuuaucuuucuacagacu

SEQ ID NO: 827742 - RNA, 22 nt, Human
uuaaagggccgauuuccaggcc

SEQ ID NO: 827743 - RNA, 22 nt, Human
aaauauaauuucugccucaaua

SEQ ID NO: 827744 - RNA, 22 nt, Human
auguuauuaaaguacagauucu

SEQ ID NO: 827745 - RNA, 22 nt, Human
aggcugcugccuuggagagugu

SEQ ID NO: 827746 - RNA, 22 nt, Human
cuuuggcaaugucauuuucaau

SEQ ID NO: 827747 - RNA, 22 nt, Human
ugucucugauaaguaguucagu

SEQ ID NO: 827748 - RNA, 21 nt, Human
ggagggcagcccagacuggcu

SEQ ID NO: 827749 - RNA, 22 nt, Human
agcagacauaucucaugucaca

SEQ ID NO: 827750 - RNA, 22 nt, Human
agaggacagguuuuccaugggc

SEQ ID NO: 827751 - RNA, 22 nt, Human
aaggcagcaugaaucccuguac

SEQ ID NO: 827752 - RNA, 22 nt, Human
aucaggauucaguaucuccagc

SEQ ID NO: 827753 - RNA, 22 nt, Human
uucaacuauuaugaauaaaauu

SEQ ID NO: 827754 - RNA, 22 nt, Human
acaauauuguacccagaaguuu

SEQ ID NO: 827755 - RNA, 22 nt, Human
uugaaaguuaucuagauucuga

SEQ ID NO: 827756 - RNA, 17 nt, Human
caagagagaugacugga

SEQ ID NO: 827757 - RNA, 22 nt, Human
ggugguggagccagcugggagu

SEQ ID NO: 827758 - RNA, 22 nt, Human
gggcagcugccaagugcaucgc

SEQ ID NO: 827759 - RNA, 22 nt, Human
aggcagcuuucuggugcaccau

SEQ ID NO: 827760 - RNA, 22 nt, Human
uagcacaucuggcgcuuauagg

SEQ ID NO: 827761 - RNA, 22 nt, Human
aaugucugccagaacugaucau

SEQ ID NO: 827762 - RNA, 22 nt, Human
guuuucaauuauaagauggcuu

SEQ ID NO: 827763 - RNA, 22 nt, Human
cuguaguugaugauuucugaua

SEQ ID NO: 827764 - RNA, 22 nt, Human
uagcacaucuucuuggccugca

SEQ ID NO: 827765 - RNA, 19 nt, Human
ucaucucacagggccuggc

SEQ ID NO: 827766 - RNA, 22 nt, Human
uuaaauuagucaagcuucucug

SEQ ID NO: 827767 - RNA, 22 nt, Human
gcugauguaagacuuuugguuu

SEQ ID NO: 827768 - RNA, 22 nt, Human
uauuuuaaagacugccagccua

SEQ ID NO: 827769 - RNA, 19 nt, Human
uccaggagcaaagccaguu

SEQ ID NO: 827770 - RNA, 22 nt, Human
gucuucaacaauaacuaccacu

SEQ ID NO: 827771 - RNA, 22 nt, Human
ugugugucagagucuccauggu

SEQ ID NO: 827772 - RNA, 22 nt, Human
cuguggaauugaugcuuagugu

SEQ ID NO: 827773 - RNA, 22 nt, Human
cacaaauggccguguucaaaga

SEQ ID NO: 827774 - RNA, 22 nt, Human
uucuucuugucugcccucacau

SEQ ID NO: 827775 - RNA, 22 nt, Human
gaggcagcugggauacaaggga

SEQ ID NO: 827776 - RNA, 22 nt, Human
ucaggaugagcucauaacuaug

SEQ ID NO: 827777 - RNA, 22 nt, Human
aaugaaauguagcuuauccaua

SEQ ID NO: 827778 - RNA, 22 nt, Human
auucuucaucacuaccuuguga

SEQ ID NO: 827779 - RNA, 21 nt, Human
cuugaaagguagagucuacag

SEQ ID NO: 827780 - RNA, 22 nt, Human
ccacagagacaggguccuugcu

SEQ ID NO: 827781 - RNA, 22 nt, Human
uugaaaguagcagcugcauaug

SEQ ID NO: 827782 - RNA, 22 nt, Human
uucaugugauaaaugugugacu

SEQ ID NO: 827783 - RNA, 22 nt, Human
uugaaauaucaaguuauuagug

SEQ ID NO: 827784 - RNA, 22 nt, Human
aggcggcugguguccugcaggu

SEQ ID NO: 827785 - RNA, 22 nt, Human
caaggccaguucaccaagggca

SEQ ID NO: 827786 - RNA, 22 nt, Human
aggagaggguggcauuaaguuu

SEQ ID NO: 827787 - RNA, 22 nt, Human
ucagauggguuuugaaggaugu

SEQ ID NO: 827788 - RNA, 17 nt, Human
cucacggaggaugaauc

SEQ ID NO: 827789 - RNA, 22 nt, Human
uuccuuaggcuguuugcagugc

SEQ ID NO: 827790 - RNA, 22 nt, Human
gcucacugcaaccucugcuucc

SEQ ID NO: 827791 - RNA, 22 nt, Human
aguuauaugugaaaacacguau

SEQ ID NO: 827792 - RNA, 22 nt, Human
gagggaggugauacugaacgua

SEQ ID NO: 827793 - RNA, 22 nt, Human
agggcaguucaacuucauagug

SEQ ID NO: 827794 - RNA, 22 nt, Human
augggaggaugcucgggugcuc

SEQ ID NO: 827795 - RNA, 22 nt, Human
cugcugagaaaagacugaggga

SEQ ID NO: 827796 - RNA, 23 nt, Human
uccaugagaugugggcuucuagu

SEQ ID NO: 827797 - RNA, 22 nt, Human
ucuuuuggguucuuaugauuua

SEQ ID NO: 827798 - RNA, 22 nt, Human
uuacaguuuaguccaagccaga

SEQ ID NO: 827799 - RNA, 22 nt, Human
ggcagcuuguccuucaggagag

SEQ ID NO: 827800 - RNA, 22 nt, Human
uuugaagucagacacugcuuug

SEQ ID NO: 827801 - RNA, 19 nt, Human
cuucuggcccugagccacc

SEQ ID NO: 827802 - RNA, 22 nt, Human
uuuuucagccaugaauuacacu

SEQ ID NO: 827803 - RNA, 22 nt, Human
gcccaggaaaugccccguggug

SEQ ID NO: 827804 - RNA, 22 nt, Human
gacccaggagugcagagagugg

SEQ ID NO: 827805 - RNA, 22 nt, Human
auggaaagggaagcaaggaaca

SEQ ID NO: 827806 - RNA, 22 nt, Human
cccaggagguggagguugcggu

SEQ ID NO: 827807 - RNA, 22 nt, Human
uggcagcugagugcacccccuc

SEQ ID NO: 827808 - RNA, 22 nt, Human
gaggcagcugaagcuucaaaga

SEQ ID NO: 827809 - RNA, 22 nt, Human
uucuuuuacauuaagauuucag

SEQ ID NO: 827810 - RNA, 22 nt, Human
gaggcacuggaggaaaggagaa

SEQ ID NO: 827811 - RNA, 20 nt, Human
ggggcugcaugcagagaaga

SEQ ID NO: 827812 - RNA, 22 nt, Human
uuaaauauuauguugucugcaa

SEQ ID NO: 827813 - RNA, 22 nt, Human
ucacugcucagucuguacuaca

SEQ ID NO: 827814 - RNA, 19 nt, Human
uuugaaagaguuuuauugg

SEQ ID NO: 827815 - RNA, 22 nt, Human
ugcccacauggugccauggcca

SEQ ID NO: 827816 - RNA, 22 nt, Human
ggcagcuucucccaggcuguuu

SEQ ID NO: 827817 - RNA, 22 nt, Human
uuucaaaguugggaauuguaau

SEQ ID NO: 827818 - RNA, 20 nt, Human
ugaggcaggagaauggcaug

SEQ ID NO: 827819 - RNA, 22 nt, Human
cagaggcacaagaaagcaaggc

SEQ ID NO: 827820 - RNA, 20 nt, Human
uuucuugucggcuguugcug

SEQ ID NO: 827821 - RNA, 22 nt, Human
agagagcauugaggaaaucuuc

SEQ ID NO: 827822 - RNA, 22 nt, Human
ucauuucuauugcuacugucug

SEQ ID NO: 827823 - RNA, 22 nt, Human
aaagcagaacugagagagcugg

SEQ ID NO: 827824 - RNA, 22 nt, Human
agagacugcgugucagcgcugg

SEQ ID NO: 827825 - RNA, 22 nt, Human
gcaggagaacaaagcaagcugc

SEQ ID NO: 827826 - RNA, 23 nt, Human
ugcaugugaauucauacuuguuu

SEQ ID NO: 827827 - RNA, 22 nt, Human
uucaggauuguguuuuuccuga

SEQ ID NO: 827828 - RNA, 22 nt, Human
cccaggagguagagguugcagu

SEQ ID NO: 827829 - RNA, 21 nt, Human
uuucacaaaaguaugugacaa

SEQ ID NO: 827830 - RNA, 22 nt, Human
uuugacaaaggaaaaaugcaca

SEQ ID NO: 827831 - RNA, 22 nt, Human
gaaggccaguuuugagauaggu

SEQ ID NO: 827832 - RNA, 22 nt, Human
gcucucuugguggcuguccugg

SEQ ID NO: 827833 - RNA, 22 nt, Human
agcagaggaggauuuaguuagg

SEQ ID NO: 827834 - RNA, 22 nt, Human
ccaggagcagauauggacauaa

SEQ ID NO: 827835 - RNA, 22 nt, Human
agcuucuuggcucagcacuugg

SEQ ID NO: 827836 - RNA, 22 nt, Human
ggaggcagaauagagugugggu

SEQ ID NO: 827837 - RNA, 22 nt, Human
ucuuagaaguucauguuccagc

SEQ ID NO: 827838 - RNA, 22 nt, Human
cuucucagucaccugugagucu

SEQ ID NO: 827839 - RNA, 22 nt, Human
ugugaacuggcagguggacggg

SEQ ID NO: 827840 - RNA, 22 nt, Human
aagugggaauagaaaugaaggu

SEQ ID NO: 827841 - RNA, 22 nt, Human
gggagggguugcauguuugagu

SEQ ID NO: 827842 - RNA, 22 nt, Human
ugaaggccuaacuuccagugcu

SEQ ID NO: 827843 - RNA, 22 nt, Human
ucacaguaaaagcauggaagag

SEQ ID NO: 827844 - RNA, 22 nt, Human
gaggccaaguuggagaccaggu

SEQ ID NO: 827845 - RNA, 22 nt, Human
ucccaggauguuggcggcaggu

SEQ ID NO: 827846 - RNA, 22 nt, Human
cauuuauuggcauguaguaggu

SEQ ID NO: 827847 - RNA, 22 nt, Human
uuucaacaccagagaccaugcg

SEQ ID NO: 827848 - RNA, 22 nt, Human
aaguggacuaauacaaggacua

SEQ ID NO: 827849 - RNA, 22 nt, Human
agcugccgaugcccagcugcau

SEQ ID NO: 827850 - RNA, 22 nt, Human
cuuaagauuugagauaccuaau

SEQ ID NO: 827851 - RNA, 22 nt, Human
gaggggcagagguagagaacaa

SEQ ID NO: 827852 - RNA, 22 nt, Human
gcugcccacaaugauuacaugg

SEQ ID NO: 827853 - RNA, 22 nt, Human
gucaggauuaaugggaguaugc

SEQ ID NO: 827854 - RNA, 22 nt, Human
cugaaaauguuacacaggaaga

SEQ ID NO: 827855 - RNA, 22 nt, Human
gugacaguggucacuuguaguu

SEQ ID NO: 827856 - RNA, 18 nt, Human
ucaggagacacagacgca

SEQ ID NO: 827857 - RNA, 22 nt, Human
ucugcuguucauucuuuuagcu

SEQ ID NO: 827858 - RNA, 22 nt, Human
auacacauauguguguauaugu

SEQ ID NO: 827859 - RNA, 22 nt, Human
gucuucuuguguugccugucuu

SEQ ID NO: 827860 - RNA, 22 nt, Human
aagcaauagcaacaacuuuaca

SEQ ID NO: 827861 - RNA, 22 nt, Human
auuugcuugugcuaugaaaguu

SEQ ID NO: 827862 - RNA, 22 nt, Human
ggaggaugccaagcugugcaca

SEQ ID NO: 827863 - RNA, 22 nt, Human
agaaggggagaagcuaccagga

SEQ ID NO: 827864 - RNA, 22 nt, Human
uaugccugauaacugugucucu

SEQ ID NO: 827865 - RNA, 22 nt, Human
aaagcagaggugauaugacuua

SEQ ID NO: 827866 - RNA, 22 nt, Human
acgagagguccuuagaaucugu

SEQ ID NO: 827867 - RNA, 22 nt, Human
aagacaauuugauacuaguugc

SEQ ID NO: 827868 - RNA, 22 nt, Human
aggcugcuucaauggauaagau

SEQ ID NO: 827869 - RNA, 22 nt, Human
ucaggagauguaaccuuagcug

SEQ ID NO: 827870 - RNA, 22 nt, Human
auucuucacauggauaggaucu

SEQ ID NO: 827871 - RNA, 22 nt, Human
acacauuuacauguuuacguau

SEQ ID NO: 827872 - RNA, 22 nt, Human
aggaagcuaaccagggagugag

SEQ ID NO: 827873 - RNA, 22 nt, Human
augauguuaccaguacuuagag

SEQ ID NO: 827874 - RNA, 22 nt, Human
uguggaaaauuggaacguuccu

SEQ ID NO: 827875 - RNA, 19 nt, Human
ugccuggacaaaugugggg

SEQ ID NO: 827876 - RNA, 22 nt, Human
uggcagcuggagggcaauggcc

SEQ ID NO: 827877 - RNA, 22 nt, Human
aaucuucuacuugacaguucuc

SEQ ID NO: 827878 - RNA, 22 nt, Human
cucacugugccuuuucccaaac

SEQ ID NO: 827879 - RNA, 22 nt, Human
gaggccaggagugcuguaaguu

SEQ ID NO: 827880 - RNA, 22 nt, Human
cagcuggccccacaguagaggc

SEQ ID NO: 827881 - RNA, 23 nt, Human
uccuuccuuugagaggcuccauc

SEQ ID NO: 827882 - RNA, 22 nt, Human
caggagggcccgagacucuucc

SEQ ID NO: 827883 - RNA, 22 nt, Human
guuuuauaggcuguugcuauau

SEQ ID NO: 827884 - RNA, 22 nt, Human
cagcugccugucuggaggcaau

SEQ ID NO: 827885 - RNA, 22 nt, Human
uugguuuagagagugugguuac

SEQ ID NO: 827886 - RNA, 22 nt, Human
cugaggaagacagcagcugugu

SEQ ID NO: 827887 - RNA, 19 nt, Human
ucauuguugguuugucggg

SEQ ID NO: 827888 - RNA, 22 nt, Human
gaggcagcuggguccggucggg

SEQ ID NO: 827889 - RNA, 22 nt, Human
aggacagcagugcuggcacuug

SEQ ID NO: 827890 - RNA, 22 nt, Human
uccaggaggaggaaggcugcca

SEQ ID NO: 827891 - RNA, 22 nt, Human
gagaggaguuacuauuuccgag

SEQ ID NO: 827892 - RNA, 22 nt, Human
aggcaguuuaggcagcgauuua

SEQ ID NO: 827893 - RNA, 22 nt, Human
cagcuggcuggucagugcacaa

SEQ ID NO: 827894 - RNA, 22 nt, Human
uggcagcugucuguggggucuc

SEQ ID NO: 827895 - RNA, 22 nt, Human
aaugucugcucuacucaggagg

SEQ ID NO: 827896 - RNA, 22 nt, Human
uggcagcuauggucuaagggcc

SEQ ID NO: 827897 - RNA, 22 nt, Human
agagggaucacccuguuucugg

SEQ ID NO: 827898 - RNA, 22 nt, Human
gaggaaccaaaucagcuugcac

SEQ ID NO: 827899 - RNA, 23 nt, Human
ccacagagcugccaauuccugug

SEQ ID NO: 827900 - RNA, 22 nt, Human
aggcaguggcugagaccagggg

SEQ ID NO: 827901 - RNA, 22 nt, Human
ugcugagguuucgucugcuugc

SEQ ID NO: 827902 - RNA, 22 nt, Human
aucaggauagucuguaaauugu

SEQ ID NO: 827903 - RNA, 21 nt, Human
gcucagaguauugcacuguuu

SEQ ID NO: 827904 - RNA, 22 nt, Human
auguuuccauuuucuuguauca

SEQ ID NO: 827905 - RNA, 22 nt, Human
cuguguuggcuuuucucuugua

SEQ ID NO: 827906 - RNA, 22 nt, Human
aggcagaugggagcuggaaguu

SEQ ID NO: 827907 - RNA, 22 nt, Human
cagaccagcucuaugaacccaa

SEQ ID NO: 827908 - RNA, 22 nt, Human
auugaaagauuuugggcucaug

SEQ ID NO: 827909 - RNA, 22 nt, Human
ggacaagccugugaguggguuu

SEQ ID NO: 827910 - RNA, 22 nt, Human
acauguaaaaggaacaugcaug

SEQ ID NO: 827911 - RNA, 22 nt, Human
acaaauguggacauggauaaug

SEQ ID NO: 827912 - RNA, 22 nt, Human
agagggagcccagucauagcug

SEQ ID NO: 827913 - RNA, 22 nt, Human
uuccugagggacuuuugagauu

SEQ ID NO: 827914 - RNA, 20 nt, Human
cugcugugugugccucagcc

SEQ ID NO: 827915 - RNA, 22 nt, Human
accaggagccauagagucaggc

SEQ ID NO: 827916 - RNA, 22 nt, Human
cuccacagcucaggcucagagu

SEQ ID NO: 827917 - RNA, 22 nt, Human
uccaggagguugagacugcagu

SEQ ID NO: 827918 - RNA, 22 nt, Human
cucagaagaacaaaggcucuac

SEQ ID NO: 827919 - RNA, 22 nt, Human
ccugcugugaagccaggccugu

SEQ ID NO: 827920 - RNA, 22 nt, Human
cugcugugcacccaggaaggcu

SEQ ID NO: 827921 - RNA, 22 nt, Human
agucccuguacuuuccacugcc

SEQ ID NO: 827922 - RNA, 17 nt, Human
cauuuguugaucaguug

SEQ ID NO: 827923 - RNA, 22 nt, Human
agaggagguccuuuucugaugu

SEQ ID NO: 827924 - RNA, 22 nt, Human
cagaagaggacuggguagcuca

SEQ ID NO: 827925 - RNA, 22 nt, Human
cacauauuugaugaagcuuugu

SEQ ID NO: 827926 - RNA, 19 nt, Human
uugaaauuguuugauaugg

SEQ ID NO: 827927 - RNA, 23 nt, Human
ugaaggccuggaggacgcguugu

SEQ ID NO: 827928 - RNA, 22 nt, Human
gaaaggccauuucugaggguuu

SEQ ID NO: 827929 - RNA, 17 nt, Human
cccacggaggugugaaa

SEQ ID NO: 827930 - RNA, 22 nt, Human
acccaggaggugacacagggcu

SEQ ID NO: 827931 - RNA, 22 nt, Human
ucucuucuaauuaggguccaug

SEQ ID NO: 827932 - RNA, 22 nt, Human
gaacccaggcuuuugaggcugu

SEQ ID NO: 827933 - RNA, 22 nt, Human
ggcagcugucucugaguuagca

SEQ ID NO: 827934 - RNA, 22 nt, Human
gugauuuucuccuccuagaagu

SEQ ID NO: 827935 - RNA, 22 nt, Human
cccaggagguuggggcuacagu

SEQ ID NO: 827936 - RNA, 22 nt, Human
cucaggauccaucuccugcccu

SEQ ID NO: 827937 - RNA, 22 nt, Human
ucucucuucaacccuuaacuag

SEQ ID NO: 827938 - RNA, 22 nt, Human
agugcuuuaccuagauaauguu

SEQ ID NO: 827939 - RNA, 22 nt, Human
agaccauagggaccucagguug

SEQ ID NO: 827940 - RNA, 22 nt, Human
agugcuuuagcauccaacuguc

SEQ ID NO: 827941 - RNA, 22 nt, Human
caggagagcccggguccgggcu

SEQ ID NO: 827942 - RNA, 22 nt, Human
uuugcaguagacaucuuauuuu

SEQ ID NO: 827943 - RNA, 22 nt, Human
uucaguaaaacacugcaauguc

SEQ ID NO: 827944 - RNA, 22 nt, Human
cuucuucaagagaaugggagac

SEQ ID NO: 827945 - RNA, 22 nt, Human
acuuugcagggcuugauaucca

SEQ ID NO: 827946 - RNA, 22 nt, Human
aaaauaacuucuacuauuugca

SEQ ID NO: 827947 - RNA, 22 nt, Human
aucuuucuauuucuaaaaacua

SEQ ID NO: 827948 - RNA, 22 nt, Human
ugacaguuaagguauacauuca

SEQ ID NO: 827949 - RNA, 22 nt, Human
gagaggagguggcuaugacagc

SEQ ID NO: 827950 - RNA, 22 nt, Human
cacaauuuccuugcuucacuuu

SEQ ID NO: 827951 - RNA, 22 nt, Human
gaucuucuauguaaugaagugu

SEQ ID NO: 827952 - RNA, 22 nt, Human
aucugcuugaaugagcaacagg

SEQ ID NO: 827953 - RNA, 22 nt, Human
uugcccagaguccacagcguac

SEQ ID NO: 827954 - RNA, 22 nt, Human
gcugcccauuccacuggauggu

SEQ ID NO: 827955 - RNA, 22 nt, Human
cgaggcagggaagcugcaaaag

SEQ ID NO: 827956 - RNA, 19 nt, Human
uucacaauuaugaaauuag

SEQ ID NO: 827957 - RNA, 22 nt, Human
agagagagggaaacugcuaaac

SEQ ID NO: 827958 - RNA, 22 nt, Human
aggaagcugcuggaguagugug

SEQ ID NO: 827959 - RNA, 21 nt, Human
ucauuugugaucugauuucca

SEQ ID NO: 827960 - RNA, 22 nt, Human
aggcugcucaguagauggagcu

SEQ ID NO: 827961 - RNA, 22 nt, Human
ggcaugcugcguacagaugaac

SEQ ID NO: 827962 - RNA, 22 nt, Human
cuuaaaaucuggcaguuagcua

SEQ ID NO: 827963 - RNA, 22 nt, Human
aaugagacacgugaagcagaug

SEQ ID NO: 827964 - RNA, 22 nt, Human
uugagaagaaauaguuugcaau

SEQ ID NO: 827965 - RNA, 22 nt, Human
cuucagaggggacucaaaguca

SEQ ID NO: 827966 - RNA, 22 nt, Human
agugcagcaugcuggggaggcu

SEQ ID NO: 827967 - RNA, 21 nt, Human
uucugggaaaugagcuggggc

SEQ ID NO: 827968 - RNA, 22 nt, Human
agaggcggagcuugcagugagc

SEQ ID NO: 827969 - RNA, 22 nt, Human
ccacagcugaccgcaggugagc

SEQ ID NO: 827970 - RNA, 23 nt, Human
acauacauggagauaaagugaug

SEQ ID NO: 827971 - RNA, 22 nt, Human
cugcuguguggauucaauggcu

SEQ ID NO: 827972 - RNA, 20 nt, Human
uuugucuguuaaguguuucu

SEQ ID NO: 827973 - RNA, 22 nt, Human
uuauucuucuucucuugccagg

SEQ ID NO: 827974 - RNA, 22 nt, Human
uauuucagguauggugugaaau

SEQ ID NO: 827975 - RNA, 22 nt, Human
gagugcaggccugagcaccauc

SEQ ID NO: 827976 - RNA, 22 nt, Human
gagagcaggaggcagcgggacg

SEQ ID NO: 827977 - RNA, 22 nt, Human
cacugucuuuugugaagacaau

SEQ ID NO: 827978 - RNA, 22 nt, Human
ucuuuuggaaaugaugugcagg

SEQ ID NO: 827979 - RNA, 22 nt, Human
cuugcugucuugcauuuagagc

SEQ ID NO: 827980 - RNA, 20 nt, Human
cccaggagugagcagcuuua

SEQ ID NO: 827981 - RNA, 22 nt, Human
cccagggaagccauuucugacu

SEQ ID NO: 827982 - RNA, 22 nt, Human
gcccaggaguuggaggcugcag

SEQ ID NO: 827983 - RNA, 22 nt, Human
aucaggaucugggagccugaaa

SEQ ID NO: 827984 - RNA, 22 nt, Human
cucacugacgaggaagcugaga

SEQ ID NO: 827985 - RNA, 22 nt, Human
gucccaggugggcuccaccucu

SEQ ID NO: 827986 - RNA, 17 nt, Human
ucaggauguagcaguag

SEQ ID NO: 827987 - RNA, 22 nt, Human
gcugcccagacauugaaucagg

SEQ ID NO: 827988 - RNA, 22 nt, Human
acaggagacccugcugguucug

SEQ ID NO: 827989 - RNA, 22 nt, Human
agcugccccaugagaggcaggu

SEQ ID NO: 827990 - RNA, 22 nt, Human
cugagccagcuggcaugugcua

SEQ ID NO: 827991 - RNA, 22 nt, Human
augaaacaguguguauagcaaa

SEQ ID NO: 827992 - RNA, 22 nt, Human
ccagugcuucuuugcuagcugg

SEQ ID NO: 827993 - RNA, 22 nt, Human
ugaggcagugugagauaauaaa

SEQ ID NO: 827994 - RNA, 17 nt, Human
ugauaguucauuuuaag

SEQ ID NO: 827995 - RNA, 22 nt, Human
ucuuugaauuucugacugucuu

SEQ ID NO: 827996 - RNA, 21 nt, Human
gcugcccaacccugcaucucc

SEQ ID NO: 827997 - RNA, 22 nt, Human
auaucacaguaguuguuuaguu

SEQ ID NO: 827998 - RNA, 21 nt, Human
cccaggaggagcuccggcucc

SEQ ID NO: 827999 - RNA, 22 nt, Human
uuacacaacaucuguauuauua

SEQ ID NO: 828000 - RNA, 22 nt, Human
gagagucuaggaaccucauaua

SEQ ID NO: 828001 - RNA, 20 nt, Human
agacaggagcccccauucag

SEQ ID NO: 828002 - RNA, 22 nt, Human
ccagaggaaaaauaucucccua

SEQ ID NO: 828003 - RNA, 22 nt, Human
aucacaaaggcugcuucaugau

SEQ ID NO: 828004 - RNA, 22 nt, Human
caacagcugaucuuugaugaag

SEQ ID NO: 828005 - RNA, 22 nt, Human
ucacugcugcugccaugaugga

SEQ ID NO: 828006 - RNA, 22 nt, Human
agggauggaagacuugaagacc

SEQ ID NO: 828007 - RNA, 22 nt, Human
acagcauugcuccaucucaaga

SEQ ID NO: 828008 - RNA, 22 nt, Human
ucaauucugguccucaggaacu

SEQ ID NO: 828009 - RNA, 22 nt, Human
guacauuucucuuguucuuauu

SEQ ID NO: 828010 - RNA, 22 nt, Human
uucaggaucacuaaacccucca

SEQ ID NO: 828011 - RNA, 19 nt, Human
uucuccaggcugcagaggg

SEQ ID NO: 828012 - RNA, 22 nt, Human
ggcagggaagcuggcaucacgg

SEQ ID NO: 828013 - RNA, 22 nt, Human
gaucauuugcaggaaacauuaa

SEQ ID NO: 828014 - RNA, 22 nt, Human
aaggaaccauuugugugcaugg

SEQ ID NO: 828015 - RNA, 22 nt, Human
agcugcuacugcucugccagag

SEQ ID NO: 828016 - RNA, 22 nt, Human
auaucaaacgaaguuauuuuaa

SEQ ID NO: 828017 - RNA, 22 nt, Human
aaggccagcuuguagggcuggu

SEQ ID NO: 828018 - RNA, 22 nt, Human
gaggccaaucaauagggcaaua

SEQ ID NO: 828019 - RNA, 20 nt, Human
gggugggagagucugagggu

SEQ ID NO: 828020 - RNA, 19 nt, Human
cucucacucgccacauccu

SEQ ID NO: 828021 - RNA, 22 nt, Human
caguuucuuggaugccaauuuc

SEQ ID NO: 828022 - RNA, 22 nt, Human
uuauccuggauuauauauguga

SEQ ID NO: 828023 - RNA, 22 nt, Human
caaaugauaccuauuacuaggc

SEQ ID NO: 828024 - RNA, 22 nt, Human
acucaggaaaaauguagugaua

SEQ ID NO: 828025 - RNA, 22 nt, Human
uugcugaagugaagguauguuu

SEQ ID NO: 828026 - RNA, 22 nt, Human
gaugagcauuguuucauguguu

SEQ ID NO: 828027 - RNA, 22 nt, Human
gaaggggacuggcagcugcaga

SEQ ID NO: 828028 - RNA, 22 nt, Human
uaggcagccagcaucaguuggg

SEQ ID NO: 828029 - RNA, 22 nt, Human
gucuauauauugcuugaauaau

SEQ ID NO: 828030 - RNA, 22 nt, Human
uuucaguuuaugucuugaauua

SEQ ID NO: 828031 - RNA, 22 nt, Human
gcuggcaggagccuuucccuuu

SEQ ID NO: 828032 - RNA, 22 nt, Human
aaguugagaugucauaggagac

SEQ ID NO: 828033 - RNA, 22 nt, Human
cccaggaggcagagcuugcagu

SEQ ID NO: 828034 - RNA, 18 nt, Human
uuugcaaaggaaguaugg

SEQ ID NO: 828035 - RNA, 22 nt, Human
uccuucuuugacaaguggcaga

SEQ ID NO: 828036 - RNA, 22 nt, Human
agugcugucaguuuuauagaua

SEQ ID NO: 828037 - RNA, 22 nt, Human
gaaguacaguuuuaucuagcca

SEQ ID NO: 828038 - RNA, 22 nt, Human
uauuucagcaagaagaaugugg

SEQ ID NO: 828039 - RNA, 22 nt, Human
ugguaauuuacgcauuucugua

SEQ ID NO: 828040 - RNA, 22 nt, Human
ucugggaaaugcuguuccuugu

SEQ ID NO: 828041 - RNA, 22 nt, Human
aggguggcugaguagauggaag

SEQ ID NO: 828042 - RNA, 22 nt, Human
ccaggacaaguguggccauggc

SEQ ID NO: 828043 - RNA, 22 nt, Human
cuacccagauccaggauggcua

SEQ ID NO: 828044 - RNA, 22 nt, Human
auaaagauuucuuuuucucuac

SEQ ID NO: 828045 - RNA, 22 nt, Human
cagugucuccagaugcuccaau

SEQ ID NO: 828046 - RNA, 22 nt, Human
ggacagaggguugacagaguau

SEQ ID NO: 828047 - RNA, 22 nt, Human
gcugcugugaauuuuuuaaaug

SEQ ID NO: 828048 - RNA, 22 nt, Human
gauuucuucauuuguggugaau

SEQ ID NO: 828049 - RNA, 22 nt, Human
gcaagcugcucuuauguggagg

SEQ ID NO: 828050 - RNA, 22 nt, Human
ucaggagagaaagaauacaauu

SEQ ID NO: 828051 - RNA, 23 nt, Human
cugcuguguuggucucgauggga

SEQ ID NO: 828052 - RNA, 22 nt, Human
ccaggagagcauugcacagagg

SEQ ID NO: 828053 - RNA, 20 nt, Human
aggcucagcugagcucuugg

SEQ ID NO: 828054 - RNA, 22 nt, Human
ucucacuuuccagacuuuucaa

SEQ ID NO: 828055 - RNA, 22 nt, Human
uccaggagucagacagauggug

SEQ ID NO: 828056 - RNA, 22 nt, Human
gccaggagccagcuucuuagca

SEQ ID NO: 828057 - RNA, 17 nt, Human
uugaacugcugagucag

SEQ ID NO: 828058 - RNA, 22 nt, Human
cuguaugaggaucagacuggac

SEQ ID NO: 828059 - RNA, 22 nt, Human
uccaugaggaccaaauucguag

SEQ ID NO: 828060 - RNA, 22 nt, Human
gcccaggauggcuggaggugcu

SEQ ID NO: 828061 - RNA, 22 nt, Human
uuucaaauagaaucuuuccaaa

SEQ ID NO: 828062 - RNA, 22 nt, Human
uucuucaaaacaacacuggccu

SEQ ID NO: 828063 - RNA, 22 nt, Human
ucaggaugguccuuuaugagaa

SEQ ID NO: 828064 - RNA, 22 nt, Human
aggggaugauccucccgcagcg

SEQ ID NO: 828065 - RNA, 22 nt, Human
cugcuguguuagcagguuuagu

SEQ ID NO: 828066 - RNA, 23 nt, Human
auugaugacuugauuacacuuuu

SEQ ID NO: 828067 - RNA, 22 nt, Human
auuugcuucugugaaaucaagu

SEQ ID NO: 828068 - RNA, 22 nt, Human
ugaacaguuucaagaaaacuuu

SEQ ID NO: 828069 - RNA, 22 nt, Human
gcucaggaccgaggggugggaa

SEQ ID NO: 828070 - RNA, 22 nt, Human
ccagacaggaacacacaucucc

SEQ ID NO: 828071 - RNA, 22 nt, Human
agugcuuugagcguuugaaaag

SEQ ID NO: 828072 - RNA, 18 nt, Human
ggcaucugcacagcagcc

SEQ ID NO: 828073 - RNA, 22 nt, Human
gacagguggggaaacuaaggua

SEQ ID NO: 828074 - RNA, 22 nt, Human
aggcagaggagaaugaucuucc

SEQ ID NO: 828075 - RNA, 22 nt, Human
guagccauuggcaaugaagccu

SEQ ID NO: 828076 - RNA, 22 nt, Human
uccugucuaaagaccugcaggc

SEQ ID NO: 828077 - RNA, 19 nt, Human
gcagcugcuugaaaagaaa

SEQ ID NO: 828078 - RNA, 22 nt, Human
agcuacccgaggacaggcuaag

SEQ ID NO: 828079 - RNA, 22 nt, Human
cccaggaacagggcucagaccc

SEQ ID NO: 828080 - RNA, 22 nt, Human
guugaaagcuuuucauuuaguu

SEQ ID NO: 828081 - RNA, 21 nt, Human
ucucugguuggaguugugcca

SEQ ID NO: 828082 - RNA, 22 nt, Human
caacauuucaaggucuuuagga

SEQ ID NO: 828083 - RNA, 22 nt, Human
cucaagacugaucgcaguggaa

SEQ ID NO: 828084 - RNA, 18 nt, Human
cugcccagagcacuugug

SEQ ID NO: 828085 - RNA, 22 nt, Human
gagaaaugcaugcaugucauca

SEQ ID NO: 828086 - RNA, 22 nt, Human
uucuuaaaacuuauggacaggu

SEQ ID NO: 828087 - RNA, 22 nt, Human
cagucuucuaaccuagcagccu

SEQ ID NO: 828088 - RNA, 22 nt, Human
ugaggcaggacauggacaacug

SEQ ID NO: 828089 - RNA, 22 nt, Human
guuuuauaggugaaauauuacu

SEQ ID NO: 828090 - RNA, 22 nt, Human
caugucuguguacacaugcaca

SEQ ID NO: 828091 - RNA, 22 nt, Human
ucauuugugugagugauuugac

SEQ ID NO: 828092 - RNA, 22 nt, Human
ggugagggaguggaacgaggug

SEQ ID NO: 828093 - RNA, 22 nt, Human
aggcaggcucaggcccaugcuu

SEQ ID NO: 828094 - RNA, 22 nt, Human
caaggccaguccauuuuggaag

SEQ ID NO: 828095 - RNA, 22 nt, Human
ucaggaggccaccaggaccugu

SEQ ID NO: 828096 - RNA, 22 nt, Human
acuuggcaaguaucuauaaagu

SEQ ID NO: 828097 - RNA, 22 nt, Human
uucugaaccauugagcacugcc

SEQ ID NO: 828098 - RNA, 22 nt, Human
caggcagggagcuggaaaggau

SEQ ID NO: 828099 - RNA, 22 nt, Human
uuuuuggguccaggcuguaucu

SEQ ID NO: 828100 - RNA, 22 nt, Human
uccauuuucuugcucuagguaa

SEQ ID NO: 828101 - RNA, 21 nt, Human
auacauucuauuaagcauuua

SEQ ID NO: 828102 - RNA, 21 nt, Human
agaggcaggcauuaaguacac

SEQ ID NO: 828103 - RNA, 22 nt, Human
gucaggaucucccaguacauau

SEQ ID NO: 828104 - RNA, 22 nt, Human
cauuuguuaaccaguguggauu

SEQ ID NO: 828105 - RNA, 22 nt, Human
agacaggaugcauacucuuggu

SEQ ID NO: 828106 - RNA, 22 nt, Human
ucugcaggcuuggaguggcagc

SEQ ID NO: 828107 - RNA, 22 nt, Human
uucagcaagaccaccauguacc

SEQ ID NO: 828108 - RNA, 22 nt, Human
cugcugugcauauuuaucuagg

SEQ ID NO: 828109 - RNA, 22 nt, Human
gaaucucaaggcuugugaggau

SEQ ID NO: 828110 - RNA, 22 nt, Human
ggaggaggggugacugaaugcu

SEQ ID NO: 828111 - RNA, 22 nt, Human
augcuuuuaugucacaugguca

SEQ ID NO: 828112 - RNA, 22 nt, Human
acaguacauaauccugagucug

SEQ ID NO: 828113 - RNA, 22 nt, Human
aauauuguuucaagaucacaga

SEQ ID NO: 828114 - RNA, 22 nt, Human
gggagacacgcugcaggcauaa

SEQ ID NO: 828115 - RNA, 22 nt, Human
uaaggccagcaugaaugcagca

SEQ ID NO: 828116 - RNA, 22 nt, Human
gucaggaugggcagccaaacua

SEQ ID NO: 828117 - RNA, 22 nt, Human
ucaucuugcugccauugcuuua

SEQ ID NO: 828118 - RNA, 22 nt, Human
ucuuagaaugucaacugauguu

SEQ ID NO: 828119 - RNA, 22 nt, Human
ggcaggcucagcagccaaggag

SEQ ID NO: 828120 - RNA, 22 nt, Human
aaaggaagauugagcuuuucca

SEQ ID NO: 828121 - RNA, 22 nt, Human
ugcuuucaaaggcuuucuagau

SEQ ID NO: 828122 - RNA, 22 nt, Human
cuugggaaugcuaacagaugac

SEQ ID NO: 828123 - RNA, 22 nt, Human
ucagugcacagagauuuuuguu

SEQ ID NO: 828124 - RNA, 19 nt, Human
ggucagcugggcuagaggc

SEQ ID NO: 828125 - RNA, 22 nt, Human
uuuacuuuugguaaggucauuu

SEQ ID NO: 828126 - RNA, 22 nt, Human
aggcuggagggcaauggcaaga

SEQ ID NO: 828127 - RNA, 22 nt, Human
gcagggaagacccggagcagcg

SEQ ID NO: 828128 - RNA, 22 nt, Human
ugaggcaggagaaucaccggaa

SEQ ID NO: 828129 - RNA, 20 nt, Human
augugucuguaaacaacucu

SEQ ID NO: 828130 - RNA, 22 nt, Human
ccuggagauuucuucaagcuuu

SEQ ID NO: 828131 - RNA, 22 nt, Human
ucugaaggugcuagagaaagcu

SEQ ID NO: 828132 - RNA, 22 nt, Human
aguccaaggagagacagcauuu

SEQ ID NO: 828133 - RNA, 22 nt, Human
uaucuguuccaggcacucagcu

SEQ ID NO: 828134 - RNA, 22 nt, Human
cucuucuuuaguccagaccauc

SEQ ID NO: 828135 - RNA, 22 nt, Human
cauuuguauguuccuccuuagg

SEQ ID NO: 828136 - RNA, 22 nt, Human
aucugccugagucuagguuuuc

SEQ ID NO: 828137 - RNA, 18 nt, Human
gagucuuuguuacugcug

SEQ ID NO: 828138 - RNA, 22 nt, Human
auacauauaugguacuuccugg

SEQ ID NO: 828139 - RNA, 22 nt, Human
aaauuguugaucuacaguaagg

SEQ ID NO: 828140 - RNA, 22 nt, Human
aagaggagacuucagcaacuug

SEQ ID NO: 828141 - RNA, 22 nt, Human
uagcuaucuguguccagaucca

SEQ ID NO: 828142 - RNA, 22 nt, Human
auucuucagaauaucuggcacu

SEQ ID NO: 828143 - RNA, 22 nt, Human
aagcaaaggcaggagcuuguga

SEQ ID NO: 828144 - RNA, 22 nt, Human
auggaaagugcauggaagucau

SEQ ID NO: 828145 - RNA, 22 nt, Human
uagcuuuccuuguugccugugc

SEQ ID NO: 828146 - RNA, 22 nt, Human
gacccaggguggucaccugaaa

SEQ ID NO: 828147 - RNA, 22 nt, Human
auuuaaauuuucugauggagag

SEQ ID NO: 828148 - RNA, 22 nt, Human
ccauuguaaauucuguggaagu

SEQ ID NO: 828149 - RNA, 22 nt, Human
aaucuguuuaguucugcguaug

SEQ ID NO: 828150 - RNA, 22 nt, Human
cucuggcuucuaccuugcaguu

SEQ ID NO: 828151 - RNA, 22 nt, Human
cagcuagcuaagaaggccagag

SEQ ID NO: 828152 - RNA, 22 nt, Human
acaguggagaaggcaugaggcu

SEQ ID NO: 828153 - RNA, 22 nt, Human
gaggagagagggacugucugca

SEQ ID NO: 828154 - RNA, 22 nt, Human
gcagaggcuguagggaagguug

SEQ ID NO: 828155 - RNA, 23 nt, Human
uuuauccaacucuguaaucucuc

SEQ ID NO: 828156 - RNA, 17 nt, Human
gccucugcuugugucau

SEQ ID NO: 828157 - RNA, 22 nt, Human
ggccagcucugcacagcagcug

SEQ ID NO: 828158 - RNA, 22 nt, Human
uucaggauggcggauguugggg

SEQ ID NO: 828159 - RNA, 22 nt, Human
cauucauuagaauagauaugua

SEQ ID NO: 828160 - RNA, 22 nt, Human
ggacagcucugccaggagcuca

SEQ ID NO: 828161 - RNA, 22 nt, Human
gaauauuuuuaaagggacuaau

SEQ ID NO: 828162 - RNA, 22 nt, Human
gcugccagcuuuccuuggcuga

SEQ ID NO: 828163 - RNA, 22 nt, Human
gcaggggcuaaggacacagaga

SEQ ID NO: 828164 - RNA, 22 nt, Human
uaaggccaaggggccauagucu

SEQ ID NO: 828165 - RNA, 22 nt, Human
uucuucuuuccuauaauuaauu

SEQ ID NO: 828166 - RNA, 22 nt, Human
aacuagucagugauucucagaa

SEQ ID NO: 828167 - RNA, 22 nt, Human
aggggagguggcagaaaugugc

SEQ ID NO: 828168 - RNA, 19 nt, Human
uccaggaggcugccauuga

SEQ ID NO: 828169 - RNA, 22 nt, Human
uuugcaguuucauugcugaaau

SEQ ID NO: 828170 - RNA, 22 nt, Human
ggaggggagguccagcugaucu

SEQ ID NO: 828171 - RNA, 22 nt, Human
cucagagaggcaguggaaguca

SEQ ID NO: 828172 - RNA, 22 nt, Human
acacaaguucuaaagauugcgc

SEQ ID NO: 828173 - RNA, 22 nt, Human
aggcaguuguugcugagcagcu

SEQ ID NO: 828174 - RNA, 22 nt, Human
gcucccaggcauggagguaauu

SEQ ID NO: 828175 - RNA, 22 nt, Human
agaaaugacaagacugaucagg

SEQ ID NO: 828176 - RNA, 22 nt, Human
aggcagcaugggccccagcucc

SEQ ID NO: 828177 - RNA, 22 nt, Human
cugcacaguuugauuucuugcu

SEQ ID NO: 828178 - RNA, 22 nt, Human
uuuaucuuuaggacuuugcaga

SEQ ID NO: 828179 - RNA, 22 nt, Human
gcugcugucacggugcuaaggg

SEQ ID NO: 828180 - RNA, 22 nt, Human
ucugcuguauuagguugaacug

SEQ ID NO: 828181 - RNA, 19 nt, Human
caggagagcaugcacuuug

SEQ ID NO: 828182 - RNA, 22 nt, Human
uauguguuugacacccugcaag

SEQ ID NO: 828183 - RNA, 22 nt, Human
cuuucauucuuagauauuagug

SEQ ID NO: 828184 - RNA, 22 nt, Human
ucccaggaugaagacaguguug

SEQ ID NO: 828185 - RNA, 22 nt, Human
gaaacuguauguaguuuuuggg

SEQ ID NO: 828186 - RNA, 22 nt, Human
uucuacaugguugcucagaggg

SEQ ID NO: 828187 - RNA, 22 nt, Human
cagcucccgccaucgggaggca

SEQ ID NO: 828188 - RNA, 22 nt, Human
ucuuccaagguugcacacuauc

SEQ ID NO: 828189 - RNA, 22 nt, Human
gagugcagaugccagccccagu

SEQ ID NO: 828190 - RNA, 20 nt, Human
cccaggagcugugccccauc

SEQ ID NO: 828191 - RNA, 22 nt, Human
agagggcagggcgguaaguccu

SEQ ID NO: 828192 - RNA, 22 nt, Human
ugaaaugacaaagguuuuucuu

SEQ ID NO: 828193 - RNA, 22 nt, Human
uuuggacuuagccugcagaauu

SEQ ID NO: 828194 - RNA, 22 nt, Human
agggcagccauugagggauucu

SEQ ID NO: 828195 - RNA, 22 nt, Human
ucugggaaccagugcggcuggg

SEQ ID NO: 828196 - RNA, 22 nt, Human
gcuggcuugauaguuucugcuu

SEQ ID NO: 828197 - RNA, 17 nt, Human
gcuguaguuugauaaga

SEQ ID NO: 828198 - RNA, 22 nt, Human
cugccaggcagggagauggcug

SEQ ID NO: 828199 - RNA, 22 nt, Human
ucucagucuuugcaaggaugcu

SEQ ID NO: 828200 - RNA, 22 nt, Human
auaaaugauucagcaggaaaua

SEQ ID NO: 828201 - RNA, 18 nt, Human
ggucuuuaggucaguguc

SEQ ID NO: 828202 - RNA, 19 nt, Human
uuugaaaggauuguuauuu

SEQ ID NO: 828203 - RNA, 22 nt, Human
auguuucaccaguuuuauaaga

SEQ ID NO: 828204 - RNA, 22 nt, Human
uucuucaaugugcccuguuuuc

SEQ ID NO: 828205 - RNA, 22 nt, Human
ugcugcuguauccuuaguguca

SEQ ID NO: 828206 - RNA, 22 nt, Human
ucucaggagccacagcgggagu

SEQ ID NO: 828207 - RNA, 22 nt, Human
gaaauuauugcuagagacugca

SEQ ID NO: 828208 - RNA, 22 nt, Human
ugcccaggauugugaggucagg

SEQ ID NO: 828209 - RNA, 22 nt, Human
ugagacaguuuuucuauuucca

SEQ ID NO: 828210 - RNA, 22 nt, Human
cugcagagcaaguaacauccuc

SEQ ID NO: 828211 - RNA, 22 nt, Human
uccaggagguaugaguggcccc

SEQ ID NO: 828212 - RNA, 22 nt, Human
ggcagcuguaagaugagugaau

SEQ ID NO: 828213 - RNA, 22 nt, Human
ucgcugugguuucuguacaugg

SEQ ID NO: 828214 - RNA, 22 nt, Human
cauuuuaagaugaccugguuuc

SEQ ID NO: 828215 - RNA, 22 nt, Human
uggaaggaagccaaggaagguu

SEQ ID NO: 828216 - RNA, 22 nt, Human
uccauuuucaucucauguauaa

SEQ ID NO: 828217 - RNA, 22 nt, Human
acaccauacucauguugguucc

SEQ ID NO: 828218 - RNA, 22 nt, Human
aagcgccaugguuccugcgcag

SEQ ID NO: 828219 - RNA, 22 nt, Human
gagagaggccuccauguacuga

SEQ ID NO: 828220 - RNA, 21 nt, Human
ucacuagugccuucugucauu

SEQ ID NO: 828221 - RNA, 20 nt, Human
cccaggaguuugcucuuacu

SEQ ID NO: 828222 - RNA, 22 nt, Human
ugaauaguccuuggaauaacug

SEQ ID NO: 828223 - RNA, 22 nt, Human
uuugcagugucagcuucugugu

SEQ ID NO: 828224 - RNA, 22 nt, Human
agugcuguaacaacuuauuugg

SEQ ID NO: 828225 - RNA, 23 nt, Human
aaauuauugcucuucaauugccu

SEQ ID NO: 828226 - RNA, 22 nt, Human
uucacagacuuuccauagauug

SEQ ID NO: 828227 - RNA, 22 nt, Human
ugcaggaaauuccaggguggcc

SEQ ID NO: 828228 - RNA, 22 nt, Human
agcacauucugccuugcuuugc

SEQ ID NO: 828229 - RNA, 22 nt, Human
uacucagagucauugcccuucu

SEQ ID NO: 828230 - RNA, 22 nt, Human
uccaugaguuugaggaaaagag

SEQ ID NO: 828231 - RNA, 18 nt, Human
aguaaagcuuauuacaug

SEQ ID NO: 828232 - RNA, 22 nt, Human
uuggaauucaaguuguagcuua

SEQ ID NO: 828233 - RNA, 22 nt, Human
uggaaggaaagguagcagagaa

SEQ ID NO: 828234 - RNA, 22 nt, Human
gauguguuuccaggauuuguuu

SEQ ID NO: 828235 - RNA, 22 nt, Human
uauuugcaacauaaaacucuga

SEQ ID NO: 828236 - RNA, 22 nt, Human
caggcagcagccacucugguau

SEQ ID NO: 828237 - RNA, 22 nt, Human
cugcccaggaaccagaggggca

SEQ ID NO: 828238 - RNA, 22 nt, Human
aacauacauauuucagugucca

SEQ ID NO: 828239 - RNA, 22 nt, Human
cacugagcugauagaauuccag

SEQ ID NO: 828240 - RNA, 22 nt, Human
ucaaauaccagcaauuucaugu

SEQ ID NO: 828241 - RNA, 22 nt, Human
cccaggaggguggccucugccc

SEQ ID NO: 828242 - RNA, 19 nt, Human
uggcaucuguaaaauggug

SEQ ID NO: 828243 - RNA, 22 nt, Human
aggaagcuccaugaaggcagag

SEQ ID NO: 828244 - RNA, 22 nt, Human
gaggccagggaugcaaugagag

SEQ ID NO: 828245 - RNA, 19 nt, Human
cuugcugggugguuucugc

SEQ ID NO: 828246 - RNA, 20 nt, Human
ucucuucuggggagauaaaa

SEQ ID NO: 828247 - RNA, 22 nt, Human
augcugugucaggaauuugaua

SEQ ID NO: 828248 - RNA, 22 nt, Human
uaucuguuggcuccuaguugua

SEQ ID NO: 828249 - RNA, 22 nt, Human
ugcuggguagaaguauuagucu

SEQ ID NO: 828250 - RNA, 22 nt, Human
cucuucuuggcccccaugaggg

SEQ ID NO: 828251 - RNA, 22 nt, Human
accaggaggcuacacuguccca

SEQ ID NO: 828252 - RNA, 23 nt, Human
cccauuuucauguuaacuccugg

SEQ ID NO: 828253 - RNA, 22 nt, Human
ucuuugcaggccaaauuguuaa

SEQ ID NO: 828254 - RNA, 22 nt, Human
gaggaggcacuugagcagaugu

SEQ ID NO: 828255 - RNA, 22 nt, Human
augcugugucuagcaggaacac

SEQ ID NO: 828256 - RNA, 22 nt, Human
auugaaagguuuugagcagaua

SEQ ID NO: 828257 - RNA, 22 nt, Human
gucaggauuuuaaaaucccagu

SEQ ID NO: 828258 - RNA, 22 nt, Human
aguauugugacucaaguauucu

SEQ ID NO: 828259 - RNA, 22 nt, Human
cuugaaagcuuugcgucuucua

SEQ ID NO: 828260 - RNA, 22 nt, Human
augcuguguggccaccuccaug

SEQ ID NO: 828261 - RNA, 22 nt, Human
gggcacagaagucuaagacauc

SEQ ID NO: 828262 - RNA, 22 nt, Human
aaggcagcacagcaacugcuca

SEQ ID NO: 828263 - RNA, 19 nt, Human
uuucccagcccuugcugug

SEQ ID NO: 828264 - RNA, 22 nt, Human
aucaggaucaugcuggguggga

SEQ ID NO: 828265 - RNA, 22 nt, Human
gaggagagaacauuccuccaua

SEQ ID NO: 828266 - RNA, 22 nt, Human
aggcagcuggaggcagagacua

SEQ ID NO: 828267 - RNA, 22 nt, Human
uguggaaaagaauaagggagau

SEQ ID NO: 828268 - RNA, 22 nt, Human
uacccaggggcugagcagaggu

SEQ ID NO: 828269 - RNA, 22 nt, Human
cauuuucaugaguuucuguuca

SEQ ID NO: 828270 - RNA, 22 nt, Human
ucugaacuccagcccugcucuc

SEQ ID NO: 828271 - RNA, 22 nt, Human
uuucaucuuccuuggcauaggu

SEQ ID NO: 828272 - RNA, 22 nt, Human
uugcugaaaucuaugacauccu

SEQ ID NO: 828273 - RNA, 22 nt, Human
auugaaaggcaaaguaggaagc

SEQ ID NO: 828274 - RNA, 23 nt, Human
uucuucucaauuaguugauucag

SEQ ID NO: 828275 - RNA, 22 nt, Human
gcuggcagggacagcugcgugu

SEQ ID NO: 828276 - RNA, 19 nt, Human
aaaaacuuaguccagaaag

SEQ ID NO: 828277 - RNA, 22 nt, Human
gaucauuuugaugcccuuuuag

SEQ ID NO: 828278 - RNA, 22 nt, Human
cugcuuugacuguuaagaacca

SEQ ID NO: 828279 - RNA, 22 nt, Human
ugaaaugaaacagaacauauca

SEQ ID NO: 828280 - RNA, 22 nt, Human
caggauggucuucauuuggcuc

SEQ ID NO: 828281 - RNA, 22 nt, Human
cuucuucaaccugaaaguuuca

SEQ ID NO: 828282 - RNA, 22 nt, Human
ugucuuuggaauauuuagcuga

SEQ ID NO: 828283 - RNA, 22 nt, Human
gaggcagagugcaccccaggag

SEQ ID NO: 828284 - RNA, 19 nt, Human
uucauucuuucuacuuacc

SEQ ID NO: 828285 - RNA, 22 nt, Human
ugaggggagguuggggcacauc

SEQ ID NO: 828286 - RNA, 22 nt, Human
ucuguggauuuuaguguucaug

SEQ ID NO: 828287 - RNA, 23 nt, Human
cccaggagccugaguccucucug

SEQ ID NO: 828288 - RNA, 21 nt, Human
uccaggagcacgggacuagga

SEQ ID NO: 828289 - RNA, 23 nt, Human
uugcauagacauccucauagauu

SEQ ID NO: 828290 - RNA, 22 nt, Human
guggaaugaauagauuugcauu

SEQ ID NO: 828291 - RNA, 22 nt, Human
aagacugugucuauggcuacuc

SEQ ID NO: 828292 - RNA, 22 nt, Human
uagcccagcaugagcagagcug

SEQ ID NO: 828293 - RNA, 22 nt, Human
uucugagacaauugagagucua

SEQ ID NO: 828294 - RNA, 22 nt, Human
ggccagaggugguacauagcuu

SEQ ID NO: 828295 - RNA, 22 nt, Human
uugcauuuaaguagauguuaca

SEQ ID NO: 828296 - RNA, 22 nt, Human
uucuguaauucuguuaguuuca

SEQ ID NO: 828297 - RNA, 22 nt, Human
auccauuugccgugcuaugugc

SEQ ID NO: 828298 - RNA, 22 nt, Human
uugggauuacagguguaagcca

SEQ ID NO: 828299 - RNA, 22 nt, Human
ugugagauuuuauuugauaugc

SEQ ID NO: 828300 - RNA, 22 nt, Human
gcuuuugagguccugcucagcc

SEQ ID NO: 828301 - RNA, 22 nt, Human
gaagaaguguaagucuguuuca

SEQ ID NO: 828302 - RNA, 22 nt, Human
uuccuggugguggugacagcac

SEQ ID NO: 828303 - RNA, 22 nt, Human
aguguucuagcgcugugcuugu

SEQ ID NO: 828304 - RNA, 22 nt, Human
aauaucuagccuuuagcagcuu

SEQ ID NO: 828305 - RNA, 22 nt, Human
augauuuguuaacagacuuaau

SEQ ID NO: 828306 - RNA, 22 nt, Human
gugauuuucuccuccuagaagu

SEQ ID NO: 828307 - RNA, 22 nt, Human
aguuggcauuuuauuuaaguau

SEQ ID NO: 828308 - RNA, 22 nt, Human
ugucuuacagcaaucuguucug

SEQ ID NO: 828309 - RNA, 22 nt, Human
auucugcugccuaguuuaugaa

SEQ ID NO: 828310 - RNA, 22 nt, Human
acauuucuccuacuuguuauuu

SEQ ID NO: 828311 - RNA, 22 nt, Human
auauaugaagaagucuugauua

SEQ ID NO: 828312 - RNA, 22 nt, Human
cccuugggcuucagcccuaccg

SEQ ID NO: 828313 - RNA, 22 nt, Human
uaucuuugguagcuuuccuaag

SEQ ID NO: 828314 - RNA, 23 nt, Human
acugccugugccgaucucucuca

SEQ ID NO: 828315 - RNA, 22 nt, Human
cucugguuucgcaggaaauaga

SEQ ID NO: 828316 - RNA, 22 nt, Human
cuuauuugcccauguuucuuua

SEQ ID NO: 828317 - RNA, 22 nt, Human
auauaguuggguuucauucuac

SEQ ID NO: 828318 - RNA, 22 nt, Human
uuuguguuguacuucugugcau

SEQ ID NO: 828319 - RNA, 16 nt, Human
ucucugcuucauaggu

SEQ ID NO: 828320 - RNA, 22 nt, Human
aauggagugguucuugcccucu

SEQ ID NO: 828321 - RNA, 22 nt, Human
guugggcugaagugugugcuua

SEQ ID NO: 828322 - RNA, 22 nt, Human
auuuccuauacaguuguccaua

SEQ ID NO: 828323 - RNA, 23 nt, Human
cauuugauccucacaauaaaugg

SEQ ID NO: 828324 - RNA, 22 nt, Human
agacaagagcugaggacauauu

SEQ ID NO: 828325 - RNA, 22 nt, Human
uuuggauugcuuggaugcuucg

SEQ ID NO: 828326 - RNA, 22 nt, Human
uugaugcugucuuucagaauca

SEQ ID NO: 828327 - RNA, 22 nt, Human
uaucaguccaggguuuugugac

SEQ ID NO: 828328 - RNA, 22 nt, Human
aauguuaaguuuagauuauaac

SEQ ID NO: 828329 - RNA, 22 nt, Human
ucucauuuacuuccacaggcug

SEQ ID NO: 828330 - RNA, 22 nt, Human
auauuuguuuggcagaguucag

SEQ ID NO: 828331 - RNA, 19 nt, Human
ugcucucuggugcuucaug

SEQ ID NO: 828332 - RNA, 22 nt, Human
caaagaugccaaaaggaagaca

SEQ ID NO: 828333 - RNA, 22 nt, Human
agaaaagaggcuuucuaagcau

SEQ ID NO: 828334 - RNA, 22 nt, Human
ugauucaguacuuucucuaacu

SEQ ID NO: 828335 - RNA, 22 nt, Human
auccauuuuuucagaaugcucu

SEQ ID NO: 828336 - RNA, 22 nt, Human
uagauucugacccucuuuuuac

SEQ ID NO: 828337 - RNA, 22 nt, Human
uucagauaagucaaguuaguau

SEQ ID NO: 828338 - RNA, 22 nt, Human
cugggcuccuaaccauccaggu

SEQ ID NO: 828339 - RNA, 22 nt, Human
uuuccuacugcccuauacacac

SEQ ID NO: 828340 - RNA, 22 nt, Human
acauauuuugaaagcuuucuaa

SEQ ID NO: 828341 - RNA, 22 nt, Human
cuuguuuucuucugcagucuau

SEQ ID NO: 828342 - RNA, 22 nt, Human
gucauuuuugacuuugaaguga

SEQ ID NO: 828343 - RNA, 22 nt, Human
ugucauauagaauguucuauga

SEQ ID NO: 828344 - RNA, 22 nt, Human
uauuacaguucgaguuucuagg

SEQ ID NO: 828345 - RNA, 22 nt, Human
ugcaugguuauauacuacuagu

SEQ ID NO: 828346 - RNA, 22 nt, Human
cuugggcuuagaagguaaguga

SEQ ID NO: 828347 - RNA, 20 nt, Human
ucuuuuauuggcagauccug

SEQ ID NO: 828348 - RNA, 17 nt, Human
aguuuuuggaccugugu

SEQ ID NO: 828349 - RNA, 20 nt, Human
auuugcuuaccuuguuucua

SEQ ID NO: 828350 - RNA, 22 nt, Human
uacauguuauuucacuauuggu

SEQ ID NO: 828351 - RNA, 22 nt, Human
ucaucuguuaugggaguuuuug

SEQ ID NO: 828352 - RNA, 22 nt, Human
acauuguugagccucuuguuca

SEQ ID NO: 828353 - RNA, 22 nt, Human
uuuguugguugcacuggugggu

SEQ ID NO: 828354 - RNA, 22 nt, Human
uaucuguauucugacagucacu

SEQ ID NO: 828355 - RNA, 22 nt, Human
ugguuuguauauguuugugaga

SEQ ID NO: 828356 - RNA, 17 nt, Human
uuuguucguuaguccgg

SEQ ID NO: 828357 - RNA, 22 nt, Human
uuucauguuggauacuguuuca

SEQ ID NO: 828358 - RNA, 19 nt, Human
uugcuucaugucuuuugcu

SEQ ID NO: 828359 - RNA, 22 nt, Human
uuauuuuguagcucugaucuuu

SEQ ID NO: 828360 - RNA, 22 nt, Human
ucauggaugauagcuucauugc

SEQ ID NO: 828361 - RNA, 22 nt, Human
ucucucugcagcccgggacacu

SEQ ID NO: 828362 - RNA, 22 nt, Human
cugaucuuaaguaacauuauuu

SEQ ID NO: 828363 - RNA, 22 nt, Human
cuucuucagaggccagccucug

SEQ ID NO: 828364 - RNA, 22 nt, Human
uucugauuguuggaggaugcuu

SEQ ID NO: 828365 - RNA, 22 nt, Human
auguuuguguuucccauucagg

SEQ ID NO: 828366 - RNA, 22 nt, Human
uugagauagguggaaucucuuu

SEQ ID NO: 828367 - RNA, 22 nt, Human
gucccauaaguagugcaacuug

SEQ ID NO: 828368 - RNA, 23 nt, Human
uuguucuuggaucuuccugaagc

SEQ ID NO: 828369 - RNA, 22 nt, Human
ucaaagaucagaugguuguagg

SEQ ID NO: 828370 - RNA, 22 nt, Human
cucugugaaccccuccuuucuu

SEQ ID NO: 828371 - RNA, 22 nt, Human
uuuugguaauuaaguagauauu

SEQ ID NO: 828372 - RNA, 20 nt, Human
uacaauauucccacuuugcu

SEQ ID NO: 828373 - RNA, 22 nt, Human
uguauuucugcuuucucuagua

SEQ ID NO: 828374 - RNA, 22 nt, Human
uacuuugucauucuaaccuucc

SEQ ID NO: 828375 - RNA, 22 nt, Human
gagaaagggaacuuacagagug

SEQ ID NO: 828376 - RNA, 22 nt, Human
guaauucugugugaaucuauua

SEQ ID NO: 828377 - RNA, 22 nt, Human
uuuguaguuguggaugcugaag

SEQ ID NO: 828378 - RNA, 23 nt, Human
aguguucagcauguaguaaauac

SEQ ID NO: 828379 - RNA, 22 nt, Human
ugcucccaggcauucucuguug

SEQ ID NO: 828380 - RNA, 22 nt, Human
ucuaauuuuggcauuuuaaccu

SEQ ID NO: 828381 - RNA, 22 nt, Human
guuucuuauuucaacuggaaca

SEQ ID NO: 828382 - RNA, 22 nt, Human
uggguguguccauauuuugacu

SEQ ID NO: 828383 - RNA, 22 nt, Human
ucucugguuauuaacuaacucc

SEQ ID NO: 828384 - RNA, 22 nt, Human
uuaaguauauccauuugacugg

SEQ ID NO: 828385 - RNA, 22 nt, Human
aucauuaacccuugaugcuggg

SEQ ID NO: 828386 - RNA, 22 nt, Human
caguuuuucaaaauuacaugau

SEQ ID NO: 828387 - RNA, 22 nt, Human
cuauuuucccauaugguugaca

SEQ ID NO: 828388 - RNA, 22 nt, Human
uagaagaacaugucaaacuaua

SEQ ID NO: 828389 - RNA, 22 nt, Human
uaucuguuuuuacagugucuuu

SEQ ID NO: 828390 - RNA, 22 nt, Human
ugauuugaaaccuuuggcaaga

SEQ ID NO: 828391 - RNA, 22 nt, Human
uguauauacacacucccauguu

SEQ ID NO: 828392 - RNA, 22 nt, Human
guauuucuuuacauaugcucau

SEQ ID NO: 828393 - RNA, 22 nt, Human
guguuuugugaggccuucuuuc

SEQ ID NO: 828394 - RNA, 19 nt, Human
auucuucucuuccugcugu

SEQ ID NO: 828395 - RNA, 22 nt, Human
uugucucuacagagaguaguag

SEQ ID NO: 828396 - RNA, 22 nt, Human
ucacuguuaauaaauagcaaag

SEQ ID NO: 828397 - RNA, 22 nt, Human
accagagcuggcagaguaucaa

SEQ ID NO: 828398 - RNA, 22 nt, Human
auuuggcauaggcagaggccca

SEQ ID NO: 828399 - RNA, 22 nt, Human
uuuacuuuugguaaggucauuu

SEQ ID NO: 828400 - RNA, 22 nt, Human
uuugaacuucuaccugucauau

SEQ ID NO: 828401 - RNA, 22 nt, Human
auauaccucauucuuugagugc

SEQ ID NO: 828402 - RNA, 22 nt, Human
cauuuugugcuagacacuaugg

SEQ ID NO: 828403 - RNA, 22 nt, Human
uuuucuaacaucuaguaauuug

SEQ ID NO: 828404 - RNA, 22 nt, Human
auuugcuuguucaccaguacuu

SEQ ID NO: 828405 - RNA, 22 nt, Human
gaguguuccagaaacuggcccu

SEQ ID NO: 828406 - RNA, 23 nt, Human
cuguuauauggguguuaugugcu

SEQ ID NO: 828407 - RNA, 22 nt, Human
ugcuuguauucauaucacagcu

SEQ ID NO: 828408 - RNA, 22 nt, Human
guuauucuauuaaugugauugu

SEQ ID NO: 828409 - RNA, 22 nt, Human
ugucuguccaucugucugggac

SEQ ID NO: 828410 - RNA, 22 nt, Human
uucuguuuauaauuugcaguug

SEQ ID NO: 828411 - RNA, 22 nt, Human
guuugcaaauuguguuaaagcu

SEQ ID NO: 828412 - RNA, 22 nt, Human
uaauuuugucacagugacaugc

SEQ ID NO: 828413 - RNA, 22 nt, Human
uuccuuggagucaaacagggag

SEQ ID NO: 828414 - RNA, 22 nt, Human
cuucuggguauuccagauaccu

SEQ ID NO: 828415 - RNA, 22 nt, Human
auguuguugaacucuuugcaug

SEQ ID NO: 828416 - RNA, 22 nt, Human
gagaugaagaggcccuuggagu

SEQ ID NO: 828417 - RNA, 22 nt, Human
uugauucugcugaucucggacg

SEQ ID NO: 828418 - RNA, 22 nt, Human
agggcucacuacaacccuggga

SEQ ID NO: 828419 - RNA, 22 nt, Human
uucuuucugggguccuucggcu

SEQ ID NO: 828420 - RNA, 22 nt, Human
caagauauguccuguuacuaag

SEQ ID NO: 828421 - RNA, 22 nt, Human
uagauuaucccugauuugucca

SEQ ID NO: 828422 - RNA, 22 nt, Human
uaggauaugcauuuuuauacau

SEQ ID NO: 828423 - RNA, 22 nt, Human
guuguuuuugaacggugguggc

SEQ ID NO: 828424 - RNA, 22 nt, Human
uucugauugcugaugaggccca

SEQ ID NO: 828425 - RNA, 22 nt, Human
cugguuuuccaauguuuugacu

SEQ ID NO: 828426 - RNA, 22 nt, Human
auggaguugagcucuguugucc

SEQ ID NO: 828427 - RNA, 22 nt, Human
uaaguauguuagaaaaucaagu

SEQ ID NO: 828428 - RNA, 22 nt, Human
uauuaugguuguagguuaacaa

SEQ ID NO: 828429 - RNA, 21 nt, Human
ucagcuugcuucauuauuaug

SEQ ID NO: 828430 - RNA, 22 nt, Human
ccuaugaaagacaggagaugcg

SEQ ID NO: 828431 - RNA, 22 nt, Human
ccuuuguucacuggagagugga

SEQ ID NO: 828432 - RNA, 22 nt, Human
ucuuucagaaacuuugucugcg

SEQ ID NO: 828433 - RNA, 23 nt, Human
gccagagcugccugcccuugcug

SEQ ID NO: 828434 - RNA, 22 nt, Human
uucucugaguacguuucagugu

SEQ ID NO: 828435 - RNA, 18 nt, Human
uuugggauccucuuuucu

SEQ ID NO: 828436 - RNA, 22 nt, Human
ugcugugagaccauuuguugag

SEQ ID NO: 828437 - RNA, 22 nt, Human
cuucucuuggguguggugucuu

SEQ ID NO: 828438 - RNA, 22 nt, Human
gucuguccacuuggaagcuccc

SEQ ID NO: 828439 - RNA, 22 nt, Human
cuugucuaguuccuggugaugu

SEQ ID NO: 828440 - RNA, 22 nt, Human
gugcagcugggcgcugaccuuc

SEQ ID NO: 828441 - RNA, 22 nt, Human
gcagcuuuggagguggaacucu

SEQ ID NO: 828442 - RNA, 22 nt, Human
uuccuuacauucauauggcuuc

SEQ ID NO: 828443 - RNA, 22 nt, Human
ucuugggcaauuucucuagagg

SEQ ID NO: 828444 - RNA, 22 nt, Human
agggcucagaaagcagguuuuc

SEQ ID NO: 828445 - RNA, 23 nt, Human
aacucuggcuagcauagaauaga

SEQ ID NO: 828446 - RNA, 22 nt, Human
ucauuguuucugcuuuucauga

SEQ ID NO: 828447 - RNA, 22 nt, Human
uguuugcucugacuaucuugcg

SEQ ID NO: 828448 - RNA, 22 nt, Human
gcauaaaggacuauaaggauca

SEQ ID NO: 828449 - RNA, 22 nt, Human
uugacuauacucuggcggaaaa

SEQ ID NO: 828450 - RNA, 23 nt, Human
uaucauuucagcucucugccugg

SEQ ID NO: 828451 - RNA, 22 nt, Human
cacaguuuuaucuuauacugau

SEQ ID NO: 828452 - RNA, 22 nt, Human
uaucuguagucucaugguuccu

SEQ ID NO: 828453 - RNA, 22 nt, Human
uaucacauacuucucauccagg

SEQ ID NO: 828454 - RNA, 22 nt, Human
gagaggaagccuucuguacuug

SEQ ID NO: 828455 - RNA, 22 nt, Human
gugguuguuuccagguuugaaa

SEQ ID NO: 828456 - RNA, 22 nt, Human
uuuugucagugagaacagaguu

SEQ ID NO: 828457 - RNA, 22 nt, Human
agauaucuuacacuuugaaguu

SEQ ID NO: 828458 - RNA, 22 nt, Human
aauuauugagcaucuacugugu

SEQ ID NO: 828459 - RNA, 22 nt, Human
aucauuugaacagaauuuguuu

SEQ ID NO: 828460 - RNA, 22 nt, Human
guacauauccuuuacguuuugu

SEQ ID NO: 828461 - RNA, 22 nt, Human
ucucuguaagcugccuucucgu

SEQ ID NO: 828462 - RNA, 22 nt, Human
uuuacuguuuacagcuaaugca

SEQ ID NO: 828463 - RNA, 22 nt, Human
agagaagagucuugucaaauua

SEQ ID NO: 828464 - RNA, 22 nt, Human
agauaaaguccaaacuguguag

SEQ ID NO: 828465 - RNA, 22 nt, Human
uuuggucuggaaucuucagggu

SEQ ID NO: 828466 - RNA, 22 nt, Human
gaauuguacugcaaucagggga

SEQ ID NO: 828467 - RNA, 18 nt, Human
agguauaugaaucucuuu

SEQ ID NO: 828468 - RNA, 22 nt, Human
uugauuugauuguaauggcucu

SEQ ID NO: 828469 - RNA, 22 nt, Human
cauuuuccucugcugguguuca

SEQ ID NO: 828470 - RNA, 22 nt, Human
uaucauuuuacugugacauuuu

SEQ ID NO: 828471 - RNA, 22 nt, Human
uucucucaguuaaacuuuguga

SEQ ID NO: 828472 - RNA, 22 nt, Human
cuuucuuucgaagacgugauua

SEQ ID NO: 828473 - RNA, 22 nt, Human
uuucauuauaaaaaguuggcuu

SEQ ID NO: 828474 - RNA, 22 nt, Human
uuguauuaaaauguguuucugu

SEQ ID NO: 828475 - RNA, 22 nt, Human
gagguauaguucuauuagauga

SEQ ID NO: 828476 - RNA, 22 nt, Human
uacucugcaggauggacuaugg

SEQ ID NO: 828477 - RNA, 22 nt, Human
aagauuuaccacuuuauucaag

SEQ ID NO: 828478 - RNA, 22 nt, Human
uucauugauuuccuuggaauaa

SEQ ID NO: 828479 - RNA, 22 nt, Human
uuugggcuguacaauuucugua

SEQ ID NO: 828480 - RNA, 22 nt, Human
ugugugaacucucugauguaca

SEQ ID NO: 828481 - RNA, 22 nt, Human
gugauuucagguuuuucauacu

SEQ ID NO: 828482 - RNA, 22 nt, Human
augugauacuccuucuagugga

SEQ ID NO: 828483 - RNA, 22 nt, Human
uaaggcuguuaggaggauuaaa

SEQ ID NO: 828484 - RNA, 22 nt, Human
aggcuuaacuacaauuuuugcc

SEQ ID NO: 828485 - RNA, 23 nt, Human
uuaagacuggcugaacuuaguag

SEQ ID NO: 828486 - RNA, 22 nt, Human
cagcuuguuuacaugcuuauuc

SEQ ID NO: 828487 - RNA, 22 nt, Human
aauaucaucucucuuuucugca

SEQ ID NO: 828488 - RNA, 22 nt, Human
cuugggcaggggaaacagcugc

SEQ ID NO: 828489 - RNA, 22 nt, Human
augcuacauuuugguuuauaaa

SEQ ID NO: 828490 - RNA, 22 nt, Human
ugcucuguucaguguaucuugu

SEQ ID NO: 828491 - RNA, 22 nt, Human
caaguaugagaaagcuauuacc

SEQ ID NO: 828492 - RNA, 22 nt, Human
auuguauacaagcuuaauuguu

SEQ ID NO: 828493 - RNA, 22 nt, Human
ucucuuugacccuuuagcucca

SEQ ID NO: 828494 - RNA, 22 nt, Human
gcagagcacccugcagugguau

SEQ ID NO: 828495 - RNA, 22 nt, Human
augguuuuguccucuuugguuc

SEQ ID NO: 828496 - RNA, 22 nt, Human
ccucaaaggccuggcaccagaa

SEQ ID NO: 828497 - RNA, 22 nt, Human
uagaucuuucacuacuguguag

SEQ ID NO: 828498 - RNA, 22 nt, Human
ucugcuguuuacugugugauau

SEQ ID NO: 828499 - RNA, 22 nt, Human
acaagauagcuuagaagauuca

SEQ ID NO: 828500 - RNA, 22 nt, Human
ugacuuuggacuagugauuuaa

SEQ ID NO: 828501 - RNA, 22 nt, Human
cgucauuuguaaaugaucaaga

SEQ ID NO: 828502 - RNA, 22 nt, Human
gcaguugcaggauuuguguugu

SEQ ID NO: 828503 - RNA, 22 nt, Human
ucuucaugaaauugauugcuua

SEQ ID NO: 828504 - RNA, 22 nt, Human
ugauaguaucugauuauuucac

SEQ ID NO: 828505 - RNA, 23 nt, Human
aucuguguguggguagggaugau

SEQ ID NO: 828506 - RNA, 20 nt, Human
uuugauugccccucugacuu

SEQ ID NO: 828507 - RNA, 22 nt, Human
cucucuguuaugcuuucaugaa

SEQ ID NO: 828508 - RNA, 17 nt, Human
cauucuguaaucuuucu

SEQ ID NO: 828509 - RNA, 22 nt, Human
guuuuguucaugaacauugggu

SEQ ID NO: 828510 - RNA, 22 nt, Human
cuugaguaaagaaguauuuuag

SEQ ID NO: 828511 - RNA, 23 nt, Human
auuuccuaaaagauaaucauuac

SEQ ID NO: 828512 - RNA, 22 nt, Human
ucugcuugugucuguccagccu

SEQ ID NO: 828513 - RNA, 22 nt, Human
agacauauuggcuugcuuuaau

SEQ ID NO: 828514 - RNA, 22 nt, Human
ucuaugaaccucugcaaugaca

SEQ ID NO: 828515 - RNA, 22 nt, Human
cagucauuaugggaguuaaucc

SEQ ID NO: 828516 - RNA, 22 nt, Human
cuugcuuuaucugguuucucau

SEQ ID NO: 828517 - RNA, 22 nt, Human
uuuuguguugccauguuaagca

SEQ ID NO: 828518 - RNA, 22 nt, Human
uuuuuugucuugaagaaauggu

SEQ ID NO: 828519 - RNA, 22 nt, Human
caauuuuuaaacuaugaaguug

SEQ ID NO: 828520 - RNA, 22 nt, Human
uuuucuuggaguggcuguccuu

SEQ ID NO: 828521 - RNA, 22 nt, Human
cacuguuuuacauguuauuuaa

SEQ ID NO: 828522 - RNA, 22 nt, Human
aagcagaaaaacugagcuccaa

SEQ ID NO: 828523 - RNA, 22 nt, Human
cucucuuuuucgugugccgaag

SEQ ID NO: 828524 - RNA, 22 nt, Human
uuaagagaagaguaucuagaac

SEQ ID NO: 828525 - RNA, 22 nt, Human
gagagaagggggauaugagccu

SEQ ID NO: 828526 - RNA, 22 nt, Human
cuccuuggguucuuucgguucc

SEQ ID NO: 828527 - RNA, 22 nt, Human
cuaguuuuaagcuccuugaggu

SEQ ID NO: 828528 - RNA, 22 nt, Human
cuagagaaaaagcuuagguacg

SEQ ID NO: 828529 - RNA, 22 nt, Human
cccauugugguuguugaggaua

SEQ ID NO: 828530 - RNA, 22 nt, Human
uguuggcagugcuacagucagu

SEQ ID NO: 828531 - RNA, 22 nt, Human
uuuguguuggaagaaaugcuac

SEQ ID NO: 828532 - RNA, 22 nt, Human
uuugacaugugcuuauaacuuu

SEQ ID NO: 828533 - RNA, 22 nt, Human
cuuguauuaggaagaaugcuuu

SEQ ID NO: 828534 - RNA, 22 nt, Human
ugugucuuuggcgaugucugga

SEQ ID NO: 828535 - RNA, 22 nt, Human
uucgcuuugcccguugucauuu

SEQ ID NO: 828536 - RNA, 22 nt, Human
cuuugugauaguguuaagacca

SEQ ID NO: 828537 - RNA, 21 nt, Human
uugauuuagcagaucuagcug

SEQ ID NO: 828538 - RNA, 22 nt, Human
cccagagcaugugcugccuuug

SEQ ID NO: 828539 - RNA, 22 nt, Human
uugcaaucagcaguguuuucac

SEQ ID NO: 828540 - RNA, 22 nt, Human
ucuuauugugaugaugaagaac

SEQ ID NO: 828541 - RNA, 22 nt, Human
uuucucuuucaaucugcaguac

SEQ ID NO: 828542 - RNA, 22 nt, Human
ugauuccugugcuuauuccagu

SEQ ID NO: 828543 - RNA, 22 nt, Human
uuucuucucacccaggacagag

SEQ ID NO: 828544 - RNA, 22 nt, Human
uuucuacacuucgugguguuuu

SEQ ID NO: 828545 - RNA, 23 nt, Human
acucugacuuaguuauagcuauu

SEQ ID NO: 828546 - RNA, 22 nt, Human
auacaugugugugcauacaugu

SEQ ID NO: 828547 - RNA, 22 nt, Human
uuauugagcacauaguaugugg

SEQ ID NO: 828548 - RNA, 22 nt, Human
cauuguguauuucuguaguacu

SEQ ID NO: 828549 - RNA, 22 nt, Human
aucaacuuguccuugauguuaa

SEQ ID NO: 828550 - RNA, 22 nt, Human
caauguuuuuccuuccuuaaua

SEQ ID NO: 828551 - RNA, 22 nt, Human
uuccuuggaaagagacgucgcu

SEQ ID NO: 828552 - RNA, 22 nt, Human
cuccaaaggauaaaagcagagu

SEQ ID NO: 828553 - RNA, 22 nt, Human
auugacuuucccuucuccucau

SEQ ID NO: 828554 - RNA, 22 nt, Human
uggcauuggaauuuguguugca

SEQ ID NO: 828555 - RNA, 22 nt, Human
uauaaacuccucuugcauuccu

SEQ ID NO: 828556 - RNA, 22 nt, Human
acucauuugcaugaugugcuau

SEQ ID NO: 828557 - RNA, 22 nt, Human
uucuucauucccuuacuuccga

SEQ ID NO: 828558 - RNA, 22 nt, Human
gggcugcacuagggcaagguga

SEQ ID NO: 828559 - RNA, 21 nt, Human
uuggaacaagcagcaguuugc

SEQ ID NO: 828560 - RNA, 22 nt, Human
aagaauaagaggauuuagaaca

SEQ ID NO: 828561 - RNA, 22 nt, Human
uuuauucucuaguuggucagau

SEQ ID NO: 828562 - RNA, 22 nt, Human
acaaaggugagcagaagacaca

SEQ ID NO: 828563 - RNA, 22 nt, Human
uuaagguucagaaaucaauacc

SEQ ID NO: 828564 - RNA, 22 nt, Human
guccuuucgagggugagugaaa

SEQ ID NO: 828565 - RNA, 22 nt, Human
gagacagagagguacucaacau

SEQ ID NO: 828566 - RNA, 22 nt, Human
cuguccauggcaaugaugcaga

SEQ ID NO: 828567 - RNA, 22 nt, Human
ugcugcuuguuuuguaaauaaa

SEQ ID NO: 828568 - RNA, 22 nt, Human
ucucaucugccauuugcaggag

SEQ ID NO: 828569 - RNA, 22 nt, Human
cuuucugaggagacgggcuuug

SEQ ID NO: 828570 - RNA, 22 nt, Human
ucuuuugagggccagaggaaga

SEQ ID NO: 828571 - RNA, 22 nt, Human
uuguuuguaaggcucuuagaau

SEQ ID NO: 828572 - RNA, 22 nt, Human parainfluenza virus 3
aagcauauugaauuauagauga

SEQ ID NO: 828573 - RNA, 22 nt, Human parainfluenza virus 3
aagcauauugaauuauagauga

SEQ ID NO: 828574 - RNA, 21 nt, Human parainfluenza virus 3
ucguuuuguucugggauuagu

SEQ ID NO: 828575 - RNA, 19 nt, Human
aguguguacugaaagcacu

SEQ ID NO: 828576 - RNA, 23 nt, Human
cagaaaucugaaaucuagaaaug

SEQ ID NO: 828577 - RNA, 22 nt, Human
gauuuacaaagcucucuagugu

SEQ ID NO: 828578 - RNA, 22 nt, Human
uggcagagugcagaagaggcau

SEQ ID NO: 828579 - RNA, 22 nt, Human
ugauggcuaucccuggaagggc

SEQ ID NO: 828580 - RNA, 22 nt, Human
aauaaucucccuuuuuguaugu

SEQ ID NO: 828581 - RNA, 22 nt, Human
caggagugagaugcgaucacuu

SEQ ID NO: 828582 - RNA, 22 nt, Human
aggugcagcaugaguccaacgg

SEQ ID NO: 828583 - RNA, 22 nt, Human
uggacagguuugggugccuguu

SEQ ID NO: 828584 - RNA, 22 nt, Human
uucaacuuuggagauuuaauaa

SEQ ID NO: 828585 - RNA, 22 nt, Human
cuguuaauugugaauuuuacau

SEQ ID NO: 828586 - RNA, 17 nt, Human
agccccucagcgucacc

SEQ ID NO: 828587 - RNA, 22 nt, Human
uuucacauuagauaugucauuu

SEQ ID NO: 828588 - RNA, 18 nt, Human
gagcccugagucugcaca

SEQ ID NO: 828589 - RNA, 22 nt, Human
uggcuuccuccagagcaggagg

SEQ ID NO: 828590 - RNA, 22 nt, Human
cacacuagucuauccauuagcu

SEQ ID NO: 828591 - RNA, 22 nt, Human
accucugcuucccggguucaag

SEQ ID NO: 828592 - RNA, 22 nt, Human
aacaguaaagacagaauuuauc

SEQ ID NO: 828593 - RNA, 22 nt, Human
aaauaauuauagcgagucuauc

SEQ ID NO: 828594 - RNA, 22 nt, Human
cccaggaaaagcagugccagca

SEQ ID NO: 828595 - RNA, 22 nt, Human
cugagcugguggaagcaugcag

SEQ ID NO: 828596 - RNA, 22 nt, Human
acaugcuuucuagguccuucug

SEQ ID NO: 828597 - RNA, 16 nt, Human
ucccaggaggcggaac

SEQ ID NO: 828598 - RNA, 22 nt, Human
gauuucaaccuaacaguaugac

SEQ ID NO: 828599 - RNA, 22 nt, Human
uaaacagaaagcagauguacuu

SEQ ID NO: 828600 - RNA, 21 nt, Human
ucuagaauccuguauaagacu

SEQ ID NO: 828601 - RNA, 22 nt, Human
aguaugaaucucuuuauucugc

SEQ ID NO: 828602 - RNA, 22 nt, Human
cagaaacauguauaaaguugua

SEQ ID NO: 828603 - RNA, 22 nt, Human
uugaaauaucaaguuauuagug

SEQ ID NO: 828604 - RNA, 22 nt, Human
uaaggcacgcauaagagggggc

SEQ ID NO: 828605 - RNA, 22 nt, Human
gcugaguguaaugauggcagag

SEQ ID NO: 828606 - RNA, 22 nt, Human
uuuuccucugcaauaaaagcag

SEQ ID NO: 828607 - RNA, 22 nt, Human
gggagcuggagcuggaagacuc

SEQ ID NO: 828608 - RNA, 17 nt, Human
aggcuggcucacaggga

SEQ ID NO: 828609 - RNA, 20 nt, Human
cuguaucagguuacaaagua

SEQ ID NO: 828610 - RNA, 22 nt, Human
uaggcaacaugucgaauacugu

SEQ ID NO: 828611 - RNA, 22 nt, Human
uccuugaauauaauaacaguag

SEQ ID NO: 828612 - RNA, 22 nt, Human
ccuguucacgguguguuguuag

SEQ ID NO: 828613 - RNA, 22 nt, Human
aaacggauauaacagcaaacgc

SEQ ID NO: 828614 - RNA, 22 nt, Human
gacccaggcccaaggcugccag

SEQ ID NO: 828615 - RNA, 18 nt, Human
agcagcugugccacacug

SEQ ID NO: 828616 - RNA, 22 nt, Human
aagccgggccugagaaaugaca

SEQ ID NO: 828617 - RNA, 22 nt, Human
gugccuggagcuaauguguaua

SEQ ID NO: 828618 - RNA, 22 nt, Human
gcuuuaaugcuucguggggcca

SEQ ID NO: 828619 - RNA, 22 nt, Human
cguguggucccggcaaggcaag

SEQ ID NO: 828620 - RNA, 22 nt, Human
gaaaugcauaaucuuaguagau

SEQ ID NO: 828621 - RNA, 22 nt, Human
aaaauggucucagcuggcacca

SEQ ID NO: 828622 - RNA, 22 nt, Human
ugcucuguauucuauggcaguu

SEQ ID NO: 828623 - RNA, 22 nt, Human
aaaugcacaggagaaccaauuc

SEQ ID NO: 828624 - RNA, 22 nt, Human
cacugaagguaggaccaaggcu

SEQ ID NO: 828625 - RNA, 22 nt, Human
ucaacugcaaguuugcuuaguu

SEQ ID NO: 828626 - RNA, 22 nt, Human
agaaauguuacaguuguuauuu

SEQ ID NO: 828627 - RNA, 22 nt, Human
cucuugaagcaggggccaguuc

SEQ ID NO: 828628 - RNA, 22 nt, Human
uacauucagcaaaagaaugguu

SEQ ID NO: 828629 - RNA, 22 nt, Human
aagaacuuccuaauauauuuuc

SEQ ID NO: 828630 - RNA, 22 nt, Human
agugcuuuauguuguugugcaa

SEQ ID NO: 828631 - RNA, 21 nt, Human
aaguaaaucagagaaauaacc

SEQ ID NO: 828632 - RNA, 22 nt, Human
agcucccagggcugggcaaguu

SEQ ID NO: 828633 - RNA, 22 nt, Human
ugucauugaggaaaacuaggug

SEQ ID NO: 828634 - RNA, 23 nt, Human
aagaauaaaugacauuaaaggug

SEQ ID NO: 828635 - RNA, 22 nt, Human
ggcugcuuuaucggcugcugaa

SEQ ID NO: 828636 - RNA, 22 nt, Human
auuuaaugucgagcuauuguag

SEQ ID NO: 828637 - RNA, 22 nt, Human
ugcuccauucucuagccagugc

SEQ ID NO: 828638 - RNA, 22 nt, Human
gcaguggcaugaugugggcuca

SEQ ID NO: 828639 - RNA, 22 nt, Human
uugcauuguaggauguuagaag

SEQ ID NO: 828640 - RNA, 22 nt, Human
gcaaaauuuacacuccuucuuc

SEQ ID NO: 828641 - RNA, 22 nt, Human
ggugcagaucuuucucuucagg

SEQ ID NO: 828642 - RNA, 22 nt, Human
gugcaugugcauccauguguac

SEQ ID NO: 828643 - RNA, 17 nt, Human
cugucugcgcaugaggu

SEQ ID NO: 828644 - RNA, 22 nt, Human
gagaugaauguaaacaaaggca

SEQ ID NO: 828645 - RNA, 22 nt, Human
ggcugcuugcuguuucuuggau

SEQ ID NO: 828646 - RNA, 21 nt, Human
acuguucauuugaugaacugg

SEQ ID NO: 828647 - RNA, 22 nt, Human
agcugccccaugagaggcaggu

SEQ ID NO: 828648 - RNA, 19 nt, Human
ccaggagagcuuggagaag

SEQ ID NO: 828649 - RNA, 22 nt, Human
uccagucaggcugaauucaagg

SEQ ID NO: 828650 - RNA, 22 nt, Human
auauuucuugagcaccugguau

SEQ ID NO: 828651 - RNA, 18 nt, Human
uggcagcaggaagccauu

SEQ ID NO: 828652 - RNA, 22 nt, Human
gcagcagagcuuuguccuggcu

SEQ ID NO: 828653 - RNA, 22 nt, Human
agccuguccagaggacagggcu

SEQ ID NO: 828654 - RNA, 21 nt, Human
ucauuugugaucugauuucca

SEQ ID NO: 828655 - RNA, 22 nt, Human
gccugagauucugcauuucuaa

SEQ ID NO: 828656 - RNA, 22 nt, Human
gcucugugggugaguagaaucu

SEQ ID NO: 828657 - RNA, 22 nt, Human
cugagcugcucccgcugcagcg

SEQ ID NO: 828658 - RNA, 22 nt, Human
cuggcagcuucaggacacucgg

SEQ ID NO: 828659 - RNA, 22 nt, Human
cagagggcucuuggcugccugc

SEQ ID NO: 828660 - RNA, 22 nt, Human
uugacaauguccuuugaauuuc

SEQ ID NO: 828661 - RNA, 22 nt, Human
auguaaggcugccuaugacacu

SEQ ID NO: 828662 - RNA, 22 nt, Human
aggcagcuggaggcagagacua

SEQ ID NO: 828663 - RNA, 22 nt, Human
uccucaggcggugaggaggggc

SEQ ID NO: 828664 - RNA, 22 nt, Human
gccccagccaaggugacacgaa

SEQ ID NO: 828665 - RNA, 22 nt, Human
aaguccuuuccaguccugugau

SEQ ID NO: 828666 - RNA, 19 nt, Human
ggccccucucacaggaguu

SEQ ID NO: 828667 - RNA, 22 nt, Human
caggcacuggccagucagcaca

SEQ ID NO: 828668 - RNA, 22 nt, Human
agagaauuuuaaaagccuugaa

SEQ ID NO: 828669 - RNA, 22 nt, Human
guuuuuaucuaauagcaguuau

SEQ ID NO: 828670 - RNA, 22 nt, Human
caguuucugggcguucacaggu

SEQ ID NO: 828671 - RNA, 22 nt, Human
gauuucaaagguucugcaugcc

SEQ ID NO: 828672 - RNA, 22 nt, Human
gccugccugcugucaucugccu

SEQ ID NO: 828673 - RNA, 22 nt, Human
acaaaguccugguguauggcca

SEQ ID NO: 828674 - RNA, 22 nt, Human
ucuccuucgaggcccagcuccc

SEQ ID NO: 828675 - RNA, 22 nt, Human
cuuguacauagagaagaagccu

SEQ ID NO: 828676 - RNA, 18 nt, Human
gcagcugacacuggaguu

SEQ ID NO: 828677 - RNA, 22 nt, Human
gaggaccacagaugagccugca

SEQ ID NO: 828678 - RNA, 22 nt, Human
ucugucugacaggguaugaacu

SEQ ID NO: 828679 - RNA, 22 nt, Human
uuuccucauuuaucugcuggga

SEQ ID NO: 828680 - RNA, 22 nt, Human
aucaguuuaaaugggcuguugg

SEQ ID NO: 828681 - RNA, 22 nt, Human
caggcagcugcgacaagagagc

SEQ ID NO: 828682 - RNA, 22 nt, Human
ucagccagugccuugaucuugc

SEQ ID NO: 828683 - RNA, 22 nt, Human
auuuguacaaauuuauguuagu

SEQ ID NO: 828684 - RNA, 22 nt, Human
agaggccuaauugcuacccuuu

SEQ ID NO: 828685 - RNA, 22 nt, Human
augguuuugaagggaggucaaa

SEQ ID NO: 828686 - RNA, 22 nt, Human
ugaggcagugauguuuaagcac

SEQ ID NO: 828687 - RNA, 23 nt, Human
uugauacagaagaaucaguuugu

SEQ ID NO: 828688 - RNA, 22 nt, Human
uaacaagucauuuuaaauuaug

SEQ ID NO: 828689 - RNA, 22 nt, Human
cugggaggacaacuuggagcuc

SEQ ID NO: 828690 - RNA, 22 nt, Human
uuucacauguggaaugccaggu

SEQ ID NO: 828691 - RNA, 22 nt, Human
uucuuacagcccuauuacuaaa

SEQ ID NO: 828692 - RNA, 22 nt, Human
gucuucuuguguugccugucuu

SEQ ID NO: 828693 - RNA, 22 nt, Human
ucuuacauauagcaugaguaca

SEQ ID NO: 828694 - RNA, 22 nt, Human
acuuugcagagccagaagagaa

SEQ ID NO: 828695 - RNA, 22 nt, Human
gcccaguaguucaagguugcag

SEQ ID NO: 828696 - RNA, 17 nt, Human
agugacuuggaaagagc

SEQ ID NO: 828697 - RNA, 22 nt, Human
gcccccucuuuggagccagcca

SEQ ID NO: 828698 - RNA, 22 nt, Human
ccugugugcugaugacgacaga

SEQ ID NO: 828699 - RNA, 19 nt, Human
caguggccuggaggucucu

SEQ ID NO: 828700 - RNA, 22 nt, Human
gccccagcucugccacaacuag

SEQ ID NO: 828701 - RNA, 22 nt, Human
cuggccugagcacagcggcugc

SEQ ID NO: 828702 - RNA, 22 nt, Human
ccagaggugcugggagaggucu

SEQ ID NO: 828703 - RNA, 22 nt, Human
cccuggaguccggagcucaccu

SEQ ID NO: 828704 - RNA, 22 nt, Human
caaaugcaaaauauaacccugu

SEQ ID NO: 828705 - RNA, 22 nt, Human
ugggacagggaaucugaucccc

SEQ ID NO: 828706 - RNA, 22 nt, Human
agcuggaggauaacucacuucu

SEQ ID NO: 828707 - RNA, 22 nt, Human
uucauuccuucuguaccuugcc

SEQ ID NO: 828708 - RNA, 22 nt, Human
cucauuaaaggaaaucaccugc

SEQ ID NO: 828709 - RNA, 22 nt, Human
cauugcugugggcauuugcugc

SEQ ID NO: 828710 - RNA, 22 nt, Human
ccacccugagccgcaagagcag

SEQ ID NO: 828711 - RNA, 22 nt, Human
gccuucagcccugacuggccag

SEQ ID NO: 828712 - RNA, 22 nt, Human
ugcaggccucacaccuggcacc

SEQ ID NO: 828713 - RNA, 22 nt, Human
uaucuacaggugucagguaaga

SEQ ID NO: 828714 - RNA, 22 nt, Human
uagcaucuggagaaacaagucc

SEQ ID NO: 828715 - RNA, 22 nt, Human
cauacuuugggauaagagugga

SEQ ID NO: 828716 - RNA, 22 nt, Human
uaaacaugugagugugcauaua

SEQ ID NO: 828717 - RNA, 22 nt, Human
uggccugccugggagcagcagg

SEQ ID NO: 828718 - RNA, 22 nt, Human
uggaccugcuggaugggcaggu

SEQ ID NO: 828719 - RNA, 22 nt, Human
ccagagccagagaggugccugc

SEQ ID NO: 828720 - RNA, 22 nt, Human
aggcaacuuuuggggaugaugg

SEQ ID NO: 828721 - RNA, 22 nt, Human
aagcagaguccccuucccaugg

SEQ ID NO: 828722 - RNA, 22 nt, Human
aauguacaaggguuccaguuuu

SEQ ID NO: 828723 - RNA, 22 nt, Human
gagcagugacuggagcaugaga

SEQ ID NO: 828724 - RNA, 16 nt, Human
uguuagcugugcauua

SEQ ID NO: 828725 - RNA, 22 nt, Human
uugugaaauguuucaaaauagu

SEQ ID NO: 828726 - RNA, 22 nt, Human
agcuagccuaggcagagugcau

SEQ ID NO: 828727 - RNA, 22 nt, Human
uuaguuuucccaucuuuauggu

SEQ ID NO: 828728 - RNA, 22 nt, Human
uggcucugcaccucaguguacc

SEQ ID NO: 828729 - RNA, 22 nt, Human
ucauccaguuguggagagggaa

SEQ ID NO: 828730 - RNA, 22 nt, Human
auguuacagaaagcaaagauga

SEQ ID NO: 828731 - RNA, 22 nt, Human
agggagcugcucugcuuccgug

SEQ ID NO: 828732 - RNA, 22 nt, Human
uauuuagaaugcguguacgugu

SEQ ID NO: 828733 - RNA, 22 nt, Human
uccaggagagguagaggguucc

SEQ ID NO: 828734 - RNA, 22 nt, Human
gcccagcacauugcugaggacc

SEQ ID NO: 828735 - RNA, 22 nt, Human
cuggggggagcugcguccagca

SEQ ID NO: 828736 - RNA, 22 nt, Human
ugccuguguccccuucuuggca

SEQ ID NO: 828737 - RNA, 21 nt, Human
gcaggggauagaaauggucug

SEQ ID NO: 828738 - RNA, 22 nt, Human
augcccgauaccuaguuaacuc

SEQ ID NO: 828739 - RNA, 22 nt, Human
uccuugaaaagaaugucuccau

SEQ ID NO: 828740 - RNA, 22 nt, Human
gagaggccaccugacgagcagu

SEQ ID NO: 828741 - RNA, 22 nt, Human
gcaggagcugcucuccugacga

SEQ ID NO: 828742 - RNA, 22 nt, Human
auuuguaauuucuuaucugugu

SEQ ID NO: 828743 - RNA, 22 nt, Human
cugaugcuauaagccacagugg

SEQ ID NO: 828744 - RNA, 22 nt, Human
uugaagcaggaaaauuucuauu

SEQ ID NO: 828745 - RNA, 22 nt, Human
auguuauuaaaguacagauucu

SEQ ID NO: 828746 - RNA, 22 nt, Human
augcugugguagacagcauucc

SEQ ID NO: 828747 - RNA, 22 nt, Human
acugggccuugccauggcagcc

SEQ ID NO: 828748 - RNA, 22 nt, Human
cagagcuggagcuugaauggag

SEQ ID NO: 828749 - RNA, 22 nt, Human
cagcaggcguugggagaaagac

SEQ ID NO: 828750 - RNA, 22 nt, Human
aggauuuaaauccuuaaccacu

SEQ ID NO: 828751 - RNA, 21 nt, Human
agcagcagaucuggugagggc

SEQ ID NO: 828752 - RNA, 22 nt, Human
gggagggaggugaugcuuggcu

SEQ ID NO: 828753 - RNA, 22 nt, Human
gccugcagaacugugaggcaau

SEQ ID NO: 828754 - RNA, 22 nt, Human
uguauguugggucaaaguacau

SEQ ID NO: 828755 - RNA, 22 nt, Human
uaucuguucaauggaagaugac

SEQ ID NO: 828756 - RNA, 22 nt, Human
auugaauagaugcauuauacua

SEQ ID NO: 828757 - RNA, 22 nt, Human
cagagggaaaaggggaguaaua

SEQ ID NO: 828758 - RNA, 22 nt, Human
ggcacugaauuucuuggcaucu

SEQ ID NO: 828759 - RNA, 22 nt, Human
ugccugaggagucagggcaggu

SEQ ID NO: 828760 - RNA, 21 nt, Human
agaugcugugcuccaggagca

SEQ ID NO: 828761 - RNA, 22 nt, Human
uggggcuguggauucucacgaa

SEQ ID NO: 828762 - RNA, 22 nt, Human
agaaauguggaucguuuuaaaa

SEQ ID NO: 828763 - RNA, 21 nt, Human
caauaaacugcacauugagac

SEQ ID NO: 828764 - RNA, 22 nt, Human
cauagaaacugagacaaggauu

SEQ ID NO: 828765 - RNA, 22 nt, Human
caaagguaaagaucugcugugg

SEQ ID NO: 828766 - RNA, 20 nt, Human
gucagugucuucaguaguga

SEQ ID NO: 828767 - RNA, 22 nt, Human
uuaacauuguccuuagcagauu

SEQ ID NO: 828768 - RNA, 22 nt, Human
aauaucaacaguguccuucuaa

SEQ ID NO: 828769 - RNA, 22 nt, Human
acugucuguccugcucuccgug

SEQ ID NO: 828770 - RNA, 23 nt, Human
ccuggcagcaaacgaggagguua

SEQ ID NO: 828771 - RNA, 19 nt, Human
gcuuuggagggagguucua

SEQ ID NO: 828772 - RNA, 22 nt, Human
cugggcagugguggcccuuccc

SEQ ID NO: 828773 - RNA, 22 nt, Human
caucagaacgugagcuccuugu

SEQ ID NO: 828774 - RNA, 22 nt, Human
caacuuucuguuaaauguuagu

SEQ ID NO: 828775 - RNA, 22 nt, Human
agagggcaaguguaguccagua

SEQ ID NO: 828776 - RNA, 22 nt, Human
aagggcagaaagggacgcuuug

SEQ ID NO: 828777 - RNA, 22 nt, Human
gucccuggaucugggacagcug

SEQ ID NO: 828778 - RNA, 22 nt, Human
uggggugggcaugcgcuguccu

SEQ ID NO: 828779 - RNA, 22 nt, Human
uauugacaauaggcaacugagg

SEQ ID NO: 828780 - RNA, 22 nt, Human
uuguaacaaucugucauaaaug

SEQ ID NO: 828781 - RNA, 22 nt, Human
auaugucgcuacaucauuagau

SEQ ID NO: 828782 - RNA, 22 nt, Human
guuccacaaaauguacccaguu

SEQ ID NO: 828783 - RNA, 22 nt, Human
uagaaacagaaaacuguaauag

SEQ ID NO: 828784 - RNA, 22 nt, Human
gucugagaaucuugcauaucau

SEQ ID NO: 828785 - RNA, 22 nt, Human
acauuucugcuagaauagguga

SEQ ID NO: 828786 - RNA, 22 nt, Human
cagggugccaaagaacaaauau

SEQ ID NO: 828787 - RNA, 19 nt, Human
auaaggcagugacuuuuuu

SEQ ID NO: 828788 - RNA, 22 nt, Human
aaguuucaaauguugauuaugc

SEQ ID NO: 828789 - RNA, 22 nt, Human
gaggguccccaugcagagcuca

SEQ ID NO: 828790 - RNA, 22 nt, Human
ucaguuuucauuucaugagcag

SEQ ID NO: 828791 - RNA, 22 nt, Human
ugaaaugagcauuuauucuuua

SEQ ID NO: 828792 - RNA, 22 nt, Human
aagaauguucauuaaacuguug

SEQ ID NO: 828793 - RNA, 23 nt, Human
cuggcuccgaagacuccaggauc

SEQ ID NO: 828794 - RNA, 22 nt, Human
gcugucuugcucacucuugcag

SEQ ID NO: 828795 - RNA, 21 nt, Human
ugaaaguuggagucaaaugua

SEQ ID NO: 828796 - RNA, 22 nt, Human
uugauacaggccuucuagauga

SEQ ID NO: 828797 - RNA, 22 nt, Human
gcaggguaggugacagguaguc

SEQ ID NO: 828798 - RNA, 22 nt, Human
gcagaggacagggauuuagauu

SEQ ID NO: 828799 - RNA, 22 nt, Human
gcagaauucuacagaugauaaa

SEQ ID NO: 828800 - RNA, 22 nt, Human
gauuucuugauaaguaguguga

SEQ ID NO: 828801 - RNA, 22 nt, Human
aaaggucagacuuaggcugggc

SEQ ID NO: 828802 - RNA, 22 nt, Human
gauggcaggugauagccgaguc

SEQ ID NO: 828803 - RNA, 22 nt, Human
ccugggcagggcuggacucuca

SEQ ID NO: 828804 - RNA, 22 nt, Human
augaagcugaccuugucuugcu

SEQ ID NO: 828805 - RNA, 22 nt, Human
gcagcugcuggaaguuccugcc

SEQ ID NO: 828806 - RNA, 22 nt, Human
uaggccaggacagagcuuccag

SEQ ID NO: 828807 - RNA, 22 nt, Human
aaucaguuucuuggcaaguuua

SEQ ID NO: 828808 - RNA, 22 nt, Human
aguaacaagugccaacguuaga

SEQ ID NO: 828809 - RNA, 22 nt, Human
agaccagcugccucccagggcc

SEQ ID NO: 828810 - RNA, 22 nt, Human
uggcccugacuuggaggccuga

SEQ ID NO: 828811 - RNA, 22 nt, Human
aaucuucagugucuaaaaagca

SEQ ID NO: 828812 - RNA, 22 nt, Human
uuuauuguuuagaagggggcug

SEQ ID NO: 828813 - RNA, 22 nt, Human
cagcugacagugaggugggggc

SEQ ID NO: 828814 - RNA, 19 nt, Human
aagcagcccuggcaagagc

SEQ ID NO: 828815 - RNA, 22 nt, Human
gccaugccugugucuccaggcc

SEQ ID NO: 828816 - RNA, 22 nt, Human
gcaggaagcauagaagaaugcc

SEQ ID NO: 828817 - RNA, 22 nt, Human
cagucaccuugaggacucagac

SEQ ID NO: 828818 - RNA, 19 nt, Human
uggcagaggcaguuuguac

SEQ ID NO: 828819 - RNA, 22 nt, Human
gcugccaccguggagaugagug

SEQ ID NO: 828820 - RNA, 22 nt, Human
cuccaggagcugugucuuucuu

SEQ ID NO: 828821 - RNA, 22 nt, Human
aaguguguugacugaauugggg

SEQ ID NO: 828822 - RNA, 22 nt, Human
uuucaucuaacacuacauaggg

SEQ ID NO: 828823 - RNA, 22 nt, Human
uguugauuaguguuuagacuua

SEQ ID NO: 828824 - RNA, 22 nt, Human
aagauacugaugauguaggcua

SEQ ID NO: 828825 - RNA, 22 nt, Human
auggcuuaugguaaauauuucu

SEQ ID NO: 828826 - RNA, 22 nt, Human
uauuccaguccuauccucuuuu

SEQ ID NO: 828827 - RNA, 22 nt, Human
cuggagagaaaugacaaagcua

SEQ ID NO: 828828 - RNA, 18 nt, Human
agcugcagaccaggaggu

SEQ ID NO: 828829 - RNA, 22 nt, Human
uggaggcaucagagugcuuggc

SEQ ID NO: 828830 - RNA, 22 nt, Human
uauucacaggcacgaaauauug

SEQ ID NO: 828831 - RNA, 22 nt, Human
cugccuggaaggagcaagggga

SEQ ID NO: 828832 - RNA, 22 nt, Human
gaggagagaugguagauugggu

SEQ ID NO: 828833 - RNA, 22 nt, Human
acaggugauucaggcucuggga

SEQ ID NO: 828834 - RNA, 22 nt, Human
uacacauguuuggcaaguaugu

SEQ ID NO: 828835 - RNA, 22 nt, Human
accugagggcccaaacuuggua

SEQ ID NO: 828836 - RNA, 22 nt, Human
ggcugggcaggucugcacaggg

SEQ ID NO: 828837 - RNA, 22 nt, Human
uggcagcuggagggcaauggcc

SEQ ID NO: 828838 - RNA, 22 nt, Human
aaaguucuggcauuuucugucu

SEQ ID NO: 828839 - RNA, 22 nt, Human
ucaguuuuucuauacuuuguag

SEQ ID NO: 828840 - RNA, 22 nt, Human
agcaugcacaugacuggcuuaa

SEQ ID NO: 828841 - RNA, 22 nt, Human
agaauuuuugauuaucuacucg

SEQ ID NO: 828842 - RNA, 22 nt, Human
gaggaaaauggaguguaauuaa

SEQ ID NO: 828843 - RNA, 22 nt, Human
ugagauuuguuuuauaaaauag

SEQ ID NO: 828844 - RNA, 22 nt, Human
ggagugacucacagcugggaca

SEQ ID NO: 828845 - RNA, 22 nt, Human
aaagaaucguguguaguuugaa

SEQ ID NO: 828846 - RNA, 22 nt, Human
aagagcuggaagugaagauaac

SEQ ID NO: 828847 - RNA, 22 nt, Human
acaugauuuuaguaucauaaua

SEQ ID NO: 828848 - RNA, 20 nt, Human
aaaguguaagcauauaauua

SEQ ID NO: 828849 - RNA, 20 nt, Human
gccugcagguuggaugggau

SEQ ID NO: 828850 - RNA, 22 nt, Human
ugcucccaggcauucucuguug

SEQ ID NO: 828851 - RNA, 22 nt, Human
ccugggaggcuguuuccagccu

SEQ ID NO: 828852 - RNA, 20 nt, Human
gucagaggacccuagagcga

SEQ ID NO: 828853 - RNA, 22 nt, Human
gggcugagggguaucucauggg

SEQ ID NO: 828854 - RNA, 22 nt, Human
agggcagaaaucgauuacaccu

SEQ ID NO: 828855 - RNA, 22 nt, Human
agaaaaggcuugaagagguuuu

SEQ ID NO: 828856 - RNA, 22 nt, Human
gccugccuucggugcgcagcgg

SEQ ID NO: 828857 - RNA, 20 nt, Human
uacagaaugcaauaaaaugg

SEQ ID NO: 828858 - RNA, 22 nt, Human
cagagguacaagcuaaguuggg

SEQ ID NO: 828859 - RNA, 18 nt, Human
ugucucugaauuccagug

SEQ ID NO: 828860 - RNA, 22 nt, Human
agcccuucaaccugccuacucc

SEQ ID NO: 828861 - RNA, 22 nt, Human
aagagcuggauugugcugcaga

SEQ ID NO: 828862 - RNA, 22 nt, Human
uagggauguaaacauaguaauu

SEQ ID NO: 828863 - RNA, 22 nt, Human
agaaauguacgauguuaugcag

SEQ ID NO: 828864 - RNA, 22 nt, Human
gccugagauucccggagccgug

SEQ ID NO: 828865 - RNA, 22 nt, Human
agcagcuguacuuucaucuguu

SEQ ID NO: 828866 - RNA, 22 nt, Human
ugcuggcccaugaagacgcagu

SEQ ID NO: 828867 - RNA, 22 nt, Human
cagucccagaagagccugggag

SEQ ID NO: 828868 - RNA, 22 nt, Human
aauaguauuuauuuggaaaaag

SEQ ID NO: 828869 - RNA, 21 nt, Human
ggacagcugcgcgcagggcuc

SEQ ID NO: 828870 - RNA, 22 nt, Human
aggcuggcuggcaggggacaca

SEQ ID NO: 828871 - RNA, 22 nt, Human
ggcggggguccaggagccugca

SEQ ID NO: 828872 - RNA, 23 nt, Human
uacauuguggauggaguccuggg

SEQ ID NO: 828873 - RNA, 22 nt, Human
ugcagagguguugcugagauaa

SEQ ID NO: 828874 - RNA, 22 nt, Human
uuaguacugauagggucaauca

SEQ ID NO: 828875 - RNA, 22 nt, Human
gccuggagaggaagccggugga

SEQ ID NO: 828876 - RNA, 22 nt, Human
ggugcagcugcagccugggagc

SEQ ID NO: 828877 - RNA, 22 nt, Human
ucuggcucucaacaaauauuua

SEQ ID NO: 828878 - RNA, 22 nt, Human
cagcuggcugcaugaugccaaa

SEQ ID NO: 828879 - RNA, 21 nt, Human
ccaggaaggacugagcucccu

SEQ ID NO: 828880 - RNA, 20 nt, Human
gcaggcagggaaugggggug

SEQ ID NO: 828881 - RNA, 17 nt, Human
uuccccugaccaagccu

SEQ ID NO: 828882 - RNA, 22 nt, Human
acaagccaauuacugugccagg

SEQ ID NO: 828883 - RNA, 22 nt, Human
caagcuccuuacauccacaggg

SEQ ID NO: 828884 - RNA, 22 nt, Human
uucacauugguucuugauagcu

SEQ ID NO: 828885 - RNA, 17 nt, Human
agcagcuggguugaucu

SEQ ID NO: 828886 - RNA, 22 nt, Human
uccagucaucucccuucacauu

SEQ ID NO: 828887 - RNA, 22 nt, Human
uuauauuaguuagacuugcugu

SEQ ID NO: 828888 - RNA, 22 nt, Human
auggcagggcagccucucagag

SEQ ID NO: 828889 - RNA, 22 nt, Human
gcuggccucuggagaagggcuu

SEQ ID NO: 828890 - RNA, 22 nt, Human
cccaggagagaggggauaaagc

SEQ ID NO: 828891 - RNA, 22 nt, Human
ugauucacagacuucacaaggc

SEQ ID NO: 828892 - RNA, 22 nt, Human
gacagacauuuccugauccaau

SEQ ID NO: 828893 - RNA, 22 nt, Human
guuuuccuucucagccauugcc

SEQ ID NO: 828894 - RNA, 22 nt, Human
agcauuuaguuaguaaauguuu

SEQ ID NO: 828895 - RNA, 22 nt, Human
ucagaaagaacacaggcaguag

SEQ ID NO: 828896 - RNA, 22 nt, Human
aggaaaugcugaugcuccugga

SEQ ID NO: 828897 - RNA, 22 nt, Human
gcuggccauagaagccaaagag

SEQ ID NO: 828898 - RNA, 22 nt, Human
uccugcaggccuguucccagua

SEQ ID NO: 828899 - RNA, 22 nt, Human
uagaaacacagaucugguguca

SEQ ID NO: 828900 - RNA, 22 nt, Human
uagcaauagaaacauauaaagu

SEQ ID NO: 828901 - RNA, 22 nt, Human
cagacaggcuagccagacucac

SEQ ID NO: 828902 - RNA, 22 nt, Human
uuuguaugugauaagacuauuc

SEQ ID NO: 828903 - RNA, 22 nt, Human
gcagaggcaaucagguaugugg

SEQ ID NO: 828904 - RNA, 23 nt, Human
agggaaaguaguaauggccuuug

SEQ ID NO: 828905 - RNA, 22 nt, Human
ucucucagaggccaggguccug

SEQ ID NO: 828906 - RNA, 22 nt, Human
cgggcuggcugcagcugcugga

SEQ ID NO: 828907 - RNA, 22 nt, Human
uacagaauuagauuauuagaga

SEQ ID NO: 828908 - RNA, 22 nt, Human
gaggcagugcauugucuagggg

SEQ ID NO: 828909 - RNA, 22 nt, Human
auaaauuuauaauuguuuccug

SEQ ID NO: 828910 - RNA, 22 nt, Human
ucugucacuuuuauuuacugaa

SEQ ID NO: 828911 - RNA, 22 nt, Human
gcagggcacagacagugccaag

SEQ ID NO: 828912 - RNA, 22 nt, Human
ugcaauaaagugcuauaaaucc

SEQ ID NO: 828913 - RNA, 22 nt, Human
cagagagagucaaaucuuugcu

SEQ ID NO: 828914 - RNA, 22 nt, Human
auuacaauaagguuuauuugua

SEQ ID NO: 828915 - RNA, 22 nt, Human
gcaugggcaagaggacuggggg

SEQ ID NO: 828916 - RNA, 22 nt, Human
auuccaaacucuuucccugucg

SEQ ID NO: 828917 - RNA, 22 nt, Human
caccuggcuggaagugcuccgg

SEQ ID NO: 828918 - RNA, 22 nt, Human
ggcugggcugcugggucagagc

SEQ ID NO: 828919 - RNA, 21 nt, Human
aggauuuacuauuaacugugu

SEQ ID NO: 828920 - RNA, 22 nt, Human
cacugcagcaccaugcagggcu

SEQ ID NO: 828921 - RNA, 22 nt, Human
uggagccaaggccaguucucag

SEQ ID NO: 828922 - RNA, 22 nt, Human
uuagaaaggagcuuauuucuuu

SEQ ID NO: 828923 - RNA, 18 nt, Human
ugcucuggucucacuugg

SEQ ID NO: 828924 - RNA, 22 nt, Human
gaacacauguccuccuuggauu

SEQ ID NO: 828925 - RNA, 23 nt, Human
uccagggauuaaugaagucaguc

SEQ ID NO: 828926 - RNA, 22 nt, Human
aacaaauggggccuuguaugaa

SEQ ID NO: 828927 - RNA, 22 nt, Human
ucugaggcauaaccuguucugc

SEQ ID NO: 828928 - RNA, 22 nt, Human
cugagggccuuggcuccugccc

SEQ ID NO: 828929 - RNA, 22 nt, Human
agcugcugcggaaagaugccac

SEQ ID NO: 828930 - RNA, 22 nt, Human
cagaggcuaagaugagugggug

SEQ ID NO: 828931 - RNA, 17 nt, Human
ucagagggaugagcagg

SEQ ID NO: 828932 - RNA, 22 nt, Human
cccuggagugugacgaggcauu

SEQ ID NO: 828933 - RNA, 22 nt, Human
ugaaaauggccugaagaagcaa

SEQ ID NO: 828934 - RNA, 22 nt, Human
cuuuggcaaggguuuuaauugu

SEQ ID NO: 828935 - RNA, 22 nt, Human
acccagcuggaugcauggaggc

SEQ ID NO: 828936 - RNA, 18 nt, Human
acaaaggucugcaagacc

SEQ ID NO: 828937 - RNA, 22 nt, Human
augaugugugcugaucaagcuu

SEQ ID NO: 828938 - RNA, 22 nt, Human
cauuuguauagugcuuagacca

SEQ ID NO: 828939 - RNA, 22 nt, Human
ccccuuccacagugcuuccuaa

SEQ ID NO: 828940 - RNA, 19 nt, Human
aucugagauuauaaacaga

SEQ ID NO: 828941 - RNA, 22 nt, Human
ucacuuagauggggaucaucac

SEQ ID NO: 828942 - RNA, 22 nt, Human
uuauuuaaaauguagguuggga

SEQ ID NO: 828943 - RNA, 22 nt, Human
aaacauugcuaaauaaugcugc

SEQ ID NO: 828944 - RNA, 22 nt, Human
cugagccagcgggcucacuuuu

SEQ ID NO: 828945 - RNA, 22 nt, Human
gauuuacagguuagguccugua

SEQ ID NO: 828946 - RNA, 21 nt, Human
aguugcauaggccagccaucc

SEQ ID NO: 828947 - RNA, 22 nt, Human
aggagucacucagggcuucauc

SEQ ID NO: 828948 - RNA, 22 nt, Human
agacgagggcccccaggacagc

SEQ ID NO: 828949 - RNA, 22 nt, Human
ucucugcugagaagggcuggca

SEQ ID NO: 828950 - RNA, 22 nt, Human
ugagccugggagauggaggcug

SEQ ID NO: 828951 - RNA, 22 nt, Human
uugaagcauuguggcuuguauu

SEQ ID NO: 828952 - RNA, 19 nt, Human
cagcugccuuuucuuugca

SEQ ID NO: 828953 - RNA, 22 nt, Human
gugcagagaaaugagaagucga

SEQ ID NO: 828954 - RNA, 19 nt, Human
aucuuacagagcagaguac

SEQ ID NO: 828955 - RNA, 22 nt, Human
gaggagcuggcugucgggaggc

SEQ ID NO: 828956 - RNA, 21 nt, Human
ccuguucacagaucuguaacu

SEQ ID NO: 828957 - RNA, 22 nt, Human
accaaggaagaaucuauuugag

SEQ ID NO: 828958 - RNA, 22 nt, Human
auuugucuuugagugcccugcu

SEQ ID NO: 828959 - RNA, 22 nt, Human
caaguccuuuucuuggcucagg

SEQ ID NO: 828960 - RNA, 18 nt, Human
cugcuugggagacgucag

SEQ ID NO: 828961 - RNA, 20 nt, Human
ucagugauuaucucugagug

SEQ ID NO: 828962 - RNA, 22 nt, Human
agcauuuaauuacaguuuaauu

SEQ ID NO: 828963 - RNA, 22 nt, Human
ucugcaggcuguacaggaagca

SEQ ID NO: 828964 - RNA, 19 nt, Human
aguagcagaaagugcagug

SEQ ID NO: 828965 - RNA, 22 nt, Human
ucagaaauguaagcugaugacu

SEQ ID NO: 828966 - RNA, 22 nt, Human
gcccaggaguugaaugcagcag

SEQ ID NO: 828967 - RNA, 22 nt, Human
agccagccgggggaccacagug

SEQ ID NO: 828968 - RNA, 19 nt, Human
cccuggcaggcaagccugg

SEQ ID NO: 828969 - RNA, 22 nt, Human
gggcacagagggucuugaagaa

SEQ ID NO: 828970 - RNA, 22 nt, Human
uaaauuuacccaaggaacaugu

SEQ ID NO: 828971 - RNA, 22 nt, Human
ugugaaaagggcuuuguacaaa

SEQ ID NO: 828972 - RNA, 22 nt, Human
ggguccagaguugaagagguua

SEQ ID NO: 828973 - RNA, 22 nt, Human
uuccaguucccaugaggauuaa

SEQ ID NO: 828974 - RNA, 22 nt, Human
ccuggagcacagcccaguccca

SEQ ID NO: 828975 - RNA, 22 nt, Human
aaauugaaugauuaagugguga

SEQ ID NO: 828976 - RNA, 22 nt, Human
caguccuugcucaaagucuaca

SEQ ID NO: 828977 - RNA, 22 nt, Human
cuggcugcaggaaggagugggc

SEQ ID NO: 828978 - RNA, 18 nt, Human
uccagagcuacuguggug

SEQ ID NO: 828979 - RNA, 21 nt, Human
uuucaauguguucuuuguagu

SEQ ID NO: 828980 - RNA, 22 nt, Human
caaaugcuggcccugcuacuua

SEQ ID NO: 828981 - RNA, 22 nt, Human
ugcuuuaaaauggacuguuuug

SEQ ID NO: 828982 - RNA, 21 nt, Human
cucaggaucuuauauauuagu

SEQ ID NO: 828983 - RNA, 22 nt, Human
auaaggcauauagucacuuuuu

SEQ ID NO: 828984 - RNA, 22 nt, Human
cuccaggccauggcugcggagg

SEQ ID NO: 828985 - RNA, 22 nt, Human
ggagccuggcaaugcugcgucc

SEQ ID NO: 828986 - RNA, 22 nt, Human
agcagggcugcagugugucuuu

SEQ ID NO: 828987 - RNA, 22 nt, Human
caauaugcaagcuauuaaguau

SEQ ID NO: 828988 - RNA, 21 nt, Human
ucaggcaggcgcagagggaag

SEQ ID NO: 828989 - RNA, 22 nt, Human
uuauuacacugaaagaauugcg

SEQ ID NO: 828990 - RNA, 22 nt, Human
gccaggcuggucuugaacuccu

SEQ ID NO: 828991 - RNA, 22 nt, Human
uaggcagcgcuuggcugugcuu

SEQ ID NO: 828992 - RNA, 22 nt, Human
auacauuagaaucugguacuca

SEQ ID NO: 828993 - RNA, 22 nt, Human
aacaaauggaacacaaaucuuu

SEQ ID NO: 828994 - RNA, 20 nt, Human
agaauucuuacccuuugaug

SEQ ID NO: 828995 - RNA, 22 nt, Human
ggccucucuggcauggcugccc

SEQ ID NO: 828996 - RNA, 22 nt, Human
caacacauugaagcuaugauga

SEQ ID NO: 828997 - RNA, 20 nt, Human
cuuuggcaaugagaacaggg

SEQ ID NO: 828998 - RNA, 22 nt, Human
caaguccucaaagggcucugcu

SEQ ID NO: 828999 - RNA, 22 nt, Human
ugggggugacuaucucgggaau

SEQ ID NO: 829000 - RNA, 22 nt, Human
ggccugagcagacagcaugaug

SEQ ID NO: 829001 - RNA, 19 nt, Human
ucaguuuuagucaucaguu

SEQ ID NO: 829002 - RNA, 17 nt, Human
aguggcaggcagauggg

SEQ ID NO: 829003 - RNA, 22 nt, Human
ucacugcaaucucugccuucca

SEQ ID NO: 829004 - RNA, 22 nt, Human
ggaggggaugguuugacccugg

SEQ ID NO: 829005 - RNA, 22 nt, Human
uuuccuaagguagugauaauuu

SEQ ID NO: 829006 - RNA, 22 nt, Human
aaauuauaggugccaccuugga

SEQ ID NO: 829007 - RNA, 23 nt, Human
gggggcugguugacucucugcag

SEQ ID NO: 829008 - RNA, 22 nt, Human
cugucaucacaguugagcagcc

SEQ ID NO: 829009 - RNA, 22 nt, Human
agagugaagguugacacuucac

SEQ ID NO: 829010 - RNA, 22 nt, Human
aggcugcuucaauggauaagau

SEQ ID NO: 829011 - RNA, 22 nt, Human
cuaugaaaugucagauucugca

SEQ ID NO: 829012 - RNA, 23 nt, Human
auggaagucacuguuuucuuguc

SEQ ID NO: 829013 - RNA, 22 nt, Human
uuuccaaaggcuaaacucaguu

SEQ ID NO: 829014 - RNA, 22 nt, Human
ugauuucauaguauauacauga

SEQ ID NO: 829015 - RNA, 22 nt, Human
ugggcuggcugaacuucaaccu

SEQ ID NO: 829016 - RNA, 22 nt, Human
auuucuucaggucagaaauaga

SEQ ID NO: 829017 - RNA, 20 nt, Human
ucacaucuggcagcugauga

SEQ ID NO: 829018 - RNA, 22 nt, Human
cccaggugcugcgugaagccuc

SEQ ID NO: 829019 - RNA, 22 nt, Human
uaucagaacacagccacagcca

SEQ ID NO: 829020 - RNA, 22 nt, Human
aggagcagcuucugaaccaugu

SEQ ID NO: 829021 - RNA, 22 nt, Human
caggcagaguuagagcaacugg

SEQ ID NO: 829022 - RNA, 22 nt, Human
uuaacaauagaguuucuucagg

SEQ ID NO: 829023 - RNA, 22 nt, Human
gaagagcuauguccagggagca

SEQ ID NO: 829024 - RNA, 22 nt, Human
agggcagaaguacagacacuua

SEQ ID NO: 829025 - RNA, 22 nt, Human
ccuggaucuccucuauucauau

SEQ ID NO: 829026 - RNA, 22 nt, Human
gguggccuuucaguggaucagg

SEQ ID NO: 829027 - RNA, 22 nt, Human
aggugccagcucucaggcagga

SEQ ID NO: 829028 - RNA, 22 nt, Human
aggcccugggcaguucuguagc

SEQ ID NO: 829029 - RNA, 22 nt, Human
ccagguggaggugugagguccu

SEQ ID NO: 829030 - RNA, 22 nt, Human
gaggccugguuuccagcauccu

SEQ ID NO: 829031 - RNA, 22 nt, Human
acaugcaugucuaugggcaggu

SEQ ID NO: 829032 - RNA, 22 nt, Human
acagagauggcacagagaaggu

SEQ ID NO: 829033 - RNA, 22 nt, Human
caggguagacaguaggugucug

SEQ ID NO: 829034 - RNA, 22 nt, Human
acuucaugcagaagagagcugu

SEQ ID NO: 829035 - RNA, 22 nt, Human
guccucuguagggcugggccac

SEQ ID NO: 829036 - RNA, 22 nt, Human
ugugccagccucuggcuguguc

SEQ ID NO: 829037 - RNA, 20 nt, Human
ugcuguaagauuagagagcu

SEQ ID NO: 829038 - RNA, 22 nt, Human
cuaacuuuagcuuagauuauca

SEQ ID NO: 829039 - RNA, 22 nt, Human
ucaaaguagggguaagccaggc

SEQ ID NO: 829040 - RNA, 22 nt, Human
ggcucaggaccugggauugcca

SEQ ID NO: 829041 - RNA, 22 nt, Human
cauugcacaucugagaagagau

SEQ ID NO: 829042 - RNA, 20 nt, Human
ccugaggguuuguguucuuu

SEQ ID NO: 829043 - RNA, 22 nt, Human
cucuucuuauggccguggcuga

SEQ ID NO: 829044 - RNA, 22 nt, Human
cagggaguuuuuguuccucuag

SEQ ID NO: 829045 - RNA, 22 nt, Human
caagagcugugaccucauucac

SEQ ID NO: 829046 - RNA, 22 nt, Human
aggcugaggcagguggaucauu

SEQ ID NO: 829047 - RNA, 22 nt, Human
uuuuuaagagauucuccagucu

SEQ ID NO: 829048 - RNA, 22 nt, Human
uuggaaauacagcaguuacuuu

SEQ ID NO: 829049 - RNA, 22 nt, Human
guggccuggauagacuccaucu

SEQ ID NO: 829050 - RNA, 23 nt, Human
gggagccauggguggucauggag

SEQ ID NO: 829051 - RNA, 22 nt, Human
agcagggggccacagucacagc

SEQ ID NO: 829052 - RNA, 22 nt, Human
aguacauuuauuaaugguaaaa

SEQ ID NO: 829053 - RNA, 22 nt, Human
gugcugugucuaucaggaauaa

SEQ ID NO: 829054 - RNA, 22 nt, Human
ggaccuggcaauuugcaucucu

SEQ ID NO: 829055 - RNA, 22 nt, Human
aagaugcuuauugcuccugcag

SEQ ID NO: 829056 - RNA, 22 nt, Human
auguacaaaauguuuugaaaug

SEQ ID NO: 829057 - RNA, 23 nt, Human
uaucagugugaugaggcugcugc

SEQ ID NO: 829058 - RNA, 22 nt, Human
uauagagguggaaacugagguu

SEQ ID NO: 829059 - RNA, 22 nt, Human
ucugaggcuucagacuguacug

SEQ ID NO: 829060 - RNA, 22 nt, Human
agaugcugccucuccucacaag

SEQ ID NO: 829061 - RNA, 22 nt, Human
uagccgcuuaauuauuugguga

SEQ ID NO: 829062 - RNA, 22 nt, Human
uaagcauucaaugcuuagcacu

SEQ ID NO: 829063 - RNA, 22 nt, Human
uuuccucugucaugacagcuga

SEQ ID NO: 829064 - RNA, 22 nt, Human
gcccaggaguucaagucuagug

SEQ ID NO: 829065 - RNA, 19 nt, Human
aacuguaauuaauacccua

SEQ ID NO: 829066 - RNA, 22 nt, Human
aaaguuguaauggaagaaaugc

SEQ ID NO: 829067 - RNA, 22 nt, Human
uuguuuuaucuuucuacagacu

SEQ ID NO: 829068 - RNA, 22 nt, Human
uagagaaauaagcuuugccuug

SEQ ID NO: 829069 - RNA, 22 nt, Human
acagacauuuucuguauugccu

SEQ ID NO: 829070 - RNA, 22 nt, Human
ucagaggacgcacuaggguugu

SEQ ID NO: 829071 - RNA, 22 nt, Human
gcuguucagaugcgauucagga

SEQ ID NO: 829072 - RNA, 22 nt, Human
gcugugcagguccccacugccu

SEQ ID NO: 829073 - RNA, 22 nt, Human
ggggauggugggaaggcaaucu

SEQ ID NO: 829074 - RNA, 22 nt, Human
uaacuuucacaucacacugacu

SEQ ID NO: 829075 - RNA, 22 nt, Human
uugcagcuuagugauguuaucu

SEQ ID NO: 829076 - RNA, 22 nt, Human
aggguggcaguuacuggagcaa

SEQ ID NO: 829077 - RNA, 22 nt, Human
cccucuggcucuucucaggccg

SEQ ID NO: 829078 - RNA, 22 nt, Human
cccagguggcagaagcugcagu

SEQ ID NO: 829079 - RNA, 22 nt, Human
gaacacaucacauuuuacagug

SEQ ID NO: 829080 - RNA, 22 nt, Human
ccuggccuuaagggcagggagc

SEQ ID NO: 829081 - RNA, 22 nt, Human
uaucuaaaggauuuaauuuagu

SEQ ID NO: 829082 - RNA, 22 nt, Human
caucagcacuaugauuaaagua

SEQ ID NO: 829083 - RNA, 22 nt, Human
ucucacugcaaauauuauguau

SEQ ID NO: 829084 - RNA, 19 nt, Human
gggcucuggccucaguggg

SEQ ID NO: 829085 - RNA, 22 nt, Human
uguaacaauuucuuacuauugu

SEQ ID NO: 829086 - RNA, 22 nt, Human
cagcucugugcaggccugggga

SEQ ID NO: 829087 - RNA, 22 nt, Human
gcagagcaguacucucuugacu

SEQ ID NO: 829088 - RNA, 22 nt, Human
cagaacauuccaugugcccugc

SEQ ID NO: 829089 - RNA, 22 nt, Human
aaauaugaaugauaagaguuau

SEQ ID NO: 829090 - RNA, 22 nt, Human
uagacacaagagaaggguauaa

SEQ ID NO: 829091 - RNA, 22 nt, Human
uacacuuuuuacuacagauucu

SEQ ID NO: 829092 - RNA, 22 nt, Human
uagcccagagucccaauuccag

SEQ ID NO: 829093 - RNA, 22 nt, Human
ucccaguguggcaggccaugga

SEQ ID NO: 829094 - RNA, 22 nt, Human
ccagcagccaccuucucgaaau

SEQ ID NO: 829095 - RNA, 22 nt, Human
uguguuuuacaaauucucuuaa

SEQ ID NO: 829096 - RNA, 22 nt, Human
agugcuuugugcucucacugca

SEQ ID NO: 829097 - RNA, 22 nt, Human
ucaucuucuauuaauagggaga

SEQ ID NO: 829098 - RNA, 22 nt, Human
gcccagagagaugcuguagacc

SEQ ID NO: 829099 - RNA, 22 nt, Human
ggcacucagagauucaggcugu

SEQ ID NO: 829100 - RNA, 22 nt, Human
ggaugcuggggaccaaucucug

SEQ ID NO: 829101 - RNA, 22 nt, Human
caugggcuacagaagcaugcug

SEQ ID NO: 829102 - RNA, 22 nt, Human
acuuugcaauacuuaauacaaa

SEQ ID NO: 829103 - RNA, 22 nt, Human
cuuggccucuucucaggguggg

SEQ ID NO: 829104 - RNA, 20 nt, Human
ucaggcaguggggaaaggca

SEQ ID NO: 829105 - RNA, 22 nt, Human
gcuggcuguguuucaucucuga

SEQ ID NO: 829106 - RNA, 22 nt, Human
gaagcucucaaacucuccccuu

SEQ ID NO: 829107 - RNA, 22 nt, Human
auuaggcagugccauuguacgg

SEQ ID NO: 829108 - RNA, 22 nt, Human
ugaccuuauuugaaaauagaga

SEQ ID NO: 829109 - RNA, 22 nt, Human
ccugucacgaugacugcacucu

SEQ ID NO: 829110 - RNA, 22 nt, Human
uguacaaucugaugauguaugg

SEQ ID NO: 829111 - RNA, 22 nt, Human
uggaggaaguugcuggaaguca

SEQ ID NO: 829112 - RNA, 22 nt, Human
aaguaugacauuuaagacaauu

SEQ ID NO: 829113 - RNA, 22 nt, Human
uaaauuauggcuggcagagcag

SEQ ID NO: 829114 - RNA, 22 nt, Human
gacccuguuucuacaaauaauu

SEQ ID NO: 829115 - RNA, 23 nt, Human
gcucugagggcuuaucccuccca

SEQ ID NO: 829116 - RNA, 22 nt, Human
cauuuacacacagaggugugcu

SEQ ID NO: 829117 - RNA, 22 nt, Human
ggcagagcugcaugagcacuca

SEQ ID NO: 829118 - RNA, 22 nt, Human
aaaugucuuucuucugcuacgu

SEQ ID NO: 829119 - RNA, 22 nt, Human
uuguuauaaagacuaaauaugu

SEQ ID NO: 829120 - RNA, 22 nt, Human
agggagagguugaaaccucagu

SEQ ID NO: 829121 - RNA, 22 nt, Human
ucugaaagaagggcagucuuuu

SEQ ID NO: 829122 - RNA, 22 nt, Human
cacuggggugggccugguagag

SEQ ID NO: 829123 - RNA, 21 nt, Human
aagcaggacauaugaugcccu

SEQ ID NO: 829124 - RNA, 22 nt, Human
cuguggaaauaaacaaugcuaa

SEQ ID NO: 829125 - RNA, 22 nt, Human
cccaggagauggugcguggucu

SEQ ID NO: 829126 - RNA, 21 nt, Human
uucaagauauuuaaaaggugg

SEQ ID NO: 829127 - RNA, 22 nt, Human
aaaugcuugcucuugauuauuu

SEQ ID NO: 829128 - RNA, 22 nt, Human
aaaugucuuugaguauuucugc

SEQ ID NO: 829129 - RNA, 22 nt, Human
cauggcuuuguucuguuagaug

SEQ ID NO: 829130 - RNA, 22 nt, Human
uggcagagucugggcuugggca

SEQ ID NO: 829131 - RNA, 22 nt, Human
auguuagaaucucugaaugugg

SEQ ID NO: 829132 - RNA, 22 nt, Human
ggacaagccugugaguggguuu

SEQ ID NO: 829133 - RNA, 22 nt, Human
augguuuguguggcccagauga

SEQ ID NO: 829134 - RNA, 22 nt, Human
guccagggcuaaaucagguucc

SEQ ID NO: 829135 - RNA, 21 nt, Human
aaaguucaugcuuuaauauuc

SEQ ID NO: 829136 - RNA, 22 nt, Human
ucuuuauugcuacugguuuguc

SEQ ID NO: 829137 - RNA, 22 nt, Human
acaauguguuuuuauacauuug

SEQ ID NO: 829138 - RNA, 19 nt, Human
gcucugagaggggcauggg

SEQ ID NO: 829139 - RNA, 22 nt, Human
ugaggcaggagaaucaccggaa

SEQ ID NO: 829140 - RNA, 22 nt, Human
caggggcuagcacuuaauguuu

SEQ ID NO: 829141 - RNA, 22 nt, Human
ucugucaauauaugugcugcag

SEQ ID NO: 829142 - RNA, 22 nt, Human
cagcgucucguugugggccucg

SEQ ID NO: 829143 - RNA, 22 nt, Human
ccugcagcuccggauuucuggg

SEQ ID NO: 829144 - RNA, 22 nt, Human
ccucugcaccauagccuucagc

SEQ ID NO: 829145 - RNA, 22 nt, Human
ucaaagucauggcuaguaauga

SEQ ID NO: 829146 - RNA, 22 nt, Human
ggcuucugccacgagagggaag

SEQ ID NO: 829147 - RNA, 22 nt, Human
augggguggaguccgggcagcg

SEQ ID NO: 829148 - RNA, 22 nt, Human
ucaagagacaggacguguuuca

SEQ ID NO: 829149 - RNA, 19 nt, Human
cccagcuugaccaccugcu

SEQ ID NO: 829150 - RNA, 22 nt, Human
uuagaaaauuugcuucuuugga

SEQ ID NO: 829151 - RNA, 22 nt, Human
uaagaaucggucgcaacagagg

SEQ ID NO: 829152 - RNA, 22 nt, Human
ugccagcccaccuuggggccuc

SEQ ID NO: 829153 - RNA, 18 nt, Human
agcuggcccuggcugccg

SEQ ID NO: 829154 - RNA, 22 nt, Human
aggggccauuguucugcccgcu

SEQ ID NO: 829155 - RNA, 22 nt, Human
uuuccucuccggggccuccagg

SEQ ID NO: 829156 - RNA, 22 nt, Human
cugggcacaaguggcccuggau

SEQ ID NO: 829157 - RNA, 22 nt, Human
aaugaugguauugaugagcuaa

SEQ ID NO: 829158 - RNA, 22 nt, Human
gcggagggcgagcccgcggagc

SEQ ID NO: 829159 - RNA, 22 nt, Human
gcagagguggcaucugggcucu

SEQ ID NO: 829160 - RNA, 22 nt, Human
uccaagggcagccauagaacuu

SEQ ID NO: 829161 - RNA, 22 nt, Human
gcaguggcuaggagucuggcgu

SEQ ID NO: 829162 - RNA, 22 nt, Human
uuugcauuaguuuagauuucaa

SEQ ID NO: 829163 - RNA, 20 nt, Human
guccugggagccacagcaca

SEQ ID NO: 829164 - RNA, 19 nt, Human
cuggccaggccaggggccc

SEQ ID NO: 829165 - RNA, 22 nt, Human
gaacaguaaauuuaugcagcac

SEQ ID NO: 829166 - RNA, 18 nt, Human
ucuuccaacacugacacc

SEQ ID NO: 829167 - RNA, 22 nt, Human
aaggcagcaccgccuccugaaa

SEQ ID NO: 829168 - RNA, 21 nt, Human
uucagcaguccucuagagaua

SEQ ID NO: 829169 - RNA, 22 nt, Human
agaugcugcuccacaggccagg

SEQ ID NO: 829170 - RNA, 18 nt, Human
gugcugugggcaguggcc

SEQ ID NO: 829171 - RNA, 22 nt, Human
ugcauuguuugauaggugaauu

SEQ ID NO: 829172 - RNA, 22 nt, Human
uaagaaucugcauuuuaacaag

SEQ ID NO: 829173 - RNA, 21 nt, Human
gcagagccugagguucuugag

SEQ ID NO: 829174 - RNA, 22 nt, Human
aggugagugugacugcaagaga

SEQ ID NO: 829175 - RNA, 22 nt, Human
cagcagagaccaagugauuuga

SEQ ID NO: 829176 - RNA, 22 nt, Human
ugcuggggcucugaccacucca

SEQ ID NO: 829177 - RNA, 22 nt, Human
caggagccccaggcugacaaua

SEQ ID NO: 829178 - RNA, 22 nt, Human
ucuguucagaauuguaacacuc

SEQ ID NO: 829179 - RNA, 22 nt, Human
uauguacaaucagcaguucaua

SEQ ID NO: 829180 - RNA, 22 nt, Human
agauauaauaauuuacaagugu

SEQ ID NO: 829181 - RNA, 22 nt, Human
guagaaauauuuaucucugaga

SEQ ID NO: 829182 - RNA, 22 nt, Human
caguccuuggcaaguucucagu

SEQ ID NO: 829183 - RNA, 22 nt, Human
agccagcuggagaccacuguuu

SEQ ID NO: 829184 - RNA, 22 nt, Human
agcugcucuuugaaggacacuu

SEQ ID NO: 829185 - RNA, 22 nt, Human
gcuuuauguaaguccaaaggca

SEQ ID NO: 829186 - RNA, 22 nt, Human
uauuucuuguuauucucguuga

SEQ ID NO: 829187 - RNA, 22 nt, Human
augcaguacugauacaugccac

SEQ ID NO: 829188 - RNA, 23 nt, Human
ugcugguguuuuugggaccaggg

SEQ ID NO: 829189 - RNA, 22 nt, Human
ccuuggcccuagccucaggcaa

SEQ ID NO: 829190 - RNA, 22 nt, Human
gugugaaaaugugcacaauaug

SEQ ID NO: 829191 - RNA, 22 nt, Human
ggcagggugccuggcuccuguu

SEQ ID NO: 829192 - RNA, 22 nt, Human
agcaggugcauggcgagcgcgg

SEQ ID NO: 829193 - RNA, 19 nt, Human
ugagagugaggaaggcuuc

SEQ ID NO: 829194 - RNA, 22 nt, Human
agucccagcccaguccuguaag

SEQ ID NO: 829195 - RNA, 22 nt, Human
cacaauuuccaagucauguuau

SEQ ID NO: 829196 - RNA, 22 nt, Human
auaguauuuaauaguuagcuca

SEQ ID NO: 829197 - RNA, 23 nt, Human
agaggccaacuucuugccccucc

SEQ ID NO: 829198 - RNA, 22 nt, Human
gagccagcuauguagcaagagg

SEQ ID NO: 829199 - RNA, 22 nt, Human
ucucuucuaacacuagaaauuc

SEQ ID NO: 829200 - RNA, 22 nt, Human
gcuguuccugcuuagaggucgg

SEQ ID NO: 829201 - RNA, 22 nt, Human
uguuauugagguuacuuauaag

SEQ ID NO: 829202 - RNA, 21 nt, Human
ccuauugaauauaggaagauu

SEQ ID NO: 829203 - RNA, 22 nt, Human
cacuggggaaaacaggcuucuu

SEQ ID NO: 829204 - RNA, 22 nt, Human
uagccuucucaagacaaaguug

SEQ ID NO: 829205 - RNA, 22 nt, Human
ggagagaaauugagguagcaag

SEQ ID NO: 829206 - RNA, 22 nt, Human
ccacagccauuccagggaggcu

SEQ ID NO: 829207 - RNA, 22 nt, Human
ucucuucuagcuucuugugguu

SEQ ID NO: 829208 - RNA, 22 nt, Human
gcucugcugagauaucugggag

SEQ ID NO: 829209 - RNA, 18 nt, Human
aggcaggcuggagugacu

SEQ ID NO: 829210 - RNA, 22 nt, Human
ccuguucaagguauuaauuauc

SEQ ID NO: 829211 - RNA, 22 nt, Human
uguuugaaacuuugaucacuaa

SEQ ID NO: 829212 - RNA, 22 nt, Human
acuaaauacacacauuuguuca

SEQ ID NO: 829213 - RNA, 19 nt, Human
acacagggaucagaggguu

SEQ ID NO: 829214 - RNA, 22 nt, Human
augaguaaaaccacuauuuaca

SEQ ID NO: 829215 - RNA, 22 nt, Human
guaggcagguggaggagugaag

SEQ ID NO: 829216 - RNA, 22 nt, Human
uggcucugugcuucuaguaucu

SEQ ID NO: 829217 - RNA, 22 nt, Human
cagaagucacccucagaauaac

SEQ ID NO: 829218 - RNA, 22 nt, Human
uccuggagccacggagcuuuca

SEQ ID NO: 829219 - RNA, 22 nt, Human
cucugguguccuuuagaauuua

SEQ ID NO: 829220 - RNA, 22 nt, Human
ucuggagcuggcagggcccugg

SEQ ID NO: 829221 - RNA, 22 nt, Human
uuugcaauuugugcugcaaaug

SEQ ID NO: 829222 - RNA, 22 nt, Human
ggccaggcuggucucagacuuc

SEQ ID NO: 829223 - RNA, 22 nt, Human
ucuuaaagagcgcaauuugagg

SEQ ID NO: 829224 - RNA, 22 nt, Human
gcugauguaagacuuuugguuu

SEQ ID NO: 829225 - RNA, 22 nt, Human
cugaagaugucugagaugcuca

SEQ ID NO: 829226 - RNA, 22 nt, Human
cauagaaaagaguagguaaugu

SEQ ID NO: 829227 - RNA, 22 nt, Human
uuccauauuuguguggcaaaag

SEQ ID NO: 829228 - RNA, 22 nt, Human
agcuggccuccgggugccuggg

SEQ ID NO: 829229 - RNA, 22 nt, Human
uugaacaguccuaagagacccu

SEQ ID NO: 829230 - RNA, 21 nt, Human
aagccucaagcagaagacaga

SEQ ID NO: 829231 - RNA, 22 nt, Human
acccaggguagagugcaguggc

SEQ ID NO: 829232 - RNA, 20 nt, Human
cuuccacacaagaagcacag

SEQ ID NO: 829233 - RNA, 22 nt, Human
aaggcagccuuuguuugauuga

SEQ ID NO: 829234 - RNA, 22 nt, Human
ccaggagacccagggaaggagc

SEQ ID NO: 829235 - RNA, 20 nt, Human
uccaggagaacugggagccg

SEQ ID NO: 829236 - RNA, 22 nt, Human
cugucaggggcggguggagcgg

SEQ ID NO: 829237 - RNA, 22 nt, Human
cgagaguggacagggcgcagcu

SEQ ID NO: 829238 - RNA, 19 nt, Human
aggcaggugcagagguccc

SEQ ID NO: 829239 - RNA, 22 nt, Human
ugucaguguauacauacaguau

SEQ ID NO: 829240 - RNA, 22 nt, Human
aacaaauguguggcaguguggg

SEQ ID NO: 829241 - RNA, 22 nt, Human
uccagugguuugaaaggggugu

SEQ ID NO: 829242 - RNA, 22 nt, Human
uuagaaaaaggcuguggucuua

SEQ ID NO: 829243 - RNA, 22 nt, Human
aggccuguuccaggccccuuuu

SEQ ID NO: 829244 - RNA, 22 nt, Human
aauguguauaugaacauacagg

SEQ ID NO: 829245 - RNA, 22 nt, Human
gcugguuuccuuaucuauaaag

SEQ ID NO: 829246 - RNA, 22 nt, Human
uuaagacauucagauauuucua

SEQ ID NO: 829247 - RNA, 22 nt, Human
uaucagaaacucuggggcaggg

SEQ ID NO: 829248 - RNA, 22 nt, Human
ucuucagauaaagggagaguau

SEQ ID NO: 829249 - RNA, 22 nt, Human
caaucaguaaccggaucauggu

SEQ ID NO: 829250 - RNA, 22 nt, Human
guggccuggaugagcuucgaca

SEQ ID NO: 829251 - RNA, 22 nt, Human
caauguguuugcauauuaaaau

SEQ ID NO: 829252 - RNA, 20 nt, Human
uaagaacaagacuaggaagc

SEQ ID NO: 829253 - RNA, 19 nt, Human
cugggagguguucagagaa

SEQ ID NO: 829254 - RNA, 22 nt, Human
guuuacaaauauuuuaaauggu

SEQ ID NO: 829255 - RNA, 22 nt, Human
ccuuccaggugcaggcaagccu

SEQ ID NO: 829256 - RNA, 22 nt, Human
cagaucuagagcuuuuccaucu

SEQ ID NO: 829257 - RNA, 23 nt, Human
uuaaacuucagugcagaacacuc

SEQ ID NO: 829258 - RNA, 22 nt, Human
auuuccuagccucucuugcagu

SEQ ID NO: 829259 - RNA, 22 nt, Human
cccaggaaagagacugcugggu

SEQ ID NO: 829260 - RNA, 22 nt, Human
acuuccugcuaugagcuucugu

SEQ ID NO: 829261 - RNA, 22 nt, Human
ugcccagcacugugccagucac

SEQ ID NO: 829262 - RNA, 22 nt, Human
ugggcagacuaaggucaaagcu

SEQ ID NO: 829263 - RNA, 22 nt, Human
gaaaggagggaaacagagcggu

SEQ ID NO: 829264 - RNA, 22 nt, Human
aggcacuguggaagacaugguu

SEQ ID NO: 829265 - RNA, 20 nt, Human
aacagggggcugcagagggc

SEQ ID NO: 829266 - RNA, 22 nt, Human
ucauuuguggaagugauugugg

SEQ ID NO: 829267 - RNA, 22 nt, Human
caaaguccauaguuuacaauag

SEQ ID NO: 829268 - RNA, 22 nt, Human
ccagggcugagcugugaccaug

SEQ ID NO: 829269 - RNA, 22 nt, Human
augacagaggagugcaggugau

SEQ ID NO: 829270 - RNA, 22 nt, Human
cuuggcugucuauaggaaagag

SEQ ID NO: 829271 - RNA, 22 nt, Human
uggcuggacagugggcagugga

SEQ ID NO: 829272 - RNA, 22 nt, Human
ccuguguguaggccaggggagu

SEQ ID NO: 829273 - RNA, 22 nt, Human
gagucacauuaauuuaauuuua

SEQ ID NO: 829274 - RNA, 22 nt, Human
ucccagagcugauaagccuuua

SEQ ID NO: 829275 - RNA, 22 nt, Human
agcaguggagcgagauguuuaa

SEQ ID NO: 829276 - RNA, 22 nt, Human
aagaaacaaccacugcucuccu

SEQ ID NO: 829277 - RNA, 22 nt, Human
cagcuuggaggaggaucuaaga

SEQ ID NO: 829278 - RNA, 22 nt, Human
acauuucacuguucacagcagg

SEQ ID NO: 829279 - RNA, 22 nt, Human
ucuguucacugagcaauggcaa

SEQ ID NO: 829280 - RNA, 22 nt, Human
acauuuacagugcuagacaauc

SEQ ID NO: 829281 - RNA, 20 nt, Human
agagccuugaggaagaugau

SEQ ID NO: 829282 - RNA, 22 nt, Human
ccagaccacccuggccaugcac

SEQ ID NO: 829283 - RNA, 22 nt, Human
ggcagcacugcagcuuguuggg

SEQ ID NO: 829284 - RNA, 21 nt, Human
cagggcacacagaggauggua

SEQ ID NO: 829285 - RNA, 20 nt, Human
gggaguggugguagccugug

SEQ ID NO: 829286 - RNA, 22 nt, Human
aaaaugaggucaauauccuuuu

SEQ ID NO: 829287 - RNA, 22 nt, Human
cagggcagcuuccuuuguuagg

SEQ ID NO: 829288 - RNA, 22 nt, Human
gcaggcagagagggguuuccag

SEQ ID NO: 829289 - RNA, 22 nt, Human
guuuuauaggcuguugcuauau

SEQ ID NO: 829290 - RNA, 22 nt, Human
gacccaggagagaggguugcau

SEQ ID NO: 829291 - RNA, 22 nt, Human
cagccaggagcucccccugcuc

SEQ ID NO: 829292 - RNA, 22 nt, Human
cagaauuugaaguaauauucca

SEQ ID NO: 829293 - RNA, 22 nt, Human
uuuaaauggcauuuucccagau

SEQ ID NO: 829294 - RNA, 22 nt, Human
cagcugccccauaaaucacagu

SEQ ID NO: 829295 - RNA, 22 nt, Human
guuuuucuuugugugaagacaa

SEQ ID NO: 829296 - RNA, 22 nt, Human
auuugucuucaguagguucuuc

SEQ ID NO: 829297 - RNA, 22 nt, Human
uucacauuaucaggauuguuuc

SEQ ID NO: 829298 - RNA, 22 nt, Human
ccugccaggagcuggugcugca

SEQ ID NO: 829299 - RNA, 22 nt, Human
gaggcagcagaacauggaagag

SEQ ID NO: 829300 - RNA, 22 nt, Human
caagcccaggauuccccaguua

SEQ ID NO: 829301 - RNA, 22 nt, Human
uguacauacauagauauacaca

SEQ ID NO: 829302 - RNA, 22 nt, Human
aaugcacaugccacauguggua

SEQ ID NO: 829303 - RNA, 22 nt, Human
uuaugauuugccacagauuggu

SEQ ID NO: 829304 - RNA, 22 nt, Human
caguugcuggaugugcagcucu

SEQ ID NO: 829305 - RNA, 22 nt, Human
ucagaggguggcugggagcauc

SEQ ID NO: 829306 - RNA, 22 nt, Human
gaggccagcgcgcagcacuuuu

SEQ ID NO: 829307 - RNA, 22 nt, Human
ucagaaauacaaaacacuuacu

SEQ ID NO: 829308 - RNA, 22 nt, Human
aggcucuguuauucuagagggc

SEQ ID NO: 829309 - RNA, 22 nt, Human
ucacugcagagaccucuaguca

SEQ ID NO: 829310 - RNA, 22 nt, Human
uggagccugagucagcggaggc

SEQ ID NO: 829311 - RNA, 22 nt, Human
gggacuggaguagaggccggug

SEQ ID NO: 829312 - RNA, 22 nt, Human
aagaugcagcuuccacuuuugc

SEQ ID NO: 829313 - RNA, 22 nt, Human
aguucacauaucuguuuuauuu

SEQ ID NO: 829314 - RNA, 22 nt, Human
uagaaaguaaaucaguuuuauu

SEQ ID NO: 829315 - RNA, 22 nt, Human
gcucugucaacagcuagcugug

SEQ ID NO: 829316 - RNA, 22 nt, Human
gcuucuggaggagcugggcuga

SEQ ID NO: 829317 - RNA, 22 nt, Human
uaaaguucagugcaugaaugug

SEQ ID NO: 829318 - RNA, 22 nt, Human
aggacagggauucaaacuccca

SEQ ID NO: 829319 - RNA, 22 nt, Human
ugugcuucugcagagacuauuu

SEQ ID NO: 829320 - RNA, 22 nt, Human
ugugcagggaagggcaugcuau

SEQ ID NO: 829321 - RNA, 22 nt, Human
cacagggcuuugauggcugagu

SEQ ID NO: 829322 - RNA, 22 nt, Human
cuguagcagugugcucuuuuuc

SEQ ID NO: 829323 - RNA, 22 nt, Human
caggcagcugggucaccguccc

SEQ ID NO: 829324 - RNA, 23 nt, Human
aguuuguaaagaaauauuugcac

SEQ ID NO: 829325 - RNA, 22 nt, Human
cugcccugccuggccagugugg

SEQ ID NO: 829326 - RNA, 22 nt, Human
aaucagucucauuuagcaggga

SEQ ID NO: 829327 - RNA, 22 nt, Human
agauacaugucaagagacuuau

SEQ ID NO: 829328 - RNA, 22 nt, Human
agaauaucguagcauauuaucu

SEQ ID NO: 829329 - RNA, 22 nt, Human
uuuccucuuauacaguguuuau

SEQ ID NO: 829330 - RNA, 21 nt, Human
agcagaacagucgagcacugc

SEQ ID NO: 829331 - RNA, 22 nt, Human
aauuacuuaagagaaacuuuga

SEQ ID NO: 829332 - RNA, 22 nt, Human
uggaaggcaacggagugagcug

SEQ ID NO: 829333 - RNA, 20 nt, Human
cucaggauugucuagccccu

SEQ ID NO: 829334 - RNA, 22 nt, Human
ccugagagagaagcgaccuggu

SEQ ID NO: 829335 - RNA, 21 nt, Human
ugcagcugacacugguaugcc

SEQ ID NO: 829336 - RNA, 17 nt, Human
agagagagcaugccacc

SEQ ID NO: 829337 - RNA, 22 nt, Human
uauuucugucagccagauaugg

SEQ ID NO: 829338 - RNA, 22 nt, Human
aauauuucuccuucguuauagc

SEQ ID NO: 829339 - RNA, 22 nt, Human
aagaaucauccugcaagagucu

SEQ ID NO: 829340 - RNA, 23 nt, Human
aaugauuucaugaugauagcagc

SEQ ID NO: 829341 - RNA, 22 nt, Human
ucagaagcugguguccuuugaa

SEQ ID NO: 829342 - RNA, 22 nt, Human
agaagcaguuauuuuuugcaca

SEQ ID NO: 829343 - RNA, 22 nt, Human
ugcugccuccaacuccugggcu

SEQ ID NO: 829344 - RNA, 22 nt, Human
cugcugagcccuggcacaggug

SEQ ID NO: 829345 - RNA, 16 nt, Human
gggcugggggauucug

SEQ ID NO: 829346 - RNA, 22 nt, Human
ccugccucaucaacuugucgug

SEQ ID NO: 829347 - RNA, 22 nt, Human
gcucugggaacugacugccuuc

SEQ ID NO: 829348 - RNA, 22 nt, Human
ugucaaaaugacuuuacuacag

SEQ ID NO: 829349 - RNA, 22 nt, Human
aaucucuuuggcucaaggaucc

SEQ ID NO: 829350 - RNA, 22 nt, Human
uaaggcaccauaauauauuuaa

SEQ ID NO: 829351 - RNA, 18 nt, Human
ggucuuuaggucaguguc

SEQ ID NO: 829352 - RNA, 22 nt, Human
uucuuacagaguuuacagagcc

SEQ ID NO: 829353 - RNA, 22 nt, Human
ccaggccuuucuucuuggucug

SEQ ID NO: 829354 - RNA, 22 nt, Human
aggaagcuagagccaccggacu

SEQ ID NO: 829355 - RNA, 22 nt, Human
ucagaaaauaacuguuaguuug

SEQ ID NO: 829356 - RNA, 22 nt, Human
acugugcacaauucuaaguccu

SEQ ID NO: 829357 - RNA, 22 nt, Human
uuagcuaaacuguaacuagaau

SEQ ID NO: 829358 - RNA, 22 nt, Human
guuugcauaucugugaaaugga

SEQ ID NO: 829359 - RNA, 20 nt, Human
uuucuugucggcuguugcug

SEQ ID NO: 829360 - RNA, 22 nt, Human
ucaaaauucuagggagaauggu

SEQ ID NO: 829361 - RNA, 22 nt, Human
uggcugccuuucaccucaucuc

SEQ ID NO: 829362 - RNA, 22 nt, Human
uggcauuuuguucaguauaugg

SEQ ID NO: 829363 - RNA, 22 nt, Human
auggaagguccuacagagcgca

SEQ ID NO: 829364 - RNA, 22 nt, Human
aagugguaggaagagagcacug

SEQ ID NO: 829365 - RNA, 22 nt, Human
cacacaugagucuccccauugg

SEQ ID NO: 829366 - RNA, 23 nt, Human
gggagccaggaccucgcgcccca

SEQ ID NO: 829367 - RNA, 23 nt, Human
uagggcagcugggagggacaugc

SEQ ID NO: 829368 - RNA, 22 nt, Human
ucagagugcagcgggaggcugg

SEQ ID NO: 829369 - RNA, 22 nt, Human
agggcagcacagcugugcuccu

SEQ ID NO: 829370 - RNA, 22 nt, Human
aaacagcuaauggccaggaaua

SEQ ID NO: 829371 - RNA, 22 nt, Human
uggcagcauguuauguaaggaa

SEQ ID NO: 829372 - RNA, 22 nt, Human
auuagcugaccucuaaggagcc

SEQ ID NO: 829373 - RNA, 22 nt, Human
agggagcucaguuggaagcggu

SEQ ID NO: 829374 - RNA, 22 nt, Human
uggccuggccacauccagcagg

SEQ ID NO: 829375 - RNA, 22 nt, Human
ucugugcauuguaacaacuaaa

SEQ ID NO: 829376 - RNA, 22 nt, Human
cugggcacauuuugacuagugu

SEQ ID NO: 829377 - RNA, 21 nt, Human
uccucugcagugagguggccu

SEQ ID NO: 829378 - RNA, 19 nt, Human
cagagcugcuggccucguc

SEQ ID NO: 829379 - RNA, 22 nt, Human
gccccugggagcagagccacca

SEQ ID NO: 829380 - RNA, 22 nt, Human
ucagagugggagaaugugccaa

SEQ ID NO: 829381 - RNA, 22 nt, Human
ugaggcagugugagauaauaaa

SEQ ID NO: 829382 - RNA, 22 nt, Human
auggcuuuucacagaggguucu

SEQ ID NO: 829383 - RNA, 22 nt, Human
ggccagcucuuguccacggagg

SEQ ID NO: 829384 - RNA, 22 nt, Human
ccauaauauuaaaugcuuuugu

SEQ ID NO: 829385 - RNA, 18 nt, Human
gcugucugaggucugagg

SEQ ID NO: 829386 - RNA, 22 nt, Human
acuuccugcagcuucucagccc

SEQ ID NO: 829387 - RNA, 22 nt, Human
aaaucugggucaagguggagug

SEQ ID NO: 829388 - RNA, 22 nt, Human
uaugcccagcuuaaaguacaca

SEQ ID NO: 829389 - RNA, 22 nt, Human
ugaagcugugggcaguggagcc

SEQ ID NO: 829390 - RNA, 22 nt, Human
agaagccauguuuaguaggaug

SEQ ID NO: 829391 - RNA, 22 nt, Human
uuuucauuguuacuaugagcua

SEQ ID NO: 829392 - RNA, 22 nt, Human
agagccuugaagaucuggaaaa

SEQ ID NO: 829393 - RNA, 22 nt, Human
ggagucagccugucagagugua

SEQ ID NO: 829394 - RNA, 22 nt, Human
ggcugucugugguggagcguug

SEQ ID NO: 829395 - RNA, 22 nt, Human
gccuggagacaaggacaaaggg

SEQ ID NO: 829396 - RNA, 23 nt, Human
ugagcugguauuguccaucucca

SEQ ID NO: 829397 - RNA, 22 nt, Human
aggcuggcuuggcucuccugug

SEQ ID NO: 829398 - RNA, 22 nt, Human
gugcucacugugagacguccug

SEQ ID NO: 829399 - RNA, 22 nt, Human
aucuuucaaucaggaaaaaucu

SEQ ID NO: 829400 - RNA, 22 nt, Human
ugucaccaccggaagaaacugc

SEQ ID NO: 829401 - RNA, 22 nt, Human
cuggcucagacagcugugcagu

SEQ ID NO: 829402 - RNA, 22 nt, Human
ugggcacuguagcuggugcugg

SEQ ID NO: 829403 - RNA, 22 nt, Human
ugcauuguuuagaacucuuugg

SEQ ID NO: 829404 - RNA, 22 nt, Human
cuggccucauagccaagcugug

SEQ ID NO: 829405 - RNA, 22 nt, Human
uagggcaguuucauguuaucuu

SEQ ID NO: 829406 - RNA, 22 nt, Human
caacugcugacaccaucacucc

SEQ ID NO: 829407 - RNA, 22 nt, Human
agucccuguacuuuccacugcc

SEQ ID NO: 829408 - RNA, 22 nt, Human
acagggcagagaggcaggcuug

SEQ ID NO: 829409 - RNA, 22 nt, Human
uucuccgcuaaguucucugcag

SEQ ID NO: 829410 - RNA, 22 nt, Human
agccuccaaaugucaggucccg

SEQ ID NO: 829411 - RNA, 22 nt, Human
uggaagccaggcccgcuccuaa

SEQ ID NO: 829412 - RNA, 22 nt, Human
uucuggagcuaaaguccacucu

SEQ ID NO: 829413 - RNA, 22 nt, Human
ccagggccaguaagauuggcau

SEQ ID NO: 829414 - RNA, 22 nt, Human
aagaauucacugguagagucaa

SEQ ID NO: 829415 - RNA, 22 nt, Human
uugaaaggguuaaagugguaaa

SEQ ID NO: 829416 - RNA, 22 nt, Human
uauuucugggaguucagaaauu

SEQ ID NO: 829417 - RNA, 20 nt, Human
ggagagcagggaagacagua

SEQ ID NO: 829418 - RNA, 22 nt, Human
aucauguuccagaaacagugau

SEQ ID NO: 829419 - RNA, 22 nt, Human
agcagcuggugagcaagcucag

SEQ ID NO: 829420 - RNA, 22 nt, Human
ugucuccucauacugucauauu

SEQ ID NO: 829421 - RNA, 22 nt, Human
ccaaggcuucccagagaugcuc

SEQ ID NO: 829422 - RNA, 22 nt, Human
cggggcuguagcacagcugagc

SEQ ID NO: 829423 - RNA, 23 nt, Human
uggcagugaucaaaagcuuacau

SEQ ID NO: 829424 - RNA, 20 nt, Human
uacagaaacaggacuuuugg

SEQ ID NO: 829425 - RNA, 22 nt, Human
uuguuuuuaugaacauccagga

SEQ ID NO: 829426 - RNA, 19 nt, Human
agacagagcucaguggguu

SEQ ID NO: 829427 - RNA, 22 nt, Human
uccucagggaagaugagccuca

SEQ ID NO: 829428 - RNA, 22 nt, Human
agcugccagaugacagugcuau

SEQ ID NO: 829429 - RNA, 22 nt, Human
gucccagggaugcagacaugag

SEQ ID NO: 829430 - RNA, 22 nt, Human
ggcauguuucaucacaucaaga

SEQ ID NO: 829431 - RNA, 22 nt, Human
uggcagaggaaaaagucacugg

SEQ ID NO: 829432 - RNA, 22 nt, Human
gcacagccagcaucugagggau

SEQ ID NO: 829433 - RNA, 22 nt, Human
gcccaggaguugaagggcugac

SEQ ID NO: 829434 - RNA, 22 nt, Human
cagacacaccaggcccauucug

SEQ ID NO: 829435 - RNA, 22 nt, Human
ucuggucaguaauaagaagugg

SEQ ID NO: 829436 - RNA, 22 nt, Human
cuggaagguucuuugugugccu

SEQ ID NO: 829437 - RNA, 22 nt, Human
uugcuucaguagcucuuuaaag

SEQ ID NO: 829438 - RNA, 22 nt, Human
aaauccuaaggagaauaugauu

SEQ ID NO: 829439 - RNA, 22 nt, Human
aagcaccuggguuauaucuuag

SEQ ID NO: 829440 - RNA, 22 nt, Human
cucuggagaacuccuugugucu

SEQ ID NO: 829441 - RNA, 22 nt, Human
cuggccuagcucucugcuugaa

SEQ ID NO: 829442 - RNA, 22 nt, Human
gaaaggugccccauaggcagga

SEQ ID NO: 829443 - RNA, 22 nt, Human
cugguuuagcuguaagguuccc

SEQ ID NO: 829444 - RNA, 22 nt, Human
uagucuuuuuaauaaauaaugc

SEQ ID NO: 829445 - RNA, 22 nt, Human
agcagccaagguaaccugugcu

SEQ ID NO: 829446 - RNA, 22 nt, Human
uuguccuuggaugaagcuggga

SEQ ID NO: 829447 - RNA, 22 nt, Human
gugauuuaguguuaaguauguu

SEQ ID NO: 829448 - RNA, 22 nt, Human
acuguacacgugucauuuacag

SEQ ID NO: 829449 - RNA, 22 nt, Human
cccuggaggaccccaauguggc

SEQ ID NO: 829450 - RNA, 22 nt, Human
uuucaaauaccauaaaccuaau

SEQ ID NO: 829451 - RNA, 17 nt, Human
gcuuccugugcugggga

SEQ ID NO: 829452 - RNA, 17 nt, Human
uggcuucccugggccac

SEQ ID NO: 829453 - RNA, 22 nt, Human
aaagaaauagauggcauuuaaa

SEQ ID NO: 829454 - RNA, 22 nt, Human
aggccagggucccacacucgca

SEQ ID NO: 829455 - RNA, 22 nt, Human
gggcuccagcccgggaccaggu

SEQ ID NO: 829456 - RNA, 22 nt, Human
ggcaaaguuuucaucucauaac

SEQ ID NO: 829457 - RNA, 22 nt, Human
ucagcaaugagaacuggcauuu

SEQ ID NO: 829458 - RNA, 22 nt, Human
augaacaauaaaauagaucaca

SEQ ID NO: 829459 - RNA, 17 nt, Human
uucaaugauuaaugcau

SEQ ID NO: 829460 - RNA, 18 nt, Human
ccagguggugacagagau

SEQ ID NO: 829461 - RNA, 21 nt, Human
gggcagcucuguuuuauuuuc

SEQ ID NO: 829462 - RNA, 22 nt, Human
acuuuggaucugauguaaucag

SEQ ID NO: 829463 - RNA, 22 nt, Human
aggcacugugcugaugucuuau

SEQ ID NO: 829464 - RNA, 22 nt, Human
ccuggugccacuagagaauguc

SEQ ID NO: 829465 - RNA, 22 nt, Human
gucauuguguggacauggagaa

SEQ ID NO: 829466 - RNA, 22 nt, Human
uggcagagagacucuccuugau

SEQ ID NO: 829467 - RNA, 22 nt, Human
ugcccugcagugagugcgucug

SEQ ID NO: 829468 - RNA, 22 nt, Human
aaaugcacucugcuucugugac

SEQ ID NO: 829469 - RNA, 22 nt, Human
guuugaaaaaagcaguauguaa

SEQ ID NO: 829470 - RNA, 22 nt, Human
cugagccauccauaccagcuua

SEQ ID NO: 829471 - RNA, 22 nt, Human
cugcucuguucccccaucaucu

SEQ ID NO: 829472 - RNA, 22 nt, Human
cucaggauauugggcuggagca

SEQ ID NO: 829473 - RNA, 22 nt, Human
aucuguucuucaaaauauuaca

SEQ ID NO: 829474 - RNA, 22 nt, Human
ccagggucucugcugccugaga

SEQ ID NO: 829475 - RNA, 22 nt, Human
caggacaguauaggcuuuagga

SEQ ID NO: 829476 - RNA, 19 nt, Human
aagaagcaauaagcuguga

SEQ ID NO: 829477 - RNA, 22 nt, Human
auguccuuugcuucucuggucc

SEQ ID NO: 829478 - RNA, 22 nt, Human
ucauggagacuuugagccuguu

SEQ ID NO: 829479 - RNA, 22 nt, Human
aacauaauguggccaaagucac

SEQ ID NO: 829480 - RNA, 22 nt, Human
cauggcuucuaagugauaacgu

SEQ ID NO: 829481 - RNA, 22 nt, Human
gggcucuggauggagccugcag

SEQ ID NO: 829482 - RNA, 21 nt, Human
ggugggcacaggagagcagag

SEQ ID NO: 829483 - RNA, 20 nt, Human
ugcagggcugccucccagcu

SEQ ID NO: 829484 - RNA, 23 nt, Human
agcagccagagauccucggcccu

SEQ ID NO: 829485 - RNA, 22 nt, Human
aacuggauuuaggaacagagaa

SEQ ID NO: 829486 - RNA, 22 nt, Human
gaggccugguuugcaugagaau

SEQ ID NO: 829487 - RNA, 22 nt, Human
aggaggggcauagaaauguaau

SEQ ID NO: 829488 - RNA, 22 nt, Human
acugucuccucaucaugccugg

SEQ ID NO: 829489 - RNA, 22 nt, Human
ugacaguuaagguauacauuca

SEQ ID NO: 829490 - RNA, 22 nt, Human
ggcacugagaggcucuuccuaa

SEQ ID NO: 829491 - RNA, 19 nt, Human
ugcaagcuuuuucuuguua

SEQ ID NO: 829492 - RNA, 22 nt, Human
uaagaacagauaaaguuucccc

SEQ ID NO: 829493 - RNA, 22 nt, Human
gcucacugccauucucuagaug

SEQ ID NO: 829494 - RNA, 22 nt, Human
ucaagagauugaauaauaacug

SEQ ID NO: 829495 - RNA, 21 nt, Human
augacagaugcugcagaucgu

SEQ ID NO: 829496 - RNA, 22 nt, Human
acuuugugcccaacagaaagaa

SEQ ID NO: 829497 - RNA, 22 nt, Human
ccugucugcagauaucucaggu

SEQ ID NO: 829498 - RNA, 22 nt, Human
ugucaccacuggcugaaacacc

SEQ ID NO: 829499 - RNA, 22 nt, Human
cacccaggcuggagugcagggg

SEQ ID NO: 829500 - RNA, 22 nt, Human
uugcuuccaguccaagucuguu

SEQ ID NO: 829501 - RNA, 19 nt, Human
aggcugcaagguggugggc

SEQ ID NO: 829502 - RNA, 22 nt, Human
cuaggaggcgggggcugcagua

SEQ ID NO: 829503 - RNA, 22 nt, Human
cuguguccugcgucaagccaau

SEQ ID NO: 829504 - RNA, 22 nt, Human
ggaggaggggcgcuuugucuau

SEQ ID NO: 829505 - RNA, 22 nt, Human
agucaaaugaguaaauauauaa

SEQ ID NO: 829506 - RNA, 22 nt, Human
acuauacauaaaacauuugggu

SEQ ID NO: 829507 - RNA, 22 nt, Human
cuuccucccccacacacucacu

SEQ ID NO: 829508 - RNA, 22 nt, Human
gaagcagcaaguauaggacagg

SEQ ID NO: 829509 - RNA, 22 nt, Human
uggauuuaauggaugaggggca

SEQ ID NO: 829510 - RNA, 22 nt, Human
ccagucccagcucugccaugcu

SEQ ID NO: 829511 - RNA, 22 nt, Human
cagaguguugaccauaagccca

SEQ ID NO: 829512 - RNA, 22 nt, Human
caaagggcucuagacucagcag

SEQ ID NO: 829513 - RNA, 22 nt, Human
cugccucucaggucccugagau

SEQ ID NO: 829514 - RNA, 22 nt, Human
auagaauuugcacuaaaucugc

SEQ ID NO: 829515 - RNA, 22 nt, Human
ucacagaagaugcuggauguug

SEQ ID NO: 829516 - RNA, 22 nt, Human
gggcugcuguagagaacauguu

SEQ ID NO: 829517 - RNA, 22 nt, Human
gcagagcuaucuucuggauuug

SEQ ID NO: 829518 - RNA, 22 nt, Human
uucaacacaggaacaugauaua

SEQ ID NO: 829519 - RNA, 22 nt, Human
uaacagaagagcaggcagcccu

SEQ ID NO: 829520 - RNA, 19 nt, Human
uguguaaagucugugguca

SEQ ID NO: 829521 - RNA, 22 nt, Human
agcagcucuguuuaccuggagg

SEQ ID NO: 829522 - RNA, 22 nt, Human
agacagcauggagcugauaaca

SEQ ID NO: 829523 - RNA, 22 nt, Human
gccaggcucagcagucaaccug

SEQ ID NO: 829524 - RNA, 22 nt, Human
cuucuucaagagaaugggagac

SEQ ID NO: 829525 - RNA, 22 nt, Human
gaacagcuucuugggagcuggg

SEQ ID NO: 829526 - RNA, 22 nt, Human
cagaguguggcaucuuccaacu

SEQ ID NO: 829527 - RNA, 22 nt, Human
ucuagaaacaugacauugaucu

SEQ ID NO: 829528 - RNA, 22 nt, Human
ccaggagacaaagaugacugcu

SEQ ID NO: 829529 - RNA, 22 nt, Human
gcagagccuugcgucaugugcc

SEQ ID NO: 829530 - RNA, 22 nt, Human
caaaggcaguuacugaaugaag

SEQ ID NO: 829531 - RNA, 22 nt, Human
aauugucaaacacaaauaagag

SEQ ID NO: 829532 - RNA, 22 nt, Human
aaucuuucccuauuaaaugugg

SEQ ID NO: 829533 - RNA, 22 nt, Human
ucaaaguaaaaguauagaguuu

SEQ ID NO: 829534 - RNA, 22 nt, Human
cuucugugcuucacaguugcca

SEQ ID NO: 829535 - RNA, 22 nt, Human
cccuccagccauggacccaggu

SEQ ID NO: 829536 - RNA, 17 nt, Human
gcagccagugcagcagg

SEQ ID NO: 829537 - RNA, 22 nt, Human
uuuccaaauaaggucacauucu

SEQ ID NO: 829538 - RNA, 22 nt, Human
cagggagggacaauugucaccu

SEQ ID NO: 829539 - RNA, 22 nt, Human
ggagucaggagcaggcugggcu

SEQ ID NO: 829540 - RNA, 23 nt, Human
aggcagagccaaggucaaaaccc

SEQ ID NO: 829541 - RNA, 22 nt, Human
acagaccaaaaaaggauauugg

SEQ ID NO: 829542 - RNA, 22 nt, Human
guaggcagggcuguggggagaa

SEQ ID NO: 829543 - RNA, 22 nt, Human
uuugaacaugcugcaugauaau

SEQ ID NO: 829544 - RNA, 21 nt, Human
uccucagggccccagagcacu

SEQ ID NO: 829545 - RNA, 22 nt, Human
uacauacacaaauauacuguuu

SEQ ID NO: 829546 - RNA, 22 nt, Human
ugucugugaccucuuaggcaag

SEQ ID NO: 829547 - RNA, 22 nt, Human
gcugcccaggguggagccggcu

SEQ ID NO: 829548 - RNA, 22 nt, Human
agccaaggacacggagccuccu

SEQ ID NO: 829549 - RNA, 22 nt, Human
ugacagcauaacacuggucuug

SEQ ID NO: 829550 - RNA, 22 nt, Human
ucuccuuugaaaguuaggacug

SEQ ID NO: 829551 - RNA, 22 nt, Human
agaucugaccuaaccccaccac

SEQ ID NO: 829552 - RNA, 22 nt, Human
ucacaacucuuuccauuuaaua

SEQ ID NO: 829553 - RNA, 22 nt, Human
aauuccagaggaggacaguccu

SEQ ID NO: 829554 - RNA, 22 nt, Human
ccuaugccugucacucugcgcu

SEQ ID NO: 829555 - RNA, 22 nt, Human
cuguccuggagggcauaggacg

SEQ ID NO: 829556 - RNA, 22 nt, Human
aagcacauuguacauuugugcu

SEQ ID NO: 829557 - RNA, 22 nt, Human
gagcugggcacacgccacuuga

SEQ ID NO: 829558 - RNA, 17 nt, Human
uccuggcucugccacug

SEQ ID NO: 829559 - RNA, 22 nt, Human
ucagggacugcagagggaagcu

SEQ ID NO: 829560 - RNA, 22 nt, Human
cugggcacaggggagcagaguc

SEQ ID NO: 829561 - RNA, 22 nt, Human
cauaacuagagugaaauguuga

SEQ ID NO: 829562 - RNA, 22 nt, Human
ugaccaaagaguugcuuguauu

SEQ ID NO: 829563 - RNA, 22 nt, Human
aguuauauaacuaucuagaugc

SEQ ID NO: 829564 - RNA, 19 nt, Human
uuugaauccagcugguaac

SEQ ID NO: 829565 - RNA, 22 nt, Human
accaggagaggcacuugcaaug

SEQ ID NO: 829566 - RNA, 22 nt, Human
agcagcucacaggauuccugaa

SEQ ID NO: 829567 - RNA, 22 nt, Human
uaauuauucuagucacauagca

SEQ ID NO: 829568 - RNA, 22 nt, Human
cagaccuggaaaacaggcuugc

SEQ ID NO: 829569 - RNA, 22 nt, Human
gaucagaaucuucauuuucagu

SEQ ID NO: 829570 - RNA, 22 nt, Human
cacauaaguggguuccauugca

SEQ ID NO: 829571 - RNA, 22 nt, Human
uggaaagacauucagccgcugg

SEQ ID NO: 829572 - RNA, 23 nt, Human
uaauacugcuucagaggcuuaga

SEQ ID NO: 829573 - RNA, 22 nt, Human
cagcauggggcuuggagucagc

SEQ ID NO: 829574 - RNA, 21 nt, Human
aaacugaccuugccugagaca

SEQ ID NO: 829575 - RNA, 22 nt, Human
cccugcagaccaaugccauaga

SEQ ID NO: 829576 - RNA, 21 nt, Human
gcucccuggcugugugaccug

SEQ ID NO: 829577 - RNA, 22 nt, Human
cuguggcuaugguguacauacu

SEQ ID NO: 829578 - RNA, 22 nt, Human
ccuggagcaggagcugcagagg

SEQ ID NO: 829579 - RNA, 22 nt, Human
uggcccugcagaacuagccugg

SEQ ID NO: 829580 - RNA, 22 nt, Human
aauacugccugugagguaacuc

SEQ ID NO: 829581 - RNA, 22 nt, Human
aggcagacaaggacacaguggg

SEQ ID NO: 829582 - RNA, 22 nt, Human
gagaaccucuccacaagucugg

SEQ ID NO: 829583 - RNA, 22 nt, Human
accuuuuuguucuguucucagc

SEQ ID NO: 829584 - RNA, 22 nt, Human
uccagagccuauauguucaacu

SEQ ID NO: 829585 - RNA, 22 nt, Human
gauacauuuuaucuccuaacag

SEQ ID NO: 829586 - RNA, 22 nt, Human
acugcagcaaagcccgugucuu

SEQ ID NO: 829587 - RNA, 22 nt, Human
uauuccuauuucuaaacauaug

SEQ ID NO: 829588 - RNA, 22 nt, Human
agccuccacagaugcaaagggc

SEQ ID NO: 829589 - RNA, 22 nt, Human
ccagagucuaugaguccucauu

SEQ ID NO: 829590 - RNA, 22 nt, Human
ucacaugcccuguauuuaccag

SEQ ID NO: 829591 - RNA, 22 nt, Human
agcugccaucugaagaacugca

SEQ ID NO: 829592 - RNA, 22 nt, Human
gcacaauaauucuuguuuugcu

SEQ ID NO: 829593 - RNA, 22 nt, Human
aggucagaagugccagggaauu

SEQ ID NO: 829594 - RNA, 22 nt, Human
auaaggcagucccuuaacaagg

SEQ ID NO: 829595 - RNA, 22 nt, Human
gggaugucacugugccuggcac

SEQ ID NO: 829596 - RNA, 22 nt, Human
uuacagaagugaaggccuuuaa

SEQ ID NO: 829597 - RNA, 22 nt, Human
aaacagcaggaacaucuugcca

SEQ ID NO: 829598 - RNA, 22 nt, Human
gagggcugccacguugggcgag

SEQ ID NO: 829599 - RNA, 22 nt, Human
ugugaauagugccgcaauaaac

SEQ ID NO: 829600 - RNA, 22 nt, Human
cugagccaaccacagcaggagc

SEQ ID NO: 829601 - RNA, 22 nt, Human
caggugcucccagagaagugcu

SEQ ID NO: 829602 - RNA, 22 nt, Human
guuuucaaggggauuuaacuga

SEQ ID NO: 829603 - RNA, 22 nt, Human
cagcaggggaacugugggccag

SEQ ID NO: 829604 - RNA, 22 nt, Human
auucuucaguauguguggauug

SEQ ID NO: 829605 - RNA, 22 nt, Human
augaagucugcacaugcaugug

SEQ ID NO: 829606 - RNA, 22 nt, Human
cucaccaggaacagcugcggag

SEQ ID NO: 829607 - RNA, 22 nt, Human
gaaaucugcccagugcacuggu

SEQ ID NO: 829608 - RNA, 23 nt, Human
aaaugcagggucgcagguuacag

SEQ ID NO: 829609 - RNA, 22 nt, Human
acaaaugccauauauaaauucu

SEQ ID NO: 829610 - RNA, 17 nt, Human
gcugagugcagggaguc

SEQ ID NO: 829611 - RNA, 22 nt, Human
ccaggagagcagaagcccaggc

SEQ ID NO: 829612 - RNA, 18 nt, Human
agggucagugucacuggc

SEQ ID NO: 829613 - RNA, 22 nt, Human
uaggcagggauuaggguugauu

SEQ ID NO: 829614 - RNA, 22 nt, Human
cugcugugcaacauugcaccua

SEQ ID NO: 829615 - RNA, 22 nt, Human
caggccuggguucaaaucccuu

SEQ ID NO: 829616 - RNA, 22 nt, Human
acauacauaugacaacuuuccu

SEQ ID NO: 829617 - RNA, 22 nt, Human
acugaaggaaacuuuuguguuu

SEQ ID NO: 829618 - RNA, 22 nt, Human
uccugccucuccaugcuaacua

SEQ ID NO: 829619 - RNA, 21 nt, Human
ggcacugagccagauggacuc

SEQ ID NO: 829620 - RNA, 23 nt, Human
agaauuguaaauagaauauaccu

SEQ ID NO: 829621 - RNA, 22 nt, Human
gcagggacugugaucucacaga

SEQ ID NO: 829622 - RNA, 22 nt, Human
ugcuuaauacguauuugcugga

SEQ ID NO: 829623 - RNA, 22 nt, Human
uggagcugguaaacagugacau

SEQ ID NO: 829624 - RNA, 22 nt, Human
gcacugcagccucagauggugg

SEQ ID NO: 829625 - RNA, 21 nt, Human
aagagcugucaggaaggcugc

SEQ ID NO: 829626 - RNA, 22 nt, Human
uccagaggcuccaaagggagau

SEQ ID NO: 829627 - RNA, 17 nt, Human
ucagcaggggccaagcu

SEQ ID NO: 829628 - RNA, 22 nt, Human
aaagauuucagaagccugugcc

SEQ ID NO: 829629 - RNA, 22 nt, Human
aucacauugccagugauuaccc

SEQ ID NO: 829630 - RNA, 22 nt, Human
gaagccccaaacccucgccauc

SEQ ID NO: 829631 - RNA, 22 nt, Human
uggcuuuaaaucuguauucaua

SEQ ID NO: 829632 - RNA, 22 nt, Human
ccagcagcuuuauuggcucucc

SEQ ID NO: 829633 - RNA, 22 nt, Human
cuggauuuaggacuaguccaag

SEQ ID NO: 829634 - RNA, 22 nt, Human
ugcugcucuguaaagugaugag

SEQ ID NO: 829635 - RNA, 22 nt, Human
uaacacauaagcugagaccaug

SEQ ID NO: 829636 - RNA, 22 nt, Human
uguuaucugagcaacgucgacg

SEQ ID NO: 829637 - RNA, 22 nt, Human
ugaugggaggugcugcaggacc

SEQ ID NO: 829638 - RNA, 22 nt, Human
cuggcagcauuaacagagagca

SEQ ID NO: 829639 - RNA, 22 nt, Human
gaagcagcuagcccacuaguca

SEQ ID NO: 829640 - RNA, 22 nt, Human
agaggccagcagugccuaucug

SEQ ID NO: 829641 - RNA, 22 nt, Human
gccacagggcagaugcgcagag

SEQ ID NO: 829642 - RNA, 22 nt, Human
agagugauucuaguuagggaau

SEQ ID NO: 829643 - RNA, 22 nt, Human
auaaguucagguaaagaaauca

SEQ ID NO: 829644 - RNA, 22 nt, Human
gggguggauuccuacaggucca

SEQ ID NO: 829645 - RNA, 22 nt, Human
uacccagggcuuuucugaugca

SEQ ID NO: 829646 - RNA, 22 nt, Human
ucaguguccggagccugagugc

SEQ ID NO: 829647 - RNA, 20 nt, Human
uauaacaguguugggugugu

SEQ ID NO: 829648 - RNA, 22 nt, Human
uucauagaucucaauuuugagg

SEQ ID NO: 829649 - RNA, 22 nt, Human
auggauaagucaaagaguaucc

SEQ ID NO: 829650 - RNA, 22 nt, Human
gggcucuggaaggugcaccaug

SEQ ID NO: 829651 - RNA, 22 nt, Human
ucugucugcucauuuaccucag

SEQ ID NO: 829652 - RNA, 22 nt, Human
cuucaucaacucuaacaaaugu

SEQ ID NO: 829653 - RNA, 22 nt, Human
ucagaacagaagaaggaacacg

SEQ ID NO: 829654 - RNA, 22 nt, Human
ggggccuguagagcuucaggga

SEQ ID NO: 829655 - RNA, 22 nt, Human
auagaauucguguuuguaauuc

SEQ ID NO: 829656 - RNA, 22 nt, Human
caggcagcgcucguggccuggc

SEQ ID NO: 829657 - RNA, 22 nt, Human
gacugucauucuagugcccaug

SEQ ID NO: 829658 - RNA, 22 nt, Human
gccuggagcucuccacuugggg

SEQ ID NO: 829659 - RNA, 22 nt, Human
ccugagaggcccucucacuguc

SEQ ID NO: 829660 - RNA, 22 nt, Human
cagaacugggcagggagcagag

SEQ ID NO: 829661 - RNA, 20 nt, Human
ucauuucuugggguuccaag

SEQ ID NO: 829662 - RNA, 22 nt, Human
ucugccuggauuuuggaaagcu

SEQ ID NO: 829663 - RNA, 22 nt, Human
gauuucuuuaugaaguacagaa

SEQ ID NO: 829664 - RNA, 22 nt, Human
uagucaccuguugugugaugcc

SEQ ID NO: 829665 - RNA, 20 nt, Human
cagcccuccaguggaggcag

SEQ ID NO: 829666 - RNA, 22 nt, Human
gcugcugucacggugcuaaggg

SEQ ID NO: 829667 - RNA, 22 nt, Human
aguuuuucugggaggcacugcu

SEQ ID NO: 829668 - RNA, 22 nt, Human
cacccagcagcacuuaagacua

SEQ ID NO: 829669 - RNA, 22 nt, Human
auggauaagaacaaauaucuga

SEQ ID NO: 829670 - RNA, 22 nt, Human
augcuguggggagugaggguag

SEQ ID NO: 829671 - RNA, 22 nt, Human
guuccaaagucucugagcugag

SEQ ID NO: 829672 - RNA, 22 nt, Human
cagggugccucccgcucgccgg

SEQ ID NO: 829673 - RNA, 22 nt, Human
aucagcugaaaaacaggcagca

SEQ ID NO: 829674 - RNA, 22 nt, Human
gaggcagcaaaauauaucauaa

SEQ ID NO: 829675 - RNA, 22 nt, Human
agagcuuauaucuuggccaucc

SEQ ID NO: 829676 - RNA, 22 nt, Human
gggacagcuguagugcuuggcu

SEQ ID NO: 829677 - RNA, 22 nt, Human
aaggaagacacagaugaaguga

SEQ ID NO: 829678 - RNA, 22 nt, Human
uuaaugauaccuauguuaauuu

SEQ ID NO: 829679 - RNA, 21 nt, Human
cugcaucucauagaacauguc

SEQ ID NO: 829680 - RNA, 22 nt, Human
uguccauggauagagcugcucg

SEQ ID NO: 829681 - RNA, 22 nt, Human
aggccugggacgggagccguga

SEQ ID NO: 829682 - RNA, 22 nt, Human
uuuuuaagcuccuuugauguca

SEQ ID NO: 829683 - RNA, 22 nt, Human
ccagcuggugggucuuucucug

SEQ ID NO: 829684 - RNA, 22 nt, Human
aagcagcagaccugauuuugaa

SEQ ID NO: 829685 - RNA, 22 nt, Human
agagccugaggaugucccagcu

SEQ ID NO: 829686 - RNA, 22 nt, Human
ugacacauuaaaugcucacaaa

SEQ ID NO: 829687 - RNA, 18 nt, Human
ggcagcuugacuagcaac

SEQ ID NO: 829688 - RNA, 22 nt, Human
ggccucugccccagccacaccu

SEQ ID NO: 829689 - RNA, 22 nt, Human
uguuugaauuuugcuaacgugu

SEQ ID NO: 829690 - RNA, 22 nt, Human
guguaaggugaaaucaacaaau

SEQ ID NO: 829691 - RNA, 22 nt, Human
gaggcagcggcucacagagaaa

SEQ ID NO: 829692 - RNA, 22 nt, Human
ccuggaaguuggagguugcagu

SEQ ID NO: 829693 - RNA, 22 nt, Human
ugguuuugcuaaaauagaaaga

SEQ ID NO: 829694 - RNA, 23 nt, Human
ucccagggaaggugagcgaggcu

SEQ ID NO: 829695 - RNA, 22 nt, Human
agggccugcaucaggagcuugg

SEQ ID NO: 829696 - RNA, 22 nt, Human
aaaauaucagcaaagggugaca

SEQ ID NO: 829697 - RNA, 22 nt, Human
ucugggagguaaccaugcugau

SEQ ID NO: 829698 - RNA, 22 nt, Human
uuuccaaaggaggaaccaguuu

SEQ ID NO: 829699 - RNA, 22 nt, Human
aagggccauaacuugcaguguu

SEQ ID NO: 829700 - RNA, 22 nt, Human
cuggguggaaagugcugagaau

SEQ ID NO: 829701 - RNA, 22 nt, Human
ucuuugcaugugcuucuuggcc

SEQ ID NO: 829702 - RNA, 22 nt, Human
uuaaggauguugugauuuauua

SEQ ID NO: 829703 - RNA, 22 nt, Human
auauccaagaaacaauuaauuc

SEQ ID NO: 829704 - RNA, 22 nt, Human
uggaagcuguggcauaacugag

SEQ ID NO: 829705 - RNA, 22 nt, Human
uauugacagagggucagaagag

SEQ ID NO: 829706 - RNA, 22 nt, Human
ugggaugggaucucgcuguguc

SEQ ID NO: 829707 - RNA, 22 nt, Human
acugaaggcuuucccaagguca

SEQ ID NO: 829708 - RNA, 23 nt, Human
agaucugauguuaccaagaauug

SEQ ID NO: 829709 - RNA, 22 nt, Human
cagaggcagccgggggagaacg

SEQ ID NO: 829710 - RNA, 22 nt, Human
gaaauauuacaguggaggggau

SEQ ID NO: 829711 - RNA, 22 nt, Human
auauucacugagcauaaagcca

SEQ ID NO: 829712 - RNA, 22 nt, Human
acacugaagagcacuuucaaag

SEQ ID NO: 829713 - RNA, 20 nt, Human
guggcaggcagugaaggagc

SEQ ID NO: 829714 - RNA, 22 nt, Human
uauuugaagauucuucugaugu

SEQ ID NO: 829715 - RNA, 19 nt, Human
ugccugucaguagaucuca

SEQ ID NO: 829716 - RNA, 22 nt, Human
cgaggcagacaaaaguuggaag

SEQ ID NO: 829717 - RNA, 22 nt, Human
ucuccaagcagggcugcaaggc

SEQ ID NO: 829718 - RNA, 22 nt, Human
auaaguaggaaaauuugaauau

SEQ ID NO: 829719 - RNA, 22 nt, Human
cuugccuguggcuaguuggcuc

SEQ ID NO: 829720 - RNA, 22 nt, Human
uggagcugggaguccugggcug

SEQ ID NO: 829721 - RNA, 22 nt, Human
ugaggggagcuagcaugccuug

SEQ ID NO: 829722 - RNA, 22 nt, Human
gcucaggagcucuugguggcgc

SEQ ID NO: 829723 - RNA, 22 nt, Human
ugguaaagaaggcuagaucuga

SEQ ID NO: 829724 - RNA, 22 nt, Human
uuuuugcaccaaccuaauagaa

SEQ ID NO: 829725 - RNA, 22 nt, Human
ccuguguggccaggcuggaguc

SEQ ID NO: 829726 - RNA, 22 nt, Human
agacaguguguguauauauggu

SEQ ID NO: 829727 - RNA, 22 nt, Human
cauuuugugcuagacacuaugg

SEQ ID NO: 829728 - RNA, 22 nt, Human
uuugcauugcauacaaggaacu

SEQ ID NO: 829729 - RNA, 22 nt, Human
ucugagaguacgggcugcgcgc

SEQ ID NO: 829730 - RNA, 22 nt, Human
gcugaaugaauguauuuuaaaa

SEQ ID NO: 829731 - RNA, 22 nt, Human
aggaucugugagugcugcagac

SEQ ID NO: 829732 - RNA, 22 nt, Human
aucaguuuauacuuauaaaucu

SEQ ID NO: 829733 - RNA, 23 nt, Human
ugguucuaggccuauaauuauau

SEQ ID NO: 829734 - RNA, 22 nt, Human
uacaguaagaugaaauagcaau

SEQ ID NO: 829735 - RNA, 22 nt, Human
cagagcuggguuugggaaaccu

SEQ ID NO: 829736 - RNA, 22 nt, Human
gcagccccaggagacgcccagg

SEQ ID NO: 829737 - RNA, 22 nt, Human
gcagaacauuucacaguaucuu

SEQ ID NO: 829738 - RNA, 22 nt, Human
ugucugguggguugacaggcag

SEQ ID NO: 829739 - RNA, 22 nt, Human
cacagggcaggccccaggccuc

SEQ ID NO: 829740 - RNA, 22 nt, Human
gaggagagagggacugucugca

SEQ ID NO: 829741 - RNA, 22 nt, Human
cuggcucaggaaaguugcugcu

SEQ ID NO: 829742 - RNA, 22 nt, Human
caggaacaauguaagucucauu

SEQ ID NO: 829743 - RNA, 22 nt, Human
ggagcugggguuggcaucuucc

SEQ ID NO: 829744 - RNA, 22 nt, Human
ugagcugggcugggcugagcug

SEQ ID NO: 829745 - RNA, 22 nt, Human
auaacuuagaguaggcaaaagu

SEQ ID NO: 829746 - RNA, 23 nt, Human
gcucagagguuuuucucuggaug

SEQ ID NO: 829747 - RNA, 22 nt, Human
ugucuuccucuuggcuugagcu

SEQ ID NO: 829748 - RNA, 22 nt, Human
ucagaagccggaagugcuccuc

SEQ ID NO: 829749 - RNA, 22 nt, Human
aggcacugaaggaagcuugcgc

SEQ ID NO: 829750 - RNA, 22 nt, Human
ggaggggaacuaaucccgugac

SEQ ID NO: 829751 - RNA, 22 nt, Human
ucucagagaucuuucugcaugu

SEQ ID NO: 829752 - RNA, 22 nt, Human
uagcugugagcacccaggcugu

SEQ ID NO: 829753 - RNA, 22 nt, Human
agauuuacuggagucuuuggug

SEQ ID NO: 829754 - RNA, 22 nt, Human
ggaggcuccacugcucuuccug

SEQ ID NO: 829755 - RNA, 22 nt, Human
uccuucagucuucugagccaua

SEQ ID NO: 829756 - RNA, 22 nt, Human
agcagcauagaagcugggagga

SEQ ID NO: 829757 - RNA, 22 nt, Human
gauaauaagcacagcaggaugu

SEQ ID NO: 829758 - RNA, 22 nt, Human
gagggcaguagccucguacccu

SEQ ID NO: 829759 - RNA, 22 nt, Human
cugcugcucgaccagucccagg

SEQ ID NO: 829760 - RNA, 22 nt, Human
cuggggacuugcagacacaauu

SEQ ID NO: 829761 - RNA, 22 nt, Human
ugggugaggaugaugaggcagc

SEQ ID NO: 829762 - RNA, 22 nt, Human
cccucagcuccacccucagcag

SEQ ID NO: 829763 - RNA, 21 nt, Human
ggagcugcaggagccgaaggc

SEQ ID NO: 829764 - RNA, 19 nt, Human
guggccugcgcugggugcg

SEQ ID NO: 829765 - RNA, 22 nt, Human
agccagaggccagccugccuca

SEQ ID NO: 829766 - RNA, 18 nt, Human
aucuuuccauagcauguu

SEQ ID NO: 829767 - RNA, 22 nt, Human
agcaguggaccucagugcuauu

SEQ ID NO: 829768 - RNA, 22 nt, Human
ucuagaaauuuugccuuguauu

SEQ ID NO: 829769 - RNA, 22 nt, Human
ugucaaaaauaagagagauugu

SEQ ID NO: 829770 - RNA, 22 nt, Human
agcagagaagacacaggcuuca

SEQ ID NO: 829771 - RNA, 22 nt, Human
ugugaaauucuugaaaugcaca

SEQ ID NO: 829772 - RNA, 22 nt, Human
cguuggagacacuugaggacuu

SEQ ID NO: 829773 - RNA, 22 nt, Human
uuauguacaauguuaauguaaa

SEQ ID NO: 829774 - RNA, 22 nt, Human
cugucuguuucugauucaaccu

SEQ ID NO: 829775 - RNA, 22 nt, Human
aucuagauuagguauaagagcu

SEQ ID NO: 829776 - RNA, 19 nt, Human
ugcugaaguugucagucug

SEQ ID NO: 829777 - RNA, 22 nt, Human
ggugcagaaggaagggagcugg

SEQ ID NO: 829778 - RNA, 22 nt, Human
acaggcagcacuaaucucuggu

SEQ ID NO: 829779 - RNA, 19 nt, Human
gggcuucugggaucaagag

SEQ ID NO: 829780 - RNA, 22 nt, Human
ccucagagaaagguauggcuga

SEQ ID NO: 829781 - RNA, 22 nt, Human
ucucagaguuccucuggagucc

SEQ ID NO: 829782 - RNA, 22 nt, Human
cagucccacaagaucuccacaa

SEQ ID NO: 829783 - RNA, 22 nt, Human
ggcacugauuccauucaugaag

SEQ ID NO: 829784 - RNA, 22 nt, Human
agccacagucaaccuguccaua

SEQ ID NO: 829785 - RNA, 22 nt, Human
aggagcagaacugauucugacu

SEQ ID NO: 829786 - RNA, 22 nt, Human
cuggaaggucuguccccacugc

SEQ ID NO: 829787 - RNA, 22 nt, Human
uaugcugugcuagauacaauau

SEQ ID NO: 829788 - RNA, 22 nt, Human
ucccagggacucucugccuucc

SEQ ID NO: 829789 - RNA, 23 nt, Human
agucucagcuggaaacauguguc

SEQ ID NO: 829790 - RNA, 22 nt, Human
cagagagaggccacugcuauua

SEQ ID NO: 829791 - RNA, 22 nt, Human
uucaagaucuuccaaaggauac

SEQ ID NO: 829792 - RNA, 20 nt, Human
aggaggcauagucuggaaag

SEQ ID NO: 829793 - RNA, 22 nt, Human
uagcauuuauuccagauuugga

SEQ ID NO: 829794 - RNA, 22 nt, Human
uuauuuauggcacuguuggugg

SEQ ID NO: 829795 - RNA, 22 nt, Human
uguacaauagcuauuaucucca

SEQ ID NO: 829796 - RNA, 22 nt, Human
uggcagggccugcucaucaucc

SEQ ID NO: 829797 - RNA, 22 nt, Human
uccuucuuucccccuagucauu

SEQ ID NO: 829798 - RNA, 22 nt, Human
ccuggagagagaggccaacugc

SEQ ID NO: 829799 - RNA, 22 nt, Human
gggcaguuuauucuagaugguu

SEQ ID NO: 829800 - RNA, 22 nt, Human
uuuugaaagaguccugcuacag

SEQ ID NO: 829801 - RNA, 22 nt, Human
aggcucagcugguggugaucgc

SEQ ID NO: 829802 - RNA, 22 nt, Human
aggucagcaugaguagaaggua

SEQ ID NO: 829803 - RNA, 22 nt, Human
cugcagccucaaccuccugagc

SEQ ID NO: 829804 - RNA, 22 nt, Human
ggcccugagcugaaguacugug

SEQ ID NO: 829805 - RNA, 22 nt, Human
ugcugccaccccucaccagagc

SEQ ID NO: 829806 - RNA, 21 nt, Human
ccccugggagcccugucagua

SEQ ID NO: 829807 - RNA, 22 nt, Human
aggcaguuguagagagggcucu

SEQ ID NO: 829808 - RNA, 21 nt, Human
auuauuauuucuguguccagc

SEQ ID NO: 829809 - RNA, 22 nt, Human
auaugugaaguggguuauuuug

SEQ ID NO: 829810 - RNA, 22 nt, Human
ugcaggcaggggaugagcagcc

SEQ ID NO: 829811 - RNA, 22 nt, Human
auccaaacauguaccacacuaa

SEQ ID NO: 829812 - RNA, 22 nt, Human
acugaaggaaagccuuugcaug

SEQ ID NO: 829813 - RNA, 22 nt, Human
cccaggaauuggaggcugcagu

SEQ ID NO: 829814 - RNA, 22 nt, Human
uccugcagccacugcaggcaga

SEQ ID NO: 829815 - RNA, 22 nt, Human
gcagccagaagacucagaacaa

SEQ ID NO: 829816 - RNA, 22 nt, Human
cauggauugaauauaaauuaga

SEQ ID NO: 829817 - RNA, 22 nt, Human
uauggcuuuucauuccuaugug

SEQ ID NO: 829818 - RNA, 22 nt, Human
gcuggaucccugugggaguggu

SEQ ID NO: 829819 - RNA, 22 nt, Human
gagcucagauucuggugucaga

SEQ ID NO: 829820 - RNA, 22 nt, Human
aaggcagccuuuugaguugauu

SEQ ID NO: 829821 - RNA, 19 nt, Human
ggcuccuguggcugcagcc

SEQ ID NO: 829822 - RNA, 22 nt, Human
ccaggccauucccagaguugcu

SEQ ID NO: 829823 - RNA, 22 nt, Human
aaugcugcaagaggugaaaaga

SEQ ID NO: 829824 - RNA, 22 nt, Human
ugcugucugauucagggugauu

SEQ ID NO: 829825 - RNA, 22 nt, Human
agggagugguuaagaaggugca

SEQ ID NO: 829826 - RNA, 22 nt, Human
cagggccagagagggcuggcug

SEQ ID NO: 829827 - RNA, 22 nt, Human
cccaggaacagggcucagaccc

SEQ ID NO: 829828 - RNA, 22 nt, Human
gucacacuagggccaaguggag

SEQ ID NO: 829829 - RNA, 22 nt, Human
uggauuuauggagaccgaaagu

SEQ ID NO: 829830 - RNA, 22 nt, Human
acagggccucagcugauucugg

SEQ ID NO: 829831 - RNA, 18 nt, Human
cguuuuuccgggauugca

SEQ ID NO: 829832 - RNA, 22 nt, Human
auauacaguuuuacaggguuuc

SEQ ID NO: 829833 - RNA, 22 nt, Human
cacuucaauuaacuucagcauu

SEQ ID NO: 829834 - RNA, 22 nt, Human
uggcucuguuuguuaacuagac

SEQ ID NO: 829835 - RNA, 22 nt, Human
uggaggagaauuuauggucgaa

SEQ ID NO: 829836 - RNA, 22 nt, Human
ccagggcaggggcuggaguuca

SEQ ID NO: 829837 - RNA, 22 nt, Human
uccugugccuccaccugcuccg

SEQ ID NO: 829838 - RNA, 19 nt, Human
acaagggcaggcaagguga

SEQ ID NO: 829839 - RNA, 22 nt, Human
gcugugcuggaaggggaccugc

SEQ ID NO: 829840 - RNA, 23 nt, Human
uauggcuuacagugcuuuaggua

SEQ ID NO: 829841 - RNA, 23 nt, Human
agccagggcacugguggagauug

SEQ ID NO: 829842 - RNA, 22 nt, Human
agcugccacugagggugcacag

SEQ ID NO: 829843 - RNA, 22 nt, Human
aggggcugcuggguccgccccu

SEQ ID NO: 829844 - RNA, 22 nt, Human
gcuguucccauguggggcucag

SEQ ID NO: 829845 - RNA, 22 nt, Human
gcagccacucucauuccacgug

SEQ ID NO: 829846 - RNA, 22 nt, Human
augaaaauacugugguugauag

SEQ ID NO: 829847 - RNA, 22 nt, Human
uaaugcacauagaaguacuuag

SEQ ID NO: 829848 - RNA, 22 nt, Human
cggcagagcuuccugcucagcg

SEQ ID NO: 829849 - RNA, 23 nt, Human
gcagacagagcagacuaagacaa

SEQ ID NO: 829850 - RNA, 22 nt, Human
gguuugaacagcuuuggagaag

SEQ ID NO: 829851 - RNA, 22 nt, Human
gagguauguaugcuacauucuu

SEQ ID NO: 829852 - RNA, 22 nt, Human
ucaguucugcuagaaaaacagu

SEQ ID NO: 829853 - RNA, 22 nt, Human
cagcuggcuccaccucugggcu

SEQ ID NO: 829854 - RNA, 22 nt, Human
aggccucacucucagagcuucu

SEQ ID NO: 829855 - RNA, 22 nt, Human
aaugcauauguaggcaagcagu

SEQ ID NO: 829856 - RNA, 22 nt, Human
cagggcagugaagaacacacgu

SEQ ID NO: 829857 - RNA, 22 nt, Human
aaagaaucacauccuucagcaa

SEQ ID NO: 829858 - RNA, 22 nt, Human
ugaggaggucagagucuggcug

SEQ ID NO: 829859 - RNA, 22 nt, Human
gugccugguuuggggaguguuc

SEQ ID NO: 829860 - RNA, 22 nt, Human
aaaaaugugaccacaggguguu

SEQ ID NO: 829861 - RNA, 22 nt, Human
cucacagaugcugugggucagg

SEQ ID NO: 829862 - RNA, 22 nt, Human
agagaugucgccuugcccaggg

SEQ ID NO: 829863 - RNA, 22 nt, Human
gagacaggauuuaaccaaagcu

SEQ ID NO: 829864 - RNA, 22 nt, Human
aaaagguagauucuccuucuau

SEQ ID NO: 829865 - RNA, 22 nt, Human
ggcuccucucuggccgcucccg

SEQ ID NO: 829866 - RNA, 22 nt, Human
cguggccuuugagugagcuccc

SEQ ID NO: 829867 - RNA, 23 nt, Human
gcugucugucaucucugcgggag

SEQ ID NO: 829868 - RNA, 22 nt, Human
ggcugccugaacuuuggggaaa

SEQ ID NO: 829869 - RNA, 18 nt, Human
uggccuggagacaacucu

SEQ ID NO: 829870 - RNA, 22 nt, Human
gagcuggugaucagcuggagga

SEQ ID NO: 829871 - RNA, 22 nt, Human
ugucaaagccugaaucacauag

SEQ ID NO: 829872 - RNA, 22 nt, Human
augaaacagugaauuagucaag

SEQ ID NO: 829873 - RNA, 22 nt, Human
acugauuacacgaguucugacu

SEQ ID NO: 829874 - RNA, 22 nt, Human
uuagaaaacauaagugguaaag

SEQ ID NO: 829875 - RNA, 22 nt, Human
gggcucugcgcucagcuccagc

SEQ ID NO: 829876 - RNA, 22 nt, Human
uagcacauaacuuagaauaguu

SEQ ID NO: 829877 - RNA, 21 nt, Human
ccuucuccacagggucuccgg

SEQ ID NO: 829878 - RNA, 22 nt, Human
cauggcuuuuuagcauauucaa

SEQ ID NO: 829879 - RNA, 22 nt, Human
ucagaagagcuggugcugccug

SEQ ID NO: 829880 - RNA, 22 nt, Human
uaaagaacacagggaauagcac

SEQ ID NO: 829881 - RNA, 20 nt, Human
ccugucuggagacaaagaga

SEQ ID NO: 829882 - RNA, 22 nt, Human
gggcagagguucaacuucaaca

SEQ ID NO: 829883 - RNA, 22 nt, Human
guguauaaugcuguuuguacau

SEQ ID NO: 829884 - RNA, 22 nt, Human
cuuaggcauccaggguucuucc

SEQ ID NO: 829885 - RNA, 22 nt, Human
augguuuauugcuuuaaugaaa

SEQ ID NO: 829886 - RNA, 22 nt, Human
gagugcaguuggggugagggga

SEQ ID NO: 829887 - RNA, 22 nt, Human
uguguacauaucuauccuagau

SEQ ID NO: 829888 - RNA, 23 nt, Human
ugcagagggacugaagccagcuu

SEQ ID NO: 829889 - RNA, 22 nt, Human
aacuagucagugauucucagaa

SEQ ID NO: 829890 - RNA, 22 nt, Human
ugaacaacugcaaaaaucucca

SEQ ID NO: 829891 - RNA, 22 nt, Human
gcaguccucucauuggccuccu

SEQ ID NO: 829892 - RNA, 17 nt, Human
gaggacagggaaguagg

SEQ ID NO: 829893 - RNA, 22 nt, Human
uugaaggaggcuccuuuuuaaa

SEQ ID NO: 829894 - RNA, 17 nt, Human
ucuggccuuccugaacu

SEQ ID NO: 829895 - RNA, 22 nt, Human
cagucccaucucccagguggcu

SEQ ID NO: 829896 - RNA, 22 nt, Human
augcugaggacaaagagaucaa

SEQ ID NO: 829897 - RNA, 22 nt, Human
ugcuguuauacuuagcugguua

SEQ ID NO: 829898 - RNA, 22 nt, Human
acagggccucagccagggcaga

SEQ ID NO: 829899 - RNA, 23 nt, Human
cccagggacacgaugacaccucc

SEQ ID NO: 829900 - RNA, 22 nt, Human
gggucuggacggcugcaggaag

SEQ ID NO: 829901 - RNA, 22 nt, Human
ucaggugggaccugcuaggaca

SEQ ID NO: 829902 - RNA, 22 nt, Human
uuuccaaagcugaguugagcaa

SEQ ID NO: 829903 - RNA, 22 nt, Human
uggcucagcgguggcagcagac

SEQ ID NO: 829904 - RNA, 22 nt, Human
gauauuuugagaaauccuauga

SEQ ID NO: 829905 - RNA, 21 nt, Human
auggcuuuuuuaaagcuugug

SEQ ID NO: 829906 - RNA, 22 nt, Human
ugaagcaacuggacaaguuggc

SEQ ID NO: 829907 - RNA, 22 nt, Human
auaugagagaggaaagauuuua

SEQ ID NO: 829908 - RNA, 22 nt, Human
gugcccugguccccagcauaua

SEQ ID NO: 829909 - RNA, 22 nt, Human
agagaugaacauaaaacaagga

SEQ ID NO: 829910 - RNA, 22 nt, Human
auggcuuuccugggacaugggc

SEQ ID NO: 829911 - RNA, 22 nt, Human
cagaggcugcucuggguggcau

SEQ ID NO: 829912 - RNA, 22 nt, Human
cuugggagacacaagaagacau

SEQ ID NO: 829913 - RNA, 19 nt, Human
cucugccucuggcuguggc

SEQ ID NO: 829914 - RNA, 22 nt, Human
cccagcuccaagggacagcgaa

SEQ ID NO: 829915 - RNA, 22 nt, Human
uuagaaacccagacucuuaggu

SEQ ID NO: 829916 - RNA, 21 nt, Human
ccucugcucgggcaugcguuu

SEQ ID NO: 829917 - RNA, 22 nt, Human
auaaugaggauuugcauauuag

SEQ ID NO: 829918 - RNA, 22 nt, Human
auuuagcaaaaaaugaugaagc

SEQ ID NO: 829919 - RNA, 20 nt, Human
ggcacuggaagcacacagga

SEQ ID NO: 829920 - RNA, 22 nt, Human
gggcugggaauggcuaaguaug

SEQ ID NO: 829921 - RNA, 22 nt, Human
aagagcuggaugaagaaaucaa

SEQ ID NO: 829922 - RNA, 22 nt, Human
uauauuaacacccacuugccuc

SEQ ID NO: 829923 - RNA, 22 nt, Human
aauauuucugcagaaugguuuu

SEQ ID NO: 829924 - RNA, 22 nt, Human
ugaaggagcucaaugaugaugc

SEQ ID NO: 829925 - RNA, 22 nt, Human
ucuuuggauaucgcuagaccgu

SEQ ID NO: 829926 - RNA, 22 nt, Human
acaggcuucucacagaaaaggg

SEQ ID NO: 829927 - RNA, 22 nt, Human
uuucacauaugguuguugauug

SEQ ID NO: 829928 - RNA, 22 nt, Human
aauucuugguccuaguguauaa

SEQ ID NO: 829929 - RNA, 22 nt, Human
gccucugcucucagguagccuc

SEQ ID NO: 829930 - RNA, 22 nt, Human
agugaccaacaaugcugagaag

SEQ ID NO: 829931 - RNA, 22 nt, Human
ugucuuuucuacuguaagcaua

SEQ ID NO: 829932 - RNA, 23 nt, Human
agggagcuaaaaggcuggagcag

SEQ ID NO: 829933 - RNA, 22 nt, Human
ccagagcugcauccagcagguu

SEQ ID NO: 829934 - RNA, 22 nt, Human
gagcucauucauucauugccug

SEQ ID NO: 829935 - RNA, 22 nt, Human
ggaaggaggaugcucuggccuu

SEQ ID NO: 829936 - RNA, 22 nt, Human
ggggauggaauguaguagugau

SEQ ID NO: 829937 - RNA, 22 nt, Human
cugccuuggcccuaguucaugg

SEQ ID NO: 829938 - RNA, 22 nt, Human
ucagggcaaagggcagaguuug

SEQ ID NO: 829939 - RNA, 18 nt, Human
gagaggagccagaauuuu

SEQ ID NO: 829940 - RNA, 22 nt, Human
gggcagagagcuggaacuccuu

SEQ ID NO: 829941 - RNA, 22 nt, Human
ggcagagacuggguuggcagag

SEQ ID NO: 829942 - RNA, 22 nt, Human
ggaucugauuaauaagguggac

SEQ ID NO: 829943 - RNA, 22 nt, Human
aaaguguaaaagcauguuaggg

SEQ ID NO: 829944 - RNA, 22 nt, Human
gugccugccccacuccucagca

SEQ ID NO: 829945 - RNA, 22 nt, Human
ugaguagcggcuauguguaacu

SEQ ID NO: 829946 - RNA, 22 nt, Human
auaguacacauccuacaauguu

SEQ ID NO: 829947 - RNA, 23 nt, Human
aucaaaguggaaaucaauuaucu

SEQ ID NO: 829948 - RNA, 22 nt, Human
agccagcucccuccccugcagg

SEQ ID NO: 829949 - RNA, 20 nt, Human
uugcagcagugaggugaagg

SEQ ID NO: 829950 - RNA, 20 nt, Human
uccagggcuagggagcucau

SEQ ID NO: 829951 - RNA, 22 nt, Human
ucugagcuuuuauuaucaaccu

SEQ ID NO: 829952 - RNA, 22 nt, Human
ccaggagcaggagcuggacaga

SEQ ID NO: 829953 - RNA, 22 nt, Human
uucugucauuuagcauugucau

SEQ ID NO: 829954 - RNA, 22 nt, Human
uaguccuuuaucaaacauuuau

SEQ ID NO: 829955 - RNA, 17 nt, Human
ccucccacaccgcccug

SEQ ID NO: 829956 - RNA, 22 nt, Human
ugucuucaguaaaauacacuau

SEQ ID NO: 829957 - RNA, 22 nt, Human
uauggaaagcucuuuuugauug

SEQ ID NO: 829958 - RNA, 22 nt, Human
cucuccuugcagauggcugccu

SEQ ID NO: 829959 - RNA, 22 nt, Human
agccuccaguagcugaagagac

SEQ ID NO: 829960 - RNA, 22 nt, Human
cauuuucucaaugaacccucuu

SEQ ID NO: 829961 - RNA, 22 nt, Human
ccucacagggccaggccccuca

SEQ ID NO: 829962 - RNA, 22 nt, Human
aaggguggauuucugagcucua

SEQ ID NO: 829963 - RNA, 22 nt, Human
ucaaagucuaucuguaauuacu

SEQ ID NO: 829964 - RNA, 22 nt, Human
uucauacaguggcugcacucca

SEQ ID NO: 829965 - RNA, 22 nt, Human
cuguccuguggaccugaggacg

SEQ ID NO: 829966 - RNA, 22 nt, Human
ugcaacuuguuuggagagaaag

SEQ ID NO: 829967 - RNA, 22 nt, Human
gauuucuugauaauucaaaucc

SEQ ID NO: 829968 - RNA, 22 nt, Human
agucuucccugugccagagugu

SEQ ID NO: 829969 - RNA, 22 nt, Human
gaauuguacgcuuuacauaggu

SEQ ID NO: 829970 - RNA, 22 nt, Human
gggcagcucugcccaucagagg

SEQ ID NO: 829971 - RNA, 22 nt, Human
gugcucuccuggcugcccugac

SEQ ID NO: 829972 - RNA, 22 nt, Human
uucagaaagguuaaucuggauu

SEQ ID NO: 829973 - RNA, 22 nt, Human
aaaguuugagugauuugacaca

SEQ ID NO: 829974 - RNA, 22 nt, Human
guuugauucaagaacaaagagu

SEQ ID NO: 829975 - RNA, 22 nt, Human
agcugcugcgccucacccuggc

SEQ ID NO: 829976 - RNA, 22 nt, Human
uucauacacgaaaaugcaugca

SEQ ID NO: 829977 - RNA, 22 nt, Human
cacucugacuggcccugcagga

SEQ ID NO: 829978 - RNA, 22 nt, Human
caaaggcaacauauacuuguuu

SEQ ID NO: 829979 - RNA, 22 nt, Human
aggagcagcccacuccuguccu

SEQ ID NO: 829980 - RNA, 18 nt, Human
ccagagcuggcuccucgc

SEQ ID NO: 829981 - RNA, 22 nt, Human
gcagugggagcuuaggcagugc

SEQ ID NO: 829982 - RNA, 22 nt, Human
ucagaggaaaggucagauggcu

SEQ ID NO: 829983 - RNA, 22 nt, Human
caggcagcuagauuuauaacaa

SEQ ID NO: 829984 - RNA, 22 nt, Human
cauuuuaagaugaccugguuuc

SEQ ID NO: 829985 - RNA, 22 nt, Human
auuaucuauguagaaugauuuu

SEQ ID NO: 829986 - RNA, 22 nt, Human
cagcaugguggagcugcucuuu

SEQ ID NO: 829987 - RNA, 22 nt, Human
agggcuggcaucucuaaugcug

SEQ ID NO: 829988 - RNA, 22 nt, Human
acacagggucuagaguuaggcc

SEQ ID NO: 829989 - RNA, 22 nt, Human
gggcugugagaguggggcugcu

SEQ ID NO: 829990 - RNA, 22 nt, Human
ggucucagacuggcaggcagug

SEQ ID NO: 829991 - RNA, 22 nt, Human
augauggugggagaugacccag

SEQ ID NO: 829992 - RNA, 22 nt, Human
ggccagggccuggggacugucc

SEQ ID NO: 829993 - RNA, 22 nt, Human
acccaggaugauaauguucaca

SEQ ID NO: 829994 - RNA, 22 nt, Human
uucuucuucuggcugcaccugg

SEQ ID NO: 829995 - RNA, 22 nt, Human
uccagggcugacuugggagagg

SEQ ID NO: 829996 - RNA, 22 nt, Human
uuucauaaugucacagucaaaa

SEQ ID NO: 829997 - RNA, 22 nt, Human
ugcagugccucggcagugcagc

SEQ ID NO: 829998 - RNA, 22 nt, Human
auaaaugccucagaaucauccc

SEQ ID NO: 829999 - RNA, 22 nt, Human
caguggcgugaucucugcucac

SEQ ID NO: 830000 - RNA, 22 nt, Human
cagcauuuaucuuguagcagga

SEQ ID NO: 830001 - RNA, 22 nt, Human
auacacauguguaugugcaugc

SEQ ID NO: 830002 - RNA, 22 nt, Human
uauaaaguuucgaaagauguau

SEQ ID NO: 830003 - RNA, 22 nt, Human
auucuacaacccaauaauaauu

SEQ ID NO: 830004 - RNA, 22 nt, Human
uacuagaaccucacaacaaucc

SEQ ID NO: 830005 - RNA, 22 nt, Human
aaguuacuggcaagggcugcag

SEQ ID NO: 830006 - RNA, 22 nt, Human
augcacuugcguguuugcaaau

SEQ ID NO: 830007 - RNA, 22 nt, Human
uuacaugguuguuggaaaugcu

SEQ ID NO: 830008 - RNA, 22 nt, Human
aaggcagcagaggaaaggugcu

SEQ ID NO: 830009 - RNA, 22 nt, Human
cuucuggaggacacuggcccca

SEQ ID NO: 830010 - RNA, 22 nt, Human
uuaaguccuugguaauuuucuu

SEQ ID NO: 830011 - RNA, 22 nt, Human
ugccaaggguaugggcaagaua

SEQ ID NO: 830012 - RNA, 22 nt, Human
ugcucuguugugcaugugggau

SEQ ID NO: 830013 - RNA, 22 nt, Human
uggcagcuccuggggccagcac

SEQ ID NO: 830014 - RNA, 22 nt, Human
agcaggaggguuuuguagaguc

SEQ ID NO: 830015 - RNA, 22 nt, Human
gcugccugauguccagcaggac

SEQ ID NO: 830016 - RNA, 22 nt, Human
uuuucaguaaugucuacauaau

SEQ ID NO: 830017 - RNA, 23 nt, Human
aaacuacauuuauaguuuuucuc

SEQ ID NO: 830018 - RNA, 22 nt, Human
cauugcacuuuggguccaggac

SEQ ID NO: 830019 - RNA, 17 nt, Human
gcccaggaaggacggcc

SEQ ID NO: 830020 - RNA, 22 nt, Human
cauuucuguucucuuccuguac

SEQ ID NO: 830021 - RNA, 21 nt, Human
ggucuuccaaauaaggagaaa

SEQ ID NO: 830022 - RNA, 22 nt, Human
cuugaaucuggcuuugccacuu

SEQ ID NO: 830023 - RNA, 22 nt, Human
aggauuuagauuuggaggaacu

SEQ ID NO: 830024 - RNA, 20 nt, Human
ggcucuggaaucuggugggc

SEQ ID NO: 830025 - RNA, 22 nt, Human
aauucuauguucuugaguaaga

SEQ ID NO: 830026 - RNA, 22 nt, Human
cagauuucuauuucaaauacau

SEQ ID NO: 830027 - RNA, 18 nt, Human
uccagagguguuggagcc

SEQ ID NO: 830028 - RNA, 22 nt, Human
uuaauauguugaaauuuauuag

SEQ ID NO: 830029 - RNA, 20 nt, Human
agaagucagcucagaaguga

SEQ ID NO: 830030 - RNA, 22 nt, Human
gugaauaauuuuuuaguauaag

SEQ ID NO: 830031 - RNA, 22 nt, Human
ucuggcucuguguccccaccca

SEQ ID NO: 830032 - RNA, 22 nt, Human
guccucugggcuuugagcaguc

SEQ ID NO: 830033 - RNA, 22 nt, Human
ugcuggagaucauuaauguuca

SEQ ID NO: 830034 - RNA, 22 nt, Human
ugcucagggacaauggagaggg

SEQ ID NO: 830035 - RNA, 18 nt, Human
gagaggcccggcugugcc

SEQ ID NO: 830036 - RNA, 22 nt, Human
ucccuggacaacagacuucacu

SEQ ID NO: 830037 - RNA, 22 nt, Human
gggcagcuggcuuauagguuug

SEQ ID NO: 830038 - RNA, 22 nt, Human
ccaaaguccacaguuuacauua

SEQ ID NO: 830039 - RNA, 22 nt, Human
agccagcaggugagugcagccu

SEQ ID NO: 830040 - RNA, 22 nt, Human
ucugggaagcugguccuguucu

SEQ ID NO: 830041 - RNA, 22 nt, Human
gguggguauugaauacaggugu

SEQ ID NO: 830042 - RNA, 22 nt, Human
cccuggagguggagguugcagg

SEQ ID NO: 830043 - RNA, 22 nt, Human
uuugaauagaggccccucagaa

SEQ ID NO: 830044 - RNA, 22 nt, Human
guuauaaaugacugcaaaaguu

SEQ ID NO: 830045 - RNA, 22 nt, Human
ucauaaaaugcuccugauauug

SEQ ID NO: 830046 - RNA, 22 nt, Human
ccacaucucgguccccucuuug

SEQ ID NO: 830047 - RNA, 22 nt, Human
caaagaagagauuuacagagcu

SEQ ID NO: 830048 - RNA, 17 nt, Human
gagugcugguggagcuc

SEQ ID NO: 830049 - RNA, 22 nt, Human
acagcuggaggccccauugucc

SEQ ID NO: 830050 - RNA, 23 nt, Human
ccagcucccaggucugaggacug

SEQ ID NO: 830051 - RNA, 22 nt, Human
uuucuuaggcucuaaaaugacu

SEQ ID NO: 830052 - RNA, 22 nt, Human
gccaggcugcuggcugcugucc

SEQ ID NO: 830053 - RNA, 22 nt, Human
caucagaauagcucuguggaua

SEQ ID NO: 830054 - RNA, 18 nt, Human
gggaagaggaucuggccc

SEQ ID NO: 830055 - RNA, 22 nt, Human
uuuuucagccaugaauuacacu

SEQ ID NO: 830056 - RNA, 22 nt, Human
aggcagccaaucagaggcugac

SEQ ID NO: 830057 - RNA, 22 nt, Human
caguucuuaauaccaugugguu

SEQ ID NO: 830058 - RNA, 22 nt, Human
caguccuugcuaugacccugag

SEQ ID NO: 830059 - RNA, 22 nt, Human
cuuuauguuggggugucuuagu

SEQ ID NO: 830060 - RNA, 22 nt, Human
ccuggaaggugaugguacagca

SEQ ID NO: 830061 - RNA, 22 nt, Human
gugugcaugcauagacaccaca

SEQ ID NO: 830062 - RNA, 23 nt, Human
aguuccagaaaaaugcucaagca

SEQ ID NO: 830063 - RNA, 22 nt, Human
caggcagccugagggaucuggg

SEQ ID NO: 830064 - RNA, 22 nt, Human
ugccugaguuuaacccucagag

SEQ ID NO: 830065 - RNA, 22 nt, Human
acagccagggucucaggaggcg

SEQ ID NO: 830066 - RNA, 22 nt, Human
gcagagugggagcccagggcug

SEQ ID NO: 830067 - RNA, 22 nt, Human
gcucaggaaacagcagggcuug

SEQ ID NO: 830068 - RNA, 22 nt, Human
acauucuuaacaguuaaaaacu

SEQ ID NO: 830069 - RNA, 22 nt, Human
uucaagaugucuucacaauagu

SEQ ID NO: 830070 - RNA, 22 nt, Human
ggagauggaauagauucugacu

SEQ ID NO: 830071 - RNA, 22 nt, Human
gcucuguguccacagcuggaaa

SEQ ID NO: 830072 - RNA, 22 nt, Human
ggggugggguuacucauugugc

SEQ ID NO: 830073 - RNA, 22 nt, Human
cagcaggaggugaguagcaggu

SEQ ID NO: 830074 - RNA, 22 nt, Human
agacagggucuugaucagagcu

SEQ ID NO: 830075 - RNA, 22 nt, Human
gcugggagaggcccugaaguga

SEQ ID NO: 830076 - RNA, 22 nt, Human
uggcagugccccuugaccagug

SEQ ID NO: 830077 - RNA, 22 nt, Human
uggccugacugucaggcuguau

SEQ ID NO: 830078 - RNA, 23 nt, Human
uuuaacuuuccaauaauucauug

SEQ ID NO: 830079 - RNA, 22 nt, Human
caugcuguguguuuuagcucca

SEQ ID NO: 830080 - RNA, 20 nt, Human
cagaaggucuaagcuuuaga

SEQ ID NO: 830081 - RNA, 22 nt, Human
ggaagggcaaaagagaugaacu

SEQ ID NO: 830082 - RNA, 21 nt, Human
gcacagcaugaguguuggcau

SEQ ID NO: 830083 - RNA, 22 nt, Human
uggcucagcugacucggcuucu

SEQ ID NO: 830084 - RNA, 22 nt, Human
uuccaggaagcaguuagcagcc

SEQ ID NO: 830085 - RNA, 22 nt, Human
gcugucugucucugugacuuaa

SEQ ID NO: 830086 - RNA, 22 nt, Human
cagcugccacuugcucucggcu

SEQ ID NO: 830087 - RNA, 22 nt, Human
ucugcaggaggcuggcugcagg

SEQ ID NO: 830088 - RNA, 22 nt, Human
ugaggggagcccgcccuggacg

SEQ ID NO: 830089 - RNA, 22 nt, Human
agaacagcaguuaugguucauu

SEQ ID NO: 830090 - RNA, 22 nt, Human
uagcagggaaggugugcugagc

SEQ ID NO: 830091 - RNA, 22 nt, Human
ccagcucccugaagccuggucu

SEQ ID NO: 830092 - RNA, 22 nt, Human
gccugucaauuuuguguacaau

SEQ ID NO: 830093 - RNA, 22 nt, Human
cagggccagcgucucgggcuau

SEQ ID NO: 830094 - RNA, 22 nt, Human
caggaaagggaugggcugccac

SEQ ID NO: 830095 - RNA, 22 nt, Human
gagggcugcaaugagacagaga

SEQ ID NO: 830096 - RNA, 23 nt, Human
ugcaugugaauucauacuuguuu

SEQ ID NO: 830097 - RNA, 22 nt, Human
uucagucagugacuaagcaguu

SEQ ID NO: 830098 - RNA, 22 nt, Human
uuuacuuuugguaaggucauuu

SEQ ID NO: 830099 - RNA, 22 nt, Human
ugaaggaagaauaggcaguguu

SEQ ID NO: 830100 - RNA, 22 nt, Human
uuuccucugcugccauugcccc

SEQ ID NO: 830101 - RNA, 22 nt, Human
gggcucugguacuuccuggcuc

SEQ ID NO: 830102 - RNA, 22 nt, Human
cagaaagaccugggcucaagag

SEQ ID NO: 830103 - RNA, 22 nt, Human
gcugcaggcgccugcggucucu

SEQ ID NO: 830104 - RNA, 21 nt, Human
acaggcuuuagaaaaugacuc

SEQ ID NO: 830105 - RNA, 22 nt, Human
uaagaacauaaauucauacggg

SEQ ID NO: 830106 - RNA, 22 nt, Human
aaugcacauguuguaauaaaua

SEQ ID NO: 830107 - RNA, 22 nt, Human
gcagcuuggugaaaggugaugg

SEQ ID NO: 830108 - RNA, 22 nt, Human
caguaugagaguugaaucaagg

SEQ ID NO: 830109 - RNA, 22 nt, Human
aaauguuucuacuugugagcau

SEQ ID NO: 830110 - RNA, 22 nt, Human
ucuggcucuaacuaggcaucag

SEQ ID NO: 830111 - RNA, 22 nt, Human
gucaccaggucugaugcagcca

SEQ ID NO: 830112 - RNA, 22 nt, Human
ucagaagcaggagugugcacaa

SEQ ID NO: 830113 - RNA, 22 nt, Human
cuuaggcagggcuggaagaucu

SEQ ID NO: 830114 - RNA, 20 nt, Human
aggaagccaaaggcugucuu

SEQ ID NO: 830115 - RNA, 22 nt, Human
uggaaagucucuuuugacugua

SEQ ID NO: 830116 - RNA, 22 nt, Human
gcuggccauauauuuugcuguu

SEQ ID NO: 830117 - RNA, 22 nt, Human
aaggcacuuuuccugagaugau

SEQ ID NO: 830118 - RNA, 22 nt, Human
gcacagggagacagccguggcc

SEQ ID NO: 830119 - RNA, 22 nt, Human
ucugggaacugagcuccccuag

SEQ ID NO: 830120 - RNA, 22 nt, Human
uggccugccucccggcuucuuu

SEQ ID NO: 830121 - RNA, 22 nt, Human
uuuuucaugagacuagaaguca

SEQ ID NO: 830122 - RNA, 22 nt, Human
auucugucuaagcuggcuacgu

SEQ ID NO: 830123 - RNA, 22 nt, Human
uggcagggugccaguugcgagu

SEQ ID NO: 830124 - RNA, 22 nt, Human
ggguggaggagaacaggcccca

SEQ ID NO: 830125 - RNA, 22 nt, Human
cagccugacaccagcuuugggc

SEQ ID NO: 830126 - RNA, 22 nt, Human
ugaaagguguccaauauuucuc

SEQ ID NO: 830127 - RNA, 22 nt, Human
uuucauaauauccagagauuuu

SEQ ID NO: 830128 - RNA, 22 nt, Human
aaagccuuggucaucugguucc

SEQ ID NO: 830129 - RNA, 22 nt, Human
ccaggacaaguguggccauggc

SEQ ID NO: 830130 - RNA, 22 nt, Human
cuuccagguccuucuugagaag

SEQ ID NO: 830131 - RNA, 22 nt, Human
ccagaggucuccugcacgggau

SEQ ID NO: 830132 - RNA, 22 nt, Human
agggccagcacuccuggcagga

SEQ ID NO: 830133 - RNA, 18 nt, Human
cagucccaaaccuuagga

SEQ ID NO: 830134 - RNA, 22 nt, Human
gugcuuccccaagccacagccu

SEQ ID NO: 830135 - RNA, 22 nt, Human
acuuccuggcugggugaccugg

SEQ ID NO: 830136 - RNA, 22 nt, Human
uguguacaggccuugcuagacu

SEQ ID NO: 830137 - RNA, 22 nt, Human
uagcaggguaaauguagaugga

SEQ ID NO: 830138 - RNA, 22 nt, Human
uuuggaauauuaaaaugucuca

SEQ ID NO: 830139 - RNA, 22 nt, Human
caggccugcaggaaaggcuccc

SEQ ID NO: 830140 - RNA, 22 nt, Human
cucacugucuguacuagcugau

SEQ ID NO: 830141 - RNA, 22 nt, Human
cugagccauaagggaggcuggg

SEQ ID NO: 830142 - RNA, 22 nt, Human
auacagaaaaguggauagccag

SEQ ID NO: 830143 - RNA, 22 nt, Human
aguguuccuugcuuucccagag

SEQ ID NO: 830144 - RNA, 22 nt, Human
gaaguccugguccucucauuca

SEQ ID NO: 830145 - RNA, 18 nt, Human
gcuccuggaccaggucac

SEQ ID NO: 830146 - RNA, 22 nt, Human
gaaguucuuagucucauuugca

SEQ ID NO: 830147 - RNA, 22 nt, Human
caguacuuugaagauauuuuag

SEQ ID NO: 830148 - RNA, 22 nt, Human
gaagccaguacugugcucugca

SEQ ID NO: 830149 - RNA, 22 nt, Human
uggaagggggaagacagcucug

SEQ ID NO: 830150 - RNA, 22 nt, Human
ggacaggguaaguacuagugug

SEQ ID NO: 830151 - RNA, 21 nt, Human
uguaaguuucaucugaauugg

SEQ ID NO: 830152 - RNA, 18 nt, Human
ugaacagaugaguugaag

SEQ ID NO: 830153 - RNA, 22 nt, Human
augucccaagauacagcuagag

SEQ ID NO: 830154 - RNA, 22 nt, Human
cugggccaucagaggggcugga

SEQ ID NO: 830155 - RNA, 17 nt, Human
cccagagaugcugccuu

SEQ ID NO: 830156 - RNA, 22 nt, Human
aggugccaauuuucagugaaca

SEQ ID NO: 830157 - RNA, 22 nt, Human
gagggguguggagccaucaguu

SEQ ID NO: 830158 - RNA, 19 nt, Human
agugucaucagcuacucag

SEQ ID NO: 830159 - RNA, 22 nt, Human
uagggcaggggaggaaucugaa

SEQ ID NO: 830160 - RNA, 21 nt, Human
gaaaggucuuaacuuacagag

SEQ ID NO: 830161 - RNA, 22 nt, Human
gcugucccgaaccccugguaau

SEQ ID NO: 830162 - RNA, 20 nt, Human
caagcccucuuuagccugcc

SEQ ID NO: 830163 - RNA, 22 nt, Human
agugaccaaucaugguuagauu

SEQ ID NO: 830164 - RNA, 22 nt, Human
uacagacaguuuuucagauauu

SEQ ID NO: 830165 - RNA, 22 nt, Human
agacccugcaccucucgugggc

SEQ ID NO: 830166 - RNA, 22 nt, Human
uuuuuccuuagggguuacucac

SEQ ID NO: 830167 - RNA, 22 nt, Human
guucauuuaugauguaacaugu

SEQ ID NO: 830168 - RNA, 22 nt, Human
aaaauguaaagcuugaguguag

SEQ ID NO: 830169 - RNA, 22 nt, Human
aacuuugaggucacugaauucc

SEQ ID NO: 830170 - RNA, 22 nt, Human
ccaggagagcauugcacagagg

SEQ ID NO: 830171 - RNA, 22 nt, Human
aacaguaaugugguguuggguu

SEQ ID NO: 830172 - RNA, 22 nt, Human
ucacuuauaaaaugcaagaucu

SEQ ID NO: 830173 - RNA, 22 nt, Human
ugauuuccuagcugacaugaaa

SEQ ID NO: 830174 - RNA, 22 nt, Human
gaaaagcuaggccaguucagcu

SEQ ID NO: 830175 - RNA, 22 nt, Human
cccuucccuucugggagaucca

SEQ ID NO: 830176 - RNA, 22 nt, Human
uggcccugacacgugguacugg

SEQ ID NO: 830177 - RNA, 22 nt, Human
uccaugagagguaacuuuacaa

SEQ ID NO: 830178 - RNA, 22 nt, Human
gaaagaggaaggagauguauua

SEQ ID NO: 830179 - RNA, 22 nt, Human
agaggcagcagucauacuacag

SEQ ID NO: 830180 - RNA, 22 nt, Human
uuuaaaaaacuagucugagucu

SEQ ID NO: 830181 - RNA, 22 nt, Human
cuacacaguucugccuaauggc

SEQ ID NO: 830182 - RNA, 22 nt, Human
ucaugcuuauugcauauuugga

SEQ ID NO: 830183 - RNA, 22 nt, Human
gcagcuggcccugacacgcaga

SEQ ID NO: 830184 - RNA, 22 nt, Human
acauaauaaaaauaacagcuca

SEQ ID NO: 830185 - RNA, 22 nt, Human
caaauucucacccuguuugauu

SEQ ID NO: 830186 - RNA, 22 nt, Human
ucuggcuccguguccgcuccca

SEQ ID NO: 830187 - RNA, 22 nt, Human
auuucaacauucucaguuguag

SEQ ID NO: 830188 - RNA, 22 nt, Human
uggccacagccucugccaguuc

SEQ ID NO: 830189 - RNA, 22 nt, Human
gcuccuucaggugguagcuguu

SEQ ID NO: 830190 - RNA, 22 nt, Human
cacagggccuugugugacugca

SEQ ID NO: 830191 - RNA, 20 nt, Human
uggagcuccagcguccaugu

SEQ ID NO: 830192 - RNA, 22 nt, Human
cuuuuccacugagccucacaaa

SEQ ID NO: 830193 - RNA, 22 nt, Human
acccaggccugagagacaggag

SEQ ID NO: 830194 - RNA, 22 nt, Human
agugcuuucuugcuccaucagu

SEQ ID NO: 830195 - RNA, 18 nt, Human
aguccuuacgaggcuaua

SEQ ID NO: 830196 - RNA, 22 nt, Human
ggcauuuagauugaauuucugu

SEQ ID NO: 830197 - RNA, 22 nt, Human
aucugcuugaguuugaagucag

SEQ ID NO: 830198 - RNA, 20 nt, Human
gacaucauguacacauugcc

SEQ ID NO: 830199 - RNA, 22 nt, Human
gggucagcugcugggggcugac

SEQ ID NO: 830200 - RNA, 22 nt, Human
gccaggccugcaagugcuggug

SEQ ID NO: 830201 - RNA, 22 nt, Human
ccagggcaauuauuuggagggu

SEQ ID NO: 830202 - RNA, 22 nt, Human
gauuuccucacuaacauccauc

SEQ ID NO: 830203 - RNA, 22 nt, Human
ggcaguggugggaggcucgcuc

SEQ ID NO: 830204 - RNA, 22 nt, Human
augauggugagguugagcacag

SEQ ID NO: 830205 - RNA, 22 nt, Human
cacaaugcguacauauaucaaa

SEQ ID NO: 830206 - RNA, 22 nt, Human
guuaggcauuugccuuaauuuu

SEQ ID NO: 830207 - RNA, 22 nt, Human
agaaaucaauaucuauauguug

SEQ ID NO: 830208 - RNA, 22 nt, Human
uggagccagagcgcagccuggg

SEQ ID NO: 830209 - RNA, 22 nt, Human
gagagcuggauucuggauaggu

SEQ ID NO: 830210 - RNA, 17 nt, Human
uauauguaugccucucc

SEQ ID NO: 830211 - RNA, 22 nt, Human
guccucuguguaggcugcagac

SEQ ID NO: 830212 - RNA, 23 nt, Human
ucuuuccucagcacacaccaaga

SEQ ID NO: 830213 - RNA, 22 nt, Human
aggcagaucacuugaggccagg

SEQ ID NO: 830214 - RNA, 22 nt, Human
cuggcagccaagugggauacuc

SEQ ID NO: 830215 - RNA, 22 nt, Human
ccucagagccuccagaaggaau

SEQ ID NO: 830216 - RNA, 22 nt, Human
cugagcugcggcaggcaccugg

SEQ ID NO: 830217 - RNA, 22 nt, Human
gcucugcuggaaguucucugga

SEQ ID NO: 830218 - RNA, 22 nt, Human
aaucuucuuucuuaacaguaca

SEQ ID NO: 830219 - RNA, 22 nt, Human
gggaggcuggcucuggccacag

SEQ ID NO: 830220 - RNA, 22 nt, Human
gcaggggcuacucugagcuucc

SEQ ID NO: 830221 - RNA, 22 nt, Human
uuauuuacaacucuucucuucc

SEQ ID NO: 830222 - RNA, 22 nt, Human
auccaugaagguacuucucagg

SEQ ID NO: 830223 - RNA, 22 nt, Human
ggagggcugccagguggagcgg

SEQ ID NO: 830224 - RNA, 22 nt, Human
gaggagcugggucagggagaca

SEQ ID NO: 830225 - RNA, 22 nt, Human
ugcccaagcagaggagugauuc

SEQ ID NO: 830226 - RNA, 22 nt, Human
ugggcugcuguuacaggggcug

SEQ ID NO: 830227 - RNA, 22 nt, Human
uaacacugguauuucauuuagu

SEQ ID NO: 830228 - RNA, 22 nt, Human
acagguggcauaggcaguuuga

SEQ ID NO: 830229 - RNA, 22 nt, Human
acacaugagaaacaucaguugu

SEQ ID NO: 830230 - RNA, 20 nt, Human
ccuccuggucaggugugcag

SEQ ID NO: 830231 - RNA, 22 nt, Human
agccucugcuuaugcaaaggua

SEQ ID NO: 830232 - RNA, 22 nt, Human
gagggagggacuagcauucucu

SEQ ID NO: 830233 - RNA, 22 nt, Human
gcagggcagccacaggcccccu

SEQ ID NO: 830234 - RNA, 22 nt, Human
ugcauugauagaaaaacaugga

SEQ ID NO: 830235 - RNA, 22 nt, Human
aaauacuagaauucagaguuga

SEQ ID NO: 830236 - RNA, 22 nt, Human
uccagggcuuggcugggacggu

SEQ ID NO: 830237 - RNA, 22 nt, Human
ggcaagcucaggccucaggugu

SEQ ID NO: 830238 - RNA, 22 nt, Human
ucuucacaggagccugccugcc

SEQ ID NO: 830239 - RNA, 22 nt, Human
uggccuggugcucaggcaguag

SEQ ID NO: 830240 - RNA, 22 nt, Human
uuucuauaugaggagcuaaagu

SEQ ID NO: 830241 - RNA, 18 nt, Human
cccagcccaccauuucuc

SEQ ID NO: 830242 - RNA, 22 nt, Human
uguacacaauucuuaacauaca

SEQ ID NO: 830243 - RNA, 22 nt, Human
aaacaugaauagauauuaaaca

SEQ ID NO: 830244 - RNA, 22 nt, Human
agaggaggaagagcuuuaaaau

SEQ ID NO: 830245 - RNA, 22 nt, Human
guaacaaaguuucuaggugcug

SEQ ID NO: 830246 - RNA, 22 nt, Human
ugaagacacauacaagggaaug

SEQ ID NO: 830247 - RNA, 18 nt, Human
cauuguacaaugcuuuau

SEQ ID NO: 830248 - RNA, 22 nt, Human
cacauccuucagcugagcccag

SEQ ID NO: 830249 - RNA, 22 nt, Human
aagcuccccgaaacccaccucu

SEQ ID NO: 830250 - RNA, 22 nt, Human
uaaaugagggcugacaugauug

SEQ ID NO: 830251 - RNA, 22 nt, Human
gcugcucuggcucugcaguguc

SEQ ID NO: 830252 - RNA, 22 nt, Human
ccauuguaaauucuguggaagu

SEQ ID NO: 830253 - RNA, 22 nt, Human
aacucaguuacauauuagaaua

SEQ ID NO: 830254 - RNA, 22 nt, Human
ucaggagcagcaugggugagag

SEQ ID NO: 830255 - RNA, 22 nt, Human
gaggccuggcugucagucccca

SEQ ID NO: 830256 - RNA, 22 nt, Human
cugagcauggccgguccauggu

SEQ ID NO: 830257 - RNA, 23 nt, Human
uguaaaaugggguaguguuacca

SEQ ID NO: 830258 - RNA, 22 nt, Human
uuacagaaaagggcuuuaagag

SEQ ID NO: 830259 - RNA, 22 nt, Human
ugugccagaaaauaugcugagg

SEQ ID NO: 830260 - RNA, 22 nt, Human
acuggaaaacacuacuacaugc

SEQ ID NO: 830261 - RNA, 22 nt, Human
ggcauuuagagggcuuuucuga

SEQ ID NO: 830262 - RNA, 22 nt, Human
caggugggaccaugauagggca

SEQ ID NO: 830263 - RNA, 22 nt, Human
guucuucaucauuuuagauagg

SEQ ID NO: 830264 - RNA, 22 nt, Human
acuggcagccacaacuggcagg

SEQ ID NO: 830265 - RNA, 22 nt, Human
gcgaaaaauguguaaauauguu

SEQ ID NO: 830266 - RNA, 22 nt, Human
gaaguccuccuaucuugcucuu

SEQ ID NO: 830267 - RNA, 22 nt, Human
ggagagagaugccgccuugcuc

SEQ ID NO: 830268 - RNA, 22 nt, Human
uacaugcuccacuuucuccugu

SEQ ID NO: 830269 - RNA, 22 nt, Human
cugugcuuaccugcccagguga

SEQ ID NO: 830270 - RNA, 22 nt, Human
uuggcagggccaggcucucucu

SEQ ID NO: 830271 - RNA, 22 nt, Human
aagaggagacuucagcaacuug

SEQ ID NO: 830272 - RNA, 22 nt, Human
acuguacuguguauuguagaau

SEQ ID NO: 830273 - RNA, 22 nt, Human
cuggcagguggauggggacucc

SEQ ID NO: 830274 - RNA, 22 nt, Human
aguaugaacggaaggccuggga

SEQ ID NO: 830275 - RNA, 20 nt, Human
aggagcugaauuagaggguu

SEQ ID NO: 830276 - RNA, 18 nt, Human
aggcacuggaauuaaggg

SEQ ID NO: 830277 - RNA, 22 nt, Human
cuggccuuggaagggagcccgu

SEQ ID NO: 830278 - RNA, 22 nt, Human
cacugccuccccaggcuccaca

SEQ ID NO: 830279 - RNA, 22 nt, Human
gcugagcugaggcagggcuggg

SEQ ID NO: 830280 - RNA, 22 nt, Human
aaggcagcuuuaaaaaagaugc

SEQ ID NO: 830281 - RNA, 17 nt, Human
uggacccuugggccucc

SEQ ID NO: 830282 - RNA, 22 nt, Human
auuuucugguugagguuuaaca

SEQ ID NO: 830283 - RNA, 22 nt, Human
cugagccacugcuuguucagug

SEQ ID NO: 830284 - RNA, 22 nt, Human
uuuauuuauccuucuggauugc

SEQ ID NO: 830285 - RNA, 22 nt, Human
gcagccacugggagugcuuaua

SEQ ID NO: 830286 - RNA, 22 nt, Human
uuuucaguuccaucucugcucu

SEQ ID NO: 830287 - RNA, 21 nt, Human
uuccagagauuguuucaccug

SEQ ID NO: 830288 - RNA, 22 nt, Human
ugagccugaguucaaggcugca

SEQ ID NO: 830289 - RNA, 22 nt, Human
guuuuucuaggaccaugugauu

SEQ ID NO: 830290 - RNA, 22 nt, Human
ucugauaacucuggccccaggc

SEQ ID NO: 830291 - RNA, 22 nt, Human
agcuuccucaccucagaggucu

SEQ ID NO: 830292 - RNA, 20 nt, Human
gcuuuuucuaauagcagucc

SEQ ID NO: 830293 - RNA, 22 nt, Human
uguacacugcaggaugcauugc

SEQ ID NO: 830294 - RNA, 22 nt, Human
ccagcuccaaguuugggcauca

SEQ ID NO: 830295 - RNA, 22 nt, Human
uguggccuugcagccuggaggu

SEQ ID NO: 830296 - RNA, 22 nt, Human
gcacaauaacagccaagguuau

SEQ ID NO: 830297 - RNA, 22 nt, Human
ugaacccaggagguugcaguga

SEQ ID NO: 830298 - RNA, 22 nt, Human
uauuccaacugucauagucaua

SEQ ID NO: 830299 - RNA, 22 nt, Human
uacauaguuccauuuacaggaa

SEQ ID NO: 830300 - RNA, 22 nt, Human
auugcagcuggucaggguaauu

SEQ ID NO: 830301 - RNA, 22 nt, Human
aaauauguaagauuagcacuag

SEQ ID NO: 830302 - RNA, 22 nt, Human
caaguaaacaauaugugauuca

SEQ ID NO: 830303 - RNA, 22 nt, Human
aggauuuacaaugauucuaggu

SEQ ID NO: 830304 - RNA, 22 nt, Human
cauugcacuccagcuugggcaa

SEQ ID NO: 830305 - RNA, 22 nt, Human
ugagugaggaagcgguggagga

SEQ ID NO: 830306 - RNA, 22 nt, Human
agcaccugcacaguggaggaaa

SEQ ID NO: 830307 - RNA, 22 nt, Human
aaaagagucuuaggcagucaua

SEQ ID NO: 830308 - RNA, 22 nt, Human
uacagggguaacaguggggaau

SEQ ID NO: 830309 - RNA, 22 nt, Human
acugucuuccaggucuggaggu

SEQ ID NO: 830310 - RNA, 21 nt, Human
ugccaggccugagcugggguc

SEQ ID NO: 830311 - RNA, 21 nt, Human
acagaugggaugagcacacug

SEQ ID NO: 830312 - RNA, 22 nt, Human
cugugcaagacuuacuuuaaua

SEQ ID NO: 830313 - RNA, 19 nt, Human
aagggcugggcaccucacu

SEQ ID NO: 830314 - RNA, 22 nt, Human
auacaucucauguaagagauaa

SEQ ID NO: 830315 - RNA, 22 nt, Human
cauuugaugacucaacucauaa

SEQ ID NO: 830316 - RNA, 22 nt, Human
ugccucugggugaccaaggagc

SEQ ID NO: 830317 - RNA, 22 nt, Human
guguguccucaguaguggcaug

SEQ ID NO: 830318 - RNA, 22 nt, Human
uggccuggcccugaggcccugu

SEQ ID NO: 830319 - RNA, 22 nt, Human
gccuuccugcagcucugagcgu

SEQ ID NO: 830320 - RNA, 22 nt, Human
gggacagaaggaagugagcaca

SEQ ID NO: 830321 - RNA, 22 nt, Human
uccuucagauuccugcuucugg

SEQ ID NO: 830322 - RNA, 22 nt, Human
cuggccaguuguccuggcuugg

SEQ ID NO: 830323 - RNA, 22 nt, Human
uggcacuggaaucguagccuug

SEQ ID NO: 830324 - RNA, 22 nt, Human
acugguuuuccagguuacuucu

SEQ ID NO: 830325 - RNA, 22 nt, Human
auccaguucucagugcuuacag

SEQ ID NO: 830326 - RNA, 22 nt, Human
gucugucauacggcuuauguaa

SEQ ID NO: 830327 - RNA, 22 nt, Human
agggagaacaguugcagcagac

SEQ ID NO: 830328 - RNA, 22 nt, Human
aagauauagauaaaacuaugca

SEQ ID NO: 830329 - RNA, 21 nt, Human
auccuugaucagaagagugcu

SEQ ID NO: 830330 - RNA, 22 nt, Human
uucuucuuuccuauaauuaauu

SEQ ID NO: 830331 - RNA, 22 nt, Human
gucauuucuguuucuucagugc

SEQ ID NO: 830332 - RNA, 22 nt, Human
ucuguucaucucaugggagaau

SEQ ID NO: 830333 - RNA, 22 nt, Human
aguccuuagaacacuguaucug

SEQ ID NO: 830334 - RNA, 22 nt, Human
uccaguucuaggucacucucug

SEQ ID NO: 830335 - RNA, 22 nt, Human
ccaaggcuccucagcuggucuu

SEQ ID NO: 830336 - RNA, 22 nt, Human
agggacagucuacuguucacug

SEQ ID NO: 830337 - RNA, 22 nt, Human
aggcagccaucugcaggaagga

SEQ ID NO: 830338 - RNA, 22 nt, Human
ccucuccuugcacccgucccgc

SEQ ID NO: 830339 - RNA, 22 nt, Human
agugauggugagugagaagcuc

SEQ ID NO: 830340 - RNA, 22 nt, Human
ugcaccauguaaguggccacgu

SEQ ID NO: 830341 - RNA, 22 nt, Human
ggccuugggcagacacgucaca

SEQ ID NO: 830342 - RNA, 22 nt, Human
aaauuauuacaagcuaguuggc

SEQ ID NO: 830343 - RNA, 22 nt, Human
uggccagguguggguucucaga

SEQ ID NO: 830344 - RNA, 18 nt, Human
ugggauggagaguaacug

SEQ ID NO: 830345 - RNA, 22 nt, Human
caggcagcucaaccuugggagc

SEQ ID NO: 830346 - RNA, 22 nt, Human
gcuucccagcagaggaaagacu

SEQ ID NO: 830347 - RNA, 22 nt, Human
agccuuguuggucugaguuugg

SEQ ID NO: 830348 - RNA, 22 nt, Human
ucuuccucucuaauugaucaga

SEQ ID NO: 830349 - RNA, 22 nt, Human
guggcagcggugugcaaggagg

SEQ ID NO: 830350 - RNA, 22 nt, Human
aggaccagaggccagagucagc

SEQ ID NO: 830351 - RNA, 21 nt, Human
agcagcugggcaacauggagg

SEQ ID NO: 830352 - RNA, 22 nt, Human
uccugaggcucacuuugaaugu

SEQ ID NO: 830353 - RNA, 22 nt, Human
gauuucuugaccccugucucag

SEQ ID NO: 830354 - RNA, 20 nt, Human
uuccaacucacaucucuaca

SEQ ID NO: 830355 - RNA, 22 nt, Human
gcagcugcuggagggaggcagg

SEQ ID NO: 830356 - RNA, 22 nt, Human
cagcagggaagcugugcuguuu

SEQ ID NO: 830357 - RNA, 22 nt, Human
uaaugucaaggugauagauuug

SEQ ID NO: 830358 - RNA, 22 nt, Human
gcugcugugaauuuuuuaaaug

SEQ ID NO: 830359 - RNA, 23 nt, Human
ccugucugugcuggguggacaca

SEQ ID NO: 830360 - RNA, 22 nt, Human
ugcucccagggacucuggcugg

SEQ ID NO: 830361 - RNA, 22 nt, Human
guuugcauguauuaagucaaua

SEQ ID NO: 830362 - RNA, 22 nt, Human
ggcugccuggaccuccucuuuc

SEQ ID NO: 830363 - RNA, 21 nt, Human
cauuucuauugaugagaaaag

SEQ ID NO: 830364 - RNA, 22 nt, Human
cuggccagaguuggagggugug

SEQ ID NO: 830365 - RNA, 23 nt, Human
aggauguaggauguauggcagag

SEQ ID NO: 830366 - RNA, 20 nt, Human
gguagcagcugcugucaucc

SEQ ID NO: 830367 - RNA, 22 nt, Human
agcaggaguuugaugcuuuuau

SEQ ID NO: 830368 - RNA, 22 nt, Human
agcagagguguuuauuauggga

SEQ ID NO: 830369 - RNA, 22 nt, Human
uucuccaacacaagcaugaugu

SEQ ID NO: 830370 - RNA, 22 nt, Human
cuugccuucuguuccuauagaa

SEQ ID NO: 830371 - RNA, 22 nt, Human
uaguccuuuaauaguuaaugug

SEQ ID NO: 830372 - RNA, 22 nt, Human
ggagcggagggagggccacugu

SEQ ID NO: 830373 - RNA, 22 nt, Human
caauuucagucucagagaguuc

SEQ ID NO: 830374 - RNA, 22 nt, Human
cugccuggucucaggcaugggg

SEQ ID NO: 830375 - RNA, 22 nt, Human
uccaggcugggcugaagggugc

SEQ ID NO: 830376 - RNA, 22 nt, Human
gcucuggacuggggccugagaa

SEQ ID NO: 830377 - RNA, 22 nt, Human
ucaggggcugugcauuucccag

SEQ ID NO: 830378 - RNA, 21 nt, Human
cugugcuucuuccuaagccag

SEQ ID NO: 830379 - RNA, 22 nt, Human
caggcugccgugaagcaggccu

SEQ ID NO: 830380 - RNA, 22 nt, Human
aggcucugugacaaucaagcug

SEQ ID NO: 830381 - RNA, 22 nt, Human
aagcugccugggaggaagggcu

SEQ ID NO: 830382 - RNA, 22 nt, Human
acagaggccccgugggagagcc

SEQ ID NO: 830383 - RNA, 22 nt, Human
cuuuauguucaguacaaugcuu

SEQ ID NO: 830384 - RNA, 22 nt, Human
gugaauaauauuguuuauaaaa

SEQ ID NO: 830385 - RNA, 22 nt, Human
aagcugccuuccaugugaggaa

SEQ ID NO: 830386 - RNA, 22 nt, Human
gcaaacaaggacauacauccug

SEQ ID NO: 830387 - RNA, 22 nt, Human
uuccaggauggcaauaaugaau

SEQ ID NO: 830388 - RNA, 22 nt, Human
uaauuauagccgcuauuuugcu

SEQ ID NO: 830389 - RNA, 22 nt, Human
ccuggcugccgagugugcagcg

SEQ ID NO: 830390 - RNA, 22 nt, Human
gaagccaacauuccaaguagaa

SEQ ID NO: 830391 - RNA, 22 nt, Human
gaggcccuccagcugucagcug

SEQ ID NO: 830392 - RNA, 22 nt, Human
cacaggcuugucagcaugaggc

SEQ ID NO: 830393 - RNA, 22 nt, Human
ucaggcugguggucagauggcu

SEQ ID NO: 830394 - RNA, 22 nt, Human
gccccagcguggcuguguuagg

SEQ ID NO: 830395 - RNA, 22 nt, Human
ccaccaggacagcccugagggg

SEQ ID NO: 830396 - RNA, 22 nt, Human
gccucugcggagcuguacauca

SEQ ID NO: 830397 - RNA, 22 nt, Human
cagcaguguacaaggugucaga

SEQ ID NO: 830398 - RNA, 22 nt, Human
uacuuugucauucuaaccuucc

SEQ ID NO: 830399 - RNA, 22 nt, Human
gaaaugcauggaucuuggcaga

SEQ ID NO: 830400 - RNA, 21 nt, Human
cagagcuguccaaacccugac

SEQ ID NO: 830401 - RNA, 22 nt, Human
gcugcucuccauggccgugagu

SEQ ID NO: 830402 - RNA, 22 nt, Human
agcugggaggugggcagugaga

SEQ ID NO: 830403 - RNA, 22 nt, Human
ccugugaggucaucugugguaa

SEQ ID NO: 830404 - RNA, 22 nt, Human
aaugcacauauauguguauaca

SEQ ID NO: 830405 - RNA, 22 nt, Human
aguggcaggcggagauguagga

SEQ ID NO: 830406 - RNA, 22 nt, Human
cagcugcuuuaguuuuccaucc

SEQ ID NO: 830407 - RNA, 22 nt, Human
uggcagcagggaggccaguguu

SEQ ID NO: 830408 - RNA, 22 nt, Human
acuuuagaccaucuuccacagu

SEQ ID NO: 830409 - RNA, 22 nt, Human
auuuaagacugacuucaccagu

SEQ ID NO: 830410 - RNA, 17 nt, Human
acagagguuauacagac

SEQ ID NO: 830411 - RNA, 22 nt, Human
cuggacagaaaaggccacugga

SEQ ID NO: 830412 - RNA, 22 nt, Human
ucugcaggccucgacaaggcca

SEQ ID NO: 830413 - RNA, 22 nt, Human
auggcuuuuuagacuuugguac

SEQ ID NO: 830414 - RNA, 22 nt, Human
ugacuucaaaggcucuacuccu

SEQ ID NO: 830415 - RNA, 22 nt, Human
agucucagaguaccugagggac

SEQ ID NO: 830416 - RNA, 22 nt, Human
uaugaaaauuuagcugaagcau

SEQ ID NO: 830417 - RNA, 22 nt, Human
ggguacaaagauuucauaagau

SEQ ID NO: 830418 - RNA, 22 nt, Human
uuuauuccaugugucuaugacc

SEQ ID NO: 830419 - RNA, 22 nt, Human
aggcuccaugcaaaggcuguuu

SEQ ID NO: 830420 - RNA, 22 nt, Human
agggcacaucugcugggaaugg

SEQ ID NO: 830421 - RNA, 22 nt, Human
ucagaggucccuagcaggagug

SEQ ID NO: 830422 - RNA, 22 nt, Human
gcaggcagaucaccugucagga

SEQ ID NO: 830423 - RNA, 22 nt, Human
ucucaggccccugaguuucucu

SEQ ID NO: 830424 - RNA, 22 nt, Human
uggcuggcuuguucacugacug

SEQ ID NO: 830425 - RNA, 22 nt, Human
gagagcccugcuccuaucccag

SEQ ID NO: 830426 - RNA, 22 nt, Human
gugacagucaaagacaugacuu

SEQ ID NO: 830427 - RNA, 22 nt, Human
agccugcaggaugggcagcacc

SEQ ID NO: 830428 - RNA, 22 nt, Human
uccauggggcccaggaugagag

SEQ ID NO: 830429 - RNA, 22 nt, Human
cuuuguagcugcuucugauuua

SEQ ID NO: 830430 - RNA, 23 nt, Human
uugaaagguagcuggcagcuaga

SEQ ID NO: 830431 - RNA, 22 nt, Human
cggagaggaccugcaacucgcu

SEQ ID NO: 830432 - RNA, 22 nt, Human
gcucagaggcacgaccucuugg

SEQ ID NO: 830433 - RNA, 22 nt, Human
agggcuggcuccguuaccuuga

SEQ ID NO: 830434 - RNA, 22 nt, Human
ugcugccaccugguggcugaag

SEQ ID NO: 830435 - RNA, 22 nt, Human
gugucccagcagcacauuggcu

SEQ ID NO: 830436 - RNA, 22 nt, Human
aagguacagaaauuaacaagga

SEQ ID NO: 830437 - RNA, 22 nt, Human
agaaaucuaagaugcucaagga

SEQ ID NO: 830438 - RNA, 22 nt, Human
uaaaacuuaacuauccagauua

SEQ ID NO: 830439 - RNA, 22 nt, Human
caggcaccccaggugagcacug

SEQ ID NO: 830440 - RNA, 22 nt, Human
ucuucuucccaucccucaaaug

SEQ ID NO: 830441 - RNA, 22 nt, Human
cagaaaucauugugaugacagg

SEQ ID NO: 830442 - RNA, 22 nt, Human
agggcugccauuucuggcccaa

SEQ ID NO: 830443 - RNA, 22 nt, Human
uuuaaucaggcaaagcauaaua

SEQ ID NO: 830444 - RNA, 22 nt, Human
cacagguguaugaauaugucca

SEQ ID NO: 830445 - RNA, 20 nt, Human
uauuuagauucaaguaugga

SEQ ID NO: 830446 - RNA, 22 nt, Human
auguuucaaugcacuuuagccu

SEQ ID NO: 830447 - RNA, 22 nt, Human
aucugcuuccugggcuccauga

SEQ ID NO: 830448 - RNA, 22 nt, Human
aaauauaauuucugccucaaua

SEQ ID NO: 830449 - RNA, 22 nt, Human
gcugggcagccuggccgcugcc

SEQ ID NO: 830450 - RNA, 22 nt, Human
auugacaaucuacuauguucug

SEQ ID NO: 830451 - RNA, 22 nt, Human
gagucacaaagccuuucuuauu

SEQ ID NO: 830452 - RNA, 22 nt, Human
agguggggaaaccagcgauccc

SEQ ID NO: 830453 - RNA, 22 nt, Human
acauaugauauugaggaucuca

SEQ ID NO: 830454 - RNA, 22 nt, Human
caggggcugugggcggagccuc

SEQ ID NO: 830455 - RNA, 22 nt, Human
ucucugggaaugggccugggua

SEQ ID NO: 830456 - RNA, 22 nt, Human
augcuguggaaguuccugaagc

SEQ ID NO: 830457 - RNA, 22 nt, Human
uccugccuaccuugcggaggug

SEQ ID NO: 830458 - RNA, 22 nt, Human
ucaggagaaggcaauguggaaa

SEQ ID NO: 830459 - RNA, 22 nt, Human
ccagagccccugagcuucccug

SEQ ID NO: 830460 - RNA, 22 nt, Human
uuauucuuuucuccagaauccc

SEQ ID NO: 830461 - RNA, 22 nt, Human
ugaagcagcaaaugaugggaga

SEQ ID NO: 830462 - RNA, 23 nt, Human
uacagaaggaguagucacuaaga

SEQ ID NO: 830463 - RNA, 22 nt, Human
gagcgauguggguauguagaag

SEQ ID NO: 830464 - RNA, 22 nt, Human
uggccuggaagagaggucgagg

SEQ ID NO: 830465 - RNA, 22 nt, Human
ucuuugaacuuggcugaucucu

SEQ ID NO: 830466 - RNA, 22 nt, Human
gcucagagcacucagacucagc

SEQ ID NO: 830467 - RNA, 22 nt, Human
uugcauuugacaaauuauuuaa

SEQ ID NO: 830468 - RNA, 22 nt, Human
ggcucugcuucagaaggcucau

SEQ ID NO: 830469 - RNA, 22 nt, Human
agccaggcugcaguuggcuggc

SEQ ID NO: 830470 - RNA, 22 nt, Human
ccaggaguuggagguugcagug

SEQ ID NO: 830471 - RNA, 22 nt, Human
gugauuuagauguugaaaguga

SEQ ID NO: 830472 - RNA, 22 nt, Human
ugcucugcaagcaggagcaaga

SEQ ID NO: 830473 - RNA, 22 nt, Human
acguuuucagccuuaauguaga

SEQ ID NO: 830474 - RNA, 22 nt, Human
gccucucucuacccaguaugau

SEQ ID NO: 830475 - RNA, 22 nt, Human
ggcccagccggcgagucucgcg

SEQ ID NO: 830476 - RNA, 22 nt, Human
ugcugccacugguagucucauu

SEQ ID NO: 830477 - RNA, 22 nt, Human
aauauuuguuaguguuuuaaug

SEQ ID NO: 830478 - RNA, 22 nt, Human
ucuggcucucauacucgccagu

SEQ ID NO: 830479 - RNA, 22 nt, Human
ucagaaaagagaaaaucuuaua

SEQ ID NO: 830480 - RNA, 22 nt, Human
agaggccacuuugccugugaug

SEQ ID NO: 830481 - RNA, 22 nt, Human
ugcuagaagauagcuagaagau

SEQ ID NO: 830482 - RNA, 22 nt, Human
gcuggccaguguggugaccacc

SEQ ID NO: 830483 - RNA, 22 nt, Human
ucccagaaaaaggaggcuauga

SEQ ID NO: 830484 - RNA, 22 nt, Human
uuucccagagguaugaauaagu

SEQ ID NO: 830485 - RNA, 22 nt, Human
ggcagcugauuagcaucaagga

SEQ ID NO: 830486 - RNA, 22 nt, Human
agauaugugcgucuuagauuga

SEQ ID NO: 830487 - RNA, 21 nt, Human
gagugcagcaagguagagucu

SEQ ID NO: 830488 - RNA, 22 nt, Human
ccaggaggcggaagguacagug

SEQ ID NO: 830489 - RNA, 22 nt, Human
ucacaaaugaggaaaucgagca

SEQ ID NO: 830490 - RNA, 22 nt, Human
aagaauguucuuguagucauga

SEQ ID NO: 830491 - RNA, 22 nt, Human
aggccagcucuacccuuggacu

SEQ ID NO: 830492 - RNA, 22 nt, Human
ugaggggaaggcaugauaaaua

SEQ ID NO: 830493 - RNA, 22 nt, Human
gugcugucaauugcuuucagua

SEQ ID NO: 830494 - RNA, 22 nt, Human
caguggggaggccaggauagaa

SEQ ID NO: 830495 - RNA, 22 nt, Human
uaauaaaugaaagugcuggcau

SEQ ID NO: 830496 - RNA, 22 nt, Human
ccacagggcucuaggcgcuucc

SEQ ID NO: 830497 - RNA, 22 nt, Human
auuuauuaugggauuuggcaca

SEQ ID NO: 830498 - RNA, 22 nt, Human
uggcccugaggacccagugugg

SEQ ID NO: 830499 - RNA, 22 nt, Human
cuucuucaauagcaagcgcaua

SEQ ID NO: 830500 - RNA, 22 nt, Human
cccagcagaccgcugugauggc

SEQ ID NO: 830501 - RNA, 19 nt, Human
cugccuguuauggagagaa

SEQ ID NO: 830502 - RNA, 22 nt, Human
aggcaguuuauccccagagccu

SEQ ID NO: 830503 - RNA, 22 nt, Human
ucaguggagcuaagcaugagau

SEQ ID NO: 830504 - RNA, 22 nt, Human
ucagggcaucaucaugaauaua

SEQ ID NO: 830505 - RNA, 22 nt, Human
gcauuuaaauuugaacuucaga

SEQ ID NO: 830506 - RNA, 22 nt, Human
ccuggcaggccccuccuggauu

SEQ ID NO: 830507 - RNA, 22 nt, Human
agcugguaugaacaggauagga

SEQ ID NO: 830508 - RNA, 23 nt, Human
gggugggccaaauuagguagccu

SEQ ID NO: 830509 - RNA, 22 nt, Human
uuugcagucaaauuugcuaaau

SEQ ID NO: 830510 - RNA, 22 nt, Human
ucauccuuuugcaugggaaggc

SEQ ID NO: 830511 - RNA, 22 nt, Human
uggcccugccacucacugcuga

SEQ ID NO: 830512 - RNA, 22 nt, Human
guggcagcaaaugccuggacua

SEQ ID NO: 830513 - RNA, 22 nt, Human
gcccaggaaaugccccguggug

SEQ ID NO: 830514 - RNA, 22 nt, Human
uauugaaauucuucauguccuc

SEQ ID NO: 830515 - RNA, 22 nt, Human
gacacagagauaggccuguguu

SEQ ID NO: 830516 - RNA, 23 nt, Human
auucuucauuaucuucuagaaaa

SEQ ID NO: 830517 - RNA, 22 nt, Human
aggccucagugaucaucaucag

SEQ ID NO: 830518 - RNA, 22 nt, Human
uccauggguagcccugguugag

SEQ ID NO: 830519 - RNA, 22 nt, Human
agcccagcaaagggagguucag

SEQ ID NO: 830520 - RNA, 22 nt, Human
gaggcaguuugccaugccagga

SEQ ID NO: 830521 - RNA, 21 nt, Human
ccugggccaaauucccuggac

SEQ ID NO: 830522 - RNA, 22 nt, Human
uuuauuuaaagucguguguuaa

SEQ ID NO: 830523 - RNA, 22 nt, Human
uaacacaugaaagcaccuucuu

SEQ ID NO: 830524 - RNA, 22 nt, Human
gaaaugugggucaugacccauu

SEQ ID NO: 830525 - RNA, 22 nt, Human
guucaaagcuccugguacagua

SEQ ID NO: 830526 - RNA, 23 nt, Human
aagcuuccuucacgucuccuggg

SEQ ID NO: 830527 - RNA, 22 nt, Human
gccuugccucagccauggaaac

SEQ ID NO: 830528 - RNA, 22 nt, Human
cugucccaggagcuguaagaca

SEQ ID NO: 830529 - RNA, 22 nt, Human
agugcuuugagcguuugaaaag

SEQ ID NO: 830530 - RNA, 22 nt, Human
agcugcugagccaggcugaugu

SEQ ID NO: 830531 - RNA, 22 nt, Human
cugaaggaagcagguggccugu

SEQ ID NO: 830532 - RNA, 22 nt, Human
aggaagcucggagagggcaaau

SEQ ID NO: 830533 - RNA, 22 nt, Human
ucugcucagugcuuaucucuaa

SEQ ID NO: 830534 - RNA, 22 nt, Human
cagauauuaggagcucaauaau

SEQ ID NO: 830535 - RNA, 22 nt, Human
uuccauaaaggugauaguauac

SEQ ID NO: 830536 - RNA, 23 nt, Human
uggccuggagagaaaagaugagu

SEQ ID NO: 830537 - RNA, 19 nt, Human
ggcugucucggcccagcca

SEQ ID NO: 830538 - RNA, 22 nt, Human
cauuacauuucaaaauguuucc

SEQ ID NO: 830539 - RNA, 19 nt, Human
ugaggccaaggucacagau

SEQ ID NO: 830540 - RNA, 22 nt, Human
aauacuuuccuauauaaggugc

SEQ ID NO: 830541 - RNA, 22 nt, Human
agccuggagguaaugaggaaac

SEQ ID NO: 830542 - RNA, 22 nt, Human
uuuuccuacugauaaacaguua

SEQ ID NO: 830543 - RNA, 22 nt, Human
ccagggcagccaacccagaugc

SEQ ID NO: 830544 - RNA, 22 nt, Human
uuuauuugaaucaggggagaau

SEQ ID NO: 830545 - RNA, 22 nt, Human
ccccaggacacauggaccaagu

SEQ ID NO: 830546 - RNA, 21 nt, Human
uggcugcuggcccucucucca

SEQ ID NO: 830547 - RNA, 22 nt, Human
cagagccaaaccucagggcccg

SEQ ID NO: 830548 - RNA, 21 nt, Human
ggcagcucagcagauggggac

SEQ ID NO: 830549 - RNA, 22 nt, Human
acagagcuuaggaugacuccca

SEQ ID NO: 830550 - RNA, 22 nt, Human
agcuaggaaauugaggcugaga

SEQ ID NO: 830551 - RNA, 22 nt, Human
acaucugaccauuacaagacau

SEQ ID NO: 830552 - RNA, 22 nt, Human
gccugccugcugugugcaaguu

SEQ ID NO: 830553 - RNA, 22 nt, Human
gugugccaggaacuggcugcug

SEQ ID NO: 830554 - RNA, 22 nt, Human
augucaaacacaacaccagugg

SEQ ID NO: 830555 - RNA, 22 nt, Human
ggcagcuccucucagcaaaaga

SEQ ID NO: 830556 - RNA, 22 nt, Human
aauuuagaauucgcuagcuaau

SEQ ID NO: 830557 - RNA, 21 nt, Human
cccaggaggcugagaagagca

SEQ ID NO: 830558 - RNA, 22 nt, Human
ugugacaugugucaucuuuucu

SEQ ID NO: 830559 - RNA, 22 nt, Human
agugcuuugaacgaaaggcuga

SEQ ID NO: 830560 - RNA, 22 nt, Human
uucuuucccaguagaugugaaa

SEQ ID NO: 830561 - RNA, 22 nt, Human
gccaccagggggcuccagugag

SEQ ID NO: 830562 - RNA, 22 nt, Human
ucaacacuauccaggcaaucuu

SEQ ID NO: 830563 - RNA, 22 nt, Human
gcacugcaucuacuggcaagua

SEQ ID NO: 830564 - RNA, 23 nt, Human
agggguggucaguacccgcagug

SEQ ID NO: 830565 - RNA, 22 nt, Human
gauuucaagcccccagagauuc

SEQ ID NO: 830566 - RNA, 22 nt, Human
aauacaguagguaauaguucau

SEQ ID NO: 830567 - RNA, 22 nt, Human
ugagaggccccagcucuuggcc

SEQ ID NO: 830568 - RNA, 22 nt, Human
uauucugugugauauguaaaug

SEQ ID NO: 830569 - RNA, 22 nt, Human
gaaauauucuugucuuguuuuc

SEQ ID NO: 830570 - RNA, 22 nt, Human
agggcugagacuaaggccagau

SEQ ID NO: 830571 - RNA, 22 nt, Human
acagcuggaggucugugagcac

SEQ ID NO: 830572 - RNA, 22 nt, Human
cagugccaugucugagccccua

SEQ ID NO: 830573 - RNA, 22 nt, Human
uuuucauuguaaaucaggaaac

SEQ ID NO: 830574 - RNA, 22 nt, Human
cccucugcugccuggcuggguc

SEQ ID NO: 830575 - RNA, 22 nt, Human
aguauuuccuggcuuaucugcu

SEQ ID NO: 830576 - RNA, 19 nt, Human
guggccucggagcgcgcgg

SEQ ID NO: 830577 - RNA, 22 nt, Human
augugcuuuauuaaguaaaaau

SEQ ID NO: 830578 - RNA, 22 nt, Human
augaagcuaaacccugcagcca

SEQ ID NO: 830579 - RNA, 22 nt, Human
auggcuuugaaguaauguaauu

SEQ ID NO: 830580 - RNA, 22 nt, Human
cauuucacaaauggccacauca

SEQ ID NO: 830581 - RNA, 22 nt, Human
caggguggggcuggcuaucaaa

SEQ ID NO: 830582 - RNA, 22 nt, Human
augggaggaugcucgggugcuc

SEQ ID NO: 830583 - RNA, 22 nt, Human
cuucucagucaccugugagucu

SEQ ID NO: 830584 - RNA, 22 nt, Human
uaaagguaguuuuaaaggugcu

SEQ ID NO: 830585 - RNA, 22 nt, Human
ucagugcuucggcgagcaccua

SEQ ID NO: 830586 - RNA, 22 nt, Human
ugaaaugauuauaugguguuug

SEQ ID NO: 830587 - RNA, 22 nt, Human
ugcugccacaaauucagcugcc

SEQ ID NO: 830588 - RNA, 21 nt, Human
ugauccuuucccccauguugc

SEQ ID NO: 830589 - RNA, 22 nt, Human
ucagggcaggacaguguaggcc

SEQ ID NO: 830590 - RNA, 22 nt, Human
caagggugguauugggagcaua

SEQ ID NO: 830591 - RNA, 22 nt, Human
acagggcagagugaaaugcuau

SEQ ID NO: 830592 - RNA, 22 nt, Human
gccuggagcucggcugagggcg

SEQ ID NO: 830593 - RNA, 17 nt, Human
guccugggaggagagag

SEQ ID NO: 830594 - RNA, 22 nt, Human
ucugucuucaucagcaugugau

SEQ ID NO: 830595 - RNA, 22 nt, Human
agccagcaugaagacagaggcc

SEQ ID NO: 830596 - RNA, 22 nt, Human
gcuggcuguguuccuucugcca

SEQ ID NO: 830597 - RNA, 22 nt, Human
gcaguggauccaaugguaucuu

SEQ ID NO: 830598 - RNA, 22 nt, Human
gagcaccucaauuugcuauuug

SEQ ID NO: 830599 - RNA, 22 nt, Human
auuauccucagaaaacauguga

SEQ ID NO: 830600 - RNA, 22 nt, Human
uucugucucuguguuuacauua

SEQ ID NO: 830601 - RNA, 22 nt, Human
uuccagugaugggcaauuuggu

SEQ ID NO: 830602 - RNA, 22 nt, Human
uaauacuuaccuugcagagucu

SEQ ID NO: 830603 - RNA, 22 nt, Human
agggcagaaauauugauacugu

SEQ ID NO: 830604 - RNA, 22 nt, Human
acaggccugacacacagagggc

SEQ ID NO: 830605 - RNA, 22 nt, Human
ggccagaggccauccuccugcu

SEQ ID NO: 830606 - RNA, 22 nt, Human
cauggcagagaaggggaacugg

SEQ ID NO: 830607 - RNA, 22 nt, Human
cccaugagauucugaauuuggc

SEQ ID NO: 830608 - RNA, 22 nt, Human
uucucuuauucuggauaugcag

SEQ ID NO: 830609 - RNA, 22 nt, Human
gcugucugucucugucccacca

SEQ ID NO: 830610 - RNA, 22 nt, Human
gcuggccugcugggcaccaccg

SEQ ID NO: 830611 - RNA, 22 nt, Human
cagagccugcucacgucucugu

SEQ ID NO: 830612 - RNA, 22 nt, Human
gaaggagagagacaucgucccu

SEQ ID NO: 830613 - RNA, 22 nt, Human
uauucacauucucaggccuggu

SEQ ID NO: 830614 - RNA, 22 nt, Human
cagucaccuagacagaacuuac

SEQ ID NO: 830615 - RNA, 22 nt, Human
augcuguggccagaguucaacu

SEQ ID NO: 830616 - RNA, 22 nt, Human
ggcucugcagugacuugagggg

SEQ ID NO: 830617 - RNA, 22 nt, Human
acacugaauaauugagaguuga

SEQ ID NO: 830618 - RNA, 22 nt, Human
agcaccuucacaggcucucagg

SEQ ID NO: 830619 - RNA, 22 nt, Human
uucagugugugauaccugcugu

SEQ ID NO: 830620 - RNA, 22 nt, Human
ugaacauauucaccucuaaaua

SEQ ID NO: 830621 - RNA, 22 nt, Human
acagugucaugucguguucccc

SEQ ID NO: 830622 - RNA, 22 nt, Human
gcuggcagaagagcugguucaa

SEQ ID NO: 830623 - RNA, 22 nt, Human
acagaguauuggaaaggcagug

SEQ ID NO: 830624 - RNA, 22 nt, Human
uucuucuugucugcccucacau

SEQ ID NO: 830625 - RNA, 22 nt, Human
ugucccagcacuuugggagucu

SEQ ID NO: 830626 - RNA, 22 nt, Human
gcagggacaacugugcaccuga

SEQ ID NO: 830627 - RNA, 18 nt, Human
cccacggugcuguagggc

SEQ ID NO: 830628 - RNA, 22 nt, Human
caagaucagggugccagaaugg

SEQ ID NO: 830629 - RNA, 22 nt, Human
gugauuccuauuaguacaugca

SEQ ID NO: 830630 - RNA, 22 nt, Human
aacagcuuugcuucuggagaca

SEQ ID NO: 830631 - RNA, 22 nt, Human
cagcccaggccgacaguuccuc

SEQ ID NO: 830632 - RNA, 22 nt, Human
cagaggcagugggguugcuccu

SEQ ID NO: 830633 - RNA, 22 nt, Human
gccaucacauccaggcuaccuc

SEQ ID NO: 830634 - RNA, 22 nt, Human
ccagucacuggaaaaugggaau

SEQ ID NO: 830635 - RNA, 22 nt, Human
uugggugcugucauggggcacg

SEQ ID NO: 830636 - RNA, 22 nt, Human
cugggagucaccaggagcaagg

SEQ ID NO: 830637 - RNA, 22 nt, Human
ggaggggagucucccaaagccg

SEQ ID NO: 830638 - RNA, 22 nt, Human
aaggucauuuaacaauuuauga

SEQ ID NO: 830639 - RNA, 23 nt, Human
cagggcugggcuugguguuaggc

SEQ ID NO: 830640 - RNA, 22 nt, Human
agcagcucuuaacaaagcaugg

SEQ ID NO: 830641 - RNA, 22 nt, Human
ugcccagggauaagccuagaga

SEQ ID NO: 830642 - RNA, 22 nt, Human
uggccugccccgagauccuggc

SEQ ID NO: 830643 - RNA, 22 nt, Human
cuuagaaauuguuacucauuca

SEQ ID NO: 830644 - RNA, 22 nt, Human
uguaaauaaugcauguaaauca

SEQ ID NO: 830645 - RNA, 22 nt, Human
uuccaugaaagugaaauggagc

SEQ ID NO: 830646 - RNA, 22 nt, Human
uacauaguauucacauuguuuu

SEQ ID NO: 830647 - RNA, 22 nt, Human
ugucccaguuuaucugggacug

SEQ ID NO: 830648 - RNA, 22 nt, Human
auacauacguacauacguaugu

SEQ ID NO: 830649 - RNA, 22 nt, Human
caugcuuugggucagaaaugcc

SEQ ID NO: 830650 - RNA, 22 nt, Human
agaaggggagaagcuaccagga

SEQ ID NO: 830651 - RNA, 22 nt, Human
uagugaaauuuaugcacagcua

SEQ ID NO: 830652 - RNA, 22 nt, Human
gcacagaaguaaaauacaaguc

SEQ ID NO: 830653 - RNA, 22 nt, Human
ccuggcugugcauugccggccc

SEQ ID NO: 830654 - RNA, 22 nt, Human
cagggccaagcugcagcaucug

SEQ ID NO: 830655 - RNA, 22 nt, Human
ccagcuggcacuguggcugccc

SEQ ID NO: 830656 - RNA, 22 nt, Human
uguguucuggaaagcucacuga

SEQ ID NO: 830657 - RNA, 22 nt, Human
cagggcacaguuauggaggugg

SEQ ID NO: 830658 - RNA, 22 nt, Human
gcacugaacuuuaaucauuucu

SEQ ID NO: 830659 - RNA, 22 nt, Human
ggggcagaaguagugccccuga

SEQ ID NO: 830660 - RNA, 22 nt, Human
caguuuuugccauuaagaguaa

SEQ ID NO: 830661 - RNA, 22 nt, Human
agggcagagauuaauuaagaca

SEQ ID NO: 830662 - RNA, 22 nt, Human
cccagcucuuuuagcggcaucu

SEQ ID NO: 830663 - RNA, 22 nt, Human
ucuuccaagguugcacacuauc

SEQ ID NO: 830664 - RNA, 22 nt, Human
ggcagucuuaucagcauuggac

SEQ ID NO: 830665 - RNA, 17 nt, Human
ucagcaaagacaaagga

SEQ ID NO: 830666 - RNA, 22 nt, Human
ccagugcuuccaggaauacggu

SEQ ID NO: 830667 - RNA, 22 nt, Human
agcaccuugcucuuggccuucc

SEQ ID NO: 830668 - RNA, 22 nt, Human
uacuuuggauccuuacaauagc

SEQ ID NO: 830669 - RNA, 22 nt, Human
ggaggccacgguuuagcaccga

SEQ ID NO: 830670 - RNA, 22 nt, Human
cucaggaaaggccaugcaaggg

SEQ ID NO: 830671 - RNA, 22 nt, Human
aaaaaucuaugacugcuucucc

SEQ ID NO: 830672 - RNA, 22 nt, Human
uuccauauguauauagcuguua

SEQ ID NO: 830673 - RNA, 22 nt, Human
cugccucaugcugccugcagcc

SEQ ID NO: 830674 - RNA, 22 nt, Human
cuggcuccauccuugagcucug

SEQ ID NO: 830675 - RNA, 22 nt, Human
ggcagcaguggcugcuauuguc

SEQ ID NO: 830676 - RNA, 22 nt, Human
cuggugcaggaaggagcuggca

SEQ ID NO: 830677 - RNA, 22 nt, Human
aggugcagcugguggagucugg

SEQ ID NO: 830678 - RNA, 22 nt, Human
aagcugcagacccccugucuca

SEQ ID NO: 830679 - RNA, 22 nt, Human
aaguaacaaugcuguugaauug

SEQ ID NO: 830680 - RNA, 22 nt, Human
cuuaacauccugcauuuuucuu

SEQ ID NO: 830681 - RNA, 22 nt, Human
ugggugggagcgcccugucugg

SEQ ID NO: 830682 - RNA, 22 nt, Human
cucagaauuacaucccauuuua

SEQ ID NO: 830683 - RNA, 22 nt, Human
guugggaagcagauggaugagc

SEQ ID NO: 830684 - RNA, 22 nt, Human
aauuuuaaucaguggugcugag

SEQ ID NO: 830685 - RNA, 22 nt, Human
ugaaucauggauaaauagcuua

SEQ ID NO: 830686 - RNA, 22 nt, Human
auaaagaggauguauuuacagc

SEQ ID NO: 830687 - RNA, 22 nt, Human
aacaugaagguaggaugguuuu

SEQ ID NO: 830688 - RNA, 22 nt, Human
gcagagcagugcuugcccagcg

SEQ ID NO: 830689 - RNA, 20 nt, Human
augauuuugcacuaacuuca

SEQ ID NO: 830690 - RNA, 22 nt, Human
cagcugccugcaacacaagcuu

SEQ ID NO: 830691 - RNA, 22 nt, Human
cagcucccagagugaccagcag

SEQ ID NO: 830692 - RNA, 22 nt, Human
ccagcugcagguguuccagaug

SEQ ID NO: 830693 - RNA, 22 nt, Human
auuguaauuuuagagaaagugg

SEQ ID NO: 830694 - RNA, 19 nt, Human
gcuguauuaaagauacaug

SEQ ID NO: 830695 - RNA, 19 nt, Human
cacagggcaggucucaugu

SEQ ID NO: 830696 - RNA, 22 nt, Human
uucuuaacucaaauauauaucc

SEQ ID NO: 830697 - RNA, 22 nt, Human
gcagugggcaacaagagcugga

SEQ ID NO: 830698 - RNA, 22 nt, Human
uaucauuguguuauuucuucca

SEQ ID NO: 830699 - RNA, 22 nt, Human
ggagaggguguggaaaguuauc

SEQ ID NO: 830700 - RNA, 21 nt, Human
ucugggcccaugcugccucac

SEQ ID NO: 830701 - RNA, 22 nt, Human
uccuggagagugggcgagcaca

SEQ ID NO: 830702 - RNA, 22 nt, Human
gcagcuggggaggucgugggga

SEQ ID NO: 830703 - RNA, 17 nt, Human
gagacagcaggagcccc

SEQ ID NO: 830704 - RNA, 22 nt, Human
uagcauuucccaaaugcauuug

SEQ ID NO: 830705 - RNA, 22 nt, Human
caggagaaauguggcugcuacc

SEQ ID NO: 830706 - RNA, 22 nt, Human
ccuggaucgaugccgagggaaa

SEQ ID NO: 830707 - RNA, 22 nt, Human
ccaggagucuggaugagguguc

SEQ ID NO: 830708 - RNA, 22 nt, Human
aaucuucacagaaaaaugucug

SEQ ID NO: 830709 - RNA, 15 nt, Human
caggagaggaagguu

SEQ ID NO: 830710 - RNA, 22 nt, Human
uuucucugcugccugugucgau

SEQ ID NO: 830711 - RNA, 22 nt, Human
cuguggaauugaugcuuagugu

SEQ ID NO: 830712 - RNA, 22 nt, Human
ccaaaguccuuucuccaccugc

SEQ ID NO: 830713 - RNA, 22 nt, Human
aguaugaauacagauuuucucu

SEQ ID NO: 830714 - RNA, 22 nt, Human
ucucagagcuucagaaagcacc

SEQ ID NO: 830715 - RNA, 22 nt, Human
ugcaguggaaucuggagagcag

SEQ ID NO: 830716 - RNA, 22 nt, Human
cugugcuggcagaccuggaguu

SEQ ID NO: 830717 - RNA, 19 nt, Human
ucagaggauuuggcuauga

SEQ ID NO: 830718 - RNA, 22 nt, Human
uguguacucaauugagccauuu

SEQ ID NO: 830719 - RNA, 22 nt, Human
guguaugaggggagaauguuuu

SEQ ID NO: 830720 - RNA, 22 nt, Human
uagugcuugagucucuccguac

SEQ ID NO: 830721 - RNA, 22 nt, Human
cugggguggauggguccaaguu

SEQ ID NO: 830722 - RNA, 22 nt, Human
ucaauaaaucccucugacccug

SEQ ID NO: 830723 - RNA, 21 nt, Human
uagggcaggcauuggaagaga

SEQ ID NO: 830724 - RNA, 19 nt, Human
uccaggagcaaagccaguu

SEQ ID NO: 830725 - RNA, 21 nt, Human
ccaggcuccugaggcugguca

SEQ ID NO: 830726 - RNA, 22 nt, Human
aguacaaugucugacacaguag

SEQ ID NO: 830727 - RNA, 22 nt, Human
acaugcauacacguacauaccu

SEQ ID NO: 830728 - RNA, 22 nt, Human
acagugucugacacauuguagc

SEQ ID NO: 830729 - RNA, 22 nt, Human
agccucuggcccuagacugcuu

SEQ ID NO: 830730 - RNA, 22 nt, Human
caagagcuuuagaaaugcucau

SEQ ID NO: 830731 - RNA, 22 nt, Human
cugcuguggugucaagcaucuc

SEQ ID NO: 830732 - RNA, 22 nt, Human
ccagugcaggugagcaccaggu

SEQ ID NO: 830733 - RNA, 22 nt, Human
caccaggcuggagugcagaggu

SEQ ID NO: 830734 - RNA, 19 nt, Human
cuauacagccucugaggaa

SEQ ID NO: 830735 - RNA, 22 nt, Human
cccucugcaggcuggaccugcc

SEQ ID NO: 830736 - RNA, 22 nt, Human
uugaagcaaauucugugcagua

SEQ ID NO: 830737 - RNA, 22 nt, Human
auucuccaucaccacuggcacu

SEQ ID NO: 830738 - RNA, 22 nt, Human
augaaauaucuugaagaaauuc

SEQ ID NO: 830739 - RNA, 22 nt, Human
cauauguauuucucauaauuag

SEQ ID NO: 830740 - RNA, 22 nt, Human
aaaauauuuuagggccaggaga

SEQ ID NO: 830741 - RNA, 22 nt, Human
uaucuguugucuuuuacaugua

SEQ ID NO: 830742 - RNA, 22 nt, Human
ugugaacuggcagguggacggg

SEQ ID NO: 830743 - RNA, 18 nt, Human
cagaagcaggcagugcag

SEQ ID NO: 830744 - RNA, 22 nt, Human
ggcauuuacauaaucuuauuua

SEQ ID NO: 830745 - RNA, 22 nt, Human
aagcccagcugaaagcauuuuu

SEQ ID NO: 830746 - RNA, 22 nt, Human
auuauaaagaacaugugugugg

SEQ ID NO: 830747 - RNA, 22 nt, Human
ggccuugggauguggcugcagc

SEQ ID NO: 830748 - RNA, 22 nt, Human
cuacauuucccagcugccuucc

SEQ ID NO: 830749 - RNA, 22 nt, Human
uuuaaaaucagaugggaguugg

SEQ ID NO: 830750 - RNA, 20 nt, Human
gcugccagugccugaugcuu

SEQ ID NO: 830751 - RNA, 17 nt, Human
agcugccagggagugug

SEQ ID NO: 830752 - RNA, 22 nt, Human
acagccagaggagccaggcugg

SEQ ID NO: 830753 - RNA, 22 nt, Human
aggguggggugcuacaucuuua

SEQ ID NO: 830754 - RNA, 22 nt, Human
cagaggaggccaccgcauaggc

SEQ ID NO: 830755 - RNA, 22 nt, Human
ggccaggagcugcacagggcuc

SEQ ID NO: 830756 - RNA, 22 nt, Human
auggaaagggaagcaaggaaca

SEQ ID NO: 830757 - RNA, 22 nt, Human
ucuuccucuagaucugaggccc

SEQ ID NO: 830758 - RNA, 22 nt, Human
ucaaugauuagaguuuagugug

SEQ ID NO: 830759 - RNA, 20 nt, Human
ugugcaggagagugaggcug

SEQ ID NO: 830760 - RNA, 22 nt, Human
cagcugacgccagaguggaauu

SEQ ID NO: 830761 - RNA, 22 nt, Human
acauuucuucccuuuagcagaa

SEQ ID NO: 830762 - RNA, 22 nt, Human
aaucacaugugcucaauuuuaa

SEQ ID NO: 830763 - RNA, 22 nt, Human
cuggcagcgugagcagcaucca

SEQ ID NO: 830764 - RNA, 22 nt, Human
aaucaguuguccaaaguucaca

SEQ ID NO: 830765 - RNA, 22 nt, Human
cucuggccugcuuccucaggua

SEQ ID NO: 830766 - RNA, 22 nt, Human
ggcgaggccgggacaggcugga

SEQ ID NO: 830767 - RNA, 22 nt, Human
aaauguguuucgaaaacuggug

SEQ ID NO: 830768 - RNA, 19 nt, Human
acacagggcuagaguuaca

SEQ ID NO: 830769 - RNA, 22 nt, Human
ugccgcagugcggggagggccc

SEQ ID NO: 830770 - RNA, 22 nt, Human
uucuuaacuggaaaaugucaga

SEQ ID NO: 830771 - RNA, 22 nt, Human
augucacagcucccauuccucc

SEQ ID NO: 830772 - RNA, 22 nt, Human
ccccagcugcauacuugccaag

SEQ ID NO: 830773 - RNA, 23 nt, Human
ucucuuucaagagcuuaaugugc

SEQ ID NO: 830774 - RNA, 22 nt, Human
aaaugguaagacaacacauuau

SEQ ID NO: 830775 - RNA, 22 nt, Human
augcugugagugugccgcagag

SEQ ID NO: 830776 - RNA, 23 nt, Human
uguaacaauucccagccuuugcc

SEQ ID NO: 830777 - RNA, 22 nt, Human
uauggaaacuaauucauuuuuc

SEQ ID NO: 830778 - RNA, 22 nt, Human
cuaaaugcccuacaaugacugg

SEQ ID NO: 830779 - RNA, 22 nt, Human
ggcagcuaggggcagggaauuc

SEQ ID NO: 830780 - RNA, 17 nt, Human
ugcauguccuuuguucc

SEQ ID NO: 830781 - RNA, 22 nt, Human
aguucacauuccgagguacugg

SEQ ID NO: 830782 - RNA, 22 nt, Human
caauuucaauacaaaauacauu

SEQ ID NO: 830783 - RNA, 22 nt, Human
agggcugggcugcuuguuguca

SEQ ID NO: 830784 - RNA, 22 nt, Human
gcaggccuuggcaaugagccug

SEQ ID NO: 830785 - RNA, 22 nt, Human
agcgagggaggucugaggacag

SEQ ID NO: 830786 - RNA, 22 nt, Human
ggccucugccucaucugggcac

SEQ ID NO: 830787 - RNA, 22 nt, Human
augacacuuggugauacuuugu

SEQ ID NO: 830788 - RNA, 22 nt, Human
aaguucaagagugacauauuag

SEQ ID NO: 830789 - RNA, 22 nt, Human
cugggccagauccagccucaca

SEQ ID NO: 830790 - RNA, 22 nt, Human
uaaggcaccuguccaggcuggg

SEQ ID NO: 830791 - RNA, 22 nt, Human
auaaggcaagcugucaguuugu

SEQ ID NO: 830792 - RNA, 22 nt, Human
gcuguccucuuggacucagggc

SEQ ID NO: 830793 - RNA, 19 nt, Human
ggaccagguccugggcagc

SEQ ID NO: 830794 - RNA, 19 nt, Human
ugcuuaauuccuaguaggu

SEQ ID NO: 830795 - RNA, 22 nt, Human
agcagggcuucugugccugugc

SEQ ID NO: 830796 - RNA, 22 nt, Human
cugcucuaauaucagauagacu

SEQ ID NO: 830797 - RNA, 22 nt, Human
cagcaggcucugaguggcugcc

SEQ ID NO: 830798 - RNA, 22 nt, Human
cucaggagaugacagaagguau

SEQ ID NO: 830799 - RNA, 22 nt, Human
uugaaucauuacaauagauaag

SEQ ID NO: 830800 - RNA, 22 nt, Human
caauaauauccugugcuguuug

SEQ ID NO: 830801 - RNA, 22 nt, Human
ugugggcaggcccgggucugag

SEQ ID NO: 830802 - RNA, 22 nt, Human
cugcccugcccaggccuugggc

SEQ ID NO: 830803 - RNA, 22 nt, Human
uguggcuuaagaaugccuuuaa

SEQ ID NO: 830804 - RNA, 21 nt, Human
ucuuccuccacagcgugccac

SEQ ID NO: 830805 - RNA, 22 nt, Human
gaacagaauuaccgaagaucug

SEQ ID NO: 830806 - RNA, 23 nt, Human
gcagaggagcaagcuggacacca

SEQ ID NO: 830807 - RNA, 22 nt, Human
cuugcaggcagggccuccugga

SEQ ID NO: 830808 - RNA, 22 nt, Human
acagagcuucccagccugagca

SEQ ID NO: 830809 - RNA, 22 nt, Human
cagggagggaggaaaauuugcu

SEQ ID NO: 830810 - RNA, 22 nt, Human
ucucugguggcuccaucaguag

SEQ ID NO: 830811 - RNA, 22 nt, Human
ggcucugcaugugagugggugg

SEQ ID NO: 830812 - RNA, 22 nt, Human
caggggccaggcugucugcugu

SEQ ID NO: 830813 - RNA, 22 nt, Human
ugccuggauucgguuguuguca

SEQ ID NO: 830814 - RNA, 22 nt, Human
caggguccggcugccuggcugu

SEQ ID NO: 830815 - RNA, 22 nt, Human
uuucauaauagugcaguuuguu

SEQ ID NO: 830816 - RNA, 22 nt, Human
aaaugugugcacaaagacagcu

SEQ ID NO: 830817 - RNA, 22 nt, Human
uggcuggggagccccgacuccc

SEQ ID NO: 830818 - RNA, 22 nt, Human
ucuggcucuuugggugauugua

SEQ ID NO: 830819 - RNA, 22 nt, Human
aggagaggcaucaagaaaaucg

SEQ ID NO: 830820 - RNA, 22 nt, Human
cccaggagacagaaacagaggu

SEQ ID NO: 830821 - RNA, 22 nt, Human
gcugccacgaucucugcuguag

SEQ ID NO: 830822 - RNA, 22 nt, Human
cagcagagcauuugguaggagg

SEQ ID NO: 830823 - RNA, 22 nt, Human
gagccagccuucuucugagguc

SEQ ID NO: 830824 - RNA, 22 nt, Human
cagcauuuggugaucaucuuaa

SEQ ID NO: 830825 - RNA, 22 nt, Human
cccaggcuggagugcaauggca

SEQ ID NO: 830826 - RNA, 20 nt, Human
cacugaagacuucuugcuca

SEQ ID NO: 830827 - RNA, 21 nt, Human
cacucaggguaugugccaggc

SEQ ID NO: 830828 - RNA, 22 nt, Human
cagucacauggaugauggauag

SEQ ID NO: 830829 - RNA, 22 nt, Human
uaguaacagauuuauacagucu

SEQ ID NO: 830830 - RNA, 22 nt, Human
ugaaccaggaggcagccagcac

SEQ ID NO: 830831 - RNA, 22 nt, Human
uucacaggaggguggaugcaug

SEQ ID NO: 830832 - RNA, 20 nt, Human
cuccagggaacagacuggag

SEQ ID NO: 830833 - RNA, 22 nt, Human
ugaaggcuguuggauggggaag

SEQ ID NO: 830834 - RNA, 22 nt, Human
gcagggaggaagagaugcuucc

SEQ ID NO: 830835 - RNA, 22 nt, Human
ugaggcaggacauggacaacug

SEQ ID NO: 830836 - RNA, 22 nt, Human
accucuggccuucaggcaucau

SEQ ID NO: 830837 - RNA, 22 nt, Human
uucuguuuuagaaauaaguagu

SEQ ID NO: 830838 - RNA, 22 nt, Human
uugcauuucccauugaguaaug

SEQ ID NO: 830839 - RNA, 22 nt, Human
gccacaugcaauugcagcacgu

SEQ ID NO: 830840 - RNA, 22 nt, Human
aucacaaaggucucagagcaca

SEQ ID NO: 830841 - RNA, 22 nt, Human
gggcuucucuuuagugagcuga

SEQ ID NO: 830842 - RNA, 22 nt, Human
cuuggcagauccaaaaaugaca

SEQ ID NO: 830843 - RNA, 20 nt, Human
cuaucuccuggcgugccuuc

SEQ ID NO: 830844 - RNA, 22 nt, Human
gugguuuucuccaacccagaac

SEQ ID NO: 830845 - RNA, 22 nt, Human
agucucugccagcuuguccucu

SEQ ID NO: 830846 - RNA, 22 nt, Human
acaaaugugucuaauugugccu

SEQ ID NO: 830847 - RNA, 22 nt, Human
uucaaacaaaacuguucccaua

SEQ ID NO: 830848 - RNA, 22 nt, Human
cccagcaguuguuggugcacau

SEQ ID NO: 830849 - RNA, 18 nt, Human
cagauccaggcagcuauu

SEQ ID NO: 830850 - RNA, 22 nt, Human
acaggcugacuuccugccaugu

SEQ ID NO: 830851 - RNA, 22 nt, Human
agaggggaaguaaugaaugaua

SEQ ID NO: 830852 - RNA, 17 nt, Human
gucugggcuuuagagac

SEQ ID NO: 830853 - RNA, 22 nt, Human
acauuugagaugccuuuuaggu

SEQ ID NO: 830854 - RNA, 22 nt, Human
cagcauugaucccaggcugugg

SEQ ID NO: 830855 - RNA, 22 nt, Human
aggcaugugacccuggacucag

SEQ ID NO: 830856 - RNA, 20 nt, Human
aauguauauuuuaugccagg

SEQ ID NO: 830857 - RNA, 20 nt, Human
ccuccaggcacacccaugug

SEQ ID NO: 830858 - RNA, 22 nt, Human
uugcauuccaguccccacugug

SEQ ID NO: 830859 - RNA, 18 nt, Human
cuuuaugugcagagcuuu

SEQ ID NO: 830860 - RNA, 22 nt, Human
ccagcucuuggugcacuuacau

SEQ ID NO: 830861 - RNA, 22 nt, Human
uggccacccagcugacgccuuc

SEQ ID NO: 830862 - RNA, 22 nt, Human
agcagccacacgccuccuucuc

SEQ ID NO: 830863 - RNA, 22 nt, Human
ugcacacaaaugugaacgugcc

SEQ ID NO: 830864 - RNA, 22 nt, Human
aauauguucaaaauagaucacu

SEQ ID NO: 830865 - RNA, 22 nt, Human
cuggcagguuuggugucuggug

SEQ ID NO: 830866 - RNA, 22 nt, Human
acuuguguaacacagaaagaac

SEQ ID NO: 830867 - RNA, 22 nt, Human
agaggcuguuacacucccagau

SEQ ID NO: 830868 - RNA, 22 nt, Human
uucaacuuuaugcauauguauu

SEQ ID NO: 830869 - RNA, 22 nt, Human
uuucucuugcgauaugcuacac

SEQ ID NO: 830870 - RNA, 22 nt, Human
ccucucuguaagggucccuccc

SEQ ID NO: 830871 - RNA, 22 nt, Human
ucagaauucugaccuuggguca

SEQ ID NO: 830872 - RNA, 22 nt, Human
aaaugcacagaaaggaugugga

SEQ ID NO: 830873 - RNA, 22 nt, Human
auuggcaguuagugacgaggcu

SEQ ID NO: 830874 - RNA, 22 nt, Human
aauggcugggaguguauuuugg

SEQ ID NO: 830875 - RNA, 22 nt, Human
cauggggagacaccuagggaaa

SEQ ID NO: 830876 - RNA, 20 nt, Human
agcuucuucugucuaauuuu

SEQ ID NO: 830877 - RNA, 22 nt, Human
uugaagcaaggcgaaucuugug

SEQ ID NO: 830878 - RNA, 22 nt, Human
gccagccugugggggcucugug

SEQ ID NO: 830879 - RNA, 22 nt, Human
aagcaucucuauguggagagug

SEQ ID NO: 830880 - RNA, 18 nt, Human
gucauugcaacauacugu

SEQ ID NO: 830881 - RNA, 22 nt, Human
aagggcagaauagagaagaugg

SEQ ID NO: 830882 - RNA, 22 nt, Human
gcuguucaaaagccacaguuac

SEQ ID NO: 830883 - RNA, 22 nt, Human
gagcucugggaaacaaagugua

SEQ ID NO: 830884 - RNA, 22 nt, Human
uggagcccagggugagaaggag

SEQ ID NO: 830885 - RNA, 22 nt, Human
cuucagaauccagaaucagaau

SEQ ID NO: 830886 - RNA, 22 nt, Human
uccugccuugccugggacauca

SEQ ID NO: 830887 - RNA, 22 nt, Human
auucacaaaaugauauagauac

SEQ ID NO: 830888 - RNA, 22 nt, Human
gcuggggagcuagaccucagca

SEQ ID NO: 830889 - RNA, 22 nt, Human
aaugcagugagccauuaaaugg

SEQ ID NO: 830890 - RNA, 22 nt, Human
uccagggagauacuggcugcca

SEQ ID NO: 830891 - RNA, 22 nt, Human
gaagugaagagauuagaaauca

SEQ ID NO: 830892 - RNA, 22 nt, Human
cagcagcuacuuggagcagcag

SEQ ID NO: 830893 - RNA, 22 nt, Human
caauuuuuuccaugcucuuaca

SEQ ID NO: 830894 - RNA, 22 nt, Human
uguauuagaucugagaacuucu

SEQ ID NO: 830895 - RNA, 22 nt, Human
uuuuccucugagcuuugaauaa

SEQ ID NO: 830896 - RNA, 22 nt, Human
aggauuuaucaggaacucucuu

SEQ ID NO: 830897 - RNA, 22 nt, Human
cugggagcccugacuagccugg

SEQ ID NO: 830898 - RNA, 22 nt, Human
gauggcuucagucuccuugggu

SEQ ID NO: 830899 - RNA, 21 nt, Human
gcagcuggucucagagcuugc

SEQ ID NO: 830900 - RNA, 22 nt, Human
ccagaagggcuauugcagugac

SEQ ID NO: 830901 - RNA, 22 nt, Human
cugaaauuccauuucagccaca

SEQ ID NO: 830902 - RNA, 22 nt, Human
uuuauuauagugguggggacug

SEQ ID NO: 830903 - RNA, 22 nt, Human
auacuuucugaccaauuaauug

SEQ ID NO: 830904 - RNA, 22 nt, Human
ccugccagcccgcguucaugcc

SEQ ID NO: 830905 - RNA, 22 nt, Human
acagucuacuugagcuuguaua

SEQ ID NO: 830906 - RNA, 22 nt, Human
cauggccugccuccuccuggug

SEQ ID NO: 830907 - RNA, 22 nt, Human
cuguccauuuucgugccuccuu

SEQ ID NO: 830908 - RNA, 22 nt, Human
gugccagcucuccccacaucug

SEQ ID NO: 830909 - RNA, 22 nt, Human
agggaaggaaaagcugucgcuu

SEQ ID NO: 830910 - RNA, 22 nt, Human
agagcugggacuuggacucaau

SEQ ID NO: 830911 - RNA, 22 nt, Human
ggacagcucugccaggagcuca

SEQ ID NO: 830912 - RNA, 22 nt, Human
auuucauacuaaggcucaaaaa

SEQ ID NO: 830913 - RNA, 22 nt, Human
ucucagagaugucaagagucua

SEQ ID NO: 830914 - RNA, 22 nt, Human
aggugcuggagucugggcagga

SEQ ID NO: 830915 - RNA, 22 nt, Human
gcugccuguugaagggucugug

SEQ ID NO: 830916 - RNA, 22 nt, Human
cagagccagcuguccuuggcau

SEQ ID NO: 830917 - RNA, 22 nt, Human
aauuaacaaauguagcugugau

SEQ ID NO: 830918 - RNA, 22 nt, Human
uggcaggcagugugggagcugg

SEQ ID NO: 830919 - RNA, 22 nt, Human
uuucauguuuucuuaaauggca

SEQ ID NO: 830920 - RNA, 22 nt, Human
uaagaaucgauguuuauuuaga

SEQ ID NO: 830921 - RNA, 22 nt, Human
cccaggaggcagaaguugcagu

SEQ ID NO: 830922 - RNA, 22 nt, Human
agggugggcuagacucuucccc

SEQ ID NO: 830923 - RNA, 22 nt, Human
cucaggauagauuguccucuca

SEQ ID NO: 830924 - RNA, 19 nt, Human
gaaggagagcugaguuagg

SEQ ID NO: 830925 - RNA, 22 nt, Human
uggcagaggagaauuaagauua

SEQ ID NO: 830926 - RNA, 22 nt, Human
gcugucuuccuugcuccaaggg

SEQ ID NO: 830927 - RNA, 22 nt, Human
aggccaggcaacauucugaagu

SEQ ID NO: 830928 - RNA, 22 nt, Human
ugaccaaaggugguuuauuugg

SEQ ID NO: 830929 - RNA, 22 nt, Human
ucuggcucccagccugcucuca

SEQ ID NO: 830930 - RNA, 22 nt, Human
cuugucugugucggauaaaacu

SEQ ID NO: 830931 - RNA, 22 nt, Human
aaauuauucucauguguuucuu

SEQ ID NO: 830932 - RNA, 22 nt, Human
cauaauuacugauaugcugauu

SEQ ID NO: 830933 - RNA, 22 nt, Human
cagucccagcugcucagaaggc

SEQ ID NO: 830934 - RNA, 22 nt, Human
gagcauuuuugucugcauuuua

SEQ ID NO: 830935 - RNA, 22 nt, Human
acuggcagcuguaggaugcaug

SEQ ID NO: 830936 - RNA, 22 nt, Human
aaggcacucauucaaggagaua

SEQ ID NO: 830937 - RNA, 22 nt, Human
ccugugugucugucacugcaca

SEQ ID NO: 830938 - RNA, 22 nt, Human
gccagagcugagugagguucuu

SEQ ID NO: 830939 - RNA, 22 nt, Human
aggcacugauucuguuuuccau

SEQ ID NO: 830940 - RNA, 22 nt, Human
ucuguucauaguaguguauaug

SEQ ID NO: 830941 - RNA, 22 nt, Human
uccaggaguuugagacugcagu

SEQ ID NO: 830942 - RNA, 22 nt, Human
agguauagaauugaaaggguuu

SEQ ID NO: 830943 - RNA, 22 nt, Human
acauuuagcuguacaaucuaug

SEQ ID NO: 830944 - RNA, 22 nt, Human
uugaagcauuugcuauagcauu

SEQ ID NO: 830945 - RNA, 19 nt, Human
ccagcagcuuugauucucu

SEQ ID NO: 830946 - RNA, 22 nt, Human
ggccagagagccgcuguuagga

SEQ ID NO: 830947 - RNA, 22 nt, Human
agcaucuggucaugagugagaa

SEQ ID NO: 830948 - RNA, 22 nt, Human
ccuuucucauuuuaagcauuag

SEQ ID NO: 830949 - RNA, 22 nt, Human
aagcugccagcugagcugaggc

SEQ ID NO: 830950 - RNA, 22 nt, Human
caaugaaaauuuaaguugcagc

SEQ ID NO: 830951 - RNA, 21 nt, Human
agagagggagaugaaacaucc

SEQ ID NO: 830952 - RNA, 22 nt, Human
uagucccauuuugagguauuug

SEQ ID NO: 830953 - RNA, 22 nt, Human
uuuaaauaggacuccugggggu

SEQ ID NO: 830954 - RNA, 22 nt, Human
agaggggagagcuaagcaauuc

SEQ ID NO: 830955 - RNA, 22 nt, Human
ccagcucugcagggccuggggu

SEQ ID NO: 830956 - RNA, 22 nt, Human
augaacuuauuucugaacuuuu

SEQ ID NO: 830957 - RNA, 22 nt, Human
ggcauggcucggagucagaaca

SEQ ID NO: 830958 - RNA, 22 nt, Human
uggcugcuagccagagcuucag

SEQ ID NO: 830959 - RNA, 22 nt, Human
gugccuggcaugcgccggugcu

SEQ ID NO: 830960 - RNA, 22 nt, Human
cagggagcuggcuggcgugagu

SEQ ID NO: 830961 - RNA, 22 nt, Human
gagccagccgcaagagcuguga

SEQ ID NO: 830962 - RNA, 22 nt, Human
ucuggcucaggagcuguguuca

SEQ ID NO: 830963 - RNA, 22 nt, Human
ggagcugucuguagggcacagg

SEQ ID NO: 830964 - RNA, 21 nt, Human
agcucagccgggcacaguggc

SEQ ID NO: 830965 - RNA, 22 nt, Human
cagguggcuucucccuaggcca

SEQ ID NO: 830966 - RNA, 22 nt, Human
gcaggaguguggugggacaucc

SEQ ID NO: 830967 - RNA, 22 nt, Human
ggccuggccuccagaugugggc

SEQ ID NO: 830968 - RNA, 22 nt, Human
uaacuuucuucauaugugaacc

SEQ ID NO: 830969 - RNA, 22 nt, Human
ggaggccaaggcgggcggauca

SEQ ID NO: 830970 - RNA, 22 nt, Human
guuuuauaauugcuucauaaga

SEQ ID NO: 830971 - RNA, 22 nt, Human
uuugaagacauauuguuacaua

SEQ ID NO: 830972 - RNA, 22 nt, Human
acaaaaauuagcugggcauggu

SEQ ID NO: 830973 - RNA, 22 nt, Human
ugcugcauuuaucuucucaaac

SEQ ID NO: 830974 - RNA, 22 nt, Human
gcccagcuuuuugaggcaggca

SEQ ID NO: 830975 - RNA, 22 nt, Human
ucaaggcuaaacuuucagagua

SEQ ID NO: 830976 - RNA, 22 nt, Human
aggucacauggauaaugaucag

SEQ ID NO: 830977 - RNA, 22 nt, Human
uuaaacaguguuucaugugggg

SEQ ID NO: 830978 - RNA, 22 nt, Human
aggcugggaaauguauuccagc

SEQ ID NO: 830979 - RNA, 22 nt, Human
uuucaauguaacauuuccaggc

SEQ ID NO: 830980 - RNA, 22 nt, Human
gggcugcugccaaucacagccu

SEQ ID NO: 830981 - RNA, 22 nt, Human
ggugggugagcccugggagcug

SEQ ID NO: 830982 - RNA, 22 nt, Human
cuucccagacgggguggcagcc

SEQ ID NO: 830983 - RNA, 22 nt, Human
uagcccagcaugagcagagcug

SEQ ID NO: 830984 - RNA, 22 nt, Human
uucucucauucaaauuaaagug

SEQ ID NO: 830985 - RNA, 22 nt, Human
uccaggagaaaacugacggugg

SEQ ID NO: 830986 - RNA, 22 nt, Human
uauuuguauguguguacauaua

SEQ ID NO: 830987 - RNA, 22 nt, Human
cacucugcgcugggcgccagcg

SEQ ID NO: 830988 - RNA, 22 nt, Human
ggggcagagcauagcuccaauu

SEQ ID NO: 830989 - RNA, 22 nt, Human
gcagcaggcuuuucauaccuug

SEQ ID NO: 830990 - RNA, 22 nt, Human
uagaaauguugguauuaacauu

SEQ ID NO: 830991 - RNA, 22 nt, Human
gggcucugggauucagagcaag

SEQ ID NO: 830992 - RNA, 22 nt, Human
gaucuucuagcagaaguaauuu

SEQ ID NO: 830993 - RNA, 22 nt, Human
ggaagggccucgggcgugggac

SEQ ID NO: 830994 - RNA, 22 nt, Human
ugcagccaccaccucugcugaa

SEQ ID NO: 830995 - RNA, 22 nt, Human
uuucagugcuucuguuuaccgg

SEQ ID NO: 830996 - RNA, 22 nt, Human
uaggagcuaaaauauuuuauau

SEQ ID NO: 830997 - RNA, 22 nt, Human
aagccagggucaggggccuccu

SEQ ID NO: 830998 - RNA, 22 nt, Human
uccuugaacagagggccugggu

SEQ ID NO: 830999 - RNA, 22 nt, Human
agugcuuuagcauccaacuguc

SEQ ID NO: 831000 - RNA, 22 nt, Human
cuguagccaguuuggccucacc

SEQ ID NO: 831001 - RNA, 22 nt, Human
uagcucuucauuucaucugauu

SEQ ID NO: 831002 - RNA, 22 nt, Human
aaguccuuuaauaucacauagu

SEQ ID NO: 831003 - RNA, 22 nt, Human
ggcugaaacagauuucaagaca

SEQ ID NO: 831004 - RNA, 22 nt, Human
agcucccaggcagucaugagga

SEQ ID NO: 831005 - RNA, 22 nt, Human
ggauuuacaaguuuaacucuca

SEQ ID NO: 831006 - RNA, 22 nt, Human
caggaggaacaagagguucugg

SEQ ID NO: 831007 - RNA, 22 nt, Human
uuccuugaaugagucauggaaa

SEQ ID NO: 831008 - RNA, 22 nt, Human
cagcucucacacccuccuccca

SEQ ID NO: 831009 - RNA, 20 nt, Human
ugugugcacacaugacauuc

SEQ ID NO: 831010 - RNA, 22 nt, Human
acaugcauucucuaaaagcaaa

SEQ ID NO: 831011 - RNA, 22 nt, Human
ugccugucagggggagugggaa

SEQ ID NO: 831012 - RNA, 22 nt, Human
uaugagaaaauaaauaucuguu

SEQ ID NO: 831013 - RNA, 22 nt, Human
ucucagagugacaaugagaauu

SEQ ID NO: 831014 - RNA, 22 nt, Human
cuggcagcaguuaugaaacaau

SEQ ID NO: 831015 - RNA, 22 nt, Human
gcucccugaaaagaacaaaguc

SEQ ID NO: 831016 - RNA, 22 nt, Human
acucugugugaguagagccugu

SEQ ID NO: 831017 - RNA, 22 nt, Human
uggaagagggagcuggguggcc

SEQ ID NO: 831018 - RNA, 22 nt, Human
caggcagccaggggaccugucc

SEQ ID NO: 831019 - RNA, 22 nt, Human
gaagagcugacagugucauccu

SEQ ID NO: 831020 - RNA, 22 nt, Human
ugugcccaucccucuggagugu

SEQ ID NO: 831021 - RNA, 22 nt, Human
uaugacauuggccaaguucugu

SEQ ID NO: 831022 - RNA, 22 nt, Human
auguaugaugcuaggcucucag

SEQ ID NO: 831023 - RNA, 22 nt, Human
ucucagggcgcagugaggcagu

SEQ ID NO: 831024 - RNA, 22 nt, Human
auuauuauauagggaaaguccc

SEQ ID NO: 831025 - RNA, 22 nt, Human
uccuucuuugacaaguggcaga

SEQ ID NO: 831026 - RNA, 22 nt, Human
agaggcugucccuugcuauucc

SEQ ID NO: 831027 - RNA, 20 nt, Human
caccagucaugagucaauac

SEQ ID NO: 831028 - RNA, 22 nt, Human
cuaaagaagcuagcaaucuaua

SEQ ID NO: 831029 - RNA, 20 nt, Human
auguagaugaaagcaaaggc

SEQ ID NO: 831030 - RNA, 22 nt, Human
gccagagcugagacacgagucc

SEQ ID NO: 831031 - RNA, 22 nt, Human
gccagcugguaggcaccuagcc

SEQ ID NO: 831032 - RNA, 22 nt, Human
aacagugagaagguggacagga

SEQ ID NO: 831033 - RNA, 22 nt, Human
ucccuggacagccuugccuggg

SEQ ID NO: 831034 - RNA, 22 nt, Human
gcacugcagguggguggagagg

SEQ ID NO: 831035 - RNA, 22 nt, Human
gagccuggauugucaccgacuu

SEQ ID NO: 831036 - RNA, 22 nt, Human
uugcugugaaaccaugggaagu

SEQ ID NO: 831037 - RNA, 22 nt, Human
aguaaaauuguauuggaaaaca

SEQ ID NO: 831038 - RNA, 22 nt, Human
aauuuuaagcauaugacugguu

SEQ ID NO: 831039 - RNA, 22 nt, Human
guggcugcucgggcuccggccc

SEQ ID NO: 831040 - RNA, 22 nt, Human
guggcccugucccaggccuccu

SEQ ID NO: 831041 - RNA, 22 nt, Human
agccccugggaguagcugcugc

SEQ ID NO: 831042 - RNA, 22 nt, Human
augcaguggcagcuccuggugu

SEQ ID NO: 831043 - RNA, 22 nt, Human
gagagcugugguuugaccaggc

SEQ ID NO: 831044 - RNA, 22 nt, Human
uuccuuaguguuagauucugug

SEQ ID NO: 831045 - RNA, 22 nt, Human
agucaguggcuccgagccuggu

SEQ ID NO: 831046 - RNA, 22 nt, Human
aguauguauuuuauacuuacag

SEQ ID NO: 831047 - RNA, 22 nt, Human
agaauaguggcaaugacugcac

SEQ ID NO: 831048 - RNA, 22 nt, Human
uuccaggaggagguacuagagg

SEQ ID NO: 831049 - RNA, 22 nt, Human
uggcagcuccggguaggggcug

SEQ ID NO: 831050 - RNA, 22 nt, Human
guucuucagaggggaaagaacc

SEQ ID NO: 831051 - RNA, 22 nt, Human
caugaaauugcuccuuuggugc

SEQ ID NO: 831052 - RNA, 22 nt, Human
uuuguuuucaaugugucauuca

SEQ ID NO: 831053 - RNA, 22 nt, Human
caagagcugaggcuggagaggu

SEQ ID NO: 831054 - RNA, 22 nt, Human
uuuucuaacaucuaguaauuug

SEQ ID NO: 831055 - RNA, 22 nt, Human
uauugaaaugaaugacagugau

SEQ ID NO: 831056 - RNA, 22 nt, Human
ucccaggaucugagggcagaga

SEQ ID NO: 831057 - RNA, 22 nt, Human
agagugaucagauaucaggugu

SEQ ID NO: 831058 - RNA, 22 nt, Human
gggguugguuuaaaugcuugag

SEQ ID NO: 831059 - RNA, 22 nt, Human
accaggcugugaagugagacua

SEQ ID NO: 831060 - RNA, 22 nt, Human
auggacagugugucuguuucca

SEQ ID NO: 831061 - RNA, 22 nt, Human
agcuugccucuuaaucaccuca

SEQ ID NO: 831062 - RNA, 22 nt, Human
aggcuagcuuuggcucaguaaa

SEQ ID NO: 831063 - RNA, 22 nt, Human
cccucccaagcacucugacaua

SEQ ID NO: 831064 - RNA, 22 nt, Human
aacauuucagcaaauaagaaca

SEQ ID NO: 831065 - RNA, 22 nt, Human
cugacucagcagcugaugaucc

SEQ ID NO: 831066 - RNA, 22 nt, Human
ugaugguugauuauaaaucagu

SEQ ID NO: 831067 - RNA, 23 nt, Human
auuugagaaaguauuuuuaagac

SEQ ID NO: 831068 - RNA, 23 nt, Human
gugcucugcggucugcuagucug

SEQ ID NO: 831069 - RNA, 22 nt, Human
cauugcuuugugcauauuuaaa

SEQ ID NO: 831070 - RNA, 19 nt, Human
ugagugggccccugcagac

SEQ ID NO: 831071 - RNA, 22 nt, Human
acccuuucuuacucacacgcuc

SEQ ID NO: 831072 - RNA, 22 nt, Human
uucagaaaaagaccauugcaau

SEQ ID NO: 831073 - RNA, 22 nt, Human
aguaaaauuaauggaucagaag

SEQ ID NO: 831074 - RNA, 22 nt, Human
cucagcuggcaauucuggcucc

SEQ ID NO: 831075 - RNA, 22 nt, Human
gagagcuguccggcugagcagc

SEQ ID NO: 831076 - RNA, 22 nt, Human
uggcauuuagaaaacaacaugu

SEQ ID NO: 831077 - RNA, 23 nt, Human
aggcgagcucuucuccagcacgu

SEQ ID NO: 831078 - RNA, 18 nt, Human
cagggcuguggggucacu

SEQ ID NO: 831079 - RNA, 22 nt, Human
gcuguccagagcaugggagcaa

SEQ ID NO: 831080 - RNA, 22 nt, Human
gcugcccuaauaucacauguua

SEQ ID NO: 831081 - RNA, 17 nt, Human
ucuguucaagugagagg

SEQ ID NO: 831082 - RNA, 22 nt, Human
uccuugaaugaagagaggugac

SEQ ID NO: 831083 - RNA, 22 nt, Human
cugcccugucuuuuucugauga

SEQ ID NO: 831084 - RNA, 20 nt, Human
acugugaaugcugaauuagc

SEQ ID NO: 831085 - RNA, 22 nt, Human
acagauauaugauuguguaaau

SEQ ID NO: 831086 - RNA, 22 nt, Human
gccccuggcuggccagcuccuc

SEQ ID NO: 831087 - RNA, 22 nt, Human
aucuaacagcaacaccagaaua

SEQ ID NO: 831088 - RNA, 22 nt, Human
cugggugaguugaugaaggaga

SEQ ID NO: 831089 - RNA, 22 nt, Human
uuacauuuuaguuaaccuguga

SEQ ID NO: 831090 - RNA, 22 nt, Human
uucuucucucauagauuaaggu

SEQ ID NO: 831091 - RNA, 22 nt, Human
uuuauccauaucauuaaaaucu

SEQ ID NO: 831092 - RNA, 22 nt, Human
uucaaguuuugccuccccaucc

SEQ ID NO: 831093 - RNA, 22 nt, Human
ugcugcacgauaaauaauuucu

SEQ ID NO: 831094 - RNA, 22 nt, Human
cugcagagaauuguggggcuuc

SEQ ID NO: 831095 - RNA, 22 nt, Human
ucccagagcagaugugcuaaag

SEQ ID NO: 831096 - RNA, 19 nt, Human
uggcuuccaucucucucau

SEQ ID NO: 831097 - RNA, 22 nt, Human
ccuggcagcuguuuggcuuggc

SEQ ID NO: 831098 - RNA, 22 nt, Human
uguacuuccccaaugacagcac

SEQ ID NO: 831099 - RNA, 19 nt, Human
gggaaauucacuugcuucc

SEQ ID NO: 831100 - RNA, 21 nt, Human
ccugcagcaccagaaggagau

SEQ ID NO: 831101 - RNA, 22 nt, Human
ggcaguggguuccccaaggcac

SEQ ID NO: 831102 - RNA, 22 nt, Human
ucugucugcgcuugcccuggug

SEQ ID NO: 831103 - RNA, 22 nt, Human
ucugccagugguuuggcccuga

SEQ ID NO: 831104 - RNA, 22 nt, Human
ggucccaggaaucuguguucua

SEQ ID NO: 831105 - RNA, 20 nt, Human
ggcaggcuuuauauggaggg

SEQ ID NO: 831106 - RNA, 22 nt, Human
acacaauacagggcucaaaaua

SEQ ID NO: 831107 - RNA, 22 nt, Human
accaggagggacccugguggcc

SEQ ID NO: 831108 - RNA, 22 nt, Human
acugcaucugaaacauggguca

SEQ ID NO: 831109 - RNA, 22 nt, Human
aaggccaggacaccaggggacu

SEQ ID NO: 831110 - RNA, 21 nt, Human
acuuuaauauacaugaggagg

SEQ ID NO: 831111 - RNA, 22 nt, Human
caggggaguuuuaugcaacaga

SEQ ID NO: 831112 - RNA, 22 nt, Human
aggcacugacaauucuggacug

SEQ ID NO: 831113 - RNA, 22 nt, Human
cuugcuuuguccagaaauucag

SEQ ID NO: 831114 - RNA, 22 nt, Human
uuacugaaaauucuucaggauu

SEQ ID NO: 831115 - RNA, 18 nt, Human
gagagggaucccucagga

SEQ ID NO: 831116 - RNA, 22 nt, Human
gaugcacaugugaguauagaag

SEQ ID NO: 831117 - RNA, 22 nt, Human
ucaggcagaccaccgugggcag

SEQ ID NO: 831118 - RNA, 22 nt, Human
aagggcugaaagaccuugggca

SEQ ID NO: 831119 - RNA, 22 nt, Human
cuggaaugccucccugucagag

SEQ ID NO: 831120 - RNA, 22 nt, Human
cggcagcucgagggccacccgu

SEQ ID NO: 831121 - RNA, 22 nt, Human
acaguaccugcucucaagcaaa

SEQ ID NO: 831122 - RNA, 22 nt, Human
gcuggagcuugagaggacaggg

SEQ ID NO: 831123 - RNA, 22 nt, Human
gcaccuggcugcccagguggag

SEQ ID NO: 831124 - RNA, 22 nt, Human
gcugucugcugggucgcucagg

SEQ ID NO: 831125 - RNA, 22 nt, Human
guaaaugugcuucuuuuaacuu

SEQ ID NO: 831126 - RNA, 22 nt, Human
agucaccaacaugguucccagg

SEQ ID NO: 831127 - RNA, 22 nt, Human
aaggccaugcacauccuaggca

SEQ ID NO: 831128 - RNA, 22 nt, Human
gaaaugugugacaaguuucaau

SEQ ID NO: 831129 - RNA, 22 nt, Human
cccugggacccgcugcagaggc

SEQ ID NO: 831130 - RNA, 22 nt, Human
aaagucaucagaaccuuccaga

SEQ ID NO: 831131 - RNA, 22 nt, Human
aaaagaggagugguuuaugaca

SEQ ID NO: 831132 - RNA, 22 nt, Human
acuacuuugggccauuuguuua

SEQ ID NO: 831133 - RNA, 22 nt, Human
gagcugccuacauugccaagag

SEQ ID NO: 831134 - RNA, 22 nt, Human
uaauaucuacuucauagaguuu

SEQ ID NO: 831135 - RNA, 22 nt, Human
ucagugcacagagauuuuuguu

SEQ ID NO: 831136 - RNA, 22 nt, Human
ccagucagccaagcugcagcgg

SEQ ID NO: 831137 - RNA, 22 nt, Human
ggcaaaaacagcaaugacuuuu

SEQ ID NO: 831138 - RNA, 22 nt, Human
gguucacacuaagcuuaagugg

SEQ ID NO: 831139 - RNA, 22 nt, Human
ugaaagcuguccacuaggcugu

SEQ ID NO: 831140 - RNA, 22 nt, Human
acauuucuuugcuagacagcag

SEQ ID NO: 831141 - RNA, 22 nt, Human
uggcccugacagguccugggca

SEQ ID NO: 831142 - RNA, 18 nt, Human
agggagagaccgcggguc

SEQ ID NO: 831143 - RNA, 22 nt, Human
cagggugcgccacucagaugua

SEQ ID NO: 831144 - RNA, 22 nt, Human
ucuucacaugaccuucaugucu

SEQ ID NO: 831145 - RNA, 22 nt, Human
uggcagcucuguucaacaugag

SEQ ID NO: 831146 - RNA, 19 nt, Human
uuuuccuucuauauguuuc

SEQ ID NO: 831147 - RNA, 22 nt, Human
uagcagaagaacaacaugaucu

SEQ ID NO: 831148 - RNA, 22 nt, Human
gccaggcucucagugacugccc

SEQ ID NO: 831149 - RNA, 22 nt, Human
uagcagggguagauagagugug

SEQ ID NO: 831150 - RNA, 22 nt, Human
uuuaggcagucauugaacaagu

SEQ ID NO: 831151 - RNA, 22 nt, Human
agccauuuuccugaaauauaac

SEQ ID NO: 831152 - RNA, 22 nt, Human
caaacauucaaguacaagucuu

SEQ ID NO: 831153 - RNA, 22 nt, Human
agagccaggacugugucucacu

SEQ ID NO: 831154 - RNA, 22 nt, Human
aguggcagagguugacugcagu

SEQ ID NO: 831155 - RNA, 23 nt, Human
cuugcaggaagcagauggcacac

SEQ ID NO: 831156 - RNA, 22 nt, Human
uccaggagggguaggcaguaug

SEQ ID NO: 831157 - RNA, 22 nt, Human
auuccaguuggguucuaauaca

SEQ ID NO: 831158 - RNA, 22 nt, Human
ugggcuggugagggaucauuua

SEQ ID NO: 831159 - RNA, 22 nt, Human
agcucccagcagagcuggccac

SEQ ID NO: 831160 - RNA, 22 nt, Human
uuucugaacaaagccauuauca

SEQ ID NO: 831161 - RNA, 22 nt, Human
uucuuuccacagaggggaugau

SEQ ID NO: 831162 - RNA, 22 nt, Human
ugcuagaauuagguuaaacaaa

SEQ ID NO: 831163 - RNA, 22 nt, Human
guccuggcccacuggcaggcug

SEQ ID NO: 831164 - RNA, 22 nt, Human
aaugcuguaaagaugcuaucug

SEQ ID NO: 831165 - RNA, 22 nt, Human
ggaggugaggccguagggugug

SEQ ID NO: 831166 - RNA, 22 nt, Human
gcaggggaguccacucuaugca

SEQ ID NO: 831167 - RNA, 21 nt, Human
cagaggcagguccugggacgg

SEQ ID NO: 831168 - RNA, 22 nt, Human
uugaaaggccuguuuauccagc

SEQ ID NO: 831169 - RNA, 22 nt, Human
caaagucccagcugcuuagaga

SEQ ID NO: 831170 - RNA, 22 nt, Human
cagggcagagccaggauuucaa

SEQ ID NO: 831171 - RNA, 21 nt, Human
uucaaaguuugccuaaagauu

SEQ ID NO: 831172 - RNA, 22 nt, Human
agcuguucccucacugcaguca

SEQ ID NO: 831173 - RNA, 19 nt, Human
gucacauuugucucccagg

SEQ ID NO: 831174 - RNA, 22 nt, Human
cucccugggcagauguggcucu

SEQ ID NO: 831175 - RNA, 22 nt, Human
ucugucaccauucagcuugaau

SEQ ID NO: 831176 - RNA, 22 nt, Human
aggaagcuccuggagagccagu

SEQ ID NO: 831177 - RNA, 21 nt, Human
ggccuuggcgggggccgaauu

SEQ ID NO: 831178 - RNA, 22 nt, Human
agcagugaugcaugacagccua

SEQ ID NO: 831179 - RNA, 22 nt, Human
uacaguauuaugagugauugaa

SEQ ID NO: 831180 - RNA, 22 nt, Human
ugccucagucuaaagucucuca

SEQ ID NO: 831181 - RNA, 22 nt, Human
ccucagcugcuucccuggagcc

SEQ ID NO: 831182 - RNA, 22 nt, Human
gguaaaaugcagauucuuagcc

SEQ ID NO: 831183 - RNA, 22 nt, Human
aauguauuccucaugcaagagu

SEQ ID NO: 831184 - RNA, 22 nt, Human
uaugaacuuuugaugugacaug

SEQ ID NO: 831185 - RNA, 22 nt, Human
caagaaauuucuuaagaacuaa

SEQ ID NO: 831186 - RNA, 22 nt, Human
cagcauggcuugaguguuuccu

SEQ ID NO: 831187 - RNA, 22 nt, Human
guaagagcacugucuccugcug

SEQ ID NO: 831188 - RNA, 22 nt, Human
uuggcuucuggcagucuggacg

SEQ ID NO: 831189 - RNA, 17 nt, Human
gucauucucagaaaaug

SEQ ID NO: 831190 - RNA, 22 nt, Human
ucaggcagaugcagggauggau

SEQ ID NO: 831191 - RNA, 22 nt, Human
ccauggcuuuugagucucaaga

SEQ ID NO: 831192 - RNA, 22 nt, Human
uggagcaagcuggagagaacau

SEQ ID NO: 831193 - RNA, 22 nt, Human
cuuuggaagugaccacaauccu

SEQ ID NO: 831194 - RNA, 22 nt, Human
cugggagguggagguugcauug

SEQ ID NO: 831195 - RNA, 21 nt, Human
ugcaggagucugugagucagg

SEQ ID NO: 831196 - RNA, 22 nt, Human
auggcauuauagcaaugguuug

SEQ ID NO: 831197 - RNA, 22 nt, Human
aggagcugacuuguaaagcauu

SEQ ID NO: 831198 - RNA, 22 nt, Human
caucugccuaaguggcccuguu

SEQ ID NO: 831199 - RNA, 22 nt, Human
cagaggaugaucuggccucucu

SEQ ID NO: 831200 - RNA, 22 nt, Human
agaauaaucacugaaguucaaa

SEQ ID NO: 831201 - RNA, 22 nt, Human
augggaugaacuugaucugcuu

SEQ ID NO: 831202 - RNA, 22 nt, Human
uauugacaauuugugaaacuau

SEQ ID NO: 831203 - RNA, 22 nt, Human
uucuucuugaaacuuuagguug

SEQ ID NO: 831204 - RNA, 23 nt, Human
uggaccugaaccagugccucugu

SEQ ID NO: 831205 - RNA, 21 nt, Human
acaguucaugauaacuccauc

SEQ ID NO: 831206 - RNA, 22 nt, Human
ugcucccaggcucuguggucug

SEQ ID NO: 831207 - RNA, 22 nt, Human
gcagagaacccagcagauuggc

SEQ ID NO: 831208 - RNA, 22 nt, Human
uucaagaugacccagucacacg

SEQ ID NO: 831209 - RNA, 22 nt, Human
augcuuaaccuugguguacaau

SEQ ID NO: 831210 - RNA, 22 nt, Human
gcacagagggcagugagccucu

SEQ ID NO: 831211 - RNA, 22 nt, Human
cccagcaucccagugggcagca

SEQ ID NO: 831212 - RNA, 18 nt, Human
acaaaugugucacaggaa

SEQ ID NO: 831213 - RNA, 22 nt, Human
gagagcuguaauagucaugucu

SEQ ID NO: 831214 - RNA, 22 nt, Human
agcucccaauugacuugaacua

SEQ ID NO: 831215 - RNA, 22 nt, Human
gcugagggcuguaacagcagag

SEQ ID NO: 831216 - RNA, 19 nt, Human
uggagaggaaaugcugcuc

SEQ ID NO: 831217 - RNA, 22 nt, Human
gaaaaaugcuccaaaucugugg

SEQ ID NO: 831218 - RNA, 21 nt, Human
aggucccagguuugggcagca

SEQ ID NO: 831219 - RNA, 22 nt, Human
gccucuggucccucaugcugug

SEQ ID NO: 831220 - RNA, 22 nt, Human
uccaaagggaagcgcuuucugu

SEQ ID NO: 831221 - RNA, 22 nt, Human
agguggguccuggcucugccau

SEQ ID NO: 831222 - RNA, 22 nt, Human
acagccuguguaccagcuggga

SEQ ID NO: 831223 - RNA, 22 nt, Human
aagcccagaugggagcauuuca

SEQ ID NO: 831224 - RNA, 22 nt, Human
gcagagugagccgaggcugcuc

SEQ ID NO: 831225 - RNA, 22 nt, Human
agacaaagacagcaucucaggu

SEQ ID NO: 831226 - RNA, 22 nt, Human
ccugggugaaaucucuccugca

SEQ ID NO: 831227 - RNA, 22 nt, Human
uucagaaugugaccuuauuugg

SEQ ID NO: 831228 - RNA, 22 nt, Human
ugucucagauacgccaucaagg

SEQ ID NO: 831229 - RNA, 22 nt, Human
cuccucugucuaccacgagggu

SEQ ID NO: 831230 - RNA, 22 nt, Human
cccuggggcugagggauggccg

SEQ ID NO: 831231 - RNA, 19 nt, Human
ucucacaucagcuccuagc

SEQ ID NO: 831232 - RNA, 22 nt, Human
gcugccugucccaggaugagga

SEQ ID NO: 831233 - RNA, 22 nt, Human
ccagcccuugcugaaggguggc

SEQ ID NO: 831234 - RNA, 22 nt, Human
ugccugcuaggcccugcugggu

SEQ ID NO: 831235 - RNA, 22 nt, Human
agcagcuuacauguggccuauc

SEQ ID NO: 831236 - RNA, 22 nt, Human
cugaggugcuagggucccugcu

SEQ ID NO: 831237 - RNA, 22 nt, Human
cugagcugggaguggauagugg

SEQ ID NO: 831238 - RNA, 22 nt, Human
ugcuguagcccugcacagugca

SEQ ID NO: 831239 - RNA, 22 nt, Human
ugcaauaaguuguguuaucacu

SEQ ID NO: 831240 - RNA, 23 nt, Human
cagggccaggcagcagcugucac

SEQ ID NO: 831241 - RNA, 22 nt, Human
caugaagcacagcucucuuuuu

SEQ ID NO: 831242 - RNA, 22 nt, Human
uguacaauguggccaguguuaa

SEQ ID NO: 831243 - RNA, 22 nt, Human
gcuggccugaccugaggcuggg

SEQ ID NO: 831244 - RNA, 22 nt, Human
uggcugaauaaaauaugguguu

SEQ ID NO: 831245 - RNA, 21 nt, Human
gcaaauguucaggaaaaaaga

SEQ ID NO: 831246 - RNA, 21 nt, Human
uccuucaguucugcacuuucu

SEQ ID NO: 831247 - RNA, 22 nt, Human
ugugaaagauacuaggcagagg

SEQ ID NO: 831248 - RNA, 22 nt, Human
agugggcagcccaggaggucuu

SEQ ID NO: 831249 - RNA, 19 nt, Human
acagaagcauagaaaagga

SEQ ID NO: 831250 - RNA, 22 nt, Human
gagcugccugaacaagcagcag

SEQ ID NO: 831251 - RNA, 22 nt, Human
agggccuggcgcguggccgccg

SEQ ID NO: 831252 - RNA, 22 nt, Human
uuccuggugguggugacagcac

SEQ ID NO: 831253 - RNA, 22 nt, Human
gggagcuguaguccagauaccg

SEQ ID NO: 831254 - RNA, 22 nt, Human
guuugcauauuugcacaggaau

SEQ ID NO: 831255 - RNA, 22 nt, Human
gcccagcugcacccuggugggu

SEQ ID NO: 831256 - RNA, 22 nt, Human
gccagggcucgcggucccucgu

SEQ ID NO: 831257 - RNA, 22 nt, Human
cuccagggaugagacagaguag

SEQ ID NO: 831258 - RNA, 22 nt, Human
agcucucaagauaagaaagaac

SEQ ID NO: 831259 - RNA, 21 nt, Human
ugcuuuaugggaaaaauguca

SEQ ID NO: 831260 - RNA, 22 nt, Human
uccucagaaaccccugugaggu

SEQ ID NO: 831261 - RNA, 22 nt, Human
ggccugcugcuaugacuuccug

SEQ ID NO: 831262 - RNA, 21 nt, Human
aucauucuggaaaauucaagc

SEQ ID NO: 831263 - RNA, 23 nt, Human
agggugagcaagcuauggagacc

SEQ ID NO: 831264 - RNA, 22 nt, Human
aaaugaccagaauacaggcuuc

SEQ ID NO: 831265 - RNA, 22 nt, Human
augcuacauuuugguuuauaaa

SEQ ID NO: 831266 - RNA, 22 nt, Human
acauuuaaauaccuauguuucu

SEQ ID NO: 831267 - RNA, 22 nt, Human
acccugagucagacagccugac

SEQ ID NO: 831268 - RNA, 19 nt, Human
acagagcucucugcuucug

SEQ ID NO: 831269 - RNA, 22 nt, Human
acauagcuuaaaugagaagaua

SEQ ID NO: 831270 - RNA, 22 nt, Human
agagaggcugggcguagggcuu

SEQ ID NO: 831271 - RNA, 22 nt, Human
cagcuggccccacaguagaggc

SEQ ID NO: 831272 - RNA, 22 nt, Human
ugugccauuucuauucugcagc

SEQ ID NO: 831273 - RNA, 22 nt, Human
cucugagagagcuggugagcac

SEQ ID NO: 831274 - RNA, 22 nt, Human
agggccagaggcaccuugcagc

SEQ ID NO: 831275 - RNA, 22 nt, Human
uggggccugagguggagcugca

SEQ ID NO: 831276 - RNA, 22 nt, Human
uugugucugggggagugacauc

SEQ ID NO: 831277 - RNA, 22 nt, Human
auaaaauuugcuacuguuaaau

SEQ ID NO: 831278 - RNA, 22 nt, Human
cugaaggauucaaaauggcagg

SEQ ID NO: 831279 - RNA, 20 nt, Human
uggcccuguuuucuccaggc

SEQ ID NO: 831280 - RNA, 22 nt, Human
agcacagguacggagaugcuac

SEQ ID NO: 831281 - RNA, 22 nt, Human
cuagaaauacaggcacgugcca

SEQ ID NO: 831282 - RNA, 22 nt, Human
accccaagacaguagaagagaa

SEQ ID NO: 831283 - RNA, 22 nt, Human
uaggauuuaggcuuuaacaucu

SEQ ID NO: 831284 - RNA, 22 nt, Human
ccugccaggacauugcuugaag

SEQ ID NO: 831285 - RNA, 22 nt, Human
aagggcugccagggggugccag

SEQ ID NO: 831286 - RNA, 22 nt, Human
uucaccgugaaccgauuccuca

SEQ ID NO: 831287 - RNA, 22 nt, Human
uggcagagcccagacuccaguc

SEQ ID NO: 831288 - RNA, 22 nt, Human
aaggcugagagucacaguccua

SEQ ID NO: 831289 - RNA, 22 nt, Human
uaaaaguauacuuucaaaggag

SEQ ID NO: 831290 - RNA, 22 nt, Human
gcugccuuuugcuccucccacc

SEQ ID NO: 831291 - RNA, 22 nt, Human
ccugcccagcuucaccucaggc

SEQ ID NO: 831292 - RNA, 22 nt, Human
ccagggugaccagcuggccuag

SEQ ID NO: 831293 - RNA, 17 nt, Human
gaggagcuccaguaggu

SEQ ID NO: 831294 - RNA, 22 nt, Human
agcuggagaucaugcugauacu

SEQ ID NO: 831295 - RNA, 22 nt, Human
cuagaaauucugauucaguagg

SEQ ID NO: 831296 - RNA, 22 nt, Human
gcagcagaggcccuacucuuug

SEQ ID NO: 831297 - RNA, 22 nt, Human
auauaguuggguuucauucuac

SEQ ID NO: 831298 - RNA, 22 nt, Human
ggcugcugguagggguaggaag

SEQ ID NO: 831299 - RNA, 22 nt, Human
gaaauaagaguccaugccaggu

SEQ ID NO: 831300 - RNA, 22 nt, Human
cuggcucauccagguguugcuc

SEQ ID NO: 831301 - RNA, 22 nt, Human
ccagguggcuucugcccgaugu

SEQ ID NO: 831302 - RNA, 22 nt, Human
cucuuaguuuaucuuugacaaa

SEQ ID NO: 831303 - RNA, 22 nt, Human
uaaggcagaaauaugagcaggg

SEQ ID NO: 831304 - RNA, 22 nt, Human
ccugccuguaagauggguacaa

SEQ ID NO: 831305 - RNA, 22 nt, Human
gagguagcgaguggacagugca

SEQ ID NO: 831306 - RNA, 22 nt, Human
uucaagaugcacaguggcauuc

SEQ ID NO: 831307 - RNA, 22 nt, Human
ggcuccugaaagacuaugggaa

SEQ ID NO: 831308 - RNA, 22 nt, Human
uccucaggagagcuccuaugcc

SEQ ID NO: 831309 - RNA, 22 nt, Human
gaguuauucuagguccuuugua

SEQ ID NO: 831310 - RNA, 22 nt, Human
gcuggccucuacaggccggcca

SEQ ID NO: 831311 - RNA, 22 nt, Human
guacuucccugggaggcaagca

SEQ ID NO: 831312 - RNA, 22 nt, Human
gaggccugguagccgagcccca

SEQ ID NO: 831313 - RNA, 22 nt, Human
acugcagccuagggaccacagu

SEQ ID NO: 831314 - RNA, 22 nt, Human
aauggacaggagagcauaguca

SEQ ID NO: 831315 - RNA, 22 nt, Human
cagaggcuguguaggcagacug

SEQ ID NO: 831316 - RNA, 20 nt, Human
ccaccuggccaaggcugugc

SEQ ID NO: 831317 - RNA, 22 nt, Human
ggcucagguugggucacaugac

SEQ ID NO: 831318 - RNA, 22 nt, Human
cagagccuuccuagcagacucu

SEQ ID NO: 831319 - RNA, 22 nt, Human
gagcugccaguguaugaauucu

SEQ ID NO: 831320 - RNA, 23 nt, Human
cauuucaacgaauuuuccuucug

SEQ ID NO: 831321 - RNA, 22 nt, Human
ucagaguguggugagaugugca

SEQ ID NO: 831322 - RNA, 22 nt, Human
cagcaucuuucucuucuggagu

SEQ ID NO: 831323 - RNA, 22 nt, Human
gcauuccugagaaugcagagug

SEQ ID NO: 831324 - RNA, 22 nt, Human
aauguuguuuuucugcaugucu

SEQ ID NO: 831325 - RNA, 22 nt, Human
gcucuguguugucagaggcacc

SEQ ID NO: 831326 - RNA, 22 nt, Human
ccuguucacccuccaugcacag

SEQ ID NO: 831327 - RNA, 22 nt, Human
cccuggagcuagucugagcaga

SEQ ID NO: 831328 - RNA, 22 nt, Human
agucaccaucuguggcagccug

SEQ ID NO: 831329 - RNA, 22 nt, Human
cugcuuuguggaaucacacugg

SEQ ID NO: 831330 - RNA, 22 nt, Human
cugccagucuaugcugcucggc

SEQ ID NO: 831331 - RNA, 22 nt, Human
gaugcacagugacccugccagu

SEQ ID NO: 831332 - RNA, 22 nt, Human
accugccucagugcagcuggau

SEQ ID NO: 831333 - RNA, 22 nt, Human
ucucaggaagauuagggcuaag

SEQ ID NO: 831334 - RNA, 22 nt, Human
cuguaaauaugaagaauauaug

SEQ ID NO: 831335 - RNA, 22 nt, Human
gcccaggaguuggaggcugcag

SEQ ID NO: 831336 - RNA, 22 nt, Human
ucucuuccaguaagagucuuua

SEQ ID NO: 831337 - RNA, 22 nt, Human
guguauaacuaucuaucuagua

SEQ ID NO: 831338 - RNA, 22 nt, Human
uggagccagcccaggccccucu

SEQ ID NO: 831339 - RNA, 22 nt, Human
aggcagcugcccucuccuuccu

SEQ ID NO: 831340 - RNA, 22 nt, Human
uuuuacuuaauucuuggucaug

SEQ ID NO: 831341 - RNA, 22 nt, Human
uaugagaaucugcaguaugcuu

SEQ ID NO: 831342 - RNA, 19 nt, Human
gcauuucucuuuacagcca

SEQ ID NO: 831343 - RNA, 22 nt, Human
ggcuggcacucuguccaguguc

SEQ ID NO: 831344 - RNA, 22 nt, Human
uugaagcagcucaggaggcuua

SEQ ID NO: 831345 - RNA, 22 nt, Human
cuucccuuggugaacagagcau

SEQ ID NO: 831346 - RNA, 22 nt, Human
uuuuuugucuugaagaaauggu

SEQ ID NO: 831347 - RNA, 22 nt, Human
uuuuuccuagugcuuucuggua

SEQ ID NO: 831348 - RNA, 22 nt, Human
aggucauuccuugucuucuugc

SEQ ID NO: 831349 - RNA, 20 nt, Human
agaggaggauuauuuuauuc

SEQ ID NO: 831350 - RNA, 22 nt, Human
uuuuggucagguuggucucgaa

SEQ ID NO: 831351 - RNA, 22 nt, Human
ucucagagccuaacuaaccuaa

SEQ ID NO: 831352 - RNA, 22 nt, Human
uccccagccgugaaggagagga

SEQ ID NO: 831353 - RNA, 22 nt, Human
uucagcagucguccaggaaaag

SEQ ID NO: 831354 - RNA, 22 nt, Human
gcugucacacaugggaucucag

SEQ ID NO: 831355 - RNA, 22 nt, Human
uguaugaagccagaaucuguuu

SEQ ID NO: 831356 - RNA, 22 nt, Human
gaggcaguuccugagugacaag

SEQ ID NO: 831357 - RNA, 22 nt, Human
cagcuggccugaucccuguggc

SEQ ID NO: 831358 - RNA, 17 nt, Human
uccuucagggccucaca

SEQ ID NO: 831359 - RNA, 22 nt, Human
cugagcuuccaguuccuccagg

SEQ ID NO: 831360 - RNA, 21 nt, Human
gccugccugcgugacccucuu

SEQ ID NO: 831361 - RNA, 22 nt, Human
ggcaccugcucaucuggacuca

SEQ ID NO: 831362 - RNA, 22 nt, Human
gcagcuguggguuccaagucua

SEQ ID NO: 831363 - RNA, 22 nt, Human
cauuguuaccaucuuuuaccua

SEQ ID NO: 831364 - RNA, 22 nt, Human
ugaugcugagccugggacugac

SEQ ID NO: 831365 - RNA, 20 nt, Human
ccugucugcaauggagguca

SEQ ID NO: 831366 - RNA, 22 nt, Human
uguaugcaccauuguauuaccu

SEQ ID NO: 831367 - RNA, 22 nt, Human
guaaacauuacugugcuguaua

SEQ ID NO: 831368 - RNA, 22 nt, Human
gcauguguuauuuuauguauga

SEQ ID NO: 831369 - RNA, 23 nt, Human
ggagugcaauggcgccaucucgg

SEQ ID NO: 831370 - RNA, 22 nt, Human
ugagaacugaggauuugaauuc

SEQ ID NO: 831371 - RNA, 22 nt, Human
uaaaauugcggugaauauuucc

SEQ ID NO: 831372 - RNA, 22 nt, Human
uauguguaggaggaggacaggg

SEQ ID NO: 831373 - RNA, 23 nt, Human
ucuggcucuaugugacagcucuc

SEQ ID NO: 831374 - RNA, 22 nt, Human
gaauauuuucaguacagauggu

SEQ ID NO: 831375 - RNA, 22 nt, Human
aaaucaguucacguucugaggu

SEQ ID NO: 831376 - RNA, 22 nt, Human
cauggcccucuucuggagcaau

SEQ ID NO: 831377 - RNA, 22 nt, Human
uucauauauaugcacuacguac

SEQ ID NO: 831378 - RNA, 22 nt, Human
ggaugcugggagacagcaggca

SEQ ID NO: 831379 - RNA, 22 nt, Human
ucagacaguuugcagugugccu

SEQ ID NO: 831380 - RNA, 22 nt, Human
ucaaacuagccugacugguauu

SEQ ID NO: 831381 - RNA, 22 nt, Human
auguuuauguugggcuauauuu

SEQ ID NO: 831382 - RNA, 22 nt, Human
cacaauuuggugcuaaagaaag

SEQ ID NO: 831383 - RNA, 22 nt, Human
ugccagcuccgaggagcugcag

SEQ ID NO: 831384 - RNA, 19 nt, Human
ccaguagagacagcugcag

SEQ ID NO: 831385 - RNA, 22 nt, Human
uggguggcacuucuggggucca

SEQ ID NO: 831386 - RNA, 22 nt, Human
gugccugggguugagcuaugaa

SEQ ID NO: 831387 - RNA, 22 nt, Human
aucagaaaauacccaguguuua

SEQ ID NO: 831388 - RNA, 22 nt, Human
aggcacugaccugcuuccuuga

SEQ ID NO: 831389 - RNA, 22 nt, Human
caggccacaaguuggguucaag

SEQ ID NO: 831390 - RNA, 22 nt, Human
uggcccugucccuggagccugg

SEQ ID NO: 831391 - RNA, 22 nt, Human
uaggccagaggagcagcuuugg

SEQ ID NO: 831392 - RNA, 22 nt, Human
ucuggaucucccucauccuggg

SEQ ID NO: 831393 - RNA, 22 nt, Human
ucugggaacagccuggcugugu

SEQ ID NO: 831394 - RNA, 22 nt, Human
gcuuccugagaaacaaucugau

SEQ ID NO: 831395 - RNA, 22 nt, Human
aguaaaaucuuaagcacagugg

SEQ ID NO: 831396 - RNA, 22 nt, Human
cuccucugucuggcccugagcc

SEQ ID NO: 831397 - RNA, 20 nt, Human
gcacugaagguuccagggga

SEQ ID NO: 831398 - RNA, 22 nt, Human
ggucagggcucuuccaguggcu

SEQ ID NO: 831399 - RNA, 22 nt, Human
aggcacugugcagucccaagca

SEQ ID NO: 831400 - RNA, 22 nt, Human
uccagccaugacucggacagug

SEQ ID NO: 831401 - RNA, 22 nt, Human
cccagcucaagcagagagcuaa

SEQ ID NO: 831402 - RNA, 22 nt, Human
ccagggcaacgcugucucagag

SEQ ID NO: 831403 - RNA, 22 nt, Human
uuacagaaucuacucgugguga

SEQ ID NO: 831404 - RNA, 22 nt, Human
uuagauaaauuaagacuuuaca

SEQ ID NO: 831405 - RNA, 23 nt, Human
accaggagaaaagcuuugcggga

SEQ ID NO: 831406 - RNA, 22 nt, Human
uucuggaguauuccuggcaccu

SEQ ID NO: 831407 - RNA, 22 nt, Human
gaaggaagucauuagugcagac

SEQ ID NO: 831408 - RNA, 22 nt, Human
aaagaggaaccaagagcacgug

SEQ ID NO: 831409 - RNA, 22 nt, Human
gcaggagagccagcaggcuucc

SEQ ID NO: 831410 - RNA, 22 nt, Human
uagggcagccacccaggcugcu

SEQ ID NO: 831411 - RNA, 22 nt, Human
gauggcagucaaccaggugagg

SEQ ID NO: 831412 - RNA, 22 nt, Human
agcuggccuguuagagcugagu

SEQ ID NO: 831413 - RNA, 22 nt, Human
ggagggcaucaaucaggccugg

SEQ ID NO: 831414 - RNA, 22 nt, Human
gcagaauuggauaguugugaua

SEQ ID NO: 831415 - RNA, 22 nt, Human
aauucuaaauguaauuuagaau

SEQ ID NO: 831416 - RNA, 22 nt, Human
auaaaaguaggaccaacuuaca

SEQ ID NO: 831417 - RNA, 22 nt, Human
augcaguaaaauaggagguaau

SEQ ID NO: 831418 - RNA, 22 nt, Human
agagccaggcggcugggcaccu

SEQ ID NO: 831419 - RNA, 22 nt, Human
gucccugcaucaccacgggacu

SEQ ID NO: 831420 - RNA, 22 nt, Human
auaaucuuucuuuuccagauag

SEQ ID NO: 831421 - RNA, 22 nt, Human
cugcucuagagagcauuaguca

SEQ ID NO: 831422 - RNA, 22 nt, Human
aggcaguggagcuggaauaggc

SEQ ID NO: 831423 - RNA, 22 nt, Human
ccagcagcccucuuccaagacu

SEQ ID NO: 831424 - RNA, 22 nt, Human
agcugcccugguaagauugaug

SEQ ID NO: 831425 - RNA, 22 nt, Human
aauguguagauguugcauuccu

SEQ ID NO: 831426 - RNA, 22 nt, Human
aggcagcaugcucugcuucuac

SEQ ID NO: 831427 - RNA, 21 nt, Human
ugagccaggcugacggcugug

SEQ ID NO: 831428 - RNA, 22 nt, Human
gcaaagcugggugugaaugcac

SEQ ID NO: 831429 - RNA, 22 nt, Human
caggcugcagcagcaguggccc

SEQ ID NO: 831430 - RNA, 21 nt, Human
uggaaagauucaaagaccagg

SEQ ID NO: 831431 - RNA, 22 nt, Human
aaggagugcaugacucagagua

SEQ ID NO: 831432 - RNA, 22 nt, Human
agcugcccuggcggagcugcuc

SEQ ID NO: 831433 - RNA, 22 nt, Human
ccaggagcauuaagagaacaua

SEQ ID NO: 831434 - RNA, 22 nt, Human
gggcagcucggaagugggaaag

SEQ ID NO: 831435 - RNA, 22 nt, Human
aaugccaacuuggauauacauu

SEQ ID NO: 831436 - RNA, 22 nt, Human
agugacagcugggaaggugaaa

SEQ ID NO: 831437 - RNA, 22 nt, Human
uaugucaaaguuaagaaauagg

SEQ ID NO: 831438 - RNA, 17 nt, Human
gcgcagcuccuggcgcg

SEQ ID NO: 831439 - RNA, 22 nt, Human
aagcccagaugugagaacugag

SEQ ID NO: 831440 - RNA, 21 nt, Human
aagcuucccugcucuccaggg

SEQ ID NO: 831441 - RNA, 20 nt, Human
ugcagggcucugcuucucuc

SEQ ID NO: 831442 - RNA, 22 nt, Human
cccuguccuuggcugugaggcu

SEQ ID NO: 831443 - RNA, 22 nt, Human
aguuauccgaaggcacugagau

SEQ ID NO: 831444 - RNA, 22 nt, Human
ucucacucauuuccuaggucuu

SEQ ID NO: 831445 - RNA, 22 nt, Human
ggcaggagauaaaauauuaguu

SEQ ID NO: 831446 - RNA, 20 nt, Human
ucuguacacucaucuucugc

SEQ ID NO: 831447 - RNA, 22 nt, Human
cugugcauugucuugucuguag

SEQ ID NO: 831448 - RNA, 22 nt, Human
ucugaggccccugggcaggaug

SEQ ID NO: 831449 - RNA, 22 nt, Human
ugcaugcauaaauguacacaca

SEQ ID NO: 831450 - RNA, 22 nt, Human
aguuaaagucugaaauagagaa

SEQ ID NO: 831451 - RNA, 22 nt, Human
uuauuauugugaccugagaaug

SEQ ID NO: 831452 - RNA, 22 nt, Human
uggcucugcugaaccuagugca

SEQ ID NO: 831453 - RNA, 22 nt, Human
gaggcagcauucgcauagacag

SEQ ID NO: 831454 - RNA, 22 nt, Human
aagugguagacaaagauaauug

SEQ ID NO: 831455 - RNA, 22 nt, Human
uugcucugacuggagugcagug

SEQ ID NO: 831456 - RNA, 22 nt, Human
guggcugcuaagucuccuuccu

SEQ ID NO: 831457 - RNA, 22 nt, Human
augacacaauuuuagagcugaa

SEQ ID NO: 831458 - RNA, 22 nt, Human
gcguaaggccucuggucucgga

SEQ ID NO: 831459 - RNA, 22 nt, Human
ggcagugguuagaaacaugagc

SEQ ID NO: 831460 - RNA, 22 nt, Human
ugcaguggaggccgugagacag

SEQ ID NO: 831461 - RNA, 22 nt, Human
ugagcuuccucccugcauccau

SEQ ID NO: 831462 - RNA, 22 nt, Human
ucaggagauguaaccuuagcug

SEQ ID NO: 831463 - RNA, 22 nt, Human
ggcuuucuagaucuagcucugu

SEQ ID NO: 831464 - RNA, 22 nt, Human
augcacccagugucuggacuau

SEQ ID NO: 831465 - RNA, 22 nt, Human
uuaacacuugaacucuacaugu

SEQ ID NO: 831466 - RNA, 22 nt, Human
ccagggcauccucacaucgcag

SEQ ID NO: 831467 - RNA, 22 nt, Human
gugcuucucuucacacccaacu

SEQ ID NO: 831468 - RNA, 22 nt, Human
aaaguucuuucucuuauuuggu

SEQ ID NO: 831469 - RNA, 22 nt, Human
gcccucagaugggaaaggaggg

SEQ ID NO: 831470 - RNA, 22 nt, Human
uggaggcauuuuagguugucac

SEQ ID NO: 831471 - RNA, 22 nt, Human
ucugcucuaguugcuuccugcc

SEQ ID NO: 831472 - RNA, 19 nt, Human
gugcuuuuuaagagcucag

SEQ ID NO: 831473 - RNA, 22 nt, Human
ccaaagagcuagaauuauaggc

SEQ ID NO: 831474 - RNA, 22 nt, Human
uagugcuuuaggccugaguguc

SEQ ID NO: 831475 - RNA, 22 nt, Human
auucaaauuaaguuaauucagc

SEQ ID NO: 831476 - RNA, 22 nt, Human
uguacaguaggaacuuguuauu

SEQ ID NO: 831477 - RNA, 22 nt, Human
gcugcucuacccaugcaucugu

SEQ ID NO: 831478 - RNA, 22 nt, Human
aaugagcugcugcuguuccacc

SEQ ID NO: 831479 - RNA, 22 nt, Human
aggcaaaauuacaaaguuauua

SEQ ID NO: 831480 - RNA, 23 nt, Human
cagaaauaaacugguuuguagau

SEQ ID NO: 831481 - RNA, 23 nt, Human
uggcagagacccagaaucuacau

SEQ ID NO: 831482 - RNA, 22 nt, Human
ucaagcaucuuggucuacgauc

SEQ ID NO: 831483 - RNA, 22 nt, Human
uugcauugaaaauauauuuuaa

SEQ ID NO: 831484 - RNA, 22 nt, Human
acauuugucuucuuucagauua

SEQ ID NO: 831485 - RNA, 22 nt, Human
gggagagagagcucauguugaa

SEQ ID NO: 831486 - RNA, 22 nt, Human
ucugccuguucaagucuucuag

SEQ ID NO: 831487 - RNA, 22 nt, Human
aaguuugcauagauuaagcauu

SEQ ID NO: 831488 - RNA, 22 nt, Human
aagccagauuucacucuuaauu

SEQ ID NO: 831489 - RNA, 22 nt, Human
uuuggaauuggaaagugcugug

SEQ ID NO: 831490 - RNA, 22 nt, Human
uaguccaguaaaacagcuaacg

SEQ ID NO: 831491 - RNA, 22 nt, Human
uaaugcuuaacagcuggcuuuu

SEQ ID NO: 831492 - RNA, 22 nt, Human
uuuuauguuccucuuuaugcga

SEQ ID NO: 831493 - RNA, 22 nt, Human
ucuuuccuacuuuauugugaac

SEQ ID NO: 831494 - RNA, 22 nt, Human
ucauugcaguugaguuguguua

SEQ ID NO: 831495 - RNA, 21 nt, Human
gcaggcuggucaaaccucagu

SEQ ID NO: 831496 - RNA, 22 nt, Human
gucucagaguccuacuuauucc

SEQ ID NO: 831497 - RNA, 21 nt, Human
uagagaaaagaagcuguuccu

SEQ ID NO: 831498 - RNA, 22 nt, Human
cuggggcugcagcgaucuucau

SEQ ID NO: 831499 - RNA, 22 nt, Human
ucucagggagggcgagucagcg

SEQ ID NO: 831500 - RNA, 21 nt, Human
auagaacaccaggcauauaua

SEQ ID NO: 831501 - RNA, 22 nt, Human
ggauucuaacugaacagaauau

SEQ ID NO: 831502 - RNA, 22 nt, Human
uaagaaacccaggaauuucuua

SEQ ID NO: 831503 - RNA, 22 nt, Human
gaggccacagcuaucagggaca

SEQ ID NO: 831504 - RNA, 22 nt, Human
uuuaauauucugcauucuccuu

SEQ ID NO: 831505 - RNA, 22 nt, Human
ggguccagacacuccagaggaa

SEQ ID NO: 831506 - RNA, 22 nt, Human
acccaggacaugggcacccgug

SEQ ID NO: 831507 - RNA, 22 nt, Human
uuccaagagcuuuaauuguuga

SEQ ID NO: 831508 - RNA, 22 nt, Human
gcagggcaugggcccugucugc

SEQ ID NO: 831509 - RNA, 22 nt, Human
guguaugagccuccagcugggc

SEQ ID NO: 831510 - RNA, 22 nt, Human
cacugagcugauagaauuccag

SEQ ID NO: 831511 - RNA, 22 nt, Human
gccaggcagccacccucugcga

SEQ ID NO: 831512 - RNA, 22 nt, Human
gggauuuaguaggauaguauac

SEQ ID NO: 831513 - RNA, 22 nt, Human
ucaugcacaugugucaccauca

SEQ ID NO: 831514 - RNA, 20 nt, Human
uccugggguaagccaugguc

SEQ ID NO: 831515 - RNA, 22 nt, Human
ucaggagagaaagaauacaauu

SEQ ID NO: 831516 - RNA, 22 nt, Human
gggccaggucggugaaugguca

SEQ ID NO: 831517 - RNA, 22 nt, Human
gcuggugcauuagcugcaguuc

SEQ ID NO: 831518 - RNA, 22 nt, Human
ccagugcuaagguagccucugc

SEQ ID NO: 831519 - RNA, 22 nt, Human
uagaaacaaugacaugcuugua

SEQ ID NO: 831520 - RNA, 21 nt, Human
augucaaaugcuuuauuuuau

SEQ ID NO: 831521 - RNA, 22 nt, Human
cagacacagauaugcauauggc

SEQ ID NO: 831522 - RNA, 22 nt, Human
aauguugagcuugaaaguaggu

SEQ ID NO: 831523 - RNA, 22 nt, Human
auggaaagccaguguuccauca

SEQ ID NO: 831524 - RNA, 22 nt, Human
uagggaggcuacuucuuguagg

SEQ ID NO: 831525 - RNA, 22 nt, Human
auuaaacugagcaaauuaacau

SEQ ID NO: 831526 - RNA, 22 nt, Human
augucuuucucacagccaguuc

SEQ ID NO: 831527 - RNA, 22 nt, Human
auaagguaugaaaaguaaaugg

SEQ ID NO: 831528 - RNA, 22 nt, Human
aagcaauauacugauaugauua

SEQ ID NO: 831529 - RNA, 20 nt, Human
gugugaagcccucaggagga

SEQ ID NO: 831530 - RNA, 22 nt, Human
cuauuucaaggcccagauauga

SEQ ID NO: 831531 - RNA, 22 nt, Human
uccuccagugucuggggccuug

SEQ ID NO: 831532 - RNA, 22 nt, Human
cucugagcagaggccguggcua

SEQ ID NO: 831533 - RNA, 22 nt, Human
gcugcccacaaugauuacaugg

SEQ ID NO: 831534 - RNA, 22 nt, Human
uggaggggcaauggagcgcgga

SEQ ID NO: 831535 - RNA, 23 nt, Human
aggcagcuggguagcaucuuucu

SEQ ID NO: 831536 - RNA, 22 nt, Human
augggaguuuucucugaugcuc

SEQ ID NO: 831537 - RNA, 22 nt, Human
cugcugcucagugucaucaugu

SEQ ID NO: 831538 - RNA, 22 nt, Human
ucaggagagaguuggguaggcu

SEQ ID NO: 831539 - RNA, 22 nt, Human
uaagauaaguggguugagaugg

SEQ ID NO: 831540 - RNA, 22 nt, Human
uuucagaaagcugaacauauga

SEQ ID NO: 831541 - RNA, 22 nt, Human
uggaaggagcuaaggaccuggg

SEQ ID NO: 831542 - RNA, 22 nt, Human
ggcagccagagggcagcuggau

SEQ ID NO: 831543 - RNA, 22 nt, Human
uucugucagaagcuagcuccug

SEQ ID NO: 831544 - RNA, 22 nt, Human
uuuuugcugauaagcagaauuc

SEQ ID NO: 831545 - RNA, 22 nt, Human
auccuuagaagggagugaggac

SEQ ID NO: 831546 - RNA, 22 nt, Human
uuccuguaugucagugaagagc

SEQ ID NO: 831547 - RNA, 22 nt, Human
aucuggcucccuuggaauccgu

SEQ ID NO: 831548 - RNA, 21 nt, Human
uccaggagcacgggacuagga

SEQ ID NO: 831549 - RNA, 22 nt, Human
aucuugcauuugcuaaaaugca

SEQ ID NO: 831550 - RNA, 22 nt, Human
gaaugaauucagcacauggaau

SEQ ID NO: 831551 - RNA, 22 nt, Human
cuggcuggccggagcgaggcgg

SEQ ID NO: 831552 - RNA, 22 nt, Human
ccucagggucugaggagaccgu

SEQ ID NO: 831553 - RNA, 22 nt, Human
acauuucucagguaagucauuu

SEQ ID NO: 831554 - RNA, 22 nt, Human
aacauucuauuuugcuaaaaca

SEQ ID NO: 831555 - RNA, 22 nt, Human
auugucuguacuuuaaaaaugu

SEQ ID NO: 831556 - RNA, 22 nt, Human
gcaucuaaauaaacgugggagu

SEQ ID NO: 831557 - RNA, 22 nt, Human
aggcugcugccuuggagagugu

SEQ ID NO: 831558 - RNA, 22 nt, Human
uauuucagacacugaucuugca

SEQ ID NO: 831559 - RNA, 22 nt, Human
gguagcacauugcauuaggaga

SEQ ID NO: 831560 - RNA, 22 nt, Human
gugagcaggauuucauggugua

SEQ ID NO: 831561 - RNA, 22 nt, Human
cuaaaauuaucaagauaauucc

SEQ ID NO: 831562 - RNA, 22 nt, Human
ugucucugaacagcuuacuaaa

SEQ ID NO: 831563 - RNA, 22 nt, Human
gccuccugguugcuucuccaac

SEQ ID NO: 831564 - RNA, 22 nt, Human
uggcagaguucgcuccuauuca

SEQ ID NO: 831565 - RNA, 22 nt, Human
cagagcugcagauugaaggcau

SEQ ID NO: 831566 - RNA, 22 nt, Human
uuacagaaguauugagagaucc

SEQ ID NO: 831567 - RNA, 22 nt, Human
cacugaguucccugacauuuca

SEQ ID NO: 831568 - RNA, 22 nt, Human
agcugccacagagccuggccag

SEQ ID NO: 831569 - RNA, 22 nt, Human
cugauacauaguagcaugucau

SEQ ID NO: 831570 - RNA, 22 nt, Human
cgugucaucugagccuugggcg

SEQ ID NO: 831571 - RNA, 22 nt, Human
ggcagggguccugguguugacu

SEQ ID NO: 831572 - RNA, 22 nt, Human
gcuggagccaagcugcucuugg

SEQ ID NO: 831573 - RNA, 22 nt, Human
cauuuguaucugggcugcugug

SEQ ID NO: 831574 - RNA, 22 nt, Human
guguguccaggcgggagucaag

SEQ ID NO: 831575 - RNA, 22 nt, Human
cagagccccucagcucucuccc

SEQ ID NO: 831576 - RNA, 22 nt, Human
cacagcuggugcacuagcucug

SEQ ID NO: 831577 - RNA, 22 nt, Human
augggggccugaacaggcaaaa

SEQ ID NO: 831578 - RNA, 18 nt, Human
ccuggcuuccaucuuggu

SEQ ID NO: 831579 - RNA, 22 nt, Human
ccagcugggauuaagggaaaau

SEQ ID NO: 831580 - RNA, 22 nt, Human
ggagaccagaaggaagcuucga

SEQ ID NO: 831581 - RNA, 22 nt, Human
acaaaugcuuaguucaccaaaa

SEQ ID NO: 831582 - RNA, 22 nt, Human
cuucucagaucucagcuuugag

SEQ ID NO: 831583 - RNA, 22 nt, Human
ucuucauuuuacaggcagaccu

SEQ ID NO: 831584 - RNA, 17 nt, Human
cauguguaugugggagu

SEQ ID NO: 831585 - RNA, 23 nt, Human
ggcagagagcauggcuggggccc

SEQ ID NO: 831586 - RNA, 22 nt, Human
aggagaggaaucauuauuacaa

SEQ ID NO: 831587 - RNA, 22 nt, Human
auagaaaacagauguccuuaaa

SEQ ID NO: 831588 - RNA, 22 nt, Human
ggcugcagaaguacuuccggau

SEQ ID NO: 831589 - RNA, 18 nt, Human
ucuuggaguaaugaucaa

SEQ ID NO: 831590 - RNA, 22 nt, Human
aagcagaaaaacugagcuccaa

SEQ ID NO: 831591 - RNA, 22 nt, Human
guuaggcaguuuucuucauucu

SEQ ID NO: 831592 - RNA, 22 nt, Human
aauuuccagaucagaugacuca

SEQ ID NO: 831593 - RNA, 22 nt, Human
gugcagugagcagugcagcacc

SEQ ID NO: 831594 - RNA, 22 nt, Human
uguaugcuuguguauaauauaa

SEQ ID NO: 831595 - RNA, 22 nt, Human
aacauuuaugguagucauugca

SEQ ID NO: 831596 - RNA, 22 nt, Human
gggaaggagguggcuugaagug

SEQ ID NO: 831597 - RNA, 22 nt, Human
ucuacuauguuucuuaaauaga

SEQ ID NO: 831598 - RNA, 22 nt, Human
gaggcugcuuugaugacaggag

SEQ ID NO: 831599 - RNA, 22 nt, Human
acaaaugcagcauaaagugaac

SEQ ID NO: 831600 - RNA, 22 nt, Human
ccagccaggcauugcaaacuga

SEQ ID NO: 831601 - RNA, 22 nt, Human
cagcuccugccugggcagcugu

SEQ ID NO: 831602 - RNA, 22 nt, Human
cagggcucaucugugugaccag

SEQ ID NO: 831603 - RNA, 19 nt, Human
acaaagcugugagcagcuu

SEQ ID NO: 831604 - RNA, 22 nt, Human
cagcccaaagccccaggcuaga

SEQ ID NO: 831605 - RNA, 22 nt, Human
caggagcaaggagcagugggau

SEQ ID NO: 831606 - RNA, 22 nt, Human
cugagcugaaacuugagaggcu

SEQ ID NO: 831607 - RNA, 20 nt, Human
gccugcagagaaggucagag

SEQ ID NO: 831608 - RNA, 22 nt, Human
gggcccuggggccugauuugca

SEQ ID NO: 831609 - RNA, 22 nt, Human
uccuugaauugugccacuuacc

SEQ ID NO: 831610 - RNA, 22 nt, Human
agaagccaacagggcaggagag

SEQ ID NO: 831611 - RNA, 22 nt, Human
cagguggggcgcccucaggcag

SEQ ID NO: 831612 - RNA, 22 nt, Human
ucacaucuuauuagaguaucuc

SEQ ID NO: 831613 - RNA, 22 nt, Human
auccuugaaugacucugcccuc

SEQ ID NO: 831614 - RNA, 22 nt, Human
ugccuguguugauuacuuuguc

SEQ ID NO: 831615 - RNA, 22 nt, Human
ucagaaaagguagcugugacaa

SEQ ID NO: 831616 - RNA, 22 nt, Human
cagcugccacaggacuuucuga

SEQ ID NO: 831617 - RNA, 22 nt, Human
uaugcacacauuagcacagggu

SEQ ID NO: 831618 - RNA, 22 nt, Human
gcaaagguagccaaggagcuca

SEQ ID NO: 831619 - RNA, 23 nt, Human
acagcaagaggaccagaugugag

SEQ ID NO: 831620 - RNA, 22 nt, Human
ugucuguaagguguuuauguua

SEQ ID NO: 831621 - RNA, 22 nt, Human
auuugucucugcacuuuacuca

SEQ ID NO: 831622 - RNA, 22 nt, Human
aggccagcccugggcugagaga

SEQ ID NO: 831623 - RNA, 22 nt, Human
ggaucugagagcaagcaggacc

SEQ ID NO: 831624 - RNA, 22 nt, Human
aaguuuuaacaaguacuuacua

SEQ ID NO: 831625 - RNA, 22 nt, Human
ugccagcacuucuggcugucug

SEQ ID NO: 831626 - RNA, 22 nt, Human
acucccacuccagaguagaagc

SEQ ID NO: 831627 - RNA, 22 nt, Human
uuccugagggacuuuugagauu

SEQ ID NO: 831628 - RNA, 22 nt, Human
agggacacaugugauuauuuau

SEQ ID NO: 831629 - RNA, 22 nt, Human
gucaacuugcaagaugcugggc

SEQ ID NO: 831630 - RNA, 22 nt, Human
gcagguggauuaucagaagugc

SEQ ID NO: 831631 - RNA, 22 nt, Human
ugagguguguccccagggaggu

SEQ ID NO: 831632 - RNA, 22 nt, Human
agcugcugugugcucaggcagg

SEQ ID NO: 831633 - RNA, 22 nt, Human
agucaccauuuucaccugccuc

SEQ ID NO: 831634 - RNA, 22 nt, Human
caagaacaguuugccaaauugg

SEQ ID NO: 831635 - RNA, 22 nt, Human
aguguacauguuuacagcaucu

SEQ ID NO: 831636 - RNA, 22 nt, Human
auucuucaccauggauaauuug

SEQ ID NO: 831637 - RNA, 22 nt, Human
gaggcuggcagaaaagcacagg

SEQ ID NO: 831638 - RNA, 22 nt, Human
cuggagggugagccucaucucu

SEQ ID NO: 831639 - RNA, 22 nt, Human
uggcucagugcauucacaguaa

SEQ ID NO: 831640 - RNA, 22 nt, Human
aaacaaguguaaacuagucugu

SEQ ID NO: 831641 - RNA, 22 nt, Human
ugggcagaguagcucagaagaa

SEQ ID NO: 831642 - RNA, 22 nt, Human
cauguacauucuguagauggag

SEQ ID NO: 831643 - RNA, 22 nt, Human
ucuacuuuucccuauacaguuu

SEQ ID NO: 831644 - RNA, 22 nt, Human
gggagagaugcugauugccaau

SEQ ID NO: 831645 - RNA, 22 nt, Human
gcuggagcugcagccugggccu

SEQ ID NO: 831646 - RNA, 22 nt, Human
agauucuacucuagauccaugg

SEQ ID NO: 831647 - RNA, 22 nt, Human
cucuuuccucagccacagucua

SEQ ID NO: 831648 - RNA, 22 nt, Human
aauacauguuuucuacuauucu

SEQ ID NO: 831649 - RNA, 20 nt, Human
cccagggaccugagcuccau

SEQ ID NO: 831650 - RNA, 22 nt, Human
ugcucuguaaggucagaaaagg

SEQ ID NO: 831651 - RNA, 22 nt, Human
aggguauaaagagcaagcagaa

SEQ ID NO: 831652 - RNA, 22 nt, Human
agagccugugggagaugcagcu

SEQ ID NO: 831653 - RNA, 22 nt, Human
aaucaguucuacaucuuaucca

SEQ ID NO: 831654 - RNA, 22 nt, Human
gagagcugggaaagccguggag

SEQ ID NO: 831655 - RNA, 22 nt, Human
gauuuccuaauguggaucucug

SEQ ID NO: 831656 - RNA, 22 nt, Human
aagccagccagugccagucuua

SEQ ID NO: 831657 - RNA, 22 nt, Human
aacagaaaucauuuagggcucu

SEQ ID NO: 831658 - RNA, 22 nt, Human
gccuggagcucaugugggcauu

SEQ ID NO: 831659 - RNA, 22 nt, Human
ugagccugguugcagugucugg

SEQ ID NO: 831660 - RNA, 18 nt, Human
aaugcacacauuuacucc

SEQ ID NO: 831661 - RNA, 22 nt, Human
ugcuuaauauugugauguaaua

SEQ ID NO: 831662 - RNA, 22 nt, Human
caguacuucuuggaaacuggau

SEQ ID NO: 831663 - RNA, 20 nt, Human
ugugcccaauguccagguuc

SEQ ID NO: 831664 - RNA, 22 nt, Human
gggagggaagguaccuguguga

SEQ ID NO: 831665 - RNA, 22 nt, Human
gcagcuggucuggccuagagua

SEQ ID NO: 831666 - RNA, 22 nt, Human
auagacuugguuaguaaauuug

SEQ ID NO: 831667 - RNA, 22 nt, Human
gccuggcccagggcuccgcagg

SEQ ID NO: 831668 - RNA, 22 nt, Human
cugcagagcauaaaucugaaua

SEQ ID NO: 831669 - RNA, 22 nt, Human
auggggagagaagggcugagcu

SEQ ID NO: 831670 - RNA, 22 nt, Human
auguauccuuauacacauuuau

SEQ ID NO: 831671 - RNA, 22 nt, Human
cacaaaugguuguagacauuaa

SEQ ID NO: 831672 - RNA, 22 nt, Human
ucuccucaccaccagcagcaga

SEQ ID NO: 831673 - RNA, 19 nt, Human
augucuguugaauuucaua

SEQ ID NO: 831674 - RNA, 22 nt, Human
guccucuggugaaagcauuccc

SEQ ID NO: 831675 - RNA, 22 nt, Human
uggaaagagguagaggaucugg

SEQ ID NO: 831676 - RNA, 20 nt, Human
cagagaccugucuucacaga

SEQ ID NO: 831677 - RNA, 22 nt, Human
uauuuccaagcugaauccaaug

SEQ ID NO: 831678 - RNA, 22 nt, Human
ugaucagucccaugaucuucca

SEQ ID NO: 831679 - RNA, 23 nt, Human
agggcugaugccauugcagcucu

SEQ ID NO: 831680 - RNA, 22 nt, Human
aggcaucugaguuugcaagcuu

SEQ ID NO: 831681 - RNA, 22 nt, Human
cagggccaccguguuugcugcu

SEQ ID NO: 831682 - RNA, 22 nt, Human
auguagcaucuauccugauaaa

SEQ ID NO: 831683 - RNA, 22 nt, Human
uggagcaggccggaaguggcuu

SEQ ID NO: 831684 - RNA, 22 nt, Human
uuuccaagacuccaguucuccc

SEQ ID NO: 831685 - RNA, 22 nt, Human
gcugcucugugacagccuccgg

SEQ ID NO: 831686 - RNA, 19 nt, Human
aaagcagaggagcaucuga

SEQ ID NO: 831687 - RNA, 19 nt, Human
cccucaggucugagcaguc

SEQ ID NO: 831688 - RNA, 20 nt, Human
aggcagacaaggagucuguu

SEQ ID NO: 831689 - RNA, 22 nt, Human
agcugcccccagggcugugcuu

SEQ ID NO: 831690 - RNA, 22 nt, Human
uggauuuauuagguuggugaaa

SEQ ID NO: 831691 - RNA, 22 nt, Human
caagggaccugagauggucucu

SEQ ID NO: 831692 - RNA, 22 nt, Human
gccaggagagcuccuucagguu

SEQ ID NO: 831693 - RNA, 22 nt, Human
cagagguauugcaaaagccuag

SEQ ID NO: 831694 - RNA, 22 nt, Human
guccuggggauuauagaguguu

SEQ ID NO: 831695 - RNA, 19 nt, Human
uugaggggccaggggagau

SEQ ID NO: 831696 - RNA, 22 nt, Human
ucuguucaugaaauaucuuuuu

SEQ ID NO: 831697 - RNA, 22 nt, Human
auggcauuugaccgcuuugugg

SEQ ID NO: 831698 - RNA, 22 nt, Human
ucugcuguaaagaauuucugcc

SEQ ID NO: 831699 - RNA, 23 nt, Human
aggugcagcccuggaccugcccc

SEQ ID NO: 831700 - RNA, 21 nt, Human
uuagcaaagcaaacacaugcu

SEQ ID NO: 831701 - RNA, 17 nt, Human
aggccucccuccaggcc

SEQ ID NO: 831702 - RNA, 22 nt, Human
cagugguugguagauacuugag

SEQ ID NO: 831703 - RNA, 21 nt, Human
ugcagagauaucugaagcaga

SEQ ID NO: 831704 - RNA, 22 nt, Human
agccuucauaaucuugggcuuu

SEQ ID NO: 831705 - RNA, 22 nt, Human
agucuugcucuugcaucugcuu

SEQ ID NO: 831706 - RNA, 22 nt, Human
gauaugaaguggcauugugaag

SEQ ID NO: 831707 - RNA, 22 nt, Human
uauuccaaaaucccaaacugcc

SEQ ID NO: 831708 - RNA, 23 nt, Human
aguacauucgaaaaauucuguga

SEQ ID NO: 831709 - RNA, 20 nt, Human
ucugugugccaucaccuaac

SEQ ID NO: 831710 - RNA, 22 nt, Human
aauuucaaacucuugcccucag

SEQ ID NO: 831711 - RNA, 22 nt, Human
uguccuuaaggagcuuaauguc

SEQ ID NO: 831712 - RNA, 22 nt, Human
gcagcuggagccagccagacac

SEQ ID NO: 831713 - RNA, 22 nt, Human
acaugcuuguuuuucacaaccu

SEQ ID NO: 831714 - RNA, 22 nt, Human
guuguauucuucaauaucagag

SEQ ID NO: 831715 - RNA, 22 nt, Human
cagcacugcuucgcagccaggg

SEQ ID NO: 831716 - RNA, 22 nt, Human
caagaaucuugcagcuuagacu

SEQ ID NO: 831717 - RNA, 22 nt, Human
gcacagccacugagugagaacc

SEQ ID NO: 831718 - RNA, 22 nt, Human
ggagcagacauaaccuuacaga

SEQ ID NO: 831719 - RNA, 22 nt, Human
ccugccuggaucagccauccug

SEQ ID NO: 831720 - RNA, 22 nt, Human
agagcuggggccagagucaagg

SEQ ID NO: 831721 - RNA, 22 nt, Human
ucucagaggucuucagccucug

SEQ ID NO: 831722 - RNA, 22 nt, Human
aaggccugcucagcugucugug

SEQ ID NO: 831723 - RNA, 22 nt, Human
gcagugugaccgagcuugcuuc

SEQ ID NO: 831724 - RNA, 22 nt, Human
guucuucaaagugacaacuaaa

SEQ ID NO: 831725 - RNA, 22 nt, Human
aagagggcugcaaucuuauugc

SEQ ID NO: 831726 - RNA, 22 nt, Human
aggcaagcauuuaaccacucau

SEQ ID NO: 831727 - RNA, 22 nt, Human
ggguggaguagaaagaugaauu

SEQ ID NO: 831728 - RNA, 22 nt, Human
uaugaccuuaggaagcaagaag

SEQ ID NO: 831729 - RNA, 21 nt, Human
gauuugcagaaacuagacagg

SEQ ID NO: 831730 - RNA, 18 nt, Human
uggcucagauggcuuuaa

SEQ ID NO: 831731 - RNA, 22 nt, Human
uuugaagauuaugccagaguga

SEQ ID NO: 831732 - RNA, 22 nt, Human
acuccuggggcugccaucacag

SEQ ID NO: 831733 - RNA, 22 nt, Human
ucuguaucacccguucccagaa

SEQ ID NO: 831734 - RNA, 22 nt, Human
acccugggucauauacagugug

SEQ ID NO: 831735 - RNA, 21 nt, Human
agucuguuaggaugacucuga

SEQ ID NO: 831736 - RNA, 22 nt, Human
cauuccuuaacguggggagucu

SEQ ID NO: 831737 - RNA, 22 nt, Human
uauuucugaauccaaaagguca

SEQ ID NO: 831738 - RNA, 22 nt, Human
caaauguguaaggaaguguuag

SEQ ID NO: 831739 - RNA, 22 nt, Human
ggcagcuguaagaugagugaau

SEQ ID NO: 831740 - RNA, 22 nt, Human
uauacagaaccgccugaagucu

SEQ ID NO: 831741 - RNA, 22 nt, Human
gccaggugcauggcugagucuc

SEQ ID NO: 831742 - RNA, 22 nt, Human
uaucagaacacauguuuugcag

SEQ ID NO: 831743 - RNA, 22 nt, Human
uucuucaguguagcaacuguau

SEQ ID NO: 831744 - RNA, 22 nt, Human
uggcccgaccucugcucaugca

SEQ ID NO: 831745 - RNA, 22 nt, Human
cugccuuugcccuugacacugu

SEQ ID NO: 831746 - RNA, 22 nt, Human
gccauccucugagcacuaggca

SEQ ID NO: 831747 - RNA, 22 nt, Human
uggcuuccacugugugcccccu

SEQ ID NO: 831748 - RNA, 22 nt, Human
aaaguugugaaaccgaacaugu

SEQ ID NO: 831749 - RNA, 21 nt, Human
cagaggggcuagccuggcugc

SEQ ID NO: 831750 - RNA, 22 nt, Human
uugaggagcaggaugggaggcu

SEQ ID NO: 831751 - RNA, 22 nt, Human
cagggcccaagacacaaugagg

SEQ ID NO: 831752 - RNA, 22 nt, Human
aggaaagcucccaguagggcuc

SEQ ID NO: 831753 - RNA, 22 nt, Human
cuccuguauguugggcuucaca

SEQ ID NO: 831754 - RNA, 22 nt, Human
uagaaaugcaguguacuguguc

SEQ ID NO: 831755 - RNA, 22 nt, Human
cagucccaaggaggaagcaguc

SEQ ID NO: 831756 - RNA, 22 nt, Human
cacugaaggaaggacuacugca

SEQ ID NO: 831757 - RNA, 22 nt, Human
gauuuccaggucauuaauaaag

SEQ ID NO: 831758 - RNA, 22 nt, Human
uuugacagauccuuaacucagc

SEQ ID NO: 831759 - RNA, 22 nt, Human
augugaaauagcuggauaugaa

SEQ ID NO: 831760 - RNA, 22 nt, Human
cauuuacacuucuaaccacaag

SEQ ID NO: 831761 - RNA, 20 nt, Human
cugccuggaggccucuaccu

SEQ ID NO: 831762 - RNA, 22 nt, Human
ugcagcucugaacagucaugaa

SEQ ID NO: 831763 - RNA, 22 nt, Human
cuucucucugcauaggcauggg

SEQ ID NO: 831764 - RNA, 18 nt, Human
caggucagccuggccuca

SEQ ID NO: 831765 - RNA, 22 nt, Human
aguuauucauuuauucuguaca

SEQ ID NO: 831766 - RNA, 22 nt, Human
ggggcugggauuugaacccagg

SEQ ID NO: 831767 - RNA, 22 nt, Human
uggagacucugcaucugugaca

SEQ ID NO: 831768 - RNA, 22 nt, Human
aaaucaguaaauguucauuaac

SEQ ID NO: 831769 - RNA, 22 nt, Human
agcagggguaacagaaggaaag

SEQ ID NO: 831770 - RNA, 22 nt, Human
guuuaaucagaggaauuauaga

SEQ ID NO: 831771 - RNA, 22 nt, Human
ugaaaugaaacagaacauauca

SEQ ID NO: 831772 - RNA, 22 nt, Human
ugggcuggcccaccacaccucg

SEQ ID NO: 831773 - RNA, 18 nt, Human
cugaggcuggcaggagcc

SEQ ID NO: 831774 - RNA, 22 nt, Human
cugcugggcuccucaugugacu

SEQ ID NO: 831775 - RNA, 22 nt, Human
gagcagggccacuucuguaccu

SEQ ID NO: 831776 - RNA, 16 nt, Human
ccaccugcagcucuca

SEQ ID NO: 831777 - RNA, 22 nt, Human
aggcagcuuucagugucucuca

SEQ ID NO: 831778 - RNA, 22 nt, Human
ucauugcacuccagccugggca

SEQ ID NO: 831779 - RNA, 22 nt, Human
cacugaaggcuaggauuagaug

SEQ ID NO: 831780 - RNA, 22 nt, Human
gcagccuguuguaccagccugu

SEQ ID NO: 831781 - RNA, 23 nt, Human
uaguuauuuucucuguaauuugc

SEQ ID NO: 831782 - RNA, 22 nt, Human
cacauguaguaagcaggcaaug

SEQ ID NO: 831783 - RNA, 21 nt, Human
gcagccacagccaccaagcua

SEQ ID NO: 831784 - RNA, 22 nt, Human
caugucuggguauaugcauaug

SEQ ID NO: 831785 - RNA, 22 nt, Human
aauggcuucugaagcacacuuu

SEQ ID NO: 831786 - RNA, 22 nt, Human
aauuagagaucaguucuuugac

SEQ ID NO: 831787 - RNA, 22 nt, Human
ucuucuuccuccacagggccca

SEQ ID NO: 831788 - RNA, 22 nt, Human
uuuccucugggcccugccaccc

SEQ ID NO: 831789 - RNA, 22 nt, Human
ucccagcagggccgaccagccu

SEQ ID NO: 831790 - RNA, 22 nt, Human
aaaagacauaugugggcauucu

SEQ ID NO: 831791 - RNA, 22 nt, Human
acagagguaggacaugagauau

SEQ ID NO: 831792 - RNA, 22 nt, Human
ggagccagcagggugacacuga

SEQ ID NO: 831793 - RNA, 19 nt, Human
ugcuagaaauucugugacu

SEQ ID NO: 831794 - RNA, 22 nt, Human
uuagaacuuaaacuucagaaag

SEQ ID NO: 831795 - RNA, 22 nt, Human
ccagccugguucagaauuggcu

SEQ ID NO: 831796 - RNA, 22 nt, Human
gcaaggagacuguagggccaag

SEQ ID NO: 831797 - RNA, 19 nt, Human
ccuggguccacucagacua

SEQ ID NO: 831798 - RNA, 22 nt, Human
gcucucuggaggccauggacag

SEQ ID NO: 831799 - RNA, 22 nt, Human
acaacuuuguagcaauuccacg

SEQ ID NO: 831800 - RNA, 22 nt, Human
ucacauuuuaucuauuuuaagu

SEQ ID NO: 831801 - RNA, 22 nt, Human
uccuccuucgggacugcuugac

SEQ ID NO: 831802 - RNA, 22 nt, Human
ugggccuggacaaggccacuag

SEQ ID NO: 831803 - RNA, 22 nt, Human
uguggcucucaugcacucccag

SEQ ID NO: 831804 - RNA, 22 nt, Human
aaaggcuaugagauagaagaua

SEQ ID NO: 831805 - RNA, 22 nt, Human
ugcaauaaggaguaauaguaaa

SEQ ID NO: 831806 - RNA, 22 nt, Human
aaaagucagucucuccuagcuc

SEQ ID NO: 831807 - RNA, 22 nt, Human
uucuggagagaaaccuuacaaa

SEQ ID NO: 831808 - RNA, 22 nt, Human
cugugcccuggccaggccucuc

SEQ ID NO: 831809 - RNA, 22 nt, Human
uggccagguugggcuuugcagc

SEQ ID NO: 831810 - RNA, 22 nt, Human
gcauggcagugaggauggugcu

SEQ ID NO: 831811 - RNA, 22 nt, Human
ccagagccggauugugaagugc

SEQ ID NO: 831812 - RNA, 22 nt, Human
uuugucagucaugucugcuuuu

SEQ ID NO: 831813 - RNA, 22 nt, Human
gagcugccggcccacaguacua

SEQ ID NO: 831814 - RNA, 22 nt, Human
gcuggccugucuagagccuuac

SEQ ID NO: 831815 - RNA, 22 nt, Human
gagcacagcuggagguagcauu

SEQ ID NO: 831816 - RNA, 22 nt, Human
ccccaggacguggcccucauag

SEQ ID NO: 831817 - RNA, 22 nt, Human
uucuucaaaacaacacuggccu

SEQ ID NO: 831818 - RNA, 22 nt, Human
cucuucaaaagucuaauccuua

SEQ ID NO: 831819 - RNA, 22 nt, Human
aggucaaaccacagcucuaggc

SEQ ID NO: 831820 - RNA, 22 nt, Human
cauuugaaugagauugcuguaa

SEQ ID NO: 831821 - RNA, 21 nt, Human
uggcugccuacaugcugcagg

SEQ ID NO: 831822 - RNA, 22 nt, Human
uaucuuuaacuugcaguauuua

SEQ ID NO: 831823 - RNA, 22 nt, Human
agcagcuguggaaaaguaacua

SEQ ID NO: 831824 - RNA, 22 nt, Human
ugucagugguagacccagaggu

SEQ ID NO: 831825 - RNA, 22 nt, Human
uuggaaggugagucccuggguu

SEQ ID NO: 831826 - RNA, 19 nt, Human
uuucuuaggccuuuggccu

SEQ ID NO: 831827 - RNA, 22 nt, Human
cucugggcaaguuucuucauga

SEQ ID NO: 831828 - RNA, 21 nt, Human
gauuucacuuaccuucauuua

SEQ ID NO: 831829 - RNA, 22 nt, Human
uuaguaauguguuaauaugaau

SEQ ID NO: 831830 - RNA, 22 nt, Human
ugaauggucacugagcaucugu

SEQ ID NO: 831831 - RNA, 22 nt, Human
aagcagccuggacuugggcugg

SEQ ID NO: 831832 - RNA, 22 nt, Human
uuugauaagagcugcugaaacu

SEQ ID NO: 831833 - RNA, 22 nt, Human
gguacaaugucuuacagaccca

SEQ ID NO: 831834 - RNA, 22 nt, Human
aaaugcacacaccaggaaacua

SEQ ID NO: 831835 - RNA, 22 nt, Human
uucuuuucuuuaggcauugugu

SEQ ID NO: 831836 - RNA, 22 nt, Human
aggagcagaccguaguccugca

SEQ ID NO: 831837 - RNA, 22 nt, Human
ugaggcuguucuaccagggcca

SEQ ID NO: 831838 - RNA, 22 nt, Human
uuccauuuauucuuguccagau

SEQ ID NO: 831839 - RNA, 22 nt, Human
ccuggccacucagguguggggc

SEQ ID NO: 831840 - RNA, 22 nt, Human
ucacagaacaauguuuaguucu

SEQ ID NO: 831841 - RNA, 22 nt, Human
auacaucuugucagauucaugu

SEQ ID NO: 831842 - RNA, 22 nt, Human
caguggcagagaacagagaccu

SEQ ID NO: 831843 - RNA, 23 nt, Human
acugagccagggccugggucagc

SEQ ID NO: 831844 - RNA, 22 nt, Human
agugggaggcggcugacgggcg

SEQ ID NO: 831845 - RNA, 22 nt, Human
agcagggcuuugcagacuuggg

SEQ ID NO: 831846 - RNA, 22 nt, Human
ccuggagauuauuugguccaau

SEQ ID NO: 831847 - RNA, 22 nt, Human
uaucagaaggaagugccuuuaa

SEQ ID NO: 831848 - RNA, 22 nt, Human
gggcaugagagggcagcuggca

SEQ ID NO: 831849 - RNA, 22 nt, Human
ugacagaaauaguucuuaauuu

SEQ ID NO: 831850 - RNA, 22 nt, Human
cagagccccccuucugaucaca

SEQ ID NO: 831851 - RNA, 22 nt, Human
cgcugccaggucaccaggggua

SEQ ID NO: 831852 - RNA, 22 nt, Human
uuauuauuccccaagucauuau

SEQ ID NO: 831853 - RNA, 15 nt, Human
cuccaugauuuugca

SEQ ID NO: 831854 - RNA, 22 nt, Human
ccagccagcugcccuuggggcc

SEQ ID NO: 831855 - RNA, 22 nt, Human
acagagcaauaacagggagagg

SEQ ID NO: 831856 - RNA, 22 nt, Human
uguucaauccccagguccugaa

SEQ ID NO: 831857 - RNA, 22 nt, Human
guacagaauuaugccaugaggg

SEQ ID NO: 831858 - RNA, 22 nt, Human
uaggggugaggccaggcaucag

SEQ ID NO: 831859 - RNA, 22 nt, Human
caggcagcauuuacucugauga

SEQ ID NO: 831860 - RNA, 22 nt, Human
aggaguguggccagggcucugg

SEQ ID NO: 831861 - RNA, 22 nt, Human
agccaaagaucagugugcaagu

SEQ ID NO: 831862 - RNA, 22 nt, Human
ugacagaaugugacucucagau

SEQ ID NO: 831863 - RNA, 22 nt, Human
agaaaugcauuagcacauauag

SEQ ID NO: 831864 - RNA, 22 nt, Human
agccucucuuuauucccagcua

SEQ ID NO: 831865 - RNA, 22 nt, Human
aggcugcuucagcugcagggag

SEQ ID NO: 831866 - RNA, 22 nt, Human
cuacagaaaccuuuuucauaca

SEQ ID NO: 831867 - RNA, 22 nt, Human
aggaggccgauuucagaggucg

SEQ ID NO: 831868 - RNA, 20 nt, Human
gucugaggagcagugggaaa

SEQ ID NO: 831869 - RNA, 23 nt, Human
ugucacauuuaguuggcauuguu

SEQ ID NO: 831870 - RNA, 22 nt, Human
augacagaaggccucccugaca

SEQ ID NO: 831871 - RNA, 18 nt, Human
cagcugccagcucaugga

SEQ ID NO: 831872 - RNA, 22 nt, Human
ggcugcagcggauuggggauug

SEQ ID NO: 831873 - RNA, 23 nt, Human
ggccuccuggucuaggcuagacu

SEQ ID NO: 831874 - RNA, 22 nt, Human
aggacagaccuaggacuggagc

SEQ ID NO: 831875 - RNA, 22 nt, Human
guaaaauagaauaacguggcua

SEQ ID NO: 831876 - RNA, 22 nt, Human
ggcugccucuggaagcuggaga

SEQ ID NO: 831877 - RNA, 18 nt, Human
ccugcagcccaggaggcc

SEQ ID NO: 831878 - RNA, 22 nt, Human
aguaugaagauuauaauuuuuc

SEQ ID NO: 831879 - RNA, 21 nt, Human
caaucaguuggcauuugagca

SEQ ID NO: 831880 - RNA, 22 nt, Human
acagguggcuuauuggcugauu

SEQ ID NO: 831881 - RNA, 22 nt, Human
ugcuuuaaauaugaauuagcau

SEQ ID NO: 831882 - RNA, 22 nt, Human
caguacuuuucaaccaguauga

SEQ ID NO: 831883 - RNA, 22 nt, Human
auggagggugucagagagcgaa

SEQ ID NO: 831884 - RNA, 22 nt, Human
cugucuccagggcaggugcagg

SEQ ID NO: 831885 - RNA, 22 nt, Human
accagcugcugauugcuaaaug

SEQ ID NO: 831886 - RNA, 22 nt, Human
gccuccugagaagccacaggcu

SEQ ID NO: 831887 - RNA, 22 nt, Human
ucuuuucuggacucugcaugga

SEQ ID NO: 831888 - RNA, 22 nt, Human
cagggccuuuuagcaucuucuc

SEQ ID NO: 831889 - RNA, 22 nt, Human
gaaacauaguugagacacugcu

SEQ ID NO: 831890 - RNA, 22 nt, Human
augcagagacagauguggcaug

SEQ ID NO: 831891 - RNA, 22 nt, Human
uugcacuaggaaaaggcagcca

SEQ ID NO: 831892 - RNA, 22 nt, Human
auuugcuuaucuccacaguugu

SEQ ID NO: 831893 - RNA, 17 nt, Human
cacaggugugguuugag

SEQ ID NO: 831894 - RNA, 20 nt, Human
uuucaagucagcaauucuca

SEQ ID NO: 831895 - RNA, 22 nt, Human
gagauuuaauuggauuaacuua

SEQ ID NO: 831896 - RNA, 22 nt, Human
uaauuguagcuuuguaaucagc

SEQ ID NO: 831897 - RNA, 22 nt, Human
cauuaucugccauugacaccau

SEQ ID NO: 831898 - RNA, 22 nt, Human
uaucagaaaugccuuaaauugg

SEQ ID NO: 831899 - RNA, 22 nt, Human
ucccagggacaccaagcuguuu

SEQ ID NO: 831900 - RNA, 19 nt, Human
accucugcagagauguuua

SEQ ID NO: 831901 - RNA, 22 nt, Human
aggcugcuggcaggcguggacg

SEQ ID NO: 831902 - RNA, 22 nt, Human
gaggcagcgggucaggaccgug

SEQ ID NO: 831903 - RNA, 22 nt, Human
gggaggugauggcaagcagcgg

SEQ ID NO: 831904 - RNA, 23 nt, Human
aauguauguuaguaucuuagaga

SEQ ID NO: 831905 - RNA, 22 nt, Human
cucugcagaauuugagcugcuc

SEQ ID NO: 831906 - RNA, 22 nt, Human
agagacaccgcgcaucauggcu

SEQ ID NO: 831907 - RNA, 22 nt, Human
caguccuuucaauggugaccuu

SEQ ID NO: 831908 - RNA, 19 nt, Human
gagguggguccccgcagcc

SEQ ID NO: 831909 - RNA, 22 nt, Human
uuuaggcacaacuacucagcua

SEQ ID NO: 831910 - RNA, 19 nt, Human
agaggcagucuccaacagg

SEQ ID NO: 831911 - RNA, 22 nt, Human
gaagagcugcaguuuccugggc

SEQ ID NO: 831912 - RNA, 22 nt, Human
gagguggaaggcaggaacaaau

SEQ ID NO: 831913 - RNA, 22 nt, Human
caggagauguaagacuucuguu

SEQ ID NO: 831914 - RNA, 22 nt, Human
auguuuuugagauacaaacaga

SEQ ID NO: 831915 - RNA, 22 nt, Human
gcagcugcagagaccggguggg

SEQ ID NO: 831916 - RNA, 23 nt, Human
auguuauuauuagcagucuugcc

SEQ ID NO: 831917 - RNA, 22 nt, Human
uggggcugugagacuacaggau

SEQ ID NO: 831918 - RNA, 22 nt, Human
ugaaauauuuagagaguaaguu

SEQ ID NO: 831919 - RNA, 22 nt, Human
gaugugagugguagcugggauu

SEQ ID NO: 831920 - RNA, 22 nt, Human
uccagccaagccuugguagcug

SEQ ID NO: 831921 - RNA, 22 nt, Human
cagcaggcccaggugcugguga

SEQ ID NO: 831922 - RNA, 22 nt, Human
uucuuacuaguauguuucagca

SEQ ID NO: 831923 - RNA, 22 nt, Human
cuucucaguugcaagugucaga

SEQ ID NO: 831924 - RNA, 22 nt, Human
cuggacagaaagggcugcugug

SEQ ID NO: 831925 - RNA, 22 nt, Human
gcagagugauggaaugugggug

SEQ ID NO: 831926 - RNA, 22 nt, Human
uuuguaaagucuguucugaguu

SEQ ID NO: 831927 - RNA, 22 nt, Human
gccuggaggaauguagcugagg

SEQ ID NO: 831928 - RNA, 22 nt, Human
uccuuuccagccucaccucagc

SEQ ID NO: 831929 - RNA, 22 nt, Human
agucccagcuacucaagaggcu

SEQ ID NO: 831930 - RNA, 22 nt, Human
auaaggcacacauagauagggu

SEQ ID NO: 831931 - RNA, 22 nt, Human
uuucuagugguuaagauuuaca

SEQ ID NO: 831932 - RNA, 22 nt, Human
ggcagagaugugggucagaauc

SEQ ID NO: 831933 - RNA, 22 nt, Human
cagcucugaggaacacuccuuu

SEQ ID NO: 831934 - RNA, 22 nt, Human
ggcagccaugucccagggcuuc

SEQ ID NO: 831935 - RNA, 22 nt, Human
ucaguucuuuauuucacaguga

SEQ ID NO: 831936 - RNA, 22 nt, Human
agagcuggcugguagcccugau

SEQ ID NO: 831937 - RNA, 22 nt, Human
ugaggcagguaagcaaguuuug

SEQ ID NO: 831938 - RNA, 22 nt, Human
cucugcuuggaacuggacagaa

SEQ ID NO: 831939 - RNA, 22 nt, Human
ugcugccuuagcagccaggcaa

SEQ ID NO: 831940 - RNA, 22 nt, Human
ucagccaggccaccuucagcuu

SEQ ID NO: 831941 - RNA, 19 nt, Human
uagaggagaagggaagugg

SEQ ID NO: 831942 - RNA, 23 nt, Human
gagcugggauacaggcuuacugc

SEQ ID NO: 831943 - RNA, 22 nt, Human
uucagagaugacaccugguguu

SEQ ID NO: 831944 - RNA, 22 nt, Human
caggaaggcccaccuguccugu

SEQ ID NO: 831945 - RNA, 22 nt, Human
caggugggccaugaaaaaugac

SEQ ID NO: 831946 - RNA, 22 nt, Human
ugcagcuccucuggcugccuga

SEQ ID NO: 831947 - RNA, 22 nt, Human
ucucagagggaaacaugaguga

SEQ ID NO: 831948 - RNA, 22 nt, Human
ggggccugcgagguucaacuuc

SEQ ID NO: 831949 - RNA, 22 nt, Human
gagcacagaaucuucccaugca

SEQ ID NO: 831950 - RNA, 22 nt, Human
aggcacugagaggcuguguugc

SEQ ID NO: 831951 - RNA, 22 nt, Human
cccuggguucuggcugggcugc

SEQ ID NO: 831952 - RNA, 19 nt, Human
guucaaacacugauucagc

SEQ ID NO: 831953 - RNA, 19 nt, Human
ggcagcuugggaagguagc

SEQ ID NO: 831954 - RNA, 22 nt, Human
agaggccagggacacugcucaa

SEQ ID NO: 831955 - RNA, 22 nt, Human
uaaguccuggcugguuugaagc

SEQ ID NO: 831956 - RNA, 22 nt, Human
acagagaaagugggcugaagau

SEQ ID NO: 831957 - RNA, 22 nt, Human
gagggugggccagauaugaggg

SEQ ID NO: 831958 - RNA, 22 nt, Human
ucaguuuuuaaaugauauaauu

SEQ ID NO: 831959 - RNA, 23 nt, Human
acagagaucuugacuuguaugga

SEQ ID NO: 831960 - RNA, 22 nt, Human
uagcagcuuccagagagggcag

SEQ ID NO: 831961 - RNA, 22 nt, Human
cugcuguggaugcaggaccuca

SEQ ID NO: 831962 - RNA, 22 nt, Human
ucuggcuccacucugugcaugc

SEQ ID NO: 831963 - RNA, 22 nt, Human
gggagcugagggaccucugugg

SEQ ID NO: 831964 - RNA, 23 nt, Human
aaaguuugaagcaacaguaguug

SEQ ID NO: 831965 - RNA, 22 nt, Human
ucagggcaccaaaaaagaugcc

SEQ ID NO: 831966 - RNA, 22 nt, Human
cuucuccucugaguccugggag

SEQ ID NO: 831967 - RNA, 22 nt, Human
auggcuuaugaauaacaguagg

SEQ ID NO: 831968 - RNA, 22 nt, Human
caaauucacaugauugcuucug

SEQ ID NO: 831969 - RNA, 22 nt, Human
aucaguuuugggggacauacug

SEQ ID NO: 831970 - RNA, 22 nt, Human
gugugcagugagcaaaagaucu

SEQ ID NO: 831971 - RNA, 22 nt, Human
acaaaauuaccuaguuauuuuc

SEQ ID NO: 831972 - RNA, 22 nt, Human
ucccagagucagagguggggcc

SEQ ID NO: 831973 - RNA, 22 nt, Human
ucaauaaauagcuuggcucagc

SEQ ID NO: 831974 - RNA, 22 nt, Human
gugggacucuucuuuggcagug

SEQ ID NO: 831975 - RNA, 22 nt, Human
cugagguguugaugaccuaugc

SEQ ID NO: 831976 - RNA, 22 nt, Human
ggccugcuauuggugggcagac

SEQ ID NO: 831977 - RNA, 22 nt, Human
ccugucagcugauggcuaugua

SEQ ID NO: 831978 - RNA, 22 nt, Human
ucagagccccuccgcuguccca

SEQ ID NO: 831979 - RNA, 22 nt, Human
cguccuuacagagggucacagc

SEQ ID NO: 831980 - RNA, 22 nt, Human
agugaaaucagguuuugacugc

SEQ ID NO: 831981 - RNA, 22 nt, Human
gaugguuuggaaugaaguagcu

SEQ ID NO: 831982 - RNA, 21 nt, Human
ggacuuacauagguaaggggu

SEQ ID NO: 831983 - RNA, 22 nt, Human
uuucaguguaucuuccaaaagc

SEQ ID NO: 831984 - RNA, 22 nt, Human
gaauauuuguaauuacuguuga

SEQ ID NO: 831985 - RNA, 21 nt, Human
ucaguaaaccuaaagauugua

SEQ ID NO: 831986 - RNA, 22 nt, Human
ugucccaguuuugcagguuaga

SEQ ID NO: 831987 - RNA, 22 nt, Human
ucugagagagggucagaugcua

SEQ ID NO: 831988 - RNA, 22 nt, Human
gagaaaugcaugcaugucauca

SEQ ID NO: 831989 - RNA, 22 nt, Human
ucauuacagagauauaaucuac

SEQ ID NO: 831990 - RNA, 22 nt, Human
cguguacagucuaucuuuuuuc

SEQ ID NO: 831991 - RNA, 22 nt, Human
ccucagggacuccaugcugcag

SEQ ID NO: 831992 - RNA, 22 nt, Human
gcagugccuugcuucucugucu

SEQ ID NO: 831993 - RNA, 22 nt, Human
ugaggcaggaauggggaaaagu

SEQ ID NO: 831994 - RNA, 22 nt, Human
gauggguggucucagacuugcc

SEQ ID NO: 831995 - RNA, 22 nt, Human
cuggagccagccagggcccucu

SEQ ID NO: 831996 - RNA, 22 nt, Human
gggcagugguccaggcuacagc

SEQ ID NO: 831997 - RNA, 22 nt, Human
acaggggcuccgaaggugaggg

SEQ ID NO: 831998 - RNA, 22 nt, Human
ucacaggguuuggaagccuccu

SEQ ID NO: 831999 - RNA, 22 nt, Human
ccagugggugcugggcucugcc

SEQ ID NO: 832000 - RNA, 21 nt, Human
accucaagcaacaaccaaggu

SEQ ID NO: 832001 - RNA, 22 nt, Human
ggcugccugaggcagugagaga

SEQ ID NO: 832002 - RNA, 22 nt, Human
gguggggucacgacagagggaa

SEQ ID NO: 832003 - RNA, 22 nt, Human
caguugccuacuacauggcagg

SEQ ID NO: 832004 - RNA, 22 nt, Human
ggcagagguagcuggaaccagg

SEQ ID NO: 832005 - RNA, 22 nt, Human
ggauggagguucucagaugcuc

SEQ ID NO: 832006 - RNA, 22 nt, Human
gcugggagucgcgucuguggcc

SEQ ID NO: 832007 - RNA, 22 nt, Human
cauugcccaguaggaucaccag

SEQ ID NO: 832008 - RNA, 22 nt, Human
cugaacucuuuaugacagcuug

SEQ ID NO: 832009 - RNA, 22 nt, Human
acccuggggguggccagugcca

SEQ ID NO: 832010 - RNA, 22 nt, Human
ugggcagacgggagcuugccuu

SEQ ID NO: 832011 - RNA, 22 nt, Human
aagccagguuccauggaggagc

SEQ ID NO: 832012 - RNA, 22 nt, Human
ggggggugcugaucaguggagc

SEQ ID NO: 832013 - RNA, 22 nt, Human
ccucugcucccuggugucugag

SEQ ID NO: 832014 - RNA, 22 nt, Human
gcaccugggacccagaggcacc

SEQ ID NO: 832015 - RNA, 21 nt, Human
acaugucucuaaucucaguga

SEQ ID NO: 832016 - RNA, 22 nt, Human
aggccugagcagaggaguggac

SEQ ID NO: 832017 - RNA, 22 nt, Human
uacaaaguuuucuuggauugag

SEQ ID NO: 832018 - RNA, 22 nt, Human
uggauuuaguucuucacaggcc

SEQ ID NO: 832019 - RNA, 20 nt, Human
caccaggcgcucugagaaca

SEQ ID NO: 832020 - RNA, 22 nt, Human
uucacaaaacacuauuuucugg

SEQ ID NO: 832021 - RNA, 22 nt, Human
ucccagggucaguggugaggcc

SEQ ID NO: 832022 - RNA, 22 nt, Human
ucuuguccuaagagcuggauuc

SEQ ID NO: 832023 - RNA, 22 nt, Human
agccucugcacgggcacgggug

SEQ ID NO: 832024 - RNA, 22 nt, Human
aauuuccaaauuucugucacac

SEQ ID NO: 832025 - RNA, 18 nt, Human
uccugccugcgggcuccc

SEQ ID NO: 832026 - RNA, 22 nt, Human
ccugcagacacuuguccagcaa

SEQ ID NO: 832027 - RNA, 22 nt, Human
ucauugcauuuauucacuggca

SEQ ID NO: 832028 - RNA, 22 nt, Human
agcagccagaaagggcagucga

SEQ ID NO: 832029 - RNA, 22 nt, Human
cagaggccuauccaguguccau

SEQ ID NO: 832030 - RNA, 22 nt, Human
uugugcucuguguuauuuaagg

SEQ ID NO: 832031 - RNA, 22 nt, Human
augcuguagaucuuagccucua

SEQ ID NO: 832032 - RNA, 22 nt, Human
uuccaggaauucagcucucagu

SEQ ID NO: 832033 - RNA, 23 nt, Human
acaguuauagcugugaauaacau

SEQ ID NO: 832034 - RNA, 22 nt, Human
ccugcagguccccggaugcgca

SEQ ID NO: 832035 - RNA, 22 nt, Human
gaagaggaugacaggagccggu

SEQ ID NO: 832036 - RNA, 22 nt, Human
cuggcuccuccaaggccuggag

SEQ ID NO: 832037 - RNA, 23 nt, Human
gugauuucagggaacagaaucag

SEQ ID NO: 832038 - RNA, 22 nt, Human
ucccaggacccaggcauucaca

SEQ ID NO: 832039 - RNA, 22 nt, Human
gcaucuucacacaaagccagug

SEQ ID NO: 832040 - RNA, 22 nt, Human
aggcagcugaggucuggcgccc

SEQ ID NO: 832041 - RNA, 22 nt, Human
cagagcagugaggaguugugua

SEQ ID NO: 832042 - RNA, 22 nt, Human
aagaaauauugggccuuauaaa

SEQ ID NO: 832043 - RNA, 22 nt, Human
caagagcuagaaauugguuaga

SEQ ID NO: 832044 - RNA, 22 nt, Human
ugguuugcccacucgagugauu

SEQ ID NO: 832045 - RNA, 22 nt, Human
accaaggagaaggugcaagcuu

SEQ ID NO: 832046 - RNA, 22 nt, Human
cagcugagucugagguucuuug

SEQ ID NO: 832047 - RNA, 22 nt, Human
aggucauuuccuuagaggcaga

SEQ ID NO: 832048 - RNA, 22 nt, Human
gggaagcaggugcagcucgccu

SEQ ID NO: 832049 - RNA, 22 nt, Human
ugaggugaagaguggagcucag

SEQ ID NO: 832050 - RNA, 22 nt, Human
uuagccauguugaagauuuaga

SEQ ID NO: 832051 - RNA, 22 nt, Human
aggagccaguuccaccccagga

SEQ ID NO: 832052 - RNA, 22 nt, Human
uugauuucuauucagauguaga

SEQ ID NO: 832053 - RNA, 21 nt, Human
aacaaagggaugcucaucuuu

SEQ ID NO: 832054 - RNA, 22 nt, Human
uaauucagggccagaaucccca

SEQ ID NO: 832055 - RNA, 22 nt, Human
uuuaggcagaacauggacuuug

SEQ ID NO: 832056 - RNA, 22 nt, Human
gcagagccaggagcccaggauc

SEQ ID NO: 832057 - RNA, 22 nt, Human
ggugaaggaggaagcugaugga

SEQ ID NO: 832058 - RNA, 22 nt, Human
aagacuguacauuuuccagucu

SEQ ID NO: 832059 - RNA, 19 nt, Human
gcaggcaguggcauucgga

SEQ ID NO: 832060 - RNA, 22 nt, Human
cuggugguucaggagaauggcu

SEQ ID NO: 832061 - RNA, 22 nt, Human
ucuguucaguugauuagacaga

SEQ ID NO: 832062 - RNA, 22 nt, Human
acuuuaucaggaaucacacagc

SEQ ID NO: 832063 - RNA, 23 nt, Human
aguguuccaguugguugagagug

SEQ ID NO: 832064 - RNA, 22 nt, Human
uguguacuugaaagggcagguc

SEQ ID NO: 832065 - RNA, 22 nt, Human
ggcacagggaggcccuggugug

SEQ ID NO: 832066 - RNA, 22 nt, Human
cugggcacagcguugggcucuu

SEQ ID NO: 832067 - RNA, 22 nt, Human
gcccagccuccaagcuccaagg

SEQ ID NO: 832068 - RNA, 22 nt, Human
aaagccaugggucuuuggcaua

SEQ ID NO: 832069 - RNA, 22 nt, Human
ggccucucucccuggcuugcag

SEQ ID NO: 832070 - RNA, 22 nt, Human
auauaauacaaccugcuaagug

SEQ ID NO: 832071 - RNA, 22 nt, Human
acuguucacccagcacuagcag

SEQ ID NO: 832072 - RNA, 18 nt, Human
ucugggcuucccgaggcu

SEQ ID NO: 832073 - RNA, 22 nt, Human
gugcagggcuggcaccggaggc

SEQ ID NO: 832074 - RNA, 20 nt, Human
cucaggauacugcaaaguug

SEQ ID NO: 832075 - RNA, 22 nt, Human
cuguuuuugugcugugucuccc

SEQ ID NO: 832076 - RNA, 22 nt, Human
ccuugcugaccaucaccuuuga

SEQ ID NO: 832077 - RNA, 22 nt, Human
caggaaauaucuccuggcagag

SEQ ID NO: 832078 - RNA, 22 nt, Human
ggggcagagucuggacuguugu

SEQ ID NO: 832079 - RNA, 22 nt, Human
uuccaaagaaauugaccaagac

SEQ ID NO: 832080 - RNA, 22 nt, Human
uaugcacauucacacaaaaaug

SEQ ID NO: 832081 - RNA, 22 nt, Human
gcuggguggaucggaggcucug

SEQ ID NO: 832082 - RNA, 22 nt, Human
ccagcagagcauggggaggaag

SEQ ID NO: 832083 - RNA, 22 nt, Human
aagggcuggaucucucugagca

SEQ ID NO: 832084 - RNA, 22 nt, Human
cugggaggauucauugagguga

SEQ ID NO: 832085 - RNA, 22 nt, Human
cuggcaaguacugggccagcuc

SEQ ID NO: 832086 - RNA, 22 nt, Human
agccagggacgcugcaggcuac

SEQ ID NO: 832087 - RNA, 22 nt, Human
ugucucugauaaguaguucagu

SEQ ID NO: 832088 - RNA, 22 nt, Human
aaaguccuguuugaaggaccug

SEQ ID NO: 832089 - RNA, 22 nt, Human
cuggagccacuuuuuauccuuu

SEQ ID NO: 832090 - RNA, 22 nt, Human
acaaagcuagagaagagaauug

SEQ ID NO: 832091 - RNA, 22 nt, Human
gcaacuuuagaaaaaucuauaa

SEQ ID NO: 832092 - RNA, 22 nt, Human
auuuccuuugcaaagacugugc

SEQ ID NO: 832093 - RNA, 22 nt, Human
cuuugaaagcucccaggacuua

SEQ ID NO: 832094 - RNA, 22 nt, Human
agcagccaauuggaggaugaag

SEQ ID NO: 832095 - RNA, 22 nt, Human
auuuugaaaagcauuugaguaa

SEQ ID NO: 832096 - RNA, 22 nt, Human
auugauggcggccucuccauau

SEQ ID NO: 832097 - RNA, 20 nt, Human
cagcaguggaugagaguuuu

SEQ ID NO: 832098 - RNA, 22 nt, Human
uguccucuuccagugcuccuuc

SEQ ID NO: 832099 - RNA, 22 nt, Human
auguguauacuugugcuuacuc

SEQ ID NO: 832100 - RNA, 22 nt, Human
caggagacaauggcuguggggc

SEQ ID NO: 832101 - RNA, 22 nt, Human
uaucuguuaugggcugaauugc

SEQ ID NO: 832102 - RNA, 22 nt, Human
caggcagggagcuggaaaggau

SEQ ID NO: 832103 - RNA, 22 nt, Human
aaaugcagguucuugagccaag

SEQ ID NO: 832104 - RNA, 22 nt, Human
ggggcacacuuuugguagauau

SEQ ID NO: 832105 - RNA, 22 nt, Human
cugggagcuagcucugagcuga

SEQ ID NO: 832106 - RNA, 22 nt, Human
agauauguuuguauauauuugu

SEQ ID NO: 832107 - RNA, 22 nt, Human
gccugugacucgucuugggcca

SEQ ID NO: 832108 - RNA, 22 nt, Human
aucugacaaccuauugacuuga

SEQ ID NO: 832109 - RNA, 22 nt, Human
uccuuccuggggucucugcugc

SEQ ID NO: 832110 - RNA, 22 nt, Human
agggcagagcacugaauuggga

SEQ ID NO: 832111 - RNA, 22 nt, Human
gcaaggcagcgcggaguagcua

SEQ ID NO: 832112 - RNA, 22 nt, Human
uuaggaaauuaugguuucagau

SEQ ID NO: 832113 - RNA, 19 nt, Human
agugaaauggaguauucaa

SEQ ID NO: 832114 - RNA, 22 nt, Human
ggcugccacgucgaggguccaa

SEQ ID NO: 832115 - RNA, 22 nt, Human
agggcuggcaagggauugaaau

SEQ ID NO: 832116 - RNA, 22 nt, Human
cagcaauaacucaaagccauuu

SEQ ID NO: 832117 - RNA, 22 nt, Human
gcacagaacuucucuuaguagg

SEQ ID NO: 832118 - RNA, 22 nt, Human
ugucuucagcaaaugccuuucu

SEQ ID NO: 832119 - RNA, 22 nt, Human
ugggaggaucgcuugagcccag

SEQ ID NO: 832120 - RNA, 22 nt, Human
cagugccucuuaagugucaccc

SEQ ID NO: 832121 - RNA, 22 nt, Human
uggcucaggccuacgacgccuu

SEQ ID NO: 832122 - RNA, 22 nt, Human
ucuggcucauacaagccugcaa

SEQ ID NO: 832123 - RNA, 22 nt, Human
gcucccaccuccagccugaguu

SEQ ID NO: 832124 - RNA, 22 nt, Human
uguguacaagaguguuuacugu

SEQ ID NO: 832125 - RNA, 22 nt, Human
agaggauguucuaggcacucau

SEQ ID NO: 832126 - RNA, 20 nt, Human
agugacagagacuguguggc

SEQ ID NO: 832127 - RNA, 22 nt, Human
uuagauaaauugcaacuugauu

SEQ ID NO: 832128 - RNA, 22 nt, Human
uguagcauguaaauugguuauu

SEQ ID NO: 832129 - RNA, 20 nt, Human
cuucuucauuaacccuacug

SEQ ID NO: 832130 - RNA, 22 nt, Human
gcagagccaggagagacccuug

SEQ ID NO: 832131 - RNA, 22 nt, Human
gaggagcugggcugagaggguc

SEQ ID NO: 832132 - RNA, 22 nt, Human
gaggccuggaauuccagccugg

SEQ ID NO: 832133 - RNA, 22 nt, Human
auucuucacaaauauauagaag

SEQ ID NO: 832134 - RNA, 22 nt, Human
uccucugcuggaagggcaagag

SEQ ID NO: 832135 - RNA, 22 nt, Human
agcagcauucucugguaugggg

SEQ ID NO: 832136 - RNA, 22 nt, Human
uguaucaaaccaaauuaauucu

SEQ ID NO: 832137 - RNA, 22 nt, Human
cgcagaagagguugucuagucc

SEQ ID NO: 832138 - RNA, 22 nt, Human
ucagggcacauucugcaguggc

SEQ ID NO: 832139 - RNA, 19 nt, Human
cugaagucuuuucagcugg

SEQ ID NO: 832140 - RNA, 20 nt, Human
aguaggggaaugcaagagca

SEQ ID NO: 832141 - RNA, 22 nt, Human
ucagcagucacauguuguccca

SEQ ID NO: 832142 - RNA, 22 nt, Human
cucugugauuuugugagccaga

SEQ ID NO: 832143 - RNA, 19 nt, Human
gcagcugcuugaaaagaaa

SEQ ID NO: 832144 - RNA, 22 nt, Human
aaugaacauauaaagagaucuu

SEQ ID NO: 832145 - RNA, 22 nt, Human
ugucacaaacauacauuauaga

SEQ ID NO: 832146 - RNA, 22 nt, Human
agacaaaggauuaaugaugaug

SEQ ID NO: 832147 - RNA, 22 nt, Human
ugugugcagccucugucuuugg

SEQ ID NO: 832148 - RNA, 22 nt, Human
ggaggugggcuaaggacucucu

SEQ ID NO: 832149 - RNA, 22 nt, Human
aauguaugagcgugaaagcacu

SEQ ID NO: 832150 - RNA, 22 nt, Human
aagauuuccuggauguaauucc

SEQ ID NO: 832151 - RNA, 22 nt, Human
cuguggugagcaacugacugaa

SEQ ID NO: 832152 - RNA, 22 nt, Human
cucugggcaaagaugccucauc

SEQ ID NO: 832153 - RNA, 22 nt, Human
ugaagcaggaaccagcagcauu

SEQ ID NO: 832154 - RNA, 22 nt, Human
uuuagaaauugcagagugggug

SEQ ID NO: 832155 - RNA, 22 nt, Human
gagacugauggggcucccagaa

SEQ ID NO: 832156 - RNA, 22 nt, Human
gcugagguggcugccuuaguaa

SEQ ID NO: 832157 - RNA, 22 nt, Human
cacauguacagaagcaggcugg

SEQ ID NO: 832158 - RNA, 22 nt, Human
uuugaacaagagcuucacauua

SEQ ID NO: 832159 - RNA, 21 nt, Human
gccuggcagguggaagggcuc

SEQ ID NO: 832160 - RNA, 22 nt, Human
ggcaggugcaccugagccaucu

SEQ ID NO: 832161 - RNA, 22 nt, Human
uugaagcaugguacuuguucaa

SEQ ID NO: 832162 - RNA, 22 nt, Human
guggcaggagagacacagccau

SEQ ID NO: 832163 - RNA, 22 nt, Human
ucugccugccagucugguccuc

SEQ ID NO: 832164 - RNA, 22 nt, Human
acaaauaugguacucggagaaa

SEQ ID NO: 832165 - RNA, 22 nt, Human
ucccagagacagagccuccucc

SEQ ID NO: 832166 - RNA, 22 nt, Human
caguagcagggauuauuuuagg

SEQ ID NO: 832167 - RNA, 22 nt, Human
cugcaggauucucccaguugga

SEQ ID NO: 832168 - RNA, 22 nt, Human
uaugcacaccuggguccuuguc

SEQ ID NO: 832169 - RNA, 22 nt, Human
aggcugccucgugagcucgcug

SEQ ID NO: 832170 - RNA, 22 nt, Human
augaacacauguacacauuucu

SEQ ID NO: 832171 - RNA, 22 nt, Human
accugaggcuguuagucuaggu

SEQ ID NO: 832172 - RNA, 20 nt, Human
cccuggccuguuucaugccc

SEQ ID NO: 832173 - RNA, 22 nt, Human
uuggcaguaaaagaaaaugcuu

SEQ ID NO: 832174 - RNA, 22 nt, Human
ggcagcuccucaaaaaauuaaa

SEQ ID NO: 832175 - RNA, 22 nt, Human
guccaugacugugacucacaug

SEQ ID NO: 832176 - RNA, 22 nt, Human
cccaggaggucgaagcugcagu

SEQ ID NO: 832177 - RNA, 22 nt, Human
cccagaaggucgaggcugcagu

SEQ ID NO: 832178 - RNA, 22 nt, Human
gauuuacagcuauacccaaugg

SEQ ID NO: 832179 - RNA, 22 nt, Human
auucuucacuguuucagaauga

SEQ ID NO: 832180 - RNA, 22 nt, Human
ugaaauagucuaaaaaaccaga

SEQ ID NO: 832181 - RNA, 22 nt, Human
agugaaauccuggucaacaggu

SEQ ID NO: 832182 - RNA, 22 nt, Human
uuugaagaccuuaucucuaaau

SEQ ID NO: 832183 - RNA, 22 nt, Human
uuagaaauauggugcugccgcc

SEQ ID NO: 832184 - RNA, 22 nt, Human
ccagugcacagccaggcaggug

SEQ ID NO: 832185 - RNA, 22 nt, Human
gggcuacagacaugcucuaagc

SEQ ID NO: 832186 - RNA, 22 nt, Human
cagaggcagaggucaucucugg

SEQ ID NO: 832187 - RNA, 22 nt, Human
ugcuuuggccacuagaauucag

SEQ ID NO: 832188 - RNA, 23 nt, Human
aggauccugguacaggagcagag

SEQ ID NO: 832189 - RNA, 22 nt, Human
uuuguaaaggccugaauuucag

SEQ ID NO: 832190 - RNA, 22 nt, Human
ucucagaguuuagagcugagcc

SEQ ID NO: 832191 - RNA, 22 nt, Human
agaggagguggugaugcuuuaa

SEQ ID NO: 832192 - RNA, 23 nt, Human
aaguucaagucacagccugucuu

SEQ ID NO: 832193 - RNA, 22 nt, Human
cacauacuuguguguacauaug

SEQ ID NO: 832194 - RNA, 22 nt, Human
cccaggagacugagcuguaacc

SEQ ID NO: 832195 - RNA, 22 nt, Human
ccagcccugccagagagagcug

SEQ ID NO: 832196 - RNA, 22 nt, Human
gcugcagcaagcccuccagggg

SEQ ID NO: 832197 - RNA, 22 nt, Human
ccuggcugcauuuugcuggaug

SEQ ID NO: 832198 - RNA, 22 nt, Human
uccaucagauucccuccugaga

SEQ ID NO: 832199 - RNA, 22 nt, Human
uuucaaagucaauaucauuacc

SEQ ID NO: 832200 - RNA, 22 nt, Human
cugaggaguuuggguuguucaa

SEQ ID NO: 832201 - RNA, 22 nt, Human
uaauauauuucugcuaagcuca

SEQ ID NO: 832202 - RNA, 22 nt, Human
uaggagggcccugaaaauggca

SEQ ID NO: 832203 - RNA, 22 nt, Human
caaugauucugcaacugugugc

SEQ ID NO: 832204 - RNA, 22 nt, Human
acauaauagcauuucuaauuug

SEQ ID NO: 832205 - RNA, 21 nt, Human
ucagggcagcugcucuucaga

SEQ ID NO: 832206 - RNA, 21 nt, Human
uggcccuggccacggcugcca

SEQ ID NO: 832207 - RNA, 22 nt, Human
ucuggccuauuucugucagauc

SEQ ID NO: 832208 - RNA, 22 nt, Human
agccaggaauuggacaacacau

SEQ ID NO: 832209 - RNA, 22 nt, Human
ggucucagcuggaguccuuggu

SEQ ID NO: 832210 - RNA, 22 nt, Human
cagaggccauauuucuucacuc

SEQ ID NO: 832211 - RNA, 22 nt, Human
aaguucaagucuccugaguaua

SEQ ID NO: 832212 - RNA, 23 nt, Human
agacccagagacuggcucugcuc

SEQ ID NO: 832213 - RNA, 22 nt, Human
ugugacagaucuuuaaauaaug

SEQ ID NO: 832214 - RNA, 22 nt, Human
ggcagcuuguccuggaggaugg

SEQ ID NO: 832215 - RNA, 22 nt, Human
aaugcuguauaucuuagcuaau

SEQ ID NO: 832216 - RNA, 22 nt, Human
uaucaauugggccaaaugguac

SEQ ID NO: 832217 - RNA, 22 nt, Human
uguggccucaaggcugcccuca

SEQ ID NO: 832218 - RNA, 22 nt, Human
caggggcucccugggugccagu

SEQ ID NO: 832219 - RNA, 22 nt, Human
ccugggagcuguggaaaggcug

SEQ ID NO: 832220 - RNA, 22 nt, Human
aagacaauuugauacuaguugc

SEQ ID NO: 832221 - RNA, 22 nt, Human
caggugggagcgaggagcuacu

SEQ ID NO: 832222 - RNA, 22 nt, Human
agaaaauauucauugagaggcu

SEQ ID NO: 832223 - RNA, 22 nt, Human
acaggcugccuaccaaguauca

SEQ ID NO: 832224 - RNA, 22 nt, Human
gccugggaagacuaagugggag

SEQ ID NO: 832225 - RNA, 22 nt, Human
ugaaagcucugucaucauuccu

SEQ ID NO: 832226 - RNA, 22 nt, Human
cugucagguuggucucagagcu

SEQ ID NO: 832227 - RNA, 22 nt, Human
gcucaagggaugggagugggug

SEQ ID NO: 832228 - RNA, 22 nt, Human
gcugcagccaaauucauuguca

SEQ ID NO: 832229 - RNA, 19 nt, Human
uguguguuuauauauguau

SEQ ID NO: 832230 - RNA, 22 nt, Human
ugccagcacaaguuaagagauc

SEQ ID NO: 832231 - RNA, 22 nt, Human
uggagggaacccaggcugcucu

SEQ ID NO: 832232 - RNA, 22 nt, Human
auacagaacaagccucaccucc

SEQ ID NO: 832233 - RNA, 22 nt, Human
uagugauuaaaggcagaauguu

SEQ ID NO: 832234 - RNA, 22 nt, Human
uggaggaugccauccaggauac

SEQ ID NO: 832235 - RNA, 22 nt, Human
uuggccuuaaccucucugugcc

SEQ ID NO: 832236 - RNA, 22 nt, Human
agccauugaauuuagugccuuu

SEQ ID NO: 832237 - RNA, 22 nt, Human
agaacagaugugggcagaccug

SEQ ID NO: 832238 - RNA, 22 nt, Human
uguagcacagagcuuugacacu

SEQ ID NO: 832239 - RNA, 22 nt, Human
cagcucugugggagcguaugug

SEQ ID NO: 832240 - RNA, 20 nt, Human
cuggcaggagcgagucuacc

SEQ ID NO: 832241 - RNA, 22 nt, Human
gacauucacaguuuccgauggu

SEQ ID NO: 832242 - RNA, 22 nt, Human
guauuuucaagagcaguaguau

SEQ ID NO: 832243 - RNA, 22 nt, Human
gagcccuccauggagccaggca

SEQ ID NO: 832244 - RNA, 22 nt, Human
uccagcagcccgaaggcccauc

SEQ ID NO: 832245 - RNA, 22 nt, Human
aaggcagagggcuggaucagag

SEQ ID NO: 832246 - RNA, 22 nt, Human
guggguggaucaccugagguca

SEQ ID NO: 832247 - RNA, 22 nt, Human
uuccucuccucccaccagguga

SEQ ID NO: 832248 - RNA, 19 nt, Human
ccagcagacacagcugccc

SEQ ID NO: 832249 - RNA, 22 nt, Human
ggcucaggggccaggccugucc

SEQ ID NO: 832250 - RNA, 21 nt, Human
auccuuagcacuuagaagagu

SEQ ID NO: 832251 - RNA, 22 nt, Human
ggcaccuggagguuuacuggau

SEQ ID NO: 832252 - RNA, 22 nt, Human
aggccucuucagggagcaugga

SEQ ID NO: 832253 - RNA, 22 nt, Human
cagggcaguuuuacuucucucu

SEQ ID NO: 832254 - RNA, 22 nt, Human
guggaaugaauagauuugcauu

SEQ ID NO: 832255 - RNA, 22 nt, Human
gcugcucuuuucagagaugaga

SEQ ID NO: 832256 - RNA, 22 nt, Human
ggugaggcccagugaucugugu

SEQ ID NO: 832257 - RNA, 22 nt, Human
gccaggaggggagaguguguca

SEQ ID NO: 832258 - RNA, 22 nt, Human
acagacagauuuugucugaugu

SEQ ID NO: 832259 - RNA, 23 nt, Human
uggcucugagcuuccugguggcc

SEQ ID NO: 832260 - RNA, 22 nt, Human
uugaagaaauuauuuuauauag

SEQ ID NO: 832261 - RNA, 22 nt, Human
gucaaguuaagauaaggucaug

SEQ ID NO: 832262 - RNA, 22 nt, Human
ugcagucuggauguccucagau

SEQ ID NO: 832263 - RNA, 19 nt, Human
aggaaagguggccuuagca

SEQ ID NO: 832264 - RNA, 22 nt, Human
auauaggcuaacaacuauugag

SEQ ID NO: 832265 - RNA, 22 nt, Human
ccuguucaagggaugauugacc

SEQ ID NO: 832266 - RNA, 22 nt, Human
uuccucucgcucuccggggccc

SEQ ID NO: 832267 - RNA, 22 nt, Human
uguaugcagggcuuguaugcag

SEQ ID NO: 832268 - RNA, 22 nt, Human
gccaggcuggugucacaacucu

SEQ ID NO: 832269 - RNA, 22 nt, Human
agggugcagaaggagccuagga

SEQ ID NO: 832270 - RNA, 22 nt, Human
cuggagccuucaccaggggaaa

SEQ ID NO: 832271 - RNA, 23 nt, Human
aggagccaggugcagcccuugug

SEQ ID NO: 832272 - RNA, 22 nt, Human
aaaggucaaaaucgugacauug

SEQ ID NO: 832273 - RNA, 22 nt, Human
acagcauugagagcuaaauuua

SEQ ID NO: 832274 - RNA, 22 nt, Human
guauacagauacuuagacgugc

SEQ ID NO: 832275 - RNA, 22 nt, Human
uucacauugugcagauuauggu

SEQ ID NO: 832276 - RNA, 22 nt, Human
ggguccaggucuucaggcagag

SEQ ID NO: 832277 - RNA, 22 nt, Human
uccagugguaguaaagaggucu

SEQ ID NO: 832278 - RNA, 22 nt, Human
cugccagcucgccacaaugaca

SEQ ID NO: 832279 - RNA, 22 nt, Human
cacuguguaagaagaugggcuu

SEQ ID NO: 832280 - RNA, 22 nt, Human
uaagauguuuugguuugauaag

SEQ ID NO: 832281 - RNA, 22 nt, Human
uuguaauuugcaaauguauugu

SEQ ID NO: 832282 - RNA, 22 nt, Human
guccucugaaguugugcaaugc

SEQ ID NO: 832283 - RNA, 22 nt, Human
acaaauauuuacugaauccacu

SEQ ID NO: 832284 - RNA, 22 nt, Human
ggcagcugugaagugccucaca

SEQ ID NO: 832285 - RNA, 22 nt, Human
ugaacaaacugcauucuucacu

SEQ ID NO: 832286 - RNA, 22 nt, Human
uauuuaguuaucuuucauaaaa

SEQ ID NO: 832287 - RNA, 22 nt, Human
ccugucugaaggcagggggaug

SEQ ID NO: 832288 - RNA, 22 nt, Human
auagaauagcauagaaaauuga

SEQ ID NO: 832289 - RNA, 22 nt, Human
auggccuggccagagcucugcu

SEQ ID NO: 832290 - RNA, 22 nt, Human
auuguaucuugucauuaugcau

SEQ ID NO: 832291 - RNA, 22 nt, Human
gucccucugugucccugcaguc

SEQ ID NO: 832292 - RNA, 22 nt, Human
aggcacuguggguguggccgga

SEQ ID NO: 832293 - RNA, 22 nt, Human
gggccacauugaagggugggua

SEQ ID NO: 832294 - RNA, 22 nt, Human
ccaucagcuccaguaucuucug

SEQ ID NO: 832295 - RNA, 22 nt, Human
ugaaagauugugauucaauaug

SEQ ID NO: 832296 - RNA, 22 nt, Human
aguuuuaugcaguguucugaua

SEQ ID NO: 832297 - RNA, 22 nt, Human
uuugacaggacuaacauauggc

SEQ ID NO: 832298 - RNA, 22 nt, Human
augagcugugggauuccagagg

SEQ ID NO: 832299 - RNA, 22 nt, Human
cacugagaggucucauuuccaa

SEQ ID NO: 832300 - RNA, 22 nt, Human
ugaaaugaucaguuugguuacu

SEQ ID NO: 832301 - RNA, 22 nt, Human
aacuuucagaauccuaugcauu

SEQ ID NO: 832302 - RNA, 22 nt, Human
aaggcagccucugccagccggg

SEQ ID NO: 832303 - RNA, 21 nt, Human
guguuuccuguuuauggcuug

SEQ ID NO: 832304 - RNA, 22 nt, Human
uacugaaaagccacaaggacca

SEQ ID NO: 832305 - RNA, 22 nt, Human
agaaugcuccagagcugaaaga

SEQ ID NO: 832306 - RNA, 22 nt, Human
agcagaaccacagcacuguuga

SEQ ID NO: 832307 - RNA, 22 nt, Human
cccaggagaauauaauguucuu

SEQ ID NO: 832308 - RNA, 22 nt, Human
cuucccugauaagagccucaga

SEQ ID NO: 832309 - RNA, 22 nt, Human
uaggcagcagugcuaugauucu

SEQ ID NO: 832310 - RNA, 22 nt, Human
gaagcagccacggggagacaga

SEQ ID NO: 832311 - RNA, 22 nt, Human
uggaggaugccuggggaggccu

SEQ ID NO: 832312 - RNA, 19 nt, Human
ugcugcuguccuugcaggg

SEQ ID NO: 832313 - RNA, 22 nt, Human
gauuuuauuagcccaaacuuug

SEQ ID NO: 832314 - RNA, 22 nt, Human
cugggccucaaucucagaguuu

SEQ ID NO: 832315 - RNA, 22 nt, Human
ccugucugagccagggugggca

SEQ ID NO: 832316 - RNA, 22 nt, Human
aaguaugugauacauguuaauu

SEQ ID NO: 832317 - RNA, 22 nt, Human
uuucaguggguuuauuucaugu

SEQ ID NO: 832318 - RNA, 22 nt, Human
augcuacagaguuugaauaugu

SEQ ID NO: 832319 - RNA, 22 nt, Human
cugugucggacgugggcagcag

SEQ ID NO: 832320 - RNA, 22 nt, Human
ugaaggaaaugacggcagaaga

SEQ ID NO: 832321 - RNA, 22 nt, Human
ugguggccaauucacagggcuc

SEQ ID NO: 832322 - RNA, 22 nt, Human
aaaucaguuggaacacaagcag

SEQ ID NO: 832323 - RNA, 20 nt, Human
gagauggcuaagugcugaac

SEQ ID NO: 832324 - RNA, 22 nt, Human
ggaaaaggccacagggacacau

SEQ ID NO: 832325 - RNA, 20 nt, Human
cucugcagcaaggccugggu

SEQ ID NO: 832326 - RNA, 22 nt, Human
ugccuugcgggcguuucuguug

SEQ ID NO: 832327 - RNA, 22 nt, Human
cugggagcggcugucacugguu

SEQ ID NO: 832328 - RNA, 22 nt, Human
gcagcugccgugagcucacgcc

SEQ ID NO: 832329 - RNA, 22 nt, Human
cugcuguguuggcauuggauag

SEQ ID NO: 832330 - RNA, 22 nt, Human
cucugaaagaguuuaguauuau

SEQ ID NO: 832331 - RNA, 22 nt, Human
aagcagaggguauggccagguu

SEQ ID NO: 832332 - RNA, 20 nt, Human
gggcaguucaaugccacucu

SEQ ID NO: 832333 - RNA, 22 nt, Human
uugauccaguugaaagugauga

SEQ ID NO: 832334 - RNA, 22 nt, Human
aagcccaguuucacacugagac

SEQ ID NO: 832335 - RNA, 22 nt, Human
uguacauugucacucaucaagu

SEQ ID NO: 832336 - RNA, 22 nt, Human
accagcucagaagccagaaaga

SEQ ID NO: 832337 - RNA, 22 nt, Human
gggagggaaagcuugaucuguc

SEQ ID NO: 832338 - RNA, 23 nt, Human
uggcagcuguguaagagaaagca

SEQ ID NO: 832339 - RNA, 19 nt, Human
uggcagggagugauauuag

SEQ ID NO: 832340 - RNA, 22 nt, Human
cgcuggccauagccuccugugu

SEQ ID NO: 832341 - RNA, 22 nt, Human
aauuucagagguagagauucua

SEQ ID NO: 832342 - RNA, 22 nt, Human
acugcagccuuugggcucauaa

SEQ ID NO: 832343 - RNA, 22 nt, Human
cuacccaggcuggagugcagua

SEQ ID NO: 832344 - RNA, 22 nt, Human
ccuguucaugaaacugcuuucc

SEQ ID NO: 832345 - RNA, 22 nt, Human
aggugagguuugggagguguca

SEQ ID NO: 832346 - RNA, 22 nt, Human
uggcuggggccacaguuuuccu

SEQ ID NO: 832347 - RNA, 22 nt, Human
agauuucagaugcucggcaguu

SEQ ID NO: 832348 - RNA, 22 nt, Human
ccugugcccucagccuggcucu

SEQ ID NO: 832349 - RNA, 22 nt, Human
agaaaagggcaggagggauaca

SEQ ID NO: 832350 - RNA, 22 nt, Human
uuuccucuuccgagggggaggc

SEQ ID NO: 832351 - RNA, 22 nt, Human
caggcacuagcagaaugaggcu

SEQ ID NO: 832352 - RNA, 22 nt, Human
cagggcugagaauuuagagaca

SEQ ID NO: 832353 - RNA, 17 nt, Human
cucuccuuccucugagg

SEQ ID NO: 832354 - RNA, 22 nt, Human
gggcagggguagcauuccaagu

SEQ ID NO: 832355 - RNA, 22 nt, Human
gaagaauccuguccucuuuagg

SEQ ID NO: 832356 - RNA, 22 nt, Human
uuucaagcauaacugggaagag

SEQ ID NO: 832357 - RNA, 22 nt, Human
ggcuuccuggggccuccugcaa

SEQ ID NO: 832358 - RNA, 22 nt, Human
ggugccagccuagugcaguggu

SEQ ID NO: 832359 - RNA, 22 nt, Human
acauuucuuccacaugcugcug

SEQ ID NO: 832360 - RNA, 22 nt, Human
ggcugccaggagggaggccagu

SEQ ID NO: 832361 - RNA, 19 nt, Human
ugcuuccucaccaucuccc

SEQ ID NO: 832362 - RNA, 22 nt, Human
aacaacugaaaagcuuuuucug

SEQ ID NO: 832363 - RNA, 22 nt, Human
ugcucuccggcuuccguggccu

SEQ ID NO: 832364 - RNA, 22 nt, Human
auauucuugugauuauaaagua

SEQ ID NO: 832365 - RNA, 22 nt, Human
gugucccaauguucaggacggc

SEQ ID NO: 832366 - RNA, 22 nt, Human
ggaaagagcuaaaagggugaga

SEQ ID NO: 832367 - RNA, 22 nt, Human
agaggaugguugaggaagaccu

SEQ ID NO: 832368 - RNA, 22 nt, Human
ugggggugaaagucuggacagu

SEQ ID NO: 832369 - RNA, 22 nt, Human
ggcagcaucucuggcagcagcu

SEQ ID NO: 832370 - RNA, 22 nt, Human
cagcucaaguuucccaggucag

SEQ ID NO: 832371 - RNA, 22 nt, Human
aggugauguccacagcuugcag

SEQ ID NO: 832372 - RNA, 18 nt, Human
acugugguuuauguguag

SEQ ID NO: 832373 - RNA, 22 nt, Human
aggcagcaaagaaaugaugcug

SEQ ID NO: 832374 - RNA, 20 nt, Human
uccaagggcagcagaaucag

SEQ ID NO: 832375 - RNA, 22 nt, Human
gccugcagaggugcugcuagcu

SEQ ID NO: 832376 - RNA, 22 nt, Human
uugucugaaagaucauuacauu

SEQ ID NO: 832377 - RNA, 23 nt, Human
ugaugggaaggaacgacuaccac

SEQ ID NO: 832378 - RNA, 22 nt, Human
acucugccuuucagcagaugaa

SEQ ID NO: 832379 - RNA, 20 nt, Human
gcagcugaaaguaugacacc

SEQ ID NO: 832380 - RNA, 22 nt, Human
uggcagcuugaaugcagucuuu

SEQ ID NO: 832381 - RNA, 22 nt, Human
gagcugccuguugcauagcaac

SEQ ID NO: 832382 - RNA, 22 nt, Human
gcauacagagaggauguggcau

SEQ ID NO: 832383 - RNA, 22 nt, Human
agagcagauggccagggggccu

SEQ ID NO: 832384 - RNA, 22 nt, Human
uuacagauggaucuagcaaaau

SEQ ID NO: 832385 - RNA, 22 nt, Human
ugaacacauaaggcuuuccugu

SEQ ID NO: 832386 - RNA, 22 nt, Human
ccaaaguccauaguuuacauua

SEQ ID NO: 832387 - RNA, 21 nt, Human
uuucacaaaaguaugugacaa

SEQ ID NO: 832388 - RNA, 22 nt, Human
aauaugcauguauacaugugua

SEQ ID NO: 832389 - RNA, 22 nt, Human
uucagagccacuucaagucuaa

SEQ ID NO: 832390 - RNA, 22 nt, Human
aaauaguuagcccugcauauau

SEQ ID NO: 832391 - RNA, 22 nt, Human
cagggaggaugggcuguuuugc

SEQ ID NO: 832392 - RNA, 22 nt, Human
uuuaggcaagggcaagauuauc

SEQ ID NO: 832393 - RNA, 22 nt, Human
ccaggcuggauuuugcaguuca

SEQ ID NO: 832394 - RNA, 22 nt, Human
aaagcucacaguaauacaaggc

SEQ ID NO: 832395 - RNA, 22 nt, Human
agagcaggcauaaagcuuugaa

SEQ ID NO: 832396 - RNA, 22 nt, Human
acagauugaucuugagaauuau

SEQ ID NO: 832397 - RNA, 22 nt, Human
uucuucaaaauccagcaugauu

SEQ ID NO: 832398 - RNA, 22 nt, Human
ucacauuuuccuugguaucugu

SEQ ID NO: 832399 - RNA, 22 nt, Human
cagggccaagccccuuuggcug

SEQ ID NO: 832400 - RNA, 22 nt, Human
ggggagugacgcagggccauag

SEQ ID NO: 832401 - RNA, 22 nt, Human
caggguuucaccauguuagcag

SEQ ID NO: 832402 - RNA, 22 nt, Human
caucagaagaaagacaaaugau

SEQ ID NO: 832403 - RNA, 18 nt, Human
uaaaugcauguuaauaac

SEQ ID NO: 832404 - RNA, 22 nt, Human
ucccaggaaaacacucgaggac

SEQ ID NO: 832405 - RNA, 22 nt, Human
cauaucccauuggccaggacau

SEQ ID NO: 832406 - RNA, 22 nt, Human
cucugagcuccuggaagcgugc

SEQ ID NO: 832407 - RNA, 21 nt, Human
caaagccaggcaacucucucc

SEQ ID NO: 832408 - RNA, 22 nt, Human
cugaaggacacgugaggagcca

SEQ ID NO: 832409 - RNA, 23 nt, Human
agcaauaagaagggauacaugug

SEQ ID NO: 832410 - RNA, 22 nt, Human
uuuagaaguucacacauuuaaa

SEQ ID NO: 832411 - RNA, 22 nt, Human
cuuguucaguugccucuccugc

SEQ ID NO: 832412 - RNA, 22 nt, Human
agccuggauccauguggcuacc

SEQ ID NO: 832413 - RNA, 22 nt, Human
caguucacacugugcuaucugc

SEQ ID NO: 832414 - RNA, 22 nt, Human
agcauugccugccuauugcuaa

SEQ ID NO: 832415 - RNA, 22 nt, Human
cauuuacagcagacugaugaaa

SEQ ID NO: 832416 - RNA, 22 nt, Human
uguacaugugucuguauaucuu

SEQ ID NO: 832417 - RNA, 22 nt, Human
aagauuuccuucaguagagcua

SEQ ID NO: 832418 - RNA, 22 nt, Human
ucaguaaaugagcaaaaauuuc

SEQ ID NO: 832419 - RNA, 22 nt, Human
gcccagcugucuggcagggaug

SEQ ID NO: 832420 - RNA, 22 nt, Human
cccaggagagagacuugaaucu

SEQ ID NO: 832421 - RNA, 22 nt, Human
auccaaagcccuaaguuaacug

SEQ ID NO: 832422 - RNA, 22 nt, Human
ugggcagauguggcucuccuug

SEQ ID NO: 832423 - RNA, 22 nt, Human
agguccagcuguugcagccucc

SEQ ID NO: 832424 - RNA, 22 nt, Human
acgcagaagggccuggcgugcc

SEQ ID NO: 832425 - RNA, 22 nt, Human
aacauuggauauuuauuaaaag

SEQ ID NO: 832426 - RNA, 22 nt, Human
uuucuguaaguggcaaauaaug

SEQ ID NO: 832427 - RNA, 22 nt, Human
acaggggaauuuacugucauua

SEQ ID NO: 832428 - RNA, 22 nt, Human
uagacagauuuaaaggaaugga

SEQ ID NO: 832429 - RNA, 22 nt, Human
gcccugugcgacucuagagguu

SEQ ID NO: 832430 - RNA, 22 nt, Human
uuuccucuuuguaccuugacua

SEQ ID NO: 832431 - RNA, 22 nt, Human
ugucaccagcugcuccucagga

SEQ ID NO: 832432 - RNA, 23 nt, Human
gaggcacucaggaaaugugagug

SEQ ID NO: 832433 - RNA, 22 nt, Human
agccucucuccagcuuggcaga

SEQ ID NO: 832434 - RNA, 22 nt, Human
gugugccaccagucaaggugaa

SEQ ID NO: 832435 - RNA, 22 nt, Human
uggugugggcguggcaggcaag

SEQ ID NO: 832436 - RNA, 22 nt, Human
gaggccuggucuaugagauguu

SEQ ID NO: 832437 - RNA, 22 nt, Human
gucagcugucuccccagagugg

SEQ ID NO: 832438 - RNA, 22 nt, Human
augcugucgaaaccaaacaucu

SEQ ID NO: 832439 - RNA, 22 nt, Human
agccuccuggaguuucugggau

SEQ ID NO: 832440 - RNA, 21 nt, Human
uuuuauugaugaauggccacu

SEQ ID NO: 832441 - RNA, 22 nt, Human
ccaaggcuggagugcaguggcg

SEQ ID NO: 832442 - RNA, 19 nt, Human
ugcucauggggacuucucc

SEQ ID NO: 832443 - RNA, 22 nt, Human
aagauauucaaagauuuauuag

SEQ ID NO: 832444 - RNA, 22 nt, Human
uuugaaguaccugguucugacu

SEQ ID NO: 832445 - RNA, 22 nt, Human
guggauggauugaggcaguggg

SEQ ID NO: 832446 - RNA, 16 nt, Human
uucugucacguacggc

SEQ ID NO: 832447 - RNA, 22 nt, Human
caagaacauugugaucacuuca

SEQ ID NO: 832448 - RNA, 22 nt, Human
gaggcacugcaguacagugacu

SEQ ID NO: 832449 - RNA, 22 nt, Human
gcugcccauuccacuggauggu

SEQ ID NO: 832450 - RNA, 20 nt, Human
guggccuguccuguuguggg

SEQ ID NO: 832451 - RNA, 22 nt, Human
aagacauuuauuugaaucaauu

SEQ ID NO: 832452 - RNA, 22 nt, Human
caagagcucagaaacccuugcu

SEQ ID NO: 832453 - RNA, 22 nt, Human
ccuggagcccaaggcagugaga

SEQ ID NO: 832454 - RNA, 22 nt, Human
uucuucuccgaggagggcuggu

SEQ ID NO: 832455 - RNA, 22 nt, Human
uugaauaauauguucaggagga

SEQ ID NO: 832456 - RNA, 22 nt, Human
acagcagcacuauugacauuuu

SEQ ID NO: 832457 - RNA, 22 nt, Human
ugggaggagcccucugggaagg

SEQ ID NO: 832458 - RNA, 22 nt, Human
agccuggaauuaaggaaaugca

SEQ ID NO: 832459 - RNA, 22 nt, Human
uccaaaaaacguuugaauaguu

SEQ ID NO: 832460 - RNA, 22 nt, Human
ucagagcuuuggagaccaggaa

SEQ ID NO: 832461 - RNA, 22 nt, Human
agcucugggccaggaacccuaa

SEQ ID NO: 832462 - RNA, 22 nt, Human
aaaguuacuaucacaaugaaau

SEQ ID NO: 832463 - RNA, 22 nt, Human
ggagugacucucggggccacua

SEQ ID NO: 832464 - RNA, 22 nt, Human
uacaaagccugguagauaucug

SEQ ID NO: 832465 - RNA, 22 nt, Human
ucauugcaccccagucccagcu

SEQ ID NO: 832466 - RNA, 22 nt, Human
uggccuggggaccugugagacc

SEQ ID NO: 832467 - RNA, 22 nt, Human
uuuaggcacagggaguugguuu

SEQ ID NO: 832468 - RNA, 22 nt, Human
ccuccaggcugaauaucuagaa

SEQ ID NO: 832469 - RNA, 22 nt, Human
gcaaggcugagcacauuugcau

SEQ ID NO: 832470 - RNA, 22 nt, Human
ugcuggcucaguuugcagacuc

SEQ ID NO: 832471 - RNA, 22 nt, Human
acugggccggugcagaguaguu

SEQ ID NO: 832472 - RNA, 22 nt, Human
agaauguagucuuggagauuua

SEQ ID NO: 832473 - RNA, 22 nt, Human
aggguccaucaaggacugcaca

SEQ ID NO: 832474 - RNA, 22 nt, Human
ggagaaggugcuggucacugug

SEQ ID NO: 832475 - RNA, 22 nt, Human
augcuacagcaucucucaucag

SEQ ID NO: 832476 - RNA, 22 nt, Human
aucuuucagggccauuuguauu

SEQ ID NO: 832477 - RNA, 22 nt, Human
uuggaucauggaaugucugcuu

SEQ ID NO: 832478 - RNA, 22 nt, Human
gcaggauggugcccuuucugcc

SEQ ID NO: 832479 - RNA, 22 nt, Human
ugugaggagaggcccagcuccc

SEQ ID NO: 832480 - RNA, 22 nt, Human
gggcauggugaugugcaccugu

SEQ ID NO: 832481 - RNA, 22 nt, Human
agggccugagcuggcugaccuc

SEQ ID NO: 832482 - RNA, 22 nt, Human
auaggcuuauauaaaaacaucu

SEQ ID NO: 832483 - RNA, 22 nt, Human
agggcagauggaacuuccccga

SEQ ID NO: 832484 - RNA, 22 nt, Human
gcugugugaaaacugggccugg

SEQ ID NO: 832485 - RNA, 22 nt, Human
auucuucagcaggggacacuau

SEQ ID NO: 832486 - RNA, 22 nt, Human
aacaugauggggaagaacaaga

SEQ ID NO: 832487 - RNA, 22 nt, Human
ucaggggaaaucucucagcgaa

SEQ ID NO: 832488 - RNA, 22 nt, Human
uguagaaacuacacaugcaaca

SEQ ID NO: 832489 - RNA, 22 nt, Human
auguauuucuauguagugaaga

SEQ ID NO: 832490 - RNA, 22 nt, Human
aaauguauccuacuuccugagu

SEQ ID NO: 832491 - RNA, 22 nt, Human
guggcaggucccauuggagcag

SEQ ID NO: 832492 - RNA, 22 nt, Human
aggccugagguuccugugcuca

SEQ ID NO: 832493 - RNA, 18 nt, Human
cuucagugacagucuggc

SEQ ID NO: 832494 - RNA, 22 nt, Human
uuaauaaacaggugcagcugaa

SEQ ID NO: 832495 - RNA, 22 nt, Human
augcuuuaaacuauaaauccac

SEQ ID NO: 832496 - RNA, 22 nt, Human
ucccaaagcuacucuucugacu

SEQ ID NO: 832497 - RNA, 22 nt, Human
gaaggggacuggcagcugcaga

SEQ ID NO: 832498 - RNA, 21 nt, Human
aaauggauagggcaauggaag

SEQ ID NO: 832499 - RNA, 22 nt, Human
ugucucagaguaucccugaacu

SEQ ID NO: 832500 - RNA, 22 nt, Human
gcagcccagguguagcucuuug

SEQ ID NO: 832501 - RNA, 22 nt, Human
cugugaggcccugggugcugga

SEQ ID NO: 832502 - RNA, 22 nt, Human
cacagcugccauggcugcacuu

SEQ ID NO: 832503 - RNA, 22 nt, Human
cacacaggagagugcuggaggu

SEQ ID NO: 832504 - RNA, 20 nt, Human
gccuguccugagugucaugg

SEQ ID NO: 832505 - RNA, 22 nt, Human
ugaaaugacaaagguuuuucuu

SEQ ID NO: 832506 - RNA, 20 nt, Human
gcaaauggaucccacaagcc

SEQ ID NO: 832507 - RNA, 22 nt, Human
cuguccuguagcuccaucaguc

SEQ ID NO: 832508 - RNA, 22 nt, Human
agcucccagcuccuuugagaga

SEQ ID NO: 832509 - RNA, 20 nt, Human
ggcugcugugggcagagagg

SEQ ID NO: 832510 - RNA, 22 nt, Human
ucacaaaagcuuuugaauuugg

SEQ ID NO: 832511 - RNA, 22 nt, Human
caaagauuuuagaauuugcaau

SEQ ID NO: 832512 - RNA, 22 nt, Human
accuuaaaacugacacauggag

SEQ ID NO: 832513 - RNA, 22 nt, Human
ucagcagggaggcucugugccc

SEQ ID NO: 832514 - RNA, 22 nt, Human
uuuuuccuagcgauuugucagc

SEQ ID NO: 832515 - RNA, 22 nt, Human
uuuuccagagcugucucuugca

SEQ ID NO: 832516 - RNA, 22 nt, Human
uggagcauauucuggagcuugg

SEQ ID NO: 832517 - RNA, 22 nt, Human
auuuuuaugacaaaccauccuc

SEQ ID NO: 832518 - RNA, 22 nt, Human
acaguguccuuguggucccugu

SEQ ID NO: 832519 - RNA, 22 nt, Human
gaggccugggagccuguccucc

SEQ ID NO: 832520 - RNA, 22 nt, Human
uaacagaaauaguaggugaggg

SEQ ID NO: 832521 - RNA, 22 nt, Human
ucaaguuucucucagauuaugg

SEQ ID NO: 832522 - RNA, 22 nt, Human
uaaguccuauuccaggucucuc

SEQ ID NO: 832523 - RNA, 22 nt, Human
ccagccagucccgcaugaccgc

SEQ ID NO: 832524 - RNA, 22 nt, Human
ucuguucauguugggcuuuucc

SEQ ID NO: 832525 - RNA, 18 nt, Human
cugcccagagcauuucau

SEQ ID NO: 832526 - RNA, 22 nt, Human
gggaaggagccugcuugcuaga

SEQ ID NO: 832527 - RNA, 22 nt, Human
ggagccaguauuuaguggucuu

SEQ ID NO: 832528 - RNA, 22 nt, Human
agccaggaaugcaugcucugcu

SEQ ID NO: 832529 - RNA, 22 nt, Human
aaagcugcugccaaucaggcuu

SEQ ID NO: 832530 - RNA, 22 nt, Human
gcagcugcagguggucccaugc

SEQ ID NO: 832531 - RNA, 18 nt, Human
aagaggaggaaacccagg

SEQ ID NO: 832532 - RNA, 22 nt, Human
cccaggaggaggaaaaagcucg

SEQ ID NO: 832533 - RNA, 22 nt, Human
ccagcucugccaagcgucagcu

SEQ ID NO: 832534 - RNA, 22 nt, Human
cuagaaaucucuguuuacauca

SEQ ID NO: 832535 - RNA, 22 nt, Human
aucuuugaagaggacuugaagu

SEQ ID NO: 832536 - RNA, 22 nt, Human
ugucagaugcgauaaacuagug

SEQ ID NO: 832537 - RNA, 22 nt, Human
uuccaggagacuuccagaaaua

SEQ ID NO: 832538 - RNA, 22 nt, Human
caggcacugugcugagcucugc

SEQ ID NO: 832539 - RNA, 22 nt, Human
cgucuuccucuuacgaugcgcu

SEQ ID NO: 832540 - RNA, 22 nt, Human
aggcagggucuugcuauguugc

SEQ ID NO: 832541 - RNA, 22 nt, Human
auuucaacagaguuugaaggca

SEQ ID NO: 832542 - RNA, 22 nt, Human
aaaguggucaccuucucauuuc

SEQ ID NO: 832543 - RNA, 22 nt, Human
cagcagaggaaagcaaaucuaa

SEQ ID NO: 832544 - RNA, 20 nt, Human
uaugaagauaugugaacagc

SEQ ID NO: 832545 - RNA, 22 nt, Human
uauuaaagggaaguuaugcaug

SEQ ID NO: 832546 - RNA, 22 nt, Human
cuuuauguccuugaagaguugu

SEQ ID NO: 832547 - RNA, 22 nt, Human
gggaaccagccgcuuccgccuc

SEQ ID NO: 832548 - RNA, 22 nt, Human
cuggggcccaucgagggcugag

SEQ ID NO: 832549 - RNA, 21 nt, Human
ggucagggggugccuccaggu

SEQ ID NO: 832550 - RNA, 22 nt, Human
ucuguucagaaauggaagugcc

SEQ ID NO: 832551 - RNA, 23 nt, Human
uguagcaucucuuauuucucagc

SEQ ID NO: 832552 - RNA, 22 nt, Human
gcacugaaugccaaaguguagg

SEQ ID NO: 832553 - RNA, 22 nt, Human
ugcaggggcuugucugggccug

SEQ ID NO: 832554 - RNA, 22 nt, Human
cugggcacuugcucacagcucu

SEQ ID NO: 832555 - RNA, 22 nt, Human
gaaagccagagagaaagggcuc

SEQ ID NO: 832556 - RNA, 22 nt, Human
ucugccuuuucacugccacuaa

SEQ ID NO: 832557 - RNA, 21 nt, Human
cuacuuaaguaggggauuagg

SEQ ID NO: 832558 - RNA, 22 nt, Human
gggcugggcaugguguucccuc

SEQ ID NO: 832559 - RNA, 22 nt, Human
ggugacugguuuaucuggcagu

SEQ ID NO: 832560 - RNA, 22 nt, Human
ugaaaucuuuaguuucuguccc

SEQ ID NO: 832561 - RNA, 22 nt, Human
ugaaacauuugaugaucuuugg

SEQ ID NO: 832562 - RNA, 23 nt, Human
aggugccaacugagagcugagag

SEQ ID NO: 832563 - RNA, 22 nt, Human
ccugcugugaccggggagcagg

SEQ ID NO: 832564 - RNA, 18 nt, Human
aggagccuuugcacugga

SEQ ID NO: 832565 - RNA, 22 nt, Human
cccagcauuucugggcugcacu

SEQ ID NO: 832566 - RNA, 22 nt, Human
ucuucagauugcacugagcaag

SEQ ID NO: 832567 - RNA, 22 nt, Human
caggagggcccgagacucuucc

SEQ ID NO: 832568 - RNA, 22 nt, Human
gauauguauugaaugaucauuu

SEQ ID NO: 832569 - RNA, 22 nt, Human
cauuuaguuauacuaaaacauu

SEQ ID NO: 832570 - RNA, 22 nt, Human
accaggaggccuggagcacaaa

SEQ ID NO: 832571 - RNA, 22 nt, Human
uggcucaguuucugcccagcug

SEQ ID NO: 832572 - RNA, 22 nt, Human
ggcaguggcuccucucuacucc

SEQ ID NO: 832573 - RNA, 23 nt, Human
ugaaacauuuaggguagaauuuc

SEQ ID NO: 832574 - RNA, 22 nt, Human
ugcugcugauggcaccuaggca

SEQ ID NO: 832575 - RNA, 22 nt, Human
ccaaagucagugcucagucguc

SEQ ID NO: 832576 - RNA, 22 nt, Human
ccuccagggcagacggggagca

SEQ ID NO: 832577 - RNA, 22 nt, Human
ugcaaacaggagaguaaguaua

SEQ ID NO: 832578 - RNA, 20 nt, Human
ucuggcucuuugcuccuccc

SEQ ID NO: 832579 - RNA, 22 nt, Human
uguccuuagggauauaaaauau

SEQ ID NO: 832580 - RNA, 22 nt, Human
aggagucagauaugggaaaguu

SEQ ID NO: 832581 - RNA, 22 nt, Human
uauuccaguucaccuuuucauc

SEQ ID NO: 832582 - RNA, 19 nt, Human
ccugggagucagcugaagg

SEQ ID NO: 832583 - RNA, 22 nt, Human
agagcuguucaacguagcaaug

SEQ ID NO: 832584 - RNA, 17 nt, Human
ugaaacaccaagacugu

SEQ ID NO: 832585 - RNA, 19 nt, Human
ucaaggcucccugagggau

SEQ ID NO: 832586 - RNA, 22 nt, Human
aaauggaucuguggaauacauu

SEQ ID NO: 832587 - RNA, 22 nt, Human
caggcaggagccagggauucca

SEQ ID NO: 832588 - RNA, 22 nt, Human
gcagggcaaugaucccgagagg

SEQ ID NO: 832589 - RNA, 22 nt, Human
ucaggccacggcucacugagac

SEQ ID NO: 832590 - RNA, 18 nt, Human
aaggcuucaaagaguaga

SEQ ID NO: 832591 - RNA, 22 nt, Human
uugguccacugugaaauuggga

SEQ ID NO: 832592 - RNA, 22 nt, Human
ucauauaaguuuaaaacuaucu

SEQ ID NO: 832593 - RNA, 22 nt, Human
ggucucagaucuuuauuaaggc

SEQ ID NO: 832594 - RNA, 22 nt, Human
auuucaguagaaaaucuugauu

SEQ ID NO: 832595 - RNA, 22 nt, Human
cagccaggagccucugcaacua

SEQ ID NO: 832596 - RNA, 22 nt, Human
acuggcaguagagggagcgcau

SEQ ID NO: 832597 - RNA, 22 nt, Human
uccaggagauucauuaggucau

SEQ ID NO: 832598 - RNA, 22 nt, Human
aaaaagauguccugaaguuuag

SEQ ID NO: 832599 - RNA, 22 nt, Human
gccaggaggucagccccucaac

SEQ ID NO: 832600 - RNA, 22 nt, Human
gauacaaauucaugucugaauu

SEQ ID NO: 832601 - RNA, 20 nt, Human
acuggaucuggcuggagcug

SEQ ID NO: 832602 - RNA, 22 nt, Human
uauacuuuccugcaacuuugau

SEQ ID NO: 832603 - RNA, 22 nt, Human
accagagcuggcagaguaucaa

SEQ ID NO: 832604 - RNA, 20 nt, Human
aggcacuguugucuguaucc

SEQ ID NO: 832605 - RNA, 22 nt, Human
aggggcuggaguucgagguuac

SEQ ID NO: 832606 - RNA, 22 nt, Human
ggggugggcgugcagggacacc

SEQ ID NO: 832607 - RNA, 22 nt, Human
uuuccucuaaacgcauuugcuu

SEQ ID NO: 832608 - RNA, 22 nt, Human
acuggcugaaguuuacuuuuug

SEQ ID NO: 832609 - RNA, 22 nt, Human
caaggagaaaacggcuucugaa

SEQ ID NO: 832610 - RNA, 22 nt, Human
cucuucuugaaagaggaauuca

SEQ ID NO: 832611 - RNA, 22 nt, Human
augguguagcaugugauaugac

SEQ ID NO: 832612 - RNA, 22 nt, Human
aggcagcuucugauuagcagcg

SEQ ID NO: 832613 - RNA, 22 nt, Human
caggcugcagaggccuuucaug

SEQ ID NO: 832614 - RNA, 22 nt, Human
uggugcaagucucugaggaggg

SEQ ID NO: 832615 - RNA, 22 nt, Human
ugcagggcacacgcacgggugu

SEQ ID NO: 832616 - RNA, 22 nt, Human
uuagauaauguagagauaugag

SEQ ID NO: 832617 - RNA, 22 nt, Human
uggaagcacuuggguuuuguug

SEQ ID NO: 832618 - RNA, 22 nt, Human
cuggagccccagacagggagag

SEQ ID NO: 832619 - RNA, 22 nt, Human
uucacagaguuauuuuuaugcu

SEQ ID NO: 832620 - RNA, 22 nt, Human
gcaaauauucaagacuuuucca

SEQ ID NO: 832621 - RNA, 18 nt, Human
uggcagagugucuguucu

SEQ ID NO: 832622 - RNA, 22 nt, Human
gagcagggagacaacucuggug

SEQ ID NO: 832623 - RNA, 22 nt, Human
ccacagagacagagcccagggu

SEQ ID NO: 832624 - RNA, 22 nt, Human
acagcagccugcagcccugugu

SEQ ID NO: 832625 - RNA, 22 nt, Human
ucacaauacucacucaauggcu

SEQ ID NO: 832626 - RNA, 22 nt, Human
aggggagcuaacaccagagccc

SEQ ID NO: 832627 - RNA, 22 nt, Human
ccaggaguggcuggugaccuuc

SEQ ID NO: 832628 - RNA, 22 nt, Human
ggaugcaggggcagcagagccu

SEQ ID NO: 832629 - RNA, 22 nt, Human
gcuuagucaauuauaaauaggc

SEQ ID NO: 832630 - RNA, 23 nt, Human
cuccccaguguccucaugcaucu

SEQ ID NO: 832631 - RNA, 22 nt, Human
cauuugcagagggugacacucu

SEQ ID NO: 832632 - RNA, 22 nt, Human
caaguaaagaaucacauuucuu

SEQ ID NO: 832633 - RNA, 22 nt, Human
cuugcugucccuugguaugaac

SEQ ID NO: 832634 - RNA, 17 nt, Human
aauagcugcucagagag

SEQ ID NO: 832635 - RNA, 22 nt, Human
acaauucuggguauuuauauag

SEQ ID NO: 832636 - RNA, 22 nt, Human
auaacagagagcuacugaacug

SEQ ID NO: 832637 - RNA, 22 nt, Human
ucccaggaauugaagccagugu

SEQ ID NO: 832638 - RNA, 22 nt, Human
agcuggguguguaucagauaaa

SEQ ID NO: 832639 - RNA, 22 nt, Human
caguggaggcucaagugugcuu

SEQ ID NO: 832640 - RNA, 22 nt, Human
gcagugcuaaguagcuggccca

SEQ ID NO: 832641 - RNA, 22 nt, Human
ugcaggugaaaauuaugaggau

SEQ ID NO: 832642 - RNA, 22 nt, Human
agaaaguucugugaguuguuca

SEQ ID NO: 832643 - RNA, 22 nt, Human
cccucccaggaguggccagaga

SEQ ID NO: 832644 - RNA, 22 nt, Human
gcugucaguuuuacccacagac

SEQ ID NO: 832645 - RNA, 22 nt, Human
ucuggcucccuggagcuccaca

SEQ ID NO: 832646 - RNA, 21 nt, Human
gagcauggcuuacaucagcag

SEQ ID NO: 832647 - RNA, 22 nt, Human
uccuucagggggccgccugcac

SEQ ID NO: 832648 - RNA, 22 nt, Human
ugagccuguggggugacaacca

SEQ ID NO: 832649 - RNA, 22 nt, Human
gcuggcaccugcaccaagcagg

SEQ ID NO: 832650 - RNA, 22 nt, Human
auugacaagugagcugggcugc

SEQ ID NO: 832651 - RNA, 22 nt, Human
gcaguggcaccgcuggcucugg

SEQ ID NO: 832652 - RNA, 22 nt, Human
ccagcuccugggucuuagucag

SEQ ID NO: 832653 - RNA, 17 nt, Human
cgagggcuugcuggcuc

SEQ ID NO: 832654 - RNA, 22 nt, Human
gucccaggcuuauguggagcuu

SEQ ID NO: 832655 - RNA, 22 nt, Human
aaaucaguuaagaugaggccau

SEQ ID NO: 832656 - RNA, 22 nt, Human
aauacugucuuucacagauauu

SEQ ID NO: 832657 - RNA, 22 nt, Human
agugucugccagcugccaggug

SEQ ID NO: 832658 - RNA, 22 nt, Human
ccugggagguggagguugcagc

SEQ ID NO: 832659 - RNA, 23 nt, Human
cuuugccacccagagccugacag

SEQ ID NO: 832660 - RNA, 22 nt, Human
aacacuuucuauuauuaugguu

SEQ ID NO: 832661 - RNA, 22 nt, Human
cuggcucauuuuagcaucaggu

SEQ ID NO: 832662 - RNA, 22 nt, Human
auguguagaacuguaaugccca

SEQ ID NO: 832663 - RNA, 22 nt, Human
cacauuucuaggaaauuaaaug

SEQ ID NO: 832664 - RNA, 22 nt, Human
uuauuauuuuguguacagcaaa

SEQ ID NO: 832665 - RNA, 22 nt, Human
uaacagaaauauuuccagguga

SEQ ID NO: 832666 - RNA, 22 nt, Human
ggagccuggucagguuggcucc

SEQ ID NO: 832667 - RNA, 22 nt, Human
gcagugcugaucccauggcaga

SEQ ID NO: 832668 - RNA, 22 nt, Human
gcucaggaccgaggggugggaa

SEQ ID NO: 832669 - RNA, 22 nt, Human
gcugagcugggacaguccuggg

SEQ ID NO: 832670 - RNA, 22 nt, Human
ccugggcuugcaucugugcugg

SEQ ID NO: 832671 - RNA, 22 nt, Human
gagccagcugagcugcacuguc

SEQ ID NO: 832672 - RNA, 22 nt, Human
gcccaggaguuugcauuuuaac

SEQ ID NO: 832673 - RNA, 22 nt, Human
cggggcugcgcucuuccugccg

SEQ ID NO: 832674 - RNA, 22 nt, Human
aucaguuugagugcugugucaa

SEQ ID NO: 832675 - RNA, 22 nt, Human
ucagaacauuuaaaaagugguu

SEQ ID NO: 832676 - RNA, 22 nt, Human
gccugccuggagcuugagguga

SEQ ID NO: 832677 - RNA, 22 nt, Human
gaggcaugcagagcuggagcag

SEQ ID NO: 832678 - RNA, 22 nt, Human
ccuggagcuuggucacgcugcg

SEQ ID NO: 832679 - RNA, 22 nt, Human
gcccugugccagucacgcugug

SEQ ID NO: 832680 - RNA, 22 nt, Human
cuuguucaguccugacuuccug

SEQ ID NO: 832681 - RNA, 22 nt, Human
cugccucuauucacugaggcag

SEQ ID NO: 832682 - RNA, 22 nt, Human
ugggcugcugucugcacaugcu

SEQ ID NO: 832683 - RNA, 22 nt, Human
gggauggacuuggggacuccag

SEQ ID NO: 832684 - RNA, 22 nt, Human
ugccugugucacagugauguuu

SEQ ID NO: 832685 - RNA, 21 nt, Human
aggcagaaagagcccaggcug

SEQ ID NO: 832686 - RNA, 22 nt, Human
agagugaaguuuuugaaaguga

SEQ ID NO: 832687 - RNA, 22 nt, Human
cugaggugcuauggaggauacg

SEQ ID NO: 832688 - RNA, 23 nt, Human
aguuuuucugcaugguucuguau

SEQ ID NO: 832689 - RNA, 22 nt, Human
augagcuucccagacaggaugg

SEQ ID NO: 832690 - RNA, 22 nt, Human
ucaguguagcagacuuguagcc

SEQ ID NO: 832691 - RNA, 22 nt, Human
cccuggaggcuggaggcaguag

SEQ ID NO: 832692 - RNA, 22 nt, Human
ugagaguauuuuggcauuauca

SEQ ID NO: 832693 - RNA, 22 nt, Human
ucugagagcuguagaagccuau

SEQ ID NO: 832694 - RNA, 20 nt, Human
gcucccugguagaaauguuu

SEQ ID NO: 832695 - RNA, 22 nt, Human
auuggcagaaacagcagggcca

SEQ ID NO: 832696 - RNA, 22 nt, Human
ucuuuucaucauuuaauaggua

SEQ ID NO: 832697 - RNA, 22 nt, Human
caaaugaagaaccuucucaccu

SEQ ID NO: 832698 - RNA, 22 nt, Human
gagcucuggcagggcaggucug

SEQ ID NO: 832699 - RNA, 22 nt, Human
aacuuuauuguuaggggcuaaa

SEQ ID NO: 832700 - RNA, 22 nt, Human
ggaggggucucuagcgaggaga

SEQ ID NO: 832701 - RNA, 22 nt, Human
ucaguuuuuacggucacaggga

SEQ ID NO: 832702 - RNA, 22 nt, Human
gcuguggccaacaaaccacuuu

SEQ ID NO: 832703 - RNA, 22 nt, Human
cuccagggagcuguggagguuu

SEQ ID NO: 832704 - RNA, 22 nt, Human
acuguucauccuuuuugaacaa

SEQ ID NO: 832705 - RNA, 22 nt, Human
gaacagcccuguuaagucuguu

SEQ ID NO: 832706 - RNA, 22 nt, Human
cagcagugucuccagcaucaca

SEQ ID NO: 832707 - RNA, 22 nt, Human
ggagccuuccagacugcccaca

SEQ ID NO: 832708 - RNA, 19 nt, Human
guuaggcaggguggggagu

SEQ ID NO: 832709 - RNA, 22 nt, Human
aaauuccagaaacucaguauau

SEQ ID NO: 832710 - RNA, 22 nt, Human
aaacauguuuucugaauauuuu

SEQ ID NO: 832711 - RNA, 22 nt, Human
acauuucucccugcaugccugc

SEQ ID NO: 832712 - RNA, 22 nt, Human
ugcuggaggggccugaccagga

SEQ ID NO: 832713 - RNA, 22 nt, Human
ugagccugcugucgcuggaccc

SEQ ID NO: 832714 - RNA, 22 nt, Human
cucuuccuacagucugcuaugc

SEQ ID NO: 832715 - RNA, 22 nt, Human
uugggcucaggaguuugagacc

SEQ ID NO: 832716 - RNA, 22 nt, Human
gccagcagggcccaaaugcugg

SEQ ID NO: 832717 - RNA, 19 nt, Human
ucccagagucuagagguug

SEQ ID NO: 832718 - RNA, 22 nt, Human
aggucaaggccaaaagaguggu

SEQ ID NO: 832719 - RNA, 22 nt, Human
gcccagcagcugguggagaagg

SEQ ID NO: 832720 - RNA, 22 nt, Human
cuggcugcuggccugaggaugc

SEQ ID NO: 832721 - RNA, 22 nt, Human
aagauauagauggugguauaaa

SEQ ID NO: 832722 - RNA, 22 nt, Human
aguggcagaagucacuggguag

SEQ ID NO: 832723 - RNA, 22 nt, Human
gcagacaggcccaguggaggga

SEQ ID NO: 832724 - RNA, 22 nt, Human
gaagucuucauucucucugaga

SEQ ID NO: 832725 - RNA, 22 nt, Human
ugccugggggacuaaggccaaa

SEQ ID NO: 832726 - RNA, 22 nt, Human
ggugccaggcuguagucagggu

SEQ ID NO: 832727 - RNA, 22 nt, Human
ugucugugaccucuuuggagcc

SEQ ID NO: 832728 - RNA, 22 nt, Human
uuggaucaaauuucaugcuguc

SEQ ID NO: 832729 - RNA, 22 nt, Human
cucucugggggccaugccaaga

SEQ ID NO: 832730 - RNA, 20 nt, Human
agcugguuaucuuaauucuu

SEQ ID NO: 832731 - RNA, 22 nt, Human
aggggagaguuaaugugaaugu

SEQ ID NO: 832732 - RNA, 22 nt, Human
caggcgagugaacagacucuca

SEQ ID NO: 832733 - RNA, 22 nt, Human
ggaggccaggaaggcucggaga

SEQ ID NO: 832734 - RNA, 22 nt, Human
caggccucuccuuagucuggca

SEQ ID NO: 832735 - RNA, 22 nt, Human
acuagaaauuacucagaauaaa

SEQ ID NO: 832736 - RNA, 22 nt, Human
cccucugccugggaccaagucc

SEQ ID NO: 832737 - RNA, 22 nt, Human
gugguuuugccauuacaaguaa

SEQ ID NO: 832738 - RNA, 22 nt, Human
uuucuugacugcuuaggaaugc

SEQ ID NO: 832739 - RNA, 22 nt, Human
uccaggcuagguuuacaggaca

SEQ ID NO: 832740 - RNA, 22 nt, Human
uggaugcuguaggacacgcucu

SEQ ID NO: 832741 - RNA, 20 nt, Human
uuuacauuuugaaacaguga

SEQ ID NO: 832742 - RNA, 22 nt, Human
ucugugcucuucucaguaucac

SEQ ID NO: 832743 - RNA, 22 nt, Human
uugcauguguaauuuuucuaaa

SEQ ID NO: 832744 - RNA, 22 nt, Human
uuuaggcaauagauggcagugu

SEQ ID NO: 832745 - RNA, 22 nt, Human
ugaggggauacgguacacauug

SEQ ID NO: 832746 - RNA, 22 nt, Human
gccucugcacuguggcacacca

SEQ ID NO: 832747 - RNA, 22 nt, Human
uuacaguauuguuaaacucuuu

SEQ ID NO: 832748 - RNA, 22 nt, Human
gcucugucuucagcacacagua

SEQ ID NO: 832749 - RNA, 22 nt, Human
acuccugggugcugaccagcgu

SEQ ID NO: 832750 - RNA, 22 nt, Human
ucaauaaaauuguuuuccuauc

SEQ ID NO: 832751 - RNA, 22 nt, Human
acuggcagagguuggacaccau

SEQ ID NO: 832752 - RNA, 22 nt, Human
uuaaagaauagugccccuauug

SEQ ID NO: 832753 - RNA, 22 nt, Human
ugcuauacggagcaucuucagg

SEQ ID NO: 832754 - RNA, 22 nt, Human
uguguacacagauaguaauggc

SEQ ID NO: 832755 - RNA, 22 nt, Human
auggcuuuguuccaauaaaacu

SEQ ID NO: 832756 - RNA, 20 nt, Human
gcagcugcccccagucccug

SEQ ID NO: 832757 - RNA, 22 nt, Human
aggggacacggcuucuccaggg

SEQ ID NO: 832758 - RNA, 18 nt, Human
agcagaauucuaggguuc

SEQ ID NO: 832759 - RNA, 22 nt, Human
aguaaacauuuucauauuuucu

SEQ ID NO: 832760 - RNA, 22 nt, Human
gcagugacagggcugcugccuu

SEQ ID NO: 832761 - RNA, 22 nt, Human
uccucugcuccaucuuuacugu

SEQ ID NO: 832762 - RNA, 22 nt, Human
auggcagcaaaugucuggcugg

SEQ ID NO: 832763 - RNA, 22 nt, Human
gguuuaauggagauauuucaga

SEQ ID NO: 832764 - RNA, 20 nt, Human
uguuccaagcuaaugaauga

SEQ ID NO: 832765 - RNA, 22 nt, Human
cugcucuggcguacucggcauc

SEQ ID NO: 832766 - RNA, 22 nt, Human
cucuggccgcagcucagcucug

SEQ ID NO: 832767 - RNA, 22 nt, Human
aaguccaugaucaagauguggc

SEQ ID NO: 832768 - RNA, 22 nt, Human
agaaucucuacucaaguacuug

SEQ ID NO: 832769 - RNA, 22 nt, Human
uaauuuaauuucaugccagccu

SEQ ID NO: 832770 - RNA, 22 nt, Human
uguaugugcuugagaagguggg

SEQ ID NO: 832771 - RNA, 22 nt, Human
aggggugaaggcccgauaggag

SEQ ID NO: 832772 - RNA, 22 nt, Human
aggcagauauuggggugaugug

SEQ ID NO: 832773 - RNA, 22 nt, Human
uguauuuuuaggaaugcgcuau

SEQ ID NO: 832774 - RNA, 22 nt, Human
uacugcaugguggaguggagcu

SEQ ID NO: 832775 - RNA, 22 nt, Human
ugcaccauuuugucaggcuacu

SEQ ID NO: 832776 - RNA, 22 nt, Human
uacaaagugagcaaccucuuuu

SEQ ID NO: 832777 - RNA, 22 nt, Human
uagaauucauguuacuguuagc

SEQ ID NO: 832778 - RNA, 22 nt, Human
ugccagccagguucugaggcua

SEQ ID NO: 832779 - RNA, 22 nt, Human
gacaaaggaucagagguuggga

SEQ ID NO: 832780 - RNA, 22 nt, Human
cagagaccccgcugcccuucug

SEQ ID NO: 832781 - RNA, 22 nt, Human
ggaccugccagaacucaggcua

SEQ ID NO: 832782 - RNA, 22 nt, Human
auuuggcaacauuaauugaauc

SEQ ID NO: 832783 - RNA, 22 nt, Human
uccagcagaaaagagguaggga

SEQ ID NO: 832784 - RNA, 22 nt, Human
ucuguucagcugccucagggua

SEQ ID NO: 832785 - RNA, 22 nt, Human
agggcacagccuaaagccuaug

SEQ ID NO: 832786 - RNA, 22 nt, Human
aaaagacaucuauuucaggcag

SEQ ID NO: 832787 - RNA, 22 nt, Human
cuguagcaaguuauucaauaaa

SEQ ID NO: 832788 - RNA, 22 nt, Human
aaguuugacagaaguuucuaau

SEQ ID NO: 832789 - RNA, 22 nt, Human
uguacauuuagagcucaauaga

SEQ ID NO: 832790 - RNA, 22 nt, Human
uccagccaagggagguuacuag

SEQ ID NO: 832791 - RNA, 22 nt, Human
agggaucaaaaaauguacaugc

SEQ ID NO: 832792 - RNA, 22 nt, Human
uagaaaugaauguuuaaaaguc

SEQ ID NO: 832793 - RNA, 20 nt, Human
cuuagaaauuuuuacccugg

SEQ ID NO: 832794 - RNA, 22 nt, Human
augcuuuuccuaaaaugaugcc

SEQ ID NO: 832795 - RNA, 23 nt, Human
uggcccugaaucuguccuggagg

SEQ ID NO: 832796 - RNA, 22 nt, Human
gacacagcacuguacaaggaau

SEQ ID NO: 832797 - RNA, 22 nt, Human
gaucugaaucaauagaauaacu

SEQ ID NO: 832798 - RNA, 22 nt, Human
ccuguucaauauucuuccuugu

SEQ ID NO: 832799 - RNA, 20 nt, Human
gacaggagaguuagguaggu

SEQ ID NO: 832800 - RNA, 22 nt, Human
gccuggagugcaguggcgugau

SEQ ID NO: 832801 - RNA, 22 nt, Human
uguguuauugccacugaagacc

SEQ ID NO: 832802 - RNA, 22 nt, Human
ccagcccuugagauggaaggga

SEQ ID NO: 832803 - RNA, 23 nt, Human
ggccucuguguucugcccacaug

SEQ ID NO: 832804 - RNA, 22 nt, Human
gaaguuuauuucaaucuauuca

SEQ ID NO: 832805 - RNA, 22 nt, Human
ccagagcccgggaccuggacuu

SEQ ID NO: 832806 - RNA, 22 nt, Human
ucucagagaaaugugucaccau

SEQ ID NO: 832807 - RNA, 20 nt, Human
ucccuggaggugguggcauc

SEQ ID NO: 832808 - RNA, 22 nt, Human
cugcuguguuucacaccucugg

SEQ ID NO: 832809 - RNA, 22 nt, Human
aggaagccaugguggacgucua

SEQ ID NO: 832810 - RNA, 22 nt, Human
ggcagcaggagccaucugguag

SEQ ID NO: 832811 - RNA, 22 nt, Human
gguagcagggcugugagucaga

SEQ ID NO: 832812 - RNA, 22 nt, Human
ugccugucuuggaguccuggcc

SEQ ID NO: 832813 - RNA, 22 nt, Human
ucuuugaaagcuguucuagagu

SEQ ID NO: 832814 - RNA, 22 nt, Human
ugaaauagaaaaacaggcuucu

SEQ ID NO: 832815 - RNA, 22 nt, Human
uggcucaguuccaucaucugga

SEQ ID NO: 832816 - RNA, 22 nt, Human
agagcugcaggguggacccagg

SEQ ID NO: 832817 - RNA, 22 nt, Human
ugaacucucucaagugacagaa

SEQ ID NO: 832818 - RNA, 22 nt, Human
auguuauuuuggaaaauacaaa

SEQ ID NO: 832819 - RNA, 22 nt, Human
ucuuuaauucagcaugaugcgg

SEQ ID NO: 832820 - RNA, 22 nt, Human
uggaauaaagugcuuugaucag

SEQ ID NO: 832821 - RNA, 22 nt, Human
cuuuggcagccucugcuauuga

SEQ ID NO: 832822 - RNA, 22 nt, Human
cacugccugugagcugugugcc

SEQ ID NO: 832823 - RNA, 22 nt, Human
ucugcagaaguggcugggccac

SEQ ID NO: 832824 - RNA, 22 nt, Human
uacaugcucaguaacuuucagu

SEQ ID NO: 832825 - RNA, 22 nt, Human
ugugugccugagccgugccugg

SEQ ID NO: 832826 - RNA, 22 nt, Human
ccaagggcucugacuugccugc

SEQ ID NO: 832827 - RNA, 22 nt, Human
acaaagaucuugcuuuccuacu

SEQ ID NO: 832828 - RNA, 22 nt, Human
acugugugcccugacgccaggg

SEQ ID NO: 832829 - RNA, 21 nt, Human
agaaauguaucauucuuuucc

SEQ ID NO: 832830 - RNA, 22 nt, Human
ccuccugggccuugcucuguga

SEQ ID NO: 832831 - RNA, 22 nt, Human
agaagucauuuauguuagauga

SEQ ID NO: 832832 - RNA, 22 nt, Human
gaaaacuauuggccuagaacaa

SEQ ID NO: 832833 - RNA, 22 nt, Human
aaguuauuuccucgugacugaa

SEQ ID NO: 832834 - RNA, 22 nt, Human
gugcucaggaagcuguuccugc

SEQ ID NO: 832835 - RNA, 22 nt, Human
gcuggaaggcuaggcucaguug

SEQ ID NO: 832836 - RNA, 22 nt, Human
gcugggagcaaagccaugcaua

SEQ ID NO: 832837 - RNA, 21 nt, Human
uccugccuuaguccagagcag

SEQ ID NO: 832838 - RNA, 22 nt, Human
gagcuguccuaccaggaguccu

SEQ ID NO: 832839 - RNA, 22 nt, Human
gaagagcuuaguuguccuagaa

SEQ ID NO: 832840 - RNA, 22 nt, Human
aaaaauagcuucucuugucccu

SEQ ID NO: 832841 - RNA, 22 nt, Human
uucaacuagauuuauacaauuc

SEQ ID NO: 832842 - RNA, 22 nt, Human
aucuacaggcugaggugggagg

SEQ ID NO: 832843 - RNA, 22 nt, Human
cucuggaauuaaggaagccugu

SEQ ID NO: 832844 - RNA, 23 nt, Human
cugcuguuuucuguaccugaagc

SEQ ID NO: 832845 - RNA, 23 nt, Human
gcugagguacauuuacaggaaga

SEQ ID NO: 832846 - RNA, 18 nt, Human
cuguucuagaacuccugu

SEQ ID NO: 832847 - RNA, 22 nt, Human
cauuuauucauuugcuagggcu

SEQ ID NO: 832848 - RNA, 22 nt, Human
agcacaggaccaaggaagcugu

SEQ ID NO: 832849 - RNA, 22 nt, Human
ggaggcucugcuccguguguuc

SEQ ID NO: 832850 - RNA, 19 nt, Human
caggaaggggcgaaucugg

SEQ ID NO: 832851 - RNA, 22 nt, Human
uacuuugaagacaauaucugga

SEQ ID NO: 832852 - RNA, 22 nt, Human
aucuauuaugcugagaaacugu

SEQ ID NO: 832853 - RNA, 22 nt, Human
ugcaccauuaauuuaugugaga

SEQ ID NO: 832854 - RNA, 22 nt, Human
ccugcugugaaacuggcauaug

SEQ ID NO: 832855 - RNA, 22 nt, Human
cugagccaguagucagggacaa

SEQ ID NO: 832856 - RNA, 22 nt, Human
uugcagggaccugcagaaagcu

SEQ ID NO: 832857 - RNA, 22 nt, Human
ugaagcaguucucagaaguggg

SEQ ID NO: 832858 - RNA, 20 nt, Human
gagccuuccccucaccacug

SEQ ID NO: 832859 - RNA, 22 nt, Human
ucacugggagaugugggaaggg

SEQ ID NO: 832860 - RNA, 22 nt, Human
gcugggaagugcaagaucaagg

SEQ ID NO: 832861 - RNA, 22 nt, Human
uccagggacagcgcuggagcua

SEQ ID NO: 832862 - RNA, 22 nt, Human
gcugccacauuuucaggacuaa

SEQ ID NO: 832863 - RNA, 22 nt, Human
uggagccuguguuucugcccag

SEQ ID NO: 832864 - RNA, 22 nt, Human
uauucacagcugccgcacucag

SEQ ID NO: 832865 - RNA, 22 nt, Human
aauuccaggaugcaggaggugc

SEQ ID NO: 832866 - RNA, 22 nt, Human
guuucacagaugguguucauau

SEQ ID NO: 832867 - RNA, 22 nt, Human
cagggcaggaauuugacauugc

SEQ ID NO: 832868 - RNA, 22 nt, Human
uccuugaaaaucuugguuuaga

SEQ ID NO: 832869 - RNA, 22 nt, Human
ccucugaggucauggacuuggc

SEQ ID NO: 832870 - RNA, 22 nt, Human
uggccaggggaguuccccucca

SEQ ID NO: 832871 - RNA, 22 nt, Human
cugagguggaacagaggugaag

SEQ ID NO: 832872 - RNA, 23 nt, Human
agaagcagcuucuggaguaucgg

SEQ ID NO: 832873 - RNA, 22 nt, Human
ucuuugcaucccuuccauaguu

SEQ ID NO: 832874 - RNA, 22 nt, Human
gugacagaguuuuagaucucau

SEQ ID NO: 832875 - RNA, 22 nt, Human
aguuauuacucuuuaacauauu

SEQ ID NO: 832876 - RNA, 22 nt, Human
agagagagggaaacugcuaaac

SEQ ID NO: 832877 - RNA, 22 nt, Human
cagaguggcagucccaggccca

SEQ ID NO: 832878 - RNA, 22 nt, Human
caagagcuacccugugccauau

SEQ ID NO: 832879 - RNA, 22 nt, Human
acuuccuguguuggucuugcug

SEQ ID NO: 832880 - RNA, 22 nt, Human
ugagcuguagcagaugcuguug

SEQ ID NO: 832881 - RNA, 22 nt, Human
guuaaauucgaugauggauaaa

SEQ ID NO: 832882 - RNA, 22 nt, Human
uuuuuccaccguacuuccugag

SEQ ID NO: 832883 - RNA, 21 nt, Human
auucugucaucccagcuacuu

SEQ ID NO: 832884 - RNA, 22 nt, Human
gagaggccaaaaucccugcccc

SEQ ID NO: 832885 - RNA, 22 nt, Human
acuucuugggacccuggcaccg

SEQ ID NO: 832886 - RNA, 22 nt, Human
ugcuguguggaugugaagaauc

SEQ ID NO: 832887 - RNA, 22 nt, Human
ucucuucauagugacacccauc

SEQ ID NO: 832888 - RNA, 22 nt, Human
uaaucuguguaccuucaucgga

SEQ ID NO: 832889 - RNA, 22 nt, Human
agagcuguagcuuccuagagcc

SEQ ID NO: 832890 - RNA, 19 nt, Human
uccuuugaauaucaguuga

SEQ ID NO: 832891 - RNA, 19 nt, Human
agucuuucccacucgucuu

SEQ ID NO: 832892 - RNA, 22 nt, Human
caggugggccgggguuuguucu

SEQ ID NO: 832893 - RNA, 18 nt, Human
aggccugggaagcugagg

SEQ ID NO: 832894 - RNA, 21 nt, Human
agagaauugccuuagauguuc

SEQ ID NO: 832895 - RNA, 22 nt, Human
guuugcauaaaguggaugcagg

SEQ ID NO: 832896 - RNA, 22 nt, Human
gggcuggaucuccugcaggcag

SEQ ID NO: 832897 - RNA, 22 nt, Human
ugguggcuucugaggauggcga

SEQ ID NO: 832898 - RNA, 20 nt, Human
cuguggcucaugcaucugcc

SEQ ID NO: 832899 - RNA, 22 nt, Human
aucaguuuuuauuaauguagcu

SEQ ID NO: 832900 - RNA, 22 nt, Human
aagucagagcaacugagacauu

SEQ ID NO: 832901 - RNA, 18 nt, Human
ucugucuguacaaguauc

SEQ ID NO: 832902 - RNA, 22 nt, Human
aaagauaauguuuccuuauucu

SEQ ID NO: 832903 - RNA, 22 nt, Human
caggcagcguccugcuuccugu

SEQ ID NO: 832904 - RNA, 19 nt, Human
auagaaaggguuaaagaca

SEQ ID NO: 832905 - RNA, 22 nt, Human
ucagcaauccucccacaggugg

SEQ ID NO: 832906 - RNA, 22 nt, Human
gcagauggugccaugucuugug

SEQ ID NO: 832907 - RNA, 22 nt, Human
ggccucugcccucacuccuguc

SEQ ID NO: 832908 - RNA, 22 nt, Human
cuucuuuacuuucuagaaauaa

SEQ ID NO: 832909 - RNA, 22 nt, Human
cacagccugcugcacucaagaa

SEQ ID NO: 832910 - RNA, 22 nt, Human
agcaggguuccaggaguugcag

SEQ ID NO: 832911 - RNA, 22 nt, Human
cucugcagaggcccaaggcuga

SEQ ID NO: 832912 - RNA, 22 nt, Human
ucuauacaugugcacacacauc

SEQ ID NO: 832913 - RNA, 22 nt, Human
ugucccauggauaccaggcuau

SEQ ID NO: 832914 - RNA, 22 nt, Human
uaaaugcaguacaaauuguucu

SEQ ID NO: 832915 - RNA, 22 nt, Human
uuucagaaagcaucaucaaagu

SEQ ID NO: 832916 - RNA, 22 nt, Human
ggccugugucugugccuguccu

SEQ ID NO: 832917 - RNA, 22 nt, Human
aucuggcuuaccuagggugccu

SEQ ID NO: 832918 - RNA, 22 nt, Human
uacauauacugagugauuugcu

SEQ ID NO: 832919 - RNA, 22 nt, Human
aggagcugagucagcccgacag

SEQ ID NO: 832920 - RNA, 22 nt, Human
auuauccagcaccaaugucaga

SEQ ID NO: 832921 - RNA, 22 nt, Human
ugccugucucugacugccauua

SEQ ID NO: 832922 - RNA, 22 nt, Human
gaggcugggaaguccaagacca

SEQ ID NO: 832923 - RNA, 22 nt, Human
uuuuuccuuggaugugucucuc

SEQ ID NO: 832924 - RNA, 22 nt, Human
gcacccaggccggcgacugcag

SEQ ID NO: 832925 - RNA, 23 nt, Human
ccugggcauuggcugcagcuucu

SEQ ID NO: 832926 - RNA, 22 nt, Human
auuccaaacuuaccccagagga

SEQ ID NO: 832927 - RNA, 22 nt, Human
uggcugcucaagggaggaggcu

SEQ ID NO: 832928 - RNA, 18 nt, Human
gaugggagcaagagaaga

SEQ ID NO: 832929 - RNA, 22 nt, Human
ucauugcaguagggagagaccc

SEQ ID NO: 832930 - RNA, 22 nt, Human
uuuaaagaaauuccucaucuuu

SEQ ID NO: 832931 - RNA, 17 nt, Human
uguuccauuugaccacc

SEQ ID NO: 832932 - RNA, 22 nt, Human
augaauaaaacauuuuaaucag

SEQ ID NO: 832933 - RNA, 22 nt, Human
ugucucagaggcaggaagagcc

SEQ ID NO: 832934 - RNA, 22 nt, Human
ucucaggggccuggaguccugg

SEQ ID NO: 832935 - RNA, 22 nt, Human
aaugccaguguguugauuccag

SEQ ID NO: 832936 - RNA, 22 nt, Human
aggaggugacagccugcaucug

SEQ ID NO: 832937 - RNA, 22 nt, Human
ucccagagacaucauuucuccg

SEQ ID NO: 832938 - RNA, 22 nt, Human
uuuucuuauggugaagcacaaa

SEQ ID NO: 832939 - RNA, 22 nt, Human
aagcugccaccagcccagggca

SEQ ID NO: 832940 - RNA, 19 nt, Human
acucaagucuaaugaaauc

SEQ ID NO: 832941 - RNA, 22 nt, Human
uccucucagugugguuguggga

SEQ ID NO: 832942 - RNA, 22 nt, Human
gagucaccuuggccgcuguccc

SEQ ID NO: 832943 - RNA, 22 nt, Human
agcugcaggcccaugcucaguc

SEQ ID NO: 832944 - RNA, 22 nt, Human
gagcugccaagauuacaaucag

SEQ ID NO: 832945 - RNA, 22 nt, Human
caccugagugucaguauucuca

SEQ ID NO: 832946 - RNA, 22 nt, Human
cagcuggcaaguggagcagggu

SEQ ID NO: 832947 - RNA, 23 nt, Human
uggcuucugccccauucucucca

SEQ ID NO: 832948 - RNA, 22 nt, Human
auucccaucgucaacuucacug

SEQ ID NO: 832949 - RNA, 22 nt, Human
ucuguggccuguguccaagugc

SEQ ID NO: 832950 - RNA, 22 nt, Human
cuuaacagagagaaguguugcu

SEQ ID NO: 832951 - RNA, 22 nt, Human
agccccucuguggcucugccuc

SEQ ID NO: 832952 - RNA, 22 nt, Human
uuaugacaggaaaaucacagaa

SEQ ID NO: 832953 - RNA, 22 nt, Human
aaugguuugauggacaaaauga

SEQ ID NO: 832954 - RNA, 22 nt, Human
caguggcugugaccagggaccu

SEQ ID NO: 832955 - RNA, 22 nt, Human
guuuagaauucuaacuuuaagg

SEQ ID NO: 832956 - RNA, 22 nt, Human
agcagcuggggccugugacgau

SEQ ID NO: 832957 - RNA, 22 nt, Human
uccugcugagcgucugucauuu

SEQ ID NO: 832958 - RNA, 22 nt, Human
cauugaaauauggaaacugaug

SEQ ID NO: 832959 - RNA, 22 nt, Human
gcucccagcauugcugcugaau

SEQ ID NO: 832960 - RNA, 22 nt, Human
gggccccuuguaucucuggcuc

SEQ ID NO: 832961 - RNA, 22 nt, Human
aagcugcccuguguuagaguuc

SEQ ID NO: 832962 - RNA, 22 nt, Human
auuauguauuugguauaguuug

SEQ ID NO: 832963 - RNA, 22 nt, Human
uucuuucccuuccagcagcucc

SEQ ID NO: 832964 - RNA, 22 nt, Human
ugugcaguuucuauguugucca

SEQ ID NO: 832965 - RNA, 22 nt, Human
ggggcagauggaacagagcaca

SEQ ID NO: 832966 - RNA, 22 nt, Human
aggccugcagcaggagcaaacc

SEQ ID NO: 832967 - RNA, 22 nt, Human
cuuguccccagcagguugguuu

SEQ ID NO: 832968 - RNA, 22 nt, Human
cugcuccacaccuccauuuccu

SEQ ID NO: 832969 - RNA, 22 nt, Human
gaagcagcuaggaucuucauuu

SEQ ID NO: 832970 - RNA, 22 nt, Human
ggcuucucgugccgaagcaaga

SEQ ID NO: 832971 - RNA, 22 nt, Human
ggagccugacagugcccagcau

SEQ ID NO: 832972 - RNA, 22 nt, Human
cugggccagcaacugcaaugga

SEQ ID NO: 832973 - RNA, 23 nt, Human
ccucccaccuauuucacuuucuu

SEQ ID NO: 832974 - RNA, 22 nt, Human
cugccacuagcuuucacaucuu

SEQ ID NO: 832975 - RNA, 21 nt, Human
ugguggagugugcugagcaug

SEQ ID NO: 832976 - RNA, 22 nt, Human
agcuuuaugggagcuuagauaa

SEQ ID NO: 832977 - RNA, 22 nt, Human
uuggaaagauuauuauuaugaa

SEQ ID NO: 832978 - RNA, 22 nt, Human
gugaauaaucacccuucuggau

SEQ ID NO: 832979 - RNA, 22 nt, Human
uggcagcugugcuucauucuuu

SEQ ID NO: 832980 - RNA, 23 nt, Human
ugggccuggaaagccuuagagag

SEQ ID NO: 832981 - RNA, 22 nt, Human
aaguuauaucaucucauugacg

SEQ ID NO: 832982 - RNA, 22 nt, Human
aagcugccuugcugaggagaaa

SEQ ID NO: 832983 - RNA, 22 nt, Human
agcuguguggugucugacagcu

SEQ ID NO: 832984 - RNA, 22 nt, Human
uuucuucagagagagcuuuccc

SEQ ID NO: 832985 - RNA, 22 nt, Human
uuucaugaggggcaaaaucuca

SEQ ID NO: 832986 - RNA, 22 nt, Human
ccucccaccauuuagagagagc

SEQ ID NO: 832987 - RNA, 22 nt, Human
aggaagcuaaccagggagugag

SEQ ID NO: 832988 - RNA, 22 nt, Human
agacagcaggggagucugguuu

SEQ ID NO: 832989 - RNA, 22 nt, Human
uuuccucugacugcuccccugc

SEQ ID NO: 832990 - RNA, 22 nt, Human
ucuggcucugaauucacuucug

SEQ ID NO: 832991 - RNA, 22 nt, Human
aaaugcagauugucauucagga

SEQ ID NO: 832992 - RNA, 22 nt, Human
agcugcccuguggggaggguug

SEQ ID NO: 832993 - RNA, 22 nt, Human
ccugagguggcugcagcacugc

SEQ ID NO: 832994 - RNA, 22 nt, Human
uaaucuacuguuuauaugaaau

SEQ ID NO: 832995 - RNA, 22 nt, Human
uaaguucagaguucucauuugu

SEQ ID NO: 832996 - RNA, 22 nt, Human
ugggcacaaacaucugccuguu

SEQ ID NO: 832997 - RNA, 22 nt, Human
aguuagaauauaauuauguuaa

SEQ ID NO: 832998 - RNA, 21 nt, Human
uuaagagcuuagcaguaggcc

SEQ ID NO: 832999 - RNA, 22 nt, Human
aucagaaaucuaggauucagaa

SEQ ID NO: 833000 - RNA, 22 nt, Human
ccugcagaccacacucaguccu

SEQ ID NO: 833001 - RNA, 22 nt, Human
agaagcugacagaugcagcagg

SEQ ID NO: 833002 - RNA, 22 nt, Human
gguuggaggugggaauagcuag

SEQ ID NO: 833003 - RNA, 22 nt, Human
gaggcucagagggagcaugguc

SEQ ID NO: 833004 - RNA, 22 nt, Human
uguggcccagaugagugugcua

SEQ ID NO: 833005 - RNA, 22 nt, Human
uuucuucauucaccuucacccc

SEQ ID NO: 833006 - RNA, 22 nt, Human
accuuucaaaguggcuaucacu

SEQ ID NO: 833007 - RNA, 22 nt, Human
uuacauaacgguaugaaaaaug

SEQ ID NO: 833008 - RNA, 22 nt, Human
gcucuggagauggagccuugag

SEQ ID NO: 833009 - RNA, 22 nt, Human
augguuuuccucugcugcuuaa

SEQ ID NO: 833010 - RNA, 22 nt, Human
ucccaagugucuuggaccaggg

SEQ ID NO: 833011 - RNA, 22 nt, Human
aaucuucuacuugacaguucuc

SEQ ID NO: 833012 - RNA, 22 nt, Human
agugucugccaacugcaugguc

SEQ ID NO: 833013 - RNA, 22 nt, Human
gacuuucucuccucccaggugu

SEQ ID NO: 833014 - RNA, 22 nt, Human
auaauuuaaauuaguaugugau

SEQ ID NO: 833015 - RNA, 22 nt, Human
ugauuuccucuacuagcaauua

SEQ ID NO: 833016 - RNA, 22 nt, Human
ucaguaaaugaaugaauauaug

SEQ ID NO: 833017 - RNA, 22 nt, Human
ugauaauauuuugaaucauaag

SEQ ID NO: 833018 - RNA, 22 nt, Human
ucugucacccgagcaggcgaga

SEQ ID NO: 833019 - RNA, 22 nt, Human
accaggaguagaauaucuguga

SEQ ID NO: 833020 - RNA, 22 nt, Human
aaucagaaagaggucauguugc

SEQ ID NO: 833021 - RNA, 22 nt, Human
uuuuccucugcagagcaguuag

SEQ ID NO: 833022 - RNA, 22 nt, Human
uccaggagauacacugcaccag

SEQ ID NO: 833023 - RNA, 22 nt, Human
gggcaguugauggaggucugga

SEQ ID NO: 833024 - RNA, 20 nt, Human
gccugccucagcuagcugag

SEQ ID NO: 833025 - RNA, 22 nt, Human
cauucauuuacuuucaacagcu

SEQ ID NO: 833026 - RNA, 22 nt, Human
gcugccugguuucucagcugca

SEQ ID NO: 833027 - RNA, 22 nt, Human
caagagcucccagaccugggca

SEQ ID NO: 833028 - RNA, 22 nt, Human
gaggcagcucuucugaaugggg

SEQ ID NO: 833029 - RNA, 22 nt, Human
ccugcagguugcagaggcggaa

SEQ ID NO: 833030 - RNA, 18 nt, Human
ccugagcccugcuuacuu

SEQ ID NO: 833031 - RNA, 22 nt, Human
gaguguuccagaaacuggcccu

SEQ ID NO: 833032 - RNA, 22 nt, Human
cucuggaguggguggccgggag

SEQ ID NO: 833033 - RNA, 21 nt, Human
ugggggagaauugguugcuuu

SEQ ID NO: 833034 - RNA, 22 nt, Human
ccaugagcuuccuauauagggu

SEQ ID NO: 833035 - RNA, 22 nt, Human
ugcuuccuucccguucuucucc

SEQ ID NO: 833036 - RNA, 22 nt, Human
uugcauugggagugaggagacc

SEQ ID NO: 833037 - RNA, 22 nt, Human
uccaggagaccagauguaggcc

SEQ ID NO: 833038 - RNA, 22 nt, Human
guuauguacuuuuuaaaucuug

SEQ ID NO: 833039 - RNA, 22 nt, Human
cagagcugauuggauccagaga

SEQ ID NO: 833040 - RNA, 23 nt, Human
agucuucauuguauuuccagacc

SEQ ID NO: 833041 - RNA, 22 nt, Human
uuucuaggcacagugucuuccc

SEQ ID NO: 833042 - RNA, 22 nt, Human
ccuugcguuuuacagcuucuag

SEQ ID NO: 833043 - RNA, 22 nt, Human
gcucagagaaucagcagacacc

SEQ ID NO: 833044 - RNA, 22 nt, Human
agugcuguaacaacuuauuugg

SEQ ID NO: 833045 - RNA, 22 nt, Human
gcuuugaagucugugucuuuug

SEQ ID NO: 833046 - RNA, 22 nt, Human
gggcuugcugauuugggcagga

SEQ ID NO: 833047 - RNA, 22 nt, Human
ccagcuccccucagcagguaau

SEQ ID NO: 833048 - RNA, 20 nt, Human
ugaaaggugggaauuguggg

SEQ ID NO: 833049 - RNA, 22 nt, Human
aagcagccagccaucaugcccg

SEQ ID NO: 833050 - RNA, 20 nt, Human
cugcucugcuuugcaggugg

SEQ ID NO: 833051 - RNA, 22 nt, Human
agucccagagaggucggggcca

SEQ ID NO: 833052 - RNA, 22 nt, Human
acagugacguuuauuugagacg

SEQ ID NO: 833053 - RNA, 22 nt, Human
acagaagagcacauuuaguaug

SEQ ID NO: 833054 - RNA, 22 nt, Human
cagucacacaaguggacuuggg

SEQ ID NO: 833055 - RNA, 22 nt, Human
gcagagcucuguucuuaucucc

SEQ ID NO: 833056 - RNA, 22 nt, Human
uuucauaugggcauuggcaaua

SEQ ID NO: 833057 - RNA, 22 nt, Human
cuuugaaaggaagccacacagc

SEQ ID NO: 833058 - RNA, 22 nt, Human
ccagcucuagccccauguggcu

SEQ ID NO: 833059 - RNA, 22 nt, Human
uccucaggcugccuggaagacu

SEQ ID NO: 833060 - RNA, 22 nt, Human
aaaugccucugcuguacacaau

SEQ ID NO: 833061 - RNA, 22 nt, Human
cuguccugauggugccacuggu

SEQ ID NO: 833062 - RNA, 22 nt, Human
cuauugaaaguguacaauucaa

SEQ ID NO: 833063 - RNA, 19 nt, Human
ucucuggggacacuuucac

SEQ ID NO: 833064 - RNA, 22 nt, Human
caucuucagguucauggucaua

SEQ ID NO: 833065 - RNA, 22 nt, Human
gcccaggacucagggugucgcg

SEQ ID NO: 833066 - RNA, 22 nt, Human
gugucauguagaaauugaugaa

SEQ ID NO: 833067 - RNA, 22 nt, Human
ucuggcucugacacuacuguua

SEQ ID NO: 833068 - RNA, 22 nt, Human
augugucaauuuucaaaugcuu

SEQ ID NO: 833069 - RNA, 22 nt, Human
uccuucagccaugggcucucca

SEQ ID NO: 833070 - RNA, 22 nt, Human
uauagccauuuccaguggcauc

SEQ ID NO: 833071 - RNA, 22 nt, Human
uccucacagucaacacuuugag

SEQ ID NO: 833072 - RNA, 22 nt, Human
gccaggugcuaucccugcgcug

SEQ ID NO: 833073 - RNA, 22 nt, Human
uuuuccaaaguaccaugucccu

SEQ ID NO: 833074 - RNA, 22 nt, Human
ucaagagaaggggaaauagacu

SEQ ID NO: 833075 - RNA, 22 nt, Human
aaaguuagaaugauaucaacga

SEQ ID NO: 833076 - RNA, 22 nt, Human
ccaaggaguagagcaggaagcu

SEQ ID NO: 833077 - RNA, 18 nt, Human
ggagagugacagagucgu

SEQ ID NO: 833078 - RNA, 22 nt, Human
uacagaaaucacaucgcuuuga

SEQ ID NO: 833079 - RNA, 23 nt, Human
ucuccagugucucuucauugagu

SEQ ID NO: 833080 - RNA, 22 nt, Human
cugccuggagcauucugaaggu

SEQ ID NO: 833081 - RNA, 22 nt, Human
ccugucugcaugagugagcaua

SEQ ID NO: 833082 - RNA, 22 nt, Human
gcuuuccuggcccugucccugc

SEQ ID NO: 833083 - RNA, 22 nt, Human
ccugccuggcugucagcagagc

SEQ ID NO: 833084 - RNA, 22 nt, Human
uuaaaaccaucagcuguaagau

SEQ ID NO: 833085 - RNA, 22 nt, Human
aucugcagaggacaggcgagga

SEQ ID NO: 833086 - RNA, 22 nt, Human
augugaaaauccaauggcagca

SEQ ID NO: 833087 - RNA, 22 nt, Human
ugcugccagggcucugcccaca

SEQ ID NO: 833088 - RNA, 23 nt, Human
acugucugauauguuuuccauca

SEQ ID NO: 833089 - RNA, 22 nt, Human
acagaacugggggcacagauag

SEQ ID NO: 833090 - RNA, 22 nt, Human
acaaaguuauucuuucagagga

SEQ ID NO: 833091 - RNA, 20 nt, Human
gcagagcuguucugugggga

SEQ ID NO: 833092 - RNA, 22 nt, Human
gccagccuucuguggccugcaa

SEQ ID NO: 833093 - RNA, 22 nt, Human
gggagccaugcuggucuucuuu

SEQ ID NO: 833094 - RNA, 22 nt, Human
ugucaagucucugaaugaaaug

SEQ ID NO: 833095 - RNA, 20 nt, Human
auacaaagagauugauguau

SEQ ID NO: 833096 - RNA, 19 nt, Human
ccuuggaguuccaggugga

SEQ ID NO: 833097 - RNA, 23 nt, Human
acauacauggagauaaagugaug

SEQ ID NO: 833098 - RNA, 22 nt, Human
cagccugcagggcugccuguug

SEQ ID NO: 833099 - RNA, 22 nt, Human
uuauuccaauuucuccuacaaa

SEQ ID NO: 833100 - RNA, 22 nt, Human
gcagaauugauggagaacuuaa

SEQ ID NO: 833101 - RNA, 22 nt, Human
cauugcacugcagcccgggcaa

SEQ ID NO: 833102 - RNA, 23 nt, Human
agcagggccagaauacuugcugu

SEQ ID NO: 833103 - RNA, 17 nt, Human
aaugaaugaauucuuug

SEQ ID NO: 833104 - RNA, 22 nt, Human
uuguuuugcuaaagggucauca

SEQ ID NO: 833105 - RNA, 22 nt, Human
uucaagauccagcacaacagug

SEQ ID NO: 833106 - RNA, 17 nt, Human
agcugaccagauggacu

SEQ ID NO: 833107 - RNA, 22 nt, Human
cagagccaggguugcaccccug

SEQ ID NO: 833108 - RNA, 22 nt, Human
uuccuguauucuaaagggaaag

SEQ ID NO: 833109 - RNA, 22 nt, Human
agcagccagagaaugaugcagu

SEQ ID NO: 833110 - RNA, 22 nt, Human
gguucacauauugagaguauuc

SEQ ID NO: 833111 - RNA, 19 nt, Human
ggcugccuggagcgagggc

SEQ ID NO: 833112 - RNA, 22 nt, Human
uacauguaagacaugagacucu

SEQ ID NO: 833113 - RNA, 22 nt, Human
ggguaauuggggccuugcagug

SEQ ID NO: 833114 - RNA, 22 nt, Human
cacagcugaaguagccaugugg

SEQ ID NO: 833115 - RNA, 22 nt, Human
ugaauagauuuuuaacauauaa

SEQ ID NO: 833116 - RNA, 23 nt, Human
aacaccaaggcucagagagauaa

SEQ ID NO: 833117 - RNA, 22 nt, Human
aguuuauagcccagauucaugg

SEQ ID NO: 833118 - RNA, 22 nt, Human
gcugucacucuccggccuuccc

SEQ ID NO: 833119 - RNA, 22 nt, Human
gucucccaaccccugugcccag

SEQ ID NO: 833120 - RNA, 22 nt, Human
gugaacuauuggguaucauaaa

SEQ ID NO: 833121 - RNA, 22 nt, Human
cugagagcagggacuugagcca

SEQ ID NO: 833122 - RNA, 22 nt, Human
aucuauacucagaguuaauauc

SEQ ID NO: 833123 - RNA, 22 nt, Human
uaguuuuuucaacaaauggugc

SEQ ID NO: 833124 - RNA, 19 nt, Human
acccucucagugccugagg

SEQ ID NO: 833125 - RNA, 21 nt, Human
aggcucagcagguguauaaag

SEQ ID NO: 833126 - RNA, 22 nt, Human
augugcaugcacuuacaugugu

SEQ ID NO: 833127 - RNA, 22 nt, Human
ccagcccuguaaggaugaggca

SEQ ID NO: 833128 - RNA, 22 nt, Human
uugaaucuggguacuuguaaua

SEQ ID NO: 833129 - RNA, 22 nt, Human
agugcuuuccuucuugugacau

SEQ ID NO: 833130 - RNA, 23 nt, Human
agcuggaggcugucuacucccaa

SEQ ID NO: 833131 - RNA, 22 nt, Human
gauuucaaggaguuuucacagu

SEQ ID NO: 833132 - RNA, 22 nt, Human
gaggggaaaguucugcacaagg

SEQ ID NO: 833133 - RNA, 22 nt, Human
agcugucugucuccugaggaga

SEQ ID NO: 833134 - RNA, 22 nt, Human
gcauaugaucacgugugucggu

SEQ ID NO: 833135 - RNA, 22 nt, Human
uccagcagaccaucaaggcuca

SEQ ID NO: 833136 - RNA, 22 nt, Human
cagcaggguagguuguaucagu

SEQ ID NO: 833137 - RNA, 22 nt, Human
ugaagaauaaaugguugagacu

SEQ ID NO: 833138 - RNA, 22 nt, Human
ugugccuggcauucugggcuuc

SEQ ID NO: 833139 - RNA, 22 nt, Human
agggcccaggacagcaucaggg

SEQ ID NO: 833140 - RNA, 22 nt, Human
cugcuucuaagaaccugcagcu

SEQ ID NO: 833141 - RNA, 22 nt, Human
uaaugaauaaacuugagaguca

SEQ ID NO: 833142 - RNA, 19 nt, Human
ccaggccaucccaguuccc

SEQ ID NO: 833143 - RNA, 22 nt, Human
cugcccuguuuggacagcccgg

SEQ ID NO: 833144 - RNA, 22 nt, Human
ugaagcaggugaauggaugucg

SEQ ID NO: 833145 - RNA, 22 nt, Human
cagagccagaacuagaccuugu

SEQ ID NO: 833146 - RNA, 22 nt, Human
agggagcuucuggccucagccu

SEQ ID NO: 833147 - RNA, 22 nt, Human
agccauucauugugcucucaga

SEQ ID NO: 833148 - RNA, 22 nt, Human
acuggcagagacccugauggcc

SEQ ID NO: 833149 - RNA, 22 nt, Human
gcagugguggagcuuacauauc

SEQ ID NO: 833150 - RNA, 22 nt, Human
agaaagaacgcacuugugcugc

SEQ ID NO: 833151 - RNA, 22 nt, Human
aggaugagccgcgcaagcugac

SEQ ID NO: 833152 - RNA, 22 nt, Human
auuuuccucaagccucuggaag

SEQ ID NO: 833153 - RNA, 22 nt, Human
gccugcagggugaugggcugcc

SEQ ID NO: 833154 - RNA, 18 nt, Human
gggcacuggggacuggag

SEQ ID NO: 833155 - RNA, 22 nt, Human
uugcuuuguggugguucuucca

SEQ ID NO: 833156 - RNA, 22 nt, Human
ugaggcagguggauuacaaggu

SEQ ID NO: 833157 - RNA, 20 nt, Human
ugcugcaguuucaugggacu

SEQ ID NO: 833158 - RNA, 22 nt, Human
gagaggccauggcugugcagug

SEQ ID NO: 833159 - RNA, 22 nt, Human
cugccucuugacagaucguggc

SEQ ID NO: 833160 - RNA, 22 nt, Human
aaaguauuugugauuuuuacca

SEQ ID NO: 833161 - RNA, 22 nt, Human
aggauuuauuccagaaaugcaa

SEQ ID NO: 833162 - RNA, 22 nt, Human
cucacuggcaagacuacaggug

SEQ ID NO: 833163 - RNA, 22 nt, Human
gaggcaccucgcgggaggaggc

SEQ ID NO: 833164 - RNA, 22 nt, Human
auaaagauuucuuuuucucuac

SEQ ID NO: 833165 - RNA, 19 nt, Human
ggccuggauuuagggcucc

SEQ ID NO: 833166 - RNA, 22 nt, Human
ggaggccuagccagcuccaguu

SEQ ID NO: 833167 - RNA, 22 nt, Human
cugugcagcuggcuuccuggaa

SEQ ID NO: 833168 - RNA, 22 nt, Human
aggcagcugugaggacuggauu

SEQ ID NO: 833169 - RNA, 22 nt, Human
ccaggagacuguacugauauuu

SEQ ID NO: 833170 - RNA, 22 nt, Human
cauagaaaguauuauggaauuu

SEQ ID NO: 833171 - RNA, 22 nt, Human
uaauuuaauccaaguguuacau

SEQ ID NO: 833172 - RNA, 22 nt, Human
uuugacauuauccuguuacugg

SEQ ID NO: 833173 - RNA, 22 nt, Human
aaggacagaaacagauugcugg

SEQ ID NO: 833174 - RNA, 22 nt, Human
uauuucugauugcucaugaggc

SEQ ID NO: 833175 - RNA, 22 nt, Human
cagggugccuguccucagcaaa

SEQ ID NO: 833176 - RNA, 18 nt, Human
acauuucuaggugaaagc

SEQ ID NO: 833177 - RNA, 22 nt, Human
uggcauuugggcuggcuuuucu

SEQ ID NO: 833178 - RNA, 22 nt, Human
aaauguuuugcucccauguggu

SEQ ID NO: 833179 - RNA, 22 nt, Human
agaauuucaaauggaaguuuua

SEQ ID NO: 833180 - RNA, 22 nt, Human
uuccucaugggguuccuucaga

SEQ ID NO: 833181 - RNA, 22 nt, Human
cagcagcucccauccgcugagc

SEQ ID NO: 833182 - RNA, 21 nt, Human
cugagggccgcagcugggcuc

SEQ ID NO: 833183 - RNA, 22 nt, Human
gccugguggacacugggcauca

SEQ ID NO: 833184 - RNA, 22 nt, Human
gcugccaauccagcugugggag

SEQ ID NO: 833185 - RNA, 22 nt, Human
aggagcugggcugcugcuggga

SEQ ID NO: 833186 - RNA, 23 nt, Human
ccugaagggucaggguccucagc

SEQ ID NO: 833187 - RNA, 22 nt, Human
agccuggaagaaccugaagucu

SEQ ID NO: 833188 - RNA, 22 nt, Human
cccagcaguaaccaguggaaau

SEQ ID NO: 833189 - RNA, 22 nt, Human
ggaaaugacuuggugcuucguu

SEQ ID NO: 833190 - RNA, 22 nt, Human
cagccuucugaaugaacguacu

SEQ ID NO: 833191 - RNA, 22 nt, Human
cuggccacaacuagcccaggac

SEQ ID NO: 833192 - RNA, 22 nt, Human
cccauugugguuguugaggaua

SEQ ID NO: 833193 - RNA, 22 nt, Human
caguacuuuucuggcuuucuac

SEQ ID NO: 833194 - RNA, 22 nt, Human
aaggucauugguucugaauucu

SEQ ID NO: 833195 - RNA, 17 nt, Human
auuuccucagggcugag

SEQ ID NO: 833196 - RNA, 22 nt, Human
uucagaaagguaaauggauuuc

SEQ ID NO: 833197 - RNA, 22 nt, Human
gagaggagucccuaucacaguu

SEQ ID NO: 833198 - RNA, 22 nt, Human
ccaggccuggaccaugccaggg

SEQ ID NO: 833199 - RNA, 22 nt, Human
cagggguggcugcagcagaggu

SEQ ID NO: 833200 - RNA, 22 nt, Human
ccagcugagaaguguaaaguga

SEQ ID NO: 833201 - RNA, 22 nt, Human
aaaagucugcucucauuucaga

SEQ ID NO: 833202 - RNA, 22 nt, Human
uccugggaagagaccugagcau

SEQ ID NO: 833203 - RNA, 18 nt, Human
gcccugguggagcuggug

SEQ ID NO: 833204 - RNA, 21 nt, Human
agugaaaugaaguguaugcuc

SEQ ID NO: 833205 - RNA, 22 nt, Human
uauuuccaccuauuauuuucug

SEQ ID NO: 833206 - RNA, 21 nt, Human
ggcagaaguagcauggacggg

SEQ ID NO: 833207 - RNA, 22 nt, Human
ugggagcaagcuggugcuggag

SEQ ID NO: 833208 - RNA, 22 nt, Human
ucaugcccagagcaguaaauua

SEQ ID NO: 833209 - RNA, 20 nt, Human
ugggagcuggugaggucuca

SEQ ID NO: 833210 - RNA, 23 nt, Human
aucaagauaauccagaugaccua

SEQ ID NO: 833211 - RNA, 22 nt, Human
cugaggucaauuaaucaacaac

SEQ ID NO: 833212 - RNA, 20 nt, Human
gcugaccccugcugucaugc

SEQ ID NO: 833213 - RNA, 22 nt, Human
gcucccaggaugaggagccagg

SEQ ID NO: 833214 - RNA, 15 nt, Human
aggcacugugggacc

SEQ ID NO: 833215 - RNA, 22 nt, Human
uauuucagcaagaagaaugugg

SEQ ID NO: 833216 - RNA, 22 nt, Human
ggagccuguuaguugagugcuc

SEQ ID NO: 833217 - RNA, 22 nt, Human
uggagcagggcaucacugugcg

SEQ ID NO: 833218 - RNA, 22 nt, Human
uacauuaucuuguuaucuuuca

SEQ ID NO: 833219 - RNA, 22 nt, Human
gagaagccgagucagcugagcc

SEQ ID NO: 833220 - RNA, 22 nt, Human
uaaagguagugugacauauugu

SEQ ID NO: 833221 - RNA, 22 nt, Human
acaacuuucuggguuaucugau

SEQ ID NO: 833222 - RNA, 22 nt, Human
augcagcuucaggauuaugaug

SEQ ID NO: 833223 - RNA, 22 nt, Human
ccauuguaguaucuguuuuagu

SEQ ID NO: 833224 - RNA, 22 nt, Human
gguggccucugcaggccucgac

SEQ ID NO: 833225 - RNA, 22 nt, Human
aggcugcugaggccaccacgcu

SEQ ID NO: 833226 - RNA, 22 nt, Human
uguuccaucaguuuuugguuga

SEQ ID NO: 833227 - RNA, 22 nt, Human
uggcacugccaaccugcuaggu

SEQ ID NO: 833228 - RNA, 22 nt, Human
ccugccugggcucacuugccag

SEQ ID NO: 833229 - RNA, 22 nt, Human
aagggcaggaaaagauggaugu

SEQ ID NO: 833230 - RNA, 22 nt, Human
auaaacaguagagaaagguggu

SEQ ID NO: 833231 - RNA, 22 nt, Human
gcauuuguguucuuccuagagc

SEQ ID NO: 833232 - RNA, 18 nt, Human
ucagcuggggcugcagcc

SEQ ID NO: 833233 - RNA, 22 nt, Human
agcugagagguggcaagcugua

SEQ ID NO: 833234 - RNA, 22 nt, Human
ccagagagauugcuucuaaaga

SEQ ID NO: 833235 - RNA, 22 nt, Human
ugguccagaugccuuggcuuua

SEQ ID NO: 833236 - RNA, 23 nt, Human
cuugcagggcuggaggcuuagaa

SEQ ID NO: 833237 - RNA, 19 nt, Human
agcauccagucaugggauc

SEQ ID NO: 833238 - RNA, 22 nt, Human
ugggacagagugagcuuuggcc

SEQ ID NO: 833239 - RNA, 22 nt, Human
uuuaggcaugcaguucuauuua

SEQ ID NO: 833240 - RNA, 22 nt, Human
uguguauucagcaagcgaaaca

SEQ ID NO: 833241 - RNA, 22 nt, Human
augaaaacggaccagagcuauu

SEQ ID NO: 833242 - RNA, 22 nt, Human
cugagccaugagccugcgccca

SEQ ID NO: 833243 - RNA, 22 nt, Human
gagaggggcccaagccacauag

SEQ ID NO: 833244 - RNA, 22 nt, Human
agcuccugaaaagcgcuugcuu

SEQ ID NO: 833245 - RNA, 22 nt, Human
ucuggcugcugcgugagugcuu

SEQ ID NO: 833246 - RNA, 22 nt, Human
ugaaaucuuauacuuugguagu

SEQ ID NO: 833247 - RNA, 22 nt, Human
ucagaguguuuuacuaaacaag

SEQ ID NO: 833248 - RNA, 22 nt, Human
cauauuugguauaacuuaagca

SEQ ID NO: 833249 - RNA, 22 nt, Human
uauccaaacauauagucucucu

SEQ ID NO: 833250 - RNA, 20 nt, Human
acccagcucugugcccuggg

SEQ ID NO: 833251 - RNA, 22 nt, Human
aaacuuuguagagaaugcuggc

SEQ ID NO: 833252 - RNA, 22 nt, Human
gcuggauccugauucgucuuug

SEQ ID NO: 833253 - RNA, 22 nt, Human
ccugggcaucucaugcaccugc

SEQ ID NO: 833254 - RNA, 22 nt, Human
uuucacacaacgugaauauacu

SEQ ID NO: 833255 - RNA, 22 nt, Human
agggaggucuuugaggggcuua

SEQ ID NO: 833256 - RNA, 22 nt, Human
uucaaaacagcuagauauugga

SEQ ID NO: 833257 - RNA, 22 nt, Human
ugcauauuuguaugauguuuag

SEQ ID NO: 833258 - RNA, 22 nt, Human
aucaguuuguauaugaaacacu

SEQ ID NO: 833259 - RNA, 22 nt, Human
cccauuuaucccaagguuacuc

SEQ ID NO: 833260 - RNA, 22 nt, Human
cuaauacucauuucuguaacuc

SEQ ID NO: 833261 - RNA, 22 nt, Human
caggaggccaacugugggacuu

SEQ ID NO: 833262 - RNA, 22 nt, Human
ugaaacaagauccacagacuug

SEQ ID NO: 833263 - RNA, 22 nt, Human
ccucaggguggcaucagaucuu

SEQ ID NO: 833264 - RNA, 22 nt, Human
agcaggagcccuuaucaccagg

SEQ ID NO: 833265 - RNA, 22 nt, Human
cucucuguuaugcuuucaugaa

SEQ ID NO: 833266 - RNA, 22 nt, Human
caaaggagguaaugggugugag

SEQ ID NO: 833267 - RNA, 22 nt, Human
guccucugacucagccuuggga

SEQ ID NO: 833268 - RNA, 22 nt, Human
aaggagcucccggcagaccagg

SEQ ID NO: 833269 - RNA, 22 nt, Human
cugggagcccgcguccuggugg

SEQ ID NO: 833270 - RNA, 22 nt, Human
auuugaagaaaguuuucuagau

SEQ ID NO: 833271 - RNA, 22 nt, Human
ggcaggguggcccuccagugag

SEQ ID NO: 833272 - RNA, 22 nt, Human
ugcugcacucaccaacagauaa

SEQ ID NO: 833273 - RNA, 22 nt, Human
agcccaggucucaaaguacagg

SEQ ID NO: 833274 - RNA, 22 nt, Human
aggucaccauggcaugcuccac

SEQ ID NO: 833275 - RNA, 22 nt, Human
cacaauacuauuuuuaggucuu

SEQ ID NO: 833276 - RNA, 22 nt, Human
uccugggcugcagggaagagca

SEQ ID NO: 833277 - RNA, 22 nt, Human
cagcucugcugggaggaugcag

SEQ ID NO: 833278 - RNA, 18 nt, Human
aaguccuuccuuugcuuu

SEQ ID NO: 833279 - RNA, 22 nt, Human
aaaguucaugguguuauagaaa

SEQ ID NO: 833280 - RNA, 22 nt, Human
gucccagaugucuggaacuccc

SEQ ID NO: 833281 - RNA, 22 nt, Human
uagaaaauagggccuguggagc

SEQ ID NO: 833282 - RNA, 22 nt, Human
uggcaauuuuaggugguuuagu

SEQ ID NO: 833283 - RNA, 22 nt, Human
ucagggcaggcgagcagcugcu

SEQ ID NO: 833284 - RNA, 20 nt, Human
gagggcaggcacccauuuca

SEQ ID NO: 833285 - RNA, 22 nt, Human
aguccuuaugagaugcugccuu

SEQ ID NO: 833286 - RNA, 22 nt, Human
uuugcauuuguuuagaaccuga

SEQ ID NO: 833287 - RNA, 22 nt, Human
uuccuuagaguuuccagaaagc

SEQ ID NO: 833288 - RNA, 22 nt, Human
ccugagugaauucccucacugu

SEQ ID NO: 833289 - RNA, 22 nt, Human
ccuggguggcagagguugcagu

SEQ ID NO: 833290 - RNA, 22 nt, Human
gcuauacagcaggagaauggaa

SEQ ID NO: 833291 - RNA, 22 nt, Human
agccuccaucccaugcacaaag

SEQ ID NO: 833292 - RNA, 22 nt, Human
ugcagaaggaggaggaaaucca

SEQ ID NO: 833293 - RNA, 23 nt, Human
uucuucucaauuaguugauucag

SEQ ID NO: 833294 - RNA, 22 nt, Human
augcugugaaaaagaaggcuga

SEQ ID NO: 833295 - RNA, 22 nt, Human
cuggugggaggcaagguggaag

SEQ ID NO: 833296 - RNA, 22 nt, Human
gcaggccucuguugagggccuu

SEQ ID NO: 833297 - RNA, 22 nt, Human
uucaugaauggaaucaaugcuc

SEQ ID NO: 833298 - RNA, 22 nt, Human
ucccugggccuccugcuaugca

SEQ ID NO: 833299 - RNA, 20 nt, Human
cacaggccuugugagcagac

SEQ ID NO: 833300 - RNA, 18 nt, Human
agcagcugucagaaugcc

SEQ ID NO: 833301 - RNA, 22 nt, Human
ggagcugcauuuagggagccuu

SEQ ID NO: 833302 - RNA, 22 nt, Human
cccuggagcaucucugcugucu

SEQ ID NO: 833303 - RNA, 22 nt, Human
ggugcucaagagggcauccucu

SEQ ID NO: 833304 - RNA, 22 nt, Human
caauuucagguggauagguuuu

SEQ ID NO: 833305 - RNA, 22 nt, Human
uggccuggaaaaaugcagaugg

SEQ ID NO: 833306 - RNA, 22 nt, Human
caagcagagacuagauagcugu

SEQ ID NO: 833307 - RNA, 22 nt, Human
cggcagcaaaggaagccagguc

SEQ ID NO: 833308 - RNA, 22 nt, Human
gcagaggcuguagggaagguug

SEQ ID NO: 833309 - RNA, 22 nt, Human
aaucccagcuacucaggaaguu

SEQ ID NO: 833310 - RNA, 22 nt, Human
cagcuggcuggucagugcacaa

SEQ ID NO: 833311 - RNA, 22 nt, Human
ggcucuggcaaggggaggcuac

SEQ ID NO: 833312 - RNA, 19 nt, Human
gaguuauugccagggcaug

SEQ ID NO: 833313 - RNA, 22 nt, Human
ugagggcugcuuccagagcuag

SEQ ID NO: 833314 - RNA, 22 nt, Human
aaaguuagacagcaucauuucu

SEQ ID NO: 833315 - RNA, 22 nt, Human
acccagagccagggucaggagc

SEQ ID NO: 833316 - RNA, 22 nt, Human
ugcauuguaggauguuuagcag

SEQ ID NO: 833317 - RNA, 23 nt, Human
cagaaaacccagagcucaguccc

SEQ ID NO: 833318 - RNA, 22 nt, Human
cagcuuccgaccgggggcugca

SEQ ID NO: 833319 - RNA, 22 nt, Human
gcauuucugugcauacacauga

SEQ ID NO: 833320 - RNA, 23 nt, Human
ggaguuggauuguacuugcugcu

SEQ ID NO: 833321 - RNA, 22 nt, Human
ugcccaaguccuccaccgaggu

SEQ ID NO: 833322 - RNA, 22 nt, Human
ucuggccacccgaggccccugc

SEQ ID NO: 833323 - RNA, 22 nt, Human
cuggccuggcagggagggcaug

SEQ ID NO: 833324 - RNA, 22 nt, Human
ugcugguggagaaaguggaggu

SEQ ID NO: 833325 - RNA, 22 nt, Human
gaggacagagccgccuggcaag

SEQ ID NO: 833326 - RNA, 22 nt, Human
aguuucuaccgguacauucagg

SEQ ID NO: 833327 - RNA, 22 nt, Human
ccucccuuggccauagccagcc

SEQ ID NO: 833328 - RNA, 22 nt, Human
aaaaguaauugcaauuuuguag

SEQ ID NO: 833329 - RNA, 22 nt, Human
cagugucuuauuuguagcucag

SEQ ID NO: 833330 - RNA, 22 nt, Human
guagaagugaugucauguuaua

SEQ ID NO: 833331 - RNA, 22 nt, Human
uuuuccagauuggacuuagucc

SEQ ID NO: 833332 - RNA, 22 nt, Human
caggcagcagccacucugguau

SEQ ID NO: 833333 - RNA, 22 nt, Human
uuccaggauagcuuucaggaau

SEQ ID NO: 833334 - RNA, 22 nt, Human
ugaauaaucuuggguauuaaua

SEQ ID NO: 833335 - RNA, 22 nt, Human
aauaauuacccaucuuuuugua

SEQ ID NO: 833336 - RNA, 22 nt, Human
aucuggcuuucuuaaugacuua

SEQ ID NO: 833337 - RNA, 20 nt, Human
agguggcuccugcugggggu

SEQ ID NO: 833338 - RNA, 20 nt, Human
uauuucugggcaaccauuua

SEQ ID NO: 833339 - RNA, 22 nt, Human
cauuucaaggaccacccuggga

SEQ ID NO: 833340 - RNA, 22 nt, Human
uucuuaaagaggcaaaacacag

SEQ ID NO: 833341 - RNA, 19 nt, Human
ucaaaugccaaugucacag

SEQ ID NO: 833342 - RNA, 22 nt, Human
gacaauacagaaagggacaugc

SEQ ID NO: 833343 - RNA, 22 nt, Human
gcucugagaggugcagcaguaa

SEQ ID NO: 833344 - RNA, 22 nt, Human
accaggaguuuugaccaggggc

SEQ ID NO: 833345 - RNA, 22 nt, Human
auacaacagaaaaugauuauuc

SEQ ID NO: 833346 - RNA, 22 nt, Human
ugcaauaacuacuuuaauguug

SEQ ID NO: 833347 - RNA, 22 nt, Human
uucuaacucuguuauguguuuc

SEQ ID NO: 833348 - RNA, 22 nt, Human
augguacaaaauguauaaaguc

SEQ ID NO: 833349 - RNA, 22 nt, Human
agagaaaacucauugagguguc

SEQ ID NO: 833350 - RNA, 15 nt, Human
cagucccagggaccc

SEQ ID NO: 833351 - RNA, 22 nt, Human
uaaucuguauuccuacuuugca

SEQ ID NO: 833352 - RNA, 22 nt, Human
agcugcagauucuaucuagaag

SEQ ID NO: 833353 - RNA, 22 nt, Human
cacacagaugguaagggaggga

SEQ ID NO: 833354 - RNA, 22 nt, Human
agcuguguagggaaucagagaa

SEQ ID NO: 833355 - RNA, 19 nt, Human
ccucccacggauuccuucc

SEQ ID NO: 833356 - RNA, 22 nt, Human
guggagccaggaucuccgcaca

SEQ ID NO: 833357 - RNA, 22 nt, Human
ugaggcuggcaaggcugguauu

SEQ ID NO: 833358 - RNA, 22 nt, Human
cuggcucccagcuuucagggag

SEQ ID NO: 833359 - RNA, 22 nt, Human
uucucuuuucaccaguugcuaa

SEQ ID NO: 833360 - RNA, 21 nt, Human
cuguggaagggaacuagaggg

SEQ ID NO: 833361 - RNA, 22 nt, Human
acauuaucccuggcacaacugc

SEQ ID NO: 833362 - RNA, 21 nt, Human
cugcucuggggaccggcugug

SEQ ID NO: 833363 - RNA, 22 nt, Human
ugcucugugguccaagauggcu

SEQ ID NO: 833364 - RNA, 22 nt, Human
augcuuaauacacuguuaaagg

SEQ ID NO: 833365 - RNA, 22 nt, Human
ggguccagcgacagcaggcuca

SEQ ID NO: 833366 - RNA, 22 nt, Human
gacagaagaggaacuuggacag

SEQ ID NO: 833367 - RNA, 22 nt, Human
cagcaaaagccagcauaagcuc

SEQ ID NO: 833368 - RNA, 22 nt, Human
aucaguuuggugcuuucaguga

SEQ ID NO: 833369 - RNA, 22 nt, Human
ucaccuuagcuagaggaagaga

SEQ ID NO: 833370 - RNA, 22 nt, Human
uuauuuaaaagugguaagauuc

SEQ ID NO: 833371 - RNA, 22 nt, Human
aagcugccugccacgcuagaua

SEQ ID NO: 833372 - RNA, 22 nt, Human
uuauagaaggagcauucacuua

SEQ ID NO: 833373 - RNA, 20 nt, Human
ucugaggcugagcucuacuu

SEQ ID NO: 833374 - RNA, 22 nt, Human
cggcuggguucggcugcaggcc

SEQ ID NO: 833375 - RNA, 22 nt, Human
auguccuuccauuuugaucugu

SEQ ID NO: 833376 - RNA, 22 nt, Human
aucagaaaggugggcaagcaga

SEQ ID NO: 833377 - RNA, 22 nt, Human
uucaaagugcauguuccucaga

SEQ ID NO: 833378 - RNA, 22 nt, Human
ccucugggagacugcuacugag

SEQ ID NO: 833379 - RNA, 22 nt, Human
ugaaacaaugugaaguugcuga

SEQ ID NO: 833380 - RNA, 22 nt, Human
aggacagcccuugagagcacau

SEQ ID NO: 833381 - RNA, 17 nt, Human
agagggaaaaugcgguu

SEQ ID NO: 833382 - RNA, 21 nt, Human
auggauuuaaacaggccacaa

SEQ ID NO: 833383 - RNA, 22 nt, Human
ucagagaaaugaaguagggauu

SEQ ID NO: 833384 - RNA, 22 nt, Human
cagcugggagcuccauuagaua

SEQ ID NO: 833385 - RNA, 22 nt, Human
cugggcacuuuggggagccuac

SEQ ID NO: 833386 - RNA, 22 nt, Human
gccagcucagaugcaggaagga

SEQ ID NO: 833387 - RNA, 21 nt, Human
uggcucugcucagagcagucc

SEQ ID NO: 833388 - RNA, 22 nt, Human
ugggcagacugagcccuguccc

SEQ ID NO: 833389 - RNA, 22 nt, Human
ucauuuccucaaauucaagguu

SEQ ID NO: 833390 - RNA, 20 nt, Human
auugucagccuucagaggag

SEQ ID NO: 833391 - RNA, 22 nt, Human
aguuuccaaagcauguucacac

SEQ ID NO: 833392 - RNA, 22 nt, Human
agucccagugacuuggccagaa

SEQ ID NO: 833393 - RNA, 22 nt, Human
uuucuaguaaucaauauaaagu

SEQ ID NO: 833394 - RNA, 22 nt, Human
uuaauacaagcauaugcacaca

SEQ ID NO: 833395 - RNA, 22 nt, Human
gagcagcuguccccaaagcuuc

SEQ ID NO: 833396 - RNA, 22 nt, Human
cugccacuuacuaggcauggug

SEQ ID NO: 833397 - RNA, 22 nt, Human
uaauuccaaguugagacaugca

SEQ ID NO: 833398 - RNA, 22 nt, Human
ucagggacuaggugcugccuga

SEQ ID NO: 833399 - RNA, 18 nt, Human
ggcugagguugacuagaa

SEQ ID NO: 833400 - RNA, 22 nt, Human
acagcagccuuguugguuucga

SEQ ID NO: 833401 - RNA, 20 nt, Human
cacguuuuuccacuagcaaa

SEQ ID NO: 833402 - RNA, 22 nt, Human
aggcaggcacacuuccuccagg

SEQ ID NO: 833403 - RNA, 22 nt, Human
uguauagaguuggaagaugacu

SEQ ID NO: 833404 - RNA, 22 nt, Human
acuguucaucucuuagaaagua

SEQ ID NO: 833405 - RNA, 22 nt, Human
cccagcuccagagccagaaaca

SEQ ID NO: 833406 - RNA, 22 nt, Human
acugugcaugaaccgaaacaaa

SEQ ID NO: 833407 - RNA, 22 nt, Human
agggcuggcuaggugcguuccc

SEQ ID NO: 833408 - RNA, 22 nt, Human
uccugaggaaaguucaugaaug

SEQ ID NO: 833409 - RNA, 22 nt, Human
gaugcagggcuggcaggagcuu

SEQ ID NO: 833410 - RNA, 22 nt, Human
gagaagguggaccugaaggagc

SEQ ID NO: 833411 - RNA, 22 nt, Human
uaauauguguuacugacuuuuu

SEQ ID NO: 833412 - RNA, 22 nt, Human
gcaggaaagguugagacuuugc

SEQ ID NO: 833413 - RNA, 22 nt, Human
cagcaggaccauugaggcauca

SEQ ID NO: 833414 - RNA, 22 nt, Human
gucaugccagcggagcucggga

SEQ ID NO: 833415 - RNA, 22 nt, Human
ugggaauggaugcuaagugcua

SEQ ID NO: 833416 - RNA, 22 nt, Human
uguuuuaaagccauugccuuuc

SEQ ID NO: 833417 - RNA, 19 nt, Human
ugaaggagggggauggcca

SEQ ID NO: 833418 - RNA, 22 nt, Human
uagcagggccaggcugggaacc

SEQ ID NO: 833419 - RNA, 22 nt, Human
ugaaaugagagcacagaauaaa

SEQ ID NO: 833420 - RNA, 22 nt, Human
cccgggaggaggaaguugcagu

SEQ ID NO: 833421 - RNA, 22 nt, Human
acaaaugcaaguuuuaugucaa

SEQ ID NO: 833422 - RNA, 22 nt, Human
agcucccagagcucgagaguaa

SEQ ID NO: 833423 - RNA, 22 nt, Human
gcauguguggaggagaugugcu

SEQ ID NO: 833424 - RNA, 22 nt, Human
agggcucugagugggaaagagg

SEQ ID NO: 833425 - RNA, 22 nt, Human
cuugcaggccuuucuagcucua

SEQ ID NO: 833426 - RNA, 22 nt, Human
uaugaacauguucauugacuua

SEQ ID NO: 833427 - RNA, 18 nt, Human
agaggggagguaagucug

SEQ ID NO: 833428 - RNA, 22 nt, Human
augaagauaagaccaggcugga

SEQ ID NO: 833429 - RNA, 22 nt, Human
caguggugaagagcaggggcuc

SEQ ID NO: 833430 - RNA, 22 nt, Human
uggaaauguauuugggcaugcc

SEQ ID NO: 833431 - RNA, 22 nt, Human
ucagugucuugggcuugaaugc

SEQ ID NO: 833432 - RNA, 22 nt, Human
agaucugaggguccaagggagg

SEQ ID NO: 833433 - RNA, 22 nt, Human
guaauugacucagcucuguuca

SEQ ID NO: 833434 - RNA, 22 nt, Human
acugcccucccaucuauugcaa

SEQ ID NO: 833435 - RNA, 22 nt, Human
ggagaaggaagaaagcuacuau

SEQ ID NO: 833436 - RNA, 22 nt, Human
ugcacuggggucccagcgcacg

SEQ ID NO: 833437 - RNA, 22 nt, Human
uauauuuaaauccagguugaaa

SEQ ID NO: 833438 - RNA, 22 nt, Human
cagagguaccagcagccucugg

SEQ ID NO: 833439 - RNA, 22 nt, Human
acagauauuuggggaaagacgu

SEQ ID NO: 833440 - RNA, 22 nt, Human
ccaaagcaagucacaugaucaa

SEQ ID NO: 833441 - RNA, 22 nt, Human
uguccuuauauuguggaagggg

SEQ ID NO: 833442 - RNA, 22 nt, Human
gccuaauaugcaaaauugauac

SEQ ID NO: 833443 - RNA, 22 nt, Human
ccuguggcacaugcagggauuc

SEQ ID NO: 833444 - RNA, 22 nt, Human
gccugaggaaugcuccugacuu

SEQ ID NO: 833445 - RNA, 22 nt, Human
cucagggcaguauggcugagag

SEQ ID NO: 833446 - RNA, 22 nt, Human
ugaggcagaguaagauacauga

SEQ ID NO: 833447 - RNA, 19 nt, Human
cuggggcuuugguacugcc

SEQ ID NO: 833448 - RNA, 22 nt, Human
gacuaugugaagugugaauagg

SEQ ID NO: 833449 - RNA, 22 nt, Human
ugcuugugagaguuuuuucaga

SEQ ID NO: 833450 - RNA, 22 nt, Human
ggccccacgggggaguccuagu

SEQ ID NO: 833451 - RNA, 21 nt, Human
aggcucagagaucaaacagua

SEQ ID NO: 833452 - RNA, 22 nt, Human
aaucaguguguaaaguggcugc

SEQ ID NO: 833453 - RNA, 22 nt, Human
aguccuuacaccuggaaccuau

SEQ ID NO: 833454 - RNA, 22 nt, Human
ccagcagcccacaggcgucccu

SEQ ID NO: 833455 - RNA, 22 nt, Human
acuuugaaucucagauaaccaa

SEQ ID NO: 833456 - RNA, 22 nt, Human
uuugggaagaggaaucucugga

SEQ ID NO: 833457 - RNA, 22 nt, Human
ugaacucgggaggaggcugcag

SEQ ID NO: 833458 - RNA, 22 nt, Human
cuucagaggggacucaaaguca

SEQ ID NO: 833459 - RNA, 22 nt, Human
gccugcagugagugcagaaggu

SEQ ID NO: 833460 - RNA, 22 nt, Human
gguggcagucuuaagagaucuu

SEQ ID NO: 833461 - RNA, 22 nt, Human
cccaggcagagagcuggugagc

SEQ ID NO: 833462 - RNA, 22 nt, Human
auuucacucuuaauugcuuccu

SEQ ID NO: 833463 - RNA, 22 nt, Human
augcuuaagcucaguuauauau

SEQ ID NO: 833464 - RNA, 22 nt, Human
auuucagauucagaaauguagg

SEQ ID NO: 833465 - RNA, 22 nt, Human
uuccuuagccugccuuccaggg

SEQ ID NO: 833466 - RNA, 22 nt, Human
aucuggcugagcgaggcccaca

SEQ ID NO: 833467 - RNA, 22 nt, Human
acacaaguucuaaagauugcgc

SEQ ID NO: 833468 - RNA, 22 nt, Human
caguacuugggaaugcugggga

SEQ ID NO: 833469 - RNA, 22 nt, Human
cagcccagcagucuuagccugc

SEQ ID NO: 833470 - RNA, 22 nt, Human
ugcuggcuacugauggcaggcc

SEQ ID NO: 833471 - RNA, 17 nt, Human
ugaauucaaucugcacu

SEQ ID NO: 833472 - RNA, 22 nt, Human
uaaauuaugucacaugacucug

SEQ ID NO: 833473 - RNA, 22 nt, Human
uuuuuauaacucuuuugugaca

SEQ ID NO: 833474 - RNA, 22 nt, Human
gaacuguaguuaauacuacaca

SEQ ID NO: 833475 - RNA, 20 nt, Human
cucucccagcacagcuuccu

SEQ ID NO: 833476 - RNA, 22 nt, Human
cagcugaguuacucugaggucu

SEQ ID NO: 833477 - RNA, 20 nt, Human
aggaagcugagauguagagg

SEQ ID NO: 833478 - RNA, 22 nt, Human
gaacaucagucauaauuuaacg

SEQ ID NO: 833479 - RNA, 23 nt, Human
uagaauucaaucuguuccacauc

SEQ ID NO: 833480 - RNA, 22 nt, Human
ccguagcacaugcuccuggggc

SEQ ID NO: 833481 - RNA, 21 nt, Human
guauugcagaguuaugugcuc

SEQ ID NO: 833482 - RNA, 22 nt, Human
gacagcagggacauguaggaag

SEQ ID NO: 833483 - RNA, 22 nt, Human
guuccauaucacagcagacgaa

SEQ ID NO: 833484 - RNA, 22 nt, Human
agaaaaaucuuggcgcuugucu

SEQ ID NO: 833485 - RNA, 22 nt, Human
caggagaucuuaggaauucuua

SEQ ID NO: 833486 - RNA, 22 nt, Human
ccagcacugcucucagacugag

SEQ ID NO: 833487 - RNA, 20 nt, Human
ugcagagcuggcuggcuccu

SEQ ID NO: 833488 - RNA, 22 nt, Human
uaaagguagcaugaaacugcaa

SEQ ID NO: 833489 - RNA, 22 nt, Human
auggcauuugaaucugucuuuu

SEQ ID NO: 833490 - RNA, 22 nt, Human
uguggccagcagguggcugugu

SEQ ID NO: 833491 - RNA, 17 nt, Human
uugggagagaaagguau

SEQ ID NO: 833492 - RNA, 22 nt, Human
ugucccagauacuggacauaga

SEQ ID NO: 833493 - RNA, 22 nt, Human
uuucaacguguaaucuuauuua

SEQ ID NO: 833494 - RNA, 22 nt, Human
uuugacaucaauacccuagaau

SEQ ID NO: 833495 - RNA, 22 nt, Human
cagugcauaaucuaaauggggg

SEQ ID NO: 833496 - RNA, 22 nt, Human
uacuaaauaguuuaauuccuca

SEQ ID NO: 833497 - RNA, 22 nt, Human
agcugcuguccuaggcacugua

SEQ ID NO: 833498 - RNA, 22 nt, Human
aggcucaguuugguuuccauug

SEQ ID NO: 833499 - RNA, 22 nt, Human
acacaguaugaaaagucuaguu

SEQ ID NO: 833500 - RNA, 22 nt, Human
uagagcuggaaaacugcaggua

SEQ ID NO: 833501 - RNA, 22 nt, Human
gagaagcaaucaguggccaccc

SEQ ID NO: 833502 - RNA, 20 nt, Human
aaggcacuaugucugcuagc

SEQ ID NO: 833503 - RNA, 20 nt, Human
gcugccuguuucuguaagua

SEQ ID NO: 833504 - RNA, 22 nt, Human
accaggaggaaguguuaaugau

SEQ ID NO: 833505 - RNA, 22 nt, Human
agauaaaaugguucaaaggcua

SEQ ID NO: 833506 - RNA, 22 nt, Human
caaaugcaugagaaauaagagg

SEQ ID NO: 833507 - RNA, 22 nt, Human
aagaguuaagcaacagauacca

SEQ ID NO: 833508 - RNA, 22 nt, Human
uacagauauagagauuuauaga

SEQ ID NO: 833509 - RNA, 19 nt, Human
uacauuuguguacacuugu

SEQ ID NO: 833510 - RNA, 22 nt, Human
gcauguuauguaucugcccagc

SEQ ID NO: 833511 - RNA, 22 nt, Human
ugucuagggagcugcucaggcu

SEQ ID NO: 833512 - RNA, 22 nt, Human
cccaagaucuuucgugcacuaa

SEQ ID NO: 833513 - RNA, 22 nt, Human
ccagcagagucuaggaaggagg

SEQ ID NO: 833514 - RNA, 22 nt, Human
cagggcugguuugucgaagaaa

SEQ ID NO: 833515 - RNA, 22 nt, Human
ugaagcaaacgcuucuguuccu

SEQ ID NO: 833516 - RNA, 19 nt, Human
uguuggugcggauguggag

SEQ ID NO: 833517 - RNA, 22 nt, Human
gggcucugggaugcucuuagag

SEQ ID NO: 833518 - RNA, 22 nt, Human
cucaaggaaagucuggagaaga

SEQ ID NO: 833519 - RNA, 22 nt, Human
cucugauuuccuuauucuguca

SEQ ID NO: 833520 - RNA, 23 nt, Human
uuuuccagaaucgacucuguaga

SEQ ID NO: 833521 - RNA, 18 nt, Human
aucucccauuggccaagg

SEQ ID NO: 833522 - RNA, 22 nt, Human
gaguccuuccagcaggcauuua

SEQ ID NO: 833523 - RNA, 22 nt, Human
ugucucaguucccuucucugga

SEQ ID NO: 833524 - RNA, 22 nt, Human
aaucagaacgcucgaucuucgg

SEQ ID NO: 833525 - RNA, 22 nt, Human
cuaugacacaggccauuauaua

SEQ ID NO: 833526 - RNA, 23 nt, Human
caguacuuaguguagcguuaauu

SEQ ID NO: 833527 - RNA, 22 nt, Human
ggucccaggcugcgggcuggug

SEQ ID NO: 833528 - RNA, 22 nt, Human
aggaagccugcaggugacugcu

SEQ ID NO: 833529 - RNA, 22 nt, Human
ucaaaguuuuugagaauuacau

SEQ ID NO: 833530 - RNA, 22 nt, Human
auacaugugggucuaaacauau

SEQ ID NO: 833531 - RNA, 22 nt, Human
agggccuggugaccuggguccu

SEQ ID NO: 833532 - RNA, 22 nt, Human
cugccuuggaaaaugugguaau

SEQ ID NO: 833533 - RNA, 22 nt, Human
cucagcagugacaagagaguau

SEQ ID NO: 833534 - RNA, 22 nt, Human
ucugagcuacgaugccugucac

SEQ ID NO: 833535 - RNA, 22 nt, Human
ucuggcucaaaauacguacucu

SEQ ID NO: 833536 - RNA, 22 nt, Human
ccugggagagucuguggucucc

SEQ ID NO: 833537 - RNA, 22 nt, Human
ugggaccaagucauuucuuuag

SEQ ID NO: 833538 - RNA, 22 nt, Human
gcuguauuuaacaacuggcuca

SEQ ID NO: 833539 - RNA, 22 nt, Human
ggccucugggguccugagccca

SEQ ID NO: 833540 - RNA, 19 nt, Human
guuccaaaggccagaccuu

SEQ ID NO: 833541 - RNA, 22 nt, Human
agcugagcugcagaugacugua

SEQ ID NO: 833542 - RNA, 22 nt, Human
ugcagaagacacaagguaacgu

SEQ ID NO: 833543 - RNA, 21 nt, Human
ugccagcauuaaacagucauu

SEQ ID NO: 833544 - RNA, 22 nt, Human
ucacaauauuuaucuuccaauu

SEQ ID NO: 833545 - RNA, 22 nt, Human
cucagagaagucuuugcuaaac

SEQ ID NO: 833546 - RNA, 23 nt, Human
uccagcagagccuuccaggaggg

SEQ ID NO: 833547 - RNA, 22 nt, Human
ggcugccuucccugagccccgg

SEQ ID NO: 833548 - RNA, 21 nt, Human
cauugucgacauuuuccccuc

SEQ ID NO: 833549 - RNA, 22 nt, Human
cagccagccucucaaccaugca

SEQ ID NO: 833550 - RNA, 22 nt, Human
gcugcaggagcuggagcugugg

SEQ ID NO: 833551 - RNA, 23 nt, Human
aggcagcagguuguccaggguga

SEQ ID NO: 833552 - RNA, 22 nt, Human
cuggagcuaauaauccaucuga

SEQ ID NO: 833553 - RNA, 23 nt, Human
uuagagaugauuaaaaaaucuug

SEQ ID NO: 833554 - RNA, 22 nt, Human
cugugccuggggggcagagcug

SEQ ID NO: 833555 - RNA, 22 nt, Human
gagagucacugucugcauuucc

SEQ ID NO: 833556 - RNA, 22 nt, Human
agaggggcucaagcaguggucu

SEQ ID NO: 833557 - RNA, 22 nt, Human
cccaggaggcagagguugcagu

SEQ ID NO: 833558 - RNA, 22 nt, Human
uaaaaguuuuaguuguacauaa

SEQ ID NO: 833559 - RNA, 22 nt, Human
uguacaguauauuucaaagcca

SEQ ID NO: 833560 - RNA, 22 nt, Human
aagaacugugcuccaggcucca

SEQ ID NO: 833561 - RNA, 22 nt, Human
cccagcugcaccucuauggccu

SEQ ID NO: 833562 - RNA, 20 nt, Human
uccuucaggcagggccuagu

SEQ ID NO: 833563 - RNA, 22 nt, Human
gcagcagcccagggcucucaga

SEQ ID NO: 833564 - RNA, 22 nt, Human
ucagagaaguaagguggggugc

SEQ ID NO: 833565 - RNA, 22 nt, Human
gagagcugggcuuugggugaag

SEQ ID NO: 833566 - RNA, 22 nt, Human
aagccgaggccacacagcagga

SEQ ID NO: 833567 - RNA, 22 nt, Human
ucugccugcaguguggcagggc

SEQ ID NO: 833568 - RNA, 22 nt, Human
gcaguggggcgcugggaguugg

SEQ ID NO: 833569 - RNA, 22 nt, Human
ugggccuggguuccuccugggc

SEQ ID NO: 833570 - RNA, 22 nt, Human
aaugcacagcuaaagugguucc

SEQ ID NO: 833571 - RNA, 22 nt, Human
uuucaguuuuugcucgauguau

SEQ ID NO: 833572 - RNA, 22 nt, Human
ugaggcaggaugcuugcacagg

SEQ ID NO: 833573 - RNA, 22 nt, Human
uggcuucagacuucugcuacgu

SEQ ID NO: 833574 - RNA, 22 nt, Human
aguccaugguucugacucaucu

SEQ ID NO: 833575 - RNA, 22 nt, Human
acaauguaggauauguacuugu

SEQ ID NO: 833576 - RNA, 23 nt, Human
cccuggccuuggggcacaggcug

SEQ ID NO: 833577 - RNA, 22 nt, Human
cagcagagcugugugggaaggg

SEQ ID NO: 833578 - RNA, 22 nt, Human
agugaaauuccuggucuuuguu

SEQ ID NO: 833579 - RNA, 22 nt, Human
caaggcaggaagccugucuuau

SEQ ID NO: 833580 - RNA, 18 nt, Human
gcagcugcaguuguagcu

SEQ ID NO: 833581 - RNA, 22 nt, Human
ggcacagggagccgcaguugca

SEQ ID NO: 833582 - RNA, 22 nt, Human
gcugauuauuacaugucugugg

SEQ ID NO: 833583 - RNA, 22 nt, Human
uccaggagggauugggcugugg

SEQ ID NO: 833584 - RNA, 22 nt, Human
ucaaaauuagugaccaaaggca

SEQ ID NO: 833585 - RNA, 22 nt, Human
cugggagggguagccaauccua

SEQ ID NO: 833586 - RNA, 22 nt, Human
gcagggccuuagcagcggcugc

SEQ ID NO: 833587 - RNA, 20 nt, Human
cccugcagccaugggagugg

SEQ ID NO: 833588 - RNA, 22 nt, Human
ggcuuaaugguucuuuuucuca

SEQ ID NO: 833589 - RNA, 22 nt, Human
agugucugaaccaccggggcau

SEQ ID NO: 833590 - RNA, 22 nt, Human
ugcugucuguuuacuggcuaua

SEQ ID NO: 833591 - RNA, 22 nt, Human
ugaaaucaauugcaauguuuau

SEQ ID NO: 833592 - RNA, 22 nt, Human
accaugggucagccaccucagc

SEQ ID NO: 833593 - RNA, 22 nt, Human
ucucaggaauagaguggcagca

SEQ ID NO: 833594 - RNA, 22 nt, Human
gcagcugagcgugaggaagagu

SEQ ID NO: 833595 - RNA, 22 nt, Human
ggacacagcugcagccacaccc

SEQ ID NO: 833596 - RNA, 17 nt, Human
uucaaagcuuaucaagg

SEQ ID NO: 833597 - RNA, 22 nt, Human
ucauggcacuuagcacaguccu

SEQ ID NO: 833598 - RNA, 22 nt, Human
gaauuucagagguaacaucauc

SEQ ID NO: 833599 - RNA, 22 nt, Human
aggcagaccaugaaucaugacc

SEQ ID NO: 833600 - RNA, 22 nt, Human
uugcuagcugguguaugcauug

SEQ ID NO: 833601 - RNA, 22 nt, Human
cagugcaguugguggcaggggu

SEQ ID NO: 833602 - RNA, 19 nt, Human
uggcugggcgugccuccgu

SEQ ID NO: 833603 - RNA, 20 nt, Human
ucuggcaggugaacgagcug

SEQ ID NO: 833604 - RNA, 22 nt, Human
guguggcugauugacaugguca

SEQ ID NO: 833605 - RNA, 21 nt, Human
cuguuucuugugaagugacac

SEQ ID NO: 833606 - RNA, 22 nt, Human
caaauaguaugagcaaugauuc

SEQ ID NO: 833607 - RNA, 22 nt, Human
ccacagggcacagacaggaagc

SEQ ID NO: 833608 - RNA, 19 nt, Human
uucuccaggcugcagaggg

SEQ ID NO: 833609 - RNA, 22 nt, Human
aagcagaugggacuccaaggca

SEQ ID NO: 833610 - RNA, 22 nt, Human
cagggucuuauaaggccaauuu

SEQ ID NO: 833611 - RNA, 22 nt, Human
uuucuggcagcgggacaggggu

SEQ ID NO: 833612 - RNA, 22 nt, Human
cuuuuuccagcuucaggguggg

SEQ ID NO: 833613 - RNA, 22 nt, Human
uagaaacugauagucuugugcu

SEQ ID NO: 833614 - RNA, 22 nt, Human
uauguacaccggggaagguggg

SEQ ID NO: 833615 - RNA, 22 nt, Human
ccugggugacccgugagcgucc

SEQ ID NO: 833616 - RNA, 22 nt, Human
cagaguacugggagaacagaag

SEQ ID NO: 833617 - RNA, 22 nt, Human
ggcagcagggucuagauugaug

SEQ ID NO: 833618 - RNA, 22 nt, Human
cuugggaaugcuaacagaugac

SEQ ID NO: 833619 - RNA, 22 nt, Human
uuccuuccgggcaccaggcacu

SEQ ID NO: 833620 - RNA, 23 nt, Human
aaccagauaaauggcuccagggc

SEQ ID NO: 833621 - RNA, 22 nt, Human
ccuggagcucacugggagccgg

SEQ ID NO: 833622 - RNA, 22 nt, Human
cagccaucccagccugugguuc

SEQ ID NO: 833623 - RNA, 22 nt, Human
uuuauauuucccaggauuggcc

SEQ ID NO: 833624 - RNA, 22 nt, Human
ugaaggugucuuugugaacauc

SEQ ID NO: 833625 - RNA, 22 nt, Human
ugucugagugugccugggcauu

SEQ ID NO: 833626 - RNA, 23 nt, Human
cuggcucuguagguggcauccuu

SEQ ID NO: 833627 - RNA, 22 nt, Human
uggaaagcgaggaguuggcauu

SEQ ID NO: 833628 - RNA, 22 nt, Human
agcaauauaaauguuggguaga

SEQ ID NO: 833629 - RNA, 22 nt, Human
ugcagccaucuuucuuggagga

SEQ ID NO: 833630 - RNA, 22 nt, Human
aaaguuguucaguaagaaacuc

SEQ ID NO: 833631 - RNA, 22 nt, Human
cucuuaguaaugccaugaagca

SEQ ID NO: 833632 - RNA, 22 nt, Human
agguaaagacugcaaggagaau

SEQ ID NO: 833633 - RNA, 22 nt, Human
gccuccuggccuuugcuccuca

SEQ ID NO: 833634 - RNA, 22 nt, Human
cuggccuuggugcuugcagaca

SEQ ID NO: 833635 - RNA, 18 nt, Human
uacagauuauagauacau

SEQ ID NO: 833636 - RNA, 22 nt, Human
ucuaaccuuugaaacugcuuuc

SEQ ID NO: 833637 - RNA, 22 nt, Human
guacucucuugaaggccuuucu

SEQ ID NO: 833638 - RNA, 21 nt, Human
agagagaaggccauauggucc

SEQ ID NO: 833639 - RNA, 22 nt, Human
gggccuguguguucaggagccu

SEQ ID NO: 833640 - RNA, 22 nt, Human
caguacuugggggguucuaagu

SEQ ID NO: 833641 - RNA, 23 nt, Human
uggcaccaggcauucuaggggua

SEQ ID NO: 833642 - RNA, 22 nt, Human
caggggcuguggcacauggugu

SEQ ID NO: 833643 - RNA, 22 nt, Human
uuccuuagauccuucaaucacg

SEQ ID NO: 833644 - RNA, 22 nt, Human
auaauuuaauuuucacaguggu

SEQ ID NO: 833645 - RNA, 22 nt, Human
accucugcaaugcaaugucaug

SEQ ID NO: 833646 - RNA, 22 nt, Human
agaggagcugggaggcccucgu

SEQ ID NO: 833647 - RNA, 22 nt, Human
uuuccaaaaugaaucuaaugca

SEQ ID NO: 833648 - RNA, 22 nt, Human
uuaaacagguuuuugaauggcc

SEQ ID NO: 833649 - RNA, 22 nt, Human
ccaaacaaauccccauucuuag

SEQ ID NO: 833650 - RNA, 18 nt, Human
uggcagggaggaaauaua

SEQ ID NO: 833651 - RNA, 22 nt, Human
gaaggcaggcuucugauuaggu

SEQ ID NO: 833652 - RNA, 22 nt, Human
gugaaaauaaggcugguucuug

SEQ ID NO: 833653 - RNA, 22 nt, Human
uuccuuagggaaagggauaagg

SEQ ID NO: 833654 - RNA, 22 nt, Human
augcuauacucaaagaaauuca

SEQ ID NO: 833655 - RNA, 22 nt, Human
agggcugcuccuccuucaggcc

SEQ ID NO: 833656 - RNA, 22 nt, Human
auaaacacuucuagggcacaca

SEQ ID NO: 833657 - RNA, 22 nt, Human
cugaaggauuagagagcacuua

SEQ ID NO: 833658 - RNA, 22 nt, Human
cucaggauuaaggaaucuaaau

SEQ ID NO: 833659 - RNA, 22 nt, Human
uucauacaaugggauauuauga

SEQ ID NO: 833660 - RNA, 20 nt, Human
ucugcccaccccggcuccca

SEQ ID NO: 833661 - RNA, 22 nt, Human
gcagcugguuaaugggagaauu

SEQ ID NO: 833662 - RNA, 22 nt, Human
gcagagacuccacugucuugug

SEQ ID NO: 833663 - RNA, 22 nt, Human
ggagcauguggggugagcaggg

SEQ ID NO: 833664 - RNA, 22 nt, Human
guuuucuuugaaugcuucuaga

SEQ ID NO: 833665 - RNA, 22 nt, Human
ucaccacugaacagaccuuugg

SEQ ID NO: 833666 - RNA, 22 nt, Human
auuucuguaacuuaugaaaguu

SEQ ID NO: 833667 - RNA, 22 nt, Human
aguauaaagugguuuucagcac

SEQ ID NO: 833668 - RNA, 21 nt, Human
cacugcagccuugaccugggc

SEQ ID NO: 833669 - RNA, 22 nt, Human
uggccugccuucgcugagcuga

SEQ ID NO: 833670 - RNA, 22 nt, Human
gguauaaaugaucagaucgcug

SEQ ID NO: 833671 - RNA, 22 nt, Human
acugaaggaagcgggcaggggu

SEQ ID NO: 833672 - RNA, 21 nt, Human
agaggccuuacaggauagacc

SEQ ID NO: 833673 - RNA, 20 nt, Human
gggcaguggcgcuaucucag

SEQ ID NO: 833674 - RNA, 22 nt, Human
cugggccauggaagucucugcc

SEQ ID NO: 833675 - RNA, 22 nt, Human
cagugaaaucacaacuuuaguu

SEQ ID NO: 833676 - RNA, 22 nt, Human
uuagaaaugucacagaucugau

SEQ ID NO: 833677 - RNA, 22 nt, Human
cuuguagaauugaaauggucuc

SEQ ID NO: 833678 - RNA, 22 nt, Human
ucagagugugacuuggucauga

SEQ ID NO: 833679 - RNA, 22 nt, Human
aagaaaagaaaccugaggcuuu

SEQ ID NO: 833680 - RNA, 22 nt, Human
cugagcccaggcgggagcugag

SEQ ID NO: 833681 - RNA, 22 nt, Human
uguucaaaugaucuucuuaaau

SEQ ID NO: 833682 - RNA, 22 nt, Human
aggcuggaguacaguggcuauu

SEQ ID NO: 833683 - RNA, 22 nt, Human
ccagcugcgggcaucgagaguu

SEQ ID NO: 833684 - RNA, 22 nt, Human
ucucugucugagccuggcagac

SEQ ID NO: 833685 - RNA, 23 nt, Human
acuuuagauaaauuaugugcaca

SEQ ID NO: 833686 - RNA, 22 nt, Human
cguauacaugaagacauugcug

SEQ ID NO: 833687 - RNA, 22 nt, Human
gcucugcugcuuacuagauggu

SEQ ID NO: 833688 - RNA, 22 nt, Human
uuccuuguuuguagcucuggga

SEQ ID NO: 833689 - RNA, 22 nt, Human
gcaggagcagucaggggcagcu

SEQ ID NO: 833690 - RNA, 22 nt, Human
cagcauggugccagugagucca

SEQ ID NO: 833691 - RNA, 22 nt, Human
agagugauggguugugcugacc

SEQ ID NO: 833692 - RNA, 22 nt, Human
aggugcuuggcucgugcacaca

SEQ ID NO: 833693 - RNA, 22 nt, Human
cucuggaggccuaaggaagugg

SEQ ID NO: 833694 - RNA, 22 nt, Human
agcagcuccugccaugagugcu

SEQ ID NO: 833695 - RNA, 22 nt, Human
uggcucaggcuugaaaauagau

SEQ ID NO: 833696 - RNA, 19 nt, Human
ucucaauguucagaaagcu

SEQ ID NO: 833697 - RNA, 22 nt, Human
ucucccaggcugcccuguggac

SEQ ID NO: 833698 - RNA, 22 nt, Human
agccacagugcaagagagaaaa

SEQ ID NO: 833699 - RNA, 22 nt, Human
aaaucaguuguuauauuaaaga

SEQ ID NO: 833700 - RNA, 22 nt, Human
aaucaguguggugacuugucug

SEQ ID NO: 833701 - RNA, 22 nt, Human
ucccaggauguuggcggcaggu

SEQ ID NO: 833702 - RNA, 22 nt, Human
ccagcugguguuccuuaggacc

SEQ ID NO: 833703 - RNA, 22 nt, Human
ugagacaguucugcagcugggu

SEQ ID NO: 833704 - RNA, 22 nt, Human
aagcaaaagguuacacuucugg

SEQ ID NO: 833705 - RNA, 22 nt, Human
cagggccaaguuggugccuuuu

SEQ ID NO: 833706 - RNA, 22 nt, Human
cuccuuagugccucugcacgag

SEQ ID NO: 833707 - RNA, 22 nt, Human
gggcaggaugcaguuucagaga

SEQ ID NO: 833708 - RNA, 22 nt, Human
auuggcaggaaccgaggagggg

SEQ ID NO: 833709 - RNA, 22 nt, Human
auacaucuuccuuuuaaaaugc

SEQ ID NO: 833710 - RNA, 22 nt, Human
cacugaaauauuaauaucuuau

SEQ ID NO: 833711 - RNA, 22 nt, Human
uacagucuuuggaaagagauag

SEQ ID NO: 833712 - RNA, 22 nt, Human
caucagcaggcaacacucuugg

SEQ ID NO: 833713 - RNA, 22 nt, Human
ugggcucugcugcguaccaguu

SEQ ID NO: 833714 - RNA, 22 nt, Human
ggcugagcacuuuaggcaggag

SEQ ID NO: 833715 - RNA, 22 nt, Human
uccugccucuugccuucuucac

SEQ ID NO: 833716 - RNA, 22 nt, Human
guacaugucaaaaaaugcauaa

SEQ ID NO: 833717 - RNA, 22 nt, Human
ccucuuccacugggccccaucc

SEQ ID NO: 833718 - RNA, 22 nt, Human
gcucugggugaacuuggagcaa

SEQ ID NO: 833719 - RNA, 22 nt, Human
caguaaagcauguaugucuuca

SEQ ID NO: 833720 - RNA, 22 nt, Human
uggaggcaccacuggcugcccg

SEQ ID NO: 833721 - RNA, 22 nt, Human
acaguuaucuuugaaauagaga

SEQ ID NO: 833722 - RNA, 22 nt, Human
ucacuggggccuuuggucagga

SEQ ID NO: 833723 - RNA, 22 nt, Human
uggcucaggauaauuuucccaa

SEQ ID NO: 833724 - RNA, 22 nt, Human
aggcugagauagguggaucauu

SEQ ID NO: 833725 - RNA, 22 nt, Human
gggcagcagagcccugccgagu

SEQ ID NO: 833726 - RNA, 22 nt, Human
ugaagcagagaauuugacaguc

SEQ ID NO: 833727 - RNA, 22 nt, Human
aggagagagcugagcuuugcug

SEQ ID NO: 833728 - RNA, 22 nt, Human
ucugugacuugcgggaggagaa

SEQ ID NO: 833729 - RNA, 22 nt, Human
uggcauuuggcuuacuuauguu

SEQ ID NO: 833730 - RNA, 22 nt, Human
ccaggacucaguggggaaaggg

SEQ ID NO: 833731 - RNA, 22 nt, Human
guuuaauaauguugaauuacua

SEQ ID NO: 833732 - RNA, 22 nt, Human
gaaggaaaggucucaugccuuu

SEQ ID NO: 833733 - RNA, 22 nt, Human
agggcucuguccccagaggccc

SEQ ID NO: 833734 - RNA, 22 nt, Human
ucaccaggcuggaaugcagugg

SEQ ID NO: 833735 - RNA, 22 nt, Human
uggggcugucccgguuuggcga

SEQ ID NO: 833736 - RNA, 22 nt, Human
ugggagcugggguuggacgucu

SEQ ID NO: 833737 - RNA, 22 nt, Human
cccugccucugaagcugcucag

SEQ ID NO: 833738 - RNA, 22 nt, Human
caggacaguuugcuuugcccug

SEQ ID NO: 833739 - RNA, 22 nt, Human
auuaaauuggacgcugggggaa

SEQ ID NO: 833740 - RNA, 22 nt, Human
ugaaaaggagccuuagguaggu

SEQ ID NO: 833741 - RNA, 22 nt, Human
uuaacacauauuuaucaauugc

SEQ ID NO: 833742 - RNA, 22 nt, Human
uuaauuaaauucaugagcauug

SEQ ID NO: 833743 - RNA, 22 nt, Human
cagcacuggggggauucggagc

SEQ ID NO: 833744 - RNA, 22 nt, Human
cgcugccaggauccccugccgg

SEQ ID NO: 833745 - RNA, 22 nt, Human
caggcuugggagcagagccacu

SEQ ID NO: 833746 - RNA, 22 nt, Human
aagauuucugcuuuuggaggca

SEQ ID NO: 833747 - RNA, 19 nt, Human
agggcugcucuggccuggg

SEQ ID NO: 833748 - RNA, 23 nt, Human
cacugcagcguggucuggcagga

SEQ ID NO: 833749 - RNA, 22 nt, Human
ccagagacgucggucagggcgc

SEQ ID NO: 833750 - RNA, 22 nt, Human
ucagcaauaugauaggcuuugu

SEQ ID NO: 833751 - RNA, 22 nt, Human
aaucagaaauucuacaucacaa

SEQ ID NO: 833752 - RNA, 22 nt, Human
auaaaaguucaagagaguacag

SEQ ID NO: 833753 - RNA, 22 nt, Human
ucacugcaaggaggcuucucaa

SEQ ID NO: 833754 - RNA, 22 nt, Human
aggagaggguggcauuaaguuu

SEQ ID NO: 833755 - RNA, 22 nt, Human
aagcagcuggaagaguaagaug

SEQ ID NO: 833756 - RNA, 22 nt, Human
cacaaaugugcagaaaugugag

SEQ ID NO: 833757 - RNA, 22 nt, Human
ccuguguggaaaccgcaugacg

SEQ ID NO: 833758 - RNA, 17 nt, Human
ucuguccagggagugug

SEQ ID NO: 833759 - RNA, 22 nt, Human
ccacagaguuacaaaacaguca

SEQ ID NO: 833760 - RNA, 22 nt, Human
ucugcagauuuaucagcagcug

SEQ ID NO: 833761 - RNA, 23 nt, Human
gugagucuugccuuugcugugga

SEQ ID NO: 833762 - RNA, 20 nt, Human
ugcuuccuggccacugcggg

SEQ ID NO: 833763 - RNA, 22 nt, Human
cagaauaaagguacaauugagu

SEQ ID NO: 833764 - RNA, 22 nt, Human
aggaugaggcuggcaggucuug

SEQ ID NO: 833765 - RNA, 22 nt, Human
cacagggcagguacucucagag

SEQ ID NO: 833766 - RNA, 22 nt, Human
ggcuggcacugaggagagcucu

SEQ ID NO: 833767 - RNA, 19 nt, Human
agccagggugagaaggagc

SEQ ID NO: 833768 - RNA, 22 nt, Human
guuugcauggaagacagugagu

SEQ ID NO: 833769 - RNA, 22 nt, Human
ccaggguguagggauuccagau

SEQ ID NO: 833770 - RNA, 22 nt, Human
aaaucagugcucauuugaaagg

SEQ ID NO: 833771 - RNA, 17 nt, Human
uuccucucacauuuuuu

SEQ ID NO: 833772 - RNA, 22 nt, Human
auuuaguguauucuaauaugug

SEQ ID NO: 833773 - RNA, 22 nt, Human
ugcugcuguuuccuacaucuca

SEQ ID NO: 833774 - RNA, 22 nt, Human
aagcagcacaguaauauuggug

SEQ ID NO: 833775 - RNA, 22 nt, Human
gccaccucggcuuucucugcuc

SEQ ID NO: 833776 - RNA, 22 nt, Human
uuauuccauucaguucaacaag

SEQ ID NO: 833777 - RNA, 22 nt, Human
ccauaaggagccagacauucca

SEQ ID NO: 833778 - RNA, 22 nt, Human
gacagggcgagacucagucuca

SEQ ID NO: 833779 - RNA, 22 nt, Human
uuagagucaaaauggcauguua

SEQ ID NO: 833780 - RNA, 23 nt, Human
aucaaacuggugagaaugucagu

SEQ ID NO: 833781 - RNA, 22 nt, Human
gcaagauguuaacauagggaga

SEQ ID NO: 833782 - RNA, 19 nt, Human
gcagccaggugcucuaccu

SEQ ID NO: 833783 - RNA, 22 nt, Human
auuaaaagcuucccaagaguua

SEQ ID NO: 833784 - RNA, 22 nt, Human
aauguauaaaguguuaauaacu

SEQ ID NO: 833785 - RNA, 22 nt, Human
ggcccaucucuugcucuggguu

SEQ ID NO: 833786 - RNA, 22 nt, Human
acugucaccaucagagcgggaa

SEQ ID NO: 833787 - RNA, 23 nt, Human
ggcugagacuacaggcgcuugcc

SEQ ID NO: 833788 - RNA, 22 nt, Human
gggacugggagauccuccuggc

SEQ ID NO: 833789 - RNA, 22 nt, Human
aacuagaaccacuuguauuucc

SEQ ID NO: 833790 - RNA, 22 nt, Human
ucagcagauggguuguguuggc

SEQ ID NO: 833791 - RNA, 22 nt, Human
gggaguggguuuggccuaggcc

SEQ ID NO: 833792 - RNA, 22 nt, Human
gcagggugauagugaggcucag

SEQ ID NO: 833793 - RNA, 21 nt, Human
ggccugagcaccuguccaccu

SEQ ID NO: 833794 - RNA, 22 nt, Human
augggaggaagagaagaugucu

SEQ ID NO: 833795 - RNA, 22 nt, Human
gacagggccgcagauggagacu

SEQ ID NO: 833796 - RNA, 22 nt, Human
gcucccacgcaauucuuuucag

SEQ ID NO: 833797 - RNA, 22 nt, Human
aauuucagaacccaaauuagcg

SEQ ID NO: 833798 - RNA, 19 nt, Human
auuccucaaggacagaaau

SEQ ID NO: 833799 - RNA, 22 nt, Human
aagauuuagggccaguuuacau

SEQ ID NO: 833800 - RNA, 18 nt, Human
gggcaagcggcugucacc

SEQ ID NO: 833801 - RNA, 22 nt, Human
ugugaaaagcguguguucuagg

SEQ ID NO: 833802 - RNA, 22 nt, Human
uuaaacagacaguaaaugaaac

SEQ ID NO: 833803 - RNA, 22 nt, Human
ccaguccagugccaugcauggc

SEQ ID NO: 833804 - RNA, 22 nt, Human
ucaggcugccuaucagacugug

SEQ ID NO: 833805 - RNA, 22 nt, Human
ggcugcuggcauugagguaggu

SEQ ID NO: 833806 - RNA, 22 nt, Human
cagcuggccaaucagggcgccc

SEQ ID NO: 833807 - RNA, 22 nt, Human
auucuccagcucacuguccaua

SEQ ID NO: 833808 - RNA, 23 nt, Human
uggcucugugucacauacaggau

SEQ ID NO: 833809 - RNA, 22 nt, Human
cagcacagggacaauagcagau

SEQ ID NO: 833810 - RNA, 22 nt, Human
agcugccacaugcccaagggca

SEQ ID NO: 833811 - RNA, 22 nt, Human
uggcagaguggaccauacucaa

SEQ ID NO: 833812 - RNA, 22 nt, Human
uaaauguaccuucugccuuacu

SEQ ID NO: 833813 - RNA, 22 nt, Human
ugccuggguccaggccaagccu

SEQ ID NO: 833814 - RNA, 22 nt, Human
uggcuccuucauucuccugcca

SEQ ID NO: 833815 - RNA, 22 nt, Human
uauguacuaacuuucauucuag

SEQ ID NO: 833816 - RNA, 22 nt, Human
ucugccugcuaacuccugcacc

SEQ ID NO: 833817 - RNA, 22 nt, Human
cugcaguguucuggaaugcauu

SEQ ID NO: 833818 - RNA, 22 nt, Human
gucuggagccacccuaagcauu

SEQ ID NO: 833819 - RNA, 20 nt, Human
ugcuccaucuaaagugauua

SEQ ID NO: 833820 - RNA, 21 nt, Human
uccaggaguggcugggcaggg

SEQ ID NO: 833821 - RNA, 22 nt, Human
uaugcauaauuggauaaguaga

SEQ ID NO: 833822 - RNA, 22 nt, Human
gugcauugcgaugcagacgacc

SEQ ID NO: 833823 - RNA, 22 nt, Human
ugggccuggcccuguggaggag

SEQ ID NO: 833824 - RNA, 22 nt, Human
gggcuggaggaccggccucgga

SEQ ID NO: 833825 - RNA, 23 nt, Human
gugcugugagccccuuggccucc

SEQ ID NO: 833826 - RNA, 22 nt, Human
ucagggcauggcugcacuuggc

SEQ ID NO: 833827 - RNA, 22 nt, Human
ucuccucugcgcggcagugccc

SEQ ID NO: 833828 - RNA, 22 nt, Human
uuuaacuuaaucugcuugauga

SEQ ID NO: 833829 - RNA, 22 nt, Human
cugccuggccugaucuccacgc

SEQ ID NO: 833830 - RNA, 22 nt, Human
agcucacagaaauccugcagga

SEQ ID NO: 833831 - RNA, 22 nt, Human
aacaugucuggguauucacaag

SEQ ID NO: 833832 - RNA, 22 nt, Human
gccgaagcugccgucugguccu

SEQ ID NO: 833833 - RNA, 22 nt, Human
ggcuccuggggaggugagcuug

SEQ ID NO: 833834 - RNA, 22 nt, Human
uagggcuauucugaguaauaau

SEQ ID NO: 833835 - RNA, 22 nt, Human
agauuuauguggucacacucag

SEQ ID NO: 833836 - RNA, 22 nt, Human
uugaacagcuguuacauuguua

SEQ ID NO: 833837 - RNA, 22 nt, Human
auuucauugaaguuaauucuuc

SEQ ID NO: 833838 - RNA, 22 nt, Human
uccuucaagaugccacagcuuu

SEQ ID NO: 833839 - RNA, 22 nt, Human
agaauuguaagcaauuugauua

SEQ ID NO: 833840 - RNA, 22 nt, Human
ccaggcugggcuacaaguugag

SEQ ID NO: 833841 - RNA, 17 nt, Human
cugcuuugugcaacgcu

SEQ ID NO: 833842 - RNA, 22 nt, Human
augggaggguggaaaggcucug

SEQ ID NO: 833843 - RNA, 22 nt, Human
uuuugaaagggugauuuggcuu

SEQ ID NO: 833844 - RNA, 18 nt, Human
uggagccagcucuaggau

SEQ ID NO: 833845 - RNA, 22 nt, Human
cagccacguagcccuuggccgu

SEQ ID NO: 833846 - RNA, 22 nt, Human
cagcugacccagugaggaggca

SEQ ID NO: 833847 - RNA, 22 nt, Human
caggccagugugcuucccaggc

SEQ ID NO: 833848 - RNA, 22 nt, Human
gcugcugguccucagagcucau

SEQ ID NO: 833849 - RNA, 22 nt, Human
ucaaguuuaauugagauguuua

SEQ ID NO: 833850 - RNA, 22 nt, Human
cuugaacucaaugugaggaaga

SEQ ID NO: 833851 - RNA, 22 nt, Human
gacagggcauggugcagaguuc

SEQ ID NO: 833852 - RNA, 22 nt, Human
ugcagcauugcaaagcagucuu

SEQ ID NO: 833853 - RNA, 22 nt, Human
caaguccuccaugugacuaggu

SEQ ID NO: 833854 - RNA, 22 nt, Human
uccuuccucggggacccagauc

SEQ ID NO: 833855 - RNA, 22 nt, Human
ggcugcugugaccucaggugau

SEQ ID NO: 833856 - RNA, 22 nt, Human
ucucuggccgagagucccuggg

SEQ ID NO: 833857 - RNA, 22 nt, Human
agagccugcuguguaagucaca

SEQ ID NO: 833858 - RNA, 22 nt, Human
uuccauaaucaccuuauucuuu

SEQ ID NO: 833859 - RNA, 22 nt, Human
cugcaggcugagcgccugccgg

SEQ ID NO: 833860 - RNA, 22 nt, Human
agcugcugagagucugccgggc

SEQ ID NO: 833861 - RNA, 21 nt, Human
gucagcagauccagcacuugu

SEQ ID NO: 833862 - RNA, 22 nt, Human
uuugcauuacuugacuuuaguu

SEQ ID NO: 833863 - RNA, 20 nt, Human
cuucaggacccauccucccc

SEQ ID NO: 833864 - RNA, 22 nt, Human
ccagggugagugucauggguua

SEQ ID NO: 833865 - RNA, 22 nt, Human
ccuuagagaguacugggcugcc

SEQ ID NO: 833866 - RNA, 21 nt, Human
gcagacugcccugcugucccc

SEQ ID NO: 833867 - RNA, 22 nt, Human
cagagcagaaaccugggugauu

SEQ ID NO: 833868 - RNA, 22 nt, Human
ggccaggaagggaagaucagca

SEQ ID NO: 833869 - RNA, 22 nt, Human
uguuugaacugaauaacauagu

SEQ ID NO: 833870 - RNA, 22 nt, Human
uccaggagagguguggggacug

SEQ ID NO: 833871 - RNA, 22 nt, Human
cagaggccccagaacuagcucu

SEQ ID NO: 833872 - RNA, 22 nt, Human
agacaugucaccaauucuuacu

SEQ ID NO: 833873 - RNA, 22 nt, Human
caggaaugacugcagauggggc

SEQ ID NO: 833874 - RNA, 22 nt, Human
gccagcagccacagaagucacu

SEQ ID NO: 833875 - RNA, 22 nt, Human
agugcugaagacuggcuaggga

SEQ ID NO: 833876 - RNA, 22 nt, Human
ugccugucuucaggagugucac

SEQ ID NO: 833877 - RNA, 21 nt, Human
auaagcaugcugauuacauuu

SEQ ID NO: 833878 - RNA, 22 nt, Human
cugugcuugcggguguggagcc

SEQ ID NO: 833879 - RNA, 23 nt, Human
acagcugcaccuggccgccuggc

SEQ ID NO: 833880 - RNA, 22 nt, Human
ucugagaguagagcugccucuu

SEQ ID NO: 833881 - RNA, 22 nt, Human
acaggggauugauuggaagucu

SEQ ID NO: 833882 - RNA, 22 nt, Human
gggagcaggagccugccugcca

SEQ ID NO: 833883 - RNA, 18 nt, Human
acugugugaauuagcucc

SEQ ID NO: 833884 - RNA, 22 nt, Human
ugcucacagcccagaacauaau

SEQ ID NO: 833885 - RNA, 22 nt, Human
agcccaagcuaugaggugaccu

SEQ ID NO: 833886 - RNA, 22 nt, Human
gugcauguuaaugguguacaaa

SEQ ID NO: 833887 - RNA, 22 nt, Human
gcagcugagagaagaacagggc

SEQ ID NO: 833888 - RNA, 22 nt, Human
cagguaaaaauaaauuugugag

SEQ ID NO: 833889 - RNA, 18 nt, Human
acccucuggcuucugagc

SEQ ID NO: 833890 - RNA, 22 nt, Human
auuuaugacuggugaauagaac

SEQ ID NO: 833891 - RNA, 18 nt, Human
uaaauauauuucccccuu

SEQ ID NO: 833892 - RNA, 22 nt, Human
auguuacacauaggcauaaaug

SEQ ID NO: 833893 - RNA, 17 nt, Human
ccaggagagaugcuugu

SEQ ID NO: 833894 - RNA, 22 nt, Human
uuugaaauaugaggcauuauga

SEQ ID NO: 833895 - RNA, 22 nt, Human
gguggcaggcccugagcauccc

SEQ ID NO: 833896 - RNA, 22 nt, Human
cagagccuaaaacgacuccacu

SEQ ID NO: 833897 - RNA, 22 nt, Human
uggguggcggccugguucugag

SEQ ID NO: 833898 - RNA, 22 nt, Human
uaaaucucacuggguauauugg

SEQ ID NO: 833899 - RNA, 22 nt, Human
aauuuacaguugcugaugguac

SEQ ID NO: 833900 - RNA, 22 nt, Human
cccuuccucccaggcuucugug

SEQ ID NO: 833901 - RNA, 22 nt, Human
ucccagcagucagagcuaugug

SEQ ID NO: 833902 - RNA, 19 nt, Human
ucaaugcaugaaaucagcc

SEQ ID NO: 833903 - RNA, 22 nt, Human
uccagggaaggugugaggcugg

SEQ ID NO: 833904 - RNA, 22 nt, Human
gaguaagagcuggcuuuggugu

SEQ ID NO: 833905 - RNA, 22 nt, Human
cggagaggugggggcagcaucu

SEQ ID NO: 833906 - RNA, 22 nt, Human
uggcaggggaggugcuugcuua

SEQ ID NO: 833907 - RNA, 22 nt, Human
guccuggggaauacagaagccg

SEQ ID NO: 833908 - RNA, 22 nt, Human
ugcaggugguuuggacacugcu

SEQ ID NO: 833909 - RNA, 22 nt, Human
agaggcaggaagagcugauuuu

SEQ ID NO: 833910 - RNA, 22 nt, Human
augugcuuguaauguuaaaugu

SEQ ID NO: 833911 - RNA, 22 nt, Human
acagggcagagggcaguuggua

SEQ ID NO: 833912 - RNA, 22 nt, Human
gggcagcuccuguggaauccac

SEQ ID NO: 833913 - RNA, 22 nt, Human
uuuauuauucucuggagaaugu

SEQ ID NO: 833914 - RNA, 22 nt, Human
cugcugugggcaggguagcugg

SEQ ID NO: 833915 - RNA, 22 nt, Human
cagaagcaaaugccuugcugag

SEQ ID NO: 833916 - RNA, 22 nt, Human
cccuggaggaaaaucugaggcu

SEQ ID NO: 833917 - RNA, 22 nt, Human
ccuuccaggagucucugcaggu

SEQ ID NO: 833918 - RNA, 22 nt, Human
cugucucucuaggacacugggg

SEQ ID NO: 833919 - RNA, 22 nt, Human
aagggcugcuguagaagcagag

SEQ ID NO: 833920 - RNA, 22 nt, Human
ugaagcaguuacuggguguuaa

SEQ ID NO: 833921 - RNA, 22 nt, Human
cccaggcagggacgugcucugg

SEQ ID NO: 833922 - RNA, 22 nt, Human
agcugaaggcuagaacagcugg

SEQ ID NO: 833923 - RNA, 22 nt, Human
guggcagcaaaauccugcauuc

SEQ ID NO: 833924 - RNA, 22 nt, Human
ucacugaauacuugucucaucc

SEQ ID NO: 833925 - RNA, 22 nt, Human
acaagguauccacauuaaaugu

SEQ ID NO: 833926 - RNA, 22 nt, Human
cagaauuuuucgaauguacugu

SEQ ID NO: 833927 - RNA, 22 nt, Human
gucacuguauccagguuccagc

SEQ ID NO: 833928 - RNA, 22 nt, Human
gauuuccuugcauauugguaau

SEQ ID NO: 833929 - RNA, 23 nt, Human
aagucaccaagaggaaggcggag

SEQ ID NO: 833930 - RNA, 22 nt, Human
uagcuguguaagcuugguaaga

SEQ ID NO: 833931 - RNA, 22 nt, Human
cccaggagguggagguugcggu

SEQ ID NO: 833932 - RNA, 22 nt, Human
ucuucucaguuucucuaggaug

SEQ ID NO: 833933 - RNA, 22 nt, Human
aagccagguguugugguaagag

SEQ ID NO: 833934 - RNA, 22 nt, Human
ggcaaaaaccauaauuacuuuu

SEQ ID NO: 833935 - RNA, 22 nt, Human
ggcaggcugggugucauggagu

SEQ ID NO: 833936 - RNA, 22 nt, Human
aagaaauguagagccuaguaaa

SEQ ID NO: 833937 - RNA, 22 nt, Human
gagaggucaucucccaucagca

SEQ ID NO: 833938 - RNA, 22 nt, Human
agcaggcuuucaagagucuucu

SEQ ID NO: 833939 - RNA, 22 nt, Human
uugucccaggacuugcauagau

SEQ ID NO: 833940 - RNA, 22 nt, Human
guccuggguccccgcaggucag

SEQ ID NO: 833941 - RNA, 23 nt, Human
uggcccugugcaugcugcuuccc

SEQ ID NO: 833942 - RNA, 22 nt, Human
ggcccugugguuuugcaaaguc

SEQ ID NO: 833943 - RNA, 22 nt, Human
cagaagcauuccagcaaauagu

SEQ ID NO: 833944 - RNA, 22 nt, Human
ggcugggcuccgggagcaugcg

SEQ ID NO: 833945 - RNA, 22 nt, Human
ggccugcugacccaaguccugu

SEQ ID NO: 833946 - RNA, 22 nt, Human
cagcuugcuaauuuugacuuca

SEQ ID NO: 833947 - RNA, 22 nt, Human
cacugaaggcugcagcucagcc

SEQ ID NO: 833948 - RNA, 22 nt, Human
agagccugggaauuugcauguu

SEQ ID NO: 833949 - RNA, 22 nt, Human
aaugugguuaacccauuuaaga

SEQ ID NO: 833950 - RNA, 22 nt, Human
ccuggcagcaggugggcccgug

SEQ ID NO: 833951 - RNA, 22 nt, Human
uuaagacaguguauuuguuuuc

SEQ ID NO: 833952 - RNA, 22 nt, Human
cugcugcauuacucuucucaag

SEQ ID NO: 833953 - RNA, 22 nt, Human
cacugcaguaacucuaggacug

SEQ ID NO: 833954 - RNA, 22 nt, Human
cagcagagaaauuaaacuucug

SEQ ID NO: 833955 - RNA, 22 nt, Human
acauuucuccuacuuguuauuu

SEQ ID NO: 833956 - RNA, 22 nt, Human
aaaccgcaauuacuuuugcguc

SEQ ID NO: 833957 - RNA, 22 nt, Human
agggcuggagccacagcuggga

SEQ ID NO: 833958 - RNA, 21 nt, Human
auacagaaggcagacucucuc

SEQ ID NO: 833959 - RNA, 22 nt, Human
aggggugauuugggacaggaca

SEQ ID NO: 833960 - RNA, 22 nt, Human
ggcagccaugcacgcugccugg

SEQ ID NO: 833961 - RNA, 22 nt, Human
ugggcagagucauacaggagac

SEQ ID NO: 833962 - RNA, 22 nt, Human
gaggggcuugaggcccugaugg

SEQ ID NO: 833963 - RNA, 22 nt, Human
aggguagguguaagauagcccu

SEQ ID NO: 833964 - RNA, 22 nt, Human
aggcagugcaugcaaaggucgg

SEQ ID NO: 833965 - RNA, 22 nt, Human
ucagcugccuuucccaugcuag

SEQ ID NO: 833966 - RNA, 22 nt, Human
uuucagauggagguuuaggaca

SEQ ID NO: 833967 - RNA, 22 nt, Human
ccaggaggcagaaguugcagug

SEQ ID NO: 833968 - RNA, 22 nt, Human
ugggaguguucuuggcuugcuu

SEQ ID NO: 833969 - RNA, 22 nt, Human
gcuggcagaauuucuucuugcu

SEQ ID NO: 833970 - RNA, 22 nt, Human
ugguccugagcaccagccugac

SEQ ID NO: 833971 - RNA, 22 nt, Human
uggcagagguauauugggagga

SEQ ID NO: 833972 - RNA, 22 nt, Human
ucccaggaugugcgugccgccg

SEQ ID NO: 833973 - RNA, 22 nt, Human
augaugguaaauucaguauccg

SEQ ID NO: 833974 - RNA, 22 nt, Human
caguccaggccuggaggagcca

SEQ ID NO: 833975 - RNA, 22 nt, Human
cagcaauaguguguuuguuuca

SEQ ID NO: 833976 - RNA, 22 nt, Human
aucuacagugcacaggacagcc

SEQ ID NO: 833977 - RNA, 22 nt, Human
uaguccauuuucacacugcuga

SEQ ID NO: 833978 - RNA, 22 nt, Human
cagcuggcccuuugguagccuu

SEQ ID NO: 833979 - RNA, 20 nt, Human
cugagcugagcuccaugggu

SEQ ID NO: 833980 - RNA, 22 nt, Human
uaucagaagacuuacaguaucg

SEQ ID NO: 833981 - RNA, 22 nt, Human
caucaguguggcaguucacugu

SEQ ID NO: 833982 - RNA, 22 nt, Human
gcugugcuugggaagaaucucu

SEQ ID NO: 833983 - RNA, 22 nt, Human
uuuucauuuacauuagggaaga

SEQ ID NO: 833984 - RNA, 22 nt, Human
agaauucuccuucagggcagga

SEQ ID NO: 833985 - RNA, 22 nt, Human
gcugaaggaggcucugguacua

SEQ ID NO: 833986 - RNA, 22 nt, Human
gcugucacucaccaggccugca

SEQ ID NO: 833987 - RNA, 19 nt, Human
uugaaauuguuugauaugg

SEQ ID NO: 833988 - RNA, 22 nt, Human
uguggcuguguccaccugcugc

SEQ ID NO: 833989 - RNA, 22 nt, Human
uggcccugcugggucagagcug

SEQ ID NO: 833990 - RNA, 22 nt, Human
aagcaacucccuccucauuuuu

SEQ ID NO: 833991 - RNA, 22 nt, Human
ugugccugaguuggcugaguac

SEQ ID NO: 833992 - RNA, 22 nt, Human
cauaauuugauaugcuugaugg

SEQ ID NO: 833993 - RNA, 23 nt, Human
ccacuagcaccuguucaacuucu

SEQ ID NO: 833994 - RNA, 22 nt, Human
ggucccugguucccucugagcu

SEQ ID NO: 833995 - RNA, 22 nt, Human
aaggccugggaguacugggaca

SEQ ID NO: 833996 - RNA, 22 nt, Human
aaaacucugcaguuaguuucua

SEQ ID NO: 833997 - RNA, 22 nt, Human
caggugggcguggcgagaaggc

SEQ ID NO: 833998 - RNA, 22 nt, Human
uuccucugaaauggcuuggaaa

SEQ ID NO: 833999 - RNA, 22 nt, Human
acaggugggcuuaagagucggc

SEQ ID NO: 834000 - RNA, 21 nt, Human
ugacugaggcuucuucacaca

SEQ ID NO: 834001 - RNA, 22 nt, Human
agcugcccugggucuugcugcu

SEQ ID NO: 834002 - RNA, 20 nt, Human
gcugaggucauuaugccuca

SEQ ID NO: 834003 - RNA, 19 nt, Human
cuucuucuuggcagccaag

SEQ ID NO: 834004 - RNA, 22 nt, Human
uuccuaauggcaaaacauguuu

SEQ ID NO: 834005 - RNA, 23 nt, Human
gaggcagcuccugcagugcccug

SEQ ID NO: 834006 - RNA, 22 nt, Human
gcugcuuccuuuccugcugacc

SEQ ID NO: 834007 - RNA, 20 nt, Human
ugggccugagccugugggcu

SEQ ID NO: 834008 - RNA, 22 nt, Human
gggccuggugcuucugacuccu

SEQ ID NO: 834009 - RNA, 22 nt, Human
cuggccuuuuguuucuggagaa

SEQ ID NO: 834010 - RNA, 22 nt, Human
ccucaggauccgcaggugcagu

SEQ ID NO: 834011 - RNA, 22 nt, Human
uucauguauuuaucauguaaau

SEQ ID NO: 834012 - RNA, 22 nt, Human
ugccucagcugaggccgcucca

SEQ ID NO: 834013 - RNA, 22 nt, Human
caaagaugcugauguuggauca

SEQ ID NO: 834014 - RNA, 22 nt, Human
uacaugaaccuuuaugugugau

SEQ ID NO: 834015 - RNA, 19 nt, Human
cagaacagaggucauggcc

SEQ ID NO: 834016 - RNA, 22 nt, Human
uggcuuaauauuucauauuuaa

SEQ ID NO: 834017 - RNA, 22 nt, Human
cuggugggagcagcaggcagcu

SEQ ID NO: 834018 - RNA, 22 nt, Human
aggagccaagcagaacuaagga

SEQ ID NO: 834019 - RNA, 22 nt, Human
cagaguguaucuguguaagcau

SEQ ID NO: 834020 - RNA, 19 nt, Human
ugcagaagacacaguggug

SEQ ID NO: 834021 - RNA, 22 nt, Human
uucuucaauuuuccauauacug

SEQ ID NO: 834022 - RNA, 18 nt, Human
ucucuuuuccccucauug

SEQ ID NO: 834023 - RNA, 22 nt, Human
augauacaagcaaaacuaauca

SEQ ID NO: 834024 - RNA, 22 nt, Human
ugcaggugcguuuucaagccuc

SEQ ID NO: 834025 - RNA, 22 nt, Human
agugucauuuuguccaucuucu

SEQ ID NO: 834026 - RNA, 19 nt, Human
agauggcaaaaugcaaaga

SEQ ID NO: 834027 - RNA, 22 nt, Human
aagcaccugcaguugacaaaaa

SEQ ID NO: 834028 - RNA, 22 nt, Human
guguccagggccguguugucuu

SEQ ID NO: 834029 - RNA, 22 nt, Human
cccaagggagugccuggucaac

SEQ ID NO: 834030 - RNA, 22 nt, Human
uaggcagcugcaaacuucgguc

SEQ ID NO: 834031 - RNA, 22 nt, Human
caggaaagguagucacaaugua

SEQ ID NO: 834032 - RNA, 22 nt, Human
gcacagcaauuucuauaagcuc

SEQ ID NO: 834033 - RNA, 22 nt, Human
gggugggaucuguggagccuca

SEQ ID NO: 834034 - RNA, 22 nt, Human
aagaugauguuguguuuucacu

SEQ ID NO: 834035 - RNA, 22 nt, Human
cagggcuguggcuuugugcugu

SEQ ID NO: 834036 - RNA, 22 nt, Human
cagagcucagagcagggcacuc

SEQ ID NO: 834037 - RNA, 23 nt, Human
gagugcagaauagacaugcagug

SEQ ID NO: 834038 - RNA, 22 nt, Human
agugaguggacccugcaaggaa

SEQ ID NO: 834039 - RNA, 22 nt, Human
cccaggaaguggagguugcagu

SEQ ID NO: 834040 - RNA, 20 nt, Human
uuuaggcauuacucuuuugu

SEQ ID NO: 834041 - RNA, 22 nt, Human
guugcacaguuccucaagcagg

SEQ ID NO: 834042 - RNA, 22 nt, Human
gagagggagccagccaggaacc

SEQ ID NO: 834043 - RNA, 22 nt, Human
caggcuugauuauucagacaau

SEQ ID NO: 834044 - RNA, 21 nt, Human
ugaggcuguuguaccagggag

SEQ ID NO: 834045 - RNA, 22 nt, Human
uggcuucaucugcagcacugcc

SEQ ID NO: 834046 - RNA, 19 nt, Human
auaaggcaggaggaaauuu

SEQ ID NO: 834047 - RNA, 22 nt, Human
cucuggacacuggcaugggguc

SEQ ID NO: 834048 - RNA, 22 nt, Human
uacauuccacuagugacuggcg

SEQ ID NO: 834049 - RNA, 22 nt, Human
ggcuggucacaccacugcaggg

SEQ ID NO: 834050 - RNA, 22 nt, Human
caccagggacaaugcuaggggu

SEQ ID NO: 834051 - RNA, 22 nt, Human
gaaaccucuuagccucucuuug

SEQ ID NO: 834052 - RNA, 17 nt, Human
ggcagccucaggcguuu

SEQ ID NO: 834053 - RNA, 22 nt, Human
uacuuacacagcuguagaaggu

SEQ ID NO: 834054 - RNA, 22 nt, Human
uggcagaguuauggguauuuau

SEQ ID NO: 834055 - RNA, 21 nt, Human
aggcuguccuuugccagcccu

SEQ ID NO: 834056 - RNA, 22 nt, Human
gcugcccaguucugcugcugcc

SEQ ID NO: 834057 - RNA, 22 nt, Human
aaauagauugcugaggcauuac

SEQ ID NO: 834058 - RNA, 22 nt, Human
aggguaggaacugaguggaagg

SEQ ID NO: 834059 - RNA, 22 nt, Human
gcuucucucucagacugcaagc

SEQ ID NO: 834060 - RNA, 22 nt, Human
ggcugccuccucgagacaggau

SEQ ID NO: 834061 - RNA, 22 nt, Human
gcuguguuugacaguagcagac

SEQ ID NO: 834062 - RNA, 22 nt, Human
cucuggcuuugcucaugcaucc

SEQ ID NO: 834063 - RNA, 22 nt, Human
uuugcagucuggccugcuuugg

SEQ ID NO: 834064 - RNA, 22 nt, Human
ugauuucaaguagugacaugcu

SEQ ID NO: 834065 - RNA, 18 nt, Human
gaaagccaugcagcagug

SEQ ID NO: 834066 - RNA, 22 nt, Human
cacagcauaaugaaauauacuu

SEQ ID NO: 834067 - RNA, 17 nt, Human
ccucacagggaccagac

SEQ ID NO: 834068 - RNA, 22 nt, Human
uuugcauuuugauaagaucacu

SEQ ID NO: 834069 - RNA, 22 nt, Human
caggcagcugcuggguucagcc

SEQ ID NO: 834070 - RNA, 22 nt, Human
cccaggagguggagguugcagu

SEQ ID NO: 834071 - RNA, 22 nt, Human
gucauauacacugcauguaauc

SEQ ID NO: 834072 - RNA, 22 nt, Human
ugaggcaggacugagcgggaug

SEQ ID NO: 834073 - RNA, 22 nt, Human
ugaggcaguucuuacuuguauu

SEQ ID NO: 834074 - RNA, 22 nt, Human
aaucaugugggauagucugcuc

SEQ ID NO: 834075 - RNA, 22 nt, Human
uccagggagauggcagaggcug

SEQ ID NO: 834076 - RNA, 22 nt, Human
cuggcccuucucuugcuuccug

SEQ ID NO: 834077 - RNA, 22 nt, Human
caucagaaggccagaggguagc

SEQ ID NO: 834078 - RNA, 22 nt, Human
agucucagggccacccggggaa

SEQ ID NO: 834079 - RNA, 22 nt, Human
agggccaggaacaccugaaggg

SEQ ID NO: 834080 - RNA, 22 nt, Human
gaggaaugucagcacaggccuc

SEQ ID NO: 834081 - RNA, 22 nt, Human
gcuggcugggucccugagaggc

SEQ ID NO: 834082 - RNA, 22 nt, Human
cccagcaucuccaggcauggcc

SEQ ID NO: 834083 - RNA, 22 nt, Human
acuuugcagggcuugauaucca

SEQ ID NO: 834084 - RNA, 19 nt, Human
gcaggguguugacuguccc

SEQ ID NO: 834085 - RNA, 22 nt, Human
guuuagaacacggaaauacuga

SEQ ID NO: 834086 - RNA, 22 nt, Human
auaugagaguaaaugccgaucu

SEQ ID NO: 834087 - RNA, 22 nt, Human
uacaguaaccuuauuugucauu

SEQ ID NO: 834088 - RNA, 22 nt, Human
aggcucagcccaagguggagag

SEQ ID NO: 834089 - RNA, 22 nt, Human
cucucugguacauagaguuugg

SEQ ID NO: 834090 - RNA, 22 nt, Human
uacauaugaacuuuauaacuug

SEQ ID NO: 834091 - RNA, 22 nt, Human
caggccucagagaguggcgggg

SEQ ID NO: 834092 - RNA, 17 nt, Human
gcuggcugacccaugcc

SEQ ID NO: 834093 - RNA, 22 nt, Human
ucugggagacguguguugucag

SEQ ID NO: 834094 - RNA, 22 nt, Human
ccagccugaaaugccucauccu

SEQ ID NO: 834095 - RNA, 19 nt, Human
cugucaggggcuggauguu

SEQ ID NO: 834096 - RNA, 22 nt, Human
uccuggaggggacagcaugggc

SEQ ID NO: 834097 - RNA, 22 nt, Human
agcucauggugcuaucucaggg

SEQ ID NO: 834098 - RNA, 22 nt, Human
ucccucuguguugggcaugccu

SEQ ID NO: 834099 - RNA, 22 nt, Human
ugggcugcggauaggccucgga

SEQ ID NO: 834100 - RNA, 20 nt, Human
ccaggcacugucccaugcag

SEQ ID NO: 834101 - RNA, 22 nt, Human
uauuucuuucagguauguguug

SEQ ID NO: 834102 - RNA, 22 nt, Human
aucagcaaggcaaucacugcag

SEQ ID NO: 834103 - RNA, 22 nt, Human
agagggcauuaacucugucuug

SEQ ID NO: 834104 - RNA, 22 nt, Human
uggcagagaaccugggcuuugu

SEQ ID NO: 834105 - RNA, 22 nt, Human
auauacuuggagacuaucauug

SEQ ID NO: 834106 - RNA, 22 nt, Human
uaacacauauuugcaguaagca

SEQ ID NO: 834107 - RNA, 22 nt, Human
gggcuggggcucaauaauuugu

SEQ ID NO: 834108 - RNA, 22 nt, Human
uacugaaauacuaagaaguuaa

SEQ ID NO: 834109 - RNA, 22 nt, Human
cccuguccuggaugggagcacu

SEQ ID NO: 834110 - RNA, 22 nt, Human
cccagccucugggcucacccaa

SEQ ID NO: 834111 - RNA, 22 nt, Human
agcugcuccuuuccugcaggcg

SEQ ID NO: 834112 - RNA, 22 nt, Human
gcaggcuccaaggccugggaga

SEQ ID NO: 834113 - RNA, 22 nt, Human
agguaggguuaauggagauaua

SEQ ID NO: 834114 - RNA, 19 nt, Human
ggccaggcugacugugguc

SEQ ID NO: 834115 - RNA, 22 nt, Human
uuugaagauaaauauggagaaa

SEQ ID NO: 834116 - RNA, 22 nt, Human
cagcucuguaaauuccuucauc

SEQ ID NO: 834117 - RNA, 22 nt, Human
gcagggugaaggucacauagaa

SEQ ID NO: 834118 - RNA, 22 nt, Human
ucuaaagaagaggguucugcgg

SEQ ID NO: 834119 - RNA, 21 nt, Human
aggaggggucuuucccacuga

SEQ ID NO: 834120 - RNA, 22 nt, Human
augucuuuauaaauguauaaug

SEQ ID NO: 834121 - RNA, 22 nt, Human
agaugcugugucuguucccuug

SEQ ID NO: 834122 - RNA, 22 nt, Human
aaggcugauuagacugauagcu

SEQ ID NO: 834123 - RNA, 22 nt, Human
ugucccauggacacaacuucuu

SEQ ID NO: 834124 - RNA, 22 nt, Human
ugacccauggucugaucauagg

SEQ ID NO: 834125 - RNA, 23 nt, Human
ucaugcccaggcuccagauguca

SEQ ID NO: 834126 - RNA, 22 nt, Human
ggccucacccaucggugccuuu

SEQ ID NO: 834127 - RNA, 22 nt, Human
gaaacuuacuuacucacauuuc

SEQ ID NO: 834128 - RNA, 22 nt, Human
cauuuacaauguacagguugug

SEQ ID NO: 834129 - RNA, 21 nt, Human
gaggccacuaauaggggcaga

SEQ ID NO: 834130 - RNA, 22 nt, Human
cucugucccagacccaccucuc

SEQ ID NO: 834131 - RNA, 22 nt, Human
ggcugcuggggacgugggagag

SEQ ID NO: 834132 - RNA, 17 nt, Human
ucccaggaacagggaau

SEQ ID NO: 834133 - RNA, 22 nt, Human
caggaccuggaaugcuugugaa

SEQ ID NO: 834134 - RNA, 22 nt, Human
cuugugcaauugacauugaauc

SEQ ID NO: 834135 - RNA, 22 nt, Human
uuuccuuccagguuccuaaggc

SEQ ID NO: 834136 - RNA, 22 nt, Human
cugggaggauacacaagaucag

SEQ ID NO: 834137 - RNA, 22 nt, Human
acagagcauauaaagugcuuug

SEQ ID NO: 834138 - RNA, 22 nt, Human
cagcagugugcaggugugcugg

SEQ ID NO: 834139 - RNA, 22 nt, Human
aggcagcuggcagcacccaggg

SEQ ID NO: 834140 - RNA, 20 nt, Human
ugaugguucuuuccggguug

SEQ ID NO: 834141 - RNA, 22 nt, Human
caaaugugacuuuugggcuucu

SEQ ID NO: 834142 - RNA, 18 nt, Human
cauaauuuucuuucuuua

SEQ ID NO: 834143 - RNA, 21 nt, Human
ggcagcugaccgcgcggugca

SEQ ID NO: 834144 - RNA, 22 nt, Human
cugugcaagcccaagauaaaac

SEQ ID NO: 834145 - RNA, 22 nt, Human
ggcagggagagcaugcugauaa

SEQ ID NO: 834146 - RNA, 22 nt, Human
ugggcugcugagaaugagagag

SEQ ID NO: 834147 - RNA, 22 nt, Human
ucaugucaguuucuucuauaaa

SEQ ID NO: 834148 - RNA, 22 nt, Human
ugcugcucucagccaccaggaa

SEQ ID NO: 834149 - RNA, 22 nt, Human
agcuggagcuucaagcagguaa

SEQ ID NO: 834150 - RNA, 22 nt, Human
gugucccacucuggaggugaag

SEQ ID NO: 834151 - RNA, 22 nt, Human
gaggccuggcucugcccuccug

SEQ ID NO: 834152 - RNA, 22 nt, Human
caaagguauaaguuaauauaca

SEQ ID NO: 834153 - RNA, 22 nt, Human
ugucucagggcagcagcagggg

SEQ ID NO: 834154 - RNA, 19 nt, Human
caugagcugcucacuuccc

SEQ ID NO: 834155 - RNA, 22 nt, Human
cagcuccagcccaggcagcucc

SEQ ID NO: 834156 - RNA, 22 nt, Human
ucauuuauaaggaugcaauuaa

SEQ ID NO: 834157 - RNA, 22 nt, Human
uauuucaugugcaccauaauuc

SEQ ID NO: 834158 - RNA, 22 nt, Human
cccaggaaugggaaggaggaau

SEQ ID NO: 834159 - RNA, 22 nt, Human
uggaggaaaauuacuggggucu

SEQ ID NO: 834160 - RNA, 22 nt, Human
uuccaaaguuaguuauuagaaa

SEQ ID NO: 834161 - RNA, 22 nt, Human
cugcucuaacugcauuaguuuu

SEQ ID NO: 834162 - RNA, 22 nt, Human
ucuuugaauccuuuacaucuga

SEQ ID NO: 834163 - RNA, 22 nt, Human
uuguuuucacagcuuugcccgg

SEQ ID NO: 834164 - RNA, 22 nt, Human
agggcugcaggcaagauauggc

SEQ ID NO: 834165 - RNA, 22 nt, Human
ccagaucuaguguuguaaagcu

SEQ ID NO: 834166 - RNA, 23 nt, Human
uugcauguagcccaugaguaacu

SEQ ID NO: 834167 - RNA, 22 nt, Human
gaagaagcaggaguguguagca

SEQ ID NO: 834168 - RNA, 22 nt, Human
cugccagccaggccagguaggc

SEQ ID NO: 834169 - RNA, 22 nt, Human
acuuccuguuaugugugccucu

SEQ ID NO: 834170 - RNA, 22 nt, Human
uuguaugaucaaaagaaaugua

SEQ ID NO: 834171 - RNA, 22 nt, Human
ccuggagccccucuggccagcc

SEQ ID NO: 834172 - RNA, 22 nt, Human
aaggccugggaggccucucuuc

SEQ ID NO: 834173 - RNA, 20 nt, Human
agcagcuguguuuucauccu

SEQ ID NO: 834174 - RNA, 22 nt, Human
ucacaggacccugaggguggcg

SEQ ID NO: 834175 - RNA, 22 nt, Human
uuacagaaaguuucccaugccg

SEQ ID NO: 834176 - RNA, 22 nt, Human
gcucucugccuuucucaaugac

SEQ ID NO: 834177 - RNA, 22 nt, Human
gagucaccuugggucagcgaua

SEQ ID NO: 834178 - RNA, 21 nt, Human
uggcagaguugaguaguuaug

SEQ ID NO: 834179 - RNA, 22 nt, Human
ccuugcaggggaacaggcagug

SEQ ID NO: 834180 - RNA, 22 nt, Human
gcugucuggguugagggcccug

SEQ ID NO: 834181 - RNA, 22 nt, Human
ggcaguagccagggacuggcag

SEQ ID NO: 834182 - RNA, 23 nt, Human
ggagaggggugugggcaucuuua

SEQ ID NO: 834183 - RNA, 22 nt, Human
agugaaauugcuguaagaggaa

SEQ ID NO: 834184 - RNA, 22 nt, Human
uuaacacuccuaacuacagucu

SEQ ID NO: 834185 - RNA, 22 nt, Human
cugaaggagguagagugacaua

SEQ ID NO: 834186 - RNA, 22 nt, Human
cuccagggcagcauggcagugg

SEQ ID NO: 834187 - RNA, 22 nt, Human
aggaagcccuugucauuucugu

SEQ ID NO: 834188 - RNA, 22 nt, Human
uggcucagcaagacauugaccu

SEQ ID NO: 834189 - RNA, 22 nt, Human
uaacacauuuuccucauacgga

SEQ ID NO: 834190 - RNA, 22 nt, Human
acauaucuuucccucuccugaa

SEQ ID NO: 834191 - RNA, 22 nt, Human
ugcagcuguuacggacccuguc

SEQ ID NO: 834192 - RNA, 22 nt, Human
guguccagagaaacucacagcu

SEQ ID NO: 834193 - RNA, 22 nt, Human
ucucaggggauucacuggcacc

SEQ ID NO: 834194 - RNA, 22 nt, Human
gcagagaagaugcccaggcuuc

SEQ ID NO: 834195 - RNA, 22 nt, Human
cugcuguguggauucaauggcu

SEQ ID NO: 834196 - RNA, 22 nt, Human
uuguuuguaugcugagaagaau

SEQ ID NO: 834197 - RNA, 22 nt, Human
cccaggcugaugggaugggcca

SEQ ID NO: 834198 - RNA, 22 nt, Human
cccagcagaaucugaugagggc

SEQ ID NO: 834199 - RNA, 22 nt, Human
ggcagcuccaaaaggaaacacu

SEQ ID NO: 834200 - RNA, 22 nt, Human
cccccaaggccaggcugagacc

SEQ ID NO: 834201 - RNA, 22 nt, Human
uuucaagaacaacauucauuca

SEQ ID NO: 834202 - RNA, 22 nt, Human
cauuggaaugcauuugaagaga

SEQ ID NO: 834203 - RNA, 22 nt, Human
caggcugagcucuggccugggc

SEQ ID NO: 834204 - RNA, 22 nt, Human
agagaagagcaaugauaaauuu

SEQ ID NO: 834205 - RNA, 22 nt, Human
aaaugcagauuuugaugcagca

SEQ ID NO: 834206 - RNA, 23 nt, Human
ccagccucugggucuucauccag

SEQ ID NO: 834207 - RNA, 22 nt, Human
ccucuugccaaucagcuacaga

SEQ ID NO: 834208 - RNA, 22 nt, Human
auuuaaaugcuuaagaggguuu

SEQ ID NO: 834209 - RNA, 22 nt, Human
uguauuuucugaagauaaucaa

SEQ ID NO: 834210 - RNA, 22 nt, Human
aaacucuggagauguuuaugca

SEQ ID NO: 834211 - RNA, 22 nt, Human
gcugccagcucacucuccugag

SEQ ID NO: 834212 - RNA, 22 nt, Human
cagguaagagacggauuggccc

SEQ ID NO: 834213 - RNA, 22 nt, Human
uccucugcucagcauuccucac

SEQ ID NO: 834214 - RNA, 22 nt, Human
gaggcagcaugguaccuuggag

SEQ ID NO: 834215 - RNA, 22 nt, Human
gagccauacaaccuauaaagug

SEQ ID NO: 834216 - RNA, 22 nt, Human
cgcuggggcuuuuugcuugaga

SEQ ID NO: 834217 - RNA, 22 nt, Human
cuagucacucagcacugacaaa

SEQ ID NO: 834218 - RNA, 22 nt, Human
gcuggaucauauggugguucua

SEQ ID NO: 834219 - RNA, 22 nt, Human
ugggggagauugugcaucucua

SEQ ID NO: 834220 - RNA, 22 nt, Human
uuuggaaugguaccuucaguug

SEQ ID NO: 834221 - RNA, 22 nt, Human
cuggagccuagguugaccuggg

SEQ ID NO: 834222 - RNA, 22 nt, Human
agggcagcagcccauggcucug

SEQ ID NO: 834223 - RNA, 22 nt, Human
cuuaaaaucuggcaguuagcua

SEQ ID NO: 834224 - RNA, 22 nt, Human
uuuauccaccuuacccuguucc

SEQ ID NO: 834225 - RNA, 22 nt, Human
uggcuauugagugaucucuaga

SEQ ID NO: 834226 - RNA, 22 nt, Human
agggcaaguugagugugcgugg

SEQ ID NO: 834227 - RNA, 22 nt, Human
uccucugccccagaugaaauuu

SEQ ID NO: 834228 - RNA, 22 nt, Human
aacagaaaagguagguggcuuu

SEQ ID NO: 834229 - RNA, 22 nt, Human
gaggccugucgcuaggccucug

SEQ ID NO: 834230 - RNA, 22 nt, Human
ugggcagaggcucugaagucca

SEQ ID NO: 834231 - RNA, 22 nt, Human
ggcugcaggcagaggcugucug

SEQ ID NO: 834232 - RNA, 22 nt, Human
aauuaguauugcgauucauuag

SEQ ID NO: 834233 - RNA, 22 nt, Human
ugucuucaucuccaugcacaga

SEQ ID NO: 834234 - RNA, 22 nt, Human
cuugcaggauuuugcugcugua

SEQ ID NO: 834235 - RNA, 22 nt, Human
uucuggagaucugccuauggga

SEQ ID NO: 834236 - RNA, 22 nt, Human
ccuggaucuuuguuguaaauau

SEQ ID NO: 834237 - RNA, 22 nt, Human
uguuccaauaaggaguugaaau

SEQ ID NO: 834238 - RNA, 22 nt, Human
uaucagaaagauauuacugggg

SEQ ID NO: 834239 - RNA, 22 nt, Human
agguacagaugaaagucuaguu

SEQ ID NO: 834240 - RNA, 22 nt, Human
uuagacauagaauauugucuag

SEQ ID NO: 834241 - RNA, 22 nt, Human
uugaauuagacuuugcuacagg

SEQ ID NO: 834242 - RNA, 22 nt, Human
aaguucaagucugcaucuuuuu

SEQ ID NO: 834243 - RNA, 22 nt, Human
ccagaagucaggaaugagucuu

SEQ ID NO: 834244 - RNA, 22 nt, Human
gaacacaugauuauaaaugcua

SEQ ID NO: 834245 - RNA, 22 nt, Human
acaaaagugagugugucucaga

SEQ ID NO: 834246 - RNA, 22 nt, Human
cuguuuaucccuuuggucagca

SEQ ID NO: 834247 - RNA, 22 nt, Human
accaggagagauuuuauugaga

SEQ ID NO: 834248 - RNA, 22 nt, Human
auguaucagauaaagcaugugg

SEQ ID NO: 834249 - RNA, 22 nt, Human
acaggcagcgucauugcugcuc

SEQ ID NO: 834250 - RNA, 22 nt, Human
ccucuggggguccucagagucu

SEQ ID NO: 834251 - RNA, 22 nt, Human
gcacagggcccugugcguaggu

SEQ ID NO: 834252 - RNA, 22 nt, Human
agggcagacuaggauggaagug

SEQ ID NO: 834253 - RNA, 22 nt, Human
uuguuugaggucacugauauuu

SEQ ID NO: 834254 - RNA, 22 nt, Human
cacuggaauucaagauacugag

SEQ ID NO: 834255 - RNA, 22 nt, Human
cacagggcaccaguuggccauc

SEQ ID NO: 834256 - RNA, 22 nt, Human
cuggagaggcugggaacagguu

SEQ ID NO: 834257 - RNA, 22 nt, Human
aaaguuugaaugauauauuagu

SEQ ID NO: 834258 - RNA, 20 nt, Human
ccuggagccuggaaggaguc

SEQ ID NO: 834259 - RNA, 23 nt, Human
gggauauggaccuuggaggaguc

SEQ ID NO: 834260 - RNA, 22 nt, Human
guccucagagugggcagguccu

SEQ ID NO: 834261 - RNA, 22 nt, Human
cagcugccccgcuggcugacca

SEQ ID NO: 834262 - RNA, 22 nt, Human
agcauuuaggagaauuugagaa

SEQ ID NO: 834263 - RNA, 20 nt, Human
ugcagaagaacguucugguu

SEQ ID NO: 834264 - RNA, 21 nt, Human
agugaaauugcaucagaggga

SEQ ID NO: 834265 - RNA, 22 nt, Human
ugugcuucuugcagcuccugua

SEQ ID NO: 834266 - RNA, 22 nt, Human
ugugaauaccuugaauucauca

SEQ ID NO: 834267 - RNA, 22 nt, Human
cuggcucauagagcagcuccaa

SEQ ID NO: 834268 - RNA, 23 nt, Human
uuacuuuugcaccaaccuaauau

SEQ ID NO: 834269 - RNA, 22 nt, Human
augcugagacuggagcagcugg

SEQ ID NO: 834270 - RNA, 22 nt, Human
acagaguagcucaagaagauug

SEQ ID NO: 834271 - RNA, 22 nt, Human
caauuucacuaauaauauuuac

SEQ ID NO: 834272 - RNA, 22 nt, Human
ccagaauucagaaagggcauaa

SEQ ID NO: 834273 - RNA, 22 nt, Human
ccaggaagcggugagggcugcc

SEQ ID NO: 834274 - RNA, 22 nt, Human
uaaagcaguguugggucggacg

SEQ ID NO: 834275 - RNA, 22 nt, Human
gcucccaguucccaaagugacc

SEQ ID NO: 834276 - RNA, 22 nt, Human
ucugggaaguccucugucaugc

SEQ ID NO: 834277 - RNA, 22 nt, Human
agcagaggaggauuuaguuagg

SEQ ID NO: 834278 - RNA, 22 nt, Human
cuggggugucucgucugccauu

SEQ ID NO: 834279 - RNA, 22 nt, Human
aggaguggugcaggaccugcca

SEQ ID NO: 834280 - RNA, 22 nt, Human
agaaaucucaguaucucaggga

SEQ ID NO: 834281 - RNA, 22 nt, Human
caggccuggcccccggcacacc

SEQ ID NO: 834282 - RNA, 23 nt, Human
aggcugcagaagaauagggucau

SEQ ID NO: 834283 - RNA, 22 nt, Human
ugaggcagggagaguggauaug

SEQ ID NO: 834284 - RNA, 22 nt, Human
caggaggcccaaagggcgcaga

SEQ ID NO: 834285 - RNA, 19 nt, Human
ccucugccagcccgccucu

SEQ ID NO: 834286 - RNA, 22 nt, Human
aaaaguuuaagacucauucuag

SEQ ID NO: 834287 - RNA, 22 nt, Human
ucuggaucggguuccucagguc

SEQ ID NO: 834288 - RNA, 21 nt, Human
aggcagcaggauccagggaca

SEQ ID NO: 834289 - RNA, 21 nt, Human
ucagcagcaucugccuagagu

SEQ ID NO: 834290 - RNA, 22 nt, Human
ggcucagguuuccuucccagcu

SEQ ID NO: 834291 - RNA, 22 nt, Human
uuguugguggaauugaugcuag

SEQ ID NO: 834292 - RNA, 22 nt, Human
gcaccugauugauuucacugcu

SEQ ID NO: 834293 - RNA, 22 nt, Human
auggcagccugagcagaggaau

SEQ ID NO: 834294 - RNA, 22 nt, Human
acuggauuccauugugcaaaga

SEQ ID NO: 834295 - RNA, 22 nt, Human
ggcagcugggucacaccgaucu

SEQ ID NO: 834296 - RNA, 19 nt, Human
gagcugccuuuugaagacc

SEQ ID NO: 834297 - RNA, 22 nt, Human
aggauuuauuggugggaaguua

SEQ ID NO: 834298 - RNA, 17 nt, Human
aucuggcugcuucuaga

SEQ ID NO: 834299 - RNA, 22 nt, Human
cucuggccagagccugcgggaa

SEQ ID NO: 834300 - RNA, 22 nt, Human
acagugucuccugguacccagu

SEQ ID NO: 834301 - RNA, 22 nt, Human
ugggacacccucacgccugcac

SEQ ID NO: 834302 - RNA, 22 nt, Human
gggcagcuagcccucuagccca

SEQ ID NO: 834303 - RNA, 22 nt, Human
auaauguagguauguguauuua

SEQ ID NO: 834304 - RNA, 22 nt, Human
aauucuauaggcaagcuauuuu

SEQ ID NO: 834305 - RNA, 22 nt, Human
cuuccaaaauuuauauguugaa

SEQ ID NO: 834306 - RNA, 23 nt, Human
aguaaagcaauuguuggcgagag

SEQ ID NO: 834307 - RNA, 22 nt, Human
aggugaguugguaggaaguuug

SEQ ID NO: 834308 - RNA, 22 nt, Human
ugccaggccucaggagucucca

SEQ ID NO: 834309 - RNA, 22 nt, Human
gaacccaguccaggugcagccu

SEQ ID NO: 834310 - RNA, 22 nt, Human
cacagcagaaaguguaggagga

SEQ ID NO: 834311 - RNA, 22 nt, Human
guacagaaauggggccccaggu

SEQ ID NO: 834312 - RNA, 21 nt, Human
ugcagcagaguaagcagggga

SEQ ID NO: 834313 - RNA, 22 nt, Human
gagagcacaugaacauggagga

SEQ ID NO: 834314 - RNA, 22 nt, Human
gagggggcgugcaaggcuccgc

SEQ ID NO: 834315 - RNA, 22 nt, Human
cagguaggauggaagggcucaa

SEQ ID NO: 834316 - RNA, 22 nt, Human
ucagcagggagaggagaaugca

SEQ ID NO: 834317 - RNA, 18 nt, Human
ugugaacacauuuuucug

SEQ ID NO: 834318 - RNA, 22 nt, Human
uuugaguugcuuauuuaauagg

SEQ ID NO: 834319 - RNA, 17 nt, Human
uuccuggaagucauucc

SEQ ID NO: 834320 - RNA, 22 nt, Human
caaagugcuaggauuacaggcc

SEQ ID NO: 834321 - RNA, 22 nt, Human
cuccagggggcauccacacagc

SEQ ID NO: 834322 - RNA, 22 nt, Human
gagauggggucagcugggacau

SEQ ID NO: 834323 - RNA, 22 nt, Human
uguccucagauaugucuacucu

SEQ ID NO: 834324 - RNA, 22 nt, Human
ugcccacauggugccauggcca

SEQ ID NO: 834325 - RNA, 22 nt, Human
ugaagaauaagauagauggagc

SEQ ID NO: 834326 - RNA, 22 nt, Human
aggaccuguaccucagcaucua

SEQ ID NO: 834327 - RNA, 22 nt, Human
gcugggaggaucucucccuguc

SEQ ID NO: 834328 - RNA, 22 nt, Human
ccacagaaaguugucuagagua

SEQ ID NO: 834329 - RNA, 22 nt, Human
ggcacugauaauguccucucuc

SEQ ID NO: 834330 - RNA, 22 nt, Human
cccaggaacuccagagcuccuc

SEQ ID NO: 834331 - RNA, 22 nt, Human
acagcugugaaaauccacagga

SEQ ID NO: 834332 - RNA, 22 nt, Human
ggcagcuucucccaggcuguuu

SEQ ID NO: 834333 - RNA, 22 nt, Human
ugcugccaggucuugcugucca

SEQ ID NO: 834334 - RNA, 23 nt, Human
ggcucugugcugggccugcagga

SEQ ID NO: 834335 - RNA, 21 nt, Human
aggagcuguguuagcuggucg

SEQ ID NO: 834336 - RNA, 22 nt, Human
aaggcaggaugcggacccaucu

SEQ ID NO: 834337 - RNA, 22 nt, Human
agcuuaggaggaugaugaacau

SEQ ID NO: 834338 - RNA, 22 nt, Human
cugcagcugucucuacugggca

SEQ ID NO: 834339 - RNA, 22 nt, Human
cagcuucugucugauuagcaag

SEQ ID NO: 834340 - RNA, 22 nt, Human
ccuggagggcgccgcacagucc

SEQ ID NO: 834341 - RNA, 22 nt, Human
agcugccacauggugucacugu

SEQ ID NO: 834342 - RNA, 18 nt, Human
gagucuuuguuacugcug

SEQ ID NO: 834343 - RNA, 22 nt, Human
aauuuccagaccccauccacag

SEQ ID NO: 834344 - RNA, 22 nt, Human
gagugguaggcaguguuaggaa

SEQ ID NO: 834345 - RNA, 22 nt, Human
gaggccuguagucauggaugua

SEQ ID NO: 834346 - RNA, 22 nt, Human
gagcagcugcagugcagacccu

SEQ ID NO: 834347 - RNA, 22 nt, Human
gucauaaagcuuguugcauuua

SEQ ID NO: 834348 - RNA, 22 nt, Human
aaugugaaaccgcacagaauaa

SEQ ID NO: 834349 - RNA, 22 nt, Human
gcagaauuuucuguuuucuaga

SEQ ID NO: 834350 - RNA, 22 nt, Human
augugaaaaauuucuuauuaca

SEQ ID NO: 834351 - RNA, 22 nt, Human
ugggcccaagagagucuccaac

SEQ ID NO: 834352 - RNA, 22 nt, Human
cuggccuuuagccccagugucu

SEQ ID NO: 834353 - RNA, 22 nt, Human
agcagcugcagagggcuccccc

SEQ ID NO: 834354 - RNA, 22 nt, Human
aaguucuacuguggguaaaaug

SEQ ID NO: 834355 - RNA, 22 nt, Human
auacaacuuuaucuguaaugag

SEQ ID NO: 834356 - RNA, 22 nt, Human
gaagcagcuuucuggugaggag

SEQ ID NO: 834357 - RNA, 22 nt, Human
acaguacauaauccugagucug

SEQ ID NO: 834358 - RNA, 22 nt, Human
uuaacacuaucugucauaauua

SEQ ID NO: 834359 - RNA, 22 nt, Human
caggggcaggugugagaucauc

SEQ ID NO: 834360 - RNA, 21 nt, Human
gcagcagaggcuugacagaca

SEQ ID NO: 834361 - RNA, 18 nt, Human
acaaauguagugucuuaa

SEQ ID NO: 834362 - RNA, 20 nt, Human
auguaaaauuauaaggcuga

SEQ ID NO: 834363 - RNA, 17 nt, Human
auccccagcaucuagaa

SEQ ID NO: 834364 - RNA, 22 nt, Human
agcuggccuucggugucacugg

SEQ ID NO: 834365 - RNA, 23 nt, Human
uuuuccuguggagacaugacugg

SEQ ID NO: 834366 - RNA, 22 nt, Human
auuaaauuuucacuaggcuccc

SEQ ID NO: 834367 - RNA, 22 nt, Human
gucuggggaagucagggcauca

SEQ ID NO: 834368 - RNA, 22 nt, Human
gccuggagaaaggaagguggga

SEQ ID NO: 834369 - RNA, 22 nt, Human
cuucucucccuggcacucagac

SEQ ID NO: 834370 - RNA, 22 nt, Human
acuuggagagcauugcugggga

SEQ ID NO: 834371 - RNA, 22 nt, Human
ccagagugacgugaagugugaa

SEQ ID NO: 834372 - RNA, 22 nt, Human
uggcccugugugcaggcugcac

SEQ ID NO: 834373 - RNA, 18 nt, Human
ugucucaggcugaaacag

SEQ ID NO: 834374 - RNA, 22 nt, Human
gcccugucccuuggcuucuagg

SEQ ID NO: 834375 - RNA, 22 nt, Human
auaucuuuguuuuugccaagau

SEQ ID NO: 834376 - RNA, 22 nt, Human
ucugggcuuuacacugugcuua

SEQ ID NO: 834377 - RNA, 23 nt, Human
ugcugggcagagcuggugcugag

SEQ ID NO: 834378 - RNA, 22 nt, Human
ucacugcucucuaagcaucgcc

SEQ ID NO: 834379 - RNA, 22 nt, Human
gcaggcaggagcccaacugccu

SEQ ID NO: 834380 - RNA, 22 nt, Human
gugggaugcaguggugaguggc

SEQ ID NO: 834381 - RNA, 22 nt, Human
auuucugauaaacguaagcugc

SEQ ID NO: 834382 - RNA, 22 nt, Human
gcaugguggccuuaggguagcc

SEQ ID NO: 834383 - RNA, 22 nt, Human
aaggcagcaacuaauggaucuc

SEQ ID NO: 834384 - RNA, 22 nt, Human
ugucccaggccucauguugcca

SEQ ID NO: 834385 - RNA, 21 nt, Human
ucagaguggaagacaguuuga

SEQ ID NO: 834386 - RNA, 22 nt, Human
uugucuuaaauggauggacaau

SEQ ID NO: 834387 - RNA, 22 nt, Human
caucagaaggaaggacgauuau

SEQ ID NO: 834388 - RNA, 22 nt, Human
cuggcaggcagacuucugcaag

SEQ ID NO: 834389 - RNA, 22 nt, Human
ggagccagggaagcugcuuccu

SEQ ID NO: 834390 - RNA, 22 nt, Human
uaucuguuaggaucagagcugg

SEQ ID NO: 834391 - RNA, 22 nt, Human
cagcuccugcagcugcugccgu

SEQ ID NO: 834392 - RNA, 22 nt, Human
acacacucaauugcauaagcac

SEQ ID NO: 834393 - RNA, 22 nt, Human
uuugcauugcauuaaguauucu

SEQ ID NO: 834394 - RNA, 22 nt, Human
gagauuuagagagacuuaaaca

SEQ ID NO: 834395 - RNA, 22 nt, Human
ucaaaauuuuauuucucaagga

SEQ ID NO: 834396 - RNA, 20 nt, Human
uuccuguauacaaagaguuc

SEQ ID NO: 834397 - RNA, 22 nt, Human
ugaagcagagugaaggugaauu

SEQ ID NO: 834398 - RNA, 20 nt, Human
gcccaggaucucugaggcau

SEQ ID NO: 834399 - RNA, 19 nt, Human
ggagccuggagcacgugcc

SEQ ID NO: 834400 - RNA, 22 nt, Human
cuccaggccagggaaguggaca

SEQ ID NO: 834401 - RNA, 22 nt, Human
accagagcagacuacuggaggu

SEQ ID NO: 834402 - RNA, 22 nt, Human
gagacagaguuucacucuuguu

SEQ ID NO: 834403 - RNA, 22 nt, Human
gggugggagucuggcccucaaa

SEQ ID NO: 834404 - RNA, 22 nt, Human
cagcccuguccagcagagggug

SEQ ID NO: 834405 - RNA, 22 nt, Human
uaguuucagcuccuucauccug

SEQ ID NO: 834406 - RNA, 23 nt, Human
ccagcuccgugagccucgggcuc

SEQ ID NO: 834407 - RNA, 22 nt, Human
aagaaugagcucaaagaucuua

SEQ ID NO: 834408 - RNA, 20 nt, Human
auaaaauaacugccacaaga

SEQ ID NO: 834409 - RNA, 21 nt, Human
agcugggccucagccugcagu

SEQ ID NO: 834410 - RNA, 22 nt, Human
ggcccaaggcccaggucgagcu

SEQ ID NO: 834411 - RNA, 22 nt, Human
aaggccauuauucugauauauu

SEQ ID NO: 834412 - RNA, 22 nt, Human
gacauaauccuccucaccuacu

SEQ ID NO: 834413 - RNA, 17 nt, Human
aagauuucauuagcuga

SEQ ID NO: 834414 - RNA, 22 nt, Human
gaguggggucugggcaucaguc

SEQ ID NO: 834415 - RNA, 22 nt, Human
uuucaaacauaucuucauuacu

SEQ ID NO: 834416 - RNA, 22 nt, Human
cagcauuuggaggagaggcuuu

SEQ ID NO: 834417 - RNA, 22 nt, Human
uucucugaucuugcuagacuga

SEQ ID NO: 834418 - RNA, 22 nt, Human
cagaauguagaucaucaucaag

SEQ ID NO: 834419 - RNA, 22 nt, Human
ccaggcagccaagugugugugu

SEQ ID NO: 834420 - RNA, 22 nt, Human
cuggugccuccucccugugcuu

SEQ ID NO: 834421 - RNA, 22 nt, Human
ccaaggagcaaguuuacaccug

SEQ ID NO: 834422 - RNA, 22 nt, Human
augcaguauaaaucauuucugg

SEQ ID NO: 834423 - RNA, 22 nt, Human
aguugaaauuagaguccuggcu

SEQ ID NO: 834424 - RNA, 22 nt, Human
aaggcugagacagcacaggucc

SEQ ID NO: 834425 - RNA, 22 nt, Human
gcucaagagagaugcaguucuu

SEQ ID NO: 834426 - RNA, 20 nt, Human
acauguacuaaugaauacag

SEQ ID NO: 834427 - RNA, 22 nt, Human
uugugucccccuuugagagcca

SEQ ID NO: 834428 - RNA, 22 nt, Human
acagaauacuacagacugguua

SEQ ID NO: 834429 - RNA, 22 nt, Human
ccagagccuggcaucugcauaa

SEQ ID NO: 834430 - RNA, 22 nt, Human
accagcagaguugaggaggaca

SEQ ID NO: 834431 - RNA, 20 nt, Human
uuacagaaaugauguuauuu

SEQ ID NO: 834432 - RNA, 20 nt, Human
uguauauuuucugguguaaa

SEQ ID NO: 834433 - RNA, 22 nt, Human
aggcagaggagaaugaucuucc

SEQ ID NO: 834434 - RNA, 22 nt, Human
aggggcugggacagagccaagc

SEQ ID NO: 834435 - RNA, 22 nt, Human
ccugggagugucagacuugcuu

SEQ ID NO: 834436 - RNA, 22 nt, Human
auguaacaggugaagcucugag

SEQ ID NO: 834437 - RNA, 22 nt, Human
uaauguguugaauauuuguaca

SEQ ID NO: 834438 - RNA, 22 nt, Human
aggcaguuucugggacagcaua

SEQ ID NO: 834439 - RNA, 22 nt, Human
ugggcucucuggcaggaaggcu

SEQ ID NO: 834440 - RNA, 22 nt, Human
aagucacaagcauauaugcauu

SEQ ID NO: 834441 - RNA, 22 nt, Human
uguggccuccccacuucugggg

SEQ ID NO: 834442 - RNA, 22 nt, Human
uccucccacauaggacaauggg

SEQ ID NO: 834443 - RNA, 22 nt, Human
aggguagggccguagggccaug

SEQ ID NO: 834444 - RNA, 22 nt, Human
cuggcuucugggccagggcaga

SEQ ID NO: 834445 - RNA, 22 nt, Human
gcucagagauggggaaugaaaa

SEQ ID NO: 834446 - RNA, 22 nt, Human
ucauugcaggcauuccccugcc

SEQ ID NO: 834447 - RNA, 22 nt, Human
cccaggaguuugaguucagcau

SEQ ID NO: 834448 - RNA, 22 nt, Human
cucugugccucaguuuucuucu

SEQ ID NO: 834449 - RNA, 22 nt, Human
ccauggcaauggucagucuauu

SEQ ID NO: 834450 - RNA, 22 nt, Human
acagaauuugcuugggcaaugg

SEQ ID NO: 834451 - RNA, 22 nt, Human
aggcacugacucaagggagcca

SEQ ID NO: 834452 - RNA, 22 nt, Human
ugcugccaugcagagcaacaga

SEQ ID NO: 834453 - RNA, 22 nt, Human
guccugggaaggaagccaggga

SEQ ID NO: 834454 - RNA, 22 nt, Human
cuggugucugcucccucacagc

SEQ ID NO: 834455 - RNA, 21 nt, Human
uuugcauuuuacaugugggga

SEQ ID NO: 834456 - RNA, 21 nt, Human
aaugaaguggcuauuuugagg

SEQ ID NO: 834457 - RNA, 22 nt, Human
aucaguuucacuugcuugcaaa

SEQ ID NO: 834458 - RNA, 22 nt, Human
aaaagagguuaaccaggugugu

SEQ ID NO: 834459 - RNA, 22 nt, Human
uuauuuauuguguaccuacugu

SEQ ID NO: 834460 - RNA, 22 nt, Human
gcauuuccugugcuuggcauau

SEQ ID NO: 834461 - RNA, 21 nt, Human
uaagaacauuaucuucuuccu

SEQ ID NO: 834462 - RNA, 21 nt, Human
cuugaaagguagagucuacag

SEQ ID NO: 834463 - RNA, 22 nt, Human
caguacuuauuucuauuuaggg

SEQ ID NO: 834464 - RNA, 21 nt, Human
ucucugggcccuccugugggg

SEQ ID NO: 834465 - RNA, 22 nt, Human
cugggcugagccugggcugugu

SEQ ID NO: 834466 - RNA, 21 nt, Human
uuucugaaggcaacaucuauc

SEQ ID NO: 834467 - RNA, 22 nt, Human
ucagaauaugcuaaugacauuu

SEQ ID NO: 834468 - RNA, 22 nt, Human
ggccucucauguccugggcuuc

SEQ ID NO: 834469 - RNA, 22 nt, Human
acagaacugcaggaggaaaagc

SEQ ID NO: 834470 - RNA, 22 nt, Human
acagacagggcaccugccuccu

SEQ ID NO: 834471 - RNA, 18 nt, Human
ggcugugcguggaggcug

SEQ ID NO: 834472 - RNA, 22 nt, Human
uuucagaaaacuuaucaucagu

SEQ ID NO: 834473 - RNA, 22 nt, Human
uuuccauauuuggucuuuggga

SEQ ID NO: 834474 - RNA, 22 nt, Human
aucauuccacauguaccacuag

SEQ ID NO: 834475 - RNA, 22 nt, Human
cacagcuuguuuagugacucac

SEQ ID NO: 834476 - RNA, 22 nt, Human
auuuguugcuagcagcacugau

SEQ ID NO: 834477 - RNA, 20 nt, Human
aggagccauugacugcagca

SEQ ID NO: 834478 - RNA, 22 nt, Human
uuaauucugccuuucauguaac

SEQ ID NO: 834479 - RNA, 22 nt, Human
ucccagggugcgccugcccucg

SEQ ID NO: 834480 - RNA, 22 nt, Human
augcagcugugggcaagaaaug

SEQ ID NO: 834481 - RNA, 22 nt, Human
ccagggcuccauugcucauccu

SEQ ID NO: 834482 - RNA, 23 nt, Human
cuggccuccgacacuggccaaga

SEQ ID NO: 834483 - RNA, 22 nt, Human
aagucacccuagggccuggacu

SEQ ID NO: 834484 - RNA, 18 nt, Human
gccugcaggcacgggggu

SEQ ID NO: 834485 - RNA, 22 nt, Human
gcuguguuggugaagcuguagc

SEQ ID NO: 834486 - RNA, 22 nt, Human
ugggccaggauuucaagacccu

SEQ ID NO: 834487 - RNA, 22 nt, Human
uaaaguuuguagcaauugauau

SEQ ID NO: 834488 - RNA, 22 nt, Human
ucccagggcagcuguccagaag

SEQ ID NO: 834489 - RNA, 22 nt, Human
ucccagacaaucauuggccacc

SEQ ID NO: 834490 - RNA, 22 nt, Human
auaaauaucacuguugucccuc

SEQ ID NO: 834491 - RNA, 22 nt, Human
uuauuccagcuaagaguccugg

SEQ ID NO: 834492 - RNA, 22 nt, Human
ccauggcuuucuuucauuguaa

SEQ ID NO: 834493 - RNA, 22 nt, Human
gagaggugaaggcugcccuggg

SEQ ID NO: 834494 - RNA, 22 nt, Human
auuuccaagaaagcuuuaggau

SEQ ID NO: 834495 - RNA, 22 nt, Human
gcugugcagccaagugccucug

SEQ ID NO: 834496 - RNA, 22 nt, Human
ugcuggggguucagaugaguaa

SEQ ID NO: 834497 - RNA, 22 nt, Human
gcagcuuuguggagaggcccau

SEQ ID NO: 834498 - RNA, 22 nt, Human
aauaaacugcucaauugcauca

SEQ ID NO: 834499 - RNA, 22 nt, Human
auucuguauuucuaauaagauc

SEQ ID NO: 834500 - RNA, 22 nt, Human
guggccugccgugugguauggg

SEQ ID NO: 834501 - RNA, 22 nt, Human
aguaacuaugcuugagaaucag

SEQ ID NO: 834502 - RNA, 22 nt, Human
gucucuggguuaagcagugcau

SEQ ID NO: 834503 - RNA, 22 nt, Human
acagagcuguacaugugccaug

SEQ ID NO: 834504 - RNA, 21 nt, Human
cuggacugaggagacagucgc

SEQ ID NO: 834505 - RNA, 22 nt, Human
uucagaaaugaauauugguauu

SEQ ID NO: 834506 - RNA, 22 nt, Human
caagagcucaccggagagcauu

SEQ ID NO: 834507 - RNA, 22 nt, Human
uacaguaaagcugcuaugaauu

SEQ ID NO: 834508 - RNA, 20 nt, Human
agcccaggccugugugaguc

SEQ ID NO: 834509 - RNA, 22 nt, Human
ccuuaaauucuccauuugaaag

SEQ ID NO: 834510 - RNA, 22 nt, Human
ggagccagagucugcaguguaa

SEQ ID NO: 834511 - RNA, 22 nt, Human
ugugccugucacccucagagag

SEQ ID NO: 834512 - RNA, 18 nt, Human
gucaccuggaucagauua

SEQ ID NO: 834513 - RNA, 22 nt, Human
cugggcugugguguggcccaaa

SEQ ID NO: 834514 - RNA, 22 nt, Human
cauuaugugggaaaauguucuu

SEQ ID NO: 834515 - RNA, 22 nt, Human
acacauauauacauauuugugc

SEQ ID NO: 834516 - RNA, 22 nt, Human
uugaaaggugcugugugcugau

SEQ ID NO: 834517 - RNA, 22 nt, Human
cucuuaaagaauguuccagcug

SEQ ID NO: 834518 - RNA, 22 nt, Human
aaucauucuuauuucacagcaa

SEQ ID NO: 834519 - RNA, 22 nt, Human
agaaaucaugacuaagagcagu

SEQ ID NO: 834520 - RNA, 22 nt, Human
uuuaggcauacuuuugggagaa

SEQ ID NO: 834521 - RNA, 22 nt, Human
gcaggcagagaaggaacauuua

SEQ ID NO: 834522 - RNA, 21 nt, Human
aggcagcucaggcccagagag

SEQ ID NO: 834523 - RNA, 22 nt, Human
ccagaaaaugcagaacauagaa

SEQ ID NO: 834524 - RNA, 17 nt, Human
agaggcagauacuugga

SEQ ID NO: 834525 - RNA, 22 nt, Human
uccuuggcagcagggagcauga

SEQ ID NO: 834526 - RNA, 22 nt, Human
acuguucauuuggauuucucug

SEQ ID NO: 834527 - RNA, 22 nt, Human
uguggccuccuguuccugggua

SEQ ID NO: 834528 - RNA, 22 nt, Human
uaauuuaauuccauggauucua

SEQ ID NO: 834529 - RNA, 22 nt, Human
guguguuucagaagccaggugu

SEQ ID NO: 834530 - RNA, 22 nt, Human
uacccaggaggaaacugaggcu

SEQ ID NO: 834531 - RNA, 22 nt, Human
ucaccugggagggcugugguag

SEQ ID NO: 834532 - RNA, 21 nt, Human
cagaaguaaggguaacuucuc

SEQ ID NO: 834533 - RNA, 20 nt, Human
uacaauacacaugcauauga

SEQ ID NO: 834534 - RNA, 22 nt, Human
cuggggcucacuuuggucaggc

SEQ ID NO: 834535 - RNA, 22 nt, Human
gaguccuucuggcuggcaggau

SEQ ID NO: 834536 - RNA, 21 nt, Human
guauucuuuaugaagugaaaa

SEQ ID NO: 834537 - RNA, 22 nt, Human
guucuccauucagcuuccugug

SEQ ID NO: 834538 - RNA, 22 nt, Human
uggcucagaacuacuucuaguu

SEQ ID NO: 834539 - RNA, 22 nt, Human
agugugucugaucacuugugag

SEQ ID NO: 834540 - RNA, 22 nt, Human
gccagggcaggggagcaucugc

SEQ ID NO: 834541 - RNA, 19 nt, Human
ucaaagucugagucacuuu

SEQ ID NO: 834542 - RNA, 22 nt, Human
cauuuguaauacugacuugcag

SEQ ID NO: 834543 - RNA, 22 nt, Human
ugcuuauucuuuccacaauuca

SEQ ID NO: 834544 - RNA, 22 nt, Human
augaaacacacacgcgcauacu

SEQ ID NO: 834545 - RNA, 22 nt, Human
cccaggagaugcacuccauugg

SEQ ID NO: 834546 - RNA, 20 nt, Human
uccaagcccuccuuccauuc

SEQ ID NO: 834547 - RNA, 22 nt, Human
agaaaaggauugauggaucaga

SEQ ID NO: 834548 - RNA, 22 nt, Human
uagaauaaguugaugauauaug

SEQ ID NO: 834549 - RNA, 22 nt, Human
cucuacucuuaacacagcuagg

SEQ ID NO: 834550 - RNA, 22 nt, Human
accugccuaucagcugccugcu

SEQ ID NO: 834551 - RNA, 22 nt, Human
acagccaggagccaugggcagg

SEQ ID NO: 834552 - RNA, 22 nt, Human
uaucugagaaagaagcaccaga

SEQ ID NO: 834553 - RNA, 22 nt, Human
aaaguucuggggguguuucugg

SEQ ID NO: 834554 - RNA, 22 nt, Human
ucccagaguucaaugggaaggu

SEQ ID NO: 834555 - RNA, 18 nt, Human
ccuggaccugucuccuuu

SEQ ID NO: 834556 - RNA, 22 nt, Human
augguuuguaacccaauacucc

SEQ ID NO: 834557 - RNA, 19 nt, Human
uucacaauuaugaaauuag

SEQ ID NO: 834558 - RNA, 22 nt, Human
ggagguggcagggaacauaauu

SEQ ID NO: 834559 - RNA, 20 nt, Human
aagcagaagcugcucucagc

SEQ ID NO: 834560 - RNA, 22 nt, Human
acagcaggauuuggcgauguug

SEQ ID NO: 834561 - RNA, 22 nt, Human
gccuggcuccuaaggacuggcu

SEQ ID NO: 834562 - RNA, 22 nt, Human
caggaagagaacauggaggcug

SEQ ID NO: 834563 - RNA, 22 nt, Human
agcugcucucacuggacgccug

SEQ ID NO: 834564 - RNA, 22 nt, Human
uaacacauaucuacaacaugug

SEQ ID NO: 834565 - RNA, 22 nt, Human
aaggcagcucagcucauggcag

SEQ ID NO: 834566 - RNA, 22 nt, Human
ucucagagauuuauggaaaacu

SEQ ID NO: 834567 - RNA, 22 nt, Human
cccagcucucugcucuuagccu

SEQ ID NO: 834568 - RNA, 22 nt, Human
auucuucacauaagugcuguac

SEQ ID NO: 834569 - RNA, 22 nt, Human
guggcuucuggcugggccucag

SEQ ID NO: 834570 - RNA, 22 nt, Human
cucuucuugcuagacugagugc

SEQ ID NO: 834571 - RNA, 22 nt, Human
auugcuaggaacagguugcacc

SEQ ID NO: 834572 - RNA, 22 nt, Human
agcaccuguugcacuucauaau

SEQ ID NO: 834573 - RNA, 22 nt, Human
gcuguucauagaaauggucuca

SEQ ID NO: 834574 - RNA, 22 nt, Human
ggcuucugguaaagaccacacc

SEQ ID NO: 834575 - RNA, 22 nt, Human
acacccagagcgccagugccga

SEQ ID NO: 834576 - RNA, 22 nt, Human
aggcagaaaauagucauccaaa

SEQ ID NO: 834577 - RNA, 22 nt, Human
cacaaaaguaggaggcaggcgg

SEQ ID NO: 834578 - RNA, 22 nt, Human
uuucuuaguccuagagugauuu

SEQ ID NO: 834579 - RNA, 22 nt, Human
uagaaaucagguuuuuagaaag

SEQ ID NO: 834580 - RNA, 22 nt, Human
ugcuuaauaggaguugaacauu

SEQ ID NO: 834581 - RNA, 22 nt, Human
caagacaagaucuaagcaugcu

SEQ ID NO: 834582 - RNA, 22 nt, Human
uguucagagacagaaauucuaa

SEQ ID NO: 834583 - RNA, 22 nt, Human
gcagacagacugcagugauuuu

SEQ ID NO: 834584 - RNA, 22 nt, Human
ugcuggccaacaaggcuccaag

SEQ ID NO: 834585 - RNA, 22 nt, Human
agcagagccaggucucucugua

SEQ ID NO: 834586 - RNA, 22 nt, Human
aauuuguuaaaagugagugaca

SEQ ID NO: 834587 - RNA, 22 nt, Human
agauuucccaaauacuuguuau

SEQ ID NO: 834588 - RNA, 22 nt, Human
ggcaguggguggaucucaggga

SEQ ID NO: 834589 - RNA, 22 nt, Human
gccuggcacucacugaagaggc

SEQ ID NO: 834590 - RNA, 21 nt, Human
uggagacucugguucuuugug

SEQ ID NO: 834591 - RNA, 22 nt, Human
auucaguaggucuagaauaaga

SEQ ID NO: 834592 - RNA, 20 nt, Human
acaaaauagguacuggguag

SEQ ID NO: 834593 - RNA, 22 nt, Human
agccuguggaucccugcacugg

SEQ ID NO: 834594 - RNA, 22 nt, Human
gauuucaaggauguuagaggug

SEQ ID NO: 834595 - RNA, 22 nt, Human
aucacgucaugguuugaucugg

SEQ ID NO: 834596 - RNA, 22 nt, Human
uauguacauggagagcaauuga

SEQ ID NO: 834597 - RNA, 22 nt, Human
uuucucuaaauagggaggcuua

SEQ ID NO: 834598 - RNA, 22 nt, Human
ggcugccauaacugauaccaua

SEQ ID NO: 834599 - RNA, 22 nt, Human
gccagcucccaagugagccccu

SEQ ID NO: 834600 - RNA, 22 nt, Human
ucagugucuugaccugggugug

SEQ ID NO: 834601 - RNA, 22 nt, Human
aguggcagccgagcaggagaug

SEQ ID NO: 834602 - RNA, 22 nt, Human
caaauagugucacauugugagg

SEQ ID NO: 834603 - RNA, 22 nt, Human
cgcugggggaacagcgagggug

SEQ ID NO: 834604 - RNA, 22 nt, Human
uccuucagcuacucaguuucca

SEQ ID NO: 834605 - RNA, 20 nt, Human
uggcuccucuuggcuguggc

SEQ ID NO: 834606 - RNA, 19 nt, Human
ugucacugucauggcccag

SEQ ID NO: 834607 - RNA, 22 nt, Human
cuggccugagaaugcuacccuu

SEQ ID NO: 834608 - RNA, 22 nt, Human
ccagucacucugugagagcuac

SEQ ID NO: 834609 - RNA, 22 nt, Human
cugugucccuugucccagagcc

SEQ ID NO: 834610 - RNA, 20 nt, Human
uugagcuuuuaguacagaca

SEQ ID NO: 834611 - RNA, 22 nt, Human
uaauaucuggcauucaaacaug

SEQ ID NO: 834612 - RNA, 22 nt, Human
uccaggaggcaccuuuggacca

SEQ ID NO: 834613 - RNA, 22 nt, Human
aucuagaaaguguugaagauca

SEQ ID NO: 834614 - RNA, 22 nt, Human
uauuccagugugaucuuuguag

SEQ ID NO: 834615 - RNA, 22 nt, Human
uggggacauagccagucuggcu

SEQ ID NO: 834616 - RNA, 22 nt, Human
ugggauaguggccaggaccccc

SEQ ID NO: 834617 - RNA, 22 nt, Human
uggcucuguugugcugagccag

SEQ ID NO: 834618 - RNA, 22 nt, Human
cuggcuggucaucagcaguacg

SEQ ID NO: 834619 - RNA, 22 nt, Human
gcugucuccauagcuguguguc

SEQ ID NO: 834620 - RNA, 22 nt, Human
agcccuagagcuggaggucagu

SEQ ID NO: 834621 - RNA, 21 nt, Human
ugcucacagaugugcucagug

SEQ ID NO: 834622 - RNA, 22 nt, Human
gggugcugacuggggccugaaa

SEQ ID NO: 834623 - RNA, 22 nt, Human
acaaauguggacauggauaaug

SEQ ID NO: 834624 - RNA, 22 nt, Human
agagugcaaccgaaacaagcag

SEQ ID NO: 834625 - RNA, 22 nt, Human
uaggaaaagucuagauugauga

SEQ ID NO: 834626 - RNA, 22 nt, Human
cagcaggauaugguggagagag

SEQ ID NO: 834627 - RNA, 22 nt, Human
cuguguuggcuuuucucuugua

SEQ ID NO: 834628 - RNA, 22 nt, Human
uugacaauugggagauauaaag

SEQ ID NO: 834629 - RNA, 22 nt, Human
agcaggguuuggggauuggcac

SEQ ID NO: 834630 - RNA, 22 nt, Human
gcugucugggaugucacugcug

SEQ ID NO: 834631 - RNA, 22 nt, Human
cuagccaugggcauuaaaggua

SEQ ID NO: 834632 - RNA, 22 nt, Human
gcagagaaaguuuuguccucag

SEQ ID NO: 834633 - RNA, 22 nt, Human
uugcugugucugauggcugaga

SEQ ID NO: 834634 - RNA, 22 nt, Human
ugcagcucauugguguccuggu

SEQ ID NO: 834635 - RNA, 22 nt, Human
uaaggcauucucaugcugugaa

SEQ ID NO: 834636 - RNA, 22 nt, Human
cucuccagccacagaagcugcu

SEQ ID NO: 834637 - RNA, 22 nt, Human
aucuacauaaaacgaauacaua

SEQ ID NO: 834638 - RNA, 22 nt, Human
ggcugugcgggcagccguggga

SEQ ID NO: 834639 - RNA, 20 nt, Human
uaguauuugcauaaggauag

SEQ ID NO: 834640 - RNA, 22 nt, Human
ucccaggaugaagacaguguug

SEQ ID NO: 834641 - RNA, 22 nt, Human
gcagcuaccacccaggaaggac

SEQ ID NO: 834642 - RNA, 22 nt, Human
ugcaagggcuuagggggcugug

SEQ ID NO: 834643 - RNA, 22 nt, Human
guuaugaaauaaauauagauca

SEQ ID NO: 834644 - RNA, 22 nt, Human
gggcuggcgggaaaggcaauuc

SEQ ID NO: 834645 - RNA, 22 nt, Human
auuccaaaggcuggccuggagg

SEQ ID NO: 834646 - RNA, 22 nt, Human
agcagcugccagagagaguucc

SEQ ID NO: 834647 - RNA, 22 nt, Human
uuuccucugagugagcugggag

SEQ ID NO: 834648 - RNA, 22 nt, Human
caguagcaggcaggugcuuuug

SEQ ID NO: 834649 - RNA, 22 nt, Human
ccacugucuuuuccaggcugaa

SEQ ID NO: 834650 - RNA, 22 nt, Human
uacuauaccauguaagauauga

SEQ ID NO: 834651 - RNA, 22 nt, Human
aauaauuagugggacagagaac

SEQ ID NO: 834652 - RNA, 22 nt, Human
acauguggucaaucuguguagg

SEQ ID NO: 834653 - RNA, 22 nt, Human
cuggagccaugucuugacugcu

SEQ ID NO: 834654 - RNA, 22 nt, Human
gugcucuggcuggucucccggu

SEQ ID NO: 834655 - RNA, 22 nt, Human
gagaggauccacaaaccaggaa

SEQ ID NO: 834656 - RNA, 22 nt, Human
uugguacaaaaguaacuguggu

SEQ ID NO: 834657 - RNA, 22 nt, Human
ugggugcuucgucagcucugag

SEQ ID NO: 834658 - RNA, 22 nt, Human
uccagagguauguagagaguau

SEQ ID NO: 834659 - RNA, 22 nt, Human
uuuacacaaaagauagcacacc

SEQ ID NO: 834660 - RNA, 22 nt, Human
ugccaggagagugcaugcaggg

SEQ ID NO: 834661 - RNA, 21 nt, Human
guggccugauuaugaaugggu

SEQ ID NO: 834662 - RNA, 22 nt, Human
ugaaauagacacagugcuauac

SEQ ID NO: 834663 - RNA, 22 nt, Human
gcugcagcagcugcaggguugu

SEQ ID NO: 834664 - RNA, 22 nt, Human
aaauguguguauguacauauau

SEQ ID NO: 834665 - RNA, 22 nt, Human
cuccagggagcugcgggagcca

SEQ ID NO: 834666 - RNA, 22 nt, Human
aggcagaauguuggaaaggaag

SEQ ID NO: 834667 - RNA, 22 nt, Human
ugcuagaaaucugaaacuagca

SEQ ID NO: 834668 - RNA, 22 nt, Human
aggaugggccugggauaugcuu

SEQ ID NO: 834669 - RNA, 22 nt, Human
aggcugucaucuuugcaggcag

SEQ ID NO: 834670 - RNA, 22 nt, Human
aaaacuaaauacgcuuugccuc

SEQ ID NO: 834671 - RNA, 22 nt, Human
agccaacuaauuaaacaacuuu

SEQ ID NO: 834672 - RNA, 22 nt, Human
gcuggagguuucaccugaguuu

SEQ ID NO: 834673 - RNA, 22 nt, Human
agaaaugcucuuccugaccaga

SEQ ID NO: 834674 - RNA, 22 nt, Human
ucucuucuauuugagacuauuu

SEQ ID NO: 834675 - RNA, 22 nt, Human
gucagaggaauggaugagugau

SEQ ID NO: 834676 - RNA, 22 nt, Human
agauuucccacuccauguauug

SEQ ID NO: 834677 - RNA, 22 nt, Human
ggcugcugguggaaugguaggc

SEQ ID NO: 834678 - RNA, 22 nt, Human
ccucuucugagugagacucccu

SEQ ID NO: 834679 - RNA, 22 nt, Human
cugcagugcaagcccagaugga

SEQ ID NO: 834680 - RNA, 22 nt, Human
uaggacaggugaggggcugugg

SEQ ID NO: 834681 - RNA, 22 nt, Human
ccaggcagagggauccccaucc

SEQ ID NO: 834682 - RNA, 22 nt, Human
aggagcuggaguccaggcaagu

SEQ ID NO: 834683 - RNA, 20 nt, Human
agcaagaguaaggacagcga

SEQ ID NO: 834684 - RNA, 22 nt, Human
uaguccuugcugggcacagagu

SEQ ID NO: 834685 - RNA, 23 nt, Human
ugcaggggaggcuuaaagcaggu

SEQ ID NO: 834686 - RNA, 22 nt, Human
gagggagggaaaguuuaacacu

SEQ ID NO: 834687 - RNA, 22 nt, Human
cagcuggggcagccacgugcgg

SEQ ID NO: 834688 - RNA, 22 nt, Human
uuacagaacugcccuaguuggc

SEQ ID NO: 834689 - RNA, 22 nt, Human
cacugcagaucagaggcugaga

SEQ ID NO: 834690 - RNA, 22 nt, Human
ggccuguguccuccuugcccug

SEQ ID NO: 834691 - RNA, 22 nt, Human
uggaaggaaagguagcagagaa

SEQ ID NO: 834692 - RNA, 22 nt, Human
guggcccaggcuuggcgcuggc

SEQ ID NO: 834693 - RNA, 22 nt, Human
uuuccagagcaugucugcucag

SEQ ID NO: 834694 - RNA, 22 nt, Human
uuuuaugugcuggacuggcagu

SEQ ID NO: 834695 - RNA, 22 nt, Human
aagcgccaugguuccugcgcag

SEQ ID NO: 834696 - RNA, 22 nt, Human
ucugcagcuugcacaggcaggc

SEQ ID NO: 834697 - RNA, 22 nt, Human
gcccaggagguggaggugcagu

SEQ ID NO: 834698 - RNA, 22 nt, Human
gaggaugugucuggucugggca

SEQ ID NO: 834699 - RNA, 22 nt, Human
caaaguuaugaaugauaagauu

SEQ ID NO: 834700 - RNA, 22 nt, Human
ugagccuggccugcagagacca

SEQ ID NO: 834701 - RNA, 22 nt, Human
uugaaggacaucuuguuucuag

SEQ ID NO: 834702 - RNA, 22 nt, Human
aagcagccacuggccaguuaua

SEQ ID NO: 834703 - RNA, 22 nt, Human
aggccuggugugccggaugcag

SEQ ID NO: 834704 - RNA, 22 nt, Human
gggcugcuuccuggggaaugcu

SEQ ID NO: 834705 - RNA, 22 nt, Human
gcugagcugcuguucauccugc

SEQ ID NO: 834706 - RNA, 22 nt, Human
gucugucacucaggggcuggag

SEQ ID NO: 834707 - RNA, 22 nt, Human
augauugaccaucugcugggcu

SEQ ID NO: 834708 - RNA, 22 nt, Human
aucugucuugccuugcauauuu

SEQ ID NO: 834709 - RNA, 22 nt, Human
uacaguagaauuuuuaguaacu

SEQ ID NO: 834710 - RNA, 22 nt, Human
augcuguguggucaaguuaauu

SEQ ID NO: 834711 - RNA, 22 nt, Human
ggacacaagcuccggggcugca

SEQ ID NO: 834712 - RNA, 22 nt, Human
acgagagguccuuagaaucugu

SEQ ID NO: 834713 - RNA, 22 nt, Human
gccaggcugcuccagggaggcc

SEQ ID NO: 834714 - RNA, 22 nt, Human
ggcugaaguguaguggcucacu

SEQ ID NO: 834715 - RNA, 22 nt, Human
ggucccagaauugguuagcaca

SEQ ID NO: 834716 - RNA, 22 nt, Human
agcccaaggcuucccugcuggc

SEQ ID NO: 834717 - RNA, 22 nt, Human
cagccagggagcaaagaguuga

SEQ ID NO: 834718 - RNA, 17 nt, Human
accagccucuccugggg

SEQ ID NO: 834719 - RNA, 22 nt, Human
ucccaggaaggauucggcauuu

SEQ ID NO: 834720 - RNA, 22 nt, Human
ggcagccuccagggcacuggug

SEQ ID NO: 834721 - RNA, 22 nt, Human
auguuucaccaguuuuauaaga

SEQ ID NO: 834722 - RNA, 22 nt, Human
aggugagggugccagugcaugg

SEQ ID NO: 834723 - RNA, 22 nt, Human
ucuggagccuuggaugggaaag

SEQ ID NO: 834724 - RNA, 22 nt, Human
uaacacaugguuaguacacaau

SEQ ID NO: 834725 - RNA, 22 nt, Human
caugucuguguacacaugcaca

SEQ ID NO: 834726 - RNA, 22 nt, Human
cauauuuauagaucuggcauuu

SEQ ID NO: 834727 - RNA, 22 nt, Human
agagugggccucugagucccag

SEQ ID NO: 834728 - RNA, 22 nt, Human
acacaggggaaaguggagcuga

SEQ ID NO: 834729 - RNA, 22 nt, Human
uuugcauucuagaaaaauuucu

SEQ ID NO: 834730 - RNA, 22 nt, Human
uguguuuugaacucaucuacug

SEQ ID NO: 834731 - RNA, 22 nt, Human
uccaggagguuuggaggaagca

SEQ ID NO: 834732 - RNA, 22 nt, Human
uuaugaaagacauuucuguugg

SEQ ID NO: 834733 - RNA, 22 nt, Human
cuuucaaugugccugccuuggg

SEQ ID NO: 834734 - RNA, 22 nt, Human
gugaggggaguaaagccauguu

SEQ ID NO: 834735 - RNA, 22 nt, Human
ucauuuguucucauucucuacu

SEQ ID NO: 834736 - RNA, 22 nt, Human
agugggcagugcgcucggaugc

SEQ ID NO: 834737 - RNA, 22 nt, Human
auguacaguggaaacuaacaaa

SEQ ID NO: 834738 - RNA, 22 nt, Human
uuugugaaaugaagucacaacu

SEQ ID NO: 834739 - RNA, 22 nt, Human
uauuacugagguuuuauggagu

SEQ ID NO: 834740 - RNA, 22 nt, Human
acagcuugcaauggcuuucaac

SEQ ID NO: 834741 - RNA, 22 nt, Human
cccagccucuguuugcuccucu

SEQ ID NO: 834742 - RNA, 22 nt, Human
gaaauuauugcuagagacugca

SEQ ID NO: 834743 - RNA, 22 nt, Human
aucuggcucgcuaggcucuggg

SEQ ID NO: 834744 - RNA, 22 nt, Human
uuccagggcuaauuccugugga

SEQ ID NO: 834745 - RNA, 21 nt, Human
guggcccugguguggcugcac

SEQ ID NO: 834746 - RNA, 21 nt, Human
aggaaguggccagauugggaa

SEQ ID NO: 834747 - RNA, 22 nt, Human
ccacucugauuuuggcuccacu

SEQ ID NO: 834748 - RNA, 22 nt, Human
gcuggcauuacaggagagaacc

SEQ ID NO: 834749 - RNA, 22 nt, Human
uauagaagagacaugugcauag

SEQ ID NO: 834750 - RNA, 22 nt, Human
ggaggccaaagugugggcggcu

SEQ ID NO: 834751 - RNA, 22 nt, Human
ugucccagguccuagaugacca

SEQ ID NO: 834752 - RNA, 22 nt, Human
auuucaaggcuauuaauauaaa

SEQ ID NO: 834753 - RNA, 22 nt, Human
ucucuucacaugcuugcuccaa

SEQ ID NO: 834754 - RNA, 22 nt, Human
aucuggcuuuuaccccacggcc

SEQ ID NO: 834755 - RNA, 23 nt, Human
aggaggccugaaacugaggcuga

SEQ ID NO: 834756 - RNA, 22 nt, Human
ucauaauacaaagaguucugca

SEQ ID NO: 834757 - RNA, 22 nt, Human
ugcuggaggaguuuacuguggc

SEQ ID NO: 834758 - RNA, 22 nt, Human
aauguucagaggacaauauaaa

SEQ ID NO: 834759 - RNA, 22 nt, Human
uuucuucaauugcuaacaagga

SEQ ID NO: 834760 - RNA, 23 nt, Human
gcauugucuccccacuucugggc

SEQ ID NO: 834761 - RNA, 22 nt, Human
uacuuuaaaaacugauaauuca

SEQ ID NO: 834762 - RNA, 22 nt, Human
acacaggaagucagcacugaug

SEQ ID NO: 834763 - RNA, 22 nt, Human
uuaauacagucuccagaaguaa

SEQ ID NO: 834764 - RNA, 22 nt, Human
aagagcuggagcugcuacagga

SEQ ID NO: 834765 - RNA, 22 nt, Human
gcagaagggaauaaggagcuuu

SEQ ID NO: 834766 - RNA, 22 nt, Human
gaggccagaaugagcugaaugc

SEQ ID NO: 834767 - RNA, 22 nt, Human
uuugcagugucagcuucugugu

SEQ ID NO: 834768 - RNA, 22 nt, Human
agggccugucagcgguguccug

SEQ ID NO: 834769 - RNA, 22 nt, Human
auagcuuucuuaaauauauaaa

SEQ ID NO: 834770 - RNA, 22 nt, Human
ucucagaggugcccuggcaucu

SEQ ID NO: 834771 - RNA, 22 nt, Human
gaagaacaagcagugcuuuccu

SEQ ID NO: 834772 - RNA, 22 nt, Human
cucugagaggugagaagcagca

SEQ ID NO: 834773 - RNA, 22 nt, Human
auuucaacguuagauguaauag

SEQ ID NO: 834774 - RNA, 22 nt, Human
ugcccaggauugugaggucagg

SEQ ID NO: 834775 - RNA, 22 nt, Human
gauguguuuccaggauuuguuu

SEQ ID NO: 834776 - RNA, 22 nt, Human
acucugagcaucccaagucuua

SEQ ID NO: 834777 - RNA, 22 nt, Human
ucagcugaguucuagagcacuc

SEQ ID NO: 834778 - RNA, 22 nt, Human
caggagcugggucuggaagcag

SEQ ID NO: 834779 - RNA, 22 nt, Human
uacauguaauuuucauaguaag

SEQ ID NO: 834780 - RNA, 22 nt, Human
cuaucauuuuacaugguuggug

SEQ ID NO: 834781 - RNA, 22 nt, Human
uuucuguagggauuucacaguu

SEQ ID NO: 834782 - RNA, 22 nt, Human
gggaucagcaagccacugcacc

SEQ ID NO: 834783 - RNA, 22 nt, Human
cagcuagcuaagaaggccagag

SEQ ID NO: 834784 - RNA, 22 nt, Human
ucuucucuacaccagcagcccc

SEQ ID NO: 834785 - RNA, 22 nt, Human
aggugccagugcuguggucccc

SEQ ID NO: 834786 - RNA, 22 nt, Human
agcagggggaguuagacuagau

SEQ ID NO: 834787 - RNA, 22 nt, Human
aggaaaaauaaggcagcagggc

SEQ ID NO: 834788 - RNA, 23 nt, Human
cugucuccugggcuagguggaau

SEQ ID NO: 834789 - RNA, 22 nt, Human
uuuccaaaguugccauaagcuu

SEQ ID NO: 834790 - RNA, 22 nt, Human
auaacuuucuucacccuugcug

SEQ ID NO: 834791 - RNA, 22 nt, Human
gcugccucaggcaccuccuggc

SEQ ID NO: 834792 - RNA, 22 nt, Human
acuuugaaacuaaaauucauua

SEQ ID NO: 834793 - RNA, 17 nt, Human
cuggagccaagagggcc

SEQ ID NO: 834794 - RNA, 22 nt, Human
ccagggcaaaugagaucauagc

SEQ ID NO: 834795 - RNA, 22 nt, Human
aggcaguguauugcuagcggcu

SEQ ID NO: 834796 - RNA, 22 nt, Human
ccuggagauuucuucaagcuuu

SEQ ID NO: 834797 - RNA, 21 nt, Human
agaaaaguagaguuuucagag

SEQ ID NO: 834798 - RNA, 22 nt, Human
uugcuuugccaccagaagucua

SEQ ID NO: 834799 - RNA, 22 nt, Human
ccuggcagacugugagggcagg

SEQ ID NO: 834800 - RNA, 22 nt, Human
aucuggcucauucagggaacgg

SEQ ID NO: 834801 - RNA, 22 nt, Human
agcugggucuugggccaggaga

SEQ ID NO: 834802 - RNA, 22 nt, Human
ucuggagauaagacagacagau

SEQ ID NO: 834803 - RNA, 22 nt, Human
gguggccucgguggugcacagg

SEQ ID NO: 834804 - RNA, 22 nt, Human
ggccugccucacagucagcacc

SEQ ID NO: 834805 - RNA, 22 nt, Human
aaaucagucccucuuggaauuu

SEQ ID NO: 834806 - RNA, 22 nt, Human
agaucaguuagauagcuugaug

SEQ ID NO: 834807 - RNA, 22 nt, Human
agaauccuguuuuacuucauca

SEQ ID NO: 834808 - RNA, 22 nt, Human
ggggagaguccuuuccaguucc

SEQ ID NO: 834809 - RNA, 22 nt, Human
auguuuuauauuuugcagcagu

SEQ ID NO: 834810 - RNA, 22 nt, Human
ccugggagugugccaucucugu

SEQ ID NO: 834811 - RNA, 22 nt, Human
gcccucuggcagccuuggcugg

SEQ ID NO: 834812 - RNA, 22 nt, Human
cucuggagcauuucaccuacau

SEQ ID NO: 834813 - RNA, 22 nt, Human
ggucccaggauugguugcgcag

SEQ ID NO: 834814 - RNA, 22 nt, Human
ugaauaguccuuggaauaacug

SEQ ID NO: 834815 - RNA, 22 nt, Human
ucagaacauugacauucuuauu

SEQ ID NO: 834816 - RNA, 22 nt, Human
ugcagauucaaaugaaaugcaa

SEQ ID NO: 834817 - RNA, 22 nt, Human
cauaauuucccaagagauugaa

SEQ ID NO: 834818 - RNA, 22 nt, Human
agggauggaagcucgucugcaa

SEQ ID NO: 834819 - RNA, 22 nt, Human
agaggacaaaaugagaagugcu

SEQ ID NO: 834820 - RNA, 22 nt, Human
gugucauuaaccaccaugcaaa

SEQ ID NO: 834821 - RNA, 20 nt, Human
ccucaggaugagggugagca

SEQ ID NO: 834822 - RNA, 22 nt, Human
caauaguucgguccugaaggcc

SEQ ID NO: 834823 - RNA, 22 nt, Human
aacucaguguguuucuuaguau

SEQ ID NO: 834824 - RNA, 22 nt, Human
aaagacuuggcuuaugauuugc

SEQ ID NO: 834825 - RNA, 22 nt, Human
aauaauaagauacuaagggagu

SEQ ID NO: 834826 - RNA, 22 nt, Human
ucccugggcuucuccagacuug

SEQ ID NO: 834827 - RNA, 22 nt, Human
auaucagaaauaguaagcagag

SEQ ID NO: 834828 - RNA, 22 nt, Human
cauuucaauacaguuuguaaau

SEQ ID NO: 834829 - RNA, 22 nt, Human
uuauuauagauuaugcaagauu

SEQ ID NO: 834830 - RNA, 22 nt, Human
ugggcagagaguagaggcaacg

SEQ ID NO: 834831 - RNA, 22 nt, Human
cugggccuagcaacagaggagu

SEQ ID NO: 834832 - RNA, 22 nt, Human
uagaaacagauguuuuugaaga

SEQ ID NO: 834833 - RNA, 22 nt, Human
auggauaauggugauaguugca

SEQ ID NO: 834834 - RNA, 22 nt, Human
auggcauuccaagucuucuuuu

SEQ ID NO: 834835 - RNA, 22 nt, Human
uccaggagggggagccgugccg

SEQ ID NO: 834836 - RNA, 22 nt, Human
caggaccccauauucacugaac

SEQ ID NO: 834837 - RNA, 22 nt, Human
ccugggagggcaagugcugaug

SEQ ID NO: 834838 - RNA, 22 nt, Human
uuaagucacuuaucuaaagaca

SEQ ID NO: 834839 - RNA, 23 nt, Human
ugccagaggcagucacaguggug

SEQ ID NO: 834840 - RNA, 22 nt, Human
caagaugugccuaaucagaccu

SEQ ID NO: 834841 - RNA, 22 nt, Human
guuccaggcaagugggauagga

SEQ ID NO: 834842 - RNA, 22 nt, Human
aaguccaucucugccccacaca

SEQ ID NO: 834843 - RNA, 22 nt, Human
aauauaauuuuauuccuagagu

SEQ ID NO: 834844 - RNA, 22 nt, Human
ugaagguggcauaggagagaug

SEQ ID NO: 834845 - RNA, 22 nt, Human
auacaaagacaaaucucaaucu

SEQ ID NO: 834846 - RNA, 22 nt, Human
ggcaugggccgaggugccuccu

SEQ ID NO: 834847 - RNA, 22 nt, Human
gaugcacuugccccuccucaga

SEQ ID NO: 834848 - RNA, 22 nt, Human
agucucagaaaagaagcaugga

SEQ ID NO: 834849 - RNA, 22 nt, Human
gcagcaugagcuauacaaagua

SEQ ID NO: 834850 - RNA, 23 nt, Human
uccaggagaaccccugucugucc

SEQ ID NO: 834851 - RNA, 22 nt, Human
cacagcuuaugccacugauugg

SEQ ID NO: 834852 - RNA, 16 nt, Human
gagggcagaggcggaa

SEQ ID NO: 834853 - RNA, 22 nt, Human
ggcucugggucuguggggagcg

SEQ ID NO: 834854 - RNA, 22 nt, Human
cugagaggcacaaggcauuucg

SEQ ID NO: 834855 - RNA, 22 nt, Human
ggagacagugacuuagagacug

SEQ ID NO: 834856 - RNA, 23 nt, Human
ugggccuggccucccaguccagc

SEQ ID NO: 834857 - RNA, 22 nt, Human
cuacagaaaaucagccacaggc

SEQ ID NO: 834858 - RNA, 22 nt, Human
cagccugcauuuguaucuguau

SEQ ID NO: 834859 - RNA, 22 nt, Human
agguggagacccagagaaggcg

SEQ ID NO: 834860 - RNA, 22 nt, Human
guggcagcugguaugcagacag

SEQ ID NO: 834861 - RNA, 22 nt, Human
cuaaaugccuuuccuaccuaac

SEQ ID NO: 834862 - RNA, 22 nt, Human
gccuggaguucagccaaguccc

SEQ ID NO: 834863 - RNA, 23 nt, Human
uuacaguaggaguuggaaaacca

SEQ ID NO: 834864 - RNA, 22 nt, Human
ugauuuccaguugcugggugcu

SEQ ID NO: 834865 - RNA, 22 nt, Human
uaggagagcugaacuauugucu

SEQ ID NO: 834866 - RNA, 22 nt, Human
agaggccaguggcugugcuguc

SEQ ID NO: 834867 - RNA, 22 nt, Human
uaaauguauaggcacuaaaccu

SEQ ID NO: 834868 - RNA, 22 nt, Human
aaggccuggauuuagguuguga

SEQ ID NO: 834869 - RNA, 22 nt, Human
cucccuggaggugagcuggcac

SEQ ID NO: 834870 - RNA, 22 nt, Human
gccugaugagcuuccagcugag

SEQ ID NO: 834871 - RNA, 22 nt, Human
augaagcugguuuuggcuuggg

SEQ ID NO: 834872 - RNA, 22 nt, Human
ggagcuggucagccuugagcau

SEQ ID NO: 834873 - RNA, 22 nt, Human
uguaugaagguuuaccugcugu

SEQ ID NO: 834874 - RNA, 22 nt, Human
gcucugcuggagggaaagagaa

SEQ ID NO: 834875 - RNA, 22 nt, Human
aggcaguguguagcuggaagag

SEQ ID NO: 834876 - RNA, 21 nt, Human
gcagccagccgagaccaugcc

SEQ ID NO: 834877 - RNA, 22 nt, Human
ucgagcucuggagccaaggaug

SEQ ID NO: 834878 - RNA, 22 nt, Human
agauuucaauggauauugcaag

SEQ ID NO: 834879 - RNA, 22 nt, Human
aagcagagcaagcguauuuauu

SEQ ID NO: 834880 - RNA, 21 nt, Human
uccaaaaaggagcguccuucu

SEQ ID NO: 834881 - RNA, 22 nt, Human
uggcagcuaucuuuaaugagau

SEQ ID NO: 834882 - RNA, 18 nt, Human
gaggcagcuagcaauuuu

SEQ ID NO: 834883 - RNA, 23 nt, Human
uccugagaugagacagugcugcc

SEQ ID NO: 834884 - RNA, 22 nt, Human
uauuuccagcaguaagaagaca

SEQ ID NO: 834885 - RNA, 22 nt, Human
ggugaaggcacaagagggcaag

SEQ ID NO: 834886 - RNA, 18 nt, Human
cauuaugugguuauagaa

SEQ ID NO: 834887 - RNA, 18 nt, Human
cucugcuaaugggcagcu

SEQ ID NO: 834888 - RNA, 22 nt, Human
uuguauuucuccacuuucuguu

SEQ ID NO: 834889 - RNA, 22 nt, Human
gagacaaaaguuggagugcaag

SEQ ID NO: 834890 - RNA, 22 nt, Human
agucccagcucagaaccacuag

SEQ ID NO: 834891 - RNA, 22 nt, Human
ugccaggcgugguggugcgcac

SEQ ID NO: 834892 - RNA, 22 nt, Human
uggcucagcagguuagaaacua

SEQ ID NO: 834893 - RNA, 20 nt, Human
aggcagagcgcacuuuuaga

SEQ ID NO: 834894 - RNA, 22 nt, Human
cuuuacauccuguuucccguuu

SEQ ID NO: 834895 - RNA, 22 nt, Human
gaaacuguauguaguuuuuggg

SEQ ID NO: 834896 - RNA, 22 nt, Human
ucacaugcuugaggaaagaaaa

SEQ ID NO: 834897 - RNA, 22 nt, Human
gcuggagccauuggcuuggccu

SEQ ID NO: 834898 - RNA, 19 nt, Human
ugggccugcaucugggucu

SEQ ID NO: 834899 - RNA, 22 nt, Human
uuucaauguaugucuuucugag

SEQ ID NO: 834900 - RNA, 22 nt, Human
caggcagagugagguggucuaa

SEQ ID NO: 834901 - RNA, 22 nt, Human
gagagcuguguucauucuacca

SEQ ID NO: 834902 - RNA, 22 nt, Human
guggcuugaccaucccugcuac

SEQ ID NO: 834903 - RNA, 22 nt, Human
agcugggagcagagccacagcc

SEQ ID NO: 834904 - RNA, 22 nt, Human
cucaggaugcaggucacaggac

SEQ ID NO: 834905 - RNA, 22 nt, Human
cuggguggcgucuggggccagu

SEQ ID NO: 834906 - RNA, 22 nt, Human
gugcagcagggggaagacagug

SEQ ID NO: 834907 - RNA, 22 nt, Human
cuguggaaaauuuguauguaau

SEQ ID NO: 834908 - RNA, 22 nt, Human
cugccugcuucugagccagagg

SEQ ID NO: 834909 - RNA, 22 nt, Human
aacauuuaugauugagguaaau

SEQ ID NO: 834910 - RNA, 22 nt, Human
aaugcacagcguuccaugcuug

SEQ ID NO: 834911 - RNA, 22 nt, Human
aaaggcuccuucucccaugacc

SEQ ID NO: 834912 - RNA, 22 nt, Human
uaacacacugaaggugagaugg

SEQ ID NO: 834913 - RNA, 22 nt, Human
caguuucuuaucuucaaaauug

SEQ ID NO: 834914 - RNA, 22 nt, Human
guccaugauucuguguaguaga

SEQ ID NO: 834915 - RNA, 22 nt, Human
ggcagauggaagaggcuggguc

SEQ ID NO: 834916 - RNA, 22 nt, Human
uuuccuaugauauucuaugugu

SEQ ID NO: 834917 - RNA, 22 nt, Human
cugcuguguaucauuuuagaug

SEQ ID NO: 834918 - RNA, 22 nt, Human
uucuuuuccuacacagcgauuu

SEQ ID NO: 834919 - RNA, 22 nt, Human
ugucccucauugacgcugugcc

SEQ ID NO: 834920 - RNA, 22 nt, Human
cacagguguucuugcagugaaa

SEQ ID NO: 834921 - RNA, 19 nt, Human
cuggcucuuggguggagga

SEQ ID NO: 834922 - RNA, 22 nt, Human
uguggcugucuguucuccuagg

SEQ ID NO: 834923 - RNA, 22 nt, Human
uguaggauuuucaccagaccuu

SEQ ID NO: 834924 - RNA, 22 nt, Human
uggcucuguugagguauggauu

SEQ ID NO: 834925 - RNA, 22 nt, Human
gaggggcucuugggcaugaagg

SEQ ID NO: 834926 - RNA, 22 nt, Human
gcaaggcugugcacuuugcauu

SEQ ID NO: 834927 - RNA, 22 nt, Human
ucuggcuccuggcuccacugcc

SEQ ID NO: 834928 - RNA, 22 nt, Human
gcagcugauggaaguccuauug

SEQ ID NO: 834929 - RNA, 22 nt, Human
uucugugaaucuuuuuucccac

SEQ ID NO: 834930 - RNA, 22 nt, Human
cagaaguaagauuacugugaga

SEQ ID NO: 834931 - RNA, 22 nt, Human
cugccaggacugacgucuucag

SEQ ID NO: 834932 - RNA, 22 nt, Human
ucagaauucagagggagugggg

SEQ ID NO: 834933 - RNA, 22 nt, Human
gugcauauaugcacauaugugu

SEQ ID NO: 834934 - RNA, 22 nt, Human
ugcagugguguccagguguacu

SEQ ID NO: 834935 - RNA, 22 nt, Human
agucucuuuguggacucugccu

SEQ ID NO: 834936 - RNA, 22 nt, Human
gcugucucauacaaggcccugc

SEQ ID NO: 834937 - RNA, 22 nt, Human
cagcaauaaugucuacaaaucu

SEQ ID NO: 834938 - RNA, 22 nt, Human
gagguggucgaggagggguacc

SEQ ID NO: 834939 - RNA, 22 nt, Human
gccuggaggggacagucucugg

SEQ ID NO: 834940 - RNA, 22 nt, Human
aagaauguggguggauaugaug

SEQ ID NO: 834941 - RNA, 22 nt, Human
gcuuuuauugucuuuacgacga

SEQ ID NO: 834942 - RNA, 21 nt, Human
gcucuuggaaggggcucagcu

SEQ ID NO: 834943 - RNA, 19 nt, Human
aaaauugcguauuuugagg

SEQ ID NO: 834944 - RNA, 22 nt, Human
ccugaggggcugcaggccagcu

SEQ ID NO: 834945 - RNA, 22 nt, Human
uucaaugagcccaagaacguga

SEQ ID NO: 834946 - RNA, 22 nt, Human
ucagugugaguaccaugcucag

SEQ ID NO: 834947 - RNA, 22 nt, Human
gggcuggcaucgguugcugaga

SEQ ID NO: 834948 - RNA, 22 nt, Human
cccagccuggugcacugugggg

SEQ ID NO: 834949 - RNA, 22 nt, Human
ggcacugaaccaggacacaagc

SEQ ID NO: 834950 - RNA, 22 nt, Human
gaagcagcaaaucugcaguauc

SEQ ID NO: 834951 - RNA, 22 nt, Human
guuauguauugggaaauccaag

SEQ ID NO: 834952 - RNA, 22 nt, Human
agaagcuuccuacauuguucuu

SEQ ID NO: 834953 - RNA, 22 nt, Human
uguggccaccagagcugcuauu

SEQ ID NO: 834954 - RNA, 19 nt, Human
uuacuuggcaaagucaguc

SEQ ID NO: 834955 - RNA, 22 nt, Human
aucuggcuuuuacugaauugcu

SEQ ID NO: 834956 - RNA, 22 nt, Human
ugcucugguccucccucggcgc

SEQ ID NO: 834957 - RNA, 22 nt, Human
cugaaagaauaagauguuuaca

SEQ ID NO: 834958 - RNA, 22 nt, Human
gccugccuuugugaggaagcgg

SEQ ID NO: 834959 - RNA, 22 nt, Human
ccugucugcggaggaguggaag

SEQ ID NO: 834960 - RNA, 22 nt, Human
aacaugcuuugauaaauaaaag

SEQ ID NO: 834961 - RNA, 22 nt, Human
caucagaauguuauggggggcu

SEQ ID NO: 834962 - RNA, 22 nt, Human
guuuuaguggguggccacugau

SEQ ID NO: 834963 - RNA, 22 nt, Human
cagcaguggaacuacccaggga

SEQ ID NO: 834964 - RNA, 22 nt, Human
uuggaaaaacacgauagugguu

SEQ ID NO: 834965 - RNA, 22 nt, Human
agaguggggaagguguugagaa

SEQ ID NO: 834966 - RNA, 19 nt, Human
gagcacagcggcauuuggu

SEQ ID NO: 834967 - RNA, 22 nt, Human
aacagaauugcugcugccaaug

SEQ ID NO: 834968 - RNA, 22 nt, Human
cauuugaaauaguucauucuug

SEQ ID NO: 834969 - RNA, 22 nt, Human
cauguuuucuaggcuuucacaa

SEQ ID NO: 834970 - RNA, 20 nt, Human
aggcucagcugagcucuugg

SEQ ID NO: 834971 - RNA, 22 nt, Human
uggcagggccugaaucuuauac

SEQ ID NO: 834972 - RNA, 22 nt, Human
ugaggcaggaguucaggcugcg

SEQ ID NO: 834973 - RNA, 22 nt, Human
uucauuccuucccuaagcaacu

SEQ ID NO: 834974 - RNA, 22 nt, Human
aagaaaucauaucauuucuugg

SEQ ID NO: 834975 - RNA, 22 nt, Human
cccugagagugagugccaccuu

SEQ ID NO: 834976 - RNA, 22 nt, Human
acagcauucaauaaauaauaac

SEQ ID NO: 834977 - RNA, 22 nt, Human
ccugcccuagagaugacacaau

SEQ ID NO: 834978 - RNA, 22 nt, Human
uggcagcuguguccagguagaa

SEQ ID NO: 834979 - RNA, 22 nt, Human
cugccuuccaaccccagacucc

SEQ ID NO: 834980 - RNA, 22 nt, Human
ugaaaugacagucuuaagcucu

SEQ ID NO: 834981 - RNA, 23 nt, Human
cauggcagcaagagcucauggcc

SEQ ID NO: 834982 - RNA, 22 nt, Human
agaaguuaccacauacuucucu

SEQ ID NO: 834983 - RNA, 22 nt, Human
ggagcugggaauuggaucaucu

SEQ ID NO: 834984 - RNA, 22 nt, Human
cccagacugcagagcgggcaga

SEQ ID NO: 834985 - RNA, 17 nt, Human
aaucagauuucugagga

SEQ ID NO: 834986 - RNA, 22 nt, Human
acaauuccacauggcaugcagg

SEQ ID NO: 834987 - RNA, 22 nt, Human
aaagcccauguggaaguacagg

SEQ ID NO: 834988 - RNA, 22 nt, Human
gauggcuucacuuacauggcug

SEQ ID NO: 834989 - RNA, 22 nt, Human
aacaaaugaccugauuucuucc

SEQ ID NO: 834990 - RNA, 22 nt, Human
cagagccaggucuaggagucuc

SEQ ID NO: 834991 - RNA, 21 nt, Human
uggccucccacacuuccaugg

SEQ ID NO: 834992 - RNA, 22 nt, Human
gaagaaucugaggacagucauu

SEQ ID NO: 834993 - RNA, 22 nt, Human
caaaagauacuugcaucuaacu

SEQ ID NO: 834994 - RNA, 22 nt, Human
cccaggaguaagugacauuguu

SEQ ID NO: 834995 - RNA, 22 nt, Human
aaggcaggaugggaaaagauuu

SEQ ID NO: 834996 - RNA, 22 nt, Human
aaggcagccgugugacugcaug

SEQ ID NO: 834997 - RNA, 22 nt, Human
gaagaauccaugcuaauuuacc

SEQ ID NO: 834998 - RNA, 22 nt, Human
agccacagucugaugccugaga

SEQ ID NO: 834999 - RNA, 22 nt, Human
ccccagccuuccaugggaauug

SEQ ID NO: 835000 - RNA, 22 nt, Human
cuucagaacuauaaaaaguacu

SEQ ID NO: 835001 - RNA, 22 nt, Human
caguauguacucuuaucaugua

SEQ ID NO: 835002 - RNA, 20 nt, Human
agucccuuuggucagguauu

SEQ ID NO: 835003 - RNA, 22 nt, Human
gggugggacugaagucugaggg

SEQ ID NO: 835004 - RNA, 20 nt, Human
gaagcagcuucauguagaca

SEQ ID NO: 835005 - RNA, 22 nt, Human
cucuugggagugcucuggagaa

SEQ ID NO: 835006 - RNA, 22 nt, Human
acuucacagaaauuuuaugagg

SEQ ID NO: 835007 - RNA, 22 nt, Human
gcucucuggguggugggcaaca

SEQ ID NO: 835008 - RNA, 22 nt, Human
uccaggaggcagggcugugccc

SEQ ID NO: 835009 - RNA, 22 nt, Human
cccaggaggcagagguuggagc

SEQ ID NO: 835010 - RNA, 22 nt, Human
gaaggagacccugaagaugcug

SEQ ID NO: 835011 - RNA, 22 nt, Human
acuguucauauucuuagaaauu

SEQ ID NO: 835012 - RNA, 22 nt, Human
ggaggcgauccugggaaacacc

SEQ ID NO: 835013 - RNA, 22 nt, Human
cggagggguuugaacagaggag

SEQ ID NO: 835014 - RNA, 22 nt, Human
uggcagaguucgcugugccuuu

SEQ ID NO: 835015 - RNA, 22 nt, Human
ucaagagaagugcuccacagua

SEQ ID NO: 835016 - RNA, 22 nt, Human
uccucaggaucuaggagugcuu

SEQ ID NO: 835017 - RNA, 22 nt, Human
gcuggauccacaaauaacuuug

SEQ ID NO: 835018 - RNA, 22 nt, Human
aagucauuaucucuucuaaucu

SEQ ID NO: 835019 - RNA, 22 nt, Human
agauuuccaucuuuuucaugug

SEQ ID NO: 835020 - RNA, 22 nt, Human
augcagcaguuuacaaagcaau

SEQ ID NO: 835021 - RNA, 22 nt, Human
ggucucuguugccuccaucaag

SEQ ID NO: 835022 - RNA, 22 nt, Human
ccacagcaugcaggccugacac

SEQ ID NO: 835023 - RNA, 22 nt, Human
ugucucugugagaucugacgau

SEQ ID NO: 835024 - RNA, 22 nt, Human
ccagguaggagagagggauccu

SEQ ID NO: 835025 - RNA, 22 nt, Human
ccuggccugugaaucugagagc

SEQ ID NO: 835026 - RNA, 20 nt, Human
gcugucuggauuagaagccu

SEQ ID NO: 835027 - RNA, 22 nt, Human
auugaaagauaggcuacugugg

SEQ ID NO: 835028 - RNA, 22 nt, Human
ugggaggcagguaggugaugau

SEQ ID NO: 835029 - RNA, 22 nt, Human
cuggagccggaccagggacggu

SEQ ID NO: 835030 - RNA, 22 nt, Human
aaagccuucaaguagauguaag

SEQ ID NO: 835031 - RNA, 22 nt, Human
uggcuguguuaccacuucaugu

SEQ ID NO: 835032 - RNA, 22 nt, Human
ugggccugggucuuugcugcca

SEQ ID NO: 835033 - RNA, 22 nt, Human
aaguucaaguguaaucuuuauu

SEQ ID NO: 835034 - RNA, 22 nt, Human
cgaugguucuggcugcuuguau

SEQ ID NO: 835035 - RNA, 22 nt, Human
cacugcauggaugauggcugua

SEQ ID NO: 835036 - RNA, 22 nt, Human
ccagcccucacugaggccucuc

SEQ ID NO: 835037 - RNA, 22 nt, Human
ugcugcuccccagcacacagca

SEQ ID NO: 835038 - RNA, 22 nt, Human
ggagucccagcaaagccuuccc

SEQ ID NO: 835039 - RNA, 22 nt, Human
aguuuauguagaauuggcaaua

SEQ ID NO: 835040 - RNA, 22 nt, Human
agaucucaccucuguguauuau

SEQ ID NO: 835041 - RNA, 22 nt, Human
acuguguccuauuuccuugaca

SEQ ID NO: 835042 - RNA, 23 nt, Human
cugcccugaucuugaucuauugu

SEQ ID NO: 835043 - RNA, 22 nt, Human
caauuucaucuugugcuucaau

SEQ ID NO: 835044 - RNA, 22 nt, Human
uguauauucugccuaaaagcuu

SEQ ID NO: 835045 - RNA, 22 nt, Human
ggcugccuacuuucccagaguu

SEQ ID NO: 835046 - RNA, 22 nt, Human
cuuguggcccauggcuuccugc

SEQ ID NO: 835047 - RNA, 22 nt, Human
aaagcagguugcaauuacagug

SEQ ID NO: 835048 - RNA, 22 nt, Human
cugcaggcccccuuccuggagu

SEQ ID NO: 835049 - RNA, 22 nt, Human
uacauagcaaggaaaugacaga

SEQ ID NO: 835050 - RNA, 22 nt, Human
uuagaaauacaagugagguuga

SEQ ID NO: 835051 - RNA, 19 nt, Human
gcugugugaccuugggcaa

SEQ ID NO: 835052 - RNA, 22 nt, Human
uggcugggugcuauccaguacu

SEQ ID NO: 835053 - RNA, 22 nt, Human
aaaaggcauggagguugauagu

SEQ ID NO: 835054 - RNA, 22 nt, Human
uggcagggaguugcaggauuuc

SEQ ID NO: 835055 - RNA, 22 nt, Human
acuuuuuacaggguguauacca

SEQ ID NO: 835056 - RNA, 22 nt, Human
cagagacagaaaauggaucuag

SEQ ID NO: 835057 - RNA, 22 nt, Human
agacaggacacaagcugcauaa

SEQ ID NO: 835058 - RNA, 21 nt, Human
uaugaacaugaccaauagucc

SEQ ID NO: 835059 - RNA, 22 nt, Human
agaagccauucccuguaggcuc

SEQ ID NO: 835060 - RNA, 22 nt, Human
ggccuggaaugcuuuccuacca

SEQ ID NO: 835061 - RNA, 22 nt, Human
ucuucagacccuuagcugugau

SEQ ID NO: 835062 - RNA, 19 nt, Human
uucacauuggaagaaguag

SEQ ID NO: 835063 - RNA, 22 nt, Human
gacucguucauaguuccaauuu

SEQ ID NO: 835064 - RNA, 22 nt, Human
gcucaggacccaggugugaccu

SEQ ID NO: 835065 - RNA, 22 nt, Human
aggaaaaaccuguuaaugguag

SEQ ID NO: 835066 - RNA, 18 nt, Human
cugcugugucgucugggc

SEQ ID NO: 835067 - RNA, 22 nt, Human
uaaagcaggccacauaugugau

SEQ ID NO: 835068 - RNA, 22 nt, Human
cuccagggagcuuggaaagacc

SEQ ID NO: 835069 - RNA, 22 nt, Human
ugccucagagugggcuugcuau

SEQ ID NO: 835070 - RNA, 22 nt, Human
uagucaccuuuggcaccugcaa

SEQ ID NO: 835071 - RNA, 22 nt, Human
ucugccuuccccauaaucugau

SEQ ID NO: 835072 - RNA, 22 nt, Human
ggagggacccacucuagaggug

SEQ ID NO: 835073 - RNA, 22 nt, Human
uuuaacagaugcuaugucuacc

SEQ ID NO: 835074 - RNA, 22 nt, Human
gagguagcaugcuggaagggac

SEQ ID NO: 835075 - RNA, 22 nt, Human
aggcccugcuuuccagagcuca

SEQ ID NO: 835076 - RNA, 22 nt, Human
gccugagcaggcguggaccaug

SEQ ID NO: 835077 - RNA, 22 nt, Human
cagggcagccaggccccguggg

SEQ ID NO: 835078 - RNA, 22 nt, Human
uaaaugcaagugcuccugggag

SEQ ID NO: 835079 - RNA, 22 nt, Human
agcagggccucuggcacugguc

SEQ ID NO: 835080 - RNA, 22 nt, Human
ccaggcucugucuggucagaag

SEQ ID NO: 835081 - RNA, 22 nt, Human
uuucucugaggcuggccucccu

SEQ ID NO: 835082 - RNA, 22 nt, Human
agccuggccacucagggccuga

SEQ ID NO: 835083 - RNA, 22 nt, Human
caggucagaggcgcagccccca

SEQ ID NO: 835084 - RNA, 22 nt, Human
uaguauuuaaucacuuuugucu

SEQ ID NO: 835085 - RNA, 23 nt, Human
ccugugugcccuuaauucacagc

SEQ ID NO: 835086 - RNA, 22 nt, Human
cuccugagcucugaggaagcuu

SEQ ID NO: 835087 - RNA, 22 nt, Human
cuggcccagagagcagagcuua

SEQ ID NO: 835088 - RNA, 22 nt, Human
uuuccaaacccagcgagcuaca

SEQ ID NO: 835089 - RNA, 22 nt, Human
auccaggguguggagagagcuc

SEQ ID NO: 835090 - RNA, 22 nt, Human
aaaguguagagacuuuggaacc

SEQ ID NO: 835091 - RNA, 22 nt, Human
uuuccaaaaguuuguucugugc

SEQ ID NO: 835092 - RNA, 23 nt, Human
cagcccuuccugcauguuuuugu

SEQ ID NO: 835093 - RNA, 22 nt, Human
caggaugggauguagugggccc

SEQ ID NO: 835094 - RNA, 23 nt, Human
uauuacaauuggucuuauuaaga

SEQ ID NO: 835095 - RNA, 22 nt, Human
gcaucuaaacuugcaucauugu

SEQ ID NO: 835096 - RNA, 22 nt, Human
uggaggugagugugguacagca

SEQ ID NO: 835097 - RNA, 22 nt, Human
gugccugggcaugagcuuguug

SEQ ID NO: 835098 - RNA, 22 nt, Human
gcugagagcaaagcaugucuag

SEQ ID NO: 835099 - RNA, 22 nt, Human
gugggccucuugaggguggcua

SEQ ID NO: 835100 - RNA, 22 nt, Human
uuaaaguucauuaaaugagcca

SEQ ID NO: 835101 - RNA, 22 nt, Human
cugguucauccccuuccaggaa

SEQ ID NO: 835102 - RNA, 18 nt, Human
cagagcagagguggagcg

SEQ ID NO: 835103 - RNA, 22 nt, Human
acugugcaaugaguaauaaacu

SEQ ID NO: 835104 - RNA, 22 nt, Human
ccagggcaggagaaagacucac

SEQ ID NO: 835105 - RNA, 22 nt, Human
cccagcccugaccuauuggaaa

SEQ ID NO: 835106 - RNA, 22 nt, Human
guccucugggagccuugagccu

SEQ ID NO: 835107 - RNA, 22 nt, Human
auggcucauuuaucuugcagcc

SEQ ID NO: 835108 - RNA, 22 nt, Human
uaggaaaugcuccauugcauaa

SEQ ID NO: 835109 - RNA, 19 nt, Human
ucugucacuggggguauuc

SEQ ID NO: 835110 - RNA, 22 nt, Human
augguuuaagggagaauauuga

SEQ ID NO: 835111 - RNA, 22 nt, Human
cugcagaggguuugagcauccu

SEQ ID NO: 835112 - RNA, 22 nt, Human
aaaauuauagaucuagugccug

SEQ ID NO: 835113 - RNA, 22 nt, Human
uguucuugagccuuuagaccua

SEQ ID NO: 835114 - RNA, 22 nt, Human
cuacagaaacacuggacaugug

SEQ ID NO: 835115 - RNA, 22 nt, Human
ccauuuguucgcccagcuccaa

SEQ ID NO: 835116 - RNA, 22 nt, Human
gcugugugcucacguaguggaa

SEQ ID NO: 835117 - RNA, 22 nt, Human
uucagugucaauuuuuaaauau

SEQ ID NO: 835118 - RNA, 22 nt, Human
cagcaagauuuuuaaagcaagg

SEQ ID NO: 835119 - RNA, 22 nt, Human
agggugcauguuugcaagagug

SEQ ID NO: 835120 - RNA, 22 nt, Human
gccccagguugccugucccagg

SEQ ID NO: 835121 - RNA, 20 nt, Human
agaaaaaguguggaaauuuc

SEQ ID NO: 835122 - RNA, 22 nt, Human
cucugucaggcugcagaugcuc

SEQ ID NO: 835123 - RNA, 21 nt, Human
aaagagguuaauauuguaagu

SEQ ID NO: 835124 - RNA, 22 nt, Human
gggcagcucuuugguauccuuc

SEQ ID NO: 835125 - RNA, 22 nt, Human
uguacaaugccgagacuaacuc

SEQ ID NO: 835126 - RNA, 22 nt, Human
cugggaggugaacagaaaaacu

SEQ ID NO: 835127 - RNA, 22 nt, Human
uagaauucaagauucaacaggc

SEQ ID NO: 835128 - RNA, 22 nt, Human
ucacagaagagauauugacaga

SEQ ID NO: 835129 - RNA, 22 nt, Human
cagcugccugucuggaggcaau

SEQ ID NO: 835130 - RNA, 18 nt, Human
aggcagacacuagagguc

SEQ ID NO: 835131 - RNA, 23 nt, Human
agcacagacuagaaaggucuuuc

SEQ ID NO: 835132 - RNA, 22 nt, Human
uguccuuacaaggucccuuucg

SEQ ID NO: 835133 - RNA, 22 nt, Human
cccaggaaaguggaggcggcug

SEQ ID NO: 835134 - RNA, 22 nt, Human
uguuuucagucauauagcaggu

SEQ ID NO: 835135 - RNA, 22 nt, Human
uuagacauguuugcuaaaauga

SEQ ID NO: 835136 - RNA, 22 nt, Human
auauuccauugguuucccuucu

SEQ ID NO: 835137 - RNA, 22 nt, Human
ucaguuuucaauuucaucagag

SEQ ID NO: 835138 - RNA, 22 nt, Human
gagcugccagacaugggaauga

SEQ ID NO: 835139 - RNA, 22 nt, Human
agggcagagcugucuaaauggc

SEQ ID NO: 835140 - RNA, 22 nt, Human
agcccuccucacaucagcgucc

SEQ ID NO: 835141 - RNA, 22 nt, Human
cuggcagcuuagcacucugguu

SEQ ID NO: 835142 - RNA, 22 nt, Human
uuccucagcuggccugauuggg

SEQ ID NO: 835143 - RNA, 22 nt, Human
gcgcaggagccgcggagggccg

SEQ ID NO: 835144 - RNA, 22 nt, Human
acccaggacaaaauaaccaggu

SEQ ID NO: 835145 - RNA, 22 nt, Human
ccuguucaaguugcagggcugg

SEQ ID NO: 835146 - RNA, 22 nt, Human
aaagccuugcccgucacuggga

SEQ ID NO: 835147 - RNA, 22 nt, Human
uccuggagaauccugccaccug

SEQ ID NO: 835148 - RNA, 22 nt, Human
ugcugggggcuuucuggauacc

SEQ ID NO: 835149 - RNA, 22 nt, Human
agaaaguucacugguauauuuu

SEQ ID NO: 835150 - RNA, 22 nt, Human
agggccucugacgcccccagcc

SEQ ID NO: 835151 - RNA, 22 nt, Human
uguacauagaucuugaaaauua

SEQ ID NO: 835152 - RNA, 22 nt, Human
ucuguucaagacugaggugaca

SEQ ID NO: 835153 - RNA, 22 nt, Human
auugaaagguuuugagcagaua

SEQ ID NO: 835154 - RNA, 22 nt, Human
ugcugccagagagacagggacu

SEQ ID NO: 835155 - RNA, 22 nt, Human
gcugugcagucuuuggugugcc

SEQ ID NO: 835156 - RNA, 22 nt, Human
ugaaagguuaaaaguaguauug

SEQ ID NO: 835157 - RNA, 20 nt, Human
aggaaaaauggaaacuggag

SEQ ID NO: 835158 - RNA, 22 nt, Human
ggccucugguucguggugaccu

SEQ ID NO: 835159 - RNA, 22 nt, Human
cagggccaguucucgcagcagu

SEQ ID NO: 835160 - RNA, 22 nt, Human
uggccuuggacagagcgcuccu

SEQ ID NO: 835161 - RNA, 22 nt, Human
gcugccuccugaaagcgcucug

SEQ ID NO: 835162 - RNA, 22 nt, Human
aucacaaaggcugcuucaugau

SEQ ID NO: 835163 - RNA, 22 nt, Human
gcagcuccuccugggcuggaga

SEQ ID NO: 835164 - RNA, 22 nt, Human
guaggcagugguuggaagagaa

SEQ ID NO: 835165 - RNA, 22 nt, Human
caggccucccggugcacacuga

SEQ ID NO: 835166 - RNA, 22 nt, Human
uacaacauuguguugcuucaua

SEQ ID NO: 835167 - RNA, 22 nt, Human
uggucaggcugcucugcggcgu

SEQ ID NO: 835168 - RNA, 22 nt, Human
agagcagugcugaagaguaggg

SEQ ID NO: 835169 - RNA, 22 nt, Human
uauuuccauguuagaacuaagu

SEQ ID NO: 835170 - RNA, 22 nt, Human
uugcacagaugagggugaugcu

SEQ ID NO: 835171 - RNA, 22 nt, Human
aggguggcuggaggaaucagaa

SEQ ID NO: 835172 - RNA, 22 nt, Human
cagucaccauagaauaaaacau

SEQ ID NO: 835173 - RNA, 22 nt, Human
agaagccacuggagguugagau

SEQ ID NO: 835174 - RNA, 22 nt, Human
cauuuccacuucugaaaacugg

SEQ ID NO: 835175 - RNA, 22 nt, Human
aggagcugaaacuucucauaug

SEQ ID NO: 835176 - RNA, 18 nt, Human
uuccaugauuccuuucac

SEQ ID NO: 835177 - RNA, 22 nt, Human
cuagaauugcauucuaugaaua

SEQ ID NO: 835178 - RNA, 22 nt, Human
caguuaaaggcccaauaucugg

SEQ ID NO: 835179 - RNA, 22 nt, Human
uuuacagauguggaaagugagc

SEQ ID NO: 835180 - RNA, 22 nt, Human
cuucuaggcuucucagggggca

SEQ ID NO: 835181 - RNA, 22 nt, Human
agucugucuacuuaaagucugu

SEQ ID NO: 835182 - RNA, 22 nt, Human
aggggugugcauccuggaggau

SEQ ID NO: 835183 - RNA, 22 nt, Human
agccuggagaagauguguauug

SEQ ID NO: 835184 - RNA, 22 nt, Human
cagucaccaccagguggcagua

SEQ ID NO: 835185 - RNA, 22 nt, Human
ggaggccaucuggcuggaggcu

SEQ ID NO: 835186 - RNA, 22 nt, Human
ccugucuggaacauggccuguu

SEQ ID NO: 835187 - RNA, 19 nt, Human
ggcugccuuuccuuaccag

SEQ ID NO: 835188 - RNA, 22 nt, Human
agugcagccgagaucaggugcu

SEQ ID NO: 835189 - RNA, 22 nt, Human
gcaggggcugagcaccagcggg

SEQ ID NO: 835190 - RNA, 22 nt, Human
auaugaagaauuccaauuugga

SEQ ID NO: 835191 - RNA, 22 nt, Human
agagacaggguuuugccauguu

SEQ ID NO: 835192 - RNA, 22 nt, Human
uggcuuccgccgcgggccucgg

SEQ ID NO: 835193 - RNA, 22 nt, Human
cagagcuguccaaacccugaca

SEQ ID NO: 835194 - RNA, 22 nt, Human
ucccuggccauuccucuaggcc

SEQ ID NO: 835195 - RNA, 22 nt, Human
aggcagacaaggucccuggucu

SEQ ID NO: 835196 - RNA, 22 nt, Human
uggcagcucauuuggaaaugga

SEQ ID NO: 835197 - RNA, 18 nt, Human
ucagagguacagaaaagu

SEQ ID NO: 835198 - RNA, 22 nt, Human
uccuugaauggacauuacacug

SEQ ID NO: 835199 - RNA, 22 nt, Human
uggggcuggggaucuugagccu

SEQ ID NO: 835200 - RNA, 22 nt, Human
agucccagacuccaguuuucug

SEQ ID NO: 835201 - RNA, 22 nt, Human
ucuuagaaauuccccaguggcu

SEQ ID NO: 835202 - RNA, 22 nt, Human
aggcagcauccagaggagaaug

SEQ ID NO: 835203 - RNA, 22 nt, Human
cugccaaggcuggggaggacaa

SEQ ID NO: 835204 - RNA, 18 nt, Human
uguacaguuaugagcauu

SEQ ID NO: 835205 - RNA, 22 nt, Human
aggcagcuagagagugaaacug

SEQ ID NO: 835206 - RNA, 22 nt, Human
ggcaggagaaaggucucuucuu

SEQ ID NO: 835207 - RNA, 22 nt, Human
gcucugagagugggugauucug

SEQ ID NO: 835208 - RNA, 22 nt, Human
cugaggcuuugugugcaugccu

SEQ ID NO: 835209 - RNA, 22 nt, Human
cccaggaaugagcaggcagggg

SEQ ID NO: 835210 - RNA, 22 nt, Human
uauacaaugaguacauucuggg

SEQ ID NO: 835211 - RNA, 22 nt, Human
ucccaggcuaggccucugcguu

SEQ ID NO: 835212 - RNA, 20 nt, Human
uauuugaaauggccaagugu

SEQ ID NO: 835213 - RNA, 22 nt, Human
cccagccaaggugcugguguug

SEQ ID NO: 835214 - RNA, 22 nt, Human
ggaggggagauguuugggcuca

SEQ ID NO: 835215 - RNA, 22 nt, Human
ugggcacaggggaauggaugaa

SEQ ID NO: 835216 - RNA, 22 nt, Human
cagggcaguuugugccuaugag

SEQ ID NO: 835217 - RNA, 18 nt, Human
uccauuguucuacuguga

SEQ ID NO: 835218 - RNA, 22 nt, Human
auuucuuuucaagagggugcuu

SEQ ID NO: 835219 - RNA, 22 nt, Human
uaaguucaaugaacucaguucu

SEQ ID NO: 835220 - RNA, 22 nt, Human
uuacagaagaguaacuuggcaa

SEQ ID NO: 835221 - RNA, 22 nt, Human
uaaauucagugaguaauuucug

SEQ ID NO: 835222 - RNA, 22 nt, Human
uuaagauagaacccaguagucu

SEQ ID NO: 835223 - RNA, 17 nt, Human
ccugggaggaguuauga

SEQ ID NO: 835224 - RNA, 22 nt, Human
uauuucagggagaauaaauuug

SEQ ID NO: 835225 - RNA, 21 nt, Human
ugccagcauguaggcuaguug

SEQ ID NO: 835226 - RNA, 22 nt, Human
acaaaguuugugguauuccaag

SEQ ID NO: 835227 - RNA, 22 nt, Human
accaggcuggagugcaguggcg

SEQ ID NO: 835228 - RNA, 22 nt, Human
gggaaauugucaacacucucaa

SEQ ID NO: 835229 - RNA, 22 nt, Human
cucaggaugucggugacuauug

SEQ ID NO: 835230 - RNA, 22 nt, Human
aggccugggcaagaaggggcgu

SEQ ID NO: 835231 - RNA, 20 nt, Human
aauaaaagaagccuucaccc

SEQ ID NO: 835232 - RNA, 20 nt, Human
aggaggggauagaaucaaag

SEQ ID NO: 835233 - RNA, 22 nt, Human
caggcagcucgaugccuuguug

SEQ ID NO: 835234 - RNA, 22 nt, Human
gcucaggauuucauccaugugu

SEQ ID NO: 835235 - RNA, 20 nt, Human
gcugcucuccacggucugca

SEQ ID NO: 835236 - RNA, 22 nt, Human
uggccucugcaauggauucacc

SEQ ID NO: 835237 - RNA, 21 nt, Human
uucaaugaaaacaaagugagg

SEQ ID NO: 835238 - RNA, 23 nt, Human
augaaugaauaaggcaggaaagc

SEQ ID NO: 835239 - RNA, 18 nt, Human
cccucuccugcuaguggg

SEQ ID NO: 835240 - RNA, 22 nt, Human
aaaugaacucuuccugcauccc

SEQ ID NO: 835241 - RNA, 22 nt, Human
auaugaaaauguuuuagcugua

SEQ ID NO: 835242 - RNA, 22 nt, Human
uggcagaguuggagguggaaga

SEQ ID NO: 835243 - RNA, 22 nt, Human
uccuguaguugcuaaguuuguu

SEQ ID NO: 835244 - RNA, 22 nt, Human
aguccuuugggaaaaaugacua

SEQ ID NO: 835245 - RNA, 20 nt, Human
ggaagcagagaacuguuuuc

SEQ ID NO: 835246 - RNA, 21 nt, Human
uccuuccuugagguccuuucc

SEQ ID NO: 835247 - RNA, 22 nt, Human
ucaguguaaguuauguagaugu

SEQ ID NO: 835248 - RNA, 22 nt, Human
ucucagagcuucaguuauuuuc

SEQ ID NO: 835249 - RNA, 20 nt, Human
auucuacaagaauaagcaug

SEQ ID NO: 835250 - RNA, 22 nt, Human
cuuacauuuaaucaugugucau

SEQ ID NO: 835251 - RNA, 22 nt, Human
gagauuggccuggcuugccaac

SEQ ID NO: 835252 - RNA, 22 nt, Human
guggaggacaaaagaagccuuu

SEQ ID NO: 835253 - RNA, 22 nt, Human
uggagcaggacugcugcccuca

SEQ ID NO: 835254 - RNA, 23 nt, Human
ugacacauuuccuuuccacugca

SEQ ID NO: 835255 - RNA, 22 nt, Human
uucacaggcuuggagguggggg

SEQ ID NO: 835256 - RNA, 22 nt, Human
agccccuuccaguucucagauc

SEQ ID NO: 835257 - RNA, 22 nt, Human
cugggaguguucuaggucacau

SEQ ID NO: 835258 - RNA, 22 nt, Human
ucccuggaacagagagacaacg

SEQ ID NO: 835259 - RNA, 19 nt, Human
gcaugcuugguggcuucug

SEQ ID NO: 835260 - RNA, 22 nt, Human
caucagcagucacaugaugcug

SEQ ID NO: 835261 - RNA, 22 nt, Human
ugggcuguccagcaccugggcu

SEQ ID NO: 835262 - RNA, 22 nt, Human
uuccuuagugacuucuagcuac

SEQ ID NO: 835263 - RNA, 22 nt, Human
auucuuaauugccaugcuguau

SEQ ID NO: 835264 - RNA, 22 nt, Human
ggcagcaggcgacuucccuauu

SEQ ID NO: 835265 - RNA, 22 nt, Human
ugcccaggcuggaaugcagugg

SEQ ID NO: 835266 - RNA, 22 nt, Human
caauuucaugccauguauugcu

SEQ ID NO: 835267 - RNA, 19 nt, Human
agauggggaagagugugag

SEQ ID NO: 835268 - RNA, 22 nt, Human
uucugaaagccaauucauugaa

SEQ ID NO: 835269 - RNA, 22 nt, Human
acaguccuuguguggaacauua

SEQ ID NO: 835270 - RNA, 22 nt, Human
aagggcagcuuaaauugguagc

SEQ ID NO: 835271 - RNA, 22 nt, Human
gcagcugccccgacugugaguc

SEQ ID NO: 835272 - RNA, 20 nt, Human
ucugugcaccugcuacaagg

SEQ ID NO: 835273 - RNA, 20 nt, Human
gaugggaaucggagcuggua

SEQ ID NO: 835274 - RNA, 22 nt, Human
ggugcagugguguggcaaaggg

SEQ ID NO: 835275 - RNA, 22 nt, Human
uaugacuuauuucaucaguucu

SEQ ID NO: 835276 - RNA, 22 nt, Human
cccaggagguggaguucacagu

SEQ ID NO: 835277 - RNA, 22 nt, Human
ggcgcacaaugugcagguuugu

SEQ ID NO: 835278 - RNA, 22 nt, Human
auucuucauuuacuguuacuug

SEQ ID NO: 835279 - RNA, 22 nt, Human
cucuucuugucucugguuagaa

SEQ ID NO: 835280 - RNA, 17 nt, Human
uucaagauauugaaaug

SEQ ID NO: 835281 - RNA, 22 nt, Human
auugaaaauaaggccagaaaca

SEQ ID NO: 835282 - RNA, 22 nt, Human
uggcagcugaggggaggcuuug

SEQ ID NO: 835283 - RNA, 23 nt, Human
gagagcugacugucaagacuguu

SEQ ID NO: 835284 - RNA, 22 nt, Human
uucuaacaaguggcuuguuagu

SEQ ID NO: 835285 - RNA, 19 nt, Human
cauaauacaguggaucuga

SEQ ID NO: 835286 - RNA, 22 nt, Human
caugaagcauguuuugucauga

SEQ ID NO: 835287 - RNA, 22 nt, Human
uauuccaagcacagcaacccag

SEQ ID NO: 835288 - RNA, 22 nt, Human
ugucauuuucuaaucuguuguc

SEQ ID NO: 835289 - RNA, 22 nt, Human
auuauguaacugugguucagca

SEQ ID NO: 835290 - RNA, 22 nt, Human
gccacaggcacuuaagggcugg

SEQ ID NO: 835291 - RNA, 22 nt, Human
aucuggcuauugacauguuaua

SEQ ID NO: 835292 - RNA, 22 nt, Human
cagcuucugcuaucgaacaucu

SEQ ID NO: 835293 - RNA, 22 nt, Human
uacacacagaggccaugggauu

SEQ ID NO: 835294 - RNA, 22 nt, Human
accucugcaacccuggaauggg

SEQ ID NO: 835295 - RNA, 21 nt, Human
agaauaaugguaucauuugcu

SEQ ID NO: 835296 - RNA, 22 nt, Human
gcugggcuucucaaugcugccu

SEQ ID NO: 835297 - RNA, 22 nt, Human
uagauuuccucuuccucauucc

SEQ ID NO: 835298 - RNA, 22 nt, Human
cugugucccccucagccaggug

SEQ ID NO: 835299 - RNA, 20 nt, Human
cccagguaggugccaugagu

SEQ ID NO: 835300 - RNA, 22 nt, Human
acaugcuuuaacuuauuuugau

SEQ ID NO: 835301 - RNA, 22 nt, Human
aagaacaacugcuuuaaaagca

SEQ ID NO: 835302 - RNA, 22 nt, Human
aggcagugcucaagacagcagc

SEQ ID NO: 835303 - RNA, 22 nt, Human
cuuuggaauauuuuauugagaa

SEQ ID NO: 835304 - RNA, 16 nt, Human
agcagccagcacugga

SEQ ID NO: 835305 - RNA, 22 nt, Human
agccacgucccugucaggguca

SEQ ID NO: 835306 - RNA, 22 nt, Human
uggcagaguaggauggcccugu

SEQ ID NO: 835307 - RNA, 22 nt, Human
ccagucugaggccuggugaggg

SEQ ID NO: 835308 - RNA, 22 nt, Human
ggcugcucugccuuccagcugg

SEQ ID NO: 835309 - RNA, 18 nt, Human
acacugcagcagucugcu

SEQ ID NO: 835310 - RNA, 22 nt, Human
ucugcaggcucuagaugagguu

SEQ ID NO: 835311 - RNA, 23 nt, Human
uaauucacauauacauugcuuca

SEQ ID NO: 835312 - RNA, 20 nt, Human
agauuauuccuaagauuucu

SEQ ID NO: 835313 - RNA, 23 nt, Human
ucugggcaccuuguugacaugau

SEQ ID NO: 835314 - RNA, 22 nt, Human
auacaugucaucauauguuugu

SEQ ID NO: 835315 - RNA, 22 nt, Human
uauaauuuaucaugucacaguu

SEQ ID NO: 835316 - RNA, 22 nt, Human
uugacacaguuuucucauuaag

SEQ ID NO: 835317 - RNA, 20 nt, Human
ucucaggccccaguuuucuu

SEQ ID NO: 835318 - RNA, 22 nt, Human
aaaggucaagcuggacucaggu

SEQ ID NO: 835319 - RNA, 22 nt, Human
gccugccugaaggcuguaccag

SEQ ID NO: 835320 - RNA, 22 nt, Human
ugggcugccggcaggcucugcc

SEQ ID NO: 835321 - RNA, 22 nt, Human
acagaaauugggcaaauggaag

SEQ ID NO: 835322 - RNA, 22 nt, Human
ugggugagugggaaaagcccag

SEQ ID NO: 835323 - RNA, 20 nt, Human
caggcacacucauuccugcu

SEQ ID NO: 835324 - RNA, 22 nt, Human
ucauguaaguauagaaagcagu

SEQ ID NO: 835325 - RNA, 22 nt, Human
agaggcuggauugagcauagac

SEQ ID NO: 835326 - RNA, 19 nt, Human
cagaaauagcgaaguguaa

SEQ ID NO: 835327 - RNA, 22 nt, Human
ugcaagaggaauucuagaagca

SEQ ID NO: 835328 - RNA, 22 nt, Human
aauccugugugacucuggggag

SEQ ID NO: 835329 - RNA, 22 nt, Human
ugaagcagauggucuggucauu

SEQ ID NO: 835330 - RNA, 22 nt, Human
ccugccagugaagcugacgggc

SEQ ID NO: 835331 - RNA, 22 nt, Human
cccagacuccucuggcuggugg

SEQ ID NO: 835332 - RNA, 22 nt, Human
gcacagggcaacaggucuguua

SEQ ID NO: 835333 - RNA, 22 nt, Human
aauaucaguauauuguaucagu

SEQ ID NO: 835334 - RNA, 22 nt, Human
accuuucauuaaagucuguagu

SEQ ID NO: 835335 - RNA, 22 nt, Human
ggccucaguuucuucaacugua

SEQ ID NO: 835336 - RNA, 20 nt, Human
aaguuacauuguauuguacc

SEQ ID NO: 835337 - RNA, 22 nt, Human
uuuccaaaggaguaccacgcau

SEQ ID NO: 835338 - RNA, 22 nt, Human
cuggcugugcugcaggcuuugg

SEQ ID NO: 835339 - RNA, 22 nt, Human
auagauacauuagguaacuugu

SEQ ID NO: 835340 - RNA, 22 nt, Human
guguccaucagcagccacugug

SEQ ID NO: 835341 - RNA, 22 nt, Human
ggagaggaaaugccagcacuuc

SEQ ID NO: 835342 - RNA, 22 nt, Human
uuauacuaaaacgcauugaauu

SEQ ID NO: 835343 - RNA, 22 nt, Human
acaacuuuagucuggagggaaa

SEQ ID NO: 835344 - RNA, 22 nt, Human
acagcagcgucaacuuaaaauu

SEQ ID NO: 835345 - RNA, 19 nt, Human
uggcuccugccugccuucu

SEQ ID NO: 835346 - RNA, 22 nt, Human
caggaggggguggaguuucgcc

SEQ ID NO: 835347 - RNA, 22 nt, Human
agggcacaagacucugagcccc

SEQ ID NO: 835348 - RNA, 22 nt, Human
cuagaaauguagauucuuagug

SEQ ID NO: 835349 - RNA, 22 nt, Human
uccucagggggccaacccagcc

SEQ ID NO: 835350 - RNA, 18 nt, Human
uaggagagaauuuauuua

SEQ ID NO: 835351 - RNA, 22 nt, Human
ugucucugugacuccuuccgcc

SEQ ID NO: 835352 - RNA, 22 nt, Human
cagaggcaaaagagguggaggu

SEQ ID NO: 835353 - RNA, 22 nt, Human
aaggccagcuuguagggcuggu

SEQ ID NO: 835354 - RNA, 22 nt, Human
cugucuguuuuaccuucuccag

SEQ ID NO: 835355 - RNA, 22 nt, Human
aggagccuccuucucaugugca

SEQ ID NO: 835356 - RNA, 22 nt, Human
acaguaauuaaaauggaucugc

SEQ ID NO: 835357 - RNA, 22 nt, Human
aacauacagugagcaguggacu

SEQ ID NO: 835358 - RNA, 22 nt, Human
acagagcauuugggacagagag

SEQ ID NO: 835359 - RNA, 22 nt, Human
gcucaaggcaggcagacaugag

SEQ ID NO: 835360 - RNA, 22 nt, Human
ccauuucacucuuccugaagga

SEQ ID NO: 835361 - RNA, 22 nt, Human
gccuguguggaugcgccggugc

SEQ ID NO: 835362 - RNA, 22 nt, Human
gcucccaggaagagaagggcca

SEQ ID NO: 835363 - RNA, 22 nt, Human
uccaggagaggccugaccaggu

SEQ ID NO: 835364 - RNA, 22 nt, Human
ccgggccucgggacaccgggua

SEQ ID NO: 835365 - RNA, 22 nt, Human
ugagguaggugguaagagauac

SEQ ID NO: 835366 - RNA, 22 nt, Human
ggccucgcggcuucugguggcu

SEQ ID NO: 835367 - RNA, 23 nt, Human
uagagcagggaaaucugucagag

SEQ ID NO: 835368 - RNA, 22 nt, Human
cauggcuuguaauaaauuuaua

SEQ ID NO: 835369 - RNA, 22 nt, Human
cugccaggcagggagauggcug

SEQ ID NO: 835370 - RNA, 22 nt, Human
uguguaaagcuuguuccagaaa

SEQ ID NO: 835371 - RNA, 22 nt, Human
caaauccagaucccagucguag

SEQ ID NO: 835372 - RNA, 22 nt, Human
aaggcugcuuuuaacaugcaua

SEQ ID NO: 835373 - RNA, 22 nt, Human
aaucaguuaggguguuaaugag

SEQ ID NO: 835374 - RNA, 22 nt, Human
uucauuacugcgguagucacac

SEQ ID NO: 835375 - RNA, 18 nt, Human
auccuugaugagaggucu

SEQ ID NO: 835376 - RNA, 22 nt, Human
gaaugcacuuccaacaucuauu

SEQ ID NO: 835377 - RNA, 22 nt, Human
ugucauaaucaguuuugcaugu

SEQ ID NO: 835378 - RNA, 22 nt, Human
cucugugcccuacugcucagcu

SEQ ID NO: 835379 - RNA, 22 nt, Human
ugaaauuaugcauuguuguacc

SEQ ID NO: 835380 - RNA, 22 nt, Human
cuccucuggaaauuccucugcc

SEQ ID NO: 835381 - RNA, 22 nt, Human
ugagagugaaaugucacauguc

SEQ ID NO: 835382 - RNA, 22 nt, Human
ggcaggcugcuugggucauguc

SEQ ID NO: 835383 - RNA, 22 nt, Human
ucuaaacaguuucacucuuaau

SEQ ID NO: 835384 - RNA, 22 nt, Human
auaagaaacauuauucuuucca

SEQ ID NO: 835385 - RNA, 22 nt, Human
gcacagggagcaggucucuggu

SEQ ID NO: 835386 - RNA, 22 nt, Human
aagacagagggaagcaaugaug

SEQ ID NO: 835387 - RNA, 22 nt, Human
gacagagugcagggcuagaaga

SEQ ID NO: 835388 - RNA, 22 nt, Human
ggcuggagugggcuccagaguu

SEQ ID NO: 835389 - RNA, 22 nt, Human
ucaagugcuugugagguauuug

SEQ ID NO: 835390 - RNA, 22 nt, Human
cccuggccagcucaugucugag

SEQ ID NO: 835391 - RNA, 22 nt, Human
acaaugaacacacaaggaauuc

SEQ ID NO: 835392 - RNA, 22 nt, Human
gaggcagcaucuauggugggaa

SEQ ID NO: 835393 - RNA, 22 nt, Human
ggagccaggcaaucuguacuuu

SEQ ID NO: 835394 - RNA, 22 nt, Human
ucccagcgcggggggaggaucc

SEQ ID NO: 835395 - RNA, 22 nt, Human
ugcagaagcugcaggucagugg

SEQ ID NO: 835396 - RNA, 22 nt, Human
ugggccacggggguggagagcu

SEQ ID NO: 835397 - RNA, 22 nt, Human
gagggcauaguuaaauaggagg

SEQ ID NO: 835398 - RNA, 22 nt, Human
gccuuaauuuaugucuaacaua

SEQ ID NO: 835399 - RNA, 20 nt, Human
uuccuuaggcauuggaagaa

SEQ ID NO: 835400 - RNA, 22 nt, Human
aggcugggcuccgcccaacucc

SEQ ID NO: 835401 - RNA, 22 nt, Human
gcagauggcugagccugcagau

SEQ ID NO: 835402 - RNA, 22 nt, Human
uuaggaguccagaugucuuggg

SEQ ID NO: 835403 - RNA, 22 nt, Human
ucagggcagaauccaaagaauu

SEQ ID NO: 835404 - RNA, 22 nt, Human
gccaggagggaaaggacaauuu

SEQ ID NO: 835405 - RNA, 22 nt, Human
ccuuuuucccuggagggacagc

SEQ ID NO: 835406 - RNA, 20 nt, Human
agugucugggccucaggccc

SEQ ID NO: 835407 - RNA, 22 nt, Human
gugcugucguggaacugggcug

SEQ ID NO: 835408 - RNA, 22 nt, Human
cugggugguuuugaugugaauu

SEQ ID NO: 835409 - RNA, 22 nt, Human
aaguccuucccaagcauguacc

SEQ ID NO: 835410 - RNA, 22 nt, Human
uauuugagcgaagcaguguuuu

SEQ ID NO: 835411 - RNA, 22 nt, Human
uguguacagcaggauuucucaa

SEQ ID NO: 835412 - RNA, 19 nt, Human
agcagagcagggccguggg

SEQ ID NO: 835413 - RNA, 22 nt, Human
cucugcaggggaggcaugcacu

SEQ ID NO: 835414 - RNA, 22 nt, Human
ugggcuccucgucacucgcugu

SEQ ID NO: 835415 - RNA, 22 nt, Human
ugcaggccggcccuaggccuca

SEQ ID NO: 835416 - RNA, 22 nt, Human
ugugaauacagcaugugcuucu

SEQ ID NO: 835417 - RNA, 22 nt, Human
caguugcuacaguucaagugug

SEQ ID NO: 835418 - RNA, 22 nt, Human
uggcuuuacugucauucuuaug

SEQ ID NO: 835419 - RNA, 22 nt, Human
agggcagcauugccuuucucca

SEQ ID NO: 835420 - RNA, 22 nt, Human
auguagcagauauuugugcaca

SEQ ID NO: 835421 - RNA, 22 nt, Human
uuuccucugaugcugacuugga

SEQ ID NO: 835422 - RNA, 22 nt, Human
gugcauuuaggucacaugaugu

SEQ ID NO: 835423 - RNA, 22 nt, Human
aucaguuucuaccauguggaau

SEQ ID NO: 835424 - RNA, 22 nt, Human
ucagcauaucuugagcuucaug

SEQ ID NO: 835425 - RNA, 22 nt, Human
uggcagagaugaagaguuguuu

SEQ ID NO: 835426 - RNA, 22 nt, Human
uaguuuuacuugcgaugauaau

SEQ ID NO: 835427 - RNA, 22 nt, Human
gcugccuggcuuuaguccacuu

SEQ ID NO: 835428 - RNA, 22 nt, Human
ucccaggacaggccacauggaa

SEQ ID NO: 835429 - RNA, 22 nt, Human
ucagggcacaggccuguggguu

SEQ ID NO: 835430 - RNA, 22 nt, Human
agcuggcagcucucagggguac

SEQ ID NO: 835431 - RNA, 22 nt, Human
cugcucugaguauuaacggagg

SEQ ID NO: 835432 - RNA, 21 nt, Human
gggugcuguggucaugcagga

SEQ ID NO: 835433 - RNA, 22 nt, Human
ugcagggccuucuagaccaugg

SEQ ID NO: 835434 - RNA, 22 nt, Human
auguagaaaguucauagaugcg

SEQ ID NO: 835435 - RNA, 22 nt, Human
agcuggcaguaugacuggugac

SEQ ID NO: 835436 - RNA, 22 nt, Human
agccagcagggcuuagaggaca

SEQ ID NO: 835437 - RNA, 22 nt, Human
auucuagaugcuguaaguagca

SEQ ID NO: 835438 - RNA, 22 nt, Human
uaugcauaugaccccaagcuug

SEQ ID NO: 835439 - RNA, 22 nt, Human
auaaagucuaccguauuaaaga

SEQ ID NO: 835440 - RNA, 22 nt, Human
gcagcucccagcuugaaagguc

SEQ ID NO: 835441 - RNA, 22 nt, Human
uggccuugggcagguggccugc

SEQ ID NO: 835442 - RNA, 22 nt, Human
uguaugaaugggaaaaggaaac

SEQ ID NO: 835443 - RNA, 22 nt, Human
cuuuggcaaugaaacacaagaa

SEQ ID NO: 835444 - RNA, 22 nt, Human
uccagaauauuugggaaagaug

SEQ ID NO: 835445 - RNA, 22 nt, Human
uauuuuaaagacugccagccua

SEQ ID NO: 835446 - RNA, 22 nt, Human
agggcagcuagcuguagaaaga

SEQ ID NO: 835447 - RNA, 22 nt, Human
ucccagccauuccuuuaggugu

SEQ ID NO: 835448 - RNA, 22 nt, Human
ccugucauacuaacguaguggg

SEQ ID NO: 835449 - RNA, 22 nt, Human
cuguccuuacugcuucuggcuu

SEQ ID NO: 835450 - RNA, 22 nt, Human
cccuggcaaaacacucucuuga

SEQ ID NO: 835451 - RNA, 22 nt, Human
gcucaggagcugacagccucaa

SEQ ID NO: 835452 - RNA, 22 nt, Human
cccaggaaaucaggcuuucuag

SEQ ID NO: 835453 - RNA, 22 nt, Human
acguguucaauuuccaucugac

SEQ ID NO: 835454 - RNA, 22 nt, Human
aagaaaugcagaaaugugcugg

SEQ ID NO: 835455 - RNA, 22 nt, Human
cuggguaaguuccuaaggcuca

SEQ ID NO: 835456 - RNA, 22 nt, Human
caggagcccguugcuccggcgg

SEQ ID NO: 835457 - RNA, 20 nt, Human
cugugcuuuggaaccuggaa

SEQ ID NO: 835458 - RNA, 22 nt, Human
agugccuggaccccaugacaua

SEQ ID NO: 835459 - RNA, 22 nt, Human
caucagaaagaguccuggacuu

SEQ ID NO: 835460 - RNA, 22 nt, Human
cagcauuuagaauuugaagugu

SEQ ID NO: 835461 - RNA, 22 nt, Human
aggcaggggagcuggaagggua

SEQ ID NO: 835462 - RNA, 22 nt, Human
gccucugcaucuucgccgcacu

SEQ ID NO: 835463 - RNA, 22 nt, Human
gaggcagcugaagcuucaaaga

SEQ ID NO: 835464 - RNA, 21 nt, Human
aggccucuucauggccaugau

SEQ ID NO: 835465 - RNA, 22 nt, Human
cuuggcagcuuuuggaggagcc

SEQ ID NO: 835466 - RNA, 22 nt, Human
uguguauuucuggaacagacua

SEQ ID NO: 835467 - RNA, 22 nt, Human
gcugucugcaucucuagagcuu

SEQ ID NO: 835468 - RNA, 22 nt, Human
caggccugaguguggaagucuu

SEQ ID NO: 835469 - RNA, 23 nt, Human
agaugaggcuucuccauguuggu

SEQ ID NO: 835470 - RNA, 22 nt, Human
ucaguauccacaaaugcucaaa

SEQ ID NO: 835471 - RNA, 22 nt, Human
uuuaggcauugaauuagaauag

SEQ ID NO: 835472 - RNA, 22 nt, Human
agcagcaggcuguguggacuga

SEQ ID NO: 835473 - RNA, 23 nt, Human
uuucacaaugagcauuacagaau

SEQ ID NO: 835474 - RNA, 22 nt, Human
ugggcagaaggaagagccaccu

SEQ ID NO: 835475 - RNA, 22 nt, Human
auccaaaucaugucagaagaac

SEQ ID NO: 835476 - RNA, 22 nt, Human
gggcagcucagccaccaugcag

SEQ ID NO: 835477 - RNA, 22 nt, Human
uagaaacucaggauacucuucc

SEQ ID NO: 835478 - RNA, 22 nt, Human
ggagauggcucugcaaggucua

SEQ ID NO: 835479 - RNA, 22 nt, Human
ucagguguuagaagaaauuuca

SEQ ID NO: 835480 - RNA, 22 nt, Human
agcaccaucagaugcaauaucu

SEQ ID NO: 835481 - RNA, 22 nt, Human
ggcucuggcguccaauggagcg

SEQ ID NO: 835482 - RNA, 22 nt, Human
uagcagaaccagcagucaauuu

SEQ ID NO: 835483 - RNA, 22 nt, Human
ggcccuguccuggcugucuccg

SEQ ID NO: 835484 - RNA, 22 nt, Human
gaaucacgguauucugcacggg

SEQ ID NO: 835485 - RNA, 17 nt, Human
aggagucucagaugagc

SEQ ID NO: 835486 - RNA, 22 nt, Human
gagccuucaucgcagccuuguu

SEQ ID NO: 835487 - RNA, 22 nt, Human
uguaugaaagaacaagggcuua

SEQ ID NO: 835488 - RNA, 22 nt, Human
uggcugcugcuuggucuucuuc

SEQ ID NO: 835489 - RNA, 22 nt, Human
ccaggagagcgcccucccggcc

SEQ ID NO: 835490 - RNA, 19 nt, Human
ugaagcagcaaacucucag

SEQ ID NO: 835491 - RNA, 22 nt, Human
cggagccugcuuguugcagcug

SEQ ID NO: 835492 - RNA, 22 nt, Human
ggguggagaggcuaaguccagu

SEQ ID NO: 835493 - RNA, 22 nt, Human
uaucuuuagaggaagagaaucu

SEQ ID NO: 835494 - RNA, 22 nt, Human
ccacaggaccagaggagaucac

SEQ ID NO: 835495 - RNA, 22 nt, Human
ccucagcucuucccugugcaca

SEQ ID NO: 835496 - RNA, 22 nt, Human
cacauauuguaguucaccagga

SEQ ID NO: 835497 - RNA, 22 nt, Human
acaaucauuccguucacaacag

SEQ ID NO: 835498 - RNA, 22 nt, Human
uccugagauaaaucucauguga

SEQ ID NO: 835499 - RNA, 22 nt, Human
uuauuucauugauuucuaagac

SEQ ID NO: 835500 - RNA, 22 nt, Human
ucaaaagucugcauucuucaca

SEQ ID NO: 835501 - RNA, 22 nt, Human
acugcaggagacacagcugcug

SEQ ID NO: 835502 - RNA, 22 nt, Human
ugcccuguuccugccuccagcu

SEQ ID NO: 835503 - RNA, 22 nt, Human
auccauuugaaagaacagucca

SEQ ID NO: 835504 - RNA, 22 nt, Human
uuccuucucagcccucgaggau

SEQ ID NO: 835505 - RNA, 22 nt, Human
auaaaaacugacccauccuuug

SEQ ID NO: 835506 - RNA, 22 nt, Human
aaagauuuaugaaguucaauua

SEQ ID NO: 835507 - RNA, 22 nt, Human
cagauacuguaaaauuucagua

SEQ ID NO: 835508 - RNA, 22 nt, Human
agccucugauggcucccaagga

SEQ ID NO: 835509 - RNA, 22 nt, Human
uugcagcuucuaccacuguuuc

SEQ ID NO: 835510 - RNA, 22 nt, Human
ugugaaauauuuauauacucaa

SEQ ID NO: 835511 - RNA, 22 nt, Human
gaggcuggugguuaguuccauu

SEQ ID NO: 835512 - RNA, 22 nt, Human
uugcucuguaauaaucuggggu

SEQ ID NO: 835513 - RNA, 22 nt, Human
agacagcugggaaauggagugu

SEQ ID NO: 835514 - RNA, 22 nt, Human
ugugggcucccccucacucugu

SEQ ID NO: 835515 - RNA, 20 nt, Human
ugcucaggauggagaggugu

SEQ ID NO: 835516 - RNA, 22 nt, Human
uucuuuccucccagccuuugga

SEQ ID NO: 835517 - RNA, 22 nt, Human
uccaggacuagcauuucugaua

SEQ ID NO: 835518 - RNA, 22 nt, Human
agaggcagccguauuucaaagg

SEQ ID NO: 835519 - RNA, 22 nt, Human
agucauaugacccuucacaaac

SEQ ID NO: 835520 - RNA, 22 nt, Human
aagaagagaacuggcauccuaa

SEQ ID NO: 835521 - RNA, 22 nt, Human
uaauuucaccguugcuagaaau

SEQ ID NO: 835522 - RNA, 22 nt, Human
ugcuggaauaauuucauguuaa

SEQ ID NO: 835523 - RNA, 22 nt, Human
cccagccugugacagccguccu

SEQ ID NO: 835524 - RNA, 22 nt, Human
uccuuggcaugccgucuucucc

SEQ ID NO: 835525 - RNA, 22 nt, Human
aaggcacuuaacgugggaggau

SEQ ID NO: 835526 - RNA, 22 nt, Human
uccaggaggugaggggaccaaa

SEQ ID NO: 835527 - RNA, 22 nt, Human
aucuggcuccuacacuugaaga

SEQ ID NO: 835528 - RNA, 22 nt, Human
ucucagaguuugaaucuggagu

SEQ ID NO: 835529 - RNA, 22 nt, Human
ggcagcuguggacgucgucauu

SEQ ID NO: 835530 - RNA, 22 nt, Human
agguauaagaagauuauuuaua

SEQ ID NO: 835531 - RNA, 22 nt, Human
uuccuugguagagagaauauuu

SEQ ID NO: 835532 - RNA, 22 nt, Human
gcccaggagguugggcugugca

SEQ ID NO: 835533 - RNA, 22 nt, Human
aauguguguauuucuaggcgag

SEQ ID NO: 835534 - RNA, 23 nt, Human
aaggucacagaacuuagcaagcc

SEQ ID NO: 835535 - RNA, 22 nt, Human
gagcccucucuguaggcaagua

SEQ ID NO: 835536 - RNA, 22 nt, Human
acaaggaggucuggggggcccu

SEQ ID NO: 835537 - RNA, 23 nt, Human
accaggaguugucucaggaaaca

SEQ ID NO: 835538 - RNA, 22 nt, Human
caggacagguguucuagaucag

SEQ ID NO: 835539 - RNA, 22 nt, Human
gcuggcucccauugguccuucc

SEQ ID NO: 835540 - RNA, 22 nt, Human
gaggccugaaaggggaccuaug

SEQ ID NO: 835541 - RNA, 22 nt, Human
caaauuccucagaaucagaaaa

SEQ ID NO: 835542 - RNA, 19 nt, Human
aggacucuggaggcaugag

SEQ ID NO: 835543 - RNA, 22 nt, Human
uggcucaggagggaucuuugcu

SEQ ID NO: 835544 - RNA, 22 nt, Human
uuccucaucugugcaccucacu

SEQ ID NO: 835545 - RNA, 20 nt, Human
uugcauuggaugugcaggug

SEQ ID NO: 835546 - RNA, 22 nt, Human
aauaauguugacgauagucuua

SEQ ID NO: 835547 - RNA, 22 nt, Human
agaugaaaagauaagcagcaau

SEQ ID NO: 835548 - RNA, 22 nt, Human
uguggccuggaaggggcugcuc

SEQ ID NO: 835549 - RNA, 22 nt, Human
gcuuccuggagggagagagcug

SEQ ID NO: 835550 - RNA, 18 nt, Human
cagaaaucacaccagcac

SEQ ID NO: 835551 - RNA, 22 nt, Human
uucaugaaacuuaacuguuggg

SEQ ID NO: 835552 - RNA, 22 nt, Human
acaggagaaaucuggucaaaag

SEQ ID NO: 835553 - RNA, 22 nt, Human
ugucccaggcugaaguacagug

SEQ ID NO: 835554 - RNA, 22 nt, Human
uggcagcacuagguacugagcu

SEQ ID NO: 835555 - RNA, 22 nt, Human
uuuauuuauaagccacuugcug

SEQ ID NO: 835556 - RNA, 22 nt, Human
uggcucagucauggaugaguaa

SEQ ID NO: 835557 - RNA, 22 nt, Human
caggcagcaggagcccugcucg

SEQ ID NO: 835558 - RNA, 22 nt, Human
guggccucaugucuauaaagag

SEQ ID NO: 835559 - RNA, 22 nt, Human
agaaaacuugucacagcucuca

SEQ ID NO: 835560 - RNA, 22 nt, Human
ucucagagauucagggagaagu

SEQ ID NO: 835561 - RNA, 22 nt, Human
ugagguggcuagggaggcacuc

SEQ ID NO: 835562 - RNA, 22 nt, Human
uccuuagagacaagaccaguuu

SEQ ID NO: 835563 - RNA, 22 nt, Human
gucugcugcagagcauggcuuu

SEQ ID NO: 835564 - RNA, 22 nt, Human
cauacauaugcauguguguaua

SEQ ID NO: 835565 - RNA, 22 nt, Human
aaaugcaccuugcugugagacu

SEQ ID NO: 835566 - RNA, 22 nt, Human
caggcugcggucggcucugguc

SEQ ID NO: 835567 - RNA, 22 nt, Human
uggcagaggcucugugauguug

SEQ ID NO: 835568 - RNA, 22 nt, Human
ucacaggguguacaucaccuau

SEQ ID NO: 835569 - RNA, 22 nt, Human
gaaauagacacuuucuaugaau

SEQ ID NO: 835570 - RNA, 22 nt, Human
gccugaagaacagcugugagga

SEQ ID NO: 835571 - RNA, 22 nt, Human
auuauaggcuugagccaccgug

SEQ ID NO: 835572 - RNA, 22 nt, Human
cugcaggggccucgagcacagg

SEQ ID NO: 835573 - RNA, 22 nt, Human
cugggcuccuaaccauccaggu

SEQ ID NO: 835574 - RNA, 22 nt, Human
ggaaggucgagcugcaucuggc

SEQ ID NO: 835575 - RNA, 22 nt, Human
aucauuucccuuuagaucacaa

SEQ ID NO: 835576 - RNA, 22 nt, Human
uucagaaagugaaucuuguuau

SEQ ID NO: 835577 - RNA, 22 nt, Human
ccagugcuucuuugcuagcugg

SEQ ID NO: 835578 - RNA, 22 nt, Human
agagggauggccccguaacuca

SEQ ID NO: 835579 - RNA, 21 nt, Human
ggugucaguuuuggucauuag

SEQ ID NO: 835580 - RNA, 22 nt, Human
uuucccaguucccugcucuaua

SEQ ID NO: 835581 - RNA, 22 nt, Human
aggccagccucaggcagggacc

SEQ ID NO: 835582 - RNA, 22 nt, Human
cugaagcacagcauauaaauaa

SEQ ID NO: 835583 - RNA, 20 nt, Human
aggcaccugucacaggugag

SEQ ID NO: 835584 - RNA, 22 nt, Human
aaaugcagcagcuaauugaaaa

SEQ ID NO: 835585 - RNA, 22 nt, Human
aaauaguucagcuuguaaaccc

SEQ ID NO: 835586 - RNA, 22 nt, Human
caaggcugcugcgggucgcacc

SEQ ID NO: 835587 - RNA, 22 nt, Human
gcagggucugaggccacagagg

SEQ ID NO: 835588 - RNA, 21 nt, Human
agcuuccugcagugggagguc

SEQ ID NO: 835589 - RNA, 19 nt, Human
gagcccucuccauggccac

SEQ ID NO: 835590 - RNA, 19 nt, Human
caggagagcaugcacuuug

SEQ ID NO: 835591 - RNA, 22 nt, Human
ggucccugaagaggccuggggu

SEQ ID NO: 835592 - RNA, 22 nt, Human
agggccagagucuguguagaua

SEQ ID NO: 835593 - RNA, 22 nt, Human
ugcagggcccuugggguugaac

SEQ ID NO: 835594 - RNA, 22 nt, Human
uuugaaaucuaaucaaggaaca

SEQ ID NO: 835595 - RNA, 22 nt, Human
acugaaagauaaaucaguuagc

SEQ ID NO: 835596 - RNA, 20 nt, Human
ucacauccucucccaacaug

SEQ ID NO: 835597 - RNA, 22 nt, Human
gaauauauuggugaaaauaguu

SEQ ID NO: 835598 - RNA, 22 nt, Human
cagccagaaccuaggaugagcu

SEQ ID NO: 835599 - RNA, 22 nt, Human
ugggcagaguugugaugaacug

SEQ ID NO: 835600 - RNA, 22 nt, Human
gcuucacaggcaaguuaagccu

SEQ ID NO: 835601 - RNA, 22 nt, Human
ccucaggggcuuuucguuguug

SEQ ID NO: 835602 - RNA, 22 nt, Human
ccagcugcuugggaaaaugucu

SEQ ID NO: 835603 - RNA, 22 nt, Human
uuagagucaagcugcauguucu

SEQ ID NO: 835604 - RNA, 22 nt, Human
uacauauuugucuuuguacugu

SEQ ID NO: 835605 - RNA, 22 nt, Human
caugcuuuucaaucuaucuuaa

SEQ ID NO: 835606 - RNA, 22 nt, Human
gagcugaguuaccuccagauca

SEQ ID NO: 835607 - RNA, 20 nt, Human
cuuggccuacuuagcuuugu

SEQ ID NO: 835608 - RNA, 22 nt, Human
uuucacauuuaggcgugaauug

SEQ ID NO: 835609 - RNA, 22 nt, Human
cuggggcugcgguggaggagcc

SEQ ID NO: 835610 - RNA, 22 nt, Human
aauguauguguauaucaaauca

SEQ ID NO: 835611 - RNA, 22 nt, Human
acauuucucaucuaguagagua

SEQ ID NO: 835612 - RNA, 22 nt, Human
aggcagcguagcaaggcuagua

SEQ ID NO: 835613 - RNA, 22 nt, Human
cauugcacuccacccuaggcaa

SEQ ID NO: 835614 - RNA, 22 nt, Human
gcucagagauguucaguagcuu

SEQ ID NO: 835615 - RNA, 22 nt, Human
guuuuuccuugcugaggacccg

SEQ ID NO: 835616 - RNA, 21 nt, Human
gcugccaccgcgugcuccagg

SEQ ID NO: 835617 - RNA, 21 nt, Human
gccagggaagagaguuggcug

SEQ ID NO: 835618 - RNA, 22 nt, Human
ggcccugggcagaggagugggc

SEQ ID NO: 835619 - RNA, 22 nt, Human
auguuugaaauuguaaguauau

SEQ ID NO: 835620 - RNA, 22 nt, Human
uuugcuauuuuucugugcagcu

SEQ ID NO: 835621 - RNA, 23 nt, Human
gcugucaguuguuuuugucucua

SEQ ID NO: 835622 - RNA, 22 nt, Human
caaggaaacaugaaaugcauug

SEQ ID NO: 835623 - RNA, 22 nt, Human
auguaucaugcaggguccauga

SEQ ID NO: 835624 - RNA, 22 nt, Human
guuuuguugcugcagagcucaa

SEQ ID NO: 835625 - RNA, 22 nt, Human
agagcuggaaucagaccucagg

SEQ ID NO: 835626 - RNA, 22 nt, Human
caggcuggaguuaccuuuaggg

SEQ ID NO: 835627 - RNA, 22 nt, Human
uugauggcugugauuuacucag

SEQ ID NO: 835628 - RNA, 21 nt, Human
gcccagcaaggugagaaggcc

SEQ ID NO: 835629 - RNA, 22 nt, Human
acauuucuaauuuaauguaaca

SEQ ID NO: 835630 - RNA, 22 nt, Human
agugugggugagggaggcccuc

SEQ ID NO: 835631 - RNA, 22 nt, Human
uucuucuucauuucugacgaug

SEQ ID NO: 835632 - RNA, 22 nt, Human
cugggcugcaggaguggggcaa

SEQ ID NO: 835633 - RNA, 22 nt, Human
agcaauauuucagcuagcaggu

SEQ ID NO: 835634 - RNA, 22 nt, Human
agacaaauggaguaugagcaac

SEQ ID NO: 835635 - RNA, 22 nt, Human
caacuuuucugugaauuuaagu

SEQ ID NO: 835636 - RNA, 22 nt, Human
cugaauaauguucucuuguaug

SEQ ID NO: 835637 - RNA, 22 nt, Human
aggauuuauuauaugcccucau

SEQ ID NO: 835638 - RNA, 22 nt, Human
gcuguucagggcacucaugggc

SEQ ID NO: 835639 - RNA, 21 nt, Human
agggaaagaaaaugagcuaau

SEQ ID NO: 835640 - RNA, 22 nt, Human
aauuauguagccauaugaaaca

SEQ ID NO: 835641 - RNA, 22 nt, Human
agccuggacagcuacggagaac

SEQ ID NO: 835642 - RNA, 22 nt, Human
ucaaauaugugauagaagcuaa

SEQ ID NO: 835643 - RNA, 22 nt, Human
agagucuuccaggcagccugag

SEQ ID NO: 835644 - RNA, 22 nt, Human
uaaugcacaugacugaacuauu

SEQ ID NO: 835645 - RNA, 22 nt, Human
cccaggcuggauuucgguggca

SEQ ID NO: 835646 - RNA, 21 nt, Human
uagaaaucagcuggugccucu

SEQ ID NO: 835647 - RNA, 22 nt, Human
cauugcacuccaucuugggcaa

SEQ ID NO: 835648 - RNA, 22 nt, Human
caugcuuauucauucugcuaac

SEQ ID NO: 835649 - RNA, 18 nt, Human
agaugaaagcaaaugaca

SEQ ID NO: 835650 - RNA, 22 nt, Human
acugcuuuucagagucugccug

SEQ ID NO: 835651 - RNA, 22 nt, Human
caguuuuucaaaauuacaugau

SEQ ID NO: 835652 - RNA, 22 nt, Human
gggcugcuuuuuucuuagcaga

SEQ ID NO: 835653 - RNA, 22 nt, Human
ugaaauguuugaagaccacuga

SEQ ID NO: 835654 - RNA, 22 nt, Human
cacaugggcguaauguccaugg

SEQ ID NO: 835655 - RNA, 22 nt, Human
acaggauuagcaaguaaucagg

SEQ ID NO: 835656 - RNA, 22 nt, Human
agcugaguuaauucaucacuua

SEQ ID NO: 835657 - RNA, 22 nt, Human
ccuggcuguggcggugcucuca

SEQ ID NO: 835658 - RNA, 22 nt, Human
cuggcucaauaaauauuagcug

SEQ ID NO: 835659 - RNA, 22 nt, Human
uauucacaguugauuuacaguu

SEQ ID NO: 835660 - RNA, 22 nt, Human
ccagggcagaaaaagagggaau

SEQ ID NO: 835661 - RNA, 22 nt, Human
ucugcaggcuuauaggaugggu

SEQ ID NO: 835662 - RNA, 21 nt, Human
cccaggaguccuauuuaaaug

SEQ ID NO: 835663 - RNA, 22 nt, Human
aguaucaaggaucuccagcacc

SEQ ID NO: 835664 - RNA, 22 nt, Human
aucuaggauuugaaugcacagu

SEQ ID NO: 835665 - RNA, 22 nt, Human
gcaaagucucaagacccaagug

SEQ ID NO: 835666 - RNA, 22 nt, Human
ucauuguuucugcuuuucauga

SEQ ID NO: 835667 - RNA, 18 nt, Human
caagaaucucuaaagaag

SEQ ID NO: 835668 - RNA, 22 nt, Human
agggguggccugccuuacuccc

SEQ ID NO: 835669 - RNA, 22 nt, Human
uucuacagacuauaacugugau

SEQ ID NO: 835670 - RNA, 22 nt, Human
cugggccuagaggaagcugaca

SEQ ID NO: 835671 - RNA, 22 nt, Human
uaaguucaagucuuggauauaa

SEQ ID NO: 835672 - RNA, 22 nt, Human
aggcagugccuggaccccagcu

SEQ ID NO: 835673 - RNA, 22 nt, Human
uaucuguuccaggcacucagcu

SEQ ID NO: 835674 - RNA, 22 nt, Human
agcugcagucaagcugggccac

SEQ ID NO: 835675 - RNA, 22 nt, Human
gaggcagcuuaggguacugacu

SEQ ID NO: 835676 - RNA, 23 nt, Human
ucugucaccuauggcugcucuuc

SEQ ID NO: 835677 - RNA, 22 nt, Human
acauucaugucccacuucuagc

SEQ ID NO: 835678 - RNA, 22 nt, Human
ucagagugaccuuacauggucu

SEQ ID NO: 835679 - RNA, 22 nt, Human
agccacagagagggagcugcaa

SEQ ID NO: 835680 - RNA, 22 nt, Human
uaugaacucuggagucugagug

SEQ ID NO: 835681 - RNA, 22 nt, Human
uugcauguuauuuaaucuguau

SEQ ID NO: 835682 - RNA, 22 nt, Human
uuucaacaccagagaccaugcg

SEQ ID NO: 835683 - RNA, 22 nt, Human
auacagaauuugcccuuuucau

SEQ ID NO: 835684 - RNA, 22 nt, Human
ccuggggcucaagauggcgccg

SEQ ID NO: 835685 - RNA, 22 nt, Human
acagaccaaguuuccagcaggu

SEQ ID NO: 835686 - RNA, 22 nt, Human
cucauaaugugacuguauuuga

SEQ ID NO: 835687 - RNA, 22 nt, Human
agccauggcgccacuagaggga

SEQ ID NO: 835688 - RNA, 22 nt, Human
gcucugagccgggggccugucc

SEQ ID NO: 835689 - RNA, 22 nt, Human
acccagagcugggcuuggcaaa

SEQ ID NO: 835690 - RNA, 22 nt, Human
ugguccagacauuucugaggua

SEQ ID NO: 835691 - RNA, 22 nt, Human
caggccugauacacugaacucu

SEQ ID NO: 835692 - RNA, 22 nt, Human
cuguggaaggccuguccugaaa

SEQ ID NO: 835693 - RNA, 22 nt, Human
gcucugggauuaccagccuuag

SEQ ID NO: 835694 - RNA, 22 nt, Human
uaaagaucuuaggaagauuuuc

SEQ ID NO: 835695 - RNA, 22 nt, Human
auaugcacauacauacauaggu

SEQ ID NO: 835696 - RNA, 22 nt, Human
gccuucaguagugucagcugua

SEQ ID NO: 835697 - RNA, 22 nt, Human
ggcuggcauccagggaaaucca

SEQ ID NO: 835698 - RNA, 22 nt, Human
gggauggcucaaaggagucagg

SEQ ID NO: 835699 - RNA, 22 nt, Human
aaauacugucucugagagagcc

SEQ ID NO: 835700 - RNA, 22 nt, Human
cucaaauauaagcuaaaugugg

SEQ ID NO: 835701 - RNA, 22 nt, Human
uccaggagacacccuugugugu

SEQ ID NO: 835702 - RNA, 22 nt, Human
aucauaaagugcuaucugauug

SEQ ID NO: 835703 - RNA, 23 nt, Human
uaagaacagacaagcauuuacau

SEQ ID NO: 835704 - RNA, 22 nt, Human
guccaaauuuuucacauguaga

SEQ ID NO: 835705 - RNA, 23 nt, Human
uggcagcagaucuuaaagugacc

SEQ ID NO: 835706 - RNA, 22 nt, Human
acagucauuagauacaaugucu

SEQ ID NO: 835707 - RNA, 22 nt, Human
ggagcagggcagugaauucugg

SEQ ID NO: 835708 - RNA, 22 nt, Human
gaggcagagucacaaagagucu

SEQ ID NO: 835709 - RNA, 22 nt, Human
aagaaauuaaggaaugcaacga

SEQ ID NO: 835710 - RNA, 22 nt, Human
agcagcugaucaaagcacuuau

SEQ ID NO: 835711 - RNA, 22 nt, Human
uaagaagcuucugcuaaugccu

SEQ ID NO: 835712 - RNA, 22 nt, Human
ggaggacacuggcucugccuuc

SEQ ID NO: 835713 - RNA, 22 nt, Human
acauuuaggauguuuugagaga

SEQ ID NO: 835714 - RNA, 22 nt, Human
ggcagaggagcuggaaacaugg

SEQ ID NO: 835715 - RNA, 22 nt, Human
gcaaagucugcaucuggaucag

SEQ ID NO: 835716 - RNA, 22 nt, Human
ugauuucccuguagccucugaa

SEQ ID NO: 835717 - RNA, 22 nt, Human
gggcagugguuacacagcugag

SEQ ID NO: 835718 - RNA, 22 nt, Human
uaauacuuuugccuuguauuca

SEQ ID NO: 835719 - RNA, 22 nt, Human
guucagggagggacagaugaag

SEQ ID NO: 835720 - RNA, 19 nt, Human
gaggagcuaucggagacag

SEQ ID NO: 835721 - RNA, 22 nt, Human
ucacaaauauuuuaacaguagg

SEQ ID NO: 835722 - RNA, 22 nt, Human
uaagugcaauguuuuacuuaaa

SEQ ID NO: 835723 - RNA, 22 nt, Human
agcccaggcagagggaugcuug

SEQ ID NO: 835724 - RNA, 22 nt, Human
aagauuucucuccuggaaagca

SEQ ID NO: 835725 - RNA, 22 nt, Human
gagcagugaagacagaaguaca

SEQ ID NO: 835726 - RNA, 22 nt, Human
cagguccccuccccuaccaggc

SEQ ID NO: 835727 - RNA, 22 nt, Human
cagggccuccuaaggcaucuaa

SEQ ID NO: 835728 - RNA, 18 nt, Human
ccuggagcuccacagcaa

SEQ ID NO: 835729 - RNA, 23 nt, Human
aggaacugaggccuagggaggua

SEQ ID NO: 835730 - RNA, 22 nt, Human
uggcucugaccagguagaggag

SEQ ID NO: 835731 - RNA, 23 nt, Human
cagaccuggcagucauccucaac

SEQ ID NO: 835732 - RNA, 22 nt, Human
cucuucagauaaaagggauauu

SEQ ID NO: 835733 - RNA, 22 nt, Human
auuuggaaaugcaucucuugag

SEQ ID NO: 835734 - RNA, 22 nt, Human
uguuuguucccucucuuuccug

SEQ ID NO: 835735 - RNA, 22 nt, Human
uguaucaaggguuuauguaagc

SEQ ID NO: 835736 - RNA, 22 nt, Human
cccagcauccucagggagcggg

SEQ ID NO: 835737 - RNA, 22 nt, Human
uuuuauuggagugauaccaagc

SEQ ID NO: 835738 - RNA, 22 nt, Human
auagaauucuuugaaauuuaug

SEQ ID NO: 835739 - RNA, 22 nt, Human
cugaaaauguuacacaggaaga

SEQ ID NO: 835740 - RNA, 22 nt, Human
agccacagcccacaggacucuu

SEQ ID NO: 835741 - RNA, 22 nt, Human
agcuucuuggcucagcacuugg

SEQ ID NO: 835742 - RNA, 22 nt, Human
ucaggcugcccguucagggcuc

SEQ ID NO: 835743 - RNA, 22 nt, Human
cagggaggcugucuuaugccug

SEQ ID NO: 835744 - RNA, 22 nt, Human
gggagagagaaaacguggcgca

SEQ ID NO: 835745 - RNA, 23 nt, Human
ggucccaguggagaggccucacc

SEQ ID NO: 835746 - RNA, 22 nt, Human
uccaagaagucaucuaaacugu

SEQ ID NO: 835747 - RNA, 22 nt, Human
cauuuucagcacccaucugaaa

SEQ ID NO: 835748 - RNA, 22 nt, Human
cagaaauucccauuucagauuc

SEQ ID NO: 835749 - RNA, 22 nt, Human
gcccaggaguucaaggcugcag

SEQ ID NO: 835750 - RNA, 17 nt, Human
uccaugagacaugaaga

SEQ ID NO: 835751 - RNA, 22 nt, Human
uggagcaggugcucaggguaau

SEQ ID NO: 835752 - RNA, 22 nt, Human
ggcagcagggcugucucccuac

SEQ ID NO: 835753 - RNA, 20 nt, Human
ugagugauggaggcggguca

SEQ ID NO: 835754 - RNA, 22 nt, Human
ccucugcugcuguugagcaccg

SEQ ID NO: 835755 - RNA, 22 nt, Human
ugcuagaauuugcagaagcaua

SEQ ID NO: 835756 - RNA, 22 nt, Human
cugccuguuagucuagcaguua

SEQ ID NO: 835757 - RNA, 22 nt, Human
ucuuucagccacuuaccugucu

SEQ ID NO: 835758 - RNA, 22 nt, Human
aaggaggaauuucagggugaau

SEQ ID NO: 835759 - RNA, 22 nt, Human
gggcugagucugcugccuguca

SEQ ID NO: 835760 - RNA, 22 nt, Human
gcagggagguuugcugaccugg

SEQ ID NO: 835761 - RNA, 22 nt, Human
auguaacuucugugaaucugac

SEQ ID NO: 835762 - RNA, 22 nt, Human
aaagccuugggauuugugauca

SEQ ID NO: 835763 - RNA, 20 nt, Human
ccugggcuccaggagccccg

SEQ ID NO: 835764 - RNA, 22 nt, Human
ucaaaauuucagcacuagcccu

SEQ ID NO: 835765 - RNA, 22 nt, Human
cuuccucaugugcaaugcaagc

SEQ ID NO: 835766 - RNA, 22 nt, Human
uggagcaggugggaugucguga

SEQ ID NO: 835767 - RNA, 22 nt, Human
ucagagucauugcaaguagaag

SEQ ID NO: 835768 - RNA, 22 nt, Human
ucagcuggagaugagaaccgaa

SEQ ID NO: 835769 - RNA, 22 nt, Human
uggcccugacugauguggaggg

SEQ ID NO: 835770 - RNA, 20 nt, Human
aaguuuucuccaaauacagu

SEQ ID NO: 835771 - RNA, 22 nt, Human
uuacagaauguucuuccaacag

SEQ ID NO: 835772 - RNA, 22 nt, Human
gcagcccagagcgcaggacccc

SEQ ID NO: 835773 - RNA, 22 nt, Human
aagggccuccuggggagccugg

SEQ ID NO: 835774 - RNA, 22 nt, Human
gccugccuuuuggaggcacauu

SEQ ID NO: 835775 - RNA, 22 nt, Human
ggacacaguggaagacagcuug

SEQ ID NO: 835776 - RNA, 22 nt, Human
uggaaagaauuccuaugguuca

SEQ ID NO: 835777 - RNA, 22 nt, Human
aaaugcaucagcucauaagaga

SEQ ID NO: 835778 - RNA, 22 nt, Human
ggcagaguggagugcggccucc

SEQ ID NO: 835779 - RNA, 22 nt, Human
ucacaauuuggauacagcuaug

SEQ ID NO: 835780 - RNA, 22 nt, Human
ucucugaguauccugaacugcc

SEQ ID NO: 835781 - RNA, 19 nt, Human
uaaaaugucuguggucagu

SEQ ID NO: 835782 - RNA, 17 nt, Human
uugaacugcugagucag

SEQ ID NO: 835783 - RNA, 22 nt, Human
guacacauuaugcuucucuaaa

SEQ ID NO: 835784 - RNA, 22 nt, Human
ccuggcugaaccaaugaagugg

SEQ ID NO: 835785 - RNA, 22 nt, Human
agcccagccggauucccaguuc

SEQ ID NO: 835786 - RNA, 22 nt, Human
uaggcagaauuguugaaugaag

SEQ ID NO: 835787 - RNA, 22 nt, Human
auagaauuauggaaagcaucuu

SEQ ID NO: 835788 - RNA, 22 nt, Human
ccuggcugguggcagcgacaag

SEQ ID NO: 835789 - RNA, 22 nt, Human
caauuuuuguacuuauaguacu

SEQ ID NO: 835790 - RNA, 22 nt, Human
gcucagaggaugcuccuuuaug

SEQ ID NO: 835791 - RNA, 22 nt, Human
auguaucaacaaauuguacagu

SEQ ID NO: 835792 - RNA, 22 nt, Human
gagauguacaauguguauuaau

SEQ ID NO: 835793 - RNA, 22 nt, Human
aggcuuccgaguagcugggacu

SEQ ID NO: 835794 - RNA, 22 nt, Human
gggcucucaugaguguguggua

SEQ ID NO: 835795 - RNA, 22 nt, Human
uuucauggcuaggacuagagug

SEQ ID NO: 835796 - RNA, 21 nt, Human
uucaauacuauuucaauaguc

SEQ ID NO: 835797 - RNA, 22 nt, Human
acauuucucauucuccccuaac

SEQ ID NO: 835798 - RNA, 22 nt, Human
augcacaagaggcuagaaaaga

SEQ ID NO: 835799 - RNA, 22 nt, Human
auuucucuuagcaagacauuac

SEQ ID NO: 835800 - RNA, 22 nt, Human
cacugaaucucaaggggagggu

SEQ ID NO: 835801 - RNA, 22 nt, Human
gaggcagccucaguggaccucg

SEQ ID NO: 835802 - RNA, 22 nt, Human
aguuuuauuccaaugugcagca

SEQ ID NO: 835803 - RNA, 18 nt, Human
uggcucugcagccagaug

SEQ ID NO: 835804 - RNA, 22 nt, Human
ucaaucacguguuccauguucu

SEQ ID NO: 835805 - RNA, 22 nt, Human
auauuauucuaguaacagugau

SEQ ID NO: 835806 - RNA, 22 nt, Human
ggagcaggagucucuugaauuu

SEQ ID NO: 835807 - RNA, 22 nt, Human
accaguccgcggagcuccgggg

SEQ ID NO: 835808 - RNA, 22 nt, Human
auggguuucccucugaaauuau

SEQ ID NO: 835809 - RNA, 22 nt, Human
aggggcuguggaaaccaacucu

SEQ ID NO: 835810 - RNA, 22 nt, Human
auuucuguaguccacauucuuu

SEQ ID NO: 835811 - RNA, 19 nt, Human
aguggcagaucuggaagua

SEQ ID NO: 835812 - RNA, 21 nt, Human
ucaggggcuguguuuuccauc

SEQ ID NO: 835813 - RNA, 22 nt, Human
ugccacagaggugaagcccacu

SEQ ID NO: 835814 - RNA, 22 nt, Human
gaggcaggguguugauuacaga

SEQ ID NO: 835815 - RNA, 22 nt, Human
ucucuggguuuuuguccuguac

SEQ ID NO: 835816 - RNA, 22 nt, Human
gcucccagcauugcuucccagg

SEQ ID NO: 835817 - RNA, 22 nt, Human
agagugaaguaauuguuaggau

SEQ ID NO: 835818 - RNA, 22 nt, Human
uuuuaguguagucaccgugggu

SEQ ID NO: 835819 - RNA, 22 nt, Human
cagcccuggugccaagguuccc

SEQ ID NO: 835820 - RNA, 22 nt, Human
ugaguuuuuucaacauaugaag

SEQ ID NO: 835821 - RNA, 22 nt, Human
ucucagaguuuacggggcugaa

SEQ ID NO: 835822 - RNA, 22 nt, Human
caguucuuauuuggccaguguc

SEQ ID NO: 835823 - RNA, 19 nt, Human
gcuggcagauguggccgug

SEQ ID NO: 835824 - RNA, 22 nt, Human
aaucagaacuccuaccacagag

SEQ ID NO: 835825 - RNA, 22 nt, Human
aaaguccugacugcaggggaug

SEQ ID NO: 835826 - RNA, 22 nt, Human
ugcagcaggagccaggccuggu

SEQ ID NO: 835827 - RNA, 22 nt, Human
gauaaaauaacuauggaauacu

SEQ ID NO: 835828 - RNA, 22 nt, Human
uccaggagucuagccucaggcc

SEQ ID NO: 835829 - RNA, 22 nt, Human
ugcauuguugaugaguugaaua

SEQ ID NO: 835830 - RNA, 22 nt, Human
gccaggaguucagaugcauguu

SEQ ID NO: 835831 - RNA, 22 nt, Human
caggguggaauggaaugcuggc

SEQ ID NO: 835832 - RNA, 22 nt, Human
gaggcugcaggcaaugcugccc

SEQ ID NO: 835833 - RNA, 22 nt, Human
aaaagggacuacucucagcucc

SEQ ID NO: 835834 - RNA, 21 nt, Human
uucucagaucgaguagugaga

SEQ ID NO: 835835 - RNA, 22 nt, Human
uaaggcacuucaauguuuagaa

SEQ ID NO: 835836 - RNA, 19 nt, Human
ugucuuaauuaacucagag

SEQ ID NO: 835837 - RNA, 22 nt, Human
aggccuccuggcuccaggccuu

SEQ ID NO: 835838 - RNA, 22 nt, Human
cagaggcugaugugggaugggc

SEQ ID NO: 835839 - RNA, 22 nt, Human
accccagaggcggaggcugcag

SEQ ID NO: 835840 - RNA, 22 nt, Human
ugcuuuauguuaucagaagggu

SEQ ID NO: 835841 - RNA, 22 nt, Human
uuucuguuaggcaucauuuuaa

SEQ ID NO: 835842 - RNA, 20 nt, Human
uguucacaguaguugcugcu

SEQ ID NO: 835843 - RNA, 22 nt, Human
aucuucucaagcagcauccugu

SEQ ID NO: 835844 - RNA, 22 nt, Human
gcuguccugggaacaggcacua

SEQ ID NO: 835845 - RNA, 22 nt, Human
gccucugggcucugccccuggc

SEQ ID NO: 835846 - RNA, 19 nt, Human
cucagcuguagcucaugug

SEQ ID NO: 835847 - RNA, 22 nt, Human
ccaaggagaaugacaccaugga

SEQ ID NO: 835848 - RNA, 20 nt, Human
guaaugaauguaaacaguaa

SEQ ID NO: 835849 - RNA, 22 nt, Human
uggcacuggcgcaggauggcgg

SEQ ID NO: 835850 - RNA, 19 nt, Human
guggccagggcaggggcug

SEQ ID NO: 835851 - RNA, 22 nt, Human
ugcuauugugaacagugccaca

SEQ ID NO: 835852 - RNA, 22 nt, Human
cugcccuggucccauggcugau

SEQ ID NO: 835853 - RNA, 19 nt, Human
cccaggagucuggcugguu

SEQ ID NO: 835854 - RNA, 22 nt, Human
auucuuggcaaggagauuuaaa

SEQ ID NO: 835855 - RNA, 22 nt, Human
uggccugcuuucauuugaugcu

SEQ ID NO: 835856 - RNA, 22 nt, Human
caaguccuaaauguauuuguug

SEQ ID NO: 835857 - RNA, 22 nt, Human
gcaggagccacuucagggaugc

SEQ ID NO: 835858 - RNA, 22 nt, Human
ugcacacacaugaaguagcaug

SEQ ID NO: 835859 - RNA, 21 nt, Human
acagcaagccuuccuuucagg

SEQ ID NO: 835860 - RNA, 22 nt, Human
guggccucuguuggcuccuagg

SEQ ID NO: 835861 - RNA, 22 nt, Human
ugcaguggcgccaucucagcuc

SEQ ID NO: 835862 - RNA, 22 nt, Human
caggcagcccugcaccaagugu

SEQ ID NO: 835863 - RNA, 20 nt, Human
cagcaggaaaagugccucag

SEQ ID NO: 835864 - RNA, 22 nt, Human
caggaaccuaaagagacauuac

SEQ ID NO: 835865 - RNA, 22 nt, Human
gcagcuucaguaggugaagaca

SEQ ID NO: 835866 - RNA, 22 nt, Human
gcugagggcauguguggcgacu

SEQ ID NO: 835867 - RNA, 21 nt, Human
auggagggaccagggaagcag

SEQ ID NO: 835868 - RNA, 22 nt, Human
gcccucugcacagcucugagca

SEQ ID NO: 835869 - RNA, 22 nt, Human
ucacagcaaaagugugcagagc

SEQ ID NO: 835870 - RNA, 22 nt, Human
cugcugcugcuaucuacccagg

SEQ ID NO: 835871 - RNA, 22 nt, Human
gagcuggcuccgccaugcugcu

SEQ ID NO: 835872 - RNA, 18 nt, Human
caauuucauccuuaagcc

SEQ ID NO: 835873 - RNA, 22 nt, Human
ggaggcucccacgcagcucaca

SEQ ID NO: 835874 - RNA, 22 nt, Human
aggauuuaggagcuggcuaacg

SEQ ID NO: 835875 - RNA, 22 nt, Human
aguaaacacugucuuuauauau

SEQ ID NO: 835876 - RNA, 22 nt, Human
cauugcucaggcccagcaggaa

SEQ ID NO: 835877 - RNA, 22 nt, Human
aaacuuuguucgucugaugugg

SEQ ID NO: 835878 - RNA, 22 nt, Human
uuuaaugaauaauucaaaucug

SEQ ID NO: 835879 - RNA, 17 nt, Human
uggagcugcguguguuc

SEQ ID NO: 835880 - RNA, 23 nt, Human
ggggccugcaccggucugcgcgg

SEQ ID NO: 835881 - RNA, 22 nt, Human
gcugggcagccccuacagagag

SEQ ID NO: 835882 - RNA, 22 nt, Human
uuauccaagcagaagcugcaca

SEQ ID NO: 835883 - RNA, 22 nt, Human
cugagccaaaaagcagagcuug

SEQ ID NO: 835884 - RNA, 22 nt, Human
uuguggaaauacagacuccaag

SEQ ID NO: 835885 - RNA, 22 nt, Human
caugugguucaaguacuccaca

SEQ ID NO: 835886 - RNA, 18 nt, Human
gcaggcuuuuccuggguc

SEQ ID NO: 835887 - RNA, 22 nt, Human
uggccuggggaagaccaugggc

SEQ ID NO: 835888 - RNA, 22 nt, Human
gcagccacacuguuacagaaug

SEQ ID NO: 835889 - RNA, 22 nt, Human
uucaagauggcugcaaauacuu

SEQ ID NO: 835890 - RNA, 22 nt, Human
uggacucaaguccaaguucacg

SEQ ID NO: 835891 - RNA, 22 nt, Human
cagggccuuauccugccauuga

SEQ ID NO: 835892 - RNA, 23 nt, Human
gccucagagaaacagcugcacac

SEQ ID NO: 835893 - RNA, 20 nt, Human
gcccacucuaauccacuguc

SEQ ID NO: 835894 - RNA, 16 nt, Human
aggaggggaauuagga

SEQ ID NO: 835895 - RNA, 22 nt, Human
ucucugggugauggcagggcac

SEQ ID NO: 835896 - RNA, 22 nt, Human
ggugagaggcagaggacagcuu

SEQ ID NO: 835897 - RNA, 22 nt, Human
aaaugcauguagaauaauagag

SEQ ID NO: 835898 - RNA, 18 nt, Human
ggcagggaaaagauaggg

SEQ ID NO: 835899 - RNA, 22 nt, Human
aguuagaaaguaaaucauuuga

SEQ ID NO: 835900 - RNA, 22 nt, Human
cugccgagugggucaugaggca

SEQ ID NO: 835901 - RNA, 22 nt, Human
agccagggagguggagguugca

SEQ ID NO: 835902 - RNA, 22 nt, Human
ccugagaccaaguugcagccau

SEQ ID NO: 835903 - RNA, 22 nt, Human
ccuggccugcucggcucuuaag

SEQ ID NO: 835904 - RNA, 22 nt, Human
ucucagagagcuguguuuuccu

SEQ ID NO: 835905 - RNA, 19 nt, Human
ggucucagugcagcugcag

SEQ ID NO: 835906 - RNA, 22 nt, Human
cuacaaugacagaauugaguag

SEQ ID NO: 835907 - RNA, 22 nt, Human
cccuuagcucaauuucuugccc

SEQ ID NO: 835908 - RNA, 22 nt, Human
aaagaacaaauuagcuguuuua

SEQ ID NO: 835909 - RNA, 22 nt, Human
agccaagcugaucuccugcuga

SEQ ID NO: 835910 - RNA, 22 nt, Human
agggaggaucugcuccuugucu

SEQ ID NO: 835911 - RNA, 22 nt, Human
agccagccaguucacuaggaaa

SEQ ID NO: 835912 - RNA, 22 nt, Human
cucagaagaacaaaggcucuac

SEQ ID NO: 835913 - RNA, 19 nt, Human
cugcucaggucagucuguc

SEQ ID NO: 835914 - RNA, 22 nt, Human
guucuucaucauuaacacucug

SEQ ID NO: 835915 - RNA, 22 nt, Human
gagagaggccuccauguacuga

SEQ ID NO: 835916 - RNA, 22 nt, Human
ugcugccacauuuaaagagggg

SEQ ID NO: 835917 - RNA, 22 nt, Human
gucucccacuuucuggccucuu

SEQ ID NO: 835918 - RNA, 22 nt, Human
gcucccagauuucagccuugug

SEQ ID NO: 835919 - RNA, 22 nt, Human
aagagagagcauucuucuguua

SEQ ID NO: 835920 - RNA, 22 nt, Human
cuuugcaaacgauuaccacaug

SEQ ID NO: 835921 - RNA, 22 nt, Human
ccaggagagcaggcgugcagcu

SEQ ID NO: 835922 - RNA, 22 nt, Human
ugcccuguuaucuuggaagagu

SEQ ID NO: 835923 - RNA, 22 nt, Human
uggagcugauacagcuggcuuu

SEQ ID NO: 835924 - RNA, 22 nt, Human
aaacuuuaagacaguccucaag

SEQ ID NO: 835925 - RNA, 22 nt, Human
aaauguguuucuuugugaaugg

SEQ ID NO: 835926 - RNA, 22 nt, Human
cccaggagguuggggcuacagu

SEQ ID NO: 835927 - RNA, 22 nt, Human
gcuguccaugucuggccucagu

SEQ ID NO: 835928 - RNA, 19 nt, Human
cgcaggagccgaggugacc

SEQ ID NO: 835929 - RNA, 22 nt, Human
ccaggcauccauugcuuccucu

SEQ ID NO: 835930 - RNA, 22 nt, Human
caggagaagguuuggagugcag

SEQ ID NO: 835931 - RNA, 22 nt, Human
uuugacaaauccuucagcaaug

SEQ ID NO: 835932 - RNA, 22 nt, Human
ugcucuggguccugggccuccu

SEQ ID NO: 835933 - RNA, 22 nt, Human
uugcuuuguuacugcaguuucc

SEQ ID NO: 835934 - RNA, 22 nt, Human
ucaaggugcugugcugugcuag

SEQ ID NO: 835935 - RNA, 22 nt, Human
uugucugugaaauggaaauagu

SEQ ID NO: 835936 - RNA, 22 nt, Human
uaagaauuguguugaauagagu

SEQ ID NO: 835937 - RNA, 22 nt, Human
ccaggcaucacgggcauguggc

SEQ ID NO: 835938 - RNA, 22 nt, Human
uauacagaaagaauucaagucu

SEQ ID NO: 835939 - RNA, 22 nt, Human
ccugggcaacauagugagaccc

SEQ ID NO: 835940 - RNA, 22 nt, Human
ggcagugaaaaaguauguuucc

SEQ ID NO: 835941 - RNA, 20 nt, Human
guaaaauauggucuuugggu

SEQ ID NO: 835942 - RNA, 22 nt, Human
acuuucucaggaauucacagac

SEQ ID NO: 835943 - RNA, 22 nt, Human
aaaugauugucaaaguucuguu

SEQ ID NO: 835944 - RNA, 22 nt, Human
auuuucaaaacaucugcugugu

SEQ ID NO: 835945 - RNA, 22 nt, Human
auguuuccagguucuuccuaug

SEQ ID NO: 835946 - RNA, 22 nt, Human
gugcugcucacaucuggaggua

SEQ ID NO: 835947 - RNA, 22 nt, Human
uagucaccucuuuaaauguccu

SEQ ID NO: 835948 - RNA, 19 nt, Human
ugcccaggccagguugggc

SEQ ID NO: 835949 - RNA, 22 nt, Human
gucacaggccuggaugaggggc

SEQ ID NO: 835950 - RNA, 22 nt, Human
gaaggaaaaauacucuguaagg

SEQ ID NO: 835951 - RNA, 22 nt, Human
cuggacuuuggcccaucugcca

SEQ ID NO: 835952 - RNA, 22 nt, Human
ucugggcccuaaaccagcucua

SEQ ID NO: 835953 - RNA, 22 nt, Human
cuguccuaugaguacucacuag

SEQ ID NO: 835954 - RNA, 22 nt, Human
uugaauaauuaauuacacucag

SEQ ID NO: 835955 - RNA, 22 nt, Human
agcacagaguugcagagagcgu

SEQ ID NO: 835956 - RNA, 22 nt, Human
gaggggaagacuucuggacagu

SEQ ID NO: 835957 - RNA, 22 nt, Human
caguuucuacgacuuaagcaca

SEQ ID NO: 835958 - RNA, 22 nt, Human
agucuucagagaaauuaacucu

SEQ ID NO: 835959 - RNA, 22 nt, Human
aggaaaaucgagucuggaggca

SEQ ID NO: 835960 - RNA, 22 nt, Human
agauuuccuaugguaauuauag

SEQ ID NO: 835961 - RNA, 22 nt, Human
caggagaggcuguacguuucuc

SEQ ID NO: 835962 - RNA, 22 nt, Human
ugggcuacucugggagccuaac

SEQ ID NO: 835963 - RNA, 22 nt, Human
gcccaugcucucaggcgggccu

SEQ ID NO: 835964 - RNA, 21 nt, Human
aggcccagcuuuccucuugcu

SEQ ID NO: 835965 - RNA, 22 nt, Human
uaagacaauucuucagucacaa

SEQ ID NO: 835966 - RNA, 22 nt, Human
ugccugcucuuaccacucuccc

SEQ ID NO: 835967 - RNA, 22 nt, Human
gaggggcuggguagggcaaccc

SEQ ID NO: 835968 - RNA, 19 nt, Human
ucccaggaagcaaauguca

SEQ ID NO: 835969 - RNA, 22 nt, Human
auguaguauuuggaaauguaaa

SEQ ID NO: 835970 - RNA, 21 nt, Human
gugguuauuuucauuagcauc

SEQ ID NO: 835971 - RNA, 22 nt, Human
cugcgcagggguggcgccagaa

SEQ ID NO: 835972 - RNA, 22 nt, Human
auuuugcuggucugaauuacuu

SEQ ID NO: 835973 - RNA, 22 nt, Human
ggguuggggcccagcagucugc

SEQ ID NO: 835974 - RNA, 16 nt, Human
cagaguguaaacagga

SEQ ID NO: 835975 - RNA, 22 nt, Human
cuucuugcugggggccucagug

SEQ ID NO: 835976 - RNA, 22 nt, Human
aggagcagaauuuaaugugcag

SEQ ID NO: 835977 - RNA, 22 nt, Human
gccuucaggaggguuccagaca

SEQ ID NO: 835978 - RNA, 22 nt, Human
ucccagaggaaauggcagcuga

SEQ ID NO: 835979 - RNA, 22 nt, Human
ccucugcagcagagagccagag

SEQ ID NO: 835980 - RNA, 22 nt, Human
gugcagguguuuuggcugccag

SEQ ID NO: 835981 - RNA, 19 nt, Human
caucuggaugauucuccug

SEQ ID NO: 835982 - RNA, 22 nt, Human
aggcucagagagcuguguccau

SEQ ID NO: 835983 - RNA, 22 nt, Human
gucaaguuuauccgcucauuca

SEQ ID NO: 835984 - RNA, 22 nt, Human
ugaaaggugacauuucuuggau

SEQ ID NO: 835985 - RNA, 22 nt, Human
agacaaagaaaccguagaagca

SEQ ID NO: 835986 - RNA, 22 nt, Human
uucccaguauuaccuucaggaa

SEQ ID NO: 835987 - RNA, 23 nt, Human
ccucagcauggcaggagcccagc

SEQ ID NO: 835988 - RNA, 22 nt, Human
agcagaugagccucaugacugg

SEQ ID NO: 835989 - RNA, 22 nt, Human
ugcagccaucgcagagucugua

SEQ ID NO: 835990 - RNA, 22 nt, Human
uagaagcaguaauagaaauagg

SEQ ID NO: 835991 - RNA, 22 nt, Human
uugauacauuuuuaggauaaac

SEQ ID NO: 835992 - RNA, 22 nt, Human
ugccucugugugcaggugagca

SEQ ID NO: 835993 - RNA, 22 nt, Human
agcugguuagcaaucuaaguga

SEQ ID NO: 835994 - RNA, 22 nt, Human
cagagccaugguaugggcuugu

SEQ ID NO: 835995 - RNA, 19 nt, Human
cagagcagugguuccugaa

SEQ ID NO: 835996 - RNA, 22 nt, Human
cucccuggaggcccagaccugg

SEQ ID NO: 835997 - RNA, 22 nt, Human
gccucugcaggugcgguuaucc

SEQ ID NO: 835998 - RNA, 22 nt, Human
ugucaugcuuauguuacauacu

SEQ ID NO: 835999 - RNA, 22 nt, Human
uccuuggcuuucuggagcuucu

SEQ ID NO: 836000 - RNA, 22 nt, Human
acacagggauauuucagguggu

SEQ ID NO: 836001 - RNA, 22 nt, Human
cagcucccaguggcagcuccuu

SEQ ID NO: 836002 - RNA, 22 nt, Human
uggagcaggaagucuauggcug

SEQ ID NO: 836003 - RNA, 22 nt, Human
agggacugagcuaggaucuagu

SEQ ID NO: 836004 - RNA, 22 nt, Human
uggcagcagacaaaaggccauu

SEQ ID NO: 836005 - RNA, 22 nt, Human
ugaaggcauugaugaaggaauc

SEQ ID NO: 836006 - RNA, 22 nt, Human
uggcugaacuaaugugcuguuu

SEQ ID NO: 836007 - RNA, 22 nt, Human
uucuucaaacaaaaguggcaug

SEQ ID NO: 836008 - RNA, 22 nt, Human
cacagguggcuccaaguuagag

SEQ ID NO: 836009 - RNA, 22 nt, Human
agggcugcccagugugagagcu

SEQ ID NO: 836010 - RNA, 22 nt, Human
cagugcaugaaacaauaugcag

SEQ ID NO: 836011 - RNA, 20 nt, Human
ugcugucguguuuucugcuu

SEQ ID NO: 836012 - RNA, 22 nt, Human
uccagggagagccgcugcucca

SEQ ID NO: 836013 - RNA, 22 nt, Human
uagaggugacacugagaccaua

SEQ ID NO: 836014 - RNA, 22 nt, Human
auaaggcaucucucaguuagca

SEQ ID NO: 836015 - RNA, 22 nt, Human
aggacuucaucaccuguauaaa

SEQ ID NO: 836016 - RNA, 22 nt, Human
uuuggaaaguguacaaauuuga

SEQ ID NO: 836017 - RNA, 23 nt, Human
uuccacaaugaaaauaaagcagg

SEQ ID NO: 836018 - RNA, 22 nt, Human
acaaagucugaaaccugaggca

SEQ ID NO: 836019 - RNA, 22 nt, Human
augcugugccuucucugugcca

SEQ ID NO: 836020 - RNA, 21 nt, Human
auacauucuauuaagcauuua

SEQ ID NO: 836021 - RNA, 22 nt, Human
auuuaucaccaguuagcugacu

SEQ ID NO: 836022 - RNA, 22 nt, Human
aaaaaugaaacggcugguuggc

SEQ ID NO: 836023 - RNA, 22 nt, Human
ccagagcuucggggcggcugua

SEQ ID NO: 836024 - RNA, 22 nt, Human
gccucugcaccaguacugugcc

SEQ ID NO: 836025 - RNA, 22 nt, Human
cccaggaagaaauucugauuug

SEQ ID NO: 836026 - RNA, 22 nt, Human
gugucccaggccucuggaauua

SEQ ID NO: 836027 - RNA, 22 nt, Human
ccuggcuccugccucugcaggg

SEQ ID NO: 836028 - RNA, 22 nt, Human
cccuggugguacggcacuggca

SEQ ID NO: 836029 - RNA, 22 nt, Human
ggagcugaaggggugggcucag

SEQ ID NO: 836030 - RNA, 23 nt, Human
cagagcuggcucagagcugccug

SEQ ID NO: 836031 - RNA, 22 nt, Human
ggaggccauaguuugggaguca

SEQ ID NO: 836032 - RNA, 22 nt, Human
guacauaaaggaggcucuuugc

SEQ ID NO: 836033 - RNA, 20 nt, Human
uucauucauuccacaacuuc

SEQ ID NO: 836034 - RNA, 22 nt, Human
ccacccuggacaggccucugag

SEQ ID NO: 836035 - RNA, 22 nt, Human
uccucaugccgggucucacgcu

SEQ ID NO: 836036 - RNA, 22 nt, Human
agauacaucuugaacuucuaga

SEQ ID NO: 836037 - RNA, 22 nt, Human
cacagaguggaggcuuggccug

SEQ ID NO: 836038 - RNA, 22 nt, Human
cugggcuguucugccccugggu

SEQ ID NO: 836039 - RNA, 23 nt, Human
gguggcaggaguggaugcugagc

SEQ ID NO: 836040 - RNA, 17 nt, Human
agcuccugcccauggcu

SEQ ID NO: 836041 - RNA, 22 nt, Human
ugagcuucuuuauuuggccaga

SEQ ID NO: 836042 - RNA, 22 nt, Human
uguauguguauguacauaugca

SEQ ID NO: 836043 - RNA, 22 nt, Human
augccuguaaucccagugcuuu

SEQ ID NO: 836044 - RNA, 22 nt, Human
auguuagaaggaauguuaaaag

SEQ ID NO: 836045 - RNA, 22 nt, Human
ucacauuuucauauucucugag

SEQ ID NO: 836046 - RNA, 22 nt, Human
gucauuccuuauguugauucag

SEQ ID NO: 836047 - RNA, 22 nt, Human
acaggugguaaaauggacuguc

SEQ ID NO: 836048 - RNA, 22 nt, Human
agcugcaggccucuccugggga

SEQ ID NO: 836049 - RNA, 22 nt, Human
uguacaaucuuggucccuuuau

SEQ ID NO: 836050 - RNA, 22 nt, Human
uucaucaauguguuuaauaaug

SEQ ID NO: 836051 - RNA, 22 nt, Human
ugcagcugguuuagaacuagau

SEQ ID NO: 836052 - RNA, 22 nt, Human
agccuucagcaguucaggugcc

SEQ ID NO: 836053 - RNA, 19 nt, Human
ucuggcuccugccaggcug

SEQ ID NO: 836054 - RNA, 22 nt, Human
cuucccagaccuuagagugcag

SEQ ID NO: 836055 - RNA, 22 nt, Human
aaguaaaauguuuccuuuauua

SEQ ID NO: 836056 - RNA, 22 nt, Human
cugggcaguuuauucaguucug

SEQ ID NO: 836057 - RNA, 22 nt, Human
ccaggcugagcaugauuggagc

SEQ ID NO: 836058 - RNA, 22 nt, Human
cuggccugaucucaugcugucc

SEQ ID NO: 836059 - RNA, 17 nt, Human
aggcagcucagaacauc

SEQ ID NO: 836060 - RNA, 20 nt, Human
ccagagcugauggcugcccg

SEQ ID NO: 836061 - RNA, 22 nt, Human
ucagucuucccuccagugcaac

SEQ ID NO: 836062 - RNA, 22 nt, Human
uugaaucucuugaaucucuguu

SEQ ID NO: 836063 - RNA, 22 nt, Human
ccaggagcaaagaucacuggga

SEQ ID NO: 836064 - RNA, 22 nt, Human
aaagcucuuuuccaaguauuga

SEQ ID NO: 836065 - RNA, 22 nt, Human
caacagaaggaagcagggucag

SEQ ID NO: 836066 - RNA, 22 nt, Human
ugauuuccacgugcacccaggu

SEQ ID NO: 836067 - RNA, 20 nt, Human
acugcuucuuucucugaccu

SEQ ID NO: 836068 - RNA, 22 nt, Human
uucucauucugacucaguguag

SEQ ID NO: 836069 - RNA, 22 nt, Human
ggcagccauggacacuggcuag

SEQ ID NO: 836070 - RNA, 22 nt, Human
uccagcagggaauuaguagucu

SEQ ID NO: 836071 - RNA, 22 nt, Human
gaggggcugggguugacuccaa

SEQ ID NO: 836072 - RNA, 23 nt, Human
uggagaugccccacucccugucu

SEQ ID NO: 836073 - RNA, 22 nt, Human
ucagagucucccccaguuuggg

SEQ ID NO: 836074 - RNA, 22 nt, Human
aaggagagguuguccguguugu

SEQ ID NO: 836075 - RNA, 22 nt, Human
uaaaauagcaugugcagugaaa

SEQ ID NO: 836076 - RNA, 22 nt, Human
gccuggcugagguggggaggca

SEQ ID NO: 836077 - RNA, 22 nt, Human
uccagaaacuuuuccagucuca

SEQ ID NO: 836078 - RNA, 22 nt, Human
ccuggcucuguccucgcgcaaa

SEQ ID NO: 836079 - RNA, 22 nt, Human
ucuggagccacaaaccucagcu

SEQ ID NO: 836080 - RNA, 22 nt, Human
auuccaaagguuaaugcccauu

SEQ ID NO: 836081 - RNA, 22 nt, Human
acucugcuuauugcugcaggca

SEQ ID NO: 836082 - RNA, 22 nt, Human
gacagcugugcaggagaagggg

SEQ ID NO: 836083 - RNA, 21 nt, Human
uccagggaacuucucaggaau

SEQ ID NO: 836084 - RNA, 22 nt, Human
guagaaaugguguguuucuucu

SEQ ID NO: 836085 - RNA, 22 nt, Human
guauagaaacccagaaagauag

SEQ ID NO: 836086 - RNA, 22 nt, Human
ggacacagauaaucacacagau

SEQ ID NO: 836087 - RNA, 22 nt, Human
ugcccaggguggagugcagcgg

SEQ ID NO: 836088 - RNA, 22 nt, Human
uuugcagugauucuugcaguga

SEQ ID NO: 836089 - RNA, 22 nt, Human
gcagaggcauuucugacgcugc

SEQ ID NO: 836090 - RNA, 22 nt, Human
aaauuucaguuggaaugagcuc

SEQ ID NO: 836091 - RNA, 22 nt, Human
aagcugccacacggugaguacu

SEQ ID NO: 836092 - RNA, 22 nt, Human
uaaauucuacaacuucaaagau

SEQ ID NO: 836093 - RNA, 23 nt, Human
ucacacagcuggucagguacaga

SEQ ID NO: 836094 - RNA, 22 nt, Human
ucuuuccaaggacucuguagca

SEQ ID NO: 836095 - RNA, 22 nt, Human
ucccagagcucuggagguugga

SEQ ID NO: 836096 - RNA, 22 nt, Human
gcuuuaaugcaauuucaccuca

SEQ ID NO: 836097 - RNA, 22 nt, Human
gagcagagacaguacaacuggc

SEQ ID NO: 836098 - RNA, 20 nt, Human
ucagagucaucaaagauggu

SEQ ID NO: 836099 - RNA, 21 nt, Human
uacugagaccucacagugugc

SEQ ID NO: 836100 - RNA, 22 nt, Human
ugggcagagaucuggaucaaac

SEQ ID NO: 836101 - RNA, 22 nt, Human
gcucccuccaugaggcagaccg

SEQ ID NO: 836102 - RNA, 22 nt, Human
uucagggagagcgggacgggug

SEQ ID NO: 836103 - RNA, 22 nt, Human
aguagaaagaaggcacugggcc

SEQ ID NO: 836104 - RNA, 22 nt, Human
ccuggaucuaaggaagcuggga

SEQ ID NO: 836105 - RNA, 23 nt, Human
cagguggcuccacgagggguggg

SEQ ID NO: 836106 - RNA, 22 nt, Human
gccaccucuuugucucugccgc

SEQ ID NO: 836107 - RNA, 22 nt, Human
gaauuucaagcagugcaauguu

SEQ ID NO: 836108 - RNA, 22 nt, Human
ugaggcaggaaguuauauaaug

SEQ ID NO: 836109 - RNA, 22 nt, Human
uagaaaucauuuagaaguauug

SEQ ID NO: 836110 - RNA, 22 nt, Human
ccuguggcucucuuuggagguc

SEQ ID NO: 836111 - RNA, 22 nt, Human
agcuuccuuggcgcugaggccu

SEQ ID NO: 836112 - RNA, 22 nt, Human
agaaauguauagugaauuuuuc

SEQ ID NO: 836113 - RNA, 18 nt, Human
cgaggcaggcggaucacg

SEQ ID NO: 836114 - RNA, 22 nt, Human
guggcugcagagggcacagcau

SEQ ID NO: 836115 - RNA, 22 nt, Human
ugagcccaggaguaugaggcug

SEQ ID NO: 836116 - RNA, 22 nt, Human
aggccucacauugggcuucaag

SEQ ID NO: 836117 - RNA, 22 nt, Human
ccuggcagcauugguagagauu

SEQ ID NO: 836118 - RNA, 22 nt, Human
cuacccagauccaggauggcua

SEQ ID NO: 836119 - RNA, 22 nt, Human
cuggcugccacuucagggucuu

SEQ ID NO: 836120 - RNA, 22 nt, Human
ccuggaucuuucugacugacaa

SEQ ID NO: 836121 - RNA, 22 nt, Human
uuuaucuuuggaucuucagaaa

SEQ ID NO: 836122 - RNA, 22 nt, Human
aagguacaaaguauuauuuaaa

SEQ ID NO: 836123 - RNA, 22 nt, Human
uucagaaaucgaguuucauguc

SEQ ID NO: 836124 - RNA, 22 nt, Human
cuguucacacacuuguacucuc

SEQ ID NO: 836125 - RNA, 22 nt, Human
auucuguauggaaaagcacuau

SEQ ID NO: 836126 - RNA, 22 nt, Human
cuccagggaaaggggcguccgc

SEQ ID NO: 836127 - RNA, 22 nt, Human
gcugcugugccuggcguccugu

SEQ ID NO: 836128 - RNA, 22 nt, Human
cccaugagaccugguuuaaggc

SEQ ID NO: 836129 - RNA, 22 nt, Human
gugaauaagaccuaaggaugaa

SEQ ID NO: 836130 - RNA, 22 nt, Human
agagggcagucucagauuggga

SEQ ID NO: 836131 - RNA, 22 nt, Human
ggcccucccugagccagguggg

SEQ ID NO: 836132 - RNA, 22 nt, Human
agaugaagauaucugcaggggc

SEQ ID NO: 836133 - RNA, 22 nt, Human
aggcaccuugagagcaggagcu

SEQ ID NO: 836134 - RNA, 22 nt, Human
auugucuuuggugcuuccagga

SEQ ID NO: 836135 - RNA, 22 nt, Human
aaaugcauugguuucuacuugu

SEQ ID NO: 836136 - RNA, 22 nt, Human
gcagcuggggccacacuuaggc

SEQ ID NO: 836137 - RNA, 22 nt, Human
caggcagccuucucgucucaca

SEQ ID NO: 836138 - RNA, 22 nt, Human
gcuggccugggcucaagaccag

SEQ ID NO: 836139 - RNA, 22 nt, Human
auuugcuuuuacuauguuaaaa

SEQ ID NO: 836140 - RNA, 22 nt, Human
agguaagggucacaguucauau

SEQ ID NO: 836141 - RNA, 22 nt, Human
cucugaacucuugggcagcaug

SEQ ID NO: 836142 - RNA, 22 nt, Human
ccagccuggacugggucuugug

SEQ ID NO: 836143 - RNA, 22 nt, Human
ggagccuguggcugcuugaagc

SEQ ID NO: 836144 - RNA, 22 nt, Human
aagcagcuuaaauuagagccug

SEQ ID NO: 836145 - RNA, 22 nt, Human
gggagccuugggagugccagcc

SEQ ID NO: 836146 - RNA, 22 nt, Human
cccagcccagcguucgaggggu

SEQ ID NO: 836147 - RNA, 22 nt, Human
ccacagagagugucagccuuug

SEQ ID NO: 836148 - RNA, 22 nt, Human
cauaauuucuguaucagcacca

SEQ ID NO: 836149 - RNA, 22 nt, Human
gagaaagcuucuuucccacagg

SEQ ID NO: 836150 - RNA, 21 nt, Human
gcugcugccccuagugaggcc

SEQ ID NO: 836151 - RNA, 22 nt, Human
ccucuucugcuucaggagcacu

SEQ ID NO: 836152 - RNA, 22 nt, Human
gggcagcucucacagcagccaa

SEQ ID NO: 836153 - RNA, 22 nt, Human
aaaucucacuguagucaaagug

SEQ ID NO: 836154 - RNA, 22 nt, Human
gucccagggagguucagggcuu

SEQ ID NO: 836155 - RNA, 22 nt, Human
uuccaugaaauguguuaugcuu

SEQ ID NO: 836156 - RNA, 22 nt, Human
uagcuagaaugcuucgugauau

SEQ ID NO: 836157 - RNA, 22 nt, Human
ucaugaacaucucaaauaacca

SEQ ID NO: 836158 - RNA, 22 nt, Human
aaaucuggccccuugccuauuu

SEQ ID NO: 836159 - RNA, 22 nt, Human
guuauacauauguguuaacaaa

SEQ ID NO: 836160 - RNA, 22 nt, Human
gagagugaggcaucaggggcag

SEQ ID NO: 836161 - RNA, 22 nt, Human
cuuuauguccaccagacugcaa

SEQ ID NO: 836162 - RNA, 22 nt, Human
cagacuggccacaucugcacug

SEQ ID NO: 836163 - RNA, 22 nt, Human
uggagggcaugcuguccauggg

SEQ ID NO: 836164 - RNA, 22 nt, Human
gugagcagaacagguggcuucu

SEQ ID NO: 836165 - RNA, 22 nt, Human
cuguguggacugguugaggccc

SEQ ID NO: 836166 - RNA, 22 nt, Human
caggagcccagaguccucagcu

SEQ ID NO: 836167 - RNA, 22 nt, Human
gggcccacuggcugucugaccc

SEQ ID NO: 836168 - RNA, 22 nt, Human
agccuggaggccaggagacagu

SEQ ID NO: 836169 - RNA, 22 nt, Human
uggcuaggcuccaagagcugga

SEQ ID NO: 836170 - RNA, 22 nt, Human
guuaauaaagguauagaaucag

SEQ ID NO: 836171 - RNA, 22 nt, Human
ucugcucuguggcuucagcuaa

SEQ ID NO: 836172 - RNA, 20 nt, Human
gccugagcuccgccuccugu

SEQ ID NO: 836173 - RNA, 22 nt, Human
aggucauuacaauuaucauuuu

SEQ ID NO: 836174 - RNA, 22 nt, Human
ucuuugaugugguuaauuauga

SEQ ID NO: 836175 - RNA, 22 nt, Human
gggcugcuuauacugaugauaa

SEQ ID NO: 836176 - RNA, 22 nt, Human
ugaagcuuuccuguggucagga

SEQ ID NO: 836177 - RNA, 21 nt, Human
cauuucaaagagcuggaaauc

SEQ ID NO: 836178 - RNA, 22 nt, Human
aaaguucagauuagacucaaga

SEQ ID NO: 836179 - RNA, 22 nt, Human
acucugccccgaguucugggaa

SEQ ID NO: 836180 - RNA, 22 nt, Human
ggacagagcccugguggccuaa

SEQ ID NO: 836181 - RNA, 22 nt, Human
agaggccaucugcucugugggg

SEQ ID NO: 836182 - RNA, 22 nt, Human
augggaggcagcagagcccagc

SEQ ID NO: 836183 - RNA, 22 nt, Human
acagaauuaucaggaaauguua

SEQ ID NO: 836184 - RNA, 22 nt, Human
auguacauuuguaguaauauca

SEQ ID NO: 836185 - RNA, 22 nt, Human
gacagggcgcccagccuguuuc

SEQ ID NO: 836186 - RNA, 22 nt, Human
ucuuaaaaguaugccaauugga

SEQ ID NO: 836187 - RNA, 22 nt, Human
gugcuuaauacaugucaauaac

SEQ ID NO: 836188 - RNA, 22 nt, Human
uacagaaguaaauaccaaaagc

SEQ ID NO: 836189 - RNA, 23 nt, Human
agaauuccaguuucuuaugucac

SEQ ID NO: 836190 - RNA, 22 nt, Human
gaagaacaccugcugcccagug

SEQ ID NO: 836191 - RNA, 22 nt, Human
ucucugaguaagugacaguuca

SEQ ID NO: 836192 - RNA, 22 nt, Human
aaaguccuuuuugccaugcaag

SEQ ID NO: 836193 - RNA, 22 nt, Human
cagaaucagcccuugcuauuaa

SEQ ID NO: 836194 - RNA, 22 nt, Human
auacagauguugaauguuauau

SEQ ID NO: 836195 - RNA, 22 nt, Human
aaagaaggaccuggaggaggau

SEQ ID NO: 836196 - RNA, 22 nt, Human
ugcuggaggauuaaacaaguca

SEQ ID NO: 836197 - RNA, 22 nt, Human
agccagcuggugggucagcugg

SEQ ID NO: 836198 - RNA, 22 nt, Human
ugcagggcuacaggacuacaac

SEQ ID NO: 836199 - RNA, 22 nt, Human
aauuuacacuucauuuggaggg

SEQ ID NO: 836200 - RNA, 22 nt, Human
agccuggcccugcugaacucug

SEQ ID NO: 836201 - RNA, 22 nt, Human
acugugugaaacaucaaugugu

SEQ ID NO: 836202 - RNA, 22 nt, Human
cagcuggcgggcagagccgcca

SEQ ID NO: 836203 - RNA, 22 nt, Human
uagcaggguccaaugugaggca

SEQ ID NO: 836204 - RNA, 22 nt, Human
uuggcaggaauauugcagaggu

SEQ ID NO: 836205 - RNA, 22 nt, Human
uugaaaggugacauuguuagag

SEQ ID NO: 836206 - RNA, 22 nt, Human
cccagggagguagcaggagaaa

SEQ ID NO: 836207 - RNA, 22 nt, Human
uaaauguguuagucaugguuuu

SEQ ID NO: 836208 - RNA, 22 nt, Human
uucuucaaauagcagggaguca

SEQ ID NO: 836209 - RNA, 18 nt, Human
gggcauggaugcagcauc

SEQ ID NO: 836210 - RNA, 22 nt, Human
uuuccucuucgauuaaguuugg

SEQ ID NO: 836211 - RNA, 22 nt, Human
uuguuacacauaauaacauuuu

SEQ ID NO: 836212 - RNA, 22 nt, Human
uucuuauagaagcaaccauugu

SEQ ID NO: 836213 - RNA, 22 nt, Human
gcagcaggcacggucucgacau

SEQ ID NO: 836214 - RNA, 22 nt, Human
gcagugggaagguuggcacaug

SEQ ID NO: 836215 - RNA, 22 nt, Human
cuggcuuuggucaugugaucau

SEQ ID NO: 836216 - RNA, 22 nt, Human
auucuucagaauaucuggcacu

SEQ ID NO: 836217 - RNA, 22 nt, Human
ggcauuuaauccaucugauuga

SEQ ID NO: 836218 - RNA, 22 nt, Human
ggggcagcucccgagggcagga

SEQ ID NO: 836219 - RNA, 22 nt, Human
ucugaggcuaagagacagaggc

SEQ ID NO: 836220 - RNA, 22 nt, Human
ucagaagaagagacuccacagc

SEQ ID NO: 836221 - RNA, 22 nt, Human
ggagcagagcucuucaucugca

SEQ ID NO: 836222 - RNA, 22 nt, Human
agugcugucaguuuuauagaua

SEQ ID NO: 836223 - RNA, 22 nt, Human
gcugcagcuguaggacacaauu

SEQ ID NO: 836224 - RNA, 22 nt, Human
guggcugcagagccagcaagcu

SEQ ID NO: 836225 - RNA, 21 nt, Human
ggcagccugacccccagagag

SEQ ID NO: 836226 - RNA, 22 nt, Human
cccuucagcugagugggacagc

SEQ ID NO: 836227 - RNA, 22 nt, Human
ucuucacaccgggcagcaggaa

SEQ ID NO: 836228 - RNA, 22 nt, Human
uuuggaauuggcauucuauucu

SEQ ID NO: 836229 - RNA, 22 nt, Human
uguguccauucaggcacugacc

SEQ ID NO: 836230 - RNA, 22 nt, Human
caguccuuauuccuauauuccu

SEQ ID NO: 836231 - RNA, 20 nt, Human
cauuugaaucuccauucugc

SEQ ID NO: 836232 - RNA, 22 nt, Human
cauucauuuaugaaauaucuau

SEQ ID NO: 836233 - RNA, 22 nt, Human
gcaggagacaacuguaaggaga

SEQ ID NO: 836234 - RNA, 19 nt, Human
ucuguucacauuguuucgc

SEQ ID NO: 836235 - RNA, 22 nt, Human
uaacagaaauuuuaguuagggg

SEQ ID NO: 836236 - RNA, 22 nt, Human
aaaugugucaguuucauucucu

SEQ ID NO: 836237 - RNA, 22 nt, Human
ucccaggaagaucccagggacc

SEQ ID NO: 836238 - RNA, 22 nt, Human
ggaggccuugaggccaggagcu

SEQ ID NO: 836239 - RNA, 22 nt, Human
uccaggaggcucugguugacgu

SEQ ID NO: 836240 - RNA, 22 nt, Human
acagugaaugcccaagaaaagu

SEQ ID NO: 836241 - RNA, 22 nt, Human
aggccagguuccucaaucuuga

SEQ ID NO: 836242 - RNA, 22 nt, Human
cuuuccaaugucacuaugaauc

SEQ ID NO: 836243 - RNA, 22 nt, Human
gaggucaggcuugcagcagggu

SEQ ID NO: 836244 - RNA, 22 nt, Human
aaggugucacugggacaggaaa

SEQ ID NO: 836245 - RNA, 22 nt, Human
ucugagagguuaagcaauuuga

SEQ ID NO: 836246 - RNA, 21 nt, Human
cucuggaggcaagggagagug

SEQ ID NO: 836247 - RNA, 22 nt, Human
ccagcccugucaccaacuggag

SEQ ID NO: 836248 - RNA, 22 nt, Human
cugugugcugaaaugcagugag

SEQ ID NO: 836249 - RNA, 22 nt, Human
auucuucauuguugauucaugu

SEQ ID NO: 836250 - RNA, 23 nt, Human
caauuucauaugauucuaccuaa

SEQ ID NO: 836251 - RNA, 22 nt, Human
auucuggauuaucaguccacca

SEQ ID NO: 836252 - RNA, 22 nt, Human
aaaacaguuuaggcaucacagu

SEQ ID NO: 836253 - RNA, 22 nt, Human
gauuucaaguaucuugggcgag

SEQ ID NO: 836254 - RNA, 18 nt, Human
gcaggagauggguggggu

SEQ ID NO: 836255 - RNA, 22 nt, Human
cagcuugggucaggugccugcu

SEQ ID NO: 836256 - RNA, 22 nt, Human
ucacccuugauaauguucuucu

SEQ ID NO: 836257 - RNA, 22 nt, Human
uuuccagguauuaauacuguau

SEQ ID NO: 836258 - RNA, 22 nt, Human
ugaugcugcugggaguggugcu

SEQ ID NO: 836259 - RNA, 22 nt, Human
uguaagaaucagucuuuaaugu

SEQ ID NO: 836260 - RNA, 22 nt, Human
caggaaaggugugucaugaugg

SEQ ID NO: 836261 - RNA, 22 nt, Human
cagcagccuacaaugcacagaa

SEQ ID NO: 836262 - RNA, 22 nt, Human
gcaugcugcaccagagccucuc

SEQ ID NO: 836263 - RNA, 22 nt, Human
ugucccagcagcuggguucucu

SEQ ID NO: 836264 - RNA, 22 nt, Human
gcaggcagucaucuuucauauu

SEQ ID NO: 836265 - RNA, 22 nt, Human
acccaggagcucugggguccuc

SEQ ID NO: 836266 - RNA, 22 nt, Human
agaaauguauucuguauguuuu

SEQ ID NO: 836267 - RNA, 22 nt, Human
guguuuuaagaaagaagcucag

SEQ ID NO: 836268 - RNA, 22 nt, Human
gggcuguggagccgcgagggcu

SEQ ID NO: 836269 - RNA, 20 nt, Human
gccagcacagggagcaguuc

SEQ ID NO: 836270 - RNA, 22 nt, Human
ucgcugugguuucuguacaugg

SEQ ID NO: 836271 - RNA, 22 nt, Human
uccuggagauaauugcagugaa

SEQ ID NO: 836272 - RNA, 22 nt, Human
cuggcagucugccucuucacug

SEQ ID NO: 836273 - RNA, 22 nt, Human
uggcagcugcguuguguuucug

SEQ ID NO: 836274 - RNA, 22 nt, Human
cccagcucucucaguucugcuu

SEQ ID NO: 836275 - RNA, 22 nt, Human
ggccucucuccuuggcuugcag

SEQ ID NO: 836276 - RNA, 22 nt, Human
gcugucuguggugucagcugac

SEQ ID NO: 836277 - RNA, 21 nt, Human
ccagaggccucucuuggccac

SEQ ID NO: 836278 - RNA, 22 nt, Human
gcagagccccauugcuggcggg

SEQ ID NO: 836279 - RNA, 22 nt, Human
ucccaggacuuccaguuggagg

SEQ ID NO: 836280 - RNA, 22 nt, Human
ucucagagggaaaggccaauuu

SEQ ID NO: 836281 - RNA, 22 nt, Human
gaacaauagugguaacaaagcc

SEQ ID NO: 836282 - RNA, 22 nt, Human
ccaguacugucuccaauauucc

SEQ ID NO: 836283 - RNA, 22 nt, Human
gccugagacagugugguccaau

SEQ ID NO: 836284 - RNA, 22 nt, Human
uacaaaguuugggguccucaaa

SEQ ID NO: 836285 - RNA, 22 nt, Human
ugccagaagugcuuuauaagug

SEQ ID NO: 836286 - RNA, 22 nt, Human
uaguccuuuccggcugcuauaa

SEQ ID NO: 836287 - RNA, 22 nt, Human
ucucccacgguacaggauaaac

SEQ ID NO: 836288 - RNA, 22 nt, Human
aggucauuuuugccuucuauuu

SEQ ID NO: 836289 - RNA, 22 nt, Human
caaggcaggcaguucacuugag

SEQ ID NO: 836290 - RNA, 22 nt, Human
ugaagcaggaucguuugcuuca

SEQ ID NO: 836291 - RNA, 22 nt, Human
caagggccuccaccuugcucgu

SEQ ID NO: 836292 - RNA, 22 nt, Human
uucagcaaacacgaugcuuguu

SEQ ID NO: 836293 - RNA, 22 nt, Human
ggcugcucuucuuggcgaccuc

SEQ ID NO: 836294 - RNA, 22 nt, Human
acaaaauuaugaagaggccuug

SEQ ID NO: 836295 - RNA, 22 nt, Human
uuugacaucuaagaauucuuac

SEQ ID NO: 836296 - RNA, 22 nt, Human
aagauuuacuagcauaauagcu

SEQ ID NO: 836297 - RNA, 22 nt, Human
ccugagccugaguggugcaggg

SEQ ID NO: 836298 - RNA, 22 nt, Human
aucaguuuaacugucaagagcc

SEQ ID NO: 836299 - RNA, 22 nt, Human
uuccaggaagauucaacaaaag

SEQ ID NO: 836300 - RNA, 22 nt, Human
agugaaauaaagcugccuaugg

SEQ ID NO: 836301 - RNA, 22 nt, Human
gagaggcugacuggcuguccug

SEQ ID NO: 836302 - RNA, 22 nt, Human
uuacuuuggguccugcuuauaa

SEQ ID NO: 836303 - RNA, 22 nt, Human
gagagggccgggggccagcucc

SEQ ID NO: 836304 - RNA, 20 nt, Human
uaaggcuguuuuguauuccu

SEQ ID NO: 836305 - RNA, 22 nt, Human
ucucccacagccgugcuucaag

SEQ ID NO: 836306 - RNA, 22 nt, Human
gcugcuguugauuuaguccaau

SEQ ID NO: 836307 - RNA, 19 nt, Human
uagcugccuguuaccucca

SEQ ID NO: 836308 - RNA, 20 nt, Human
gggcuggcgcauggggaaag

SEQ ID NO: 836309 - RNA, 22 nt, Human
cagggcugcuggccgugcccuc

SEQ ID NO: 836310 - RNA, 21 nt, Human
aggcacuguuugugguuuggg

SEQ ID NO: 836311 - RNA, 22 nt, Human
cugcucugcagcuuggacuccc

SEQ ID NO: 836312 - RNA, 22 nt, Human
ucuucagagugaaagucuguga

SEQ ID NO: 836313 - RNA, 22 nt, Human
aauaaaaugaacugguagaguu

SEQ ID NO: 836314 - RNA, 22 nt, Human
gagccagcgccuugccucuggg

SEQ ID NO: 836315 - RNA, 22 nt, Human
gccagggaacccaagggccuca

SEQ ID NO: 836316 - RNA, 22 nt, Human
gccauuuagggaggcaagguga

SEQ ID NO: 836317 - RNA, 22 nt, Human
gcccaggauggcuggaggugcu

SEQ ID NO: 836318 - RNA, 22 nt, Human
ccucuggggugagugggccacu

SEQ ID NO: 836319 - RNA, 22 nt, Human
auugcaccuuggguuuugaaag

SEQ ID NO: 836320 - RNA, 22 nt, Human
uccaugagcuagcuuuccaaag

SEQ ID NO: 836321 - RNA, 22 nt, Human
uacuaucucuucuaacuucaga

SEQ ID NO: 836322 - RNA, 22 nt, Human
ucagcagggccuccuugugcag

SEQ ID NO: 836323 - RNA, 22 nt, Human
acagccaggaauucuggagaag

SEQ ID NO: 836324 - RNA, 22 nt, Human
uccauuuucaucucauguauaa

SEQ ID NO: 836325 - RNA, 22 nt, Human
ggcuccugggaugggacugagc

SEQ ID NO: 836326 - RNA, 22 nt, Human
agaggcugggaaggguccccgg

SEQ ID NO: 836327 - RNA, 22 nt, Human
uugcauaaagauuuuauugcau

SEQ ID NO: 836328 - RNA, 22 nt, Human
ggcgugggaaguggggcuucug

SEQ ID NO: 836329 - RNA, 22 nt, Human
acuguguggaccacucugaggc

SEQ ID NO: 836330 - RNA, 22 nt, Human
aggauccuuuuucugcuguuug

SEQ ID NO: 836331 - RNA, 22 nt, Human
auugucgcuuauuuaggugcuu

SEQ ID NO: 836332 - RNA, 19 nt, Human
ucccaggaaccuuuuauuu

SEQ ID NO: 836333 - RNA, 22 nt, Human
caaauguauaaauguacuuucu

SEQ ID NO: 836334 - RNA, 22 nt, Human
gacaggggucccucugggcugu

SEQ ID NO: 836335 - RNA, 22 nt, Human
ugccaggauauaagagugcgau

SEQ ID NO: 836336 - RNA, 22 nt, Human
ugaggcagccugcauuaaagag

SEQ ID NO: 836337 - RNA, 22 nt, Human
uaagacauuugaaaugugaucc

SEQ ID NO: 836338 - RNA, 22 nt, Human
agcauuuauuucuuagaaauug

SEQ ID NO: 836339 - RNA, 22 nt, Human
aggugaguuacaggaggagguc

SEQ ID NO: 836340 - RNA, 22 nt, Human
ucagcagcagcucagcauguuu

SEQ ID NO: 836341 - RNA, 22 nt, Human
ccauggcucuuaccuuguuaua

SEQ ID NO: 836342 - RNA, 22 nt, Human
cugcucugcaaggcacagugau

SEQ ID NO: 836343 - RNA, 22 nt, Human
ugcaucuguucagagcugucga

SEQ ID NO: 836344 - RNA, 22 nt, Human
aucuuguuaaaaugcagaaacu

SEQ ID NO: 836345 - RNA, 20 nt, Human
uuucagugguuugugccuag

SEQ ID NO: 836346 - RNA, 22 nt, Human
gcuggagccuucugcucuguug

SEQ ID NO: 836347 - RNA, 22 nt, Human
uggaaggaagccaaggaagguu

SEQ ID NO: 836348 - RNA, 20 nt, Human
ccugucuccucuuaccuggc

SEQ ID NO: 836349 - RNA, 22 nt, Human
uuccaggggcagcagugauggu

SEQ ID NO: 836350 - RNA, 22 nt, Human
aauguguguucggggcccagag

SEQ ID NO: 836351 - RNA, 22 nt, Human
ccagggcugcugugggacucca

SEQ ID NO: 836352 - RNA, 22 nt, Human
cagaagcacuaggaggaaacgu

SEQ ID NO: 836353 - RNA, 22 nt, Human
uggucucuucuuccaagauggc

SEQ ID NO: 836354 - RNA, 17 nt, Human
gugcagggaugaaggau

SEQ ID NO: 836355 - RNA, 22 nt, Human
gcuccagaugaaaggccagagg

SEQ ID NO: 836356 - RNA, 22 nt, Human
ggucaggguuccagguaucuuc

SEQ ID NO: 836357 - RNA, 22 nt, Human
cucacugcccugaaguuggguu

SEQ ID NO: 836358 - RNA, 22 nt, Human
gggagcugguuccugcccucca

SEQ ID NO: 836359 - RNA, 22 nt, Human
augacaaaagaagacaugaggu

SEQ ID NO: 836360 - RNA, 22 nt, Human
auggaaagugcauggaagucau

SEQ ID NO: 836361 - RNA, 22 nt, Human
acauuucuuagccuaguuccag

SEQ ID NO: 836362 - RNA, 19 nt, Human
ugcucaggccaaggagccc

SEQ ID NO: 836363 - RNA, 22 nt, Human
uggcacugaccccaggccugug

SEQ ID NO: 836364 - RNA, 22 nt, Human
aucagcaaaaaugccuucagaa

SEQ ID NO: 836365 - RNA, 22 nt, Human
agcugccgaugcccagcugcau

SEQ ID NO: 836366 - RNA, 20 nt, Human
cucuggcuccgcgugaccgc

SEQ ID NO: 836367 - RNA, 22 nt, Human
cacacuuugugcuaaucuauuu

SEQ ID NO: 836368 - RNA, 22 nt, Human
caaguccucugguuucaaauag

SEQ ID NO: 836369 - RNA, 22 nt, Human
aaguuucaugauguaauuauug

SEQ ID NO: 836370 - RNA, 22 nt, Human
gcagaggccaucaacuuugcca

SEQ ID NO: 836371 - RNA, 22 nt, Human
cugggcagcuaccaccacugcu

SEQ ID NO: 836372 - RNA, 22 nt, Human
ccagagccugcugagccccauu

SEQ ID NO: 836373 - RNA, 22 nt, Human
guaaaucccauccuuucucugg

SEQ ID NO: 836374 - RNA, 22 nt, Human
uuuccucuccaccaggaggucu

SEQ ID NO: 836375 - RNA, 22 nt, Human
cuggcuuucccuggacaacagc

SEQ ID NO: 836376 - RNA, 22 nt, Human
uaauuucacugauaugaaguca

SEQ ID NO: 836377 - RNA, 22 nt, Human
ucuauacacacaaagaaugcuu

SEQ ID NO: 836378 - RNA, 22 nt, Human
aauuucaaugcacucaugguug

SEQ ID NO: 836379 - RNA, 22 nt, Human
ggcuguccuuggccaaggcacu

SEQ ID NO: 836380 - RNA, 22 nt, Human
ugcauguguguguauuuauaaa

SEQ ID NO: 836381 - RNA, 22 nt, Human
ucuggaucuccagcacuuauca

SEQ ID NO: 836382 - RNA, 22 nt, Human
gaaguccucaaugcauugucuu

SEQ ID NO: 836383 - RNA, 22 nt, Human
aguguccccuccaagggccugg

SEQ ID NO: 836384 - RNA, 22 nt, Human
cugugggcugaaagugcucccg

SEQ ID NO: 836385 - RNA, 22 nt, Human
agugucauuccagggacccucg

SEQ ID NO: 836386 - RNA, 20 nt, Human
uucaggauucuagaccacac

SEQ ID NO: 836387 - RNA, 22 nt, Human
uuguaacagcugcuuaauagag

SEQ ID NO: 836388 - RNA, 22 nt, Human
cagaaaaggaagagcuauguaa

SEQ ID NO: 836389 - RNA, 22 nt, Human
gguggggcccuggcacugguau

SEQ ID NO: 836390 - RNA, 20 nt, Human
agaaucugacccagagagac

SEQ ID NO: 836391 - RNA, 22 nt, Human
uagaacagaggguugcccagau

SEQ ID NO: 836392 - RNA, 22 nt, Human
gcugagagcaguguggccuuaa

SEQ ID NO: 836393 - RNA, 22 nt, Human
auaauucaugggccuuucaccu

SEQ ID NO: 836394 - RNA, 22 nt, Human
uuccaggacuggguguuugaag

SEQ ID NO: 836395 - RNA, 22 nt, Human
aggauuuauuacaagccauggu

SEQ ID NO: 836396 - RNA, 22 nt, Human
aucauucuaguccuuauggucu

SEQ ID NO: 836397 - RNA, 22 nt, Human
uuacaucuaaacugugaacaau

SEQ ID NO: 836398 - RNA, 22 nt, Human
uccucagacacccugcuggcuu

SEQ ID NO: 836399 - RNA, 22 nt, Human
uuucuagaggcuccaggggagu

SEQ ID NO: 836400 - RNA, 22 nt, Human
uuccucagaaaauacuguccaa

SEQ ID NO: 836401 - RNA, 22 nt, Human
uaguaucuuucuauauuuccca

SEQ ID NO: 836402 - RNA, 22 nt, Human
uaucuguuguaguacagaugau

SEQ ID NO: 836403 - RNA, 17 nt, Human
gcucccugaggacagcu

SEQ ID NO: 836404 - RNA, 22 nt, Human
gaggccuggguuggaggugcau

SEQ ID NO: 836405 - RNA, 17 nt, Human
uccuucagugccucugc

SEQ ID NO: 836406 - RNA, 22 nt, Human
gccuggagcagacgugucccgg

SEQ ID NO: 836407 - RNA, 22 nt, Human
ugcugggggugucucaccaggc

SEQ ID NO: 836408 - RNA, 22 nt, Human
auguguccacaggugugagaga

SEQ ID NO: 836409 - RNA, 22 nt, Human
augaccccuaaaauuuacuguc

SEQ ID NO: 836410 - RNA, 22 nt, Human
agauacauauagaaaacaucaa

SEQ ID NO: 836411 - RNA, 22 nt, Human
aggcccugaagucggccccuca

SEQ ID NO: 836412 - RNA, 22 nt, Human
gggucccaggaaggagcagugu

SEQ ID NO: 836413 - RNA, 21 nt, Human
acagauauuucauugaacauu

SEQ ID NO: 836414 - RNA, 22 nt, Human
ccuccaggauaagucagggccu

SEQ ID NO: 836415 - RNA, 22 nt, Human
gguggguuuggaagagcaggcu

SEQ ID NO: 836416 - RNA, 18 nt, Human
cugagggcagccccuggg

SEQ ID NO: 836417 - RNA, 22 nt, Human
ggacucagcagccaggaguggc

SEQ ID NO: 836418 - RNA, 22 nt, Human
acuggaaaugagaugauaucag

SEQ ID NO: 836419 - RNA, 22 nt, Human
gagggggagaugugcacacacu

SEQ ID NO: 836420 - RNA, 22 nt, Human
gggcagcuguaucugagcuuau

SEQ ID NO: 836421 - RNA, 22 nt, Human
agccaacuaggagauuaaggua

SEQ ID NO: 836422 - RNA, 22 nt, Human
gcugguuagaaaacagagcuca

SEQ ID NO: 836423 - RNA, 22 nt, Human
acaggagaauuaucuggaacaa

SEQ ID NO: 836424 - RNA, 22 nt, Human
agcaggaaguagucuguaagca

SEQ ID NO: 836425 - RNA, 22 nt, Human
uaagaaauuuaguuauagaaug

SEQ ID NO: 836426 - RNA, 22 nt, Human
cagagccacugucugccaggca

SEQ ID NO: 836427 - RNA, 22 nt, Human
ucucuucuuguguuuuccugcc

SEQ ID NO: 836428 - RNA, 22 nt, Human
gaggagagaagcuaacggugcu

SEQ ID NO: 836429 - RNA, 22 nt, Human
cacuuaagcaguuaauuuaucu

SEQ ID NO: 836430 - RNA, 18 nt, Human
caguuuuuauaucuggca

SEQ ID NO: 836431 - RNA, 22 nt, Human
aguguuccugcucucaggaagc

SEQ ID NO: 836432 - RNA, 22 nt, Human
ucacauuuucuacuacuguacg

SEQ ID NO: 836433 - RNA, 22 nt, Human
ugggcugcccaagguggccaug

SEQ ID NO: 836434 - RNA, 22 nt, Human
guuucacagucugcagaauuuu

SEQ ID NO: 836435 - RNA, 22 nt, Human
aggagguggccugagcgugccc

SEQ ID NO: 836436 - RNA, 23 nt, Human
cagggaggagauacuguguaucu

SEQ ID NO: 836437 - RNA, 22 nt, Human
uaugauuuguagacauuugauu

SEQ ID NO: 836438 - RNA, 22 nt, Human
gcacagggccuggcacauaaga

SEQ ID NO: 836439 - RNA, 22 nt, Human
uccucugccaaagggaguugcc

SEQ ID NO: 836440 - RNA, 22 nt, Human
aauaacuucaguucuuacauua

SEQ ID NO: 836441 - RNA, 22 nt, Human
gggaguggauuauguggaccca

SEQ ID NO: 836442 - RNA, 22 nt, Human
uagcagggucucaggagucagg

SEQ ID NO: 836443 - RNA, 22 nt, Human
uugucuguaaagacggccacca

SEQ ID NO: 836444 - RNA, 22 nt, Human
uaucuuugcaaauaucucuaag

SEQ ID NO: 836445 - RNA, 22 nt, Human
aagauuauuuaagacaggaacc

SEQ ID NO: 836446 - RNA, 22 nt, Human
aaguuguauauaccgcuuuaag

SEQ ID NO: 836447 - RNA, 22 nt, Human
gaucagaaugggacauauccug

SEQ ID NO: 836448 - RNA, 22 nt, Human
uuuuaaguuaauauaauugagg

SEQ ID NO: 836449 - RNA, 22 nt, Human
uaguuacagcaggcaggauaua

SEQ ID NO: 836450 - RNA, 22 nt, Human
accacuguaucuccagcacauu

SEQ ID NO: 836451 - RNA, 22 nt, Human
ucacuugccuagcccaguucag

SEQ ID NO: 836452 - RNA, 22 nt, Human
cuggcagcucuacucagagccu

SEQ ID NO: 836453 - RNA, 22 nt, Human
uggagagguugaauaacuuguc

SEQ ID NO: 836454 - RNA, 22 nt, Human
cagugcaguuucccagaugcug

SEQ ID NO: 836455 - RNA, 22 nt, Human
acaagaauuuacauguagugga

SEQ ID NO: 836456 - RNA, 22 nt, Human
gagcuguccgccccugggccga

SEQ ID NO: 836457 - RNA, 23 nt, Human
auacauacagucuuacugacuuu

SEQ ID NO: 836458 - RNA, 22 nt, Human
ugcuauaagaauuauauuacuc

SEQ ID NO: 836459 - RNA, 22 nt, Human
uggcaaggcugugggggcagag

SEQ ID NO: 836460 - RNA, 22 nt, Human
agcugggccugagcuggaagcu

SEQ ID NO: 836461 - RNA, 22 nt, Human
cagagccaggccugcccucuuu

SEQ ID NO: 836462 - RNA, 22 nt, Human
uuggcagugucugcaaaaugga

SEQ ID NO: 836463 - RNA, 23 nt, Human
acacaaggguaacugccagccau

SEQ ID NO: 836464 - RNA, 22 nt, Human
gguuauauaauucagugcuuuc

SEQ ID NO: 836465 - RNA, 22 nt, Human
uuguaugaggauagcaagaagc

SEQ ID NO: 836466 - RNA, 22 nt, Human
uccuuuccaugcuucuagaggc

SEQ ID NO: 836467 - RNA, 22 nt, Human
agcugccauggccugaauuuac

SEQ ID NO: 836468 - RNA, 22 nt, Human
cugacucuccucaagcauaaau

SEQ ID NO: 836469 - RNA, 22 nt, Human
uaguaucuauuaguaacaagag

SEQ ID NO: 836470 - RNA, 22 nt, Human
auggaaaggcuguggaaacuua

SEQ ID NO: 836471 - RNA, 22 nt, Human
cuggaagguuccucccagcucc

SEQ ID NO: 836472 - RNA, 22 nt, Human
ugcagaccucccauggcugccu

SEQ ID NO: 836473 - RNA, 22 nt, Human
gccucugcugcaagccugguug

SEQ ID NO: 836474 - RNA, 18 nt, Human
cuccagggaacucaguca

SEQ ID NO: 836475 - RNA, 22 nt, Human
gcucaggaaaacagucuaguaa

SEQ ID NO: 836476 - RNA, 22 nt, Human
cuggagccgcauggagcaggga

SEQ ID NO: 836477 - RNA, 22 nt, Human
gagacauggcaaaagcacuggu

SEQ ID NO: 836478 - RNA, 22 nt, Human
ugaaaugaagggcuuguucugg

SEQ ID NO: 836479 - RNA, 22 nt, Human
cucugcugcccaggccugcuag

SEQ ID NO: 836480 - RNA, 22 nt, Human
aacagaauaguugauguacagu

SEQ ID NO: 836481 - RNA, 22 nt, Human
ucugccuugagguccucagcuc

SEQ ID NO: 836482 - RNA, 22 nt, Human
ggcagggaggaggugaaaguga

SEQ ID NO: 836483 - RNA, 22 nt, Human
ugggagcucagaaagggagguc

SEQ ID NO: 836484 - RNA, 22 nt, Human
acaugucaauuuaguacucuua

SEQ ID NO: 836485 - RNA, 22 nt, Human
uuucuucauagaccuugucuug

SEQ ID NO: 836486 - RNA, 22 nt, Human
cuguacaucucugaggacagua

SEQ ID NO: 836487 - RNA, 22 nt, Human
aaaguucuaaaacucuuuguga

SEQ ID NO: 836488 - RNA, 22 nt, Human
ugggcagaauugugguaguuaa

SEQ ID NO: 836489 - RNA, 22 nt, Human
acccaggacucucuuccaguag

SEQ ID NO: 836490 - RNA, 20 nt, Human
gccuggaggcaaugggaaga

SEQ ID NO: 836491 - RNA, 22 nt, Human
gauggggaugagaagugagcag

SEQ ID NO: 836492 - RNA, 22 nt, Human
uucucugagauagacuaagugg

SEQ ID NO: 836493 - RNA, 22 nt, Human
guugaguggguuaggaugcuga

SEQ ID NO: 836494 - RNA, 22 nt, Human
ggagcuggcuacagagaacucc

SEQ ID NO: 836495 - RNA, 22 nt, Human
gcagaggcuccauuuuacagau

SEQ ID NO: 836496 - RNA, 20 nt, Human
uauggcuuggcaaagcuuca

SEQ ID NO: 836497 - RNA, 22 nt, Human
uguccucacaggaaugaacuuu

SEQ ID NO: 836498 - RNA, 22 nt, Human
caggccugagacaucugagaua

SEQ ID NO: 836499 - RNA, 22 nt, Human
ggucacugcucuaaacaaaagu

SEQ ID NO: 836500 - RNA, 22 nt, Human
aaugagcuagaccugcuuccuc

SEQ ID NO: 836501 - RNA, 22 nt, Human
uacauugcuuucuaauacaucu

SEQ ID NO: 836502 - RNA, 18 nt, Human
cagaugagaugcaaucuc

SEQ ID NO: 836503 - RNA, 22 nt, Human
uggcucaggguccccaaauggu

SEQ ID NO: 836504 - RNA, 22 nt, Human
uccagaauacucugaaaucauu

SEQ ID NO: 836505 - RNA, 17 nt, Human
agguauaaaaugguagc

SEQ ID NO: 836506 - RNA, 22 nt, Human
aagcuuccugaaugcucauuua

SEQ ID NO: 836507 - RNA, 22 nt, Human
caggugggagccacagcguaca

SEQ ID NO: 836508 - RNA, 22 nt, Human
agcaccugucacaagcagaagg

SEQ ID NO: 836509 - RNA, 21 nt, Human
uucucagagucuauuacaguu

SEQ ID NO: 836510 - RNA, 22 nt, Human
gcuuuggaugugugccugaggu

SEQ ID NO: 836511 - RNA, 22 nt, Human
agguaggggguuugggaacugc

SEQ ID NO: 836512 - RNA, 21 nt, Human
aaagaacaggcagauguucuu

SEQ ID NO: 836513 - RNA, 22 nt, Human
uggcugaaggaagauucuucua

SEQ ID NO: 836514 - RNA, 22 nt, Human
cugguccuugacgcgugggagg

SEQ ID NO: 836515 - RNA, 22 nt, Human
ucaggggacuuaggagagaagu

SEQ ID NO: 836516 - RNA, 22 nt, Human
caucagaauuacuuggggagcu

SEQ ID NO: 836517 - RNA, 22 nt, Human
cagcuuccauaagagauggaga

SEQ ID NO: 836518 - RNA, 17 nt, Human
cucagaguugcuuuguc

SEQ ID NO: 836519 - RNA, 22 nt, Human
aagggcuggcccugggaagagu

SEQ ID NO: 836520 - RNA, 22 nt, Human
cugaggccucucuccugggcuu

SEQ ID NO: 836521 - RNA, 22 nt, Human
uccagcagguuggucaggugca

SEQ ID NO: 836522 - RNA, 22 nt, Human
uauuugcaacauaaaacucuga

SEQ ID NO: 836523 - RNA, 22 nt, Human
agcccagguugaggcugcagug

SEQ ID NO: 836524 - RNA, 22 nt, Human
cugaggcucccucgggucugcu

SEQ ID NO: 836525 - RNA, 22 nt, Human
cacagaggaaaggcaguuggua

SEQ ID NO: 836526 - RNA, 22 nt, Human
uuucagcugguaaaggaguagc

SEQ ID NO: 836527 - RNA, 22 nt, Human
cagcugaacauguagagcaucu

SEQ ID NO: 836528 - RNA, 22 nt, Human
ucaauucaauugaacaguuacu

SEQ ID NO: 836529 - RNA, 21 nt, Human
gcagccacugccuucaacaau

SEQ ID NO: 836530 - RNA, 22 nt, Human
gcccaggaucugcucagaucau

SEQ ID NO: 836531 - RNA, 22 nt, Human
ucugggcagcagcagcuaguag

SEQ ID NO: 836532 - RNA, 22 nt, Human
ucucagagagaugaaacuucca

SEQ ID NO: 836533 - RNA, 17 nt, Human
cagacagauauccuggg

SEQ ID NO: 836534 - RNA, 22 nt, Human
uuuguaaaaggaggaagcaugg

SEQ ID NO: 836535 - RNA, 22 nt, Human
cucuggagggaggcugagcugg

SEQ ID NO: 836536 - RNA, 22 nt, Human
aaucauaauuguauacauucau

SEQ ID NO: 836537 - RNA, 22 nt, Human
gcugucugagaacaugguggaa

SEQ ID NO: 836538 - RNA, 20 nt, Human
cugggaggucuuccaaauca

SEQ ID NO: 836539 - RNA, 22 nt, Human
ugaaaugagauaauuuaagugc

SEQ ID NO: 836540 - RNA, 22 nt, Human
ccucuguccuggggaguggagc

SEQ ID NO: 836541 - RNA, 22 nt, Human
ggcaugcucuuuguccacagua

SEQ ID NO: 836542 - RNA, 22 nt, Human
augucacagucugacucaguga

SEQ ID NO: 836543 - RNA, 22 nt, Human
auucauucugaccucaagagaa

SEQ ID NO: 836544 - RNA, 22 nt, Human
gcaggcagagguggaggagaca

SEQ ID NO: 836545 - RNA, 22 nt, Human
ggcacugacacuagcauggcac

SEQ ID NO: 836546 - RNA, 20 nt, Human
uaacuuucuaugcuuucagc

SEQ ID NO: 836547 - RNA, 21 nt, Human
ucucuacacuuucacuaggcu

SEQ ID NO: 836548 - RNA, 22 nt, Human
caggcaggucagugaagaagga

SEQ ID NO: 836549 - RNA, 22 nt, Human
ucuggccaacaaaaacuaaguc

SEQ ID NO: 836550 - RNA, 22 nt, Human
aacugcuguggccuaguacuua

SEQ ID NO: 836551 - RNA, 23 nt, Human
augcucugggcugugggaccugc

SEQ ID NO: 836552 - RNA, 23 nt, Human
ucccagccucuucucuugcauac

SEQ ID NO: 836553 - RNA, 22 nt, Human
gcugucugcaagccaggaaaug

SEQ ID NO: 836554 - RNA, 22 nt, Human
uccucacaagcaagcacaggua

SEQ ID NO: 836555 - RNA, 22 nt, Human
ucugcuguucauucuuuuagcu

SEQ ID NO: 836556 - RNA, 22 nt, Human
guaacauaguuugugcuucauc

SEQ ID NO: 836557 - RNA, 17 nt, Human
caagagagaugacugga

SEQ ID NO: 836558 - RNA, 22 nt, Human
augcuguguggccaccuccaug

SEQ ID NO: 836559 - RNA, 22 nt, Human
cccaaggccucuccuuggcuug

SEQ ID NO: 836560 - RNA, 22 nt, Human
ggcuucuuccugugaacauguu

SEQ ID NO: 836561 - RNA, 22 nt, Human
ugaagccaucaggaagccagca

SEQ ID NO: 836562 - RNA, 17 nt, Human
agcagcuggcacaggag

SEQ ID NO: 836563 - RNA, 22 nt, Human
ccccuuccaggaagcagaaucg

SEQ ID NO: 836564 - RNA, 20 nt, Human
cagcugccuggcucugggau

SEQ ID NO: 836565 - RNA, 22 nt, Human
uuauuuucagcuaggaaagcca

SEQ ID NO: 836566 - RNA, 22 nt, Human
uucauucauuacgugccaggca

SEQ ID NO: 836567 - RNA, 22 nt, Human
aagggagacaguugugugagga

SEQ ID NO: 836568 - RNA, 22 nt, Human
agccuggagaggcgccauacac

SEQ ID NO: 836569 - RNA, 22 nt, Human
gccagcagguggagagaucaag

SEQ ID NO: 836570 - RNA, 22 nt, Human
uccaugagcuagggauucauca

SEQ ID NO: 836571 - RNA, 22 nt, Human
aaaaacugcaauuacuuuuguc

SEQ ID NO: 836572 - RNA, 22 nt, Human
cuggcuuuaacccuacaaaccu

SEQ ID NO: 836573 - RNA, 22 nt, Human
gaaaucugucuuuguuugaaua

SEQ ID NO: 836574 - RNA, 22 nt, Human
uuagaaaucugcugccaugcaa

SEQ ID NO: 836575 - RNA, 22 nt, Human
aaguguguauuguuuaugcugc

SEQ ID NO: 836576 - RNA, 22 nt, Human
ugcacauucacuuagguauugu

SEQ ID NO: 836577 - RNA, 22 nt, Human
auagaaauggcagcuggugcua

SEQ ID NO: 836578 - RNA, 22 nt, Human
uaugaacuagcugauuuaguuu

SEQ ID NO: 836579 - RNA, 18 nt, Human
ucugagggugcgggagcu

SEQ ID NO: 836580 - RNA, 22 nt, Human
uacucagagucauugcccuucu

SEQ ID NO: 836581 - RNA, 22 nt, Human
uccuauugguagacauuucugu

SEQ ID NO: 836582 - RNA, 22 nt, Human
ucucuucugaaaccugucuuua

SEQ ID NO: 836583 - RNA, 22 nt, Human
gaaagauauuuauuggcaacag

SEQ ID NO: 836584 - RNA, 22 nt, Human
gacagguggggaaacuaaggua

SEQ ID NO: 836585 - RNA, 22 nt, Human
aguuacaaccaugacacaagca

SEQ ID NO: 836586 - RNA, 22 nt, Human
ccuauugacaauucucuucucc

SEQ ID NO: 836587 - RNA, 22 nt, Human
uggcagcuauggucuaagggcc

SEQ ID NO: 836588 - RNA, 20 nt, Human
cagagacccaggcuucagcu

SEQ ID NO: 836589 - RNA, 22 nt, Human
gaggagggagcuggaagcucuu

SEQ ID NO: 836590 - RNA, 20 nt, Human
gaaguccuuucacucuuccc

SEQ ID NO: 836591 - RNA, 22 nt, Human
ccaucuccacugucccugucaa

SEQ ID NO: 836592 - RNA, 22 nt, Human
uggacagguugaguaggaggag

SEQ ID NO: 836593 - RNA, 22 nt, Human
ggugaggcagguggcugcugag

SEQ ID NO: 836594 - RNA, 22 nt, Human
agucugucugucacuucugcag

SEQ ID NO: 836595 - RNA, 22 nt, Human
aagauauacuauuaaguaccau

SEQ ID NO: 836596 - RNA, 22 nt, Human
uaugaguacaaggacucugucu

SEQ ID NO: 836597 - RNA, 22 nt, Human
ucaagaaagggcuucaccagga

SEQ ID NO: 836598 - RNA, 21 nt, Human
ccuccaggagcagagcccuga

SEQ ID NO: 836599 - RNA, 22 nt, Human
gagauucuguagucaggcaucu

SEQ ID NO: 836600 - RNA, 22 nt, Human
acaacaaaaucacuagucuucc

SEQ ID NO: 836601 - RNA, 20 nt, Human
auauguguacguguauacau

SEQ ID NO: 836602 - RNA, 23 nt, Human
cccaggaguuucacugcaaaggu

SEQ ID NO: 836603 - RNA, 22 nt, Human
aucaauucuuaggaaaauagcu

SEQ ID NO: 836604 - RNA, 22 nt, Human
cugggaaauggcuucgagcuca

SEQ ID NO: 836605 - RNA, 20 nt, Human
cccugagacaaaggaggggc

SEQ ID NO: 836606 - RNA, 22 nt, Human
aucagaaauugcuaccagugga

SEQ ID NO: 836607 - RNA, 21 nt, Human
agcugcuccagggagcucagg

SEQ ID NO: 836608 - RNA, 22 nt, Human
caauuucagaccuuuccuugga

SEQ ID NO: 836609 - RNA, 22 nt, Human
ugaggggagacagaguggacuc

SEQ ID NO: 836610 - RNA, 22 nt, Human
aggaccaacauagcagcagugg

SEQ ID NO: 836611 - RNA, 22 nt, Human
aaaagccaugcauaccuaagag

SEQ ID NO: 836612 - RNA, 22 nt, Human
cucagaagccuucagucuuggc

SEQ ID NO: 836613 - RNA, 22 nt, Human
cuuaggcagacugcugaugcag

SEQ ID NO: 836614 - RNA, 19 nt, Human
uggggccuccugucccugg

SEQ ID NO: 836615 - RNA, 22 nt, Human
cugggccagucucggccgcucu

SEQ ID NO: 836616 - RNA, 22 nt, Human
aacauauaaacucuuaaguuca

SEQ ID NO: 836617 - RNA, 20 nt, Human
ugaaaaggucaggagacaug

SEQ ID NO: 836618 - RNA, 22 nt, Human
uucuucaugcuguugcugcuug

SEQ ID NO: 836619 - RNA, 22 nt, Human
ugggccuguugggguugaguua

SEQ ID NO: 836620 - RNA, 22 nt, Human
acucuugucucaacuuuuguau

SEQ ID NO: 836621 - RNA, 22 nt, Human
caggguggcccuguggucucau

SEQ ID NO: 836622 - RNA, 21 nt, Human
auacuuugaauuacagccuug

SEQ ID NO: 836623 - RNA, 18 nt, Human
agaaggagcuaugggcag

SEQ ID NO: 836624 - RNA, 22 nt, Human
cccaaggcugcagugagcauga

SEQ ID NO: 836625 - RNA, 22 nt, Human
ucagaaauuuucucaguaguuc

SEQ ID NO: 836626 - RNA, 17 nt, Human
gcugacccuggagaagu

SEQ ID NO: 836627 - RNA, 22 nt, Human
cuugaauccaaaugggagauga

SEQ ID NO: 836628 - RNA, 22 nt, Human
gagccaggucgggccgcggcga

SEQ ID NO: 836629 - RNA, 22 nt, Human
acacacagguaaaggagccugg

SEQ ID NO: 836630 - RNA, 22 nt, Human
gcaagcugaugugauagugaaa

SEQ ID NO: 836631 - RNA, 22 nt, Human
ugacagggugauuaugagagcu

SEQ ID NO: 836632 - RNA, 22 nt, Human
uggggaggacgggcgccuuccu

SEQ ID NO: 836633 - RNA, 22 nt, Human
auguaagguucagaguauguga

SEQ ID NO: 836634 - RNA, 22 nt, Human
gaauuucaacaguccucaaaug

SEQ ID NO: 836635 - RNA, 22 nt, Human
acauuucugagcagggagcugu

SEQ ID NO: 836636 - RNA, 22 nt, Human
agcagagucugugugcacuuua

SEQ ID NO: 836637 - RNA, 22 nt, Human
agugugugcaugcauucgugca

SEQ ID NO: 836638 - RNA, 22 nt, Human
gucuucuuguuuugaaggaaau

SEQ ID NO: 836639 - RNA, 22 nt, Human
agagccaggcaggcaauguuga

SEQ ID NO: 836640 - RNA, 21 nt, Human
ugcugccaucaugcagagaug

SEQ ID NO: 836641 - RNA, 22 nt, Human
gggaggugauuaggaccaugua

SEQ ID NO: 836642 - RNA, 22 nt, Human
auaaaacuuauuagaauugugu

SEQ ID NO: 836643 - RNA, 22 nt, Human
ugaauaauuaugggaguccuaa

SEQ ID NO: 836644 - RNA, 21 nt, Human
ucccacucuaaauggacugaa

SEQ ID NO: 836645 - RNA, 22 nt, Human
gagaggcagaggccugaaaccg

SEQ ID NO: 836646 - RNA, 22 nt, Human
uggcucagccagcccuaggaac

SEQ ID NO: 836647 - RNA, 22 nt, Human
auggccuuagugaugauuaaua

SEQ ID NO: 836648 - RNA, 22 nt, Human
ucagccagcaucagcuaagugc

SEQ ID NO: 836649 - RNA, 22 nt, Human
uuggaaggcccugccuagcagg

SEQ ID NO: 836650 - RNA, 22 nt, Human
ccuggcagcuaagugcuuugag

SEQ ID NO: 836651 - RNA, 22 nt, Human
uugaaagggauauaucuuucug

SEQ ID NO: 836652 - RNA, 17 nt, Human
ugguggcuggagucagg

SEQ ID NO: 836653 - RNA, 22 nt, Human
agacaucagcuugugugcaggg

SEQ ID NO: 836654 - RNA, 22 nt, Human
aggucauuggggacuaucuccg

SEQ ID NO: 836655 - RNA, 22 nt, Human
ugaggccagucucaucacaggc

SEQ ID NO: 836656 - RNA, 22 nt, Human
gccuggucucuuucaugucagu

SEQ ID NO: 836657 - RNA, 22 nt, Human
caggcugaucagggcugggaug

SEQ ID NO: 836658 - RNA, 22 nt, Human
guagaaauagugguugacagga

SEQ ID NO: 836659 - RNA, 22 nt, Human
cauauaauguuugaagaugugg

SEQ ID NO: 836660 - RNA, 22 nt, Human
agcuggcuccagaaggagucgu

SEQ ID NO: 836661 - RNA, 21 nt, Human
acagcagggcuggcaugacag

SEQ ID NO: 836662 - RNA, 22 nt, Human
aguguuccacacaucuggggaa

SEQ ID NO: 836663 - RNA, 22 nt, Human
ccaggcaggcgauggugcagug

SEQ ID NO: 836664 - RNA, 22 nt, Human
auggaguucuuuaaauucacag

SEQ ID NO: 836665 - RNA, 20 nt, Human
ucucuucuggggagauaaaa

SEQ ID NO: 836666 - RNA, 22 nt, Human
acuuggcaaguaucuauaaagu

SEQ ID NO: 836667 - RNA, 22 nt, Human
ccagcuugaagaugugcugguu

SEQ ID NO: 836668 - RNA, 20 nt, Human
ccuaggcaugcugagucucc

SEQ ID NO: 836669 - RNA, 22 nt, Human
uacaguaaccagucuacuuaga

SEQ ID NO: 836670 - RNA, 22 nt, Human
cccaggagguguagcugcgugg

SEQ ID NO: 836671 - RNA, 22 nt, Human
ucugagggugggagaaggagcu

SEQ ID NO: 836672 - RNA, 22 nt, Human
uuugcauuuuagauuuaggccu

SEQ ID NO: 836673 - RNA, 22 nt, Human
ccaaagugcugggguuacaggc

SEQ ID NO: 836674 - RNA, 22 nt, Human
uuacagaaagguugugggauag

SEQ ID NO: 836675 - RNA, 22 nt, Human
ucagucuuugcuuaugacaaua

SEQ ID NO: 836676 - RNA, 22 nt, Human
cugcucugugguccaugagaca

SEQ ID NO: 836677 - RNA, 22 nt, Human
aggucacccguuugacuaucca

SEQ ID NO: 836678 - RNA, 22 nt, Human
ucuguucagguuucagagaacu

SEQ ID NO: 836679 - RNA, 22 nt, Human
auuacaguaacagcuacaaugc

SEQ ID NO: 836680 - RNA, 22 nt, Human
ugucaugccaccguuucccaga

SEQ ID NO: 836681 - RNA, 22 nt, Human
gagcagaugugugccaggaugc

SEQ ID NO: 836682 - RNA, 22 nt, Human
uucucagaauugacugggagca

SEQ ID NO: 836683 - RNA, 22 nt, Human
uuacaaagagugccagagugug

SEQ ID NO: 836684 - RNA, 21 nt, Human
caaguccuuugccaaagugcu

SEQ ID NO: 836685 - RNA, 22 nt, Human
cagagggcucaguccugcugga

SEQ ID NO: 836686 - RNA, 22 nt, Human
cauggcaggugcagauucugug

SEQ ID NO: 836687 - RNA, 22 nt, Human
gcccuuccaacccagagggcaa

SEQ ID NO: 836688 - RNA, 22 nt, Human
ggacuggccggcgcugaggccc

SEQ ID NO: 836689 - RNA, 22 nt, Human
caucuggcuagcuaucauugug

SEQ ID NO: 836690 - RNA, 22 nt, Human
gagcugcugguugcuggugccu

SEQ ID NO: 836691 - RNA, 22 nt, Human
acugaaggcuuaacucuuucau

SEQ ID NO: 836692 - RNA, 22 nt, Human
uacagaguggugagaucuuuug

SEQ ID NO: 836693 - RNA, 22 nt, Human
cccuggaguagcacugggucgc

SEQ ID NO: 836694 - RNA, 22 nt, Human
ucagccucucugaguccagacc

SEQ ID NO: 836695 - RNA, 22 nt, Human
gccucugcggggcccgagcccg

SEQ ID NO: 836696 - RNA, 22 nt, Human
auccuugagccaaugacugauu

SEQ ID NO: 836697 - RNA, 22 nt, Human
uucacagauuucccugcacaug

SEQ ID NO: 836698 - RNA, 22 nt, Human
acagguggccccgagggagugg

SEQ ID NO: 836699 - RNA, 22 nt, Human
uucuuguauauaaaaaucauuu

SEQ ID NO: 836700 - RNA, 22 nt, Human
uaaguaaauuuauaaugugauu

SEQ ID NO: 836701 - RNA, 22 nt, Human
ugaaacacugcgauaaaauccu

SEQ ID NO: 836702 - RNA, 22 nt, Human
ggcugcugcccaccccugcaug

SEQ ID NO: 836703 - RNA, 22 nt, Human
acauaauaggugccugaauauu

SEQ ID NO: 836704 - RNA, 22 nt, Human
agcuucuguucaucuuccaggc

SEQ ID NO: 836705 - RNA, 22 nt, Human
cucagagcaaugaacaugcaaa

SEQ ID NO: 836706 - RNA, 22 nt, Human
agcugccagcaaguuucaaaca

SEQ ID NO: 836707 - RNA, 22 nt, Human
uugcaauagccuuauuuccaaa

SEQ ID NO: 836708 - RNA, 22 nt, Human
ugcagccuugccuccucccagc

SEQ ID NO: 836709 - RNA, 22 nt, Human
cuacccaggcuuagagggcugg

SEQ ID NO: 836710 - RNA, 22 nt, Human
acaaaaagggagaugagguaga

SEQ ID NO: 836711 - RNA, 22 nt, Human
agugcuuucccugaaaccuucc

SEQ ID NO: 836712 - RNA, 22 nt, Human
agucuacaaagaaaaguuauug

SEQ ID NO: 836713 - RNA, 22 nt, Human
agcccaggaaucugcaucuuga

SEQ ID NO: 836714 - RNA, 22 nt, Human
gcugggagcccuggucugcucc

SEQ ID NO: 836715 - RNA, 19 nt, Human
ugcaggaggacugagcaga

SEQ ID NO: 836716 - RNA, 22 nt, Human
uagggcaggugaagaaaagcua

SEQ ID NO: 836717 - RNA, 22 nt, Human
cuuaacagauacaucugugguu

SEQ ID NO: 836718 - RNA, 18 nt, Human
ccgggcuuuggugacaca

SEQ ID NO: 836719 - RNA, 22 nt, Human
ccagggugagaaaaggcuggau

SEQ ID NO: 836720 - RNA, 22 nt, Human
gcugccaugguccaggcuccag

SEQ ID NO: 836721 - RNA, 20 nt, Human
cccugagaccagagagcagc

SEQ ID NO: 836722 - RNA, 22 nt, Human
ggaaagaccugagauaggaaua

SEQ ID NO: 836723 - RNA, 22 nt, Human
ugaaacaaauuuggaaaaucua

SEQ ID NO: 836724 - RNA, 22 nt, Human
gccucugcaugcucagcaccca

SEQ ID NO: 836725 - RNA, 22 nt, Human
agggcagcuaaggugcugacug

SEQ ID NO: 836726 - RNA, 22 nt, Human
cugcugggucuaugcaagugga

SEQ ID NO: 836727 - RNA, 22 nt, Human
gcuccugucuuggggcacuggc

SEQ ID NO: 836728 - RNA, 22 nt, Human
cauuuacagugagaguuuuuac

SEQ ID NO: 836729 - RNA, 22 nt, Human
ucacaccuguaaucccaggccu

SEQ ID NO: 836730 - RNA, 22 nt, Human
agaaugcaguuugaaauaaggu

SEQ ID NO: 836731 - RNA, 22 nt, Human
aagacuuucaaaccuauguuug

SEQ ID NO: 836732 - RNA, 22 nt, Human
gcacugaaaauguuggauucca

SEQ ID NO: 836733 - RNA, 22 nt, Human
cucaggauugugccuagggaga

SEQ ID NO: 836734 - RNA, 22 nt, Human
auugagaauccauuugagauga

SEQ ID NO: 836735 - RNA, 22 nt, Human
guggagccaggggcuguaggua

SEQ ID NO: 836736 - RNA, 16 nt, Human
uuuccaaagggcagcu

SEQ ID NO: 836737 - RNA, 22 nt, Human
ucuuuccuuagaauaauucuuu

SEQ ID NO: 836738 - RNA, 22 nt, Human
uaacagaagaugaaacuucuuu

SEQ ID NO: 836739 - RNA, 22 nt, Human
uaugaaaagguggccaauguag

SEQ ID NO: 836740 - RNA, 22 nt, Human
ucugucacucccugaugaugaa

SEQ ID NO: 836741 - RNA, 22 nt, Human
agagccuguuuugugggagaug

SEQ ID NO: 836742 - RNA, 22 nt, Human
gggccuccggggugagcugugg

SEQ ID NO: 836743 - RNA, 22 nt, Human
ggcaggugcucugugggccugg

SEQ ID NO: 836744 - RNA, 22 nt, Human
augaaaauugacagcggaagua

SEQ ID NO: 836745 - RNA, 22 nt, Human
augggugugaaaauggucaucu

SEQ ID NO: 836746 - RNA, 22 nt, Human
ccacugggcguuucuguccaau

SEQ ID NO: 836747 - RNA, 23 nt, Human
uacaugcuauaauuucacccuca

SEQ ID NO: 836748 - RNA, 22 nt, Human
uugaagcauuucuuugagcuuc

SEQ ID NO: 836749 - RNA, 22 nt, Human
uggucuuuaagguagcugucau

SEQ ID NO: 836750 - RNA, 22 nt, Human
uuuaggcagcuacauacuaacu

SEQ ID NO: 836751 - RNA, 22 nt, Human
agggcagagggugccucaccug

SEQ ID NO: 836752 - RNA, 22 nt, Human
cuguccugcaguugggggcagg

SEQ ID NO: 836753 - RNA, 22 nt, Human
auggcuuucucuaaugugguau

SEQ ID NO: 836754 - RNA, 22 nt, Human
uguaugaaaaggaauagauuga

SEQ ID NO: 836755 - RNA, 20 nt, Human
acugccuugguucaguaggu

SEQ ID NO: 836756 - RNA, 22 nt, Human
gacccaggguuucugcacaggg

SEQ ID NO: 836757 - RNA, 22 nt, Human
uuucuguagugugguauguagg

SEQ ID NO: 836758 - RNA, 22 nt, Human
ggagaugguggaagcuggugca

SEQ ID NO: 836759 - RNA, 23 nt, Human
caugccaguuugugcaggcagau

SEQ ID NO: 836760 - RNA, 22 nt, Human
cccaggucugugccagcucuga

SEQ ID NO: 836761 - RNA, 22 nt, Human
acagauauaaacuauaguagug

SEQ ID NO: 836762 - RNA, 23 nt, Human
aaguaacagggauaauagcaguu

SEQ ID NO: 836763 - RNA, 22 nt, Human
ggccucugcaacuggcuguggc

SEQ ID NO: 836764 - RNA, 22 nt, Human
ugugaaggcagcagcucugucc

SEQ ID NO: 836765 - RNA, 23 nt, Human
agccucuuuucuccugcccugca

SEQ ID NO: 836766 - RNA, 22 nt, Human
cuuauguacacacauauauugu

SEQ ID NO: 836767 - RNA, 22 nt, Human
ccagcagcucccucaggguccg

SEQ ID NO: 836768 - RNA, 17 nt, Human
agaacuguaguagcucc

SEQ ID NO: 836769 - RNA, 22 nt, Human
uagaaaugcccagauucugcua

SEQ ID NO: 836770 - RNA, 22 nt, Human
aagauucuacaguagguacauu

SEQ ID NO: 836771 - RNA, 22 nt, Human
aggaaaggccuuugcauuuggu

SEQ ID NO: 836772 - RNA, 22 nt, Human
gcagggacagggcagggccuuu

SEQ ID NO: 836773 - RNA, 22 nt, Human
uauuuguauuucaugcaguaaa

SEQ ID NO: 836774 - RNA, 22 nt, Human
uggagcagagaugguggccuuc

SEQ ID NO: 836775 - RNA, 22 nt, Human
ucccagccacagguguagcccu

SEQ ID NO: 836776 - RNA, 22 nt, Human
cugcccugucugcagccuggcu

SEQ ID NO: 836777 - RNA, 22 nt, Human
uucauacucacuccaauaacug

SEQ ID NO: 836778 - RNA, 22 nt, Human
aaaggugacacucugccagcug

SEQ ID NO: 836779 - RNA, 22 nt, Human
ugagaauuuucaguuucacuuu

SEQ ID NO: 836780 - RNA, 22 nt, Human
gccugggugucgaucacuagug

SEQ ID NO: 836781 - RNA, 22 nt, Human
ugaaguaacuguccaggaucca

SEQ ID NO: 836782 - RNA, 22 nt, Human
uuucaucuuccuuggcauaggu

SEQ ID NO: 836783 - RNA, 22 nt, Human
aggcacugcuucuaaguaggaa

SEQ ID NO: 836784 - RNA, 22 nt, Human
cugccagcucaaagcgcagcua

SEQ ID NO: 836785 - RNA, 23 nt, Human
uggaggaaacacaucagaagacc

SEQ ID NO: 836786 - RNA, 22 nt, Human
cuuaaagaguauuuaauauaau

SEQ ID NO: 836787 - RNA, 22 nt, Human
cuggccacuggagguggcaccc

SEQ ID NO: 836788 - RNA, 22 nt, Human
gccuucccacccugcgaggcug

SEQ ID NO: 836789 - RNA, 22 nt, Human
ccagcagagggucuuggccauu

SEQ ID NO: 836790 - RNA, 22 nt, Human
ugggccuguggcuuggcucuag

SEQ ID NO: 836791 - RNA, 22 nt, Human
ggcuucuccagguacugagcau

SEQ ID NO: 836792 - RNA, 22 nt, Human
ucucagagauuuuguuucccuu

SEQ ID NO: 836793 - RNA, 22 nt, Human
gucccauaaguagugcaacuug

SEQ ID NO: 836794 - RNA, 21 nt, Human
ugcaggaaagugcugcgaccc

SEQ ID NO: 836795 - RNA, 22 nt, Human
cuccugaguaguagcauuguca

SEQ ID NO: 836796 - RNA, 22 nt, Human
uuguaacacuuuucuauuaaua

SEQ ID NO: 836797 - RNA, 22 nt, Human
uucugaggcacuggcucuccca

SEQ ID NO: 836798 - RNA, 23 nt, Human
uugaaggagaaagcuuucuuggu

SEQ ID NO: 836799 - RNA, 22 nt, Human
uugaaucuauguauucagugua

SEQ ID NO: 836800 - RNA, 22 nt, Human
ucauugucuugauaugauuguc

SEQ ID NO: 836801 - RNA, 22 nt, Human
aaucacuuuucucuaauguagc

SEQ ID NO: 836802 - RNA, 22 nt, Human
cugcagccuccugggguacaug

SEQ ID NO: 836803 - RNA, 22 nt, Human
gggcagaggcucuggcccaucc

SEQ ID NO: 836804 - RNA, 22 nt, Human
gcccaggauucuuucuuccuua

SEQ ID NO: 836805 - RNA, 22 nt, Human
aguggcagagcaggugcuggaa

SEQ ID NO: 836806 - RNA, 22 nt, Human
aagggcaggagaagacggauau

SEQ ID NO: 836807 - RNA, 22 nt, Human
ugagccuggagucguggagggg

SEQ ID NO: 836808 - RNA, 22 nt, Human
agguggggccaaaugcuacagu

SEQ ID NO: 836809 - RNA, 22 nt, Human
uccaggagguaugaguggcccc

SEQ ID NO: 836810 - RNA, 21 nt, Human
guuugcaugaacaagucagcc

SEQ ID NO: 836811 - RNA, 22 nt, Human
acccaggaggcagagguugcag

SEQ ID NO: 836812 - RNA, 22 nt, Human
ugaggcagggaguuuaauuguc

SEQ ID NO: 836813 - RNA, 22 nt, Human
ucuuugcaggccaaauuguuaa

SEQ ID NO: 836814 - RNA, 22 nt, Human
auguaugagagauucuuuuauu

SEQ ID NO: 836815 - RNA, 22 nt, Human
uagcugccuagacagcuauagc

SEQ ID NO: 836816 - RNA, 17 nt, Human
ugcugccaagucccaac

SEQ ID NO: 836817 - RNA, 22 nt, Human
caguuauuaugaggucauuagg

SEQ ID NO: 836818 - RNA, 22 nt, Human
gaggagaggcuggacgcgguga

SEQ ID NO: 836819 - RNA, 18 nt, Human
uggagccauugccaccau

SEQ ID NO: 836820 - RNA, 22 nt, Human
ucauacaucuuguauaucuauc

SEQ ID NO: 836821 - RNA, 22 nt, Human
cuucuucaaccugaaaguuuca

SEQ ID NO: 836822 - RNA, 22 nt, Human
guggcugggcuccgagcggcuu

SEQ ID NO: 836823 - RNA, 22 nt, Human
cuucaagauauuucuagaauca

SEQ ID NO: 836824 - RNA, 22 nt, Human
uaacaguguggacuugagaucu

SEQ ID NO: 836825 - RNA, 22 nt, Human
aggcacugggggaugagcaagg

SEQ ID NO: 836826 - RNA, 22 nt, Human
aaauguauugcauaggauauuu

SEQ ID NO: 836827 - RNA, 22 nt, Human
agagacaggauaucugcucaug

SEQ ID NO: 836828 - RNA, 22 nt, Human
cuuccugcaggacagccaucug

SEQ ID NO: 836829 - RNA, 22 nt, Human
ggucagccuuggauuugguagc

SEQ ID NO: 836830 - RNA, 22 nt, Human
cacagaaguuucauagucucga

SEQ ID NO: 836831 - RNA, 21 nt, Human
ugaaaucugaugggacaaaug

SEQ ID NO: 836832 - RNA, 22 nt, Human
gagcucccaggccccagcaagg

SEQ ID NO: 836833 - RNA, 20 nt, Human
ugccagggccagcagaggcu

SEQ ID NO: 836834 - RNA, 22 nt, Human
ccuccugggcuccugucugcac

SEQ ID NO: 836835 - RNA, 22 nt, Human
agaacagcagcacgucaagcug

SEQ ID NO: 836836 - RNA, 22 nt, Human
guacauuucauuuaaaugaugu

SEQ ID NO: 836837 - RNA, 22 nt, Human
ugcucauuggcgaucugaggga

SEQ ID NO: 836838 - RNA, 22 nt, Human
cuggcugcaggaugaggcugcc

SEQ ID NO: 836839 - RNA, 22 nt, Human
ugggcaagucacuucugucuuu

SEQ ID NO: 836840 - RNA, 22 nt, Human
cucaggaggaggaaguucauug

SEQ ID NO: 836841 - RNA, 22 nt, Human
ugaugcuucacgcugaauaugc

SEQ ID NO: 836842 - RNA, 22 nt, Human
aacagacagaaaaaugugaucu

SEQ ID NO: 836843 - RNA, 22 nt, Human
ucagcugccccaguggccccag

SEQ ID NO: 836844 - RNA, 22 nt, Human
uaccuuuugcuuauuaugacac

SEQ ID NO: 836845 - RNA, 22 nt, Human
aaggcugagggcuguaccuggc

SEQ ID NO: 836846 - RNA, 22 nt, Human
uuauuccaguaaucucuguaau

SEQ ID NO: 836847 - RNA, 22 nt, Human
gggccugugcacaguucuguua

SEQ ID NO: 836848 - RNA, 22 nt, Human
aguuucauauuaccaugucacc

SEQ ID NO: 836849 - RNA, 22 nt, Human
gccggggcuggggagagacaug

SEQ ID NO: 836850 - RNA, 22 nt, Human
ugaggcagucacccccuccugc

SEQ ID NO: 836851 - RNA, 22 nt, Human
uuccuuagacagagguggucau

SEQ ID NO: 836852 - RNA, 22 nt, Human
caggcagcaucagucugcugua

SEQ ID NO: 836853 - RNA, 22 nt, Human
gccuccugaaaggaagagcucc

SEQ ID NO: 836854 - RNA, 22 nt, Human
aggagaguucacacuggucaga

SEQ ID NO: 836855 - RNA, 22 nt, Human
gccagcccagcuccaggggaaa

SEQ ID NO: 836856 - RNA, 22 nt, Human
uugaaaggcacaggcaccuggg

SEQ ID NO: 836857 - RNA, 22 nt, Human
cuuuacagaauaagaauacugg

SEQ ID NO: 836858 - RNA, 22 nt, Human
uuauacuuuauacuacaucauu

SEQ ID NO: 836859 - RNA, 22 nt, Human
uggcagcuagauaguguguuua

SEQ ID NO: 836860 - RNA, 22 nt, Human
ugggaggcuuccagaccuugcu

SEQ ID NO: 836861 - RNA, 22 nt, Human
agccuggauccuaggcucagcu

SEQ ID NO: 836862 - RNA, 22 nt, Human
gccuuccuuuuaccaccagcca

SEQ ID NO: 836863 - RNA, 22 nt, Human
aaagccauugaacuguacuuua

SEQ ID NO: 836864 - RNA, 22 nt, Human
uacaguagacaauguuaguaug

SEQ ID NO: 836865 - RNA, 22 nt, Human
uauaaaauucucaguuuggggu

SEQ ID NO: 836866 - RNA, 22 nt, Human
cugggaggcggagguuguagug

SEQ ID NO: 836867 - RNA, 22 nt, Human
uccagcagguccgagacaaguu

SEQ ID NO: 836868 - RNA, 23 nt, Human
uagaaugucauucaaugauaugg

SEQ ID NO: 836869 - RNA, 22 nt, Human
uuuucucuacaaaauaaccagc

SEQ ID NO: 836870 - RNA, 22 nt, Human
aaaguuuguuauaugauaagga

SEQ ID NO: 836871 - RNA, 22 nt, Human
aaaaguucccugguuagaaaag

SEQ ID NO: 836872 - RNA, 22 nt, Human
ggagcugcucagagccaguccc

SEQ ID NO: 836873 - RNA, 22 nt, Human
cagaggcaggaagaugggcagu

SEQ ID NO: 836874 - RNA, 22 nt, Human
augcugugucaccuuaggauuu

SEQ ID NO: 836875 - RNA, 22 nt, Human
cgaggcagaggcugaaacggcu

SEQ ID NO: 836876 - RNA, 22 nt, Human
cacauugaaaugacccaauaau

SEQ ID NO: 836877 - RNA, 22 nt, Human
acccugggcuuggccugcucag

SEQ ID NO: 836878 - RNA, 22 nt, Human
auucuccacacauccagaccuu

SEQ ID NO: 836879 - RNA, 22 nt, Human
uaucagaaugcagccaugugca

SEQ ID NO: 836880 - RNA, 22 nt, Human
agcaggugacagggcuguggug

SEQ ID NO: 836881 - RNA, 22 nt, Human
accaaggaguuugguauuuuag

SEQ ID NO: 836882 - RNA, 21 nt, Human
acagcauguuuguguguuugc

SEQ ID NO: 836883 - RNA, 22 nt, Human
ucaggauccauagacucccaaa

SEQ ID NO: 836884 - RNA, 23 nt, Human
gaguguucauagcaggcucuugc

SEQ ID NO: 836885 - RNA, 22 nt, Human
ucucuuucuauaugugagucuu

SEQ ID NO: 836886 - RNA, 22 nt, Human
cugccuggcauggagaagagaa

SEQ ID NO: 836887 - RNA, 22 nt, Human
aggcugcuuccuuacguggcug

SEQ ID NO: 836888 - RNA, 22 nt, Human
ucucugauguauaucagagaac

SEQ ID NO: 836889 - RNA, 22 nt, Human
ugaggcaggagguugagaacug

SEQ ID NO: 836890 - RNA, 19 nt, Human
uccccagcaccucugaguc

SEQ ID NO: 836891 - RNA, 22 nt, Human
cccaggagauaacguucccaag

SEQ ID NO: 836892 - RNA, 22 nt, Human
uauggcuugucuuuauaccagg

SEQ ID NO: 836893 - RNA, 22 nt, Human
gcccaggaagccaccgggaagu

SEQ ID NO: 836894 - RNA, 22 nt, Human
acaagagauuaucuacagauga

SEQ ID NO: 836895 - RNA, 22 nt, Human
cauucuuacacaauauuuuaau

SEQ ID NO: 836896 - RNA, 22 nt, Human
uugcaggauuuuagagaugaca

SEQ ID NO: 836897 - RNA, 22 nt, Human
uaaaugaagaaauggagauugu

SEQ ID NO: 836898 - RNA, 22 nt, Human
cuggggcuggugaggcaggcuc

SEQ ID NO: 836899 - RNA, 22 nt, Human
gcagacuguaucaaugucagua

SEQ ID NO: 836900 - RNA, 22 nt, Human
gugcccaggcccaaggcaccac

SEQ ID NO: 836901 - RNA, 22 nt, Human
accugagaaugggggcaugugu

SEQ ID NO: 836902 - RNA, 22 nt, Human
uucacagaauggcaaguuaugg

SEQ ID NO: 836903 - RNA, 19 nt, Human
ugggcuuccccagggcaga

SEQ ID NO: 836904 - RNA, 23 nt, Human
uugucugugcuuuuccaguugcu

SEQ ID NO: 836905 - RNA, 22 nt, Human
cauuucugauuacagaauacua

SEQ ID NO: 836906 - RNA, 22 nt, Human
agggcagcccuucugggagggc

SEQ ID NO: 836907 - RNA, 22 nt, Human
uugauacagcagccugugaucc

SEQ ID NO: 836908 - RNA, 23 nt, Human
guggagccacaucacaggcuccu

SEQ ID NO: 836909 - RNA, 21 nt, Human
ccugagggugguugugaagau

SEQ ID NO: 836910 - RNA, 22 nt, Human
aaaugcacagaggccagagagg

SEQ ID NO: 836911 - RNA, 23 nt, Human
ugggaguguugggaucucugcuc

SEQ ID NO: 836912 - RNA, 22 nt, Human
uuucaguuuccagcuuugucau

SEQ ID NO: 836913 - RNA, 17 nt, Human
ccaggugggaggugggg

SEQ ID NO: 836914 - RNA, 22 nt, Human
augcacgccccacacuggugug

SEQ ID NO: 836915 - RNA, 22 nt, Human
gaggcugcccaacuggagugga

SEQ ID NO: 836916 - RNA, 22 nt, Human
cgcugggcgccgaccugcuggc

SEQ ID NO: 836917 - RNA, 22 nt, Human
cugucaguaggcucccaucauu

SEQ ID NO: 836918 - RNA, 18 nt, Human
uucaccagugugaugggu

SEQ ID NO: 836919 - RNA, 22 nt, Human
gcuggccugggcagccugucgg

SEQ ID NO: 836920 - RNA, 22 nt, Human
ucgugucagaucagagguuccu

SEQ ID NO: 836921 - RNA, 17 nt, Human
caauuucauagguuuug

SEQ ID NO: 836922 - RNA, 22 nt, Human
agcccaagcauaggagggaggc

SEQ ID NO: 836923 - RNA, 22 nt, Human
cuacauuuggagaguauaggaa

SEQ ID NO: 836924 - RNA, 22 nt, Human
uguaugaaccuuuaauauagug

SEQ ID NO: 836925 - RNA, 22 nt, Human
acaugcuuccaaauuauguugg

SEQ ID NO: 836926 - RNA, 22 nt, Human
uuacuacugcuuuacuacuggg

SEQ ID NO: 836927 - RNA, 22 nt, Human
uaaauaugcauguauccuuauc

SEQ ID NO: 836928 - RNA, 22 nt, Human
aaaguauucuugacuguuuuuc

SEQ ID NO: 836929 - RNA, 17 nt, Human
uucucuuccuggauagu

SEQ ID NO: 836930 - RNA, 22 nt, Human
gcaggcagguggcaucuuguga

SEQ ID NO: 836931 - RNA, 19 nt, Human
gcugcuggcucuggcugga

SEQ ID NO: 836932 - RNA, 22 nt, Human
uucugucuguaaacuucucaau

SEQ ID NO: 836933 - RNA, 22 nt, Human
ugcauaauacguuuccuauaac

SEQ ID NO: 836934 - RNA, 22 nt, Human
agggccagcugaugagaaugag

SEQ ID NO: 836935 - RNA, 22 nt, Human
acauuucuugaugccucuguga

SEQ ID NO: 836936 - RNA, 22 nt, Human
ugaaccagagucuccagugguu

SEQ ID NO: 836937 - RNA, 20 nt, Human
cgugcugugaccuugagcau

SEQ ID NO: 836938 - RNA, 21 nt, Human
accaggcuugugggagggagc

SEQ ID NO: 836939 - RNA, 22 nt, Human
acuucucuucauagguggcaau

SEQ ID NO: 836940 - RNA, 22 nt, Human
aaguuuuccuguguccaagaug

SEQ ID NO: 836941 - RNA, 22 nt, Human
uggcucagccauucguguugcc

SEQ ID NO: 836942 - RNA, 23 nt, Human
gugagcagcccacuaggaaugcc

SEQ ID NO: 836943 - RNA, 22 nt, Human
uggcucagcuuuccccaucugg

SEQ ID NO: 836944 - RNA, 22 nt, Human
ggcaaggccuugcccagcauuc

SEQ ID NO: 836945 - RNA, 22 nt, Human
uuacaguaugaucaacuuuuca

SEQ ID NO: 836946 - RNA, 23 nt, Human
accaggagccaagaucucccugg

SEQ ID NO: 836947 - RNA, 22 nt, Human
ggacucuguuuuccugaucacu

SEQ ID NO: 836948 - RNA, 20 nt, Human
ucagggcaugggacagcccc

SEQ ID NO: 836949 - RNA, 22 nt, Human
ugucucaggcccaagccaguaa

SEQ ID NO: 836950 - RNA, 21 nt, Human
uccuccuucaaguccuggccu

SEQ ID NO: 836951 - RNA, 21 nt, Human
gugcuuuuccuuaauguucuu

SEQ ID NO: 836952 - RNA, 22 nt, Human
gccaggcaaauuaaggaaugca

SEQ ID NO: 836953 - RNA, 22 nt, Human
gucccuggggaaucagcuggag

SEQ ID NO: 836954 - RNA, 22 nt, Human
ugucucagaauggcucauaaua

SEQ ID NO: 836955 - RNA, 22 nt, Human
cugcugugcaggugccuaugau

SEQ ID NO: 836956 - RNA, 22 nt, Human
ugauuuccaaaaggcuucuaag

SEQ ID NO: 836957 - RNA, 22 nt, Human
cugcuguguuucugcuagaaaa

SEQ ID NO: 836958 - RNA, 22 nt, Human
guuauguaugagggaaugauua

SEQ ID NO: 836959 - RNA, 22 nt, Human
ggccaggagcaagccaggcucu

SEQ ID NO: 836960 - RNA, 22 nt, Human
aguuugaaauguuggcaauauu

SEQ ID NO: 836961 - RNA, 22 nt, Human
aaaugucuuucaauagagaaau

SEQ ID NO: 836962 - RNA, 22 nt, Human
aguaaaucagaccucauuaugu

SEQ ID NO: 836963 - RNA, 22 nt, Human
gcccagcuccucugcagacccu

SEQ ID NO: 836964 - RNA, 22 nt, Human
gggagggaaggaggcgccgugu

SEQ ID NO: 836965 - RNA, 20 nt, Human
agucccagaucaaauuucug

SEQ ID NO: 836966 - RNA, 22 nt, Human
uuugcauaagucauguccagug

SEQ ID NO: 836967 - RNA, 22 nt, Human
uuguaacagguacuaaauaacu

SEQ ID NO: 836968 - RNA, 22 nt, Human
agggucaggagacacuggcaac

SEQ ID NO: 836969 - RNA, 22 nt, Human
caaacuggcuaugggaaucuug

SEQ ID NO: 836970 - RNA, 22 nt, Human
cagucccaggguugguucagcu

SEQ ID NO: 836971 - RNA, 20 nt, Human
cugagcgucuaagaggugag

SEQ ID NO: 836972 - RNA, 17 nt, Human
agguggcugcugcgccu

SEQ ID NO: 836973 - RNA, 22 nt, Human
aauauuguuucaagaucacaga

SEQ ID NO: 836974 - RNA, 22 nt, Human
gcuugggauaugcugauguaaa

SEQ ID NO: 836975 - RNA, 22 nt, Human
uuccaaaggaauggggagcuau

SEQ ID NO: 836976 - RNA, 22 nt, Human
caguccuggggaccaggcugag

SEQ ID NO: 836977 - RNA, 22 nt, Human
auaaagauuuuuaggcauuucu

SEQ ID NO: 836978 - RNA, 22 nt, Human
ucccagagcccaaguuggagag

SEQ ID NO: 836979 - RNA, 22 nt, Human
cagagcagcagagcuuccaugg

SEQ ID NO: 836980 - RNA, 22 nt, Human
aaaugcacugaacacauguugu

SEQ ID NO: 836981 - RNA, 22 nt, Human
acucagaagauauaaugacuca

SEQ ID NO: 836982 - RNA, 20 nt, Human
cuuugccuauucucugccug

SEQ ID NO: 836983 - RNA, 22 nt, Human
aaaaucugcuuccuuuuacaga

SEQ ID NO: 836984 - RNA, 22 nt, Human
caguuucuucaucaguuaagca

SEQ ID NO: 836985 - RNA, 22 nt, Human
acaagauagcuuagaagauuca

SEQ ID NO: 836986 - RNA, 22 nt, Human
ugcagaaggccugacauugcac

SEQ ID NO: 836987 - RNA, 22 nt, Human
ucaggcuggaaugcaguggggc

SEQ ID NO: 836988 - RNA, 22 nt, Human
uggcagcacuugaacuugagcc

SEQ ID NO: 836989 - RNA, 22 nt, Human
gcuaggagauugagcucugaag

SEQ ID NO: 836990 - RNA, 22 nt, Human
cuacauuuuaauaagcugcuua

SEQ ID NO: 836991 - RNA, 22 nt, Human
aggagaggucucccuuccccag

SEQ ID NO: 836992 - RNA, 22 nt, Human
caaagugcuggaauuacaggug

SEQ ID NO: 836993 - RNA, 21 nt, Human
ggcagcguguggacaggaagg

SEQ ID NO: 836994 - RNA, 22 nt, Human
gccaggcauucuagaaguagug

SEQ ID NO: 836995 - RNA, 22 nt, Human
agaagccagcuucagcugcccg

SEQ ID NO: 836996 - RNA, 22 nt, Human
guguaugauuucaaauggcuag

SEQ ID NO: 836997 - RNA, 21 nt, Human
acagccugucaucucaugguc

SEQ ID NO: 836998 - RNA, 22 nt, Human
ccagauuugagcgucuuaaacc

SEQ ID NO: 836999 - RNA, 22 nt, Human
ugucauaacuuagugacaaauc

SEQ ID NO: 837000 - RNA, 22 nt, Human
aaagaacaauguggaaucuccu

SEQ ID NO: 837001 - RNA, 22 nt, Human
aagauguaucaguuaagucuuc

SEQ ID NO: 837002 - RNA, 22 nt, Human
uucuuccucagcagggcugccu

SEQ ID NO: 837003 - RNA, 22 nt, Human
ucuucauauauaaaguggaaua

SEQ ID NO: 837004 - RNA, 22 nt, Human
aggcuccuaucgcuuucagcaa

SEQ ID NO: 837005 - RNA, 22 nt, Human
uugguacaaugugcuagguagg

SEQ ID NO: 837006 - RNA, 22 nt, Human
cuggccuuuaaaaugaccuuau

SEQ ID NO: 837007 - RNA, 22 nt, Human
ggcagcuuccugagccagcagc

SEQ ID NO: 837008 - RNA, 20 nt, Human
agcauuugaaauaugacuau

SEQ ID NO: 837009 - RNA, 22 nt, Human
gucccugggaugcccuucuggg

SEQ ID NO: 837010 - RNA, 22 nt, Human
agagaacacgugcaucugcaau

SEQ ID NO: 837011 - RNA, 22 nt, Human
aggcagagcuggguuuugaaau

SEQ ID NO: 837012 - RNA, 22 nt, Human
cccuccagagcuugaccugcug

SEQ ID NO: 837013 - RNA, 22 nt, Human
cuaaucaucuuucucuuaaagc

SEQ ID NO: 837014 - RNA, 22 nt, Human
gggcuggcaucaguugccgaga

SEQ ID NO: 837015 - RNA, 22 nt, Human
agccucucuuucugguggcuaa

SEQ ID NO: 837016 - RNA, 22 nt, Human
agagcagcuggggcagagacca

SEQ ID NO: 837017 - RNA, 22 nt, Human
aacaguaucuuuuaucagaaau

SEQ ID NO: 837018 - RNA, 22 nt, Human
gaggauggaggugugagcuaug

SEQ ID NO: 837019 - RNA, 22 nt, Human
ucacuguaucauguugcacuua

SEQ ID NO: 837020 - RNA, 22 nt, Human
gcucuccaaacccuguggcuuu

SEQ ID NO: 837021 - RNA, 22 nt, Human
cagagacauucaguaaauuauc

SEQ ID NO: 837022 - RNA, 17 nt, Human
ugaaaucagcacccagg

SEQ ID NO: 837023 - RNA, 22 nt, Human
cucaaggacuuauucaugccug

SEQ ID NO: 837024 - RNA, 22 nt, Human
aggcagcuggaaaacuccaggc

SEQ ID NO: 837025 - RNA, 22 nt, Human
aacaucuuuuuguuugcugaaa

SEQ ID NO: 837026 - RNA, 19 nt, Human
gggaugggcccucacccuc

SEQ ID NO: 837027 - RNA, 22 nt, Human
ucccagggacugggcuaggcuu

SEQ ID NO: 837028 - RNA, 22 nt, Human
cacaagacuuauuuguguagaa

SEQ ID NO: 837029 - RNA, 22 nt, Human
ccaggguggcguagaugcuggg

SEQ ID NO: 837030 - RNA, 22 nt, Human
cugcugugcagacagacucucu

SEQ ID NO: 837031 - RNA, 22 nt, Human
cccaggaggcagauguugcagu

SEQ ID NO: 837032 - RNA, 18 nt, Human
ggccugaggauuucagca

SEQ ID NO: 837033 - RNA, 22 nt, Human
gcaggagaaaugaagauugggu

SEQ ID NO: 837034 - RNA, 22 nt, Human
gcucugugcaguucagggacac

SEQ ID NO: 837035 - RNA, 19 nt, Human
augauacaggugaaaauug

SEQ ID NO: 837036 - RNA, 22 nt, Human
uugcucaggcuuagagcuacua

SEQ ID NO: 837037 - RNA, 22 nt, Human
uaaauuguuuucuagaaguugu

SEQ ID NO: 837038 - RNA, 22 nt, Human
uucacauuugcccuuaugugug

SEQ ID NO: 837039 - RNA, 22 nt, Human
gcagugcuuuagucuguccuuu

SEQ ID NO: 837040 - RNA, 22 nt, Human
auugaaagagaauguagcucuu

SEQ ID NO: 837041 - RNA, 22 nt, Human
ugaacuccaaauacugcugauu

SEQ ID NO: 837042 - RNA, 22 nt, Human
gauuuccuagacauggggcaga

SEQ ID NO: 837043 - RNA, 22 nt, Human
gccagguggucuggcuccagag

SEQ ID NO: 837044 - RNA, 22 nt, Human
ucugccagaaguucugagagua

SEQ ID NO: 837045 - RNA, 22 nt, Human
uggccuggcucacagugagauu

SEQ ID NO: 837046 - RNA, 22 nt, Human
ccuugcugcgugcuagcacaga

SEQ ID NO: 837047 - RNA, 22 nt, Human
cauuucuguacauguuuuggug

SEQ ID NO: 837048 - RNA, 22 nt, Human
uuugcauuaucucacuuauaua

SEQ ID NO: 837049 - RNA, 22 nt, Human
uugcauuguugcaaugaaguau

SEQ ID NO: 837050 - RNA, 20 nt, Human
aagaaacuugaaaguacaag

SEQ ID NO: 837051 - RNA, 22 nt, Human
caaugugugcuuacaggccagu

SEQ ID NO: 837052 - RNA, 22 nt, Human
uguacaaugcugagguuugggg

SEQ ID NO: 837053 - RNA, 22 nt, Human
aggugcagcugacaccaugugg

SEQ ID NO: 837054 - RNA, 22 nt, Human
cuuaagaugaggucaugcuaua

SEQ ID NO: 837055 - RNA, 22 nt, Human
cugcugugacagcugccguguu

SEQ ID NO: 837056 - RNA, 22 nt, Human
uucauucugggcucuaaggaac

SEQ ID NO: 837057 - RNA, 22 nt, Human
uucaaugagcccggggccauag

SEQ ID NO: 837058 - RNA, 22 nt, Human
uuuaaaauuuagaccucuccac

SEQ ID NO: 837059 - RNA, 22 nt, Human
ccugaagcaaggguaggcaggu

SEQ ID NO: 837060 - RNA, 22 nt, Human
ucuuuaaugugauuguaauuau

SEQ ID NO: 837061 - RNA, 22 nt, Human
acagugcuggcuacaacccugg

SEQ ID NO: 837062 - RNA, 22 nt, Human
gcugccuuuuaaagccucgcuu

SEQ ID NO: 837063 - RNA, 22 nt, Human
cagcuacuccucccaugacuuc

SEQ ID NO: 837064 - RNA, 22 nt, Human
ccuucucuacuccugaugcaug

SEQ ID NO: 837065 - RNA, 22 nt, Human
caucugcuguuccuuggacuca

SEQ ID NO: 837066 - RNA, 22 nt, Human
ccucucauagucuguauccuuu

SEQ ID NO: 837067 - RNA, 22 nt, Human
ugccuggcaaugccagaagcca

SEQ ID NO: 837068 - RNA, 22 nt, Human
uauguguacaucugguugagca

SEQ ID NO: 837069 - RNA, 22 nt, Human
ugcagaaguauuccaggcccca

SEQ ID NO: 837070 - RNA, 21 nt, Human
uggcucugagccucauggcug

SEQ ID NO: 837071 - RNA, 22 nt, Human
uauguuaagugggauaaucaaa

SEQ ID NO: 837072 - RNA, 22 nt, Human
agugaaauggaugcugcuacug

SEQ ID NO: 837073 - RNA, 22 nt, Human
agagccagcauuugacacuggc

SEQ ID NO: 837074 - RNA, 22 nt, Human
ucccagccuuucuuuucugcug

SEQ ID NO: 837075 - RNA, 22 nt, Human
uuucagaugcaauuaauuuuca

SEQ ID NO: 837076 - RNA, 22 nt, Human
caaggagauaaaauguugagcu

SEQ ID NO: 837077 - RNA, 22 nt, Human
uuucagacagauucuucucagu

SEQ ID NO: 837078 - RNA, 22 nt, Human
ugaggcagcaauugauuauuca

SEQ ID NO: 837079 - RNA, 22 nt, Human
agcccagaggcugggcgugcau

SEQ ID NO: 837080 - RNA, 21 nt, Human
agagaagaggacuuucucaca

SEQ ID NO: 837081 - RNA, 22 nt, Human
gggcuggugaggcugcccugca

SEQ ID NO: 837082 - RNA, 22 nt, Human
gcugagcucccagcaguaucug

SEQ ID NO: 837083 - RNA, 22 nt, Human
cugggguggugcaggccucaug

SEQ ID NO: 837084 - RNA, 22 nt, Human
uuggcuuccaggaucucagcag

SEQ ID NO: 837085 - RNA, 22 nt, Human
uggaagcagugauucuugucug

SEQ ID NO: 837086 - RNA, 23 nt, Human
cucugcaggagagugggcagggc

SEQ ID NO: 837087 - RNA, 22 nt, Human
agaauuccuccucugggacacu

SEQ ID NO: 837088 - RNA, 22 nt, Human
ggcuggagauaugucuggaaca

SEQ ID NO: 837089 - RNA, 22 nt, Human
gcagccacuuugcaaccaagag

SEQ ID NO: 837090 - RNA, 22 nt, Human
ggaaggagggcggcaaugauga

SEQ ID NO: 837091 - RNA, 22 nt, Human
cccuggagcugcuugcauguug

SEQ ID NO: 837092 - RNA, 22 nt, Human
cgcagcagccccgugguaggug

SEQ ID NO: 837093 - RNA, 22 nt, Human
ggcucccugccuguccucaguc

SEQ ID NO: 837094 - RNA, 22 nt, Human
ugcagccaauucauucauucuu

SEQ ID NO: 837095 - RNA, 22 nt, Human
uuuaagagcuaguaugucauuu

SEQ ID NO: 837096 - RNA, 22 nt, Human
guuccaaacaagucauaaagua

SEQ ID NO: 837097 - RNA, 22 nt, Human
ggaggccaaggcagguggauca

SEQ ID NO: 837098 - RNA, 17 nt, Human
ugagcaguagaagaugc

SEQ ID NO: 837099 - RNA, 21 nt, Human
uguucacauggagcagaaugu

SEQ ID NO: 837100 - RNA, 22 nt, Human
ggcuccuguggcaagacagcuu

SEQ ID NO: 837101 - RNA, 22 nt, Human
agacuuugagcucuuagagaag

SEQ ID NO: 837102 - RNA, 23 nt, Human
ucugucacuuucugcuguggagu

SEQ ID NO: 837103 - RNA, 22 nt, Human
uuaugcuaagugcaacaagcca

SEQ ID NO: 837104 - RNA, 22 nt, Human
ugcugccucagcuuccugggcu

SEQ ID NO: 837105 - RNA, 22 nt, Human
uauaguaaaauuuucauuuaug

SEQ ID NO: 837106 - RNA, 22 nt, Human
aggccugaaggaagaugagcug

SEQ ID NO: 837107 - RNA, 22 nt, Human
aagagggcagcacagguggguc

SEQ ID NO: 837108 - RNA, 22 nt, Human
aggggcuggcuuaucugagagu

SEQ ID NO: 837109 - RNA, 22 nt, Human
ccauggcauuuuaugugucuua

SEQ ID NO: 837110 - RNA, 21 nt, Human
ucaaagcacauauuugcacau

SEQ ID NO: 837111 - RNA, 22 nt, Human
ucugcugcugagcacacuccua

SEQ ID NO: 837112 - RNA, 22 nt, Human
cugcucucuguuccccuggauc

SEQ ID NO: 837113 - RNA, 22 nt, Human
uuucaaauggagucgugaaaug

SEQ ID NO: 837114 - RNA, 22 nt, Human
ucaagauaccaccauuauaugu

SEQ ID NO: 837115 - RNA, 19 nt, Human
uccugggcugggccagguc

SEQ ID NO: 837116 - RNA, 22 nt, Human
uaauacagaaguguauuaaaau

SEQ ID NO: 837117 - RNA, 22 nt, Human
ugacaauacagagagagcaaaa

SEQ ID NO: 837118 - RNA, 22 nt, Human
ucccagaggcuccagucucuau

SEQ ID NO: 837119 - RNA, 22 nt, Human
aaaugcauuuuuaauuagaccc

SEQ ID NO: 837120 - RNA, 17 nt, Human
ucugccgacugccagcu

SEQ ID NO: 837121 - RNA, 22 nt, Human
caaacugagcaucagaaaguuu

SEQ ID NO: 837122 - RNA, 22 nt, Human
ccugcacuaccuggggcugcug

SEQ ID NO: 837123 - RNA, 22 nt, Human
aggcugcaggucugggucaugu

SEQ ID NO: 837124 - RNA, 22 nt, Human
aguuugaauugaaaugcagaug

SEQ ID NO: 837125 - RNA, 22 nt, Human
ccacugaggcaggcaguaucua

SEQ ID NO: 837126 - RNA, 23 nt, Human
ucugagagaacaaugccuccuau

SEQ ID NO: 837127 - RNA, 22 nt, Human
agggaagcuuguuacugagaag

SEQ ID NO: 837128 - RNA, 22 nt, Human
gagcugucucuauaugaaugcu

SEQ ID NO: 837129 - RNA, 22 nt, Human
gcaggaguuaggcgucguggau

SEQ ID NO: 837130 - RNA, 22 nt, Human
ucugucuccucugaggugccag

SEQ ID NO: 837131 - RNA, 22 nt, Human
aaucgguugaacccaggaagug

SEQ ID NO: 837132 - RNA, 22 nt, Human
cagagggagcccuccaggagca

SEQ ID NO: 837133 - RNA, 22 nt, Human
ugcugccaaaugcgagcucugu

SEQ ID NO: 837134 - RNA, 22 nt, Human
aggcaggugggucacuugaguc

SEQ ID NO: 837135 - RNA, 22 nt, Human
cuggccugaggccgccuucaga

SEQ ID NO: 837136 - RNA, 22 nt, Human
acuggcagcagcagcccuuggg

SEQ ID NO: 837137 - RNA, 22 nt, Human
cuuagaaaucgaacucagguua

SEQ ID NO: 837138 - RNA, 22 nt, Human
aagcuggcaauuaucaaaacug

SEQ ID NO: 837139 - RNA, 22 nt, Human
uguuuaagcugaugagguaucg

SEQ ID NO: 837140 - RNA, 22 nt, Human
cccagacauaacagcagagagg

SEQ ID NO: 837141 - RNA, 22 nt, Human
aggaggggcaaugauagucugg

SEQ ID NO: 837142 - RNA, 22 nt, Human
gcuuccuagaucugugguacuc

SEQ ID NO: 837143 - RNA, 22 nt, Human
augguuuuagaaucaggaaaaa

SEQ ID NO: 837144 - RNA, 22 nt, Human
gcugcccucccagggcaagcuu

SEQ ID NO: 837145 - RNA, 22 nt, Human
uuacagaaggaacacuacucag

SEQ ID NO: 837146 - RNA, 22 nt, Human
uuucuucagccuucacaaccug

SEQ ID NO: 837147 - RNA, 22 nt, Human
aaguucaagaucaagguuccag

SEQ ID NO: 837148 - RNA, 22 nt, Human
cuacagaauucaacaaaugguu

SEQ ID NO: 837149 - RNA, 22 nt, Human
caaauucaaugaacauguuuaa

SEQ ID NO: 837150 - RNA, 22 nt, Human
aggcagagaaaaaccagauaug

SEQ ID NO: 837151 - RNA, 22 nt, Human
ccuggcagguggcgcccucggc

SEQ ID NO: 837152 - RNA, 22 nt, Human
aggcagcugaccacaguaugau

SEQ ID NO: 837153 - RNA, 22 nt, Human
cagguggguacaucacagagac

SEQ ID NO: 837154 - RNA, 22 nt, Human
cacccacccacugcucauuggc

SEQ ID NO: 837155 - RNA, 22 nt, Human
uuccaaacugccaauucagaag

SEQ ID NO: 837156 - RNA, 22 nt, Human
acaaagucacaauaauuaaccu

SEQ ID NO: 837157 - RNA, 22 nt, Human
cauguugaauggccuugauuuu

SEQ ID NO: 837158 - RNA, 22 nt, Human
uacaguuuguuacauuguuagu

SEQ ID NO: 837159 - RNA, 22 nt, Human
aggcggcugguguccugcaggu

SEQ ID NO: 837160 - RNA, 22 nt, Human
gcagagccaggcuggggcaggu

SEQ ID NO: 837161 - RNA, 20 nt, Human
aagauucauuguaauuaggg

SEQ ID NO: 837162 - RNA, 22 nt, Human
gagcagcugguaggugaaccca

SEQ ID NO: 837163 - RNA, 22 nt, Human
gagagcugcagccgagaggggg

SEQ ID NO: 837164 - RNA, 22 nt, Human
accaaggagacaaagguguauu

SEQ ID NO: 837165 - RNA, 22 nt, Human
ccaugagcuucaacugacacag

SEQ ID NO: 837166 - RNA, 20 nt, Human
aauaaacuacugagagaugu

SEQ ID NO: 837167 - RNA, 22 nt, Human
aaacagaaggguagguaaacau

SEQ ID NO: 837168 - RNA, 20 nt, Human
acagaaagagagaaugucag

SEQ ID NO: 837169 - RNA, 22 nt, Human
ccucucccacguggcagaggcu

SEQ ID NO: 837170 - RNA, 22 nt, Human
gcugccucugcgacucugggcg

SEQ ID NO: 837171 - RNA, 23 nt, Human
cauguacagaguuugauaaagug

SEQ ID NO: 837172 - RNA, 22 nt, Human
aguuugaaaguauugacagaag

SEQ ID NO: 837173 - RNA, 22 nt, Human
cccagagcugagucugauauau

SEQ ID NO: 837174 - RNA, 22 nt, Human
ucugucucaaguucuugcacuc

SEQ ID NO: 837175 - RNA, 22 nt, Human
ugggacaguuguccuccacucu

SEQ ID NO: 837176 - RNA, 22 nt, Human
ugaaaucuuagccauucugccu

SEQ ID NO: 837177 - RNA, 22 nt, Human
caggaguggugugagggacucc

SEQ ID NO: 837178 - RNA, 22 nt, Human
caacagucugguuuauauaaua

SEQ ID NO: 837179 - RNA, 22 nt, Human
uguagaaagaauauguuucaua

SEQ ID NO: 837180 - RNA, 22 nt, Human
ugagacaaccuaauuaaacacc

SEQ ID NO: 837181 - RNA, 18 nt, Human
caugucugcgccacaagg

SEQ ID NO: 837182 - RNA, 22 nt, Human
aacagaacccgagugugaaucu

SEQ ID NO: 837183 - RNA, 22 nt, Human
cuggcagcugcccgagaugccc

SEQ ID NO: 837184 - RNA, 22 nt, Human
guuccaaauuuggaucuuuagg

SEQ ID NO: 837185 - RNA, 19 nt, Human
gccugcagaaaaggcaggg

SEQ ID NO: 837186 - RNA, 22 nt, Human
agccaagcacucaacuccugga

SEQ ID NO: 837187 - RNA, 22 nt, Human
aaaguuuguugcuuacaaagaa

SEQ ID NO: 837188 - RNA, 22 nt, Human
uucaagaugccagggacgcggc

SEQ ID NO: 837189 - RNA, 23 nt, Human
cugcagucgccggccugggugcc

SEQ ID NO: 837190 - RNA, 22 nt, Human
uagaaagcuugggguguuuaaa

SEQ ID NO: 837191 - RNA, 20 nt, Human
gugaccagaagacagugggu

SEQ ID NO: 837192 - RNA, 20 nt, Human
gaaguccuguuauauccuuu

SEQ ID NO: 837193 - RNA, 19 nt, Human
aucugccuguuaucacaua

SEQ ID NO: 837194 - RNA, 22 nt, Human
augguuuacaauguuuucaguu

SEQ ID NO: 837195 - RNA, 22 nt, Human
uggaaagaaaaacaggccauga

SEQ ID NO: 837196 - RNA, 22 nt, Human
ucaaguguaguggugucagguc

SEQ ID NO: 837197 - RNA, 22 nt, Human
gcucccagggaccgcagggcag

SEQ ID NO: 837198 - RNA, 22 nt, Human
cagacagaaggcuccuugaggu

SEQ ID NO: 837199 - RNA, 22 nt, Human
gcuucccacagcuggacugggg

SEQ ID NO: 837200 - RNA, 22 nt, Human
cuggcucaccuccgcuccagca

SEQ ID NO: 837201 - RNA, 22 nt, Human
uggcagcuguuaauguuuuguu

SEQ ID NO: 837202 - RNA, 22 nt, Human
gccagggggucagcaggcacuu

SEQ ID NO: 837203 - RNA, 22 nt, Human
agggggcccuugcaggugagcg

SEQ ID NO: 837204 - RNA, 22 nt, Human
gaggagaggggcucccaagagc

SEQ ID NO: 837205 - RNA, 22 nt, Human
cuucucaaaguugugaaucagg

SEQ ID NO: 837206 - RNA, 22 nt, Human
ucaaaccaccuuguuacugggg

SEQ ID NO: 837207 - RNA, 22 nt, Human
ugcucccaaacgaccuacugug

SEQ ID NO: 837208 - RNA, 22 nt, Human
aagaggucauaccagauaaggg

SEQ ID NO: 837209 - RNA, 22 nt, Human
aucuagcaguguuauaauugga

SEQ ID NO: 837210 - RNA, 22 nt, Human
aaaaugugaucuacaaaugcaa

SEQ ID NO: 837211 - RNA, 22 nt, Human
uuucagacaggacuucauaugu

SEQ ID NO: 837212 - RNA, 22 nt, Human
agcucacaguguccuuccucaa

SEQ ID NO: 837213 - RNA, 22 nt, Human
ucuguucagacacuuuacaugu

SEQ ID NO: 837214 - RNA, 22 nt, Human
aagaacagauucagccugaacu

SEQ ID NO: 837215 - RNA, 22 nt, Human
ugacagggcuagaggcaaugca

SEQ ID NO: 837216 - RNA, 22 nt, Human
cagcccucagguccucagcagc

SEQ ID NO: 837217 - RNA, 22 nt, Human
guagggagcccagagcccagug

SEQ ID NO: 837218 - RNA, 22 nt, Human
ucugccugagggagcugaggaa

SEQ ID NO: 837219 - RNA, 22 nt, Human
ucuuugcaaauguuauuaucuu

SEQ ID NO: 837220 - RNA, 22 nt, Human
agaaaugaauauguagugguua

SEQ ID NO: 837221 - RNA, 22 nt, Human
gaggucaauaauaugugcuuua

SEQ ID NO: 837222 - RNA, 22 nt, Human
cagccaggacagggaaacuagu

SEQ ID NO: 837223 - RNA, 22 nt, Human
acauucuagaagucuuugcaau

SEQ ID NO: 837224 - RNA, 22 nt, Human
agucuugcauuuucugaagaug

SEQ ID NO: 837225 - RNA, 22 nt, Human
cagaaauguuuauauguggugu

SEQ ID NO: 837226 - RNA, 20 nt, Human
gcucccagccugcagucccc

SEQ ID NO: 837227 - RNA, 22 nt, Human
aggcugggaaauguagucuucc

SEQ ID NO: 837228 - RNA, 22 nt, Human
cuguauuuucaugccuacguac

SEQ ID NO: 837229 - RNA, 21 nt, Human
acauucacaggauauuaucau

SEQ ID NO: 837230 - RNA, 22 nt, Human
agccugccuugggcugcuugag

SEQ ID NO: 837231 - RNA, 22 nt, Human
auugcuuaucuaucuuuaaguc

SEQ ID NO: 837232 - RNA, 22 nt, Human
guucuaauauuuuaaaagccaa

SEQ ID NO: 837233 - RNA, 22 nt, Human
agaauucucuuccauugaaaca

SEQ ID NO: 837234 - RNA, 22 nt, Human
cugcccugaccugccucagagu

SEQ ID NO: 837235 - RNA, 22 nt, Human
ugcugaugaguccuucuaucgc

SEQ ID NO: 837236 - RNA, 22 nt, Human
cuccucacuuuccagacugggc

SEQ ID NO: 837237 - RNA, 22 nt, Human
agguuuucagcuguauccugag

SEQ ID NO: 837238 - RNA, 22 nt, Human
agcagccaaccuuacauucauc

SEQ ID NO: 837239 - RNA, 22 nt, Human
uuaagaauggaaugaggaauuu

SEQ ID NO: 837240 - RNA, 23 nt, Human
ugcucugugaauaguuggugacu

SEQ ID NO: 837241 - RNA, 22 nt, Human
uagcagcucacagccucccauu

SEQ ID NO: 837242 - RNA, 22 nt, Human
aaauauacuagaugaugaccca

SEQ ID NO: 837243 - RNA, 22 nt, Human
ucaaaugcacguagagaaaaua

SEQ ID NO: 837244 - RNA, 22 nt, Human
cugccuggaaugccagcuucuc

SEQ ID NO: 837245 - RNA, 22 nt, Human
ucaaaugcuucuacuccuaaga

SEQ ID NO: 837246 - RNA, 22 nt, Human
uucuccagaccuugugacuaug

SEQ ID NO: 837247 - RNA, 22 nt, Human
ucuuugcaaaauacaacaaugg

SEQ ID NO: 837248 - RNA, 22 nt, Human
uaguccuuacuuacuagaauaa

SEQ ID NO: 837249 - RNA, 22 nt, Human
ucaaaaguuucacauagagaua

SEQ ID NO: 837250 - RNA, 22 nt, Human
aaguccuuauguggaggggcua

SEQ ID NO: 837251 - RNA, 22 nt, Human
cagagcugcucaugguggccag

SEQ ID NO: 837252 - RNA, 22 nt, Human
ucagaggaccuuacugagaacc

SEQ ID NO: 837253 - RNA, 22 nt, Human
ugcugccuucuaggcgugcccu

SEQ ID NO: 837254 - RNA, 22 nt, Human
cugccacuuucacccagugcuc

SEQ ID NO: 837255 - RNA, 22 nt, Human
cugggccucauccucagaguuu

SEQ ID NO: 837256 - RNA, 22 nt, Human
caggccagguggcaggcaaaac

SEQ ID NO: 837257 - RNA, 22 nt, Human
agagggcagggcgguaaguccu

SEQ ID NO: 837258 - RNA, 22 nt, Human
cuuguauuccccuaucucuaaa

SEQ ID NO: 837259 - RNA, 17 nt, Human
ccagguggaaucgugga

SEQ ID NO: 837260 - RNA, 22 nt, Human
auacaaguugugauaauguaaa

SEQ ID NO: 837261 - RNA, 21 nt, Human
aaagugguaaggauuauuuug

SEQ ID NO: 837262 - RNA, 22 nt, Human
agucccagaucuccauucgguc

SEQ ID NO: 837263 - RNA, 22 nt, Human
gcugccuggagcucagccugcc

SEQ ID NO: 837264 - RNA, 22 nt, Human
gcuggaccaggugugcacaggc

SEQ ID NO: 837265 - RNA, 22 nt, Human
gcaggccugacuguagggggca

SEQ ID NO: 837266 - RNA, 22 nt, Human
acugucacuccaacugagucgu

SEQ ID NO: 837267 - RNA, 22 nt, Human
guacaaaguggaccugauagua

SEQ ID NO: 837268 - RNA, 22 nt, Human
uguaauggaagugggauugcau

SEQ ID NO: 837269 - RNA, 22 nt, Human
cagugguggaaugaggaauugu

SEQ ID NO: 837270 - RNA, 22 nt, Human
ugucagaacucuauugaugucc

SEQ ID NO: 837271 - RNA, 22 nt, Human
uggcugggggugcuauagcugc

SEQ ID NO: 837272 - RNA, 22 nt, Human
cugcccagaaucacucacucga

SEQ ID NO: 837273 - RNA, 22 nt, Human
cuucagaagaaaagcagugugu

SEQ ID NO: 837274 - RNA, 22 nt, Human
cuggcuccacucccugccugac

SEQ ID NO: 837275 - RNA, 22 nt, Human
agcuucuggaagccuggcagca

SEQ ID NO: 837276 - RNA, 19 nt, Human
acagggcagcaauaggaua

SEQ ID NO: 837277 - RNA, 22 nt, Human
cugucccucaucaccucugggu

SEQ ID NO: 837278 - RNA, 22 nt, Human
ggaagagggaaccacgacugua

SEQ ID NO: 837279 - RNA, 20 nt, Human
ugggcagcacugcuggcugg

SEQ ID NO: 837280 - RNA, 22 nt, Human
gccaggcuccccggaucccugg

SEQ ID NO: 837281 - RNA, 22 nt, Human
agaaaugacaagacugaucagg

SEQ ID NO: 837282 - RNA, 22 nt, Human
gugcagcugcaggagucagguc

SEQ ID NO: 837283 - RNA, 22 nt, Human
cugggcucagcccaugcugucc

SEQ ID NO: 837284 - RNA, 22 nt, Human
agaggggaggcgaaccagaguc

SEQ ID NO: 837285 - RNA, 22 nt, Human
aucacaggugguaggaaaagaa

SEQ ID NO: 837286 - RNA, 22 nt, Human
gccagagcacaggcugguagua

SEQ ID NO: 837287 - RNA, 22 nt, Human
aaaugcagaucccugaaucuca

SEQ ID NO: 837288 - RNA, 22 nt, Human
ucuuucaaugagcauucuuucc

SEQ ID NO: 837289 - RNA, 21 nt, Human
agccagcuaucacacagcauu

SEQ ID NO: 837290 - RNA, 22 nt, Human
gaggcagaggaagguggucucu

SEQ ID NO: 837291 - RNA, 22 nt, Human
uacacacaugcauuugccuuau

SEQ ID NO: 837292 - RNA, 22 nt, Human
gaaaucugcuucuugcauagua

SEQ ID NO: 837293 - RNA, 22 nt, Human
uaauuauuugaagacauuagag

SEQ ID NO: 837294 - RNA, 22 nt, Human
ucuuagaaguucauguuccagc

SEQ ID NO: 837295 - RNA, 22 nt, Human
acagccuguuugaucuggugcu

SEQ ID NO: 837296 - RNA, 22 nt, Human
aggcagcagccacaaggccuga

SEQ ID NO: 837297 - RNA, 20 nt, Human
cugggcagguguuugaucuc

SEQ ID NO: 837298 - RNA, 22 nt, Human
auuauauugaguauaaccagag

SEQ ID NO: 837299 - RNA, 22 nt, Human
agagcuuagaauuucagaugau

SEQ ID NO: 837300 - RNA, 20 nt, Human
uggagcugugguaaggagca

SEQ ID NO: 837301 - RNA, 22 nt, Human
aggagagcuggugucuggaauc

SEQ ID NO: 837302 - RNA, 22 nt, Human
uuccucuccucacaugagucac

SEQ ID NO: 837303 - RNA, 22 nt, Human
agaggcggagguugcagugagc

SEQ ID NO: 837304 - RNA, 22 nt, Human
auaaacagcuccauuuagugcc

SEQ ID NO: 837305 - RNA, 22 nt, Human
gcugccugcucggcuccuggga

SEQ ID NO: 837306 - RNA, 22 nt, Human
uauauguaaauaagucuaaugu

SEQ ID NO: 837307 - RNA, 22 nt, Human
ugggauggagccugaguauagu

SEQ ID NO: 837308 - RNA, 20 nt, Human
caggaggcaaggucaagguc

SEQ ID NO: 837309 - RNA, 22 nt, Human
uagggaugacgaaaggacagag

SEQ ID NO: 837310 - RNA, 22 nt, Human
cucccacuccuggcucaccaca

SEQ ID NO: 837311 - RNA, 19 nt, Human
agucccaggcccgaaagag

SEQ ID NO: 837312 - RNA, 22 nt, Human
gggcuggaggugagcaggacag

SEQ ID NO: 837313 - RNA, 22 nt, Human
gaaaauguuagcuucauaguca

SEQ ID NO: 837314 - RNA, 22 nt, Human
acugucugcaaaacucauacuc

SEQ ID NO: 837315 - RNA, 22 nt, Human
uccugcagagacagaggccuca

SEQ ID NO: 837316 - RNA, 22 nt, Human
ccuguucacuuugacuucucca

SEQ ID NO: 837317 - RNA, 22 nt, Human
aaugcacauaaauauggucuua

SEQ ID NO: 837318 - RNA, 22 nt, Human
aggcaggccccugagaauagac

SEQ ID NO: 837319 - RNA, 22 nt, Human
ugcacauuaguguuugagaugc

SEQ ID NO: 837320 - RNA, 22 nt, Human
uccacagaauguaagauccaca

SEQ ID NO: 837321 - RNA, 22 nt, Human
uacaagaaauuucugcauauau

SEQ ID NO: 837322 - RNA, 22 nt, Human
gccaccagguuagauccagccu

SEQ ID NO: 837323 - RNA, 22 nt, Human
gggcuggcucccagguguugaa

SEQ ID NO: 837324 - RNA, 22 nt, Human
aggagcugagggagcgcccuug

SEQ ID NO: 837325 - RNA, 22 nt, Human
ggcuucagugacuggugcccuc

SEQ ID NO: 837326 - RNA, 22 nt, Human
gaguggggcguggauccagcgu

SEQ ID NO: 837327 - RNA, 22 nt, Human
cuacauuaaauuggcuuacuua

SEQ ID NO: 837328 - RNA, 19 nt, Human
ugcagccacgugagagacu

SEQ ID NO: 837329 - RNA, 22 nt, Human
gaggucagucagaccaggguuu

SEQ ID NO: 837330 - RNA, 22 nt, Human
uugcauaaaugcuuaaaauuug

SEQ ID NO: 837331 - RNA, 22 nt, Human
aucagaauaauuagauuucaga

SEQ ID NO: 837332 - RNA, 22 nt, Human
augggaggcagacacuaaguuc

SEQ ID NO: 837333 - RNA, 22 nt, Human
uacuuguagcagguggcauuua

SEQ ID NO: 837334 - RNA, 19 nt, Human
uggagggguuugaaugugg

SEQ ID NO: 837335 - RNA, 22 nt, Human
caguacuuugcaucauuccacu

SEQ ID NO: 837336 - RNA, 22 nt, Human
ggugggcaggucacucugccuc

SEQ ID NO: 837337 - RNA, 22 nt, Human
gccugccuguuggcugaggugc

SEQ ID NO: 837338 - RNA, 22 nt, Human
uuguguccugauuugacacaau

SEQ ID NO: 837339 - RNA, 22 nt, Human
cccaggaggacauuccauaccc

SEQ ID NO: 837340 - RNA, 22 nt, Human
uuauguauggauggcugaaagu

SEQ ID NO: 837341 - RNA, 22 nt, Human
uauuuugucuucugcucaucac

SEQ ID NO: 837342 - RNA, 22 nt, Human
ggcagccauacucagaccuggg

SEQ ID NO: 837343 - RNA, 16 nt, Human
ugggcagaugagaaga

SEQ ID NO: 837344 - RNA, 22 nt, Human
uauggcuuuuuauucaucuuac

SEQ ID NO: 837345 - RNA, 22 nt, Human
gagcacaggcuuugguggacac

SEQ ID NO: 837346 - RNA, 22 nt, Human
uugaaauggaagugaaaauucu

SEQ ID NO: 837347 - RNA, 22 nt, Human
gaaggcugaugacagauucugc

SEQ ID NO: 837348 - RNA, 22 nt, Human
ccugccuggagcugagugugga

SEQ ID NO: 837349 - RNA, 21 nt, Human
gggcagaggggccuccugggu

SEQ ID NO: 837350 - RNA, 22 nt, Human
gcccacagcucguuccucuccu

SEQ ID NO: 837351 - RNA, 22 nt, Human
augugcuucauucuacaugaca

SEQ ID NO: 837352 - RNA, 22 nt, Human
ucuucccuaaucaccaucuuca

SEQ ID NO: 837353 - RNA, 22 nt, Human
gagcucaggagcaucagaagaa

SEQ ID NO: 837354 - RNA, 22 nt, Human
acagaaauuagcagugaguuua

SEQ ID NO: 837355 - RNA, 22 nt, Human
gagccaggcccguacuugcugu

SEQ ID NO: 837356 - RNA, 23 nt, Human
uccaugagaugugggcuucuagu

SEQ ID NO: 837357 - RNA, 22 nt, Human
uccuggaguauuucuguggugu

SEQ ID NO: 837358 - RNA, 22 nt, Human
ucauugcagaaauaaaggugaa

SEQ ID NO: 837359 - RNA, 22 nt, Human
gaguuauuuguagggauuauau

SEQ ID NO: 837360 - RNA, 22 nt, Human
agaucugaaucucauccgagga

SEQ ID NO: 837361 - RNA, 22 nt, Human
ugugcccauuacacagaggcau

SEQ ID NO: 837362 - RNA, 22 nt, Human
cugggcagagcuaacaccugag

SEQ ID NO: 837363 - RNA, 22 nt, Human
cuuauguauaauguuccacaua

SEQ ID NO: 837364 - RNA, 22 nt, Human
cucuggagcaccgggcuaucca

SEQ ID NO: 837365 - RNA, 22 nt, Human
auauaugcauguguacuuaugu

SEQ ID NO: 837366 - RNA, 22 nt, Human
cagggccacuguagaugaggag

SEQ ID NO: 837367 - RNA, 22 nt, Human
ucauacacaagagcauguaaca

SEQ ID NO: 837368 - RNA, 20 nt, Human
uauuuacaacuuagagccuc

SEQ ID NO: 837369 - RNA, 22 nt, Human
ugcaccugagaggucucugagg

SEQ ID NO: 837370 - RNA, 22 nt, Human
uucaugugaauauauuugucuu

SEQ ID NO: 837371 - RNA, 20 nt, Human
ggcagcaggaguuuccucuu

SEQ ID NO: 837372 - RNA, 22 nt, Human
caaaguccuagaacagugcuug

SEQ ID NO: 837373 - RNA, 19 nt, Human
accaggcuuauggucagug

SEQ ID NO: 837374 - RNA, 22 nt, Human
ccucuggucccagcucugcugc

SEQ ID NO: 837375 - RNA, 17 nt, Human
gagagcugcugcuuccg

SEQ ID NO: 837376 - RNA, 22 nt, Human
gagcagugggaaggaacagggu

SEQ ID NO: 837377 - RNA, 22 nt, Human
ugccuucaaucaggauggucuc

SEQ ID NO: 837378 - RNA, 22 nt, Human
cagaguguauucugcaguugca

SEQ ID NO: 837379 - RNA, 22 nt, Human
ccaggaaauagugcugugaucu

SEQ ID NO: 837380 - RNA, 22 nt, Human
agggcugccugcucugcauuga

SEQ ID NO: 837381 - RNA, 22 nt, Human
uaauuacagguccaaaacaauc

SEQ ID NO: 837382 - RNA, 22 nt, Human
gcaggagucacugacuuggucc

SEQ ID NO: 837383 - RNA, 22 nt, Human
cagggcuggcucaugaaaaguu

SEQ ID NO: 837384 - RNA, 22 nt, Human
aaauucuaugucaauguuuauu

SEQ ID NO: 837385 - RNA, 22 nt, Human
gggcagcugcagggauggugac

SEQ ID NO: 837386 - RNA, 22 nt, Human
agauguguuucuaguuccugca

SEQ ID NO: 837387 - RNA, 22 nt, Human
uauaagaaacaaggcaaauuuu

SEQ ID NO: 837388 - RNA, 22 nt, Human
gaugagggccugguggcugugc

SEQ ID NO: 837389 - RNA, 22 nt, Human
uggcauuuucuccuuugaguuu

SEQ ID NO: 837390 - RNA, 22 nt, Human
aucuuccuucacuuucucccac

SEQ ID NO: 837391 - RNA, 22 nt, Human
guuauauauaguauuucucuga

SEQ ID NO: 837392 - RNA, 22 nt, Human
caaaaugugagucccaccucaa

SEQ ID NO: 837393 - RNA, 22 nt, Human
uuccaguuaaggaagcuauucu

SEQ ID NO: 837394 - RNA, 20 nt, Human
agauggugaaggccagggag

SEQ ID NO: 837395 - RNA, 22 nt, Human
ggaggccaucagggagggcauu

SEQ ID NO: 837396 - RNA, 22 nt, Human
cugagacuuucaugugcuuuua

SEQ ID NO: 837397 - RNA, 22 nt, Human
gcccagcaccucucucaggguu

SEQ ID NO: 837398 - RNA, 22 nt, Human
gcugucacaaauauuucucagc

SEQ ID NO: 837399 - RNA, 22 nt, Human
ggagaggugaauggcugcucua

SEQ ID NO: 837400 - RNA, 22 nt, Human
agcaggaguguccccuggcugu

SEQ ID NO: 837401 - RNA, 22 nt, Human
auuugcauaauagugauuugua

SEQ ID NO: 837402 - RNA, 22 nt, Human
uuaucauugucgcagucuaauu

SEQ ID NO: 837403 - RNA, 22 nt, Human
cccuggagggcagacagaugcc

SEQ ID NO: 837404 - RNA, 22 nt, Human
uauuucuguaacucagggucug

SEQ ID NO: 837405 - RNA, 22 nt, Human
acacaggggcucggcugggugc

SEQ ID NO: 837406 - RNA, 22 nt, Human
cuggccuggagccucugggugg

SEQ ID NO: 837407 - RNA, 22 nt, Human
cacuggugacuucugagcugga

SEQ ID NO: 837408 - RNA, 22 nt, Human
ucagagguaagggcugagagga

SEQ ID NO: 837409 - RNA, 22 nt, Human
ugcugggcuugaaagcugcuaa

SEQ ID NO: 837410 - RNA, 22 nt, Human
aggcuuccuggaggaagaggua

SEQ ID NO: 837411 - RNA, 22 nt, Human
gcugggcugagcuagacuuggc

SEQ ID NO: 837412 - RNA, 22 nt, Human
uuaucguacgcuucagaaauuu

SEQ ID NO: 837413 - RNA, 22 nt, Human
aucagaaaguucaucauguuug

SEQ ID NO: 837414 - RNA, 22 nt, Human
ucgagucauguucucccauuaa

SEQ ID NO: 837415 - RNA, 22 nt, Human
cuuugaauuccaguacaauaac

SEQ ID NO: 837416 - RNA, 22 nt, Human
cugccucuguugggcauggucu

SEQ ID NO: 837417 - RNA, 22 nt, Human
uuucacauaaauauuaugccua

SEQ ID NO: 837418 - RNA, 22 nt, Human
aaggucauuguugcauguucuc

SEQ ID NO: 837419 - RNA, 22 nt, Human
uguuuuguuuaugagagcacag

SEQ ID NO: 837420 - RNA, 22 nt, Human
ucugauuagagcauucuugagu

SEQ ID NO: 837421 - RNA, 22 nt, Human
cagcaauauacacagucuaugg

SEQ ID NO: 837422 - RNA, 22 nt, Human
uugcucagcacuggagccagcu

SEQ ID NO: 837423 - RNA, 21 nt, Human
gggagcuggaaacugggugac

SEQ ID NO: 837424 - RNA, 22 nt, Human
aaaugucagaggaacauauuga

SEQ ID NO: 837425 - RNA, 22 nt, Human
ggcucaggccuguaauccuagc

SEQ ID NO: 837426 - RNA, 22 nt, Human
uuccaugacaccgagggaaguc

SEQ ID NO: 837427 - RNA, 22 nt, Human
gcccugggauuggguggaggcu

SEQ ID NO: 837428 - RNA, 22 nt, Human
ugcugcugaucauuuauagucu

SEQ ID NO: 837429 - RNA, 22 nt, Human
guuauguaugggggccuuauga

SEQ ID NO: 837430 - RNA, 22 nt, Human
gcccaggcuggagugcaguagc

SEQ ID NO: 837431 - RNA, 22 nt, Human
uauuucuucgggauucaagcua

SEQ ID NO: 837432 - RNA, 22 nt, Human
aggcacuggguaauuaguagcu

SEQ ID NO: 837433 - RNA, 22 nt, Human
uggcucugaucagauguccagu

SEQ ID NO: 837434 - RNA, 23 nt, Human
uuucuucagaagccuugcgaggc

SEQ ID NO: 837435 - RNA, 22 nt, Human
agucucagcaagcauggcuagu

SEQ ID NO: 837436 - RNA, 22 nt, Human
accugccucuaagcagcaggug

SEQ ID NO: 837437 - RNA, 20 nt, Human
aggcucagagcaguaguaca

SEQ ID NO: 837438 - RNA, 22 nt, Human
cccagacucaucccugggagcu

SEQ ID NO: 837439 - RNA, 22 nt, Human
aucuggguucaccaugcuccug

SEQ ID NO: 837440 - RNA, 22 nt, Human
cagcuggcguggagugauugca

SEQ ID NO: 837441 - RNA, 22 nt, Human
uuugaaguguuauuucuaucac

SEQ ID NO: 837442 - RNA, 22 nt, Human
gaaaugcaggcuuggauucagc

SEQ ID NO: 837443 - RNA, 18 nt, Human
uuucacaaccuccagagg

SEQ ID NO: 837444 - RNA, 22 nt, Human
gaugaggggucauuggcuggga

SEQ ID NO: 837445 - RNA, 17 nt, Human
cugagcauccgugcucu

SEQ ID NO: 837446 - RNA, 22 nt, Human
cccaugccuucugacucacagg

SEQ ID NO: 837447 - RNA, 22 nt, Human
agggggugcccagaugaaggau

SEQ ID NO: 837448 - RNA, 22 nt, Human
cagaguccuggacacagagaca

SEQ ID NO: 837449 - RNA, 22 nt, Human
aguagaauagauggauacuauu

SEQ ID NO: 837450 - RNA, 22 nt, Human
gcauucuuuuuaggagguuccu

SEQ ID NO: 837451 - RNA, 22 nt, Human
acuuauuagcugugugaccuug

SEQ ID NO: 837452 - RNA, 22 nt, Human
agugaguggguuacagauggga

SEQ ID NO: 837453 - RNA, 22 nt, Human
uagagcauuuagaggggcagga

SEQ ID NO: 837454 - RNA, 22 nt, Human
cugacagucucauugauuugcu

SEQ ID NO: 837455 - RNA, 22 nt, Human
gaaggaggugucaguuggacug

SEQ ID NO: 837456 - RNA, 19 nt, Human
cuggcagccugucuguguc

SEQ ID NO: 837457 - RNA, 22 nt, Human
uuccauaacugaccgaaugcau

SEQ ID NO: 837458 - RNA, 22 nt, Human
cuccucccugcgauugcucugc

SEQ ID NO: 837459 - RNA, 22 nt, Human
uggcagcucccagagcuuccaa

SEQ ID NO: 837460 - RNA, 22 nt, Human
uucugucacuuuuuuggaaucu

SEQ ID NO: 837461 - RNA, 22 nt, Human
gccuuuuuuguugcucugucac

SEQ ID NO: 837462 - RNA, 22 nt, Human
cugggccuuggauugacacugu

SEQ ID NO: 837463 - RNA, 22 nt, Human
cauuuccagcuccugcaucaug

SEQ ID NO: 837464 - RNA, 22 nt, Human
aaauguguauaugaaacaugau

SEQ ID NO: 837465 - RNA, 22 nt, Human
cugagccagcuggcaugugcua

SEQ ID NO: 837466 - RNA, 22 nt, Human
auuucacucucccugccacuua

SEQ ID NO: 837467 - RNA, 22 nt, Human
caugaaaauaacauuguuguga

SEQ ID NO: 837468 - RNA, 22 nt, Human
uucuuguauguaugcaaaauca

SEQ ID NO: 837469 - RNA, 22 nt, Human
uggcuuccugcacagugucugc

SEQ ID NO: 837470 - RNA, 22 nt, Human
ccccaggagauuugggagcaca

SEQ ID NO: 837471 - RNA, 22 nt, Human
ucaggagagagaaauuggggcu

SEQ ID NO: 837472 - RNA, 22 nt, Human
cagcugacccgugggaggcggg

SEQ ID NO: 837473 - RNA, 22 nt, Human
guggggggacguuggucacuuu

SEQ ID NO: 837474 - RNA, 22 nt, Human
ggcagcaugagccuggugaauu

SEQ ID NO: 837475 - RNA, 22 nt, Human
caugcugugugguuagaacugu

SEQ ID NO: 837476 - RNA, 22 nt, Human
guaacugaggcagcuuuuaaga

SEQ ID NO: 837477 - RNA, 22 nt, Human
caggccuggcugcagcucgccu

SEQ ID NO: 837478 - RNA, 22 nt, Human
ccugggcuggaguacagcagug

SEQ ID NO: 837479 - RNA, 22 nt, Human
augcacaagcaagagauaaugg

SEQ ID NO: 837480 - RNA, 22 nt, Human
acauuuaaauaugccuuauauu

SEQ ID NO: 837481 - RNA, 22 nt, Human
ccaggacuuuaaguccagcacu

SEQ ID NO: 837482 - RNA, 22 nt, Human
acagagcuuaauucaggagcuu

SEQ ID NO: 837483 - RNA, 22 nt, Human
aucaaaguuucccagaaguugu

SEQ ID NO: 837484 - RNA, 20 nt, Human
cugcugugguccuuuauuuu

SEQ ID NO: 837485 - RNA, 22 nt, Human
ugagauguaagguaugcuuacu

SEQ ID NO: 837486 - RNA, 22 nt, Human
ucagaaauacuaucagcuuuug

SEQ ID NO: 837487 - RNA, 22 nt, Human
gugcuuuccauccucccugcug

SEQ ID NO: 837488 - RNA, 23 nt, Human
ccuucagaagaaguaacaggggc

SEQ ID NO: 837489 - RNA, 20 nt, Human
cugagagucugugcuuaguc

SEQ ID NO: 837490 - RNA, 22 nt, Human
agugagggaugaagaacugcgg

SEQ ID NO: 837491 - RNA, 22 nt, Human
gugaauaacuuucuauguuaau

SEQ ID NO: 837492 - RNA, 22 nt, Human
gagccuggggacccuccugagu

SEQ ID NO: 837493 - RNA, 22 nt, Human
gccucccuguucuuccacaaua

SEQ ID NO: 837494 - RNA, 22 nt, Human
ugagccagccuugcagcugugc

SEQ ID NO: 837495 - RNA, 22 nt, Human
auucuucaucagagaugcacua

SEQ ID NO: 837496 - RNA, 22 nt, Human
ggggauggauuccgggucccug

SEQ ID NO: 837497 - RNA, 22 nt, Human
augugugccccuuuuacucuuu

SEQ ID NO: 837498 - RNA, 19 nt, Human
ugagaggcuuaaggcagcu

SEQ ID NO: 837499 - RNA, 22 nt, Human
agaauucuuggugguuagaaua

SEQ ID NO: 837500 - RNA, 22 nt, Human
agccuggauucgugcauccaca

SEQ ID NO: 837501 - RNA, 22 nt, Human
uauuccuaagucccaacuacau

SEQ ID NO: 837502 - RNA, 22 nt, Human
gcuuuguguagaaggaggaugg

SEQ ID NO: 837503 - RNA, 22 nt, Human
uaaaugugucuauggacccgcc

SEQ ID NO: 837504 - RNA, 22 nt, Human
aaucaguuaaauauugaguaca

SEQ ID NO: 837505 - RNA, 22 nt, Human
ccaggugggaggaaagcagaga

SEQ ID NO: 837506 - RNA, 22 nt, Human
aaaugugucauauucaaaguca

SEQ ID NO: 837507 - RNA, 22 nt, Human
caguacuuguccucagguguua

SEQ ID NO: 837508 - RNA, 22 nt, Human
auuaggcauucugaaugagguc

SEQ ID NO: 837509 - RNA, 22 nt, Human
auguuucaccagcaaauuaccu

SEQ ID NO: 837510 - RNA, 22 nt, Human
guguacauagaauugugcuuug

SEQ ID NO: 837511 - RNA, 22 nt, Human
gaggcaguguugaaaaggagag

SEQ ID NO: 837512 - RNA, 22 nt, Human
cagcagcuuugccaagucagcc

SEQ ID NO: 837513 - RNA, 22 nt, Human
caggugcuguccugcacauguc

SEQ ID NO: 837514 - RNA, 18 nt, Human
gaaaggagagacaguagg

SEQ ID NO: 837515 - RNA, 22 nt, Human
ccuguucagagcuaagcaucau

SEQ ID NO: 837516 - RNA, 22 nt, Human
acuccuggguugcaguccucaa

SEQ ID NO: 837517 - RNA, 22 nt, Human
gcagggcuguggacacuuuggu

SEQ ID NO: 837518 - RNA, 22 nt, Human
uuccuuaguugacugucuuagu

SEQ ID NO: 837519 - RNA, 22 nt, Human
guggcagcggcccaggccgucu

SEQ ID NO: 837520 - RNA, 22 nt, Human
uguuccaugucuuuguaggacu

SEQ ID NO: 837521 - RNA, 22 nt, Human
gcugucaccaaagcaggcacug

SEQ ID NO: 837522 - RNA, 22 nt, Human
guggguggaggcgucgagggca

SEQ ID NO: 837523 - RNA, 22 nt, Human
ggcugcugaguuggccaggaga

SEQ ID NO: 837524 - RNA, 22 nt, Human
agucagugaaggcauugcucaa

SEQ ID NO: 837525 - RNA, 22 nt, Human
aagggcuggccacauucugggu

SEQ ID NO: 837526 - RNA, 22 nt, Human
cccuggagugccggaaucaaga

SEQ ID NO: 837527 - RNA, 22 nt, Human
aggcagcauuugaauccagguc

SEQ ID NO: 837528 - RNA, 22 nt, Human
cccucugccugcgcccuggugu

SEQ ID NO: 837529 - RNA, 22 nt, Human
uaugcacacaggcuuaauucau

SEQ ID NO: 837530 - RNA, 22 nt, Human
uucaccacagucucaucuacgc

SEQ ID NO: 837531 - RNA, 22 nt, Human
gcugggcuugguuucccugcuu

SEQ ID NO: 837532 - RNA, 22 nt, Human
gauucugagcugguguuuuacg

SEQ ID NO: 837533 - RNA, 22 nt, Human
aguuacagugaccauuuauuua

SEQ ID NO: 837534 - RNA, 22 nt, Human
uauguacaguccuuaacuuaaa

SEQ ID NO: 837535 - RNA, 22 nt, Human
agucuuuccugcuugacuguuc

SEQ ID NO: 837536 - RNA, 22 nt, Human
ggccugcuuuccgagccugcag

SEQ ID NO: 837537 - RNA, 22 nt, Human
aggcacugauucucagaguuac

SEQ ID NO: 837538 - RNA, 22 nt, Human
aguauacauauauuagccuucg

SEQ ID NO: 837539 - RNA, 22 nt, Human
aaucugucguaguaaaaagcag

SEQ ID NO: 837540 - RNA, 22 nt, Human
uggccuggugucugcgaggccu

SEQ ID NO: 837541 - RNA, 22 nt, Human
uaacagaaguuguucauugugg

SEQ ID NO: 837542 - RNA, 22 nt, Human
cagggcugaaaucaagguguag

SEQ ID NO: 837543 - RNA, 22 nt, Human
ggcuucuguccucuggaucugu

SEQ ID NO: 837544 - RNA, 22 nt, Human
gccuuggccaacaccuugcaaa

SEQ ID NO: 837545 - RNA, 22 nt, Human
cucugagcugaaacaugagcau

SEQ ID NO: 837546 - RNA, 23 nt, Human
cagggcugguagggaagagcgug

SEQ ID NO: 837547 - RNA, 22 nt, Human
aggcagcuuuaacugguaguag

SEQ ID NO: 837548 - RNA, 22 nt, Human
caguggccugagccaggcuucc

SEQ ID NO: 837549 - RNA, 21 nt, Human
cccuugccugcacuccucggc

SEQ ID NO: 837550 - RNA, 22 nt, Human
gguggggccugcuccagcggcc

SEQ ID NO: 837551 - RNA, 22 nt, Human
uauaucauggagauuaacauuc

SEQ ID NO: 837552 - RNA, 17 nt, Human
ucugggcuucagugguc

SEQ ID NO: 837553 - RNA, 20 nt, Human
augcuuucuugugugcugcu

SEQ ID NO: 837554 - RNA, 20 nt, Human
cacaagagaauacacacugg

SEQ ID NO: 837555 - RNA, 22 nt, Human
cccagcacaggcaauuccauac

SEQ ID NO: 837556 - RNA, 22 nt, Human
ggaguuggugagcaccaggcuu

SEQ ID NO: 837557 - RNA, 19 nt, Human
cagagccucagagcuagaa

SEQ ID NO: 837558 - RNA, 22 nt, Human
uauuucuugaguggucaguuuc

SEQ ID NO: 837559 - RNA, 22 nt, Human
agugagaguauuaaugugaacu

SEQ ID NO: 837560 - RNA, 22 nt, Human
acuggagcccguggaggcgcag

SEQ ID NO: 837561 - RNA, 19 nt, Human
ucugaggguccagaugcau

SEQ ID NO: 837562 - RNA, 22 nt, Human
ggaggugggagacauaggcggc

SEQ ID NO: 837563 - RNA, 22 nt, Human
gaucuucucuuuaguagaaaca

SEQ ID NO: 837564 - RNA, 19 nt, Human
ggcugggucuggcagguuc

SEQ ID NO: 837565 - RNA, 22 nt, Human
cagagcugcaaaugccccuccg

SEQ ID NO: 837566 - RNA, 22 nt, Human
auuacaaucgagagaaacaaau

SEQ ID NO: 837567 - RNA, 22 nt, Human
uaaagguaacaugaacugcuuu

SEQ ID NO: 837568 - RNA, 22 nt, Human
guacauuuugagguuaaaacaa

SEQ ID NO: 837569 - RNA, 22 nt, Human
uucagcaagaccaccauguacc

SEQ ID NO: 837570 - RNA, 22 nt, Human
aggacagcaguuggugagguuc

SEQ ID NO: 837571 - RNA, 22 nt, Human
gcugagagcggccagcugggaa

SEQ ID NO: 837572 - RNA, 22 nt, Human
gagcugccugugugccaugaug

SEQ ID NO: 837573 - RNA, 22 nt, Human
cauuuccugucuggaggucaaa

SEQ ID NO: 837574 - RNA, 22 nt, Human
aggcaagcccccagugaggcuc

SEQ ID NO: 837575 - RNA, 22 nt, Human
ccacagcugaccgcaggugagc

SEQ ID NO: 837576 - RNA, 21 nt, Human
uggcagggguaguaguacagc

SEQ ID NO: 837577 - RNA, 22 nt, Human
aucuucaacuugaucauuugaa

SEQ ID NO: 837578 - RNA, 22 nt, Human
uagugcuuaacacaaagugauu

SEQ ID NO: 837579 - RNA, 22 nt, Human
uguaggaaaaacaaugaucugc

SEQ ID NO: 837580 - RNA, 22 nt, Human
augcucugggcaggagcccugg

SEQ ID NO: 837581 - RNA, 22 nt, Human
uugaauuauaagugugucuacu

SEQ ID NO: 837582 - RNA, 22 nt, Human
gcaggaugagugaguacauuua

SEQ ID NO: 837583 - RNA, 22 nt, Human
ccaggagguggagauugcagug

SEQ ID NO: 837584 - RNA, 22 nt, Human
aacaaauguaaaaugcagaugc

SEQ ID NO: 837585 - RNA, 22 nt, Human
gccugucugcagggcugucauu

SEQ ID NO: 837586 - RNA, 21 nt, Human
aggagggcacaaggccaggaa

SEQ ID NO: 837587 - RNA, 22 nt, Human
uucagaaguagcuaagcaguca

SEQ ID NO: 837588 - RNA, 22 nt, Human
cugcuggccuagcccauccucu

SEQ ID NO: 837589 - RNA, 20 nt, Human
gcugccuuguccugcuuggu

SEQ ID NO: 837590 - RNA, 22 nt, Human
ccccaggagaaaucuuaaacua

SEQ ID NO: 837591 - RNA, 22 nt, Human
ggaggagacaguaaaaagcacg

SEQ ID NO: 837592 - RNA, 22 nt, Human
gggcuccaacggugagcaugga

SEQ ID NO: 837593 - RNA, 22 nt, Human
agcagccacagcagaucugagu

SEQ ID NO: 837594 - RNA, 22 nt, Human
uggggugguaauacaccguucu

SEQ ID NO: 837595 - RNA, 22 nt, Human
acaugaaacuguugcauuagaa

SEQ ID NO: 837596 - RNA, 22 nt, Human
agaagauuuagguugacgcuau

SEQ ID NO: 837597 - RNA, 20 nt, Human
accuugaacccgccagccau

SEQ ID NO: 837598 - RNA, 22 nt, Human
ggcucugcuggauugaggccag

SEQ ID NO: 837599 - RNA, 22 nt, Human
gccaggcuggcaaaaggaaacc

SEQ ID NO: 837600 - RNA, 22 nt, Human
ucugggaaugaauaagaccugu

SEQ ID NO: 837601 - RNA, 22 nt, Human
cagaauuuagcacaauguaugg

SEQ ID NO: 837602 - RNA, 22 nt, Human
gugcccugaguggguaggagag

SEQ ID NO: 837603 - RNA, 22 nt, Human
auugcuguggaaauauaagaug

SEQ ID NO: 837604 - RNA, 22 nt, Human
ucauucuugaucacuaguuagu

SEQ ID NO: 837605 - RNA, 22 nt, Human
agcuuuauucaugauuucaggg

SEQ ID NO: 837606 - RNA, 22 nt, Human
ggcugccuucagacuccagcuu

SEQ ID NO: 837607 - RNA, 22 nt, Human
gggcagcuggccagguauucug

SEQ ID NO: 837608 - RNA, 22 nt, Human
gcccagcagaucucagugucuc

SEQ ID NO: 837609 - RNA, 22 nt, Human
ugcacagagagaugagacacgu

SEQ ID NO: 837610 - RNA, 22 nt, Human
uggccugggugcugcugacauc

SEQ ID NO: 837611 - RNA, 22 nt, Human
aucuaucccaguuuaacucauu

SEQ ID NO: 837612 - RNA, 22 nt, Human
aggcagguccccuggaaggcac

SEQ ID NO: 837613 - RNA, 22 nt, Human
ugagcuggucacuccuucugaa

SEQ ID NO: 837614 - RNA, 22 nt, Human
uuucuuauacuauauugucauc

SEQ ID NO: 837615 - RNA, 22 nt, Human
agcagcuucuuucacuccugga

SEQ ID NO: 837616 - RNA, 20 nt, Human
cagaggcaaggagacuugga

SEQ ID NO: 837617 - RNA, 20 nt, Human
cuggguggcaagcaaggggg

SEQ ID NO: 837618 - RNA, 22 nt, Human
gccuggaguagcauggcaagcc

SEQ ID NO: 837619 - RNA, 22 nt, Human
cuuagaaaugcagauucucagg

SEQ ID NO: 837620 - RNA, 22 nt, Human
auuauguagcuaaaaauugugu

SEQ ID NO: 837621 - RNA, 22 nt, Human
ugucucugcuuuccuugcaggg

SEQ ID NO: 837622 - RNA, 22 nt, Human
uagagcuggccgggacagcugg

SEQ ID NO: 837623 - RNA, 22 nt, Human
gcucccacaaccuucuugcucc

SEQ ID NO: 837624 - RNA, 22 nt, Human
aggcccuguuaugagccacugu

SEQ ID NO: 837625 - RNA, 22 nt, Human
cagaauaugacaagauuuuccu

SEQ ID NO: 837626 - RNA, 22 nt, Human
uaacagaauuugcuaaacuccg

SEQ ID NO: 837627 - RNA, 22 nt, Human
cuggccugaggucggcuguagg

SEQ ID NO: 837628 - RNA, 22 nt, Human
augcugugcuggcuaaccaugg

SEQ ID NO: 837629 - RNA, 22 nt, Human
gugggccuugcagggugcaggg

SEQ ID NO: 837630 - RNA, 22 nt, Human
ugaacagauggcccagcagagg

SEQ ID NO: 837631 - RNA, 22 nt, Human
agcaugcugguguucauggcag

SEQ ID NO: 837632 - RNA, 22 nt, Human
aagcugcccaagacugaagcau

SEQ ID NO: 837633 - RNA, 22 nt, Human
cauagcaacagcaucaagucaa

SEQ ID NO: 837634 - RNA, 22 nt, Human
cuuuaagacucugcucuuggug

SEQ ID NO: 837635 - RNA, 22 nt, Human
uccaugugccaaggggcagagg

SEQ ID NO: 837636 - RNA, 23 nt, Human
uuacagaaaguaugcuuuuguuu

SEQ ID NO: 837637 - RNA, 22 nt, Human
gagauuuagcugcuuaacuccu

SEQ ID NO: 837638 - RNA, 22 nt, Human
auucuaacacaugcucuaagaa

SEQ ID NO: 837639 - RNA, 22 nt, Human
cagagcagguaucuuuggugaa

SEQ ID NO: 837640 - RNA, 22 nt, Human
ugcagaagauggucugagcacc

SEQ ID NO: 837641 - RNA, 22 nt, Human
agucucagccacacagaccuau

SEQ ID NO: 837642 - RNA, 22 nt, Human
gaugcacuuucuuuucaacagu

SEQ ID NO: 837643 - RNA, 22 nt, Human
gcucucugggugugucuagaua

SEQ ID NO: 837644 - RNA, 22 nt, Human
uauguuuuucaagugcacacua

SEQ ID NO: 837645 - RNA, 22 nt, Human
caguggccaugguggcaggggu

SEQ ID NO: 837646 - RNA, 22 nt, Human
uaauguguccugaaagcuucug

SEQ ID NO: 837647 - RNA, 22 nt, Human
guucuaauuuggggcuccuuag

SEQ ID NO: 837648 - RNA, 22 nt, Human
uggcgugcccuccagacuuggc

SEQ ID NO: 837649 - RNA, 21 nt, Human
uuuuuucuugcgugaggccug

SEQ ID NO: 837650 - RNA, 22 nt, Human
gaggccugcagcguggucccug

SEQ ID NO: 837651 - RNA, 18 nt, Human
aggcaggugcuggaaguc

SEQ ID NO: 837652 - RNA, 22 nt, Human
ccaggagagcucuaaauggcug

SEQ ID NO: 837653 - RNA, 17 nt, Human
uggcagcugaaagcucu

SEQ ID NO: 837654 - RNA, 22 nt, Human
acaggagacccugcugguucug

SEQ ID NO: 837655 - RNA, 22 nt, Human
ggagugaaucacuagaugcaga

SEQ ID NO: 837656 - RNA, 22 nt, Human
aucuaagauguauugagcacuu

SEQ ID NO: 837657 - RNA, 22 nt, Human
acacagaaccucauagccucuc

SEQ ID NO: 837658 - RNA, 22 nt, Human
uuccuuagcugucccuggaaau

SEQ ID NO: 837659 - RNA, 22 nt, Human
uguuagaauauuguaauauucg

SEQ ID NO: 837660 - RNA, 22 nt, Human
auucuaggcuugaaacaugaag

SEQ ID NO: 837661 - RNA, 22 nt, Human
uccaggaggaggaaggcugcca

SEQ ID NO: 837662 - RNA, 22 nt, Human
aggcaggcucaaugcccagucu

SEQ ID NO: 837663 - RNA, 22 nt, Human
gcccucucuucugcagccucca

SEQ ID NO: 837664 - RNA, 22 nt, Human
cagagacaguuucacagggucu

SEQ ID NO: 837665 - RNA, 22 nt, Human
aguucacagccauguucaugug

SEQ ID NO: 837666 - RNA, 22 nt, Human
acaugauuuuuaaagagauaau

SEQ ID NO: 837667 - RNA, 22 nt, Human
uccuucagaggacggcagccag

SEQ ID NO: 837668 - RNA, 23 nt, Human
cuuuuaacuagaguaucagcugc

SEQ ID NO: 837669 - RNA, 22 nt, Human
ucuggcucaggucagacaggga

SEQ ID NO: 837670 - RNA, 22 nt, Human
gugcaggggaucagguugcagc

SEQ ID NO: 837671 - RNA, 22 nt, Human
ucagaauuugauuccugggaua

SEQ ID NO: 837672 - RNA, 19 nt, Human
guuuuucccagacgaggca

SEQ ID NO: 837673 - RNA, 22 nt, Human
cugagaaggaagccuccacucu

SEQ ID NO: 837674 - RNA, 19 nt, Human
ugccagcauuaggcugaag

SEQ ID NO: 837675 - RNA, 22 nt, Human
ggucuuccgagaggccugugcu

SEQ ID NO: 837676 - RNA, 22 nt, Human
agagccagguguagucucggag

SEQ ID NO: 837677 - RNA, 22 nt, Human
cccugcugucaggugcugggag

SEQ ID NO: 837678 - RNA, 22 nt, Human
cuuucucuguguuucacaugcu

SEQ ID NO: 837679 - RNA, 22 nt, Human
gugauugcccagcaccauuguu

SEQ ID NO: 837680 - RNA, 22 nt, Human
aacacaaagaagcugcaggauc

SEQ ID NO: 837681 - RNA, 22 nt, Human
ugaggccaaugacccugggcag

SEQ ID NO: 837682 - RNA, 22 nt, Human
gcucagagcuugaaguuccacu

SEQ ID NO: 837683 - RNA, 22 nt, Human
cgucccaguuccagccgcgcug

SEQ ID NO: 837684 - RNA, 18 nt, Human
gcucugcccaggcugccc

SEQ ID NO: 837685 - RNA, 22 nt, Human
guuuuuccugcugacuuggguc

SEQ ID NO: 837686 - RNA, 22 nt, Human
caggagagcccggguccgggcu

SEQ ID NO: 837687 - RNA, 22 nt, Human
acaugauuggacuccuuccccu

SEQ ID NO: 837688 - RNA, 22 nt, Human
cacaugggugugccuggaggaa

SEQ ID NO: 837689 - RNA, 22 nt, Human
gaauauuuuuaaagggacuaau

SEQ ID NO: 837690 - RNA, 22 nt, Human
cagggccucauccucagagauu

SEQ ID NO: 837691 - RNA, 21 nt, Human
augaagucuaugcuucugugu

SEQ ID NO: 837692 - RNA, 20 nt, Human
gcagagccucacugcaaggg

SEQ ID NO: 837693 - RNA, 22 nt, Human
acuuucuccagaaaaccaagga

SEQ ID NO: 837694 - RNA, 22 nt, Human
uguaugcuuuccaaaaaugcug

SEQ ID NO: 837695 - RNA, 20 nt, Human
uagauuucauacuucucuuu

SEQ ID NO: 837696 - RNA, 19 nt, Human
gccucugcuggggacaggc

SEQ ID NO: 837697 - RNA, 22 nt, Human
agggagcaugggugaagcaggc

SEQ ID NO: 837698 - RNA, 22 nt, Human
uuuguguuuguacaaugcacua

SEQ ID NO: 837699 - RNA, 22 nt, Human
aaugcacaaaaauuguauguaa

SEQ ID NO: 837700 - RNA, 22 nt, Human
guccuggggauacagaagugaa

SEQ ID NO: 837701 - RNA, 22 nt, Human
cugcaggcaucuaacugugggc

SEQ ID NO: 837702 - RNA, 22 nt, Human
ugggcagacauugaguuuguuc

SEQ ID NO: 837703 - RNA, 22 nt, Human
aauauaugagggagcuauuuga

SEQ ID NO: 837704 - RNA, 23 nt, Human
uggggcugauggagacggaccag

SEQ ID NO: 837705 - RNA, 22 nt, Human
cugucuguucagauucauuacu

SEQ ID NO: 837706 - RNA, 22 nt, Human
cagugcagccaaggacaggcac

SEQ ID NO: 837707 - RNA, 22 nt, Human
uggggugccgacagggagggca

SEQ ID NO: 837708 - RNA, 22 nt, Human
auguacauuuuccuaauguuuu

SEQ ID NO: 837709 - RNA, 22 nt, Human
ugacaaaacugcaauuacuuuu

SEQ ID NO: 837710 - RNA, 22 nt, Human
agcugagcacauucaaacaggu

SEQ ID NO: 837711 - RNA, 22 nt, Human
aagguacaccaaaguucaaguu

SEQ ID NO: 837712 - RNA, 22 nt, Human
ucugucaaaaguuuucaauaaa

SEQ ID NO: 837713 - RNA, 22 nt, Human
caucacugacgcugagauucca

SEQ ID NO: 837714 - RNA, 20 nt, Human
ggguggaguugcggucugug

SEQ ID NO: 837715 - RNA, 20 nt, Human
ucagaggcugccagcugggg

SEQ ID NO: 837716 - RNA, 22 nt, Human
ccacagggugucaucagcuuga

SEQ ID NO: 837717 - RNA, 18 nt, Human
aagcugcccucaggcagg

SEQ ID NO: 837718 - RNA, 22 nt, Human
ggccuugggaggagggucagaa

SEQ ID NO: 837719 - RNA, 19 nt, Human
gugaggauacugcucagag

SEQ ID NO: 837720 - RNA, 22 nt, Human
ccagaauuuggaucaugauuuu

SEQ ID NO: 837721 - RNA, 21 nt, Human
agggagcuuuagguagaaguu

SEQ ID NO: 837722 - RNA, 22 nt, Human
augcagcugucagggagaacau

SEQ ID NO: 837723 - RNA, 22 nt, Human
uuuccuuccuugcuagccugag

SEQ ID NO: 837724 - RNA, 22 nt, Human
aaucuggcauguaagcuuagag

SEQ ID NO: 837725 - RNA, 22 nt, Human
ggucccagcuggucacugucag

SEQ ID NO: 837726 - RNA, 22 nt, Human
aagggcaggugggcauuucugg

SEQ ID NO: 837727 - RNA, 22 nt, Human
acugucugcccugagaugccag

SEQ ID NO: 837728 - RNA, 22 nt, Human
gaaauguguuguucauuucuaa

SEQ ID NO: 837729 - RNA, 22 nt, Human
cugcuuuguaaaauagacauaa

SEQ ID NO: 837730 - RNA, 22 nt, Human
ggguggcuccuaugggcauagc

SEQ ID NO: 837731 - RNA, 22 nt, Human
gagccugaugaaacaggcagac

SEQ ID NO: 837732 - RNA, 22 nt, Human
ucucuggagcugcagauccagg

SEQ ID NO: 837733 - RNA, 21 nt, Human
agggcagauuagcuguaagag

SEQ ID NO: 837734 - RNA, 22 nt, Human
gccuggagcccaguguggggcu

SEQ ID NO: 837735 - RNA, 22 nt, Human
cccacucccugcacgccugccg

SEQ ID NO: 837736 - RNA, 22 nt, Human
cucagagaaaaggagcaagggu

SEQ ID NO: 837737 - RNA, 22 nt, Human
uggcugucagcugccuggugcg

SEQ ID NO: 837738 - RNA, 22 nt, Human
uacaaguaaauuguagauacca

SEQ ID NO: 837739 - RNA, 22 nt, Human
ggagaggagauuguggcauuuu

SEQ ID NO: 837740 - RNA, 22 nt, Human
gagcaggcauucuaguggcuga

SEQ ID NO: 837741 - RNA, 22 nt, Human
agcuacccgaggacaggcuaag

SEQ ID NO: 837742 - RNA, 22 nt, Human
gguuugcaugugauguugggca

SEQ ID NO: 837743 - RNA, 22 nt, Human
cccaggagaccuagaucuguuu

SEQ ID NO: 837744 - RNA, 22 nt, Human
uucugaaccauugagcacugcc

SEQ ID NO: 837745 - RNA, 22 nt, Human
ugccagaagauucucuaucaga

SEQ ID NO: 837746 - RNA, 22 nt, Human
ugauuaacugucuauuaaucau

SEQ ID NO: 837747 - RNA, 22 nt, Human
cucuggagguugagcccagcaa

SEQ ID NO: 837748 - RNA, 23 nt, Human
agccuucaggcaaugucaguaga

SEQ ID NO: 837749 - RNA, 22 nt, Human
aggccugaaguguggagugggg

SEQ ID NO: 837750 - RNA, 18 nt, Human
uccagcgugcuccagggc

SEQ ID NO: 837751 - RNA, 22 nt, Human
uuuuaaucaugcuucuaugucc

SEQ ID NO: 837752 - RNA, 22 nt, Human
ucuaggagaaccaucagggagg

SEQ ID NO: 837753 - RNA, 22 nt, Human
aagucaccccacacucuuggga

SEQ ID NO: 837754 - RNA, 22 nt, Human
gaaggccucacucugcagcaua

SEQ ID NO: 837755 - RNA, 22 nt, Human
cccuggaggucagaggccuggg

SEQ ID NO: 837756 - RNA, 22 nt, Human
aagauuuaccacuuuauucaag

SEQ ID NO: 837757 - RNA, 20 nt, Human
uaugaguauuacuuucagga

SEQ ID NO: 837758 - RNA, 22 nt, Human
ggggcuggcucacuaagagacu

SEQ ID NO: 837759 - RNA, 22 nt, Human
uaaaauguagcuucuaggcugg

SEQ ID NO: 837760 - RNA, 22 nt, Human
agcacaauagagcaguuaaaaa

SEQ ID NO: 837761 - RNA, 22 nt, Human
augguuuuucaaguauucagaa

SEQ ID NO: 837762 - RNA, 22 nt, Human
uccauguggccagacacuggca

SEQ ID NO: 837763 - RNA, 22 nt, Human
agcagccagaaauccagaggug

SEQ ID NO: 837764 - RNA, 22 nt, Human
ucucagggcagcaaggaagcau

SEQ ID NO: 837765 - RNA, 21 nt, Human
uugaagcaaggguggcucuga

SEQ ID NO: 837766 - RNA, 22 nt, Human
agcagagcgccugcucagaggg

SEQ ID NO: 837767 - RNA, 22 nt, Human
auaagagcuagucuuuuccuug

SEQ ID NO: 837768 - RNA, 22 nt, Human
gacucugcuacaggccgagguu

SEQ ID NO: 837769 - RNA, 22 nt, Human
agggcagaggcggacacggaag

SEQ ID NO: 837770 - RNA, 22 nt, Human
auacagaagccuguauuucugg

SEQ ID NO: 837771 - RNA, 22 nt, Human
gcaggugguccccguggagugg

SEQ ID NO: 837772 - RNA, 22 nt, Human
ugggcagaggacagggaagauc

SEQ ID NO: 837773 - RNA, 22 nt, Human
caggaucccuggccuccgccca

SEQ ID NO: 837774 - RNA, 22 nt, Human
caggaacagcaccaggagcuag

SEQ ID NO: 837775 - RNA, 22 nt, Human
cuuuccuagauggccaucuuuc

SEQ ID NO: 837776 - RNA, 22 nt, Human
auuuccaauuucauccaugucc

SEQ ID NO: 837777 - RNA, 22 nt, Human
aggcacugaagugguaaaugua

SEQ ID NO: 837778 - RNA, 22 nt, Human
ccaccagcagugugcaaggauu

SEQ ID NO: 837779 - RNA, 22 nt, Human
uugaaagacuucuccugugaaa

SEQ ID NO: 837780 - RNA, 18 nt, Human
aggaagcaggaggaaggc

SEQ ID NO: 837781 - RNA, 22 nt, Human
auucugucauuucaagaaaaac

SEQ ID NO: 837782 - RNA, 21 nt, Human
ucugucucuccacugcccugc

SEQ ID NO: 837783 - RNA, 17 nt, Human
cagugcagagcccuuuc

SEQ ID NO: 837784 - RNA, 22 nt, Human
agaaaugaagagagucaagguu

SEQ ID NO: 837785 - RNA, 22 nt, Human
gaaaauagcagauagaccaaug

SEQ ID NO: 837786 - RNA, 22 nt, Human
ccugggaggcggagguugcagg

SEQ ID NO: 837787 - RNA, 22 nt, Human
aaucaguuguucacucugaaaa

SEQ ID NO: 837788 - RNA, 19 nt, Human
gagaggccugugcuugaag

SEQ ID NO: 837789 - RNA, 22 nt, Human
aacagcagggggaccugcuggu

SEQ ID NO: 837790 - RNA, 22 nt, Human
uaggccaguggcagguugugug

SEQ ID NO: 837791 - RNA, 22 nt, Human
agagcagcugugacauggacag

SEQ ID NO: 837792 - RNA, 22 nt, Human
agaaguaggcagggcuguauca

SEQ ID NO: 837793 - RNA, 22 nt, Human
cacugaaggacaguaggaaggg

SEQ ID NO: 837794 - RNA, 22 nt, Human
gcauguguugguuuaugcaugu

SEQ ID NO: 837795 - RNA, 22 nt, Human
aaacagcugucauuguuuuaaa

SEQ ID NO: 837796 - RNA, 22 nt, Human
gaauuucacaaggugaggauaa

SEQ ID NO: 837797 - RNA, 22 nt, Human
gaggaggcuuccgggaggcacg

SEQ ID NO: 837798 - RNA, 22 nt, Human
ccagccuggagggcaguggugg

SEQ ID NO: 837799 - RNA, 17 nt, Human
auuucacuuagcaugag

SEQ ID NO: 837800 - RNA, 22 nt, Human
gugggggcaggcagugcuagga

SEQ ID NO: 837801 - RNA, 22 nt, Human
uuuauucaucaucuguucauau

SEQ ID NO: 837802 - RNA, 22 nt, Human
ggcaggagggcggacaaugacc

SEQ ID NO: 837803 - RNA, 22 nt, Human
cagacaugauguaagcagaggc

SEQ ID NO: 837804 - RNA, 18 nt, Human
ugcuuggagcauuuacca

SEQ ID NO: 837805 - RNA, 22 nt, Human
ccagccucacuggcaucaccua

SEQ ID NO: 837806 - RNA, 22 nt, Human
cugcucuguuaauuaaacuuug

SEQ ID NO: 837807 - RNA, 22 nt, Human
uacaugaacaaaauagcagaaa

SEQ ID NO: 837808 - RNA, 22 nt, Human
acagagcaguucuggagcuggc

SEQ ID NO: 837809 - RNA, 22 nt, Human
uguacaguguagucaugagguu

SEQ ID NO: 837810 - RNA, 22 nt, Human
gcugucuggaggcucugaggga

SEQ ID NO: 837811 - RNA, 22 nt, Human
ggagggaaugucuagcauucuu

SEQ ID NO: 837812 - RNA, 22 nt, Human
cagagcugucauuugccaguga

SEQ ID NO: 837813 - RNA, 22 nt, Human
ccacugaaggucaacauagagc

SEQ ID NO: 837814 - RNA, 22 nt, Human
gucuuuaugguaugaaaacuga

SEQ ID NO: 837815 - RNA, 22 nt, Human
uagaaucuaguucauucauuug

SEQ ID NO: 837816 - RNA, 22 nt, Human
ucucuucuugauuuucacugga

SEQ ID NO: 837817 - RNA, 22 nt, Human
caaaaguucucacccagacaug

SEQ ID NO: 837818 - RNA, 22 nt, Human
cuucagggugacgcaggcugca

SEQ ID NO: 837819 - RNA, 22 nt, Human
ggagcuguugcgcaugcgcucg

SEQ ID NO: 837820 - RNA, 22 nt, Human
aaauguaguauguugcauguau

SEQ ID NO: 837821 - RNA, 22 nt, Human
gcagggcucaacaggacacccc

SEQ ID NO: 837822 - RNA, 22 nt, Human
agaaaugaagcaggaguuauua

SEQ ID NO: 837823 - RNA, 22 nt, Human
agagaugaaaaguggagacugg

SEQ ID NO: 837824 - RNA, 22 nt, Human
cagguggggagaguguggagca

SEQ ID NO: 837825 - RNA, 22 nt, Human
acaaagucaaauugcagccgcc

SEQ ID NO: 837826 - RNA, 22 nt, Human
gcugucuucacuuccugguuuc

SEQ ID NO: 837827 - RNA, 22 nt, Human
uccuuugacuucuugcagucca

SEQ ID NO: 837828 - RNA, 22 nt, Human
ugagccuggguggucgaggcug

SEQ ID NO: 837829 - RNA, 22 nt, Human
agcugauuccacuuuuucccca

SEQ ID NO: 837830 - RNA, 22 nt, Human
aaaauuauggaguaucccaaag

SEQ ID NO: 837831 - RNA, 22 nt, Human
aaaagccaagguccucuucaga

SEQ ID NO: 837832 - RNA, 22 nt, Human
aucagaaauugcccagcuguuu

SEQ ID NO: 837833 - RNA, 22 nt, Human
ugggccuggagcccuggagagu

SEQ ID NO: 837834 - RNA, 19 nt, Human
agcagccauagacaauaug

SEQ ID NO: 837835 - RNA, 22 nt, Human
aaagaacaucggagugggcggg

SEQ ID NO: 837836 - RNA, 22 nt, Human
uuguccuuaccucaaucuggaa

SEQ ID NO: 837837 - RNA, 22 nt, Human
aagagagaacucccuucgccag

SEQ ID NO: 837838 - RNA, 22 nt, Human
aggcacugaagaacucuuuuug

SEQ ID NO: 837839 - RNA, 22 nt, Human
ccacagggcacaagggagguug

SEQ ID NO: 837840 - RNA, 22 nt, Human
guaaacauuuucaucugugccc

SEQ ID NO: 837841 - RNA, 22 nt, Human
gcaggguccauggaggcagccc

SEQ ID NO: 837842 - RNA, 22 nt, Human
agaggcggagcuugcagugagc

SEQ ID NO: 837843 - RNA, 22 nt, Human
gcuccuggucuggagcuucaag

SEQ ID NO: 837844 - RNA, 22 nt, Human
ucagggcauccauugccuguug

SEQ ID NO: 837845 - RNA, 21 nt, Human
ggggcagagcuaggcccugca

SEQ ID NO: 837846 - RNA, 22 nt, Human
gaaguacaguuuuaucuagcca

SEQ ID NO: 837847 - RNA, 22 nt, Human
gaauacauuggaaaucagaaua

SEQ ID NO: 837848 - RNA, 22 nt, Human
guuaggcagcccaagaugucag

SEQ ID NO: 837849 - RNA, 22 nt, Human
gcaucuuucuguccauucagca

SEQ ID NO: 837850 - RNA, 20 nt, Human
gcagcuacucugucucgcuc

SEQ ID NO: 837851 - RNA, 22 nt, Human
gguggccucucaugcaagguag

SEQ ID NO: 837852 - RNA, 22 nt, Human
aagacauugucauuuuauaauu

SEQ ID NO: 837853 - RNA, 22 nt, Human
cugagcuggucuauggacuugg

SEQ ID NO: 837854 - RNA, 22 nt, Human
ggaagaagggucauuggcagcc

SEQ ID NO: 837855 - RNA, 22 nt, Human
aagaauacguaucaacaauggu

SEQ ID NO: 837856 - RNA, 22 nt, Human
ugcuggccgugagcucucggga

SEQ ID NO: 837857 - RNA, 22 nt, Human
aguuagaauagucagauuguag

SEQ ID NO: 837858 - RNA, 22 nt, Human
ucugggaauuuauuggcacuuu

SEQ ID NO: 837859 - RNA, 22 nt, Human
cuauugaauagcccaaaucauu

SEQ ID NO: 837860 - RNA, 23 nt, Human
ugugaaauuugaggucagugcuu

SEQ ID NO: 837861 - RNA, 22 nt, Human
ggcagcucugaugaugcucugg

SEQ ID NO: 837862 - RNA, 22 nt, Human
auuuuucucuuuccacugagau

SEQ ID NO: 837863 - RNA, 22 nt, Human
aaugaugguuucaucacuugaa

SEQ ID NO: 837864 - RNA, 22 nt, Human
cuccuugguguaguacugagca

SEQ ID NO: 837865 - RNA, 20 nt, Human
auuucaguguuugcaauuuc

SEQ ID NO: 837866 - RNA, 22 nt, Human
uaaaugcagauuccugagccua

SEQ ID NO: 837867 - RNA, 22 nt, Human
uuugcauuguaauauuuaguuc

SEQ ID NO: 837868 - RNA, 22 nt, Human
ucacagggcauuauggcuccag

SEQ ID NO: 837869 - RNA, 22 nt, Human
uuccagaauuuuguucugcuug

SEQ ID NO: 837870 - RNA, 23 nt, Human
ccuggcuggauucucugcauuca

SEQ ID NO: 837871 - RNA, 22 nt, Human
uggagcagcaucacuuugagcu

SEQ ID NO: 837872 - RNA, 22 nt, Human
uuuccaauaaagugucauuguu

SEQ ID NO: 837873 - RNA, 23 nt, Human
uacuuaggguuuagaucugacug

SEQ ID NO: 837874 - RNA, 22 nt, Human
accaucaguacuggaugcugac

SEQ ID NO: 837875 - RNA, 23 nt, Human
aaucuauacuuaggcugguaaua

SEQ ID NO: 837876 - RNA, 22 nt, Human
ggaggcaggaaagacagguuca

SEQ ID NO: 837877 - RNA, 21 nt, Human
uuacuuuugcaccaaccuaau

SEQ ID NO: 837878 - RNA, 22 nt, Human
agaggcugagaaacccucuucu

SEQ ID NO: 837879 - RNA, 22 nt, Human
guguuuccaguucagaaagcaa

SEQ ID NO: 837880 - RNA, 19 nt, Human
ggcucucccuugagagagc

SEQ ID NO: 837881 - RNA, 22 nt, Human
agagcugaauuuggguggugga

SEQ ID NO: 837882 - RNA, 19 nt, Human
uggcauuuggaggcaaccu

SEQ ID NO: 837883 - RNA, 22 nt, Human
uuagucaauagugaauauagag

SEQ ID NO: 837884 - RNA, 22 nt, Human
agcucccagaaggcccugcgcc

SEQ ID NO: 837885 - RNA, 22 nt, Human
ccauaagguugaaaacuguaca

SEQ ID NO: 837886 - RNA, 22 nt, Human
aguaugaaccuggguucuggau

SEQ ID NO: 837887 - RNA, 21 nt, Human
agucccaggggugagugaugu

SEQ ID NO: 837888 - RNA, 22 nt, Human
cagcugcccauccugggaaaug

SEQ ID NO: 837889 - RNA, 22 nt, Human
gcuggccaggugcuuugguucu

SEQ ID NO: 837890 - RNA, 22 nt, Human
cucagggacguuagaggacagg

SEQ ID NO: 837891 - RNA, 22 nt, Human
gcucccacugcagcccugagcc

SEQ ID NO: 837892 - RNA, 20 nt, Human
uucuuucaucuacacguugu

SEQ ID NO: 837893 - RNA, 22 nt, Human
cagagcugugauaaauagauau

SEQ ID NO: 837894 - RNA, 22 nt, Human
aauaaaauggucaguuuucuca

SEQ ID NO: 837895 - RNA, 22 nt, Human
ggcagggucuggacugaaagcu

SEQ ID NO: 837896 - RNA, 22 nt, Human
aaauuguugaucuacaguaagg

SEQ ID NO: 837897 - RNA, 22 nt, Human
gggucuggcaugcugagaugga

SEQ ID NO: 837898 - RNA, 22 nt, Human
gcaggagcucguuuccaggcug

SEQ ID NO: 837899 - RNA, 22 nt, Human
cugccugugccaaugcuccuuu

SEQ ID NO: 837900 - RNA, 22 nt, Human
guggccugucagaagccguggg

SEQ ID NO: 837901 - RNA, 22 nt, Human
aggccuguuccuuccugggcac

SEQ ID NO: 837902 - RNA, 18 nt, Human
gagcugccauauuuaguu

SEQ ID NO: 837903 - RNA, 17 nt, Human
gagauggguggaucacc

SEQ ID NO: 837904 - RNA, 22 nt, Human
agcagggcagugaucagaaagg

SEQ ID NO: 837905 - RNA, 22 nt, Human
augcaucauggaaaacucaguu

SEQ ID NO: 837906 - RNA, 22 nt, Human
uaaagccaacacuuuacugcuc

SEQ ID NO: 837907 - RNA, 22 nt, Human
cagauggccagaggcagcugca

SEQ ID NO: 837908 - RNA, 22 nt, Human
caaguccuuagaugguucuuug

SEQ ID NO: 837909 - RNA, 22 nt, Human
ucauugcagacuaacaaucuca

SEQ ID NO: 837910 - RNA, 22 nt, Human
acacagggcagagagcuggcuc

SEQ ID NO: 837911 - RNA, 22 nt, Human
guguacauauugagucugcuga

SEQ ID NO: 837912 - RNA, 22 nt, Human
uccagccacucagcagggauug

SEQ ID NO: 837913 - RNA, 22 nt, Human
cuggcagcgcagcaugaagucg

SEQ ID NO: 837914 - RNA, 20 nt, Human
aggaaaaggguggugguaga

SEQ ID NO: 837915 - RNA, 22 nt, Human
acaacuuuucuaucauguggaa

SEQ ID NO: 837916 - RNA, 23 nt, Human
ugcugggguaguuuguggcacag

SEQ ID NO: 837917 - RNA, 22 nt, Human
cugggaguugacgaggcuugua

SEQ ID NO: 837918 - RNA, 22 nt, Human
ggcagccuugacuagugacuua

SEQ ID NO: 837919 - RNA, 22 nt, Human
aaugggagagaacacaaagucc

SEQ ID NO: 837920 - RNA, 22 nt, Human
gcagaauuuggggguaaccuuu

SEQ ID NO: 837921 - RNA, 22 nt, Human
uucacauaaugauacaaagcuu

SEQ ID NO: 837922 - RNA, 22 nt, Human
ccucuggguaucuguggaagua

SEQ ID NO: 837923 - RNA, 22 nt, Human
uguccucuaauuggccucuugc

SEQ ID NO: 837924 - RNA, 22 nt, Human
uaaaucccuacaucuguguuuu

SEQ ID NO: 837925 - RNA, 22 nt, Human
aaaaagguugauccagauuagg

SEQ ID NO: 837926 - RNA, 22 nt, Human
auuuaguguguauugcuauuau

SEQ ID NO: 837927 - RNA, 22 nt, Human
agggagcuguggucagcucagu

SEQ ID NO: 837928 - RNA, 22 nt, Human
gcaggagcccuggcauguucuu

SEQ ID NO: 837929 - RNA, 22 nt, Human
gauggcaggcaggugaguagag

SEQ ID NO: 837930 - RNA, 22 nt, Human
gggacuggcacagggcugggag

SEQ ID NO: 837931 - RNA, 21 nt, Human
cagcagaguaaugcauucgua

SEQ ID NO: 837932 - RNA, 22 nt, Human
ggcugccugcuccuccugcacg

SEQ ID NO: 837933 - RNA, 20 nt, Human
aggagaugauccagagucag

SEQ ID NO: 837934 - RNA, 22 nt, Human
aauugugcuaugauuaugaaag

SEQ ID NO: 837935 - RNA, 22 nt, Human
ccagacuguggaguuccuggug

SEQ ID NO: 837936 - RNA, 22 nt, Human
ugggcugcugcggugcucuugg

SEQ ID NO: 837937 - RNA, 22 nt, Human
agccuggcuguaaccucauggu

SEQ ID NO: 837938 - RNA, 22 nt, Human
uugguacagaugagguauucuc

SEQ ID NO: 837939 - RNA, 22 nt, Human
ugaaguuauauauguugaaaau

SEQ ID NO: 837940 - RNA, 22 nt, Human
cagggccucuccuccaggaacu

SEQ ID NO: 837941 - RNA, 22 nt, Human
agucuucacucuucacuacuau

SEQ ID NO: 837942 - RNA, 22 nt, Human
gaaacccaaacuaagacaguag

SEQ ID NO: 837943 - RNA, 22 nt, Human
guaggcagauaggagugcagcc

SEQ ID NO: 837944 - RNA, 19 nt, Human
auggaaaaugccagacuga

SEQ ID NO: 837945 - RNA, 22 nt, Human
uucauucugcaguucucagcuc

SEQ ID NO: 837946 - RNA, 22 nt, Human
cccaggagagaggccaguuggc

SEQ ID NO: 837947 - RNA, 22 nt, Human
uuuauguaauuucauaggugug

SEQ ID NO: 837948 - RNA, 22 nt, Human
agagccagcaagugaauaguga

SEQ ID NO: 837949 - RNA, 20 nt, Human
ccuguucacugcgcaguuuc

SEQ ID NO: 837950 - RNA, 22 nt, Human
cuccagggaggucugcaggacu

SEQ ID NO: 837951 - RNA, 22 nt, Human
acugcuuuagaccuagagcucu

SEQ ID NO: 837952 - RNA, 22 nt, Human
uucacaggaauguaggggucuu

SEQ ID NO: 837953 - RNA, 19 nt, Human
uggcauugguccagauaaa

SEQ ID NO: 837954 - RNA, 22 nt, Human
caucagaaccaguggggacauu

SEQ ID NO: 837955 - RNA, 20 nt, Human
agcccuguuuccuggagaga

SEQ ID NO: 837956 - RNA, 22 nt, Human
ugcaggaacugggagggauagu

SEQ ID NO: 837957 - RNA, 22 nt, Human
gcuggcucuucaguggagauag

SEQ ID NO: 837958 - RNA, 22 nt, Human
ggcuggcuggcugguagacaag

SEQ ID NO: 837959 - RNA, 22 nt, Human
gugugcagaagacacaagacau

SEQ ID NO: 837960 - RNA, 22 nt, Human
aggccuuccucggagacaggga

SEQ ID NO: 837961 - RNA, 22 nt, Human
cagcccugccauggagccuccu

SEQ ID NO: 837962 - RNA, 22 nt, Human
auagucuuagucuauaguuuug

SEQ ID NO: 837963 - RNA, 22 nt, Human
aggggccucgcaggaccgcucc

SEQ ID NO: 837964 - RNA, 22 nt, Human
auguacaguuucuagacucaaa

SEQ ID NO: 837965 - RNA, 22 nt, Human
aaagcagaggugauaugacuua

SEQ ID NO: 837966 - RNA, 22 nt, Human
ugccuggaugugcuggccucac

SEQ ID NO: 837967 - RNA, 22 nt, Human
gcucugcucuugacuuaccagg

SEQ ID NO: 837968 - RNA, 22 nt, Human
ccugacgaaaggcgugcuggag

SEQ ID NO: 837969 - RNA, 22 nt, Human
agggcagcucucaccucuggcc

SEQ ID NO: 837970 - RNA, 21 nt, Human
ugcagccauucagcccuaugc

SEQ ID NO: 837971 - RNA, 22 nt, Human
aggagugcaaauaguccagaga

SEQ ID NO: 837972 - RNA, 22 nt, Human
cagaaauaaacuucucacaucg

SEQ ID NO: 837973 - RNA, 22 nt, Human
aggcagcagggccacuggcuga

SEQ ID NO: 837974 - RNA, 22 nt, Human
gccuggagugguccugcugccc

SEQ ID NO: 837975 - RNA, 22 nt, Human
ugaacgcagguccacauggcuc

SEQ ID NO: 837976 - RNA, 22 nt, Human
uuacaaagcguugagacaagua

SEQ ID NO: 837977 - RNA, 21 nt, Human
cuacagaaucgagcauucugg

SEQ ID NO: 837978 - RNA, 22 nt, Human
auaugcuugggacugauacagu

SEQ ID NO: 837979 - RNA, 22 nt, Human
cucacugcaaguuccaccuacc

SEQ ID NO: 837980 - RNA, 22 nt, Human
uuccaguugguagaauguaagg

SEQ ID NO: 837981 - RNA, 22 nt, Human
auacaagacucagcacagacgg

SEQ ID NO: 837982 - RNA, 22 nt, Human
ucacauuuguuccucugcacuu

SEQ ID NO: 837983 - RNA, 22 nt, Human
agaggccuaaccaagauguccu

SEQ ID NO: 837984 - RNA, 22 nt, Human
cacugcuuaguugguaaaugug

SEQ ID NO: 837985 - RNA, 22 nt, Human
cagcuucccuuggcugagcaga

SEQ ID NO: 837986 - RNA, 22 nt, Human
uuugcuauaaaagggucacacg

SEQ ID NO: 837987 - RNA, 22 nt, Human
gcaggcaguuugcuuuucccuc

SEQ ID NO: 837988 - RNA, 22 nt, Human
cacugaagccugggaguaagac

SEQ ID NO: 837989 - RNA, 22 nt, Human
uuucaguuuaugucuugaauua

SEQ ID NO: 837990 - RNA, 22 nt, Human
cacagugcaugaugggcagaag

SEQ ID NO: 837991 - RNA, 22 nt, Human
cacaggcucuucucacuugauu

SEQ ID NO: 837992 - RNA, 22 nt, Human
auuugcuuuaagguauaaaagg

SEQ ID NO: 837993 - RNA, 22 nt, Human
aggcagagagcaguggccgucu

SEQ ID NO: 837994 - RNA, 22 nt, Human
ggaccagagcucgggcuucuca

SEQ ID NO: 837995 - RNA, 22 nt, Human
gagcccaggcagagguugcagu

SEQ ID NO: 837996 - RNA, 22 nt, Human
uuucugaagauacagcuuugcu

SEQ ID NO: 837997 - RNA, 22 nt, Human
ggcugcuucucacucauuugca

SEQ ID NO: 837998 - RNA, 20 nt, Human
ccuggaagagcuccccaggc

SEQ ID NO: 837999 - RNA, 22 nt, Human
cuccugggaauuuaguugugag

SEQ ID NO: 838000 - RNA, 22 nt, Human
cuggcuuucuguuauaaagaca

SEQ ID NO: 838001 - RNA, 22 nt, Human
agcugcucccuauccuuuccuu

SEQ ID NO: 838002 - RNA, 22 nt, Human
ugagggaguuggguguauagga

SEQ ID NO: 838003 - RNA, 22 nt, Human
uuugcauuuccagaguagcaga

SEQ ID NO: 838004 - RNA, 20 nt, Human
uuucacagucccuguuuccu

SEQ ID NO: 838005 - RNA, 20 nt, Human
ucuuauacagaaaacauuuu

SEQ ID NO: 838006 - RNA, 22 nt, Human
uuugcauuucuaaugagcuccg

SEQ ID NO: 838007 - RNA, 22 nt, Human
ugggggucaggaugaggccuug

SEQ ID NO: 838008 - RNA, 22 nt, Human
ugggacagugugccuugcuccu

SEQ ID NO: 838009 - RNA, 22 nt, Human
gcucucugguuccagucaggaa

SEQ ID NO: 838010 - RNA, 22 nt, Human
ugcauauugugaaaauguagau

SEQ ID NO: 838011 - RNA, 22 nt, Human
uauuaucauugguaauaugguc

SEQ ID NO: 838012 - RNA, 22 nt, Human
gcagcugcagacccucagugcu

SEQ ID NO: 838013 - RNA, 22 nt, Human
agccagggauggcagugcccag

SEQ ID NO: 838014 - RNA, 19 nt, Human
ucauucaggaccaguggau

SEQ ID NO: 838015 - RNA, 22 nt, Human
agcagccacccagcugcucauu

SEQ ID NO: 838016 - RNA, 22 nt, Human
aaaguguaaggaauuuaaguaa

SEQ ID NO: 838017 - RNA, 22 nt, Human
gcaaggcugcugccacccaucu

SEQ ID NO: 838018 - RNA, 20 nt, Human
gcuuccuucccagcccccac

SEQ ID NO: 838019 - RNA, 22 nt, Human
gccugggagagggauagugcag

SEQ ID NO: 838020 - RNA, 22 nt, Human
aucucagacauguuguccauga

SEQ ID NO: 838021 - RNA, 22 nt, Human
agugcagcaugcuggggaggcu

SEQ ID NO: 838022 - RNA, 22 nt, Human
ucugggaacucugucauuuccc

SEQ ID NO: 838023 - RNA, 22 nt, Human
cggggcugcucguccuccugug

SEQ ID NO: 838024 - RNA, 22 nt, Human
cccaggucuaugccagcucuga

SEQ ID NO: 838025 - RNA, 22 nt, Human
uuuuagcacuaagugauaugcu

SEQ ID NO: 838026 - RNA, 19 nt, Human
aacuagaaagguuuugaga

SEQ ID NO: 838027 - RNA, 22 nt, Human
ccaaggagcucauauucuuguu

SEQ ID NO: 838028 - RNA, 17 nt, Human
ugccagccugucccagg

SEQ ID NO: 838029 - RNA, 22 nt, Human
gcagggaagacccggagcagcg

SEQ ID NO: 838030 - RNA, 22 nt, Human
gaaaucugaacucuguauccuu

SEQ ID NO: 838031 - RNA, 23 nt, Human
agagcuuucuaaaauguaaaucu

SEQ ID NO: 838032 - RNA, 22 nt, Human
uggagcuggaauuugagcugga

SEQ ID NO: 838033 - RNA, 23 nt, Human
gugugccaagcacugugccagga

SEQ ID NO: 838034 - RNA, 22 nt, Human
gcuggccacauugugccguccu

SEQ ID NO: 838035 - RNA, 22 nt, Human
gcugcccugugguccagcaggu

SEQ ID NO: 838036 - RNA, 22 nt, Human
ugccauuuugagauguuaauga

SEQ ID NO: 838037 - RNA, 22 nt, Human
aguaaugugccugaaauacuug

SEQ ID NO: 838038 - RNA, 22 nt, Human
aagugaguggccuggagaggug

SEQ ID NO: 838039 - RNA, 22 nt, Human
aaagagcuucauuuccauuuau

SEQ ID NO: 838040 - RNA, 22 nt, Human
ggccucggcccacugcugcggu

SEQ ID NO: 838041 - RNA, 22 nt, Human
uaggcagccagcaucaguuggg

SEQ ID NO: 838042 - RNA, 22 nt, Human
aucuucucauguguaaugaggu

SEQ ID NO: 838043 - RNA, 23 nt, Human
caggcaggaugaggacuacacuc

SEQ ID NO: 838044 - RNA, 22 nt, Human
augggcugugagguccggcagg

SEQ ID NO: 838045 - RNA, 22 nt, Human
cuccaggaaagccugaggcccg

SEQ ID NO: 838046 - RNA, 22 nt, Human
uccaggagugugugcuaauggg

SEQ ID NO: 838047 - RNA, 22 nt, Human
agaggcuccaccuucucugucc

SEQ ID NO: 838048 - RNA, 20 nt, Human
gggugagauguaggagaggg

SEQ ID NO: 838049 - RNA, 22 nt, Human
acugaaauacugcucuuggauu

SEQ ID NO: 838050 - RNA, 19 nt, Human
gugauuucuuuccacaagc

SEQ ID NO: 838051 - RNA, 22 nt, Human
accugagccuagggagguugag

SEQ ID NO: 838052 - RNA, 22 nt, Human
cacugucuuuugugaagacaau

SEQ ID NO: 838053 - RNA, 22 nt, Human
uuauuccauagaagucaaggaa

SEQ ID NO: 838054 - RNA, 22 nt, Human
gcgucugaguugcgggggcuca

SEQ ID NO: 838055 - RNA, 22 nt, Human
agagccugaggccaggaaaaug

SEQ ID NO: 838056 - RNA, 22 nt, Human
caggagugucuccacacagcaa

SEQ ID NO: 838057 - RNA, 22 nt, Human
cacaggagguuaggaagugguc

SEQ ID NO: 838058 - RNA, 22 nt, Human
gcagccagccccucugaccucu

SEQ ID NO: 838059 - RNA, 22 nt, Human
ggcucuggagcacagacgucug

SEQ ID NO: 838060 - RNA, 22 nt, Human
ucagggcauucaagaggccugg

SEQ ID NO: 838061 - RNA, 22 nt, Human
gcagggcugcugaaacuuguuu

SEQ ID NO: 838062 - RNA, 22 nt, Human
uuaaaugaggcugauguagauu

SEQ ID NO: 838063 - RNA, 22 nt, Human
gcugccugccuugccuggagga

SEQ ID NO: 838064 - RNA, 22 nt, Human
aaagaacaaaugauauaugguu

SEQ ID NO: 838065 - RNA, 22 nt, Human
aguguuucuggcaaaugaaagu

SEQ ID NO: 838066 - RNA, 22 nt, Human
uuauucuucuucucuugccagg

SEQ ID NO: 838067 - RNA, 22 nt, Human
caugguuuugagccuauuaugc

SEQ ID NO: 838068 - RNA, 19 nt, Human
aucagcaagguaggaugug

SEQ ID NO: 838069 - RNA, 22 nt, Human
acugucucucuagcaguucagg

SEQ ID NO: 838070 - RNA, 22 nt, Human
gcuccugggcucuaccuugcua

SEQ ID NO: 838071 - RNA, 22 nt, Human
ugauuuccacagucaggggugc

SEQ ID NO: 838072 - RNA, 22 nt, Human
ccugccuguacuagagacccag

SEQ ID NO: 838073 - RNA, 22 nt, Human
ucaacuuugaaaccauagugaa

SEQ ID NO: 838074 - RNA, 22 nt, Human
aaggcagauauaaagacuagag

SEQ ID NO: 838075 - RNA, 22 nt, Human
cccugcagcuuuugcauaguca

SEQ ID NO: 838076 - RNA, 22 nt, Human
gcaggagccaggccgagcuggu

SEQ ID NO: 838077 - RNA, 22 nt, Human
ccagucccaggcagaaauccag

SEQ ID NO: 838078 - RNA, 22 nt, Human
aaguucuaauuuugcauucagg

SEQ ID NO: 838079 - RNA, 22 nt, Human
agagaggcgaguuaccugugcu

SEQ ID NO: 838080 - RNA, 22 nt, Human
ugcuggcuacauuauugcuguc

SEQ ID NO: 838081 - RNA, 22 nt, Human
uaucuauuccaaauaucagcgu

SEQ ID NO: 838082 - RNA, 22 nt, Human
agggcagagagaugaaugggau

SEQ ID NO: 838083 - RNA, 22 nt, Human
gcugccugauuuacauagugaa

SEQ ID NO: 838084 - RNA, 22 nt, Human
cuggcagcagcuucuggaucga

SEQ ID NO: 838085 - RNA, 22 nt, Human
gcugccacuuggucaugucaug

SEQ ID NO: 838086 - RNA, 22 nt, Human
uggcaggguggcaacuuuuggu

SEQ ID NO: 838087 - RNA, 20 nt, Human
aagcacauuucuacaauaau

SEQ ID NO: 838088 - RNA, 22 nt, Human
uguguccuucugggagucccag

SEQ ID NO: 838089 - RNA, 22 nt, Human
uggccuccccuaacagccucuu

SEQ ID NO: 838090 - RNA, 22 nt, Human
uggcuccuaucaaggagugggu

SEQ ID NO: 838091 - RNA, 22 nt, Human
auaucauuauguuaugagcaca

SEQ ID NO: 838092 - RNA, 22 nt, Human
ucaguaaacagguuuaaguccu

SEQ ID NO: 838093 - RNA, 22 nt, Human
aucuggcuuacgaagcacuggu

SEQ ID NO: 838094 - RNA, 22 nt, Human
auucuucaucacuaccuuguga

SEQ ID NO: 838095 - RNA, 22 nt, Human
cagggccagcgcccaggcccag

SEQ ID NO: 838096 - RNA, 22 nt, Human
ugaggccaggaucccaggcucu

SEQ ID NO: 838097 - RNA, 22 nt, Human
agccuggaccaggggccucaga

SEQ ID NO: 838098 - RNA, 22 nt, Human
cugugucccaguaccuugggua

SEQ ID NO: 838099 - RNA, 17 nt, Human
uagagcugguucaggag

SEQ ID NO: 838100 - RNA, 22 nt, Human
gugugcaguagagaaagagcag

SEQ ID NO: 838101 - RNA, 20 nt, Human
acagccagaggaggcagaca

SEQ ID NO: 838102 - RNA, 22 nt, Human
acugcuuuaucugagaaguccu

SEQ ID NO: 838103 - RNA, 22 nt, Human
uaacauguuaagaaauuagaua

SEQ ID NO: 838104 - RNA, 22 nt, Human
uccaggaggguuuucugccuuc

SEQ ID NO: 838105 - RNA, 22 nt, Human
cuccaggagggggauggcugua

SEQ ID NO: 838106 - RNA, 22 nt, Human
uuccaugagcucugaguucaca

SEQ ID NO: 838107 - RNA, 22 nt, Human
agcuaccuggcuuaucacuguc

SEQ ID NO: 838108 - RNA, 22 nt, Human
ucuugauuacaaauaacaucau

SEQ ID NO: 838109 - RNA, 22 nt, Human
uuuuccuucuagagcagauuuc

SEQ ID NO: 838110 - RNA, 22 nt, Human
ccagcuccaggacugggagcug

SEQ ID NO: 838111 - RNA, 22 nt, Human
cuacauaaauuuaucacagacu

SEQ ID NO: 838112 - RNA, 22 nt, Human
cugggcuucucccccuggcaga

SEQ ID NO: 838113 - RNA, 22 nt, Human
aggcagcccugugcuggaugcu

SEQ ID NO: 838114 - RNA, 23 nt, Human
auaauaacgucugucuugucucu

SEQ ID NO: 838115 - RNA, 22 nt, Human
uccuugaagagugggcggucga

SEQ ID NO: 838116 - RNA, 22 nt, Human
cccaggccagaacuugguugcu

SEQ ID NO: 838117 - RNA, 22 nt, Human
uucagaaacccauugggucucu

SEQ ID NO: 838118 - RNA, 22 nt, Human
acaacaggguaaggcaggccau

SEQ ID NO: 838119 - RNA, 22 nt, Human
ggcaggagaauggcgugaacuc

SEQ ID NO: 838120 - RNA, 22 nt, Human
gggagagguuacccgagcaacu

SEQ ID NO: 838121 - RNA, 22 nt, Human
ucaggacagccagggugcagac

SEQ ID NO: 838122 - RNA, 22 nt, Human
auaugaagucagacaaacuggg

SEQ ID NO: 838123 - RNA, 22 nt, Human
uggagcuggaauuucugggccu

SEQ ID NO: 838124 - RNA, 22 nt, Human
ggggaugguggcauuuguaaaa

SEQ ID NO: 838125 - RNA, 22 nt, Human
ucaggaaagaagaugcucagug

SEQ ID NO: 838126 - RNA, 22 nt, Human
cagcaggauuugaaaggaagag

SEQ ID NO: 838127 - RNA, 22 nt, Human
gcaggcaguuauuuaguagaau

SEQ ID NO: 838128 - RNA, 18 nt, Human
auuuugaacaaugcugua

SEQ ID NO: 838129 - RNA, 22 nt, Human
ccagguggaaggucugugcucu

SEQ ID NO: 838130 - RNA, 18 nt, Human
uggagcugagugcugugc

SEQ ID NO: 838131 - RNA, 20 nt, Human
ugucauuguuucuaggaccu

SEQ ID NO: 838132 - RNA, 22 nt, Human
uugaggagcacuagucagguau

SEQ ID NO: 838133 - RNA, 22 nt, Human
cacaauuuccuugcuucacuuu

SEQ ID NO: 838134 - RNA, 22 nt, Human
gggcucuguccauuccuucaua

SEQ ID NO: 838135 - RNA, 22 nt, Human
cuucucuucccagggacacagg

SEQ ID NO: 838136 - RNA, 22 nt, Human
ucacaugcuacugagccagacc

SEQ ID NO: 838137 - RNA, 22 nt, Human
uuugggaaacuuaggggucaga

SEQ ID NO: 838138 - RNA, 22 nt, Human
acacagggcaaugcuuugaccu

SEQ ID NO: 838139 - RNA, 22 nt, Human
aaauaguucagccacggugacu

SEQ ID NO: 838140 - RNA, 18 nt, Human
gaggauggaaggagaugc

SEQ ID NO: 838141 - RNA, 22 nt, Human
agaccuggauuccaauccuacc

SEQ ID NO: 838142 - RNA, 22 nt, Human
agcagcaugaugacagagucuc

SEQ ID NO: 838143 - RNA, 22 nt, Human
uccaggagcauccaggugaagc

SEQ ID NO: 838144 - RNA, 22 nt, Human
auguacacaugcaugcaugugc

SEQ ID NO: 838145 - RNA, 22 nt, Human
gcaggcaggcuuccuugaacug

SEQ ID NO: 838146 - RNA, 22 nt, Human
acagcagagugugagauagcca

SEQ ID NO: 838147 - RNA, 21 nt, Human
uuuaaagaauaggaagggagg

SEQ ID NO: 838148 - RNA, 22 nt, Human
gcacaugagcugcugggauggg

SEQ ID NO: 838149 - RNA, 22 nt, Human
ugcuuuaaccaucuuguuugga

SEQ ID NO: 838150 - RNA, 22 nt, Human
agaugaagacucaggagcaggu

SEQ ID NO: 838151 - RNA, 22 nt, Human
aaggcugaguaaaacagagaac

SEQ ID NO: 838152 - RNA, 22 nt, Human
auacuucuuugauguucacagg

SEQ ID NO: 838153 - RNA, 22 nt, Human
caggccaggcugcauuugcccc

SEQ ID NO: 838154 - RNA, 22 nt, Human
cucccagagaccaagcugagaa

SEQ ID NO: 838155 - RNA, 22 nt, Human
cuauacaguaaccacagugauu

SEQ ID NO: 838156 - RNA, 22 nt, Human
agaauucauaggaaguuuccua

SEQ ID NO: 838157 - RNA, 22 nt, Human
gcucaggaucccaggggugugc

SEQ ID NO: 838158 - RNA, 22 nt, Human
ccugaagaugcuguggccuggu

SEQ ID NO: 838159 - RNA, 22 nt, Human
cagcaugcaaguccagaugugg

SEQ ID NO: 838160 - RNA, 22 nt, Human
gcugucacauuuggagcacugg

SEQ ID NO: 838161 - RNA, 22 nt, Human
ggcucugguugaccaugauggc

SEQ ID NO: 838162 - RNA, 23 nt, Human
agcccagcagagaaccuaggucc

SEQ ID NO: 838163 - RNA, 22 nt, Human
caacagaagguguacuacugaa

SEQ ID NO: 838164 - RNA, 22 nt, Human
gugucccaaucuacuuuucccu

SEQ ID NO: 838165 - RNA, 22 nt, Human
auuuagacuucccagcacugug

SEQ ID NO: 838166 - RNA, 22 nt, Human
cccacucuggcucccuucuagu

SEQ ID NO: 838167 - RNA, 22 nt, Human
ggccucaguuucuccauggguu

SEQ ID NO: 838168 - RNA, 22 nt, Human
guacagaaaugugaugacgcaa

SEQ ID NO: 838169 - RNA, 22 nt, Human
cacagcuugggcucugacaaua

SEQ ID NO: 838170 - RNA, 22 nt, Human
uggcaguguauagguggcuccu

SEQ ID NO: 838171 - RNA, 22 nt, Human
cuucuucauaggcaguccuguu

SEQ ID NO: 838172 - RNA, 22 nt, Human
uugaaaggaauacagaggccua

SEQ ID NO: 838173 - RNA, 22 nt, Human
cugcugggaaggucugcucagu

SEQ ID NO: 838174 - RNA, 22 nt, Human
agguggcuccucccauggcugg

SEQ ID NO: 838175 - RNA, 22 nt, Human
gccugagccgccugagcggcgg

SEQ ID NO: 838176 - RNA, 22 nt, Human
gcugucagcgcccaaggagcuc

SEQ ID NO: 838177 - RNA, 20 nt, Human
uaggcagcuugacccuuggu

SEQ ID NO: 838178 - RNA, 22 nt, Human
cagcaucaccgccauuucugau

SEQ ID NO: 838179 - RNA, 22 nt, Human
ugucauguguucuuaaauacau

SEQ ID NO: 838180 - RNA, 22 nt, Human
ucagcuggcaguucagaggcug

SEQ ID NO: 838181 - RNA, 23 nt, Human
cccuguagcccaggacaggcuuu

SEQ ID NO: 838182 - RNA, 22 nt, Human
gcacccagaggucagcagugcu

SEQ ID NO: 838183 - RNA, 22 nt, Human
agagcugaggauccagcugagc

SEQ ID NO: 838184 - RNA, 22 nt, Human
aggagcccugcgggaggcagag

SEQ ID NO: 838185 - RNA, 22 nt, Human
uccucugcuguucugguucuuu

SEQ ID NO: 838186 - RNA, 19 nt, Human
accaggaguaucagagcug

SEQ ID NO: 838187 - RNA, 22 nt, Human
ucucucuucaacccuuaacuag

SEQ ID NO: 838188 - RNA, 22 nt, Human
acaaugcaccagcaucuucacc

SEQ ID NO: 838189 - RNA, 21 nt, Human
ccugagccuguuuauccagaa

SEQ ID NO: 838190 - RNA, 22 nt, Human
uuugaacugauaaucuucuguu

SEQ ID NO: 838191 - RNA, 22 nt, Human
gggggcuguccugugcauugua

SEQ ID NO: 838192 - RNA, 22 nt, Human
caucacuguccaaaguucaguu

SEQ ID NO: 838193 - RNA, 22 nt, Human
guaaauuauuucaagaucaucu

SEQ ID NO: 838194 - RNA, 22 nt, Human
uuucaugagauuccuccacauc

SEQ ID NO: 838195 - RNA, 22 nt, Human
gcagggcugcagagggcacugu

SEQ ID NO: 838196 - RNA, 22 nt, Human
aauguuaauguguuugcuuaug

SEQ ID NO: 838197 - RNA, 22 nt, Human
uucaaauacauucuuugccacu

SEQ ID NO: 838198 - RNA, 22 nt, Human
gcacagguugcaaaaguucaca

SEQ ID NO: 838199 - RNA, 22 nt, Human
gaauuucagaucagagaccauu

SEQ ID NO: 838200 - RNA, 22 nt, Human
ugccugggguuggcaaacugcu

SEQ ID NO: 838201 - RNA, 22 nt, Human
gagccuguguuuccuguagcca

SEQ ID NO: 838202 - RNA, 22 nt, Human
gcugcagcagaaguucucagag

SEQ ID NO: 838203 - RNA, 22 nt, Human
acaggcucucagccaguuggca

SEQ ID NO: 838204 - RNA, 22 nt, Human
ucagaggagccaaaguucugag

SEQ ID NO: 838205 - RNA, 22 nt, Human
gccuucagcggccgcucgcugc

SEQ ID NO: 838206 - RNA, 22 nt, Human
cuggagcagguuuaggaguccc

SEQ ID NO: 838207 - RNA, 22 nt, Human
gagccugaaauacaggucacug

SEQ ID NO: 838208 - RNA, 22 nt, Human
auuccaaagcacaucagaacua

SEQ ID NO: 838209 - RNA, 22 nt, Human
ccacagagacaggguccuugcu

SEQ ID NO: 838210 - RNA, 22 nt, Human
augccagucaaagaagaugaca

SEQ ID NO: 838211 - RNA, 21 nt, Human
ugcaggcaggcagagaugcug

SEQ ID NO: 838212 - RNA, 22 nt, Human
uggcagcaauuugugauguuga

SEQ ID NO: 838213 - RNA, 22 nt, Human
ggcuggaaguccaagaucaagg

SEQ ID NO: 838214 - RNA, 22 nt, Human
gucccugcccuccugggacuca

SEQ ID NO: 838215 - RNA, 22 nt, Human
aagcuuucagagcagaauguga

SEQ ID NO: 838216 - RNA, 22 nt, Human
uucucagguagugcugaugcug

SEQ ID NO: 838217 - RNA, 22 nt, Human
ucuguagcaagugagaggcauu

SEQ ID NO: 838218 - RNA, 22 nt, Human
uccuucagaaaaccucagucuu

SEQ ID NO: 838219 - RNA, 22 nt, Human
gauuucaccugaucuugucauc

SEQ ID NO: 838220 - RNA, 19 nt, Human
agccuggcuuugcucugcu

SEQ ID NO: 838221 - RNA, 22 nt, Human
gaaggccauugcguccugggau

SEQ ID NO: 838222 - RNA, 22 nt, Human
ccugucugcaugaucccugcca

SEQ ID NO: 838223 - RNA, 22 nt, Human
aggagccaggaaaccugcucug

SEQ ID NO: 838224 - RNA, 22 nt, Human
caggaaagagcugccaggcagg

SEQ ID NO: 838225 - RNA, 22 nt, Human
ggcaggcagaggcugagacagg

SEQ ID NO: 838226 - RNA, 22 nt, Human
acuccuggggauccauuccuuu

SEQ ID NO: 838227 - RNA, 22 nt, Human
ccagaggcuggguucaccucag

SEQ ID NO: 838228 - RNA, 22 nt, Human
augaaacaugagaaauggagag

SEQ ID NO: 838229 - RNA, 22 nt, Human
ugcaggagcagagauggcugga

SEQ ID NO: 838230 - RNA, 22 nt, Human
ucuggcagggguucugcacuug

SEQ ID NO: 838231 - RNA, 21 nt, Human
aggcaucuaaagagaguagac

SEQ ID NO: 838232 - RNA, 22 nt, Human
ugaggcaguauuuuagugacuu

SEQ ID NO: 838233 - RNA, 22 nt, Human
aucuacccacugaacacaauau

SEQ ID NO: 838234 - RNA, 22 nt, Human
cauauaaauacaacauguguua

SEQ ID NO: 838235 - RNA, 22 nt, Human
auugaaagaguuuucugcugca

SEQ ID NO: 838236 - RNA, 20 nt, Human
gcauugaguauagacagaug

SEQ ID NO: 838237 - RNA, 22 nt, Human
ccacagggaacaugacagccuu

SEQ ID NO: 838238 - RNA, 22 nt, Human
auuauauaggacuugcccuucc

SEQ ID NO: 838239 - RNA, 22 nt, Human
aaggcagcaagaauuccagguu

SEQ ID NO: 838240 - RNA, 22 nt, Human
gccacugcacuccagcccaggc

SEQ ID NO: 838241 - RNA, 22 nt, Human
cagguggguguaugaaugcaaa

SEQ ID NO: 838242 - RNA, 22 nt, Human
gcccuuccuuagacagcaggau

SEQ ID NO: 838243 - RNA, 22 nt, Human
auagaacagaaacagaugcaca

SEQ ID NO: 838244 - RNA, 22 nt, Human
guucauauuacuuugagugcag

SEQ ID NO: 838245 - RNA, 22 nt, Human
uugacagcuauuuugcuuugau

SEQ ID NO: 838246 - RNA, 21 nt, Human
agcaccuuacagcuauaaugg

SEQ ID NO: 838247 - RNA, 22 nt, Human
ucauaaaugcagugucauaaau

SEQ ID NO: 838248 - RNA, 23 nt, Human
ggcacugaagcuacaauggugag

SEQ ID NO: 838249 - RNA, 22 nt, Human
agggacagaugaaugacugagu

SEQ ID NO: 838250 - RNA, 22 nt, Human
ugaugggacugccagcugcuga

SEQ ID NO: 838251 - RNA, 22 nt, Human
ucagggcauacucuucaagguc

SEQ ID NO: 838252 - RNA, 22 nt, Human
ccugggucuugguucaugcucu

SEQ ID NO: 838253 - RNA, 22 nt, Human
ccagagccucuuaugaagaucg

SEQ ID NO: 838254 - RNA, 22 nt, Human
aggccagcacgacagccgcagg

SEQ ID NO: 838255 - RNA, 22 nt, Human
uucucuucuguucagugcccaa

SEQ ID NO: 838256 - RNA, 22 nt, Human
auugcacaaacacagucagacu

SEQ ID NO: 838257 - RNA, 22 nt, Human
auguagaauuccuucuacuuug

SEQ ID NO: 838258 - RNA, 19 nt, Human
augucuggguaacagcugc

SEQ ID NO: 838259 - RNA, 22 nt, Human
gauuucuuugcaagcuguguuc

SEQ ID NO: 838260 - RNA, 22 nt, Human
cacaggugcuccucggggagcu

SEQ ID NO: 838261 - RNA, 22 nt, Human
cuguuuauuacacuggauagca

SEQ ID NO: 838262 - RNA, 22 nt, Human
uccauugucuuugguccuagcc

SEQ ID NO: 838263 - RNA, 22 nt, Human
gccugcuggcuguccauugcag

SEQ ID NO: 838264 - RNA, 22 nt, Human
gccaggcuggccagcaccuucu

SEQ ID NO: 838265 - RNA, 22 nt, Human
gugcaugugucuuuauaguaga

SEQ ID NO: 838266 - RNA, 22 nt, Human
gcuggcuugauaguuucugcuu

SEQ ID NO: 838267 - RNA, 22 nt, Human
agaaaugaaaccaaagccuaga

SEQ ID NO: 838268 - RNA, 22 nt, Human
caggcuggagugcaguugugca

SEQ ID NO: 838269 - RNA, 22 nt, Human
guggauggauuuugaggaaugg

SEQ ID NO: 838270 - RNA, 17 nt, Human
uguagcuucuccuucuc

SEQ ID NO: 838271 - RNA, 22 nt, Human
ccagcuggcaggagagucaggg

SEQ ID NO: 838272 - RNA, 22 nt, Human
cuggcagcgguuugcagccugg

SEQ ID NO: 838273 - RNA, 22 nt, Human
aggugccagaugcacagcugaa

SEQ ID NO: 838274 - RNA, 22 nt, Human
uggcaggagguuuucuccagga

SEQ ID NO: 838275 - RNA, 22 nt, Human
acauuguuugagaauacagaug

SEQ ID NO: 838276 - RNA, 21 nt, Human
aaggcagaagcauggaaugag

SEQ ID NO: 838277 - RNA, 22 nt, Human
cugcuggggucagagcacuggg

SEQ ID NO: 838278 - RNA, 22 nt, Human
gauuuuauauggcauacugugg

SEQ ID NO: 838279 - RNA, 17 nt, Human
uguggccuucugagcuu

SEQ ID NO: 838280 - RNA, 21 nt, Human
uauacaugugugcauacgugu

SEQ ID NO: 838281 - RNA, 22 nt, Human
cagaaauggaauuuuccaucac

SEQ ID NO: 838282 - RNA, 22 nt, Human
agcuggcagucauccuagugag

SEQ ID NO: 838283 - RNA, 22 nt, Human
agucccaguucgguucuuccuc

SEQ ID NO: 838284 - RNA, 22 nt, Human
cagcugccuucugcgggaaguc

SEQ ID NO: 838285 - RNA, 22 nt, Human
aauauugagaaccagcauguuu

SEQ ID NO: 838286 - RNA, 22 nt, Human
ucccagccuuccagucugguuu

SEQ ID NO: 838287 - RNA, 17 nt, Human
ugagacagggcaggccc

SEQ ID NO: 838288 - RNA, 22 nt, Human
agcauaaaggcacuagaaagag

SEQ ID NO: 838289 - RNA, 22 nt, Human
cagagcugagaauguugaugcu

SEQ ID NO: 838290 - RNA, 22 nt, Human
cuucuucagcacaauauugaug

SEQ ID NO: 838291 - RNA, 22 nt, Human
gcagcugccuucagcuggaugg

SEQ ID NO: 838292 - RNA, 22 nt, Human
gucauucuuaacaacucaguag

SEQ ID NO: 838293 - RNA, 22 nt, Human
uccugccuucauacugcuguau

SEQ ID NO: 838294 - RNA, 22 nt, Human
uuuuccucuguauuugaaaugc

SEQ ID NO: 838295 - RNA, 22 nt, Human
uaaauucccaacucugcucuuc

SEQ ID NO: 838296 - RNA, 22 nt, Human
acagaauucuaguauguggcuu

SEQ ID NO: 838297 - RNA, 22 nt, Human
cuuugaagagauuacugugcuc

SEQ ID NO: 838298 - RNA, 22 nt, Human
ucugugaacaucacauugacag

SEQ ID NO: 838299 - RNA, 22 nt, Human
cucugggcacauuuuccaggac

SEQ ID NO: 838300 - RNA, 22 nt, Human
uuucauaaccucaagcuacagu

SEQ ID NO: 838301 - RNA, 22 nt, Human
ugacaugcuuguuuuccuugaa

SEQ ID NO: 838302 - RNA, 22 nt, Human
uagggaggaggguuuucaaauc

SEQ ID NO: 838303 - RNA, 22 nt, Human
ccagggcacuuaggcccagccc

SEQ ID NO: 838304 - RNA, 21 nt, Human
cagugcucaaucugacagugg

SEQ ID NO: 838305 - RNA, 22 nt, Human
cugcaagauuggaagaugcaau

SEQ ID NO: 838306 - RNA, 22 nt, Human
ucuuuguaaaugccuagcauaa

SEQ ID NO: 838307 - RNA, 22 nt, Human
ccuggacucaggcugugggcac

SEQ ID NO: 838308 - RNA, 22 nt, Human
ccuuaaaagaacuaucucuucu

SEQ ID NO: 838309 - RNA, 18 nt, Human
caggaugagugaugggga

SEQ ID NO: 838310 - RNA, 22 nt, Human
caaauguauucucacuucaggg

SEQ ID NO: 838311 - RNA, 22 nt, Human
ugaggcagcauucuucaagaca

SEQ ID NO: 838312 - RNA, 19 nt, Human
uauggcaggccgaggcacu

SEQ ID NO: 838313 - RNA, 22 nt, Human
ccuuucucuggcagcaggacag

SEQ ID NO: 838314 - RNA, 22 nt, Human
agcauuuaugacuaauguaaaa

SEQ ID NO: 838315 - RNA, 22 nt, Human
uguuuaauaauucuaugauagu

SEQ ID NO: 838316 - RNA, 22 nt, Human
accuugaugccuuuccaagaug

SEQ ID NO: 838317 - RNA, 22 nt, Human
ggcaggugugagaucgaggcca

SEQ ID NO: 838318 - RNA, 22 nt, Human
gaauuucauugcucugcugugu

SEQ ID NO: 838319 - RNA, 23 nt, Human
auguauuuaaauuucagugauga

SEQ ID NO: 838320 - RNA, 22 nt, Human
cgggcagauugggaagguucau

SEQ ID NO: 838321 - RNA, 22 nt, Human
agggccugacacccuugccagc

SEQ ID NO: 838322 - RNA, 20 nt, Human
ggcagcuugggcagcaguua

SEQ ID NO: 838323 - RNA, 22 nt, Human
agagcucaagacgcucacagua

SEQ ID NO: 838324 - RNA, 22 nt, Human
gagcuuggugaugccuccuggu

SEQ ID NO: 838325 - RNA, 22 nt, Human
gaggggcuggcacgauggcugc

SEQ ID NO: 838326 - RNA, 19 nt, Human
ccugugugggguagagauc

SEQ ID NO: 838327 - RNA, 22 nt, Human
ucccagaggcaguugguaacuu

SEQ ID NO: 838328 - RNA, 22 nt, Human
ucucuucucuagugagcaacug

SEQ ID NO: 838329 - RNA, 22 nt, Human
cagccccucacagagcuguccu

SEQ ID NO: 838330 - RNA, 22 nt, Human
cagggcaggaugcugugauuau

SEQ ID NO: 838331 - RNA, 22 nt, Human
gagagaaaugugcaguuugggc

SEQ ID NO: 838332 - RNA, 22 nt, Human
uuccuguccgcaauggccuggg

SEQ ID NO: 838333 - RNA, 22 nt, Human
cagagagagugggguguggauu

SEQ ID NO: 838334 - RNA, 22 nt, Human
cugcagcuguagaggacagugg

SEQ ID NO: 838335 - RNA, 22 nt, Human
agggaaaguaagcauuucauua

SEQ ID NO: 838336 - RNA, 22 nt, Human
gggaguguugagcgcccugcca

SEQ ID NO: 838337 - RNA, 22 nt, Human
gcccaggagccuggagaugugu

SEQ ID NO: 838338 - RNA, 22 nt, Human
aagauucucagagugaaagaau

SEQ ID NO: 838339 - RNA, 22 nt, Human
uuaugcuaaaugaaucaaguca

SEQ ID NO: 838340 - RNA, 18 nt, Human
cucucuggucuggauccc

SEQ ID NO: 838341 - RNA, 22 nt, Human
uggaggaugagugugggcucug

SEQ ID NO: 838342 - RNA, 22 nt, Human
ugcagcagguuccaaaggguua

SEQ ID NO: 838343 - RNA, 22 nt, Human
cccagcuaccucugcuaggaga

SEQ ID NO: 838344 - RNA, 22 nt, Human
aagaaauuaaugugccauuacu

SEQ ID NO: 838345 - RNA, 22 nt, Human
acagaaauauagaagguaggaa

SEQ ID NO: 838346 - RNA, 22 nt, Human
ccagggcaucacauccaguguu

SEQ ID NO: 838347 - RNA, 22 nt, Human
augauuuccaguuguugcuaag

SEQ ID NO: 838348 - RNA, 22 nt, Human
gcauuucuuccuggugugagcc

SEQ ID NO: 838349 - RNA, 22 nt, Human
auugaaaguccuaucuaaggga

SEQ ID NO: 838350 - RNA, 22 nt, Human
caaugaaauugagauccagaga

SEQ ID NO: 838351 - RNA, 22 nt, Human
cagggagaagucuggucagucc

SEQ ID NO: 838352 - RNA, 22 nt, Human
aucucccagccacagcauucuu

SEQ ID NO: 838353 - RNA, 19 nt, Human
ugacaggcuguugccuuga

SEQ ID NO: 838354 - RNA, 22 nt, Human
cucagggucugguccuuagauu

SEQ ID NO: 838355 - RNA, 22 nt, Human
agaguguaauaagggcaagggc

SEQ ID NO: 838356 - RNA, 22 nt, Human
uuccauaauaaccugagagaaa

SEQ ID NO: 838357 - RNA, 22 nt, Human
uuccugaugcacacagucauuu

SEQ ID NO: 838358 - RNA, 22 nt, Human
uuuagacauggcuugcucacuu

SEQ ID NO: 838359 - RNA, 22 nt, Human
gcauuguccugcuucugagugu

SEQ ID NO: 838360 - RNA, 22 nt, Human
cccaggaggguggccucugccc

SEQ ID NO: 838361 - RNA, 22 nt, Human
uggcagagucucuccuuuccag

SEQ ID NO: 838362 - RNA, 22 nt, Human
gaagcagcucagauugacugaa

SEQ ID NO: 838363 - RNA, 22 nt, Human
agucagcagccuggccaggaga

SEQ ID NO: 838364 - RNA, 20 nt, Human
gccuggaggcagagauaaag

SEQ ID NO: 838365 - RNA, 22 nt, Human
ccagggccucguguucugagug

SEQ ID NO: 838366 - RNA, 22 nt, Human
gcagaagcccggucagcgcacg

SEQ ID NO: 838367 - RNA, 22 nt, Human
cagggcuguaaauuagugcuga

SEQ ID NO: 838368 - RNA, 22 nt, Human
cugggagcugucaggagcgugu

SEQ ID NO: 838369 - RNA, 22 nt, Human
ucaccgucgggggucgcugucu

SEQ ID NO: 838370 - RNA, 21 nt, Human
aaucauacaaaacaugucagg

SEQ ID NO: 838371 - RNA, 22 nt, Human
ucuuagaaaugaaguucuuucu

SEQ ID NO: 838372 - RNA, 23 nt, Human
uucaagauacgguuuccaggcug

SEQ ID NO: 838373 - RNA, 19 nt, Human
gcagccaccgcggcggccg

SEQ ID NO: 838374 - RNA, 22 nt, Human
cugggggcaauggucagagugu

SEQ ID NO: 838375 - RNA, 22 nt, Human
cccuuagcuccaagggguuugg

SEQ ID NO: 838376 - RNA, 22 nt, Human
gccugggugaauuugauccuaa

SEQ ID NO: 838377 - RNA, 22 nt, Human
cagcugcccugccuugcccuua

SEQ ID NO: 838378 - RNA, 21 nt, Human
agcuggugucagagcucuggg

SEQ ID NO: 838379 - RNA, 22 nt, Human
auucacuggcagacagaacuca

SEQ ID NO: 838380 - RNA, 22 nt, Human
aggaagcuccaugaaggcagag

SEQ ID NO: 838381 - RNA, 22 nt, Human
ucccagccggugccuggguccc

SEQ ID NO: 838382 - RNA, 22 nt, Human
ccaggagauuuuuccauagcac

SEQ ID NO: 838383 - RNA, 22 nt, Human
gcugccuguccugaggaguccg

SEQ ID NO: 838384 - RNA, 22 nt, Human
aagaaugauuacaaagcaacga

SEQ ID NO: 838385 - RNA, 18 nt, Human
ugugguggagcugccuuc

SEQ ID NO: 838386 - RNA, 22 nt, Human
cagagcuguuacuauucaugaa

SEQ ID NO: 838387 - RNA, 22 nt, Human
gcaccaggcuuagagccccagg

SEQ ID NO: 838388 - RNA, 22 nt, Human
aagagggaggugcgggugcaga

SEQ ID NO: 838389 - RNA, 22 nt, Human
ggcugcuguacugaugucaguu

SEQ ID NO: 838390 - RNA, 22 nt, Human
uuuccaaauaaggucacacuca

SEQ ID NO: 838391 - RNA, 22 nt, Human
gggcccuggauuuaagcaugga

SEQ ID NO: 838392 - RNA, 22 nt, Human
gggcucagccccauugaaccag

SEQ ID NO: 838393 - RNA, 22 nt, Human
cagcccagcacuaaguagauuu

SEQ ID NO: 838394 - RNA, 22 nt, Human
uauccaaaggaacaaucacagc

SEQ ID NO: 838395 - RNA, 22 nt, Human
ucacuuauugcucaucucaugc

SEQ ID NO: 838396 - RNA, 22 nt, Human
uuuauuauguacaggcacuaua

SEQ ID NO: 838397 - RNA, 22 nt, Human
gcacagggaggcuggccuggcc

SEQ ID NO: 838398 - RNA, 22 nt, Human
agaagccauugaagcagaccuc

SEQ ID NO: 838399 - RNA, 22 nt, Human
uuuuuccuaagcaguggagcug

SEQ ID NO: 838400 - RNA, 22 nt, Human
uggucaguugcaucagagaagu

SEQ ID NO: 838401 - RNA, 22 nt, Human
aauagaaaggaggggcucuugu

SEQ ID NO: 838402 - RNA, 22 nt, Human
agacagcugcucgcagagcuau

SEQ ID NO: 838403 - RNA, 22 nt, Human
ugcuccuuccucauccugugca

SEQ ID NO: 838404 - RNA, 21 nt, Human
gauaaaaugggccuugguccu

SEQ ID NO: 838405 - RNA, 22 nt, Human
guuuucaauuauaagauggcuu

SEQ ID NO: 838406 - RNA, 22 nt, Human
cuggagcauccaugcccagggu

SEQ ID NO: 838407 - RNA, 22 nt, Human
cucuucuuggcccccaugaggg

SEQ ID NO: 838408 - RNA, 22 nt, Human
acauuuaaugauccuacuguga

SEQ ID NO: 838409 - RNA, 22 nt, Human
uccaggaguuugaccugugggc

SEQ ID NO: 838410 - RNA, 22 nt, Human
uucugucagcugcuuugucuca

SEQ ID NO: 838411 - RNA, 22 nt, Human
uaugcacaguuacaagaauauc

SEQ ID NO: 838412 - RNA, 22 nt, Human
cuccucacacccacugcaacca

SEQ ID NO: 838413 - RNA, 22 nt, Human
aauuucagaccauuugcaauua

SEQ ID NO: 838414 - RNA, 22 nt, Human
ucauugaauuucacagcuuuau

SEQ ID NO: 838415 - RNA, 22 nt, Human
uagagcuagcuucaaaaugcga

SEQ ID NO: 838416 - RNA, 22 nt, Human
ucaggccacuucacaggugauu

SEQ ID NO: 838417 - RNA, 22 nt, Human
aaugucugagucucuguauccc

SEQ ID NO: 838418 - RNA, 22 nt, Human
aggcaggcaaccaccugggaag

SEQ ID NO: 838419 - RNA, 22 nt, Human
guaaaguucuauuugaauuuag

SEQ ID NO: 838420 - RNA, 22 nt, Human
auacagaagaacuauagccacu

SEQ ID NO: 838421 - RNA, 22 nt, Human
gcccaugcacuuucugugaugg

SEQ ID NO: 838422 - RNA, 21 nt, Human
agcaggaggcagucacagcuc

SEQ ID NO: 838423 - RNA, 22 nt, Human
cccagcacuuugaauaugucac

SEQ ID NO: 838424 - RNA, 22 nt, Human
acaaaauuuuuagacaaggcuu

SEQ ID NO: 838425 - RNA, 22 nt, Human
agcagcaggagccgugggguga

SEQ ID NO: 838426 - RNA, 22 nt, Human
uaauacuguauacugcaaauuu

SEQ ID NO: 838427 - RNA, 22 nt, Human
cuugauguauaaguugauaugu

SEQ ID NO: 838428 - RNA, 22 nt, Human
gaaauauuucucuugagccccu

SEQ ID NO: 838429 - RNA, 22 nt, Human
ccuggaggagcgcugaccagcu

SEQ ID NO: 838430 - RNA, 22 nt, Human
aaguuugagagccuuuaguaua

SEQ ID NO: 838431 - RNA, 22 nt, Human
aaaaaaucagaucuuugguuaa

SEQ ID NO: 838432 - RNA, 22 nt, Human
uaugaagaaguucugugaaaug

SEQ ID NO: 838433 - RNA, 22 nt, Human
aagaggaacugggggcugaguc

SEQ ID NO: 838434 - RNA, 22 nt, Human
ccagagcugauuccugggacuu

SEQ ID NO: 838435 - RNA, 22 nt, Human
guuuccauggcucuguuaaugg

SEQ ID NO: 838436 - RNA, 22 nt, Human
uagcagaaacuguuacagaagg

SEQ ID NO: 838437 - RNA, 22 nt, Human
cagagcuggagaaguggauuua

SEQ ID NO: 838438 - RNA, 22 nt, Human
cccaagagguggagguugcagu

SEQ ID NO: 838439 - RNA, 22 nt, Human
uugccuugauucuucucaugug

SEQ ID NO: 838440 - RNA, 22 nt, Human
gagcucugacugcugggugaca

SEQ ID NO: 838441 - RNA, 22 nt, Human
aaaugcacagguuuuaaauccu

SEQ ID NO: 838442 - RNA, 22 nt, Human
uuaacagagugccuggcaugua

SEQ ID NO: 838443 - RNA, 22 nt, Human
cugagcucuaaugucagccuug

SEQ ID NO: 838444 - RNA, 22 nt, Human
acauuucugucuuagggacugu

SEQ ID NO: 838445 - RNA, 22 nt, Human
cagucccacuagugccaauacc

SEQ ID NO: 838446 - RNA, 22 nt, Human
cugccagguuggcgcucgcucu

SEQ ID NO: 838447 - RNA, 19 nt, Human
ccuuccuccccagggccau

SEQ ID NO: 838448 - RNA, 22 nt, Human
ucagccaggccaggcauucaca

SEQ ID NO: 838449 - RNA, 22 nt, Human
ucauuucaaugauacuacuaag

SEQ ID NO: 838450 - RNA, 22 nt, Human
gaaccaaguaggauacaaggag

SEQ ID NO: 838451 - RNA, 22 nt, Human
aauucugugcaggcagagcuau

SEQ ID NO: 838452 - RNA, 22 nt, Human
auuaggcagggcaugguggcuc

SEQ ID NO: 838453 - RNA, 18 nt, Human
gcuggcugcacuucugcu

SEQ ID NO: 838454 - RNA, 22 nt, Human
ugggcugccagcucuccagaug

SEQ ID NO: 838455 - RNA, 22 nt, Human
uuuucuuaggugcuccaaguag

SEQ ID NO: 838456 - RNA, 22 nt, Human
ggggacugccuuccacagacac

SEQ ID NO: 838457 - RNA, 22 nt, Human
cccugggcagucugcacuucag

SEQ ID NO: 838458 - RNA, 22 nt, Human
ucccagaguuuccuguguccca

SEQ ID NO: 838459 - RNA, 21 nt, Human
uucuucuuggacuguuuuggc

SEQ ID NO: 838460 - RNA, 22 nt, Human
aggccugaggaccagauaaaug

SEQ ID NO: 838461 - RNA, 22 nt, Human
cugaagcaaaugaaacagcucu

SEQ ID NO: 838462 - RNA, 17 nt, Human
gguggccugcaguggcu

SEQ ID NO: 838463 - RNA, 22 nt, Human
ggucaggguauaaucaagugag

SEQ ID NO: 838464 - RNA, 22 nt, Human
ucaugcaaggcugaaacauggu

SEQ ID NO: 838465 - RNA, 22 nt, Human
cauucauuagaauagauaugua

SEQ ID NO: 838466 - RNA, 22 nt, Human
uguggugagaaacugguagauu

SEQ ID NO: 838467 - RNA, 22 nt, Human
guccuggcuuaguucgcuguaa

SEQ ID NO: 838468 - RNA, 22 nt, Human
uuaucacuuaugagcuuuuugc

SEQ ID NO: 838469 - RNA, 22 nt, Human
gggcagcucuggcugugggaag

SEQ ID NO: 838470 - RNA, 22 nt, Human
cagggacaauggcagagccuga

SEQ ID NO: 838471 - RNA, 22 nt, Human
ggcugcagguugguuggcagcu

SEQ ID NO: 838472 - RNA, 22 nt, Human
auuucccaugugaaucaauugg

SEQ ID NO: 838473 - RNA, 21 nt, Human
ggccugaguauaggacaggcc

SEQ ID NO: 838474 - RNA, 22 nt, Human
uaaauguggagacucaggaguc

SEQ ID NO: 838475 - RNA, 22 nt, Human
ccugagacaugaaccaggcucc

SEQ ID NO: 838476 - RNA, 22 nt, Human
aaacagaaauuuccucaugcuc

SEQ ID NO: 838477 - RNA, 22 nt, Human
uggcucagaguucaucuuuuag

SEQ ID NO: 838478 - RNA, 22 nt, Human
gagucuuugguaaagucugcug

SEQ ID NO: 838479 - RNA, 22 nt, Human
uguaggaguccaaucaggagac

SEQ ID NO: 838480 - RNA, 22 nt, Human
ggguggcacaggugcagagggu

SEQ ID NO: 838481 - RNA, 22 nt, Human
acaggagugaaucuggcacuua

SEQ ID NO: 838482 - RNA, 22 nt, Human
ggcucuggugaggguaggagau

SEQ ID NO: 838483 - RNA, 22 nt, Human
ucagggcagguuaacuugggug

SEQ ID NO: 838484 - RNA, 22 nt, Human
ucuguucaucaucuggacacau

SEQ ID NO: 838485 - RNA, 22 nt, Human
gcucugucauuuugcagacacu

SEQ ID NO: 838486 - RNA, 22 nt, Human
gaacacauuucucugacuguag

SEQ ID NO: 838487 - RNA, 22 nt, Human
gcagccaggaaagcuggacccu

SEQ ID NO: 838488 - RNA, 19 nt, Human
uucauucucuuauuguugu

SEQ ID NO: 838489 - RNA, 22 nt, Human
ugcccacauucaaaaggugaug

SEQ ID NO: 838490 - RNA, 22 nt, Human
cagcuucugagcaagccagggg

SEQ ID NO: 838491 - RNA, 22 nt, Human
gcucccaggcauggagguaauu

SEQ ID NO: 838492 - RNA, 22 nt, Human
aggcuggcccuacuggcugccu

SEQ ID NO: 838493 - RNA, 22 nt, Human
ucaguaacuuacuuauucaccu

SEQ ID NO: 838494 - RNA, 22 nt, Human
ugccucugcugcuguggcauca

SEQ ID NO: 838495 - RNA, 22 nt, Human
aaucauaauucaaauaagcuua

SEQ ID NO: 838496 - RNA, 22 nt, Human
acuaaggaauaugacaaacuca

SEQ ID NO: 838497 - RNA, 22 nt, Human
uauauagaaaagcagauguugg

SEQ ID NO: 838498 - RNA, 22 nt, Human
ggcagcugucucugaguuagca

SEQ ID NO: 838499 - RNA, 22 nt, Human
augcuguguauuuuacucuuuc

SEQ ID NO: 838500 - RNA, 18 nt, Human
ucauuuguuuugcaugaa

SEQ ID NO: 838501 - RNA, 22 nt, Human
caagagcauuuaguuagcuggu

SEQ ID NO: 838502 - RNA, 22 nt, Human
cugccuguuuucugauagauuu

SEQ ID NO: 838503 - RNA, 22 nt, Human
gcugccuguggcccuucugggu

SEQ ID NO: 838504 - RNA, 23 nt, Human
uccaagggcuacaaacacagacc

SEQ ID NO: 838505 - RNA, 22 nt, Human
agccuggccugggcaggcacau

SEQ ID NO: 838506 - RNA, 18 nt, Human
gcagagugcgucucugug

SEQ ID NO: 838507 - RNA, 22 nt, Human
uuuguaaauagcaguacucaug

SEQ ID NO: 838508 - RNA, 22 nt, Human
uccagggaugguaaugagcagu

SEQ ID NO: 838509 - RNA, 22 nt, Human
auuccaaacgccucgcggacuu

SEQ ID NO: 838510 - RNA, 18 nt, Human
ugucauaauauaucaccu

SEQ ID NO: 838511 - RNA, 22 nt, Human
ucugccugcggcugcagguggc

SEQ ID NO: 838512 - RNA, 22 nt, Human
auguguacaaccaagcacuaaa

SEQ ID NO: 838513 - RNA, 22 nt, Human
uacaaagucaccagcuucuugc

SEQ ID NO: 838514 - RNA, 20 nt, Human
gaggccucagccucagcucc

SEQ ID NO: 838515 - RNA, 22 nt, Human
ccacugucugcaggccucagca

SEQ ID NO: 838516 - RNA, 22 nt, Human
cagcucccuauggugaggcgac

SEQ ID NO: 838517 - RNA, 22 nt, Human
ccucuucuaggacguccuugug

SEQ ID NO: 838518 - RNA, 22 nt, Human
uguagggaggaaggguuggaaa

SEQ ID NO: 838519 - RNA, 22 nt, Human
auuugucuuuggaccugugaga

SEQ ID NO: 838520 - RNA, 22 nt, Human
ucaaaugcaggucuggucuugg

SEQ ID NO: 838521 - RNA, 22 nt, Human
auguagaagcugacagugcugu

SEQ ID NO: 838522 - RNA, 22 nt, Human
aaagauuugaaauuaggcauca

SEQ ID NO: 838523 - RNA, 21 nt, Human
cugccuugaaugguacuggga

SEQ ID NO: 838524 - RNA, 22 nt, Human
auaacaugaccugugcuucaca

SEQ ID NO: 838525 - RNA, 22 nt, Human
cugaacuuauugagugcuugcu

SEQ ID NO: 838526 - RNA, 22 nt, Human
cccaggaggccaagguugcagu

SEQ ID NO: 838527 - RNA, 22 nt, Human
aagaaugucguugguauuuuaa

SEQ ID NO: 838528 - RNA, 22 nt, Human
ugaaauaggaaacagauguuuc

SEQ ID NO: 838529 - RNA, 22 nt, Human
agaguguuuuucugucaaggac

SEQ ID NO: 838530 - RNA, 22 nt, Human
ggcuucuccccuuugagucuuc

SEQ ID NO: 838531 - RNA, 22 nt, Human
agccagagagccccagguucua

SEQ ID NO: 838532 - RNA, 19 nt, Human
gcuuuuuguugucaaaggu

SEQ ID NO: 838533 - RNA, 21 nt, Human
acaugucuggucauuuuuagc

SEQ ID NO: 838534 - RNA, 22 nt, Human
cuuuggcaaugucauuuucaau

SEQ ID NO: 838535 - RNA, 22 nt, Human
ugcagugguugagagcccagac

SEQ ID NO: 838536 - RNA, 21 nt, Human
ugcuggccucaagggugacuu

SEQ ID NO: 838537 - RNA, 22 nt, Human
ccugccugacagagaagguuca

SEQ ID NO: 838538 - RNA, 22 nt, Human
acugccuugaaagauuguugag

SEQ ID NO: 838539 - RNA, 22 nt, Human
uucaagguaugguagcugguca

SEQ ID NO: 838540 - RNA, 22 nt, Human
aauuccaaauguuuucaaucca

SEQ ID NO: 838541 - RNA, 22 nt, Human
auggacagugugaagcagauag

SEQ ID NO: 838542 - RNA, 22 nt, Human
gcugcuccgucugagcucuggu

SEQ ID NO: 838543 - RNA, 22 nt, Human
gcaccugcaggaugagccaggg

SEQ ID NO: 838544 - RNA, 22 nt, Human
guggcucuaggugagcauggag

SEQ ID NO: 838545 - RNA, 22 nt, Human
cucaggauggaagccuacagga

SEQ ID NO: 838546 - RNA, 22 nt, Human
uggcucucaggccugcugcguu

SEQ ID NO: 838547 - RNA, 22 nt, Human
uucagaaacagagugagugagu

SEQ ID NO: 838548 - RNA, 22 nt, Human
aaaauacacauacuaggggaaa

SEQ ID NO: 838549 - RNA, 22 nt, Human
cggcuggggcuguccccaugac

SEQ ID NO: 838550 - RNA, 19 nt, Human
ccuuugaaucaggacacuu

SEQ ID NO: 838551 - RNA, 22 nt, Human
gggcaagcucuucagaagcucu

SEQ ID NO: 838552 - RNA, 22 nt, Human
ccagcugucagugugaaaauaa

SEQ ID NO: 838553 - RNA, 22 nt, Human
aaucaguuagaaggaagagaau

SEQ ID NO: 838554 - RNA, 20 nt, Human
uaucaaucagaaagaagacu

SEQ ID NO: 838555 - RNA, 18 nt, Human
gggcuguguucaugccca

SEQ ID NO: 838556 - RNA, 22 nt, Human
uauaauguuuuccauggacuga

SEQ ID NO: 838557 - RNA, 22 nt, Human
accaggagccauagagucaggc

SEQ ID NO: 838558 - RNA, 22 nt, Human
uucuucuucaagugcugcauuc

SEQ ID NO: 838559 - RNA, 22 nt, Human
aggagucaggaccaaauggaaa

SEQ ID NO: 838560 - RNA, 22 nt, Human
ugaaguccuagaacuccuggua

SEQ ID NO: 838561 - RNA, 22 nt, Human
ucugucccugagagcucaggag

SEQ ID NO: 838562 - RNA, 22 nt, Human
gccagcagcccagaaggacuuu

SEQ ID NO: 838563 - RNA, 22 nt, Human
cuucucagaggccagaagcuau

SEQ ID NO: 838564 - RNA, 22 nt, Human
ggcugagggccagggcuagucu

SEQ ID NO: 838565 - RNA, 21 nt, Human
agcugagcccagaagacuggu

SEQ ID NO: 838566 - RNA, 22 nt, Human
acucccagguugccuggcaggc

SEQ ID NO: 838567 - RNA, 22 nt, Human
agcacagauucugaagaguccu

SEQ ID NO: 838568 - RNA, 22 nt, Human
cccaccaguacagaugguagau

SEQ ID NO: 838569 - RNA, 22 nt, Human
aaucagaauuuauugaaucuuu

SEQ ID NO: 838570 - RNA, 22 nt, Human
ggccucagugggccgcugcagg

SEQ ID NO: 838571 - RNA, 22 nt, Human
ugcagaguaaaagcagaugcua

SEQ ID NO: 838572 - RNA, 22 nt, Human
cacaggcugcccgcagcuggga

SEQ ID NO: 838573 - RNA, 22 nt, Human
uuuuauagcugaauaguauucc

SEQ ID NO: 838574 - RNA, 21 nt, Human
uggcucugaaagagugcugca

SEQ ID NO: 838575 - RNA, 22 nt, Human
gcugagcuagaaaaggaccaca

SEQ ID NO: 838576 - RNA, 22 nt, Human
uccauaagcagguucuuccuga

SEQ ID NO: 838577 - RNA, 20 nt, Human
gugggcagcaggcauacugg

SEQ ID NO: 838578 - RNA, 22 nt, Human
agcaggugacccaagcaggcug

SEQ ID NO: 838579 - RNA, 22 nt, Human
acacagccaggguaguaaggcu

SEQ ID NO: 838580 - RNA, 22 nt, Human
aaaucucaggccucuauuuacu

SEQ ID NO: 838581 - RNA, 22 nt, Human
ggcagaaggccucccagcuccu

SEQ ID NO: 838582 - RNA, 22 nt, Human
ccagcccugccucucagggccc

SEQ ID NO: 838583 - RNA, 22 nt, Human
gaaaagggcaagagagagggca

SEQ ID NO: 838584 - RNA, 19 nt, Human
uauuucaaagugccgucua

SEQ ID NO: 838585 - RNA, 22 nt, Human
ucucaaaucaaacuuugagcuu

SEQ ID NO: 838586 - RNA, 22 nt, Human
ccuggagcacauggcaggaggc

SEQ ID NO: 838587 - RNA, 22 nt, Human
cacugcuuuuuuggcuauguac

SEQ ID NO: 838588 - RNA, 22 nt, Human
uuauccaaacuggugaaucauu

SEQ ID NO: 838589 - RNA, 22 nt, Human
gccuugcuuugcuucuggacag

SEQ ID NO: 838590 - RNA, 22 nt, Human
ccucccuggccagagcagcagc

SEQ ID NO: 838591 - RNA, 22 nt, Human
ugauuuuuagcuauucugaaga

SEQ ID NO: 838592 - RNA, 22 nt, Human
uucuucucggcugucagauagu

SEQ ID NO: 838593 - RNA, 22 nt, Human
gccagguggcugagcagcugca

SEQ ID NO: 838594 - RNA, 22 nt, Human
caucagaacaaaucgguuaaga

SEQ ID NO: 838595 - RNA, 22 nt, Human
cacagggccacuuucccaguaa

SEQ ID NO: 838596 - RNA, 20 nt, Human
ugcuggggacauacagggug

SEQ ID NO: 838597 - RNA, 18 nt, Human
aagccagagaccacugcc

SEQ ID NO: 838598 - RNA, 22 nt, Human
uccagucauuuccauuguuccc

SEQ ID NO: 838599 - RNA, 22 nt, Human
gugaaacagaagcuccuggaau

SEQ ID NO: 838600 - RNA, 23 nt, Human
agaugaaagcuucccaucacagu

SEQ ID NO: 838601 - RNA, 21 nt, Human
ugggcagauggcaguguggcu

SEQ ID NO: 838602 - RNA, 22 nt, Human
gcccaggaggucaaguagcuau

SEQ ID NO: 838603 - RNA, 22 nt, Human
gcagaggccaggccaccagcaa

SEQ ID NO: 838604 - RNA, 20 nt, Human
uccugcaguuccuaggaggg

SEQ ID NO: 838605 - RNA, 21 nt, Human
uuuauguacuucauagaguag

SEQ ID NO: 838606 - RNA, 21 nt, Human
ccacaggggcuccccugucag

SEQ ID NO: 838607 - RNA, 22 nt, Human
aggcacugaauauccaguaaaa

SEQ ID NO: 838608 - RNA, 22 nt, Human
auuacaagaugcauccauauuu

SEQ ID NO: 838609 - RNA, 22 nt, Human
auggcccaggccuccuguggcu

SEQ ID NO: 838610 - RNA, 22 nt, Human
agauacauuaguaguuacuugu

SEQ ID NO: 838611 - RNA, 22 nt, Human
aguguuucccaguaggaugaaa

SEQ ID NO: 838612 - RNA, 19 nt, Human
agagaggcugugugaggga

SEQ ID NO: 838613 - RNA, 22 nt, Human
uggaaggggagcuggaaagggg

SEQ ID NO: 838614 - RNA, 21 nt, Human
ccauaccuaccucaccugguu

SEQ ID NO: 838615 - RNA, 22 nt, Human
uauuuuaucugccagaguggag

SEQ ID NO: 838616 - RNA, 22 nt, Human
ggcugccugaggcugaggcccg

SEQ ID NO: 838617 - RNA, 22 nt, Human
ccaggagagcaaaggucacucu

SEQ ID NO: 838618 - RNA, 22 nt, Human
cucagcccagcccaggaccagg

SEQ ID NO: 838619 - RNA, 20 nt, Human
uaacagaaguagaagugggu

SEQ ID NO: 838620 - RNA, 22 nt, Human
cauuuagaaacuguuuuuaaca

SEQ ID NO: 838621 - RNA, 22 nt, Human
aauugcaauuuucuuaaggucu

SEQ ID NO: 838622 - RNA, 19 nt, Human
aaggcagcaguagcaucca

SEQ ID NO: 838623 - RNA, 21 nt, Human
gccacugcacuccagccuggg

SEQ ID NO: 838624 - RNA, 22 nt, Human
ucagggcagccuaaggcaccuc

SEQ ID NO: 838625 - RNA, 22 nt, Human
uuaacagagaacauagaaguag

SEQ ID NO: 838626 - RNA, 22 nt, Human
guggagacuucuacuagagacc

SEQ ID NO: 838627 - RNA, 22 nt, Human
aggugcugccccgagaaggaug

SEQ ID NO: 838628 - RNA, 22 nt, Human
gcuauacacauuucuugguagu

SEQ ID NO: 838629 - RNA, 17 nt, Human
ucaugcccaacuauuac

SEQ ID NO: 838630 - RNA, 22 nt, Human
gacaggguacgggcuaggcaca

SEQ ID NO: 838631 - RNA, 22 nt, Human
aaugaugggaaggagaaaagca

SEQ ID NO: 838632 - RNA, 22 nt, Human
gaugcugaagugaagugaucuu

SEQ ID NO: 838633 - RNA, 22 nt, Human
cagccugggcuccagagucccu

SEQ ID NO: 838634 - RNA, 22 nt, Human
ggcugccuugacccuggcuccg

SEQ ID NO: 838635 - RNA, 22 nt, Human
ccugggugaugugcugcccucg

SEQ ID NO: 838636 - RNA, 22 nt, Human
uuugacaaaggaaaaaugcaca

SEQ ID NO: 838637 - RNA, 22 nt, Human
aaaaauaggucaaccguguaug

SEQ ID NO: 838638 - RNA, 22 nt, Human
cuuuaagagaucaccaaucaca

SEQ ID NO: 838639 - RNA, 22 nt, Human
cugcugagguccuugcucagac

SEQ ID NO: 838640 - RNA, 22 nt, Human
aggcucagcaucugauucauau

SEQ ID NO: 838641 - RNA, 22 nt, Human
agagcagguggcaacucuggga

SEQ ID NO: 838642 - RNA, 22 nt, Human
caugauaauuguuaacaaagua

SEQ ID NO: 838643 - RNA, 22 nt, Human
cugcccaggaaccagaggggca

SEQ ID NO: 838644 - RNA, 22 nt, Human
ugagcccagagaucugagcuau

SEQ ID NO: 838645 - RNA, 22 nt, Human
ggccugaggcgucccagcugug

SEQ ID NO: 838646 - RNA, 22 nt, Human
gcuggcaggguucucacugaaa

SEQ ID NO: 838647 - RNA, 22 nt, Human
ucugggagcacacgcagugauc

SEQ ID NO: 838648 - RNA, 22 nt, Human
auuucaguguugguuagcaagc

SEQ ID NO: 838649 - RNA, 22 nt, Human
cagccagcuucagauccaagcc

SEQ ID NO: 838650 - RNA, 22 nt, Human
caauauauaggaacaacuuagg

SEQ ID NO: 838651 - RNA, 22 nt, Human
cagccucucuguaucucaggau

SEQ ID NO: 838652 - RNA, 18 nt, Human
uggugaaggguggaggag

SEQ ID NO: 838653 - RNA, 16 nt, Human
ggagagugucugcaaa

SEQ ID NO: 838654 - RNA, 22 nt, Human
ccaggccucuggcugcuuaguc

SEQ ID NO: 838655 - RNA, 22 nt, Human
ccugccugcagaaaguaucucc

SEQ ID NO: 838656 - RNA, 22 nt, Human
cugcuuugacuguuaagaacca

SEQ ID NO: 838657 - RNA, 22 nt, Human
auucuuauuauaguaaaacagu

SEQ ID NO: 838658 - RNA, 22 nt, Human
acucugaggagugacuagaggu

SEQ ID NO: 838659 - RNA, 23 nt, Human
cugcugugaaacaugguuuuggu

SEQ ID NO: 838660 - RNA, 22 nt, Human
gccaguuccuguggagucagag

SEQ ID NO: 838661 - RNA, 22 nt, Human
agcgggugcugugucagcccuc

SEQ ID NO: 838662 - RNA, 22 nt, Human
aggcuucuacguggucccaggg

SEQ ID NO: 838663 - RNA, 22 nt, Human
aucagaaaaacauaauguuauu

SEQ ID NO: 838664 - RNA, 23 nt, Human
cuuuccuuucuuugacacccagc

SEQ ID NO: 838665 - RNA, 22 nt, Human
uuagauaauguuauuguaauuu

SEQ ID NO: 838666 - RNA, 22 nt, Human
aggcccugcccagugccacaag

SEQ ID NO: 838667 - RNA, 22 nt, Human
uucuuuaaaauagugagaaaga

SEQ ID NO: 838668 - RNA, 22 nt, Human
ggucucagcaguugcuuugacu

SEQ ID NO: 838669 - RNA, 22 nt, Human
uucuuaaaacuuauggacaggu

SEQ ID NO: 838670 - RNA, 22 nt, Human
ugcucuucggggccacugcuug

SEQ ID NO: 838671 - RNA, 22 nt, Human
agaugguguuuccccaggugga

SEQ ID NO: 838672 - RNA, 22 nt, Human
uucaacuauuaugaauaaaauu

SEQ ID NO: 838673 - RNA, 22 nt, Human
ugcuuuuaagaacaaugcugcu

SEQ ID NO: 838674 - RNA, 22 nt, Human
uuccucucaacaugccugccgg

SEQ ID NO: 838675 - RNA, 18 nt, Human
ccugccagucuggagcag

SEQ ID NO: 838676 - RNA, 22 nt, Human
gcaguggggaaugcuggggaga

SEQ ID NO: 838677 - RNA, 22 nt, Human
uuccacaauguaugaauaagau

SEQ ID NO: 838678 - RNA, 22 nt, Human
aacauucugguucuaaaaaccu

SEQ ID NO: 838679 - RNA, 22 nt, Human
ggaagaggaggagccaggcuuu

SEQ ID NO: 838680 - RNA, 22 nt, Human
cauucacaucuuguuccaucac

SEQ ID NO: 838681 - RNA, 22 nt, Human
accaggagacaugaccaaugag

SEQ ID NO: 838682 - RNA, 22 nt, Human
ugggcagaucuuugguggcuag

SEQ ID NO: 838683 - RNA, 22 nt, Human
gaacaguaucaguagugccagu

SEQ ID NO: 838684 - RNA, 20 nt, Human
gucaucgccggcagcaaaga

SEQ ID NO: 838685 - RNA, 22 nt, Human
uggcucagcuuacuuuugaggg

SEQ ID NO: 838686 - RNA, 22 nt, Human
agccugagccccauccagcuga

SEQ ID NO: 838687 - RNA, 22 nt, Human
uggccucugggaaagcagauuc

SEQ ID NO: 838688 - RNA, 22 nt, Human
acuguucaaguuuuaugcugga

SEQ ID NO: 838689 - RNA, 18 nt, Human
acauacauucugucugca

SEQ ID NO: 838690 - RNA, 22 nt, Human
gcucugcugaagccccuugcau

SEQ ID NO: 838691 - RNA, 22 nt, Human
ugcaggugccucuugagcuugu

SEQ ID NO: 838692 - RNA, 22 nt, Human
ucggagcuguagaugaaacccu

SEQ ID NO: 838693 - RNA, 22 nt, Human
cugagggcccugaagcuuggca

SEQ ID NO: 838694 - RNA, 22 nt, Human
uacauucuggaaaggcacagac

SEQ ID NO: 838695 - RNA, 22 nt, Human
agauggggcagaauggagccau

SEQ ID NO: 838696 - RNA, 22 nt, Human
caaaucuauauguugauauucu

SEQ ID NO: 838697 - RNA, 22 nt, Human
uuagcauuucaguacacauguu

SEQ ID NO: 838698 - RNA, 22 nt, Human
gcagcuggacccacacggcuua

SEQ ID NO: 838699 - RNA, 22 nt, Human
ggcugcaguuugucuuuugcuu

SEQ ID NO: 838700 - RNA, 22 nt, Human
ggggcccagcaccccuccucgc

SEQ ID NO: 838701 - RNA, 22 nt, Human
ccuggaucagagccagagaagc

SEQ ID NO: 838702 - RNA, 22 nt, Human
ugaaaagacugcaagagagcau

SEQ ID NO: 838703 - RNA, 22 nt, Human
uuacuuuguucucaagauaugu

SEQ ID NO: 838704 - RNA, 22 nt, Human
aaugaaaauuggacccuagaac

SEQ ID NO: 838705 - RNA, 22 nt, Human
ugcugggcuaggguggagcucu

SEQ ID NO: 838706 - RNA, 22 nt, Human
ucagugugaggucuuccacccg

SEQ ID NO: 838707 - RNA, 22 nt, Human
uaagacacaugcguacaagaua

SEQ ID NO: 838708 - RNA, 22 nt, Human
cuagagggauguuaggauagca

SEQ ID NO: 838709 - RNA, 22 nt, Human
ucuucuccagugcuucugcaca

SEQ ID NO: 838710 - RNA, 22 nt, Human
ucucaagcuuguugguauguuu

SEQ ID NO: 838711 - RNA, 22 nt, Human
ucucaggaguagugggauccau

SEQ ID NO: 838712 - RNA, 22 nt, Human
guguaaggccccagguucuuua

SEQ ID NO: 838713 - RNA, 22 nt, Human
agauauauuuaagguaauaagu

SEQ ID NO: 838714 - RNA, 20 nt, Human
ugcagcugguuucacaggga

SEQ ID NO: 838715 - RNA, 19 nt, Human
uguagcaguuuaaaacaac

SEQ ID NO: 838716 - RNA, 22 nt, Human
ccugcugggccugagcaaugag

SEQ ID NO: 838717 - RNA, 22 nt, Human
cagccagcuggcacugugagua

SEQ ID NO: 838718 - RNA, 22 nt, Human
agcuggugcugaagcucuugag

SEQ ID NO: 838719 - RNA, 22 nt, Human
ggaggguuagcaaaggcacaga

SEQ ID NO: 838720 - RNA, 22 nt, Human
gccuuugcaccaucagugcaau

SEQ ID NO: 838721 - RNA, 22 nt, Human
cagggcuguuagcugcugcucu

SEQ ID NO: 838722 - RNA, 22 nt, Human
uuccgcuggggccgccuggcgg

SEQ ID NO: 838723 - RNA, 22 nt, Human
cuggagcuggcuuccuuccacu

SEQ ID NO: 838724 - RNA, 22 nt, Human
gugcauuucucauacacuaaau

SEQ ID NO: 838725 - RNA, 22 nt, Human
auuuagccucauuuuugacaua

SEQ ID NO: 838726 - RNA, 22 nt, Human
uuugagauggagucuugcucug

SEQ ID NO: 838727 - RNA, 22 nt, Human
uaguuaaaauaauggagauguu

SEQ ID NO: 838728 - RNA, 22 nt, Human
uaauuuacuugcaaauaacaau

SEQ ID NO: 838729 - RNA, 22 nt, Human
ggcagcuuucaauaggguuaug

SEQ ID NO: 838730 - RNA, 22 nt, Human
gauuucuuuagguguaauagug

SEQ ID NO: 838731 - RNA, 18 nt, Human
gagguccugcucuagccc

SEQ ID NO: 838732 - RNA, 22 nt, Human
uacacauguauuuauguguaca

SEQ ID NO: 838733 - RNA, 19 nt, Human
gggcuuggggcugaagccu

SEQ ID NO: 838734 - RNA, 22 nt, Human
accacugggcgggcagccugcu

SEQ ID NO: 838735 - RNA, 22 nt, Human
ccaggcugugguuuagauagag

SEQ ID NO: 838736 - RNA, 22 nt, Human
uagaaauccccagucucauagu

SEQ ID NO: 838737 - RNA, 22 nt, Human
ccugugucagccccugccucca

SEQ ID NO: 838738 - RNA, 22 nt, Human
uuuggaaaguugucacuuuaga

SEQ ID NO: 838739 - RNA, 22 nt, Human
uguccuuauaagaaaaggaaau

SEQ ID NO: 838740 - RNA, 22 nt, Human
ucucugcucugugccucaguuu

SEQ ID NO: 838741 - RNA, 22 nt, Human
cagagcaguaaaucuggggcac

SEQ ID NO: 838742 - RNA, 22 nt, Human
auguaauaggguaacauaacau

SEQ ID NO: 838743 - RNA, 22 nt, Human
gagguuagaggucagugcaguc

SEQ ID NO: 838744 - RNA, 22 nt, Human
gcagggacaucuuugucuagua

SEQ ID NO: 838745 - RNA, 22 nt, Human
agcagggcagcugaugcgcacg

SEQ ID NO: 838746 - RNA, 22 nt, Human
aaggaaagacauauaaaugacu

SEQ ID NO: 838747 - RNA, 22 nt, Human
caggugggcuugggagaacacu

SEQ ID NO: 838748 - RNA, 22 nt, Human
aguuggagugaacaugagauug

SEQ ID NO: 838749 - RNA, 22 nt, Human
uuuccuaguucuaagaaaugua

SEQ ID NO: 838750 - RNA, 21 nt, Human
ggagucagggucuggcugggg

SEQ ID NO: 838751 - RNA, 22 nt, Human
gcugcucucagagcucaugcug

SEQ ID NO: 838752 - RNA, 20 nt, Human
aguacaauguaugauucaga

SEQ ID NO: 838753 - RNA, 22 nt, Human
ugcagcaggcacaggacggaag

SEQ ID NO: 838754 - RNA, 23 nt, Human
uuaagacuggcugaacuuaguag

SEQ ID NO: 838755 - RNA, 22 nt, Human
agccagcugccuuucacaucug

SEQ ID NO: 838756 - RNA, 22 nt, Human
uagcagagcagggaucagagcc

SEQ ID NO: 838757 - RNA, 22 nt, Human
aggcacugaaagguggccagag

SEQ ID NO: 838758 - RNA, 22 nt, Human
uccuucaguuaucacaguacug

SEQ ID NO: 838759 - RNA, 22 nt, Human
cuggagccccaggcugugcaga

SEQ ID NO: 838760 - RNA, 20 nt, Human
cccuggagagaagcuccacg

SEQ ID NO: 838761 - RNA, 22 nt, Human
gaugugggguugagggaccagc

SEQ ID NO: 838762 - RNA, 22 nt, Human
aggaccagccuccaggucucuu

SEQ ID NO: 838763 - RNA, 22 nt, Human
uguccugcaacugaaggagaag

SEQ ID NO: 838764 - RNA, 22 nt, Human
cccaggcucccaggugggacaa

SEQ ID NO: 838765 - RNA, 22 nt, Human
aaauucuuucauggcuaauaag

SEQ ID NO: 838766 - RNA, 22 nt, Human
guauuugauacaugaaauggug

SEQ ID NO: 838767 - RNA, 19 nt, Human
ggugaccaccuggucagug

SEQ ID NO: 838768 - RNA, 22 nt, Human
auuguauaacagcauguauuuu

SEQ ID NO: 838769 - RNA, 22 nt, Human
aaugcacaugucuuggccucac

SEQ ID NO: 838770 - RNA, 22 nt, Human
ggaggggccggcugccugccac

SEQ ID NO: 838771 - RNA, 22 nt, Human
ucagaacagaagcuggcuauaa

SEQ ID NO: 838772 - RNA, 22 nt, Human
cuggggccacaacggcgcacgc

SEQ ID NO: 838773 - RNA, 22 nt, Human
ugaaagguuauuuaggucugcu

SEQ ID NO: 838774 - RNA, 21 nt, Human
agaaaauggcguuuuagauuu

SEQ ID NO: 838775 - RNA, 22 nt, Human
gggagguucuguucgcacuuga

SEQ ID NO: 838776 - RNA, 22 nt, Human
uuaacacaucccugcucuaccc

SEQ ID NO: 838777 - RNA, 22 nt, Human
agcugcccuuuaugaugcugaa

SEQ ID NO: 838778 - RNA, 22 nt, Human
agguacagcaauauaagagguc

SEQ ID NO: 838779 - RNA, 22 nt, Human
uagggcagaguccaggaugggc

SEQ ID NO: 838780 - RNA, 22 nt, Human
uagcauuaucugucuuaucauu

SEQ ID NO: 838781 - RNA, 22 nt, Human
uauuaguagcuugaaauuggug

SEQ ID NO: 838782 - RNA, 19 nt, Human
gcucagagggcccugugcu

SEQ ID NO: 838783 - RNA, 22 nt, Human
cuuccuggccauugccauggca

SEQ ID NO: 838784 - RNA, 22 nt, Human
uauuccagaugaaaucauucag

SEQ ID NO: 838785 - RNA, 22 nt, Human
gcaggagugacauggaugugga

SEQ ID NO: 838786 - RNA, 22 nt, Human
cuggcugguuacuauuucuggu

SEQ ID NO: 838787 - RNA, 18 nt, Human
uccuccuuuggccuuuuc

SEQ ID NO: 838788 - RNA, 23 nt, Human
uggccugcagaguuucugcuggg

SEQ ID NO: 838789 - RNA, 21 nt, Human
aguguccuugaucuugccuug

SEQ ID NO: 838790 - RNA, 22 nt, Human
cuuuggcacagucucauuugau

SEQ ID NO: 838791 - RNA, 22 nt, Human
ucuucucuccugcuuggcagaa

SEQ ID NO: 838792 - RNA, 22 nt, Human
agccacaggaaacagagacagc

SEQ ID NO: 838793 - RNA, 22 nt, Human
ucagaggauugccucagcgagc

SEQ ID NO: 838794 - RNA, 22 nt, Human
gagggagggccaggucccaacc

SEQ ID NO: 838795 - RNA, 22 nt, Human
aaugaacagauacacauaggca

SEQ ID NO: 838796 - RNA, 22 nt, Human
auguuucagauacagaucaaau

SEQ ID NO: 838797 - RNA, 22 nt, Human
uagauauguguuuauuaugcug

SEQ ID NO: 838798 - RNA, 22 nt, Human
gcugccugggcaggaggcgcug

SEQ ID NO: 838799 - RNA, 22 nt, Human
guuuuauaggugaaauauuacu

SEQ ID NO: 838800 - RNA, 22 nt, Human
cauuuguauguuccuccuuagg

SEQ ID NO: 838801 - RNA, 22 nt, Human
uuugacagacauuuacuacauu

SEQ ID NO: 838802 - RNA, 22 nt, Human
caaaugcuacuaauaggcaagu

SEQ ID NO: 838803 - RNA, 22 nt, Human
acagagcugggugcccccugga

SEQ ID NO: 838804 - RNA, 22 nt, Human
cuuuacauaaggauaaaccugg

SEQ ID NO: 838805 - RNA, 22 nt, Human
cuuccuguugucacagucugcg

SEQ ID NO: 838806 - RNA, 22 nt, Human
agaaaugacacacaugagacau

SEQ ID NO: 838807 - RNA, 22 nt, Human
aaagguuugcauggaauuuacc

SEQ ID NO: 838808 - RNA, 22 nt, Human
ggcagggaaacagcugauccca

SEQ ID NO: 838809 - RNA, 22 nt, Human
cagagcagaagcgguccucaca

SEQ ID NO: 838810 - RNA, 22 nt, Human
gcugagaguguaggauguuuac

SEQ ID NO: 838811 - RNA, 22 nt, Human
ucagaccauccugcuguuagug

SEQ ID NO: 838812 - RNA, 22 nt, Human
uauuugaaggcauacauuuuga

SEQ ID NO: 838813 - RNA, 22 nt, Human
gaccagagaaaggcacuggaag

SEQ ID NO: 838814 - RNA, 19 nt, Human
aggguggcaaaggagggug

SEQ ID NO: 838815 - RNA, 22 nt, Human
aagauacauaaagguagagucu

SEQ ID NO: 838816 - RNA, 22 nt, Human
agaaacauccugcuuuccauuu

SEQ ID NO: 838817 - RNA, 22 nt, Human
uguauacaauucacacuuccca

SEQ ID NO: 838818 - RNA, 22 nt, Human
gcccuggccuucaucucagaca

SEQ ID NO: 838819 - RNA, 22 nt, Human
uccugucugucuuuggucccuu

SEQ ID NO: 838820 - RNA, 17 nt, Human
ucuuuccugccaugcuc

SEQ ID NO: 838821 - RNA, 22 nt, Human
gccuggugugcgccgcgcagcu

SEQ ID NO: 838822 - RNA, 22 nt, Human
uguggcugacuccuggucccca

SEQ ID NO: 838823 - RNA, 22 nt, Human
aagaagagaaaugugcugcugg

SEQ ID NO: 838824 - RNA, 22 nt, Human
uuuugugagcccauaaaugcca

SEQ ID NO: 838825 - RNA, 22 nt, Human
cugcagccuaggugcagcuggg

SEQ ID NO: 838826 - RNA, 21 nt, Human
uugaccaagggugcgugcucc

SEQ ID NO: 838827 - RNA, 22 nt, Human
ccugggugucaugggcagcugg

SEQ ID NO: 838828 - RNA, 22 nt, Human
ccuccagcugccucagucucuu

SEQ ID NO: 838829 - RNA, 22 nt, Human
caaauguguuuuuucuucuaca

SEQ ID NO: 838830 - RNA, 22 nt, Human
uguuccaagcugcuggauaagc

SEQ ID NO: 838831 - RNA, 22 nt, Human
uccugccucacaguugaaguuu

SEQ ID NO: 838832 - RNA, 22 nt, Human
uucaagauggcaccagugagug

SEQ ID NO: 838833 - RNA, 22 nt, Human
agaaaucagaacccugaaguuc

SEQ ID NO: 838834 - RNA, 22 nt, Human
cuacagaaggagaaauggguaa

SEQ ID NO: 838835 - RNA, 22 nt, Human
uuuucacacaaggugauaaguu

SEQ ID NO: 838836 - RNA, 22 nt, Human
ucagcugcucuguugagcugaa

SEQ ID NO: 838837 - RNA, 22 nt, Human
gcuguauuuauuuucuaggguu

SEQ ID NO: 838838 - RNA, 22 nt, Human
ugucucuggcccaugagcagag

SEQ ID NO: 838839 - RNA, 18 nt, Human
gagacacaagggccugga

SEQ ID NO: 838840 - RNA, 17 nt, Human
uuagcaaaauagcacuu

SEQ ID NO: 838841 - RNA, 22 nt, Human
ggccagaaaguuaagcuguggc

SEQ ID NO: 838842 - RNA, 22 nt, Human
accagguggccccagcgugguu

SEQ ID NO: 838843 - RNA, 22 nt, Human
cugcugcugagagcucagccug

SEQ ID NO: 838844 - RNA, 19 nt, Human
caguggagauuggaggagg

SEQ ID NO: 838845 - RNA, 22 nt, Human
agagcccuuucuccaggcaccu

SEQ ID NO: 838846 - RNA, 22 nt, Human
agggugccugcugcagguucag

SEQ ID NO: 838847 - RNA, 22 nt, Human
cccagggacagaugggcagcua

SEQ ID NO: 838848 - RNA, 22 nt, Human
acucugaggcaggucagggcag

SEQ ID NO: 838849 - RNA, 23 nt, Human
ccagcccuccaccagcucuaggc

SEQ ID NO: 838850 - RNA, 22 nt, Human
gauaccagacagggagggagaa

SEQ ID NO: 838851 - RNA, 22 nt, Human
gagaggcaggcgcugcaauggu

SEQ ID NO: 838852 - RNA, 20 nt, Human
gaguccuuaugggcugaggu

SEQ ID NO: 838853 - RNA, 22 nt, Human
ucaaguauaucuagucauuagg

SEQ ID NO: 838854 - RNA, 22 nt, Human
agggcugcugcuccgggcccag

SEQ ID NO: 838855 - RNA, 22 nt, Human
cauucuuauauuuacucauuca

SEQ ID NO: 838856 - RNA, 22 nt, Human
ugaggcagaaauuccuguuuuc

SEQ ID NO: 838857 - RNA, 22 nt, Human
guuaaagaguuuggcuuucuuc

SEQ ID NO: 838858 - RNA, 22 nt, Human
guggauggacaugggcaagagg

SEQ ID NO: 838859 - RNA, 22 nt, Human
ucugcagcuucuugccagagag

SEQ ID NO: 838860 - RNA, 22 nt, Human
ugaaggaauggaggaucagagc

SEQ ID NO: 838861 - RNA, 22 nt, Human
gaggccuggagccgccuaggcg

SEQ ID NO: 838862 - RNA, 22 nt, Human
ccugccugguguaagucuaagg

SEQ ID NO: 838863 - RNA, 22 nt, Human
agcagagccagaauuggaccag

SEQ ID NO: 838864 - RNA, 22 nt, Human
gagagcugucagcguagcaccg

SEQ ID NO: 838865 - RNA, 22 nt, Human
cauuuuaaaugauuuaagccaa

SEQ ID NO: 838866 - RNA, 22 nt, Human
ugugaauaaugccgcaauaaac

SEQ ID NO: 838867 - RNA, 22 nt, Human
agagcuguuuggacaucugagu

SEQ ID NO: 838868 - RNA, 22 nt, Human
accucugcaguagggcugugcc

SEQ ID NO: 838869 - RNA, 22 nt, Human
gcucuccacugaccacggggca

SEQ ID NO: 838870 - RNA, 22 nt, Human
ucugucacaauuugcuuacucu

SEQ ID NO: 838871 - RNA, 22 nt, Human
aauaauuuugagagccuggaaa

SEQ ID NO: 838872 - RNA, 22 nt, Human
cagcucuggcgucagggagcga

SEQ ID NO: 838873 - RNA, 22 nt, Human
uggagaugaauauguguaccug

SEQ ID NO: 838874 - RNA, 20 nt, Human
agggucaguagcacagagcu

SEQ ID NO: 838875 - RNA, 22 nt, Human
auuuuucucuccacuccauuaa

SEQ ID NO: 838876 - RNA, 22 nt, Human
ggcaggagcucuccaguuugcc

SEQ ID NO: 838877 - RNA, 22 nt, Human
caguacuuggucaaggaagcag

SEQ ID NO: 838878 - RNA, 22 nt, Human
uauuccuauggccacugcuacu

SEQ ID NO: 838879 - RNA, 21 nt, Human
ugugucacuaacuagaggcua

SEQ ID NO: 838880 - RNA, 22 nt, Human
ugacauaauaauccaaacauac

SEQ ID NO: 838881 - RNA, 22 nt, Human
ccaggcucaggugcgagagaca

SEQ ID NO: 838882 - RNA, 21 nt, Human
gcaaggcuuuuguguuuccca

SEQ ID NO: 838883 - RNA, 22 nt, Human
auguagaaauuaggaugauagu

SEQ ID NO: 838884 - RNA, 23 nt, Human
cccagagcacagccuccagaugc

SEQ ID NO: 838885 - RNA, 22 nt, Human
guccucaguaagagggccucug

SEQ ID NO: 838886 - RNA, 22 nt, Human
gggccucugugcagaggggccu

SEQ ID NO: 838887 - RNA, 22 nt, Human
uacauugugauguuucaauaca

SEQ ID NO: 838888 - RNA, 22 nt, Human
acauacuuaugcuaaaaauaua

SEQ ID NO: 838889 - RNA, 22 nt, Human
acuugaauuauauuucuagaga

SEQ ID NO: 838890 - RNA, 22 nt, Human
uuugcaguuucauugcugaaau

SEQ ID NO: 838891 - RNA, 22 nt, Human
gcucuggacccuggaguggcug

SEQ ID NO: 838892 - RNA, 22 nt, Human
uuaagucauuucugauuauaga

SEQ ID NO: 838893 - RNA, 22 nt, Human
aaguucaaggugauaguggcag

SEQ ID NO: 838894 - RNA, 22 nt, Human
gccuggugguauccuggcaaga

SEQ ID NO: 838895 - RNA, 22 nt, Human
ccagcccuucccaacuggccag

SEQ ID NO: 838896 - RNA, 22 nt, Human
ggagaggacauggcucccacag

SEQ ID NO: 838897 - RNA, 19 nt, Human
agaggcugucaccuguagc

SEQ ID NO: 838898 - RNA, 22 nt, Human
uccugccucaggcucuggagua

SEQ ID NO: 838899 - RNA, 22 nt, Human
caguggucugugcuucuguaca

SEQ ID NO: 838900 - RNA, 22 nt, Human
gcccagcuggcuuccagcacau

SEQ ID NO: 838901 - RNA, 22 nt, Human
cuggggaggcagggcugccccu

SEQ ID NO: 838902 - RNA, 21 nt, Human
caauuucaugggaagauggga

SEQ ID NO: 838903 - RNA, 22 nt, Human
auuaggcacuagaaugucaauu

SEQ ID NO: 838904 - RNA, 22 nt, Human
uucucagauauuuacugagcau

SEQ ID NO: 838905 - RNA, 22 nt, Human
agccaaggagugcagguggcuu

SEQ ID NO: 838906 - RNA, 22 nt, Human
gaggggcucuuuaauaguaaca

SEQ ID NO: 838907 - RNA, 22 nt, Human
aaaggugacugcagcagcuauu

SEQ ID NO: 838908 - RNA, 22 nt, Human
agcugaugccauguggaacagu

SEQ ID NO: 838909 - RNA, 22 nt, Human
aggagccaugagugacaucaca

SEQ ID NO: 838910 - RNA, 22 nt, Human
gucaccagucccagcuccugaa

SEQ ID NO: 838911 - RNA, 22 nt, Human
uccaggaguccugggagugauu

SEQ ID NO: 838912 - RNA, 22 nt, Human
auaucuuuuagagcaagcuugu

SEQ ID NO: 838913 - RNA, 22 nt, Human
aagcagaggaccgacggaggga

SEQ ID NO: 838914 - RNA, 22 nt, Human
agcuucuugaccaagccuguaa

SEQ ID NO: 838915 - RNA, 22 nt, Human
gcucccugcacucugcagcccu

SEQ ID NO: 838916 - RNA, 22 nt, Human
cuuagaaauaaugguuucaguu

SEQ ID NO: 838917 - RNA, 22 nt, Human
uuuugaauaauucagaaacagc

SEQ ID NO: 838918 - RNA, 22 nt, Human
uccagccaugcaugacaaucac

SEQ ID NO: 838919 - RNA, 22 nt, Human
gcugucucggggcuuucuccug

SEQ ID NO: 838920 - RNA, 22 nt, Human
caagaugaaacuacagggagga

SEQ ID NO: 838921 - RNA, 23 nt, Human
cccaggagccugaguccucucug

SEQ ID NO: 838922 - RNA, 22 nt, Human
agcuggguggagggcccacggu

SEQ ID NO: 838923 - RNA, 22 nt, Human
gucccagagagcacuaguccau

SEQ ID NO: 838924 - RNA, 19 nt, Human
cuucuggcccugagccacc

SEQ ID NO: 838925 - RNA, 21 nt, Human
uaaaugugagcagggcugggc

SEQ ID NO: 838926 - RNA, 22 nt, Human
aauguuaauuuacugucuucau

SEQ ID NO: 838927 - RNA, 22 nt, Human
cauucugugauucuaaaucccu

SEQ ID NO: 838928 - RNA, 22 nt, Human
uggcucagcgcggccuggucuu

SEQ ID NO: 838929 - RNA, 22 nt, Human
auguuauggcucaaacauuugg

SEQ ID NO: 838930 - RNA, 22 nt, Human
ccuggaugauccaugucaugga

SEQ ID NO: 838931 - RNA, 22 nt, Human
cagggccugcuuccuucuuguu

SEQ ID NO: 838932 - RNA, 22 nt, Human
cauugcacuucugcuuuuccuc

SEQ ID NO: 838933 - RNA, 22 nt, Human
aguaaacauuucagauuuauuu

SEQ ID NO: 838934 - RNA, 22 nt, Human
gcugucacaucaaggcacuaaa

SEQ ID NO: 838935 - RNA, 22 nt, Human
ucacagggauggaauagaaaua

SEQ ID NO: 838936 - RNA, 22 nt, Human
auuugucuagugguauucacgu

SEQ ID NO: 838937 - RNA, 22 nt, Human
uuacuuugcuuucucauuacag

SEQ ID NO: 838938 - RNA, 23 nt, Human
acucacaaagcaggaucauguug

SEQ ID NO: 838939 - RNA, 22 nt, Human
ucagggcaagucucagaagguu

SEQ ID NO: 838940 - RNA, 22 nt, Human
acugaaggucucagcaaggaug

SEQ ID NO: 838941 - RNA, 22 nt, Human
uaugcacauauaaccugcacug

SEQ ID NO: 838942 - RNA, 22 nt, Human
ggcucugcccagguggacagca

SEQ ID NO: 838943 - RNA, 22 nt, Human
auggacaggcugagcuuccuca

SEQ ID NO: 838944 - RNA, 22 nt, Human
ccaggccuagccccugagggua

SEQ ID NO: 838945 - RNA, 22 nt, Human
gggcaguggguggcugcagccu

SEQ ID NO: 838946 - RNA, 22 nt, Human
ucuuugaauucaaacuguucaa

SEQ ID NO: 838947 - RNA, 22 nt, Human
gagggcugaagauuguggcccc

SEQ ID NO: 838948 - RNA, 22 nt, Human
aggacaggauugagcugaacug

SEQ ID NO: 838949 - RNA, 22 nt, Human
gaggcccaggucaagcagccac

SEQ ID NO: 838950 - RNA, 22 nt, Human
acuggcaguuugagaaugcauu

SEQ ID NO: 838951 - RNA, 22 nt, Human
auuguggugucaguuauaggca

SEQ ID NO: 838952 - RNA, 22 nt, Human
aaaauugaggcucauguuaaau

SEQ ID NO: 838953 - RNA, 22 nt, Human
cugaaggauguguggugggagu

SEQ ID NO: 838954 - RNA, 20 nt, Human
uccuggccuucucgggcagu

SEQ ID NO: 838955 - RNA, 22 nt, Human
cugaggcuggggaagggaagug

SEQ ID NO: 838956 - RNA, 22 nt, Human
uucagaaacaucaguggaugga

SEQ ID NO: 838957 - RNA, 22 nt, Human
caaauucucaagguuuauccca

SEQ ID NO: 838958 - RNA, 22 nt, Human
gcagggacaccuuugugaagcu

SEQ ID NO: 838959 - RNA, 22 nt, Human
ucucagagauguuagggaagag

SEQ ID NO: 838960 - RNA, 22 nt, Human
uggcuggcccugggagugcaga

SEQ ID NO: 838961 - RNA, 22 nt, Human
augcagguugggcaaguguggg

SEQ ID NO: 838962 - RNA, 22 nt, Human
ugugcuucaucacuucucaguu

SEQ ID NO: 838963 - RNA, 22 nt, Human
gcuguauuccugcacuguauag

SEQ ID NO: 838964 - RNA, 22 nt, Human
aaaugcagguaguauuuauuuu

SEQ ID NO: 838965 - RNA, 22 nt, Human
ugcaggaaucagaggggaagcg

SEQ ID NO: 838966 - RNA, 20 nt, Human
accucugcaucaauccuuug

SEQ ID NO: 838967 - RNA, 22 nt, Human
gcaacuuucaagcaccaugggg

SEQ ID NO: 838968 - RNA, 22 nt, Human
ucauacaucuguccuggagcuc

SEQ ID NO: 838969 - RNA, 22 nt, Human
aaguauaagcuauucuucauga

SEQ ID NO: 838970 - RNA, 22 nt, Human
cugcccuguggcucugagucau

SEQ ID NO: 838971 - RNA, 21 nt, Human
acagcagacaggcuuaggacc

SEQ ID NO: 838972 - RNA, 22 nt, Human
aagcugaggcccauggcaaggu

SEQ ID NO: 838973 - RNA, 22 nt, Human
aaaauguguuuaugcauuucgu

SEQ ID NO: 838974 - RNA, 22 nt, Human
acccagaggugucuagcaagcu

SEQ ID NO: 838975 - RNA, 22 nt, Human
aguacuucagaggcugcccagg

SEQ ID NO: 838976 - RNA, 22 nt, Human
ggaggaggcggcagaaguuccu

SEQ ID NO: 838977 - RNA, 22 nt, Human
ccacuucaucagugcuccauuu

SEQ ID NO: 838978 - RNA, 22 nt, Human
caauuucaaugaggccacaggg

SEQ ID NO: 838979 - RNA, 19 nt, Human
uugcauuguaguuggacug

SEQ ID NO: 838980 - RNA, 22 nt, Human
gcaggcugugaggcucagaugg

SEQ ID NO: 838981 - RNA, 22 nt, Human
aaagaaggggucuacauccaau

SEQ ID NO: 838982 - RNA, 22 nt, Human
aagaacagguucuagaaccauu

SEQ ID NO: 838983 - RNA, 22 nt, Human
ccucccaccguaucucaguggc

SEQ ID NO: 838984 - RNA, 23 nt, Human
cugcagccgcguggggacgugga

SEQ ID NO: 838985 - RNA, 22 nt, Human
ccuggcugcuauagcagcaugu

SEQ ID NO: 838986 - RNA, 22 nt, Human
uuacuuuggauggucaagaaag

SEQ ID NO: 838987 - RNA, 23 nt, Human
ugggcaucuccucugugccaggc

SEQ ID NO: 838988 - RNA, 22 nt, Human
cccaggcagucuggcucuaaag

SEQ ID NO: 838989 - RNA, 22 nt, Human
uagccucucuccuccacaaccu

SEQ ID NO: 838990 - RNA, 22 nt, Human
uacaauauguggccuuuuguga

SEQ ID NO: 838991 - RNA, 22 nt, Human
gaguccuuuugugccacaggga

SEQ ID NO: 838992 - RNA, 22 nt, Human
ggcugcagggcagcuggugugg

SEQ ID NO: 838993 - RNA, 22 nt, Human
ucauugcagugauguuguaugu

SEQ ID NO: 838994 - RNA, 22 nt, Human
gaggccuggugugucucccgcu

SEQ ID NO: 838995 - RNA, 22 nt, Human
cagugggugaugaguccugggg

SEQ ID NO: 838996 - RNA, 22 nt, Human
cagucccagacauaguaaggga

SEQ ID NO: 838997 - RNA, 22 nt, Human
gaggagguuccggguggagaag

SEQ ID NO: 838998 - RNA, 22 nt, Human
gagaggcuaugagguucugugu

SEQ ID NO: 838999 - RNA, 22 nt, Human
cuggcucccucgcugaggugcu

SEQ ID NO: 839000 - RNA, 22 nt, Human
cagggcuggcuguggcaaucuc

SEQ ID NO: 839001 - RNA, 22 nt, Human
caggcacucauucagagaggug

SEQ ID NO: 839002 - RNA, 22 nt, Human
gccuggaggggccaggguggua

SEQ ID NO: 839003 - RNA, 22 nt, Human
gaggcagcugggauacaaggga

SEQ ID NO: 839004 - RNA, 22 nt, Human
aucuggcucuuccuggaguucc

SEQ ID NO: 839005 - RNA, 22 nt, Human
ucucuccuuaucauuguguuua

SEQ ID NO: 839006 - RNA, 22 nt, Human
ugcccacaggaagacaccagcg

SEQ ID NO: 839007 - RNA, 22 nt, Human
gguccuggaaauugacggaaag

SEQ ID NO: 839008 - RNA, 22 nt, Human
uaacagaaaggggacagaaaua

SEQ ID NO: 839009 - RNA, 22 nt, Human
gcugucacaagcaucuggggca

SEQ ID NO: 839010 - RNA, 19 nt, Human
cucuggagcagacacugga

SEQ ID NO: 839011 - RNA, 22 nt, Human
aagggagguaaagcuauuuaaa

SEQ ID NO: 839012 - RNA, 22 nt, Human
aucagcaagcauuuauugagug

SEQ ID NO: 839013 - RNA, 22 nt, Human
caaaugcauagaaagaugaaac

SEQ ID NO: 839014 - RNA, 22 nt, Human
aaguucaaucagaugaaaaagc

SEQ ID NO: 839015 - RNA, 22 nt, Human
acagagcugggaucugaaccca

SEQ ID NO: 839016 - RNA, 22 nt, Human
auacaacuuuacaugcaauucc

SEQ ID NO: 839017 - RNA, 23 nt, Human
ucagcugcuuccuccugccugcc

SEQ ID NO: 839018 - RNA, 19 nt, Human
gacagugcaguuguaguac

SEQ ID NO: 839019 - RNA, 22 nt, Human
uuucaggguacauggagcaaau

SEQ ID NO: 839020 - RNA, 22 nt, Human
uagaaaucuacuuagacuuucu

SEQ ID NO: 839021 - RNA, 22 nt, Human
gcuggcugaggucuagcucuuu

SEQ ID NO: 839022 - RNA, 22 nt, Human
uauugucuguccgggucaaagc

SEQ ID NO: 839023 - RNA, 22 nt, Human
acuauacagaagaggauaggaa

SEQ ID NO: 839024 - RNA, 22 nt, Human
gagcucagcacuaaaaucaugu

SEQ ID NO: 839025 - RNA, 22 nt, Human
ccugcuucagggaugauggcac

SEQ ID NO: 839026 - RNA, 22 nt, Human
uagauauggccgucuguuuuaa

SEQ ID NO: 839027 - RNA, 22 nt, Human
cagcugaggucaaagaagcagg

SEQ ID NO: 839028 - RNA, 22 nt, Human
uuacaagcagcuacauaucaca

SEQ ID NO: 839029 - RNA, 23 nt, Human
uggaauaauaagguacauuaaca

SEQ ID NO: 839030 - RNA, 22 nt, Human
uuguaacagcuguuuauauagu

SEQ ID NO: 839031 - RNA, 22 nt, Human
ugccugugguuccaguuuuuuc

SEQ ID NO: 839032 - RNA, 22 nt, Human
uaaagucaucuuuacaucuuug

SEQ ID NO: 839033 - RNA, 22 nt, Human
ugcccaaguguuuggcugaguc

SEQ ID NO: 839034 - RNA, 22 nt, Human
ucaugaaucguggaaugauuua

SEQ ID NO: 839035 - RNA, 22 nt, Human
cuggcucaauuuguacugcugu

SEQ ID NO: 839036 - RNA, 22 nt, Human
uugaggaguguuuagggugagg

SEQ ID NO: 839037 - RNA, 22 nt, Human
guggagaccuccuaggaugugu

SEQ ID NO: 839038 - RNA, 22 nt, Human
agaaaugugaauuucauuuccu

SEQ ID NO: 839039 - RNA, 17 nt, Human
cccaugagcccacuccc

SEQ ID NO: 839040 - RNA, 22 nt, Human
agccuucaaccuagcuagagca

SEQ ID NO: 839041 - RNA, 22 nt, Human
ucucagggaccaugaugaugac

SEQ ID NO: 839042 - RNA, 22 nt, Human
uuacagaaaagggguuguccuu

SEQ ID NO: 839043 - RNA, 22 nt, Human
ugcuugaaagggguuucccagu

SEQ ID NO: 839044 - RNA, 22 nt, Human
ggagagugggagcaacuguugc

SEQ ID NO: 839045 - RNA, 22 nt, Human
cugagccuuauucaccagcccu

SEQ ID NO: 839046 - RNA, 22 nt, Human
aggcuggguaccugucauaugc

SEQ ID NO: 839047 - RNA, 22 nt, Human
aaaugugcuugugaucagcugu

SEQ ID NO: 839048 - RNA, 22 nt, Human
ucuuccagcaaugugaaaucac

SEQ ID NO: 839049 - RNA, 22 nt, Human
cuguccucuguccucagcagga

SEQ ID NO: 839050 - RNA, 22 nt, Human
gcccaggaaguugaggcugccg

SEQ ID NO: 839051 - RNA, 22 nt, Human
uuuauuguuaucaugggugagu

SEQ ID NO: 839052 - RNA, 20 nt, Human
cugugccuaaaccuccgggu

SEQ ID NO: 839053 - RNA, 22 nt, Human
ugcugucaguuggcaggaugag

SEQ ID NO: 839054 - RNA, 22 nt, Human
aggcagacugugcgggaagagu

SEQ ID NO: 839055 - RNA, 22 nt, Human
acuguguguuugucuagcacag

SEQ ID NO: 839056 - RNA, 22 nt, Human
auauacaaagggcaaccucgcu

SEQ ID NO: 839057 - RNA, 22 nt, Human
agcaggugaauuccuggaugug

SEQ ID NO: 839058 - RNA, 22 nt, Human
caguccuucauuccuccuuuga

SEQ ID NO: 839059 - RNA, 22 nt, Human
gcagaugguggggcaggaaaau

SEQ ID NO: 839060 - RNA, 22 nt, Human
ccaggcccugcuccucacacca

SEQ ID NO: 839061 - RNA, 22 nt, Human
cuggcucaguucuugguuuuca

SEQ ID NO: 839062 - RNA, 22 nt, Human
uucucagauccaucagaagucc

SEQ ID NO: 839063 - RNA, 22 nt, Human
uugaaggacauccuauuucuag

SEQ ID NO: 839064 - RNA, 22 nt, Human
aagcagaauuucccacuaguug

SEQ ID NO: 839065 - RNA, 17 nt, Human
uggcucugaggcugaau

SEQ ID NO: 839066 - RNA, 22 nt, Human
ucccaggaauccguccucuaga

SEQ ID NO: 839067 - RNA, 22 nt, Human
ccuggccucgugcucacggcuc

SEQ ID NO: 839068 - RNA, 22 nt, Human
ccugccugcaaaaugggacaag

SEQ ID NO: 839069 - RNA, 22 nt, Human
ucucugggauaaacugggccag

SEQ ID NO: 839070 - RNA, 22 nt, Human
cccaaggaagacgcuugugaua

SEQ ID NO: 839071 - RNA, 22 nt, Human
cugcaucacagcaggaggcaca

SEQ ID NO: 839072 - RNA, 22 nt, Human
gcaggagagucugugccagguu

SEQ ID NO: 839073 - RNA, 22 nt, Human
ugcugugagguugagaaggaag

SEQ ID NO: 839074 - RNA, 21 nt, Human
aggugggagaccauguagguc

SEQ ID NO: 839075 - RNA, 22 nt, Human
acccugagggguauagcagaag

SEQ ID NO: 839076 - RNA, 22 nt, Human
agaaauaugcugauuagaugaa

SEQ ID NO: 839077 - RNA, 20 nt, Human
aucuggcucagauccugcag

SEQ ID NO: 839078 - RNA, 22 nt, Human
uucuucaaagaugucuguugga

SEQ ID NO: 839079 - RNA, 22 nt, Human
uuccaaagucauguugcugaua

SEQ ID NO: 839080 - RNA, 22 nt, Human
caagauaagaucauuuacacua

SEQ ID NO: 839081 - RNA, 22 nt, Human
acugaguguaggacuuugaguu

SEQ ID NO: 839082 - RNA, 22 nt, Human
uagcugcccaucuuuccuuuag

SEQ ID NO: 839083 - RNA, 22 nt, Human
auuuagaacuuuguuugccaau

SEQ ID NO: 839084 - RNA, 22 nt, Human
agaauaauacugaaaugcugaa

SEQ ID NO: 839085 - RNA, 22 nt, Human
aggagagaauguuccaggcuug

SEQ ID NO: 839086 - RNA, 22 nt, Human
auaaggcagaaauagggaaagu

SEQ ID NO: 839087 - RNA, 22 nt, Human
ggcugggcucgcugauuggcug

SEQ ID NO: 839088 - RNA, 22 nt, Human
cccccuggcaggcuggccucuc

SEQ ID NO: 839089 - RNA, 22 nt, Human
gaugaaaaucuugagaugucga

SEQ ID NO: 839090 - RNA, 22 nt, Human
agcuuuauuugucauucacggc

SEQ ID NO: 839091 - RNA, 17 nt, Human
acaagcaguggccaugg

SEQ ID NO: 839092 - RNA, 22 nt, Human
cugugccaggcccagcugacuu

SEQ ID NO: 839093 - RNA, 22 nt, Human
aaggcagcagugcacgacugau

SEQ ID NO: 839094 - RNA, 22 nt, Human
uugcacuccagcccgagcaaca

SEQ ID NO: 839095 - RNA, 23 nt, Human
ggauuuaguggaugagcugagug

SEQ ID NO: 839096 - RNA, 22 nt, Human
agucccagaucuacaggaggga

SEQ ID NO: 839097 - RNA, 22 nt, Human
acagcuguggccacuugcaucc

SEQ ID NO: 839098 - RNA, 22 nt, Human
gugggcaaggucccugccagcu

SEQ ID NO: 839099 - RNA, 17 nt, Human
gcugcagcgguaggcag

SEQ ID NO: 839100 - RNA, 22 nt, Human
aguuuucacacucaccaaaagg

SEQ ID NO: 839101 - RNA, 22 nt, Human
cccagcagccagaaugaggagc

SEQ ID NO: 839102 - RNA, 22 nt, Human
cccugccuacaggguuuucuuu

SEQ ID NO: 839103 - RNA, 22 nt, Human
cacagggcagaggguccguggc

SEQ ID NO: 839104 - RNA, 22 nt, Human
uuagagaaauucugguaaugua

SEQ ID NO: 839105 - RNA, 22 nt, Human
uauauacuuucuuccuggguag

SEQ ID NO: 839106 - RNA, 22 nt, Human
cauuucugggagacaugcuaga

SEQ ID NO: 839107 - RNA, 22 nt, Human
accugccuucucaaggacauga

SEQ ID NO: 839108 - RNA, 22 nt, Human
aauaacuggcacauaucacaua

SEQ ID NO: 839109 - RNA, 22 nt, Human
guaguuuucugaaaauuacuuu

SEQ ID NO: 839110 - RNA, 22 nt, Human
uaaaagcucuucuguugaguua

SEQ ID NO: 839111 - RNA, 22 nt, Human
uuaagcaacacacauuaauuau

SEQ ID NO: 839112 - RNA, 20 nt, Human
ggcucugcuugugagcagcc

SEQ ID NO: 839113 - RNA, 21 nt, Human
cugaggcagcacagcuaguca

SEQ ID NO: 839114 - RNA, 22 nt, Human
cagcugcccaggccaccuggag

SEQ ID NO: 839115 - RNA, 22 nt, Human
aagggcaggcagagaucauaua

SEQ ID NO: 839116 - RNA, 22 nt, Human
gaaguucaaaagacagauuuga

SEQ ID NO: 839117 - RNA, 22 nt, Human
aguaugaagcugaaugauuuua

SEQ ID NO: 839118 - RNA, 19 nt, Human
gccugccuggguuucugag

SEQ ID NO: 839119 - RNA, 22 nt, Human
cagcugccaugacauguccugc

SEQ ID NO: 839120 - RNA, 19 nt, Human
acagaaauuaguuauuuuc

SEQ ID NO: 839121 - RNA, 22 nt, Human
cagacuuucaaggagugaaggc

SEQ ID NO: 839122 - RNA, 22 nt, Human
uguauuuucuucuggaagcuua

SEQ ID NO: 839123 - RNA, 22 nt, Human
gagcaggccagcaauggaaggg

SEQ ID NO: 839124 - RNA, 22 nt, Human
ucucagaguaauucuuuaaggu

SEQ ID NO: 839125 - RNA, 17 nt, Human
uccaggagaggcaaugg

SEQ ID NO: 839126 - RNA, 22 nt, Human
gcagggaagaucuuggagcugc

SEQ ID NO: 839127 - RNA, 22 nt, Human
cagcuggcauaccugggcccgg

SEQ ID NO: 839128 - RNA, 22 nt, Human
ggaggggagguccagcugaucu

SEQ ID NO: 839129 - RNA, 22 nt, Human
cucuaacacuguaaugcuuucu

SEQ ID NO: 839130 - RNA, 22 nt, Human
agcagagcugcaguggccugcu

SEQ ID NO: 839131 - RNA, 22 nt, Human
aaaaccaggcguuuccuauuau

SEQ ID NO: 839132 - RNA, 22 nt, Human
ugggccugggagggcagacgcu

SEQ ID NO: 839133 - RNA, 22 nt, Human
uauguacauaacaugaaaugca

SEQ ID NO: 839134 - RNA, 22 nt, Human
ucucuuuuauguacacccugac

SEQ ID NO: 839135 - RNA, 21 nt, Human
ggagauggguaucgccugggc

SEQ ID NO: 839136 - RNA, 22 nt, Human
ugcaggagaaaguacggagcgu

SEQ ID NO: 839137 - RNA, 23 nt, Human
gucagggcuggggucagagugac

SEQ ID NO: 839138 - RNA, 22 nt, Human
ucaaagcaucagucaauuuagg

SEQ ID NO: 839139 - RNA, 22 nt, Human
caggguggcaggcaccauggcc

SEQ ID NO: 839140 - RNA, 22 nt, Human
accaucagagcacaguccgugc

SEQ ID NO: 839141 - RNA, 22 nt, Human
gauuuagagaauguuuuguaag

SEQ ID NO: 839142 - RNA, 22 nt, Human
cuuguccuuuacuugagacuca

SEQ ID NO: 839143 - RNA, 22 nt, Human
cacugcuuauaaauucuaggca

SEQ ID NO: 839144 - RNA, 22 nt, Human
ccagggcuggugggagaugcug

SEQ ID NO: 839145 - RNA, 22 nt, Human
ugggcccugacuucaagcaucc

SEQ ID NO: 839146 - RNA, 22 nt, Human
aucugcuuuugagaauuuacuu

SEQ ID NO: 839147 - RNA, 22 nt, Human
cagaacauucacucauaugugg

SEQ ID NO: 839148 - RNA, 21 nt, Human
cuccugggcuaagauauagug

SEQ ID NO: 839149 - RNA, 22 nt, Human
ccugagagcgaguggccucaug

SEQ ID NO: 839150 - RNA, 22 nt, Human
ucagaggacaagcucccuggug

SEQ ID NO: 839151 - RNA, 22 nt, Human
aaaucaguuagugguaggauug

SEQ ID NO: 839152 - RNA, 22 nt, Human
agcuggcauacuuugcuaggaa

SEQ ID NO: 839153 - RNA, 22 nt, Human
agagauguucauucagcauguu

SEQ ID NO: 839154 - RNA, 22 nt, Human
uagcugccaaaagggugggcua

SEQ ID NO: 839155 - RNA, 22 nt, Human
cagcaguggccaucuguguggu

SEQ ID NO: 839156 - RNA, 19 nt, Human
ucucagaggaaaaauugcu

SEQ ID NO: 839157 - RNA, 22 nt, Human
agaaugcauuuuguguagcuau

SEQ ID NO: 839158 - RNA, 22 nt, Human
gccugccucaaaaucccaguuc

SEQ ID NO: 839159 - RNA, 22 nt, Human
acacaguaccccaaggcugggc

SEQ ID NO: 839160 - RNA, 22 nt, Human
gccugguggugugcucaagugg

SEQ ID NO: 839161 - RNA, 22 nt, Human
agaugggcgcccuggacugagg

SEQ ID NO: 839162 - RNA, 22 nt, Human
uugcaggggaaggagcagagcu

SEQ ID NO: 839163 - RNA, 22 nt, Human
uggcagucuggguuggcaguua

SEQ ID NO: 839164 - RNA, 22 nt, Human
accaggggugucaacagcauuu

SEQ ID NO: 839165 - RNA, 22 nt, Human
auguucaaacaaguuaaugcca

SEQ ID NO: 839166 - RNA, 22 nt, Human
gggagggacacaaagaguuccc

SEQ ID NO: 839167 - RNA, 22 nt, Human
uguuagaaguuaaucacuaauu

SEQ ID NO: 839168 - RNA, 22 nt, Human
caggccugugaguugaggcccc

SEQ ID NO: 839169 - RNA, 22 nt, Human
uuuucuuacugucugugauccu

SEQ ID NO: 839170 - RNA, 21 nt, Human
ugggagagggcucagcuaccc

SEQ ID NO: 839171 - RNA, 22 nt, Human
auuucacaucuaucucagauuu

SEQ ID NO: 839172 - RNA, 22 nt, Human
agagccugcagcugugaagaaa

SEQ ID NO: 839173 - RNA, 22 nt, Human
gggcugcacguauucugcucac

SEQ ID NO: 839174 - RNA, 22 nt, Human
ugaaggaaagagggaacauccc

SEQ ID NO: 839175 - RNA, 22 nt, Human
ccuauacaggcuucuuuacaug

SEQ ID NO: 839176 - RNA, 22 nt, Human
uuauguaccugaauuaguaaag

SEQ ID NO: 839177 - RNA, 22 nt, Human
cucagggccaaggaugcuguug

SEQ ID NO: 839178 - RNA, 22 nt, Human
uaguuauuauuguuacuaucag

SEQ ID NO: 839179 - RNA, 22 nt, Human
ugggcucugcaucagugcccau

SEQ ID NO: 839180 - RNA, 22 nt, Human
aucuacagcugucugcacagua

SEQ ID NO: 839181 - RNA, 22 nt, Human
cccaucaggaacccaggagccc

SEQ ID NO: 839182 - RNA, 19 nt, Human
aaaagucuauucaauuaca

SEQ ID NO: 839183 - RNA, 21 nt, Human
uuucuuaggcucuaaaaugac

SEQ ID NO: 839184 - RNA, 22 nt, Human
cuuugcaauagaggcacacaug

SEQ ID NO: 839185 - RNA, 18 nt, Human
ggagccagucugucucug

SEQ ID NO: 839186 - RNA, 22 nt, Human
uggagcagagaugggagcccaa

SEQ ID NO: 839187 - RNA, 22 nt, Human
ucccagagguugagucacuuau

SEQ ID NO: 839188 - RNA, 22 nt, Human
gggcugcugcugccagcgacac

SEQ ID NO: 839189 - RNA, 22 nt, Human
ugggcuggcugaggcauucacu

SEQ ID NO: 839190 - RNA, 22 nt, Human
gcugccugccuaguuccacagu

SEQ ID NO: 839191 - RNA, 20 nt, Human
aggcugggguguuuugccca

SEQ ID NO: 839192 - RNA, 22 nt, Human
uuucaaagaguuguaaauuacu

SEQ ID NO: 839193 - RNA, 22 nt, Human
cagccugcccuggaagcccagc

SEQ ID NO: 839194 - RNA, 22 nt, Human
ccacuugugaaauaaucaaaua

SEQ ID NO: 839195 - RNA, 22 nt, Human
acauacauauguuuaaaugcau

SEQ ID NO: 839196 - RNA, 22 nt, Human
uagucucuggagacucuagggg

SEQ ID NO: 839197 - RNA, 22 nt, Human
gcagagccugugucugagcaaa

SEQ ID NO: 839198 - RNA, 22 nt, Human
aaucagaacuucucaggguggg

SEQ ID NO: 839199 - RNA, 22 nt, Human
aaauacagaguugcuuaaaagc

SEQ ID NO: 839200 - RNA, 21 nt, Human
ucccagagugcuugggacugc

SEQ ID NO: 839201 - RNA, 22 nt, Human
uuuuagaaauacugauuuagug

SEQ ID NO: 839202 - RNA, 22 nt, Human
ugcuauacauguacauauuagu

SEQ ID NO: 839203 - RNA, 22 nt, Human
caggaugugaggaggccauuug

SEQ ID NO: 839204 - RNA, 22 nt, Human
cagagagcuuagugugcugcau

SEQ ID NO: 839205 - RNA, 22 nt, Human
ccuggcucuucagagguuccua

SEQ ID NO: 839206 - RNA, 23 nt, Human
gccucugcagccuaguuaguguc

SEQ ID NO: 839207 - RNA, 20 nt, Human
ggccuuggccucuuugcagc

SEQ ID NO: 839208 - RNA, 22 nt, Human
ccccagccagcaggaccucuga

SEQ ID NO: 839209 - RNA, 22 nt, Human
cucuucuuuaguccagaccauc

SEQ ID NO: 839210 - RNA, 22 nt, Human
ggcaagaaggcuucagguagcu

SEQ ID NO: 839211 - RNA, 22 nt, Human
ccacacagggggaugaguuauu

SEQ ID NO: 839212 - RNA, 23 nt, Human
gccagccuugcucuccugcagcc

SEQ ID NO: 839213 - RNA, 22 nt, Human
gaggacagcuuagggcuuccug

SEQ ID NO: 839214 - RNA, 22 nt, Human
auguucaaacuuuuuacacacc

SEQ ID NO: 839215 - RNA, 22 nt, Human
acagaaauaacuuuuuauguuu

SEQ ID NO: 839216 - RNA, 22 nt, Human
uccaggagguugagugaguucc

SEQ ID NO: 839217 - RNA, 22 nt, Human
cuuaggcaguuuaggaaagaga

SEQ ID NO: 839218 - RNA, 22 nt, Human
agggcagagacaugcuuccuga

SEQ ID NO: 839219 - RNA, 22 nt, Human
gugcuuucugcaugguuccuac

SEQ ID NO: 839220 - RNA, 22 nt, Human
cuccaggggccagaagccuggc

SEQ ID NO: 839221 - RNA, 22 nt, Human
agcccaggugagggguucgaaa

SEQ ID NO: 839222 - RNA, 22 nt, Human
augguauugcaacaacugucau

SEQ ID NO: 839223 - RNA, 22 nt, Human
acagaguacauucagagacuau

SEQ ID NO: 839224 - RNA, 22 nt, Human
aucccugcccucauggagcuua

SEQ ID NO: 839225 - RNA, 20 nt, Human
acagaauaugcugguugugg

SEQ ID NO: 839226 - RNA, 22 nt, Human
gcccaucaucacuguggaggcu

SEQ ID NO: 839227 - RNA, 22 nt, Human
gcugguccacucccuggaggcu

SEQ ID NO: 839228 - RNA, 22 nt, Human
gaggccaggacaugaaagcuga

SEQ ID NO: 839229 - RNA, 22 nt, Human
gaggcaucugggcacagaagug

SEQ ID NO: 839230 - RNA, 22 nt, Human
gcugcuucucugauggagucca

SEQ ID NO: 839231 - RNA, 22 nt, Human
cuggccugggagcugcuagcgu

SEQ ID NO: 839232 - RNA, 22 nt, Human
agcagcagauccaaaaaaugug

SEQ ID NO: 839233 - RNA, 22 nt, Human
ucauuauccuaguaucuugaau

SEQ ID NO: 839234 - RNA, 22 nt, Human
agggccuggcuucacuuucuca

SEQ ID NO: 839235 - RNA, 22 nt, Human
ucacaggaaccaucagagaaau

SEQ ID NO: 839236 - RNA, 22 nt, Human
acugugugacuguuauuacugu

SEQ ID NO: 839237 - RNA, 22 nt, Human
ugucccucugaggcuucccugg

SEQ ID NO: 839238 - RNA, 22 nt, Human
gguucacacuuucaugauuuca

SEQ ID NO: 839239 - RNA, 23 nt, Human
uucuuucaagaaguucacagugc

SEQ ID NO: 839240 - RNA, 22 nt, Human
aggccagcgcugcuagcucccg

SEQ ID NO: 839241 - RNA, 21 nt, Human
caagccagaccaauagcagcc

SEQ ID NO: 839242 - RNA, 22 nt, Human
gauuucuguaacacuucagaua

SEQ ID NO: 839243 - RNA, 22 nt, Human
agccucuguagaaagcagugug

SEQ ID NO: 839244 - RNA, 22 nt, Human
agagcugcccacacagcagauu

SEQ ID NO: 839245 - RNA, 22 nt, Human
ccaggcagcaaauuuucugaau

SEQ ID NO: 839246 - RNA, 22 nt, Human
ugaaacuuauaagaauaugaau

SEQ ID NO: 839247 - RNA, 22 nt, Human
gaaaugugcagaauguguuaga

SEQ ID NO: 839248 - RNA, 22 nt, Human
auggggugaccaugagcauuua

SEQ ID NO: 839249 - RNA, 22 nt, Human
cuguauuuaguuaaaaugcuaa

SEQ ID NO: 839250 - RNA, 22 nt, Human
ucaugacaucuguuuaucucaa

SEQ ID NO: 839251 - RNA, 20 nt, Human
cagagcuguuauggaugaug

SEQ ID NO: 839252 - RNA, 22 nt, Human
cucagaguccauaguuuacagu

SEQ ID NO: 839253 - RNA, 22 nt, Human
auguagcagaagauguuuuccu

SEQ ID NO: 839254 - RNA, 22 nt, Human
ugagcuuacgugggaacagacu

SEQ ID NO: 839255 - RNA, 22 nt, Human
uuucacauuuuauacuuaagcc

SEQ ID NO: 839256 - RNA, 22 nt, Human
cagaagaguagcugaacaaguu

SEQ ID NO: 839257 - RNA, 22 nt, Human
uccacuuuagcaaugauugaau

SEQ ID NO: 839258 - RNA, 22 nt, Human
uuucacaaugcaauccuacuuc

SEQ ID NO: 839259 - RNA, 22 nt, Human
ccugcuguaaugugucuuuauu

SEQ ID NO: 839260 - RNA, 22 nt, Human
ccucuggcuguaccacuggcac

SEQ ID NO: 839261 - RNA, 22 nt, Human
ccuguucacugcacaguuuccg

SEQ ID NO: 839262 - RNA, 20 nt, Human
uccaggagguuaguguggcu

SEQ ID NO: 839263 - RNA, 22 nt, Human
ugggcacuauggcucugugcac

SEQ ID NO: 839264 - RNA, 22 nt, Human
cuggagcuaggaaguccaagau

SEQ ID NO: 839265 - RNA, 22 nt, Human
acugccuuauaugcugugugug

SEQ ID NO: 839266 - RNA, 22 nt, Human
gggcagagaaauggacaguugg

SEQ ID NO: 839267 - RNA, 20 nt, Human
aguguacagacacuagaaau

SEQ ID NO: 839268 - RNA, 22 nt, Human
gucuuuauuugagauugucauu

SEQ ID NO: 839269 - RNA, 22 nt, Human
auuguacaaugccuggaacauu

SEQ ID NO: 839270 - RNA, 22 nt, Human
uauuucagucacuucuucucug

SEQ ID NO: 839271 - RNA, 19 nt, Human
uccauaagcuuguguucau

SEQ ID NO: 839272 - RNA, 22 nt, Human
ucagcagugcagggugaggcag

SEQ ID NO: 839273 - RNA, 22 nt, Human
ugucucugccagcuagcagaau

SEQ ID NO: 839274 - RNA, 22 nt, Human
uuaaauuagucaagcuucucug

SEQ ID NO: 839275 - RNA, 22 nt, Human
ugggccacuugaaaguggaugu

SEQ ID NO: 839276 - RNA, 23 nt, Human
uucaaaacuggaaaaucagaugc

SEQ ID NO: 839277 - RNA, 22 nt, Human
caauauauaaugaguacuuucc

SEQ ID NO: 839278 - RNA, 22 nt, Human
ugccagugggugugcagagacu

SEQ ID NO: 839279 - RNA, 22 nt, Human
uuagaaaugcacccaagaccua

SEQ ID NO: 839280 - RNA, 22 nt, Human
ggucucaggagacuggagagca

SEQ ID NO: 839281 - RNA, 22 nt, Human
ucuggagcgaggucccugucug

SEQ ID NO: 839282 - RNA, 22 nt, Human
gcagcuggcucagagagguggg

SEQ ID NO: 839283 - RNA, 22 nt, Human
cugaggagagaucacguggugu

SEQ ID NO: 839284 - RNA, 21 nt, Human
ucucuggaauuagaccauguu

SEQ ID NO: 839285 - RNA, 22 nt, Human
agggcagccucucagccuaggu

SEQ ID NO: 839286 - RNA, 22 nt, Human
acuauacaagauuagggauuug

SEQ ID NO: 839287 - RNA, 22 nt, Human
uggcuuuacacauccacugccu

SEQ ID NO: 839288 - RNA, 22 nt, Human
ucccaggauuuuaggcucucag

SEQ ID NO: 839289 - RNA, 22 nt, Human
ucugggagauccaagcagaacu

SEQ ID NO: 839290 - RNA, 22 nt, Human
gccuuccuuacaccugcucagc

SEQ ID NO: 839291 - RNA, 20 nt, Human
ccucaagcagacugacagcu

SEQ ID NO: 839292 - RNA, 22 nt, Human
gcuuugaagacuuuuccagggu

SEQ ID NO: 839293 - RNA, 22 nt, Human
gugauuucuaaucaucugaaug

SEQ ID NO: 839294 - RNA, 22 nt, Human
aauacaaucaaauucacuagca

SEQ ID NO: 839295 - RNA, 22 nt, Human
agaucuauuagcaaacugccau

SEQ ID NO: 839296 - RNA, 20 nt, Human
augccucuaauuuugcaaac

SEQ ID NO: 839297 - RNA, 22 nt, Human
uuuaggcaaacucauugucaga

SEQ ID NO: 839298 - RNA, 22 nt, Human
ucaggagaguguucaguggagg

SEQ ID NO: 839299 - RNA, 22 nt, Human
caugcugugcaucuugaugacc

SEQ ID NO: 839300 - RNA, 22 nt, Human
uggugaagucagcggagcccgg

SEQ ID NO: 839301 - RNA, 22 nt, Human
uaaaucacuccuaauaaucagu

SEQ ID NO: 839302 - RNA, 22 nt, Human
aaaagguuuugaguacaaauau

SEQ ID NO: 839303 - RNA, 22 nt, Human
uccucaggucaaagcaggagaa

SEQ ID NO: 839304 - RNA, 18 nt, Human
agagcagcggcaucacac

SEQ ID NO: 839305 - RNA, 22 nt, Human
gagcugagccuggguggaccgc

SEQ ID NO: 839306 - RNA, 22 nt, Human
ucccaggaaugucugaaaguga

SEQ ID NO: 839307 - RNA, 22 nt, Human
aggagaaggaagugcaucacua

SEQ ID NO: 839308 - RNA, 22 nt, Human
uaaacauuuguuauucuuguuu

SEQ ID NO: 839309 - RNA, 22 nt, Human
uuucagaucauuuuuuaaguac

SEQ ID NO: 839310 - RNA, 22 nt, Human
ccaucagcaugggagcaugggc

SEQ ID NO: 839311 - RNA, 22 nt, Human
uuuuagauugggaaauguaaag

SEQ ID NO: 839312 - RNA, 22 nt, Human
cugugucucuccuuacaagacu

SEQ ID NO: 839313 - RNA, 20 nt, Human
gacauucauaguuauuacca

SEQ ID NO: 839314 - RNA, 22 nt, Human
cuggggugugcucagagcaggg

SEQ ID NO: 839315 - RNA, 22 nt, Human
cagaagcauugacuccuugcuc

SEQ ID NO: 839316 - RNA, 22 nt, Human
uggcucugagacacaggcucuc

SEQ ID NO: 839317 - RNA, 22 nt, Human
uguggucucguuauguugccca

SEQ ID NO: 839318 - RNA, 22 nt, Human
ccaggaaugaaauguagauaaa

SEQ ID NO: 839319 - RNA, 22 nt, Human
auacauuagcucauaugauuaa

SEQ ID NO: 839320 - RNA, 22 nt, Human
gaacagcugcuagagaucugug

SEQ ID NO: 839321 - RNA, 22 nt, Human
accaggagucuagccuagucaa

SEQ ID NO: 839322 - RNA, 22 nt, Human
ugaaaucuucacuaagucucuu

SEQ ID NO: 839323 - RNA, 22 nt, Human
aaaugguguuucuaaugcuaga

SEQ ID NO: 839324 - RNA, 22 nt, Human
cugcugugugaccauggacagg

SEQ ID NO: 839325 - RNA, 22 nt, Human
cccaggcuggagugcaauggug

SEQ ID NO: 839326 - RNA, 22 nt, Human
ggucacaggggagaagagugau

SEQ ID NO: 839327 - RNA, 22 nt, Human
cuggcaggcggcagagcccagg

SEQ ID NO: 839328 - RNA, 22 nt, Human
ccaaagucuggagcagcagagc

SEQ ID NO: 839329 - RNA, 22 nt, Human
gggcaugguggcaggcaccugu

SEQ ID NO: 839330 - RNA, 22 nt, Human
cagagccugccucuggcugugg

SEQ ID NO: 839331 - RNA, 21 nt, Human
ccuggcuucagggugcacugg

SEQ ID NO: 839332 - RNA, 22 nt, Human
ucccuucacagaugcgauguuu

SEQ ID NO: 839333 - RNA, 19 nt, Human
aggcagcaggccagggaug

SEQ ID NO: 839334 - RNA, 22 nt, Human
ugggcagaggcagcagaaaccu

SEQ ID NO: 839335 - RNA, 22 nt, Human
aggcccugcccagagcuccucg

SEQ ID NO: 839336 - RNA, 22 nt, Human
ggcagcuuuuaucccugacaga

SEQ ID NO: 839337 - RNA, 22 nt, Human
uccuuguugcugcagucaccug

SEQ ID NO: 839338 - RNA, 22 nt, Human
caaguccuaggucugauugaac

SEQ ID NO: 839339 - RNA, 22 nt, Human
aagggcagccugacucacgguc

SEQ ID NO: 839340 - RNA, 23 nt, Human
agaggcaggaguggcuugcccgg

SEQ ID NO: 839341 - RNA, 22 nt, Human
auagucacugccuuccauuugu

SEQ ID NO: 839342 - RNA, 22 nt, Human
aucagcaaucucguguauuagg

SEQ ID NO: 839343 - RNA, 22 nt, Human
ggugggcaacauuuggccugag

SEQ ID NO: 839344 - RNA, 22 nt, Human
aaaugaacaguugcauucucug

SEQ ID NO: 839345 - RNA, 19 nt, Human
gcaggcacagcccugggug

SEQ ID NO: 839346 - RNA, 22 nt, Human
cugcugucuuuauuucacugcu

SEQ ID NO: 839347 - RNA, 22 nt, Human
ccugggcauucuuugaguucuc

SEQ ID NO: 839348 - RNA, 22 nt, Human
acagagcacauagauuggaguu

SEQ ID NO: 839349 - RNA, 22 nt, Human
aaacuguaaacacagcaguaca

SEQ ID NO: 839350 - RNA, 20 nt, Human
aaaaacaguaaugcugaaga

SEQ ID NO: 839351 - RNA, 22 nt, Human
ccauggccgccgcugcucagga

SEQ ID NO: 839352 - RNA, 22 nt, Human
ucuuuguaacugucuauugaga

SEQ ID NO: 839353 - RNA, 22 nt, Human
uucucagaugauucagauaaac

SEQ ID NO: 839354 - RNA, 22 nt, Human
ugcauuauuugcaugugccugu

SEQ ID NO: 839355 - RNA, 22 nt, Human
aguguuugagacacauuucacu

SEQ ID NO: 839356 - RNA, 22 nt, Human
uauucacauguacauaugcuca

SEQ ID NO: 839357 - RNA, 22 nt, Human
ucuuuaauguacuuucuuucac

SEQ ID NO: 839358 - RNA, 22 nt, Human
uuugcauaggauggacauuuua

SEQ ID NO: 839359 - RNA, 22 nt, Human
gugccugugcggacucagggaa

SEQ ID NO: 839360 - RNA, 22 nt, Human
uugcauuuaaguagauguuaca

SEQ ID NO: 839361 - RNA, 21 nt, Human
uuacagaauccaugggaaguc

SEQ ID NO: 839362 - RNA, 22 nt, Human
acaaaauuguguuaaacuuuau

SEQ ID NO: 839363 - RNA, 23 nt, Human
ucacaggggccagcgcucugugg

SEQ ID NO: 839364 - RNA, 22 nt, Human
cugcugugucagaguccagggg

SEQ ID NO: 839365 - RNA, 22 nt, Human
ugugugccagccuacgaggagc

SEQ ID NO: 839366 - RNA, 22 nt, Human
cuggcagggugggcuuugcuuu

SEQ ID NO: 839367 - RNA, 22 nt, Human
agcaaggcagucagcuggcugg

SEQ ID NO: 839368 - RNA, 22 nt, Human
cagaggauucccuagugaccug

SEQ ID NO: 839369 - RNA, 22 nt, Human
uugaacauuggcaauuucauau

SEQ ID NO: 839370 - RNA, 22 nt, Human
uuuaucuuuaggacuuugcaga

SEQ ID NO: 839371 - RNA, 23 nt, Human
uggcucugagagguucagaugcu

SEQ ID NO: 839372 - RNA, 22 nt, Human
agcugagccagcagcaacagga

SEQ ID NO: 839373 - RNA, 22 nt, Human
cugcuguguuccuccugcaucu

SEQ ID NO: 839374 - RNA, 22 nt, Human
uggccucaagucugagggccuu

SEQ ID NO: 839375 - RNA, 22 nt, Human
uuuuaacuuaaaauacauagau

SEQ ID NO: 839376 - RNA, 22 nt, Human
uucugucacuuaggaggucaua

SEQ ID NO: 839377 - RNA, 22 nt, Human
uggugcuguggaggggcagaag

SEQ ID NO: 839378 - RNA, 22 nt, Human
uccuggagcuuccuucauggua

SEQ ID NO: 839379 - RNA, 22 nt, Human
agagcuggccagggaucacucu

SEQ ID NO: 839380 - RNA, 22 nt, Human
gggcacuguacacugugcaugg

SEQ ID NO: 839381 - RNA, 22 nt, Human
auuugcuuucagguauaaaagg

SEQ ID NO: 839382 - RNA, 21 nt, Human
uccauaagagaccaucuccua

SEQ ID NO: 839383 - RNA, 22 nt, Human
auuaaagaaacccagcauguga

SEQ ID NO: 839384 - RNA, 22 nt, Human
guggugcauccuugaguaagcu

SEQ ID NO: 839385 - RNA, 22 nt, Human
ucucaccauggugcuugcuuau

SEQ ID NO: 839386 - RNA, 22 nt, Human
aaugggauaauuguucauggga

SEQ ID NO: 839387 - RNA, 22 nt, Human
acuaaacugaagcaugaaaagg

SEQ ID NO: 839388 - RNA, 22 nt, Human
auccagggauaaaaguaagguu

SEQ ID NO: 839389 - RNA, 22 nt, Human
aaguucaauggaaaagcuuuag

SEQ ID NO: 839390 - RNA, 22 nt, Human
aaaugcacagagccuuagagau

SEQ ID NO: 839391 - RNA, 22 nt, Human
acuuccugcaaucguccacucc

SEQ ID NO: 839392 - RNA, 22 nt, Human
gaggaggcuggcgccgccugcc

SEQ ID NO: 839393 - RNA, 22 nt, Human
agcuggccuuagugagcaccug

SEQ ID NO: 839394 - RNA, 18 nt, Human
gaagggagcuggaaugca

SEQ ID NO: 839395 - RNA, 22 nt, Human
uggaaauggaucugaugagucu

SEQ ID NO: 839396 - RNA, 22 nt, Human
gcagcugccuauucagggcuug

SEQ ID NO: 839397 - RNA, 22 nt, Human
uucugucaaagacuuuuucagg

SEQ ID NO: 839398 - RNA, 22 nt, Human
auuacucugucugccucugacc

SEQ ID NO: 839399 - RNA, 22 nt, Human
cccagggaagccauuucugacu

SEQ ID NO: 839400 - RNA, 22 nt, Human
agccuggaguucccaggagaag

SEQ ID NO: 839401 - RNA, 22 nt, Human
uccagccaacugccuagggagc

SEQ ID NO: 839402 - RNA, 22 nt, Human
ucuggaucgccggcgccugggc

SEQ ID NO: 839403 - RNA, 22 nt, Human
uuugaagucaaagauugauucc

SEQ ID NO: 839404 - RNA, 22 nt, Human
aauauaugugguauugaccagc

SEQ ID NO: 839405 - RNA, 22 nt, Human
gaguggggcccacugcugggug

SEQ ID NO: 839406 - RNA, 18 nt, Human
agccuggaggguugaagu

SEQ ID NO: 839407 - RNA, 22 nt, Human
ugggcugcagggguugagagcu

SEQ ID NO: 839408 - RNA, 22 nt, Human
gggugggaacaggaugccagga

SEQ ID NO: 839409 - RNA, 22 nt, Human
uuugcauuugcaaauaaugaaa

SEQ ID NO: 839410 - RNA, 22 nt, Human
agaguguuauuugcucuguauu

SEQ ID NO: 839411 - RNA, 21 nt, Human
agagucugcauuucugacaag

SEQ ID NO: 839412 - RNA, 22 nt, Human
cacagcuucugagugaggauuu

SEQ ID NO: 839413 - RNA, 22 nt, Human
ugucacagggauaccauggggc

SEQ ID NO: 839414 - RNA, 22 nt, Human
agucucaggcagaggaaggcua

SEQ ID NO: 839415 - RNA, 22 nt, Human
aguaugaagaauacauagauga

SEQ ID NO: 839416 - RNA, 22 nt, Human
cccaggagauggagguugcagu

SEQ ID NO: 839417 - RNA, 22 nt, Human
gugacucacacaggccugggcu

SEQ ID NO: 839418 - RNA, 22 nt, Human
acagagguguuccagaccuagg

SEQ ID NO: 839419 - RNA, 22 nt, Human
auggggugagacuaggauuaaa

SEQ ID NO: 839420 - RNA, 22 nt, Human
gaggggcugcccuggugucagg

SEQ ID NO: 839421 - RNA, 22 nt, Human
aaaucugguucaguaaguccuc

SEQ ID NO: 839422 - RNA, 22 nt, Human
guggcccucugauagggucagg

SEQ ID NO: 839423 - RNA, 22 nt, Human
gcagugaaacaauaggaucaaa

SEQ ID NO: 839424 - RNA, 22 nt, Human
augugcauuaaaugucaauguu

SEQ ID NO: 839425 - RNA, 22 nt, Human
ugaaaaggaguccuuguuuuca

SEQ ID NO: 839426 - RNA, 22 nt, Human
uaaugcacagaauugacauggg

SEQ ID NO: 839427 - RNA, 22 nt, Human
cuggccaacuugcuuguuggca

SEQ ID NO: 839428 - RNA, 22 nt, Human
cacccaggcuagagugcagugg

SEQ ID NO: 839429 - RNA, 22 nt, Human
aggcugaggcagguggaucacc

SEQ ID NO: 839430 - RNA, 22 nt, Human
acacugaauguuuaagaacuug

SEQ ID NO: 839431 - RNA, 22 nt, Human
cuuauguaaacuacagauaaua

SEQ ID NO: 839432 - RNA, 22 nt, Human
uuccauaauuaaguggagagaa

SEQ ID NO: 839433 - RNA, 22 nt, Human
aggagcugcuuaaaugguuggu

SEQ ID NO: 839434 - RNA, 22 nt, Human
auauauuuugcggucacguggc

SEQ ID NO: 839435 - RNA, 22 nt, Human
aaagaucagucugaagcaacau

SEQ ID NO: 839436 - RNA, 22 nt, Human
cauggucuacaauuucauuuua

SEQ ID NO: 839437 - RNA, 22 nt, Human
cauuuucaugaguuucuguuca

SEQ ID NO: 839438 - RNA, 22 nt, Human
cuuucauaaaggaaaugaugag

SEQ ID NO: 839439 - RNA, 22 nt, Human
uccuggccugucuggaguagcu

SEQ ID NO: 839440 - RNA, 22 nt, Human
ucagggcauguauguuucuuua

SEQ ID NO: 839441 - RNA, 22 nt, Human
uccaagaucuacagcaguuuag

SEQ ID NO: 839442 - RNA, 22 nt, Human
ucucccaggugggugccuggag

SEQ ID NO: 839443 - RNA, 22 nt, Human
ccaggggaaacagggagcacuc

SEQ ID NO: 839444 - RNA, 22 nt, Human
caggagugcagguggugaggca

SEQ ID NO: 839445 - RNA, 22 nt, Human
acagaggucauggagaguucuc

SEQ ID NO: 839446 - RNA, 22 nt, Human
gaggagcuggcagcgucuccgc

SEQ ID NO: 839447 - RNA, 22 nt, Human
gucagugucuuaacagagauua

SEQ ID NO: 839448 - RNA, 20 nt, Human
uuucuguaaggcauuaaucu

SEQ ID NO: 839449 - RNA, 22 nt, Human
gcagggcagcuuagucccuguc

SEQ ID NO: 839450 - RNA, 22 nt, Human
acuuugaaggggaacauuuuaa

SEQ ID NO: 839451 - RNA, 22 nt, Human
uggagcugggguuugaaucugg

SEQ ID NO: 839452 - RNA, 22 nt, Human
cagcaggcugcgauugcucauu

SEQ ID NO: 839453 - RNA, 22 nt, Human
agacaaaugguaauuaugucua

SEQ ID NO: 839454 - RNA, 22 nt, Human
ugggccugugaugcugggcuau

SEQ ID NO: 839455 - RNA, 22 nt, Human
ggagccagaggcugcugcugug

SEQ ID NO: 839456 - RNA, 22 nt, Human
accuggcaugaagcaugccuua

SEQ ID NO: 839457 - RNA, 22 nt, Human
gccuggaguggacuuggccccu

SEQ ID NO: 839458 - RNA, 22 nt, Human
gccuaggaguacagaaugguuu

SEQ ID NO: 839459 - RNA, 22 nt, Human
agaggggaaggaugugauguga

SEQ ID NO: 839460 - RNA, 22 nt, Human
caggccugacccugagcuucac

SEQ ID NO: 839461 - RNA, 22 nt, Human
aggaccuguagggccugcaucc

SEQ ID NO: 839462 - RNA, 22 nt, Human
aagcuggcaugucaccugagaa

SEQ ID NO: 839463 - RNA, 22 nt, Human
cagcagcuucuguugaucagaa

SEQ ID NO: 839464 - RNA, 22 nt, Human
aagccagcauuuucccauuccu

SEQ ID NO: 839465 - RNA, 23 nt, Human
ucagucuucccugucaguaauag

SEQ ID NO: 839466 - RNA, 22 nt, Human
agaugcugucacacacacuguu

SEQ ID NO: 839467 - RNA, 22 nt, Human
acagaaugcguagugcauguug

SEQ ID NO: 839468 - RNA, 22 nt, Human
aguucuuuugugaacauaugcu

SEQ ID NO: 839469 - RNA, 22 nt, Human
ucacagaaauaagauaguuauu

SEQ ID NO: 839470 - RNA, 22 nt, Human
ggcugccugggagcccuccucu

SEQ ID NO: 839471 - RNA, 22 nt, Human
cauggcagaaaccugagcugcu

SEQ ID NO: 839472 - RNA, 22 nt, Human
ccaguuuuuccagugcuuucug

SEQ ID NO: 839473 - RNA, 22 nt, Human
aagaugauaggacuugcuuaag

SEQ ID NO: 839474 - RNA, 22 nt, Human
acagagcucccagccaucuccu

SEQ ID NO: 839475 - RNA, 22 nt, Human
cacagggcagagaccugggugc

SEQ ID NO: 839476 - RNA, 22 nt, Human
ccagcuggugacauccccaacc

SEQ ID NO: 839477 - RNA, 23 nt, Human
gcccaugcuguugggcccgagca

SEQ ID NO: 839478 - RNA, 22 nt, Human
acauuuguaugcguuuuuacug

SEQ ID NO: 839479 - RNA, 19 nt, Human
auacagauguauccaugau

SEQ ID NO: 839480 - RNA, 20 nt, Human
cuguagggugcagcaggcuc

SEQ ID NO: 839481 - RNA, 22 nt, Human
accauccugaaaccuucaugcu

SEQ ID NO: 839482 - RNA, 22 nt, Human
cagcugccacaccucuuucucu

SEQ ID NO: 839483 - RNA, 22 nt, Human
aucaguuaguuacugcuaagau

SEQ ID NO: 839484 - RNA, 22 nt, Human
ucuggauggucagcucuuccug

SEQ ID NO: 839485 - RNA, 22 nt, Human
cucuccuggggagcacacacac

SEQ ID NO: 839486 - RNA, 22 nt, Human
ucugagaggauuccugucccga

SEQ ID NO: 839487 - RNA, 19 nt, Human
ucacaggcaucuccccaga

SEQ ID NO: 839488 - RNA, 18 nt, Human
aguaaagcuuauuacaug

SEQ ID NO: 839489 - RNA, 20 nt, Human
agcuggccuguccuaggccu

SEQ ID NO: 839490 - RNA, 22 nt, Human
acagagcacugcccugugccgc

SEQ ID NO: 839491 - RNA, 21 nt, Human
gccagagcaguacaaugaggu

SEQ ID NO: 839492 - RNA, 22 nt, Human
ggccagggggcuucagacucca

SEQ ID NO: 839493 - RNA, 22 nt, Human
ggcuccuguccccucagcugcu

SEQ ID NO: 839494 - RNA, 21 nt, Human
ucuguucaaggaacuacggau

SEQ ID NO: 839495 - RNA, 20 nt, Human
ucucugcuguccacauuugc

SEQ ID NO: 839496 - RNA, 19 nt, Human
agcaacaccguuuauuucc

SEQ ID NO: 839497 - RNA, 22 nt, Human
ggccugagcucuggggaggcaa

SEQ ID NO: 839498 - RNA, 22 nt, Human
guagaaauuccauuuacuuuga

SEQ ID NO: 839499 - RNA, 22 nt, Human
ucuccuggucaccucagaaguc

SEQ ID NO: 839500 - RNA, 18 nt, Human
ucacagugcucuugccua

SEQ ID NO: 839501 - RNA, 22 nt, Human
aagagaggacauggugaaccug

SEQ ID NO: 839502 - RNA, 22 nt, Human
ugguuuaauuuccauuuccuug

SEQ ID NO: 839503 - RNA, 22 nt, Human
uggcucagugaagagauaacuu

SEQ ID NO: 839504 - RNA, 22 nt, Human
caugugucaaaugauguagcug

SEQ ID NO: 839505 - RNA, 22 nt, Human
acugcagggcauccuggccaag

SEQ ID NO: 839506 - RNA, 22 nt, Human
ggaaccaggaguuacacgaguu

SEQ ID NO: 839507 - RNA, 18 nt, Human
ucaaagucuggcuccacu

SEQ ID NO: 839508 - RNA, 22 nt, Human
gcugccuguguggccacucacu

SEQ ID NO: 839509 - RNA, 23 nt, Human
agacagaggcugaggcuggccgc

SEQ ID NO: 839510 - RNA, 17 nt, Human
cccagcuggcagugccg

SEQ ID NO: 839511 - RNA, 22 nt, Human
aaggcucuuggagugaaugcag

SEQ ID NO: 839512 - RNA, 22 nt, Human
ggagaggggcaaguuuaucuag

SEQ ID NO: 839513 - RNA, 22 nt, Human
ggacagcccauacacaugucug

SEQ ID NO: 839514 - RNA, 22 nt, Human
guggcuucacauggcauuuggc

SEQ ID NO: 839515 - RNA, 22 nt, Human
gcaagcuggcuguuagaggaug

SEQ ID NO: 839516 - RNA, 22 nt, Human
ucuguucauacagaguauagua

SEQ ID NO: 839517 - RNA, 22 nt, Human
aaauugcaaaaguacuuuuagg

SEQ ID NO: 839518 - RNA, 22 nt, Human
ccagcugauucgguggugguug

SEQ ID NO: 839519 - RNA, 19 nt, Human
gggcagaauggcaucucag

SEQ ID NO: 839520 - RNA, 22 nt, Human
uacauuaacuuacguccacaug

SEQ ID NO: 839521 - RNA, 23 nt, Human
ggccauuucauuugguucaaacu

SEQ ID NO: 839522 - RNA, 22 nt, Human
cauuaucucuucuauaugcuag

SEQ ID NO: 839523 - RNA, 22 nt, Human
aaugucugccugaacuuuauau

SEQ ID NO: 839524 - RNA, 22 nt, Human
cacagaggacuguagcggggag

SEQ ID NO: 839525 - RNA, 22 nt, Human
gcagcagagaacacaaugaugg

SEQ ID NO: 839526 - RNA, 22 nt, Human
ugagacaaaauugacagacaaa

SEQ ID NO: 839527 - RNA, 22 nt, Human
ggcucacgcaauuaucccggcc

SEQ ID NO: 839528 - RNA, 22 nt, Human
uagcuuuaccauagaagaguau

SEQ ID NO: 839529 - RNA, 22 nt, Human
gggcacugcuggaggcucccug

SEQ ID NO: 839530 - RNA, 22 nt, Human
aggcucugaucagguggcugug

SEQ ID NO: 839531 - RNA, 22 nt, Human
aaacaugagcaucucuucaagc

SEQ ID NO: 839532 - RNA, 22 nt, Human
auuaggcauauaugcuuuuaau

SEQ ID NO: 839533 - RNA, 22 nt, Human
cucucuggcuuggcacggagau

SEQ ID NO: 839534 - RNA, 22 nt, Human
uggaagcaucacuucuugccug

SEQ ID NO: 839535 - RNA, 20 nt, Human
uucugucagauuauauggga

SEQ ID NO: 839536 - RNA, 22 nt, Human
auauuucuccaaauguuuucaa

SEQ ID NO: 839537 - RNA, 22 nt, Human
uuaauaaaguaugaauuggaaa

SEQ ID NO: 839538 - RNA, 22 nt, Human
caugaaaaugucaaguucugcu

SEQ ID NO: 839539 - RNA, 22 nt, Human
caggcuugcugcuagagcacuu

SEQ ID NO: 839540 - RNA, 22 nt, Human
ccuuucagaugggcauggaccg

SEQ ID NO: 839541 - RNA, 22 nt, Human
agugugcugcuuaaacaguugu

SEQ ID NO: 839542 - RNA, 22 nt, Human
ggcagggaagcuggcaucacgg

SEQ ID NO: 839543 - RNA, 17 nt, Human
gagaguguauuggaugc

SEQ ID NO: 839544 - RNA, 22 nt, Human
ucacaacuugaagcugauuuaa

SEQ ID NO: 839545 - RNA, 22 nt, Human
aggccaaguagcuagcauugaa

SEQ ID NO: 839546 - RNA, 22 nt, Human
guuaauauuuaccugucaagaa

SEQ ID NO: 839547 - RNA, 17 nt, Human
uuuagaauacaauguuu

SEQ ID NO: 839548 - RNA, 22 nt, Human
ccaaaauguuugaaugcaugug

SEQ ID NO: 839549 - RNA, 22 nt, Human
ggagggagucagcugauuagaa

SEQ ID NO: 839550 - RNA, 22 nt, Human
gauaucauaucagacaaccucu

SEQ ID NO: 839551 - RNA, 22 nt, Human
agaaaugugagccccuuaucaa

SEQ ID NO: 839552 - RNA, 22 nt, Human
aauguaaacagcaagagaaggg

SEQ ID NO: 839553 - RNA, 22 nt, Human
uggcucagagcagggacucugg

SEQ ID NO: 839554 - RNA, 22 nt, Human
cagucaccugaagacuugacca

SEQ ID NO: 839555 - RNA, 22 nt, Human
ugcuuaauagugcacugguuuc

SEQ ID NO: 839556 - RNA, 23 nt, Human
auaaggcauaaagguacauugga

SEQ ID NO: 839557 - RNA, 21 nt, Human
gccugcagaccccaccaggcu

SEQ ID NO: 839558 - RNA, 22 nt, Human
uaugaaacauucauacaaauaa

SEQ ID NO: 839559 - RNA, 22 nt, Human
cagagccaaaugcugugguuau

SEQ ID NO: 839560 - RNA, 22 nt, Human
ugugaaagucaaauuaauugaa

SEQ ID NO: 839561 - RNA, 22 nt, Human
acagagccaaaaggacauagua

SEQ ID NO: 839562 - RNA, 22 nt, Human
aguggugcugcgcgcggagcuc

SEQ ID NO: 839563 - RNA, 22 nt, Human
ucuaaacacuaagucuugaugc

SEQ ID NO: 839564 - RNA, 22 nt, Human
ugaggcaggaggauugcaggau

SEQ ID NO: 839565 - RNA, 19 nt, Human
ggcagucucaagcagcaca

SEQ ID NO: 839566 - RNA, 22 nt, Human
uggcucaguuuagcagcucagu

SEQ ID NO: 839567 - RNA, 22 nt, Human
agcugccaucagccuuuggaug

SEQ ID NO: 839568 - RNA, 22 nt, Human
caaaugugguuucucagcauuc

SEQ ID NO: 839569 - RNA, 22 nt, Human
uugugaaacauucauggauuug

SEQ ID NO: 839570 - RNA, 22 nt, Human
auauucuuccaaaacaucauuu

SEQ ID NO: 839571 - RNA, 22 nt, Human
gugccuuccccgguggucuguu

SEQ ID NO: 839572 - RNA, 22 nt, Human
uggcagaggaggcucagauuga

SEQ ID NO: 839573 - RNA, 22 nt, Human
auugucuucuggucuuaucuuu

SEQ ID NO: 839574 - RNA, 22 nt, Human
gcuuccucgcugggcagaggca

SEQ ID NO: 839575 - RNA, 22 nt, Human
gccugucucuuggaacuuggua

SEQ ID NO: 839576 - RNA, 22 nt, Human
gucaaauauacuaagagguaaa

SEQ ID NO: 839577 - RNA, 22 nt, Human
caggcugggcagccuccccggc

SEQ ID NO: 839578 - RNA, 22 nt, Human
gcugagguggagauugcaguga

SEQ ID NO: 839579 - RNA, 22 nt, Human
gauuuagagcaggaaugcaugg

SEQ ID NO: 839580 - RNA, 22 nt, Human
ugucccagucaaggcugucauc

SEQ ID NO: 839581 - RNA, 19 nt, Human
gcucugugaugcugagggg

SEQ ID NO: 839582 - RNA, 22 nt, Human
cacauacaaugguguuauuugg

SEQ ID NO: 839583 - RNA, 22 nt, Human
uauguacaugauuucauuugcu

SEQ ID NO: 839584 - RNA, 22 nt, Human
cacaggaggaggccagagcgua

SEQ ID NO: 839585 - RNA, 22 nt, Human
gauccuugcaacucugugaggu

SEQ ID NO: 839586 - RNA, 22 nt, Human
uuaaaaugaauauugauuagca

SEQ ID NO: 839587 - RNA, 22 nt, Human
ggccccuggcaccaggcugauu

SEQ ID NO: 839588 - RNA, 22 nt, Human
ucagggacauuuagacacugau

SEQ ID NO: 839589 - RNA, 22 nt, Human
acuuucucaaaucagacuuuaa

SEQ ID NO: 839590 - RNA, 22 nt, Human
uccaggagucagacagauggug

SEQ ID NO: 839591 - RNA, 22 nt, Human
augugaaagagguguucagugg

SEQ ID NO: 839592 - RNA, 22 nt, Human
ccuggccuccuggccuucucau

SEQ ID NO: 839593 - RNA, 18 nt, Human
ugcuggguaacuguaugg

SEQ ID NO: 839594 - RNA, 22 nt, Human
caauuucacugacacccuggaa

SEQ ID NO: 839595 - RNA, 22 nt, Human
aucaaaguccaucagaagguag

SEQ ID NO: 839596 - RNA, 22 nt, Human
uauuacaauuuacauugcacuu

SEQ ID NO: 839597 - RNA, 22 nt, Human
agccaugcaccuuacucuugcu

SEQ ID NO: 839598 - RNA, 22 nt, Human
ggcucuggugcccuggcuccca

SEQ ID NO: 839599 - RNA, 22 nt, Human
gagcuggugugugcccgagcac

SEQ ID NO: 839600 - RNA, 22 nt, Human
aaaugcuguaacugauauucug

SEQ ID NO: 839601 - RNA, 22 nt, Human
ugcuggaggccugacuguguuu

SEQ ID NO: 839602 - RNA, 22 nt, Human
uggccugcccagagcagcucug

SEQ ID NO: 839603 - RNA, 22 nt, Human
acuauacauugaauguuaaggu

SEQ ID NO: 839604 - RNA, 22 nt, Human
cucugggcuuguugaccugcac

SEQ ID NO: 839605 - RNA, 22 nt, Human
uggccugggccggcagauauac

SEQ ID NO: 839606 - RNA, 22 nt, Human
gcagagcuguuaauggagcuga

SEQ ID NO: 839607 - RNA, 22 nt, Human
augguuuaguuagggcuuuuca

SEQ ID NO: 839608 - RNA, 22 nt, Human
uggcuucuuagaccaguggccu

SEQ ID NO: 839609 - RNA, 22 nt, Human
aauaacuucauguaacauuuaa

SEQ ID NO: 839610 - RNA, 22 nt, Human
ugacacaggcagcucccagcac

SEQ ID NO: 839611 - RNA, 22 nt, Human
gcccagcacagcuggaagaguc

SEQ ID NO: 839612 - RNA, 22 nt, Human
aggaaaaagaguugcugccuuc

SEQ ID NO: 839613 - RNA, 22 nt, Human
augcaguaaauguucuaguuug

SEQ ID NO: 839614 - RNA, 22 nt, Human
auggggcucugcggcugcuccc

SEQ ID NO: 839615 - RNA, 22 nt, Human
cugcccugagggccuguguguu

SEQ ID NO: 839616 - RNA, 19 nt, Human
cagcugcaccgugaccauc

SEQ ID NO: 839617 - RNA, 22 nt, Human
ugaggcaggacuugcauaaagu

SEQ ID NO: 839618 - RNA, 22 nt, Human
ucaguggauauuucuguggcug

SEQ ID NO: 839619 - RNA, 22 nt, Human
ugggacugcucuugcugggguc

SEQ ID NO: 839620 - RNA, 22 nt, Human
gacuguguccaugugcuggauu

SEQ ID NO: 839621 - RNA, 23 nt, Human
aggcuuccuaucuuagagcuggg

SEQ ID NO: 839622 - RNA, 22 nt, Human
cauaauuucacugucguauggc

SEQ ID NO: 839623 - RNA, 22 nt, Human
ggcagcuuccuaggagagggca

SEQ ID NO: 839624 - RNA, 21 nt, Human
agcugcuuucagcuccuagag

SEQ ID NO: 839625 - RNA, 22 nt, Human
ucucagagaggggccgggccuu

SEQ ID NO: 839626 - RNA, 22 nt, Human
ugauuucccucaucauaacaga

SEQ ID NO: 839627 - RNA, 22 nt, Human
ggggcagcuaccggaaguaggg

SEQ ID NO: 839628 - RNA, 22 nt, Human
cagugguuauacuuacuguuuc

SEQ ID NO: 839629 - RNA, 20 nt, Human
accauaauguuaauuacaaa

SEQ ID NO: 839630 - RNA, 22 nt, Human
acugagcugugacaaugcuuaa

SEQ ID NO: 839631 - RNA, 22 nt, Human
cugcugugcauauuuaucuagg

SEQ ID NO: 839632 - RNA, 22 nt, Human
uaaggucauggugaauaauaag

SEQ ID NO: 839633 - RNA, 22 nt, Human
aucuagaaguggcaugaauuac

SEQ ID NO: 839634 - RNA, 22 nt, Human
aggaaaaaagucugugauuaua

SEQ ID NO: 839635 - RNA, 22 nt, Human
uugggcugaaguagagggcaga

SEQ ID NO: 839636 - RNA, 22 nt, Human
aggaagccuggggcugcccucg

SEQ ID NO: 839637 - RNA, 22 nt, Human
agugaaauacugucguuuuuag

SEQ ID NO: 839638 - RNA, 22 nt, Human
ccucccucuguuagagcugucu

SEQ ID NO: 839639 - RNA, 22 nt, Human
agaauuccucuaggaucugccc

SEQ ID NO: 839640 - RNA, 23 nt, Human
acagaaaguucugcuggacagag

SEQ ID NO: 839641 - RNA, 20 nt, Human
uguuucuuuuaaugagcggc

SEQ ID NO: 839642 - RNA, 22 nt, Human
uccuucagggcugaccacaggc

SEQ ID NO: 839643 - RNA, 22 nt, Human
ugcucacugaacucuugcuguc

SEQ ID NO: 839644 - RNA, 22 nt, Human
caaaagcaguucuaucugaguu

SEQ ID NO: 839645 - RNA, 22 nt, Human
cagcugaguguuggcauguuca

SEQ ID NO: 839646 - RNA, 22 nt, Human
cagccaggccuggugaccaaag

SEQ ID NO: 839647 - RNA, 22 nt, Human
uaauuucaaauuucuuagcgug

SEQ ID NO: 839648 - RNA, 22 nt, Human
auuuacugagguaaauaaacug

SEQ ID NO: 839649 - RNA, 22 nt, Human
cuuuaacaaaugacucuugucu

SEQ ID NO: 839650 - RNA, 22 nt, Human
cugaggccagcugcagagcucu

SEQ ID NO: 839651 - RNA, 22 nt, Human
cucucaggcuugggucguggca

SEQ ID NO: 839652 - RNA, 22 nt, Human
aaaucucaguguucuaagcauu

SEQ ID NO: 839653 - RNA, 22 nt, Human
uaucaucuuguugucaugcagc

SEQ ID NO: 839654 - RNA, 22 nt, Human
uauagaaguaagcauugugaug

SEQ ID NO: 839655 - RNA, 18 nt, Human
gguggcaggucagaugcc

SEQ ID NO: 839656 - RNA, 22 nt, Human
gcuuuggagccuguguucugcc

SEQ ID NO: 839657 - RNA, 22 nt, Human
uaaguccuaacagacugggggc

SEQ ID NO: 839658 - RNA, 22 nt, Human
ugcugagaucugccaguagaug

SEQ ID NO: 839659 - RNA, 22 nt, Human
agagaacaaauuaaaggugguu

SEQ ID NO: 839660 - RNA, 22 nt, Human
accaggggaugguuggcacugu

SEQ ID NO: 839661 - RNA, 22 nt, Human
gagcagcucugggugacccagu

SEQ ID NO: 839662 - RNA, 22 nt, Human
cagagacauuaagugccaugau

SEQ ID NO: 839663 - RNA, 22 nt, Human
uccugccugagcguggaggagg

SEQ ID NO: 839664 - RNA, 22 nt, Human
uguuacuuaucucacgugaugc

SEQ ID NO: 839665 - RNA, 18 nt, Human
aggccagcccugcuacug

SEQ ID NO: 839666 - RNA, 22 nt, Human
aguaaacauagaauguucuucc

SEQ ID NO: 839667 - RNA, 22 nt, Human
cucuggaguucuucaagcuacu

SEQ ID NO: 839668 - RNA, 22 nt, Human
gccaccaggagcccaguccaaa

SEQ ID NO: 839669 - RNA, 22 nt, Human
agaaacugaauuauuucugagg

SEQ ID NO: 839670 - RNA, 22 nt, Human
agccacagagcaggagaccuuu

SEQ ID NO: 839671 - RNA, 22 nt, Human
ucaaaugcuguauuguaguaau

SEQ ID NO: 839672 - RNA, 22 nt, Human
caggaacacaaugagucucaaa

SEQ ID NO: 839673 - RNA, 22 nt, Human
ucugucacccaggcuggagugc

SEQ ID NO: 839674 - RNA, 21 nt, Human
aaggccugcuuacugcuaguu

SEQ ID NO: 839675 - RNA, 22 nt, Human
auccaugauuaguaggauaaag

SEQ ID NO: 839676 - RNA, 22 nt, Human
ugaggaugacgauggcaauggc

SEQ ID NO: 839677 - RNA, 22 nt, Human
cagagccagcccacuguucccg

SEQ ID NO: 839678 - RNA, 22 nt, Human
aaagauuuaagaauaauuugug

SEQ ID NO: 839679 - RNA, 22 nt, Human
uuccuguauuuugcgaauuuuc

SEQ ID NO: 839680 - RNA, 22 nt, Human
agaugcuucaguguuuaauuua

SEQ ID NO: 839681 - RNA, 22 nt, Human
cagacagcugcuuucuugcugu

SEQ ID NO: 839682 - RNA, 22 nt, Human
uggccuuccuggugacucauga

SEQ ID NO: 839683 - RNA, 22 nt, Human
uugcauugcuuggucuucaaga

SEQ ID NO: 839684 - RNA, 22 nt, Human
aaagucauguaaugauaugauu

SEQ ID NO: 839685 - RNA, 22 nt, Human
ugugcccauuccacuugaguac

SEQ ID NO: 839686 - RNA, 20 nt, Human
auccaugagagucuggauuc

SEQ ID NO: 839687 - RNA, 22 nt, Human
ucauuucucccggccaaaaacu

SEQ ID NO: 839688 - RNA, 21 nt, Human
ggagggcagcccagacuggcu

SEQ ID NO: 839689 - RNA, 22 nt, Human
gaugggggccagggccugcuuu

SEQ ID NO: 839690 - RNA, 22 nt, Human
acagaauuuacacaucucuaaa

SEQ ID NO: 839691 - RNA, 22 nt, Human
aggguggcaccuggaagggaug

SEQ ID NO: 839692 - RNA, 22 nt, Human
aaaugucuguuagucauaucau

SEQ ID NO: 839693 - RNA, 22 nt, Human
ggaggaccccagcagcucccca

SEQ ID NO: 839694 - RNA, 22 nt, Human
ccugcagguaaggcuaacugcc

SEQ ID NO: 839695 - RNA, 22 nt, Human
aacugcauucagaaagcucacu

SEQ ID NO: 839696 - RNA, 22 nt, Human
cuggcagcccaaccuagagucu

SEQ ID NO: 839697 - RNA, 22 nt, Human
cacccaggcagguggcugagaa

SEQ ID NO: 839698 - RNA, 22 nt, Human
ggccugggcccacugucaagag

SEQ ID NO: 839699 - RNA, 22 nt, Human
ucaggggcccuucccucagcag

SEQ ID NO: 839700 - RNA, 22 nt, Human
uccaguggcacuggagacuaga

SEQ ID NO: 839701 - RNA, 22 nt, Human
ggcucuggucagugaggggccu

SEQ ID NO: 839702 - RNA, 22 nt, Human
cauacauugcucauucaguauc

SEQ ID NO: 839703 - RNA, 22 nt, Human
cugcuggagguuggagcaugca

SEQ ID NO: 839704 - RNA, 22 nt, Human
gcaugugucuccccaguggagg

SEQ ID NO: 839705 - RNA, 22 nt, Human
ggagccagagggaugcaguuga

SEQ ID NO: 839706 - RNA, 22 nt, Human
gugcuuuuaaaggcaauuagua

SEQ ID NO: 839707 - RNA, 22 nt, Human
uuuacagagagagaacuggacu

SEQ ID NO: 839708 - RNA, 22 nt, Human
gccuggagaccugcuccucuac

SEQ ID NO: 839709 - RNA, 22 nt, Human
auaugugugaugcauggacuaa

SEQ ID NO: 839710 - RNA, 22 nt, Human
cucuucucugcagccuuugaag

SEQ ID NO: 839711 - RNA, 22 nt, Human
aaagcagagguugcagugagcu

SEQ ID NO: 839712 - RNA, 22 nt, Human
cacacaugaaucccuaguaccu

SEQ ID NO: 839713 - RNA, 22 nt, Human
cuugccuucuuuuccuauagaa

SEQ ID NO: 839714 - RNA, 22 nt, Human
uuugggcaguagauguaucacu

SEQ ID NO: 839715 - RNA, 22 nt, Human
ucaucacuguaucauugauaga

SEQ ID NO: 839716 - RNA, 22 nt, Human
aggauccuccuuagaaaagacc

SEQ ID NO: 839717 - RNA, 18 nt, Human
ucuuuggacaacuacugg

SEQ ID NO: 839718 - RNA, 22 nt, Human
ugccugucuuaauaucuggaaa

SEQ ID NO: 839719 - RNA, 22 nt, Human
uuccugggacuggagcagccca

SEQ ID NO: 839720 - RNA, 22 nt, Human
gcacacccucucaccagcacug

SEQ ID NO: 839721 - RNA, 22 nt, Human
agugggcaugaucuggugucug

SEQ ID NO: 839722 - RNA, 22 nt, Human
ucaguaaaguucuuucuugcug

SEQ ID NO: 839723 - RNA, 20 nt, Human
aggagaaauucgggacaccu

SEQ ID NO: 839724 - RNA, 22 nt, Human
acagaauuaaugaaaauuacaa

SEQ ID NO: 839725 - RNA, 22 nt, Human
uuguccaaaguaacacaucuag

SEQ ID NO: 839726 - RNA, 22 nt, Human
agugcauugcaucucugcuuca

SEQ ID NO: 839727 - RNA, 22 nt, Human
aguauguagugcaaucagucag

SEQ ID NO: 839728 - RNA, 22 nt, Human
uacagauacagaucuagauaca

SEQ ID NO: 839729 - RNA, 22 nt, Human
uccuggauucugcccugaaggc

SEQ ID NO: 839730 - RNA, 20 nt, Human
acuuucucgguuucucaccu

SEQ ID NO: 839731 - RNA, 22 nt, Human
ugaggcaggagaaucacaugaa

SEQ ID NO: 839732 - RNA, 22 nt, Human
gucaaaaaguagucauuucugu

SEQ ID NO: 839733 - RNA, 22 nt, Human
caugcacagugauaucugaaga

SEQ ID NO: 839734 - RNA, 22 nt, Human
ugcccaggaucuggcgaugcuc

SEQ ID NO: 839735 - RNA, 21 nt, Human
ugguuugcggccaaaguuaaa

SEQ ID NO: 839736 - RNA, 18 nt, Human
gccugccuagagcuugcc

SEQ ID NO: 839737 - RNA, 22 nt, Human
gagccuggccuccugccucagc

SEQ ID NO: 839738 - RNA, 22 nt, Human
aguugacauccauaacaggaag

SEQ ID NO: 839739 - RNA, 22 nt, Human
gaaaggucuuccggucuuccag

SEQ ID NO: 839740 - RNA, 22 nt, Human
acuucacagauauuuauuuggu

SEQ ID NO: 839741 - RNA, 22 nt, Human
agcaccuggucuccuggcgcug

SEQ ID NO: 839742 - RNA, 22 nt, Human
uagugcuuggcccuaccagaua

SEQ ID NO: 839743 - RNA, 20 nt, Human
accuuucaaaugauucagca

SEQ ID NO: 839744 - RNA, 22 nt, Human
gcuggccucaucacugacuucu

SEQ ID NO: 839745 - RNA, 22 nt, Human
uaugcacacauguaugcaugug

SEQ ID NO: 839746 - RNA, 22 nt, Human
ggugggcaggcgaggcccaggu

SEQ ID NO: 839747 - RNA, 22 nt, Human
uuuuauguaauccuuacugucg

SEQ ID NO: 839748 - RNA, 22 nt, Human
agucucugcacaguaagaagca

SEQ ID NO: 839749 - RNA, 19 nt, Human
aggguccagggagcggcuc

SEQ ID NO: 839750 - RNA, 22 nt, Human
acaggcugcccgcuccccaccu

SEQ ID NO: 839751 - RNA, 22 nt, Human
gccucacugcagccccaggaag

SEQ ID NO: 839752 - RNA, 22 nt, Human
gggccuggggugacguaccccu

SEQ ID NO: 839753 - RNA, 22 nt, Human
ucagaauugucuggggaauguu

SEQ ID NO: 839754 - RNA, 22 nt, Human
cccuggaggcggauguugcagu

SEQ ID NO: 839755 - RNA, 22 nt, Human
aauuucaauuacuuuugcacca

SEQ ID NO: 839756 - RNA, 22 nt, Human
cucuuucugauucgcugggacc

SEQ ID NO: 839757 - RNA, 22 nt, Human
cccaggcagugugugcaugcgu

SEQ ID NO: 839758 - RNA, 22 nt, Human
ucuuucucucuaaucaagcaca

SEQ ID NO: 839759 - RNA, 22 nt, Human
agaggacagguuuuccaugggc

SEQ ID NO: 839760 - RNA, 22 nt, Human
ggauggagaugaccauggugac

SEQ ID NO: 839761 - RNA, 22 nt, Human
aagucacagcuaaauagcuaag

SEQ ID NO: 839762 - RNA, 22 nt, Human
gcaggaugccagggcagcagcg

SEQ ID NO: 839763 - RNA, 22 nt, Human
ggcuuccuggagaaggucugag

SEQ ID NO: 839764 - RNA, 22 nt, Human
aaguuucauuguucauguaaca

SEQ ID NO: 839765 - RNA, 22 nt, Human
uuugaaguucccccauaucaga

SEQ ID NO: 839766 - RNA, 22 nt, Human
guuugaaugcaguaugcauuuu

SEQ ID NO: 839767 - RNA, 23 nt, Human
aggcacugaaugugucagugagu

SEQ ID NO: 839768 - RNA, 22 nt, Human
aaaucuguaagcaauugcucag

SEQ ID NO: 839769 - RNA, 22 nt, Human
aggggagguggcagaaaugugc

SEQ ID NO: 839770 - RNA, 22 nt, Human
cugggccugguagggcuugaaa

SEQ ID NO: 839771 - RNA, 22 nt, Human
uggcucagaagaaaagguaaac

SEQ ID NO: 839772 - RNA, 22 nt, Human
uagggcagcugcaucaggcacu

SEQ ID NO: 839773 - RNA, 22 nt, Human
gcugucacacauggccccagcu

SEQ ID NO: 839774 - RNA, 22 nt, Human
guauucauauuaaacauaucaa

SEQ ID NO: 839775 - RNA, 22 nt, Human
aaaaugcaugagaaugugcucg

SEQ ID NO: 839776 - RNA, 22 nt, Human
caguaaauuugagggaucuaau

SEQ ID NO: 839777 - RNA, 21 nt, Human
accagcaggagaucagaagga

SEQ ID NO: 839778 - RNA, 22 nt, Human
uauguagaagcugcucaaagaa

SEQ ID NO: 839779 - RNA, 22 nt, Human
aaauacauaaagguuguaccag

SEQ ID NO: 839780 - RNA, 22 nt, Human
cuuccaaacccaggguaugggc

SEQ ID NO: 839781 - RNA, 22 nt, Human
augccacugacauggacaauuu

SEQ ID NO: 839782 - RNA, 22 nt, Human
ccugagagcauuccacacugaa

SEQ ID NO: 839783 - RNA, 22 nt, Human
gggcugucaugugucagugacc

SEQ ID NO: 839784 - RNA, 22 nt, Human
uaaagccacuucauucuagucu

SEQ ID NO: 839785 - RNA, 22 nt, Human
cuugaaucuucugaguauuugc

SEQ ID NO: 839786 - RNA, 22 nt, Human
uaaaaguggauaagcuguagga

SEQ ID NO: 839787 - RNA, 22 nt, Human
ccaugagccaggcugaggaagc

SEQ ID NO: 839788 - RNA, 22 nt, Human
uccagggcuggguuggcucagc

SEQ ID NO: 839789 - RNA, 22 nt, Human
aaaggucauugaaaaggaggaa

SEQ ID NO: 839790 - RNA, 22 nt, Human
uugggaaggcguggaagcagaa

SEQ ID NO: 839791 - RNA, 22 nt, Human
gagguacaugaggauacacagg

SEQ ID NO: 839792 - RNA, 22 nt, Human
ugaagcaggguggccagauugu

SEQ ID NO: 839793 - RNA, 22 nt, Human
cagcuccccaugguuccugaag

SEQ ID NO: 839794 - RNA, 22 nt, Human
cuacagaauggagggucagaga

SEQ ID NO: 839795 - RNA, 20 nt, Human
cugcugugugugccucagcc

SEQ ID NO: 839796 - RNA, 22 nt, Human
auaacagauacucucugugagg

SEQ ID NO: 839797 - RNA, 22 nt, Human
gggugggccacugagcagcgug

SEQ ID NO: 839798 - RNA, 22 nt, Human
agaaagcaucuccauuguaggu

SEQ ID NO: 839799 - RNA, 22 nt, Human
cagaaugcaaauuuuauaauau

SEQ ID NO: 839800 - RNA, 21 nt, Human
ccagccucagaucagggagcu

SEQ ID NO: 839801 - RNA, 22 nt, Human
ccaggccuguguuguguggagg

SEQ ID NO: 839802 - RNA, 22 nt, Human
uuccagagcaguuuucagauca

SEQ ID NO: 839803 - RNA, 18 nt, Human
gccugggaggaggaaaug

SEQ ID NO: 839804 - RNA, 22 nt, Human
aaggcacugagccagccgucuc

SEQ ID NO: 839805 - RNA, 22 nt, Human
caagccucagaaucuucuccau

SEQ ID NO: 839806 - RNA, 22 nt, Human
cagcagugcuucagugugagau

SEQ ID NO: 839807 - RNA, 22 nt, Human
guggccuggcgagcuggcgcgg

SEQ ID NO: 839808 - RNA, 22 nt, Human
ggagaagggacagacucagcuu

SEQ ID NO: 839809 - RNA, 22 nt, Human
auuuacagaagcauguaauagc

SEQ ID NO: 839810 - RNA, 19 nt, Human
guaagggcuaauggacuau

SEQ ID NO: 839811 - RNA, 22 nt, Human
uucuguauauuguaaagacuca

SEQ ID NO: 839812 - RNA, 22 nt, Human
caggccuggagugcaauggcac

SEQ ID NO: 839813 - RNA, 22 nt, Human
uugcauugaugucuauacgcug

SEQ ID NO: 839814 - RNA, 22 nt, Human
ggcugagcaauuuugaugacau

SEQ ID NO: 839815 - RNA, 22 nt, Human
aguuuaugaaacacagauuuga

SEQ ID NO: 839816 - RNA, 22 nt, Human
uagcauuucacugaucuucacu

SEQ ID NO: 839817 - RNA, 21 nt, Human
acagggcaugcagcuggcugu

SEQ ID NO: 839818 - RNA, 22 nt, Human
uggcucugucaaacugcacaca

SEQ ID NO: 839819 - RNA, 22 nt, Human
ugcaggcuuuagccccauggcu

SEQ ID NO: 839820 - RNA, 19 nt, Human
cugagcagcggcagcacuu

SEQ ID NO: 839821 - RNA, 22 nt, Human
aggaggccccuccuggguugcu

SEQ ID NO: 839822 - RNA, 22 nt, Human
agaacuguccuuggaggagagu

SEQ ID NO: 839823 - RNA, 22 nt, Human
gaguccuuggcaucaucaguac

SEQ ID NO: 839824 - RNA, 22 nt, Human
aagugagauuauauguacggga

SEQ ID NO: 839825 - RNA, 22 nt, Human
auugcuguaaauuaucuuauua

SEQ ID NO: 839826 - RNA, 22 nt, Human
uuucacauacaguguauaguag

SEQ ID NO: 839827 - RNA, 22 nt, Human
aacagcaugcuggguaacauug

SEQ ID NO: 839828 - RNA, 22 nt, Human
caauuucagugcuguggagagg

SEQ ID NO: 839829 - RNA, 19 nt, Human
agaggccucagcagcuggc

SEQ ID NO: 839830 - RNA, 22 nt, Human
ccagaucuucuuuucagugucu

SEQ ID NO: 839831 - RNA, 22 nt, Human
uuccaggacaagauguuucagg

SEQ ID NO: 839832 - RNA, 22 nt, Human
uagcagcucugauucugggccc

SEQ ID NO: 839833 - RNA, 22 nt, Human
uuuccuucaucaucugagagcu

SEQ ID NO: 839834 - RNA, 22 nt, Human
acauaauagguaccugaauaau

SEQ ID NO: 839835 - RNA, 22 nt, Human
uccugggcuguggccccgggca

SEQ ID NO: 839836 - RNA, 22 nt, Human
caugcuuuuuucuaguauaaau

SEQ ID NO: 839837 - RNA, 22 nt, Human
ugagaaaagguugagaugauaa

SEQ ID NO: 839838 - RNA, 22 nt, Human
aggcugcagaacagucaggugc

SEQ ID NO: 839839 - RNA, 22 nt, Human
gaugggaggaaccugggucccu

SEQ ID NO: 839840 - RNA, 22 nt, Human
aggcccuguccauggugcugaa

SEQ ID NO: 839841 - RNA, 22 nt, Human
acccaggauaaucuguguaucu

SEQ ID NO: 839842 - RNA, 20 nt, Human
ugucagugccugaggcacag

SEQ ID NO: 839843 - RNA, 22 nt, Human
uuagaacuuaagaauacugucu

SEQ ID NO: 839844 - RNA, 17 nt, Human
gauuuccugaaguucuu

SEQ ID NO: 839845 - RNA, 22 nt, Human
ggugaggcuaagugacacaggg

SEQ ID NO: 839846 - RNA, 22 nt, Human
guguaauuauauaaagaucuac

SEQ ID NO: 839847 - RNA, 22 nt, Human
uaauuuauuucaacugccaagg

SEQ ID NO: 839848 - RNA, 22 nt, Human
cauugucacccaaagcucauag

SEQ ID NO: 839849 - RNA, 22 nt, Human
aauuccugucuuaacaguucug

SEQ ID NO: 839850 - RNA, 23 nt, Human
cucccuggaguuucuggaagaug

SEQ ID NO: 839851 - RNA, 22 nt, Human
aggcaagggggcgccaccuucc

SEQ ID NO: 839852 - RNA, 22 nt, Human
ugcuguguucuccugacucacc

SEQ ID NO: 839853 - RNA, 22 nt, Human
uggcagcugucagaaugcaaau

SEQ ID NO: 839854 - RNA, 22 nt, Human
aggcucagauucacauuugguu

SEQ ID NO: 839855 - RNA, 22 nt, Human
augaguaagaccauaauuuuug

SEQ ID NO: 839856 - RNA, 19 nt, Human
ugccuggacaaaugugggg

SEQ ID NO: 839857 - RNA, 23 nt, Human
gccaggaguggguagacuaaugc

SEQ ID NO: 839858 - RNA, 22 nt, Human
uuucauugucuacauaugacau

SEQ ID NO: 839859 - RNA, 22 nt, Human
gagggacagcuaaagagaaauu

SEQ ID NO: 839860 - RNA, 22 nt, Human
cugcugccggcgagccucccuu

SEQ ID NO: 839861 - RNA, 22 nt, Human
ggcagacuguaauaggagaauu

SEQ ID NO: 839862 - RNA, 22 nt, Human
gcuguccucugaucucuggagg

SEQ ID NO: 839863 - RNA, 22 nt, Human
guguuuccuaguuuaaugaaug

SEQ ID NO: 839864 - RNA, 22 nt, Human
ccaaaugugccuguuucaacaa

SEQ ID NO: 839865 - RNA, 22 nt, Human
ccagucugugugccagccugcg

SEQ ID NO: 839866 - RNA, 22 nt, Human
cagggcugugcccaucuucccc

SEQ ID NO: 839867 - RNA, 20 nt, Human
agaaauauugaguucagagg

SEQ ID NO: 839868 - RNA, 21 nt, Human
cagcaaaucauugggcagacu

SEQ ID NO: 839869 - RNA, 22 nt, Human
gcagggugugucucauacaguu

SEQ ID NO: 839870 - RNA, 20 nt, Human
uacugggcaagcccacagac

SEQ ID NO: 839871 - RNA, 22 nt, Human
gugcugcagagucucgugccgc

SEQ ID NO: 839872 - RNA, 22 nt, Human
aucugucagccugggauuaggg

SEQ ID NO: 839873 - RNA, 22 nt, Human
cuagaaauauuuuacagucaag

SEQ ID NO: 839874 - RNA, 22 nt, Human
cuggaguuagaguagacacuga

SEQ ID NO: 839875 - RNA, 22 nt, Human
ggcuucauggaggaggugaguc

SEQ ID NO: 839876 - RNA, 22 nt, Human
ugcagaggagucagccugggca

SEQ ID NO: 839877 - RNA, 22 nt, Human
aaacuuuggauugugauugugc

SEQ ID NO: 839878 - RNA, 22 nt, Human
acucaagauagggaaaguacaa

SEQ ID NO: 839879 - RNA, 22 nt, Human
cauuuguaggaugcuucuuguu

SEQ ID NO: 839880 - RNA, 22 nt, Human
cuacagaagccguggucaggaa

SEQ ID NO: 839881 - RNA, 22 nt, Human
ggcaggcuggcuuuguuccagg

SEQ ID NO: 839882 - RNA, 22 nt, Human
agguaaagacagugaaagaggg

SEQ ID NO: 839883 - RNA, 22 nt, Human
cucccuggcuuuguccugaggc

SEQ ID NO: 839884 - RNA, 22 nt, Human
gcugucugucuucacaucucgc

SEQ ID NO: 839885 - RNA, 22 nt, Human
agccccacacucucucugagaa

SEQ ID NO: 839886 - RNA, 22 nt, Human
aaaucugggagcagcucggcca

SEQ ID NO: 839887 - RNA, 22 nt, Human
augcugugucaggaauuugaua

SEQ ID NO: 839888 - RNA, 22 nt, Human
agcuucccaagguuggaagguu

SEQ ID NO: 839889 - RNA, 22 nt, Human
uccucugcuccaggcuggacuu

SEQ ID NO: 839890 - RNA, 22 nt, Human
aaaucuaggcucauccuggucc

SEQ ID NO: 839891 - RNA, 22 nt, Human
ccaggagaugggagcaucuaaa

SEQ ID NO: 839892 - RNA, 22 nt, Human
uuucagggagccuagaagagcu

SEQ ID NO: 839893 - RNA, 22 nt, Human
ucuucacagaugcauauacuuc

SEQ ID NO: 839894 - RNA, 20 nt, Human
ccacaggaguccagucgacc

SEQ ID NO: 839895 - RNA, 22 nt, Human
ucuaaaaaagucuguucacuug

SEQ ID NO: 839896 - RNA, 22 nt, Human
agauguaguagugggucuuuua

SEQ ID NO: 839897 - RNA, 22 nt, Human
gggcccagcgugguuccaucug

SEQ ID NO: 839898 - RNA, 22 nt, Human
agggugccuggaagccacucac

SEQ ID NO: 839899 - RNA, 22 nt, Human
aggaggcccuagagcucuagag

SEQ ID NO: 839900 - RNA, 22 nt, Human
caagccugucucaccagugcua

SEQ ID NO: 839901 - RNA, 22 nt, Human
ucaucacauaugucaugauuug

SEQ ID NO: 839902 - RNA, 22 nt, Human
acugagcugcuugaagugaacu

SEQ ID NO: 839903 - RNA, 22 nt, Human
agggcugcugaggaagccuugc

SEQ ID NO: 839904 - RNA, 22 nt, Human
auaauuuacuaagcucuaccuu

SEQ ID NO: 839905 - RNA, 22 nt, Human
ugccuguccugaggaugagggu

SEQ ID NO: 839906 - RNA, 22 nt, Human
agagccuggcucccagcuaccg

SEQ ID NO: 839907 - RNA, 22 nt, Human
uucuccagagggcucugcagga

SEQ ID NO: 839908 - RNA, 22 nt, Human
gaggugggagggcagucccuaa

SEQ ID NO: 839909 - RNA, 22 nt, Human
caggcacugugcuagauccuug

SEQ ID NO: 839910 - RNA, 22 nt, Human
auugaaagauuuugggcucaug

SEQ ID NO: 839911 - RNA, 19 nt, Human
gaaguccucuaguaaauuu

SEQ ID NO: 839912 - RNA, 22 nt, Human
cuuuccaagaaugcagauaccu

SEQ ID NO: 839913 - RNA, 22 nt, Human
ggguggagcuuggacaccagua

SEQ ID NO: 839914 - RNA, 22 nt, Human
gaggagagaacauuccuccaua

SEQ ID NO: 839915 - RNA, 22 nt, Human
gcacagaagagcuuuggaauga

SEQ ID NO: 839916 - RNA, 20 nt, Human
ggccuuggguuucgccuguu

SEQ ID NO: 839917 - RNA, 22 nt, Human
gcugucuguucgagcguguguu

SEQ ID NO: 839918 - RNA, 22 nt, Human
gauuucuucauuuguggugaau

SEQ ID NO: 839919 - RNA, 22 nt, Human
uuuugcuugagugcacaaaaug

SEQ ID NO: 839920 - RNA, 22 nt, Human
ccaggagaaugggauuacccua

SEQ ID NO: 839921 - RNA, 22 nt, Human
accucugcucaagaccccuccg

SEQ ID NO: 839922 - RNA, 19 nt, Human
cccagagcauccugaacuu

SEQ ID NO: 839923 - RNA, 22 nt, Human
cccugaggggaguggugaggug

SEQ ID NO: 839924 - RNA, 21 nt, Human
ugggcacugagggugcugcuc

SEQ ID NO: 839925 - RNA, 22 nt, Human
gggcguggauggucagugcagg

SEQ ID NO: 839926 - RNA, 19 nt, Human
ucuaacagaagugucgucc

SEQ ID NO: 839927 - RNA, 21 nt, Human
gccagccuguuuaccuguggu

SEQ ID NO: 839928 - RNA, 22 nt, Human
uucauucaucucuaaaaugccu

SEQ ID NO: 839929 - RNA, 22 nt, Human
gagccuggagcuggaacgaagc

SEQ ID NO: 839930 - RNA, 22 nt, Human
uauguuaaauguuugauguuua

SEQ ID NO: 839931 - RNA, 22 nt, Human
aaggcagcacagcaacugcuca

SEQ ID NO: 839932 - RNA, 18 nt, Human
cccagcuccacuucccuc

SEQ ID NO: 839933 - RNA, 22 nt, Human
cucuggacagcaggugcugugg

SEQ ID NO: 839934 - RNA, 22 nt, Human
cugcuuugauuagaagaguaca

SEQ ID NO: 839935 - RNA, 20 nt, Human
gugcuucagaagccauugcu

SEQ ID NO: 839936 - RNA, 22 nt, Human
agcccagggaaccaggaagugg

SEQ ID NO: 839937 - RNA, 22 nt, Human
gggaguggagagcaauggauga

SEQ ID NO: 839938 - RNA, 22 nt, Human
cugccucugguuuuggucccug

SEQ ID NO: 839939 - RNA, 22 nt, Human
uacauauguaaacauguauaaa

SEQ ID NO: 839940 - RNA, 22 nt, Human
gacagggcaagacucugucuaa

SEQ ID NO: 839941 - RNA, 22 nt, Human
aggggagccccugguccuggug

SEQ ID NO: 839942 - RNA, 22 nt, Human
cagagccugccaccuuucuccc

SEQ ID NO: 839943 - RNA, 22 nt, Human
agaauaugaugguuggagaauu

SEQ ID NO: 839944 - RNA, 22 nt, Human
cccaggagguggagcuugcagu

SEQ ID NO: 839945 - RNA, 22 nt, Human
uaucuguuggcuccuaguugua

SEQ ID NO: 839946 - RNA, 22 nt, Human
gcuggccuugugucugaggaag

SEQ ID NO: 839947 - RNA, 22 nt, Human
ggcucagguuuaaagugcuuua

SEQ ID NO: 839948 - RNA, 20 nt, Human
cucuccuugccgacuuggca

SEQ ID NO: 839949 - RNA, 22 nt, Human
gcacagaacagagaaauagcca

SEQ ID NO: 839950 - RNA, 22 nt, Human
uagccucuggaauccuuucucu

SEQ ID NO: 839951 - RNA, 22 nt, Human
agugugaccuuauuuggaaaca

SEQ ID NO: 839952 - RNA, 22 nt, Human
gggcagcugccaagugcaucgc

SEQ ID NO: 839953 - RNA, 22 nt, Human
auuaugcugguuuacacauuuu

SEQ ID NO: 839954 - RNA, 22 nt, Human
gcucucuugguggcuguccugg

SEQ ID NO: 839955 - RNA, 22 nt, Human
augaaacaguguguauagcaaa

SEQ ID NO: 839956 - RNA, 22 nt, Human
aauugcaacagguagacuuuuc

SEQ ID NO: 839957 - RNA, 22 nt, Human
ucuagaaaaaaacugcugugga

SEQ ID NO: 839958 - RNA, 20 nt, Human
auaauuuacccugcaccacu

SEQ ID NO: 839959 - RNA, 22 nt, Human
ccaggagcaacuugaaggcaag

SEQ ID NO: 839960 - RNA, 22 nt, Human
cacaagagagugcgcguugcaa

SEQ ID NO: 839961 - RNA, 22 nt, Human
aagccagauagaagaacucauu

SEQ ID NO: 839962 - RNA, 16 nt, Human
ccccaggacuuggcac

SEQ ID NO: 839963 - RNA, 22 nt, Human
cgccaggcuugguagcucaugc

SEQ ID NO: 839964 - RNA, 22 nt, Human
uucuuguaauuuggagaaauga

SEQ ID NO: 839965 - RNA, 22 nt, Human
cucuguccuugcacaguuccua

SEQ ID NO: 839966 - RNA, 22 nt, Human
gggauggggucaacauguaccu

SEQ ID NO: 839967 - RNA, 21 nt, Human
cagaggccucaugcucugugc

SEQ ID NO: 839968 - RNA, 20 nt, Human
aguaccuuuuguauguuacc

SEQ ID NO: 839969 - RNA, 22 nt, Human
agagagggcauagaaaaaggga

SEQ ID NO: 839970 - RNA, 22 nt, Human
ccagggcuggguuugucggugu

SEQ ID NO: 839971 - RNA, 22 nt, Human
aguccuucaagaaaucuggaaa

SEQ ID NO: 839972 - RNA, 22 nt, Human
gggccugggaacuugcauuuag

SEQ ID NO: 839973 - RNA, 22 nt, Human
caggggcugagaaggaacgucc

SEQ ID NO: 839974 - RNA, 22 nt, Human
gagaaguuucugguuugcauag

SEQ ID NO: 839975 - RNA, 22 nt, Human
cacaugaagagagucuaguaau

SEQ ID NO: 839976 - RNA, 22 nt, Human
caaauucucuuacuguuugaca

SEQ ID NO: 839977 - RNA, 22 nt, Human
gcugauccuuuuaugucuagcu

SEQ ID NO: 839978 - RNA, 22 nt, Human
gaggccaggaagcccaagauca

SEQ ID NO: 839979 - RNA, 22 nt, Human
uagaaacagcauauauuagccc

SEQ ID NO: 839980 - RNA, 22 nt, Human
ugcuagaauaccuaccuggagg

SEQ ID NO: 839981 - RNA, 22 nt, Human
ugugcagcuaguccuggacuug

SEQ ID NO: 839982 - RNA, 22 nt, Human
acaacaaagacacuugaaauga

SEQ ID NO: 839983 - RNA, 22 nt, Human
ucuguucaguugauguaguuuu

SEQ ID NO: 839984 - RNA, 18 nt, Human
ugacucacccugucagug

SEQ ID NO: 839985 - RNA, 22 nt, Human
aauuuggcagugucuugaagua

SEQ ID NO: 839986 - RNA, 20 nt, Human
ucuaauuaaaauugucuagu

SEQ ID NO: 839987 - RNA, 22 nt, Human
cugaggaagacagcagcugugu

SEQ ID NO: 839988 - RNA, 22 nt, Human
agucccagccuguaggauuggg

SEQ ID NO: 839989 - RNA, 22 nt, Human
acagcuggcaggggggcaugaa

SEQ ID NO: 839990 - RNA, 22 nt, Human
uaugcacacaucgcagcaggaa

SEQ ID NO: 839991 - RNA, 21 nt, Human
ccagagccugcugagcccccu

SEQ ID NO: 839992 - RNA, 22 nt, Human
ccugugucuuccccacuggugu

SEQ ID NO: 839993 - RNA, 22 nt, Human
gagggugguggcuuaaggugcu

SEQ ID NO: 839994 - RNA, 22 nt, Human
gcacugaaugcuuuuacuguaa

SEQ ID NO: 839995 - RNA, 22 nt, Human
cacagggcagugcugcccacuc

SEQ ID NO: 839996 - RNA, 22 nt, Human
cagagccaacgccaccugccca

SEQ ID NO: 839997 - RNA, 22 nt, Human
uagagcaguuggcagcuguauu

SEQ ID NO: 839998 - RNA, 18 nt, Human
cuuguucuucucuuggcg

SEQ ID NO: 839999 - RNA, 22 nt, Human
gaaugugugacucuauugagca

SEQ ID NO: 840000 - RNA, 22 nt, Human
ucccuggagauaacuucuggga

SEQ ID NO: 840001 - RNA, 22 nt, Human
cauuuagagucuugcaauuuua

SEQ ID NO: 840002 - RNA, 22 nt, Human
acagcauugcuccaucucaaga

SEQ ID NO: 840003 - RNA, 22 nt, Human
cauugcuuccuaugucccuucu

SEQ ID NO: 840004 - RNA, 22 nt, Human
uggagcugagaaguggagcucu

SEQ ID NO: 840005 - RNA, 22 nt, Human
ggugaggggagagugaaagaaa

SEQ ID NO: 840006 - RNA, 22 nt, Human
augauguugauaaauuacuuua

SEQ ID NO: 840007 - RNA, 22 nt, Human
caggcagaagaaguggaaggac

SEQ ID NO: 840008 - RNA, 22 nt, Human
uagaaacauguucuguucuguu

SEQ ID NO: 840009 - RNA, 22 nt, Human
cuggccgguauuugccucuggg

SEQ ID NO: 840010 - RNA, 22 nt, Human
acagaauucucucugcagaggc

SEQ ID NO: 840011 - RNA, 22 nt, Human
aaguguauauaugacuuauaaa

SEQ ID NO: 840012 - RNA, 17 nt, Human
ggcagcugccacuuuuu

SEQ ID NO: 840013 - RNA, 22 nt, Human
uuucacaucagagguagauuag

SEQ ID NO: 840014 - RNA, 22 nt, Human
ucagaagacuacuaggacacau

SEQ ID NO: 840015 - RNA, 22 nt, Human
gauuucaaaaguagauccauca

SEQ ID NO: 840016 - RNA, 22 nt, Human
gagcugggacauggguccucuc

SEQ ID NO: 840017 - RNA, 21 nt, Human
cagagcagcguucugcugugg

SEQ ID NO: 840018 - RNA, 22 nt, Human
cuggcuggccggaggcaucccu

SEQ ID NO: 840019 - RNA, 22 nt, Human
agccaagcaccacuggcacucg

SEQ ID NO: 840020 - RNA, 20 nt, Human
cagggccacgcuccaaggca

SEQ ID NO: 840021 - RNA, 22 nt, Human
gaugccugcauuucaggagagu

SEQ ID NO: 840022 - RNA, 22 nt, Human
gcugugcuauaucucugagugu

SEQ ID NO: 840023 - RNA, 21 nt, Human
agagaagggacucuuccaguc

SEQ ID NO: 840024 - RNA, 22 nt, Human
ccccaggagcuuguuuuagaga

SEQ ID NO: 840025 - RNA, 22 nt, Human
cuacagaagaaacuaucacuau

SEQ ID NO: 840026 - RNA, 22 nt, Human
aggcccagggcugcucucugaa

SEQ ID NO: 840027 - RNA, 22 nt, Human
gcagggcagaccuccagccuau

SEQ ID NO: 840028 - RNA, 22 nt, Human
uccugucagugaggcagaugaa

SEQ ID NO: 840029 - RNA, 22 nt, Human
cagggccugccugguuccugga

SEQ ID NO: 840030 - RNA, 22 nt, Human
auacauguaacugcauuguaau

SEQ ID NO: 840031 - RNA, 22 nt, Human
gcucccucugcucaggcacuug

SEQ ID NO: 840032 - RNA, 22 nt, Human
uguagcucuccagccagcaagg

SEQ ID NO: 840033 - RNA, 22 nt, Human
aucauuuuuaagagacucuucu

SEQ ID NO: 840034 - RNA, 22 nt, Human
gcaagcugcuuaagcucauugu

SEQ ID NO: 840035 - RNA, 22 nt, Human
aaaaaugaauucuucaguggca

SEQ ID NO: 840036 - RNA, 22 nt, Human
agcaggcuaagggaccuguuua

SEQ ID NO: 840037 - RNA, 22 nt, Human
cagaaaauaaaguuucuacgca

SEQ ID NO: 840038 - RNA, 22 nt, Human
uacaggaggauuaucaaaggau

SEQ ID NO: 840039 - RNA, 18 nt, Human
aggcacagagcauacaua

SEQ ID NO: 840040 - RNA, 22 nt, Human
gcagagccugggggucugcgga

SEQ ID NO: 840041 - RNA, 22 nt, Human
gccaagagaaugugagagaaau

SEQ ID NO: 840042 - RNA, 20 nt, Human
uccaugaguuagagacuaua

SEQ ID NO: 840043 - RNA, 22 nt, Human
uauuuccugcauggugauguaa

SEQ ID NO: 840044 - RNA, 22 nt, Human
gcagcuuuuuggaugucaguua

SEQ ID NO: 840045 - RNA, 22 nt, Human
guaagcaucugucucuucugca

SEQ ID NO: 840046 - RNA, 22 nt, Human
cacugcaggucugagauggggg

SEQ ID NO: 840047 - RNA, 22 nt, Human
uuucaacuuguuugcuuccaua

SEQ ID NO: 840048 - RNA, 22 nt, Human
ucugucaucucuaaaauagaaa

SEQ ID NO: 840049 - RNA, 22 nt, Human
gagacagcagggccagggccug

SEQ ID NO: 840050 - RNA, 22 nt, Human
aauaacuuuuaaaagacccugg

SEQ ID NO: 840051 - RNA, 22 nt, Human
ucagagugaggcgucaacauga

SEQ ID NO: 840052 - RNA, 22 nt, Human
aggauccuguauggagaagcug

SEQ ID NO: 840053 - RNA, 22 nt, Human
aucuaacacuguaaacugucuu

SEQ ID NO: 840054 - RNA, 22 nt, Human
uggccugaggcucggcaugggu

SEQ ID NO: 840055 - RNA, 22 nt, Human
cuggcucucugagauauugagu

SEQ ID NO: 840056 - RNA, 22 nt, Human
ucacauuucugauuauaccaaa

SEQ ID NO: 840057 - RNA, 22 nt, Human
ccaggcugcucacaagcugccc

SEQ ID NO: 840058 - RNA, 22 nt, Human
ucagugcagaauagugaugcau

SEQ ID NO: 840059 - RNA, 22 nt, Human
aguccuuacucgggggcccaga

SEQ ID NO: 840060 - RNA, 22 nt, Human
caguacuuaacuuauaggagag

SEQ ID NO: 840061 - RNA, 19 nt, Human
cccaggaggcggagguugc

SEQ ID NO: 840062 - RNA, 22 nt, Human
gcaggcugaugacuggaguugg

SEQ ID NO: 840063 - RNA, 22 nt, Human
gacccaggcucgugggacggcu

SEQ ID NO: 840064 - RNA, 22 nt, Human
cuugaaguugcaaaacauuaau

SEQ ID NO: 840065 - RNA, 22 nt, Human
ucuuuggaucccaacuggcugg

SEQ ID NO: 840066 - RNA, 19 nt, Human
ucccuuccugucgggcucc

SEQ ID NO: 840067 - RNA, 18 nt, Human
gggcccuggcguccgccc

SEQ ID NO: 840068 - RNA, 22 nt, Human
ccuucagaccuagacaggaauc

SEQ ID NO: 840069 - RNA, 22 nt, Human
cuggugcuggagccuagucccu

SEQ ID NO: 840070 - RNA, 22 nt, Human
aaagauuauggcauugaaauac

SEQ ID NO: 840071 - RNA, 22 nt, Human
cuugaaagcuuugcgucuucua

SEQ ID NO: 840072 - RNA, 22 nt, Human
uuacagaagagaaagaauucag

SEQ ID NO: 840073 - RNA, 22 nt, Human
gcacagggcugccaggcggcuu

SEQ ID NO: 840074 - RNA, 22 nt, Human
gaagagcuaaaggcacaggcuu

SEQ ID NO: 840075 - RNA, 18 nt, Human
gggaucaggcugccuagg

SEQ ID NO: 840076 - RNA, 22 nt, Human
agagcagagggcucugggacaa

SEQ ID NO: 840077 - RNA, 22 nt, Human
uaugaacuguacuguacuaagc

SEQ ID NO: 840078 - RNA, 22 nt, Human
ucucaagagggaggcaaucaug

SEQ ID NO: 840079 - RNA, 22 nt, Human
gcugggagccguaccugucacg

SEQ ID NO: 840080 - RNA, 22 nt, Human
caggcugaggcaguaggguuug

SEQ ID NO: 840081 - RNA, 22 nt, Human
cuuaggcaaccaggucaaugcu

SEQ ID NO: 840082 - RNA, 22 nt, Human
cucauggauauaagaacuguuu

SEQ ID NO: 840083 - RNA, 22 nt, Human
uuuaaugauagcuguuucacau

SEQ ID NO: 840084 - RNA, 22 nt, Human
cccuggcaugcaugucccuggc

SEQ ID NO: 840085 - RNA, 21 nt, Human
uggcucuguucaauauaugga

SEQ ID NO: 840086 - RNA, 22 nt, Human
auguagaacagguuaaugacag

SEQ ID NO: 840087 - RNA, 20 nt, Human
caggagggacauuucagcau

SEQ ID NO: 840088 - RNA, 22 nt, Human
guucccauacaguaucagugcu

SEQ ID NO: 840089 - RNA, 22 nt, Human
ccagggcagggaccacgugucu

SEQ ID NO: 840090 - RNA, 22 nt, Human
gguggccaggccagcucuggcc

SEQ ID NO: 840091 - RNA, 18 nt, Human
gugagcagagagcaucac

SEQ ID NO: 840092 - RNA, 22 nt, Human
uuuaacacuaguuucuuuaacu

SEQ ID NO: 840093 - RNA, 22 nt, Human
auuugaagucuucaugauuucu

SEQ ID NO: 840094 - RNA, 22 nt, Human
cucuggagugcagccugguggc

SEQ ID NO: 840095 - RNA, 22 nt, Human
agccucugugacucacagguca

SEQ ID NO: 840096 - RNA, 17 nt, Human
aggugcuggagcaucag

SEQ ID NO: 840097 - RNA, 22 nt, Human
caggcagcagaggaguguggga

SEQ ID NO: 840098 - RNA, 22 nt, Human
acugggaggcaaagagcaagga

SEQ ID NO: 840099 - RNA, 22 nt, Human
ucuucaaguuccaaagugcagg

SEQ ID NO: 840100 - RNA, 22 nt, Human
ucaagcaggguagcaagcuggu

SEQ ID NO: 840101 - RNA, 22 nt, Human
ucacauacacuaggauauuuuu

SEQ ID NO: 840102 - RNA, 22 nt, Human
ggaggccaaggcaggcggauca

SEQ ID NO: 840103 - RNA, 22 nt, Human
ucuaaacagccucuuaccaacu

SEQ ID NO: 840104 - RNA, 22 nt, Human
caggagcagaggguggucagca

SEQ ID NO: 840105 - RNA, 22 nt, Human
ccugagcugaacuaagcaguuu

SEQ ID NO: 840106 - RNA, 22 nt, Human
agggagacacaugaggaaguca

SEQ ID NO: 840107 - RNA, 22 nt, Human
aagggaaaucauauggugcagu

SEQ ID NO: 840108 - RNA, 22 nt, Human
ccagcccugaacccugcugcau

SEQ ID NO: 840109 - RNA, 22 nt, Human
aaagguuaagguguucaagaaa

SEQ ID NO: 840110 - RNA, 22 nt, Human
gucaccagugcuaagaggugga

SEQ ID NO: 840111 - RNA, 22 nt, Human
ccaaaguccauaguuuacuuua

SEQ ID NO: 840112 - RNA, 22 nt, Human
uaagaacauuuucggaaagaua

SEQ ID NO: 840113 - RNA, 22 nt, Human
gggauggggagcuggaaagggg

SEQ ID NO: 840114 - RNA, 22 nt, Human
aaaucaguucucccuuucuuca

SEQ ID NO: 840115 - RNA, 22 nt, Human
agggaagaagcugguaguaggu

SEQ ID NO: 840116 - RNA, 22 nt, Human
cauaccuuucucaagcacaugu

SEQ ID NO: 840117 - RNA, 22 nt, Human
cauuauguucaguagcuuaaaa

SEQ ID NO: 840118 - RNA, 21 nt, Human
ccuggcagaagccugauaugc

SEQ ID NO: 840119 - RNA, 21 nt, Human
gcagccagacgggauucaguu

SEQ ID NO: 840120 - RNA, 20 nt, Human
gccuggcacccggggcuggc

SEQ ID NO: 840121 - RNA, 22 nt, Human
gugccugugccaggggugugcu

SEQ ID NO: 840122 - RNA, 22 nt, Human
ccagccaggcuggcuguggagg

SEQ ID NO: 840123 - RNA, 22 nt, Human
uauuuaauuagugauuguagag

SEQ ID NO: 840124 - RNA, 22 nt, Human
uccucuucugcccaucagaggc

SEQ ID NO: 840125 - RNA, 22 nt, Human
gccugcuggauguggccaggcc

SEQ ID NO: 840126 - RNA, 20 nt, Human
aagggcagagggaacagacu

SEQ ID NO: 840127 - RNA, 19 nt, Human
uguggccaugguucagcug

SEQ ID NO: 840128 - RNA, 22 nt, Human
cagugggaagggcagaggcuuu

SEQ ID NO: 840129 - RNA, 22 nt, Human
ccugccugucccucaguccaca

SEQ ID NO: 840130 - RNA, 22 nt, Human
cucuuucaguucugauagucuc

SEQ ID NO: 840131 - RNA, 22 nt, Human
aaauuagucgguuuaggaauuu

SEQ ID NO: 840132 - RNA, 22 nt, Human
ucugucuccugccagugccucu

SEQ ID NO: 840133 - RNA, 22 nt, Human
ucuggccauggcaagccgagug

SEQ ID NO: 840134 - RNA, 22 nt, Human
gcaaagcauucuguggagucua

SEQ ID NO: 840135 - RNA, 22 nt, Human
gcccagaguucaaggcugcagu

SEQ ID NO: 840136 - RNA, 22 nt, Human
cuuccucugcggcgccgggcgc

SEQ ID NO: 840137 - RNA, 22 nt, Human
cugggcagugguggcaucuuug

SEQ ID NO: 840138 - RNA, 22 nt, Human
gcauuccuacaggcugcuauga

SEQ ID NO: 840139 - RNA, 22 nt, Human
uaacagaaaagaacugaguuug

SEQ ID NO: 840140 - RNA, 22 nt, Human
gauccuugcacuugacuuggca

SEQ ID NO: 840141 - RNA, 22 nt, Human
ucaggaucggccuuuuuuuaag

SEQ ID NO: 840142 - RNA, 22 nt, Human
ugccugggaaccaauccuggcu

SEQ ID NO: 840143 - RNA, 22 nt, Human
guauuugauagauuucaaagga

SEQ ID NO: 840144 - RNA, 17 nt, Human
agaaagaggauccacag

SEQ ID NO: 840145 - RNA, 22 nt, Human
ucagcugaaguggagaagcaga

SEQ ID NO: 840146 - RNA, 22 nt, Human
acaaaggugcgucccuucagcu

SEQ ID NO: 840147 - RNA, 22 nt, Human
aaaugaaaugagugccuggagg

SEQ ID NO: 840148 - RNA, 22 nt, Human
gcuucacacuaaaaauguuaaa

SEQ ID NO: 840149 - RNA, 22 nt, Human
acagguggaggcuuuaggaggu

SEQ ID NO: 840150 - RNA, 22 nt, Human
ugacuuccugcacucaggugau

SEQ ID NO: 840151 - RNA, 22 nt, Human
uaaugucagcauaguuuauuuu

SEQ ID NO: 840152 - RNA, 22 nt, Human
ggucccaggcucccucuugucc

SEQ ID NO: 840153 - RNA, 22 nt, Human
gcagaggagcaaguugcuacag

SEQ ID NO: 840154 - RNA, 20 nt, Human
aggcagcugggaaaugaggg

SEQ ID NO: 840155 - RNA, 18 nt, Human
agugugugcccuuucagg

SEQ ID NO: 840156 - RNA, 22 nt, Human
uacaaaguuugagaaugcuuuc

SEQ ID NO: 840157 - RNA, 22 nt, Human
aaguuauugcagcaauccaagu

SEQ ID NO: 840158 - RNA, 22 nt, Human
aauucucagguaaaaguuaagu

SEQ ID NO: 840159 - RNA, 18 nt, Human
aagucaccccugcucccu

SEQ ID NO: 840160 - RNA, 22 nt, Human
ugcuaucucuauauccauuuau

SEQ ID NO: 840161 - RNA, 21 nt, Human
ucagcagcuuuugcagucccu

SEQ ID NO: 840162 - RNA, 22 nt, Human
auguacaaaaugccacugaauu

SEQ ID NO: 840163 - RNA, 22 nt, Human
gcccauggcagaacugugagca

SEQ ID NO: 840164 - RNA, 22 nt, Human
auguuacauaguccuuauuugu

SEQ ID NO: 840165 - RNA, 22 nt, Human
ucuucuuaugugccauuaucuc

SEQ ID NO: 840166 - RNA, 22 nt, Human
gaauuacaugacccugaguaga

SEQ ID NO: 840167 - RNA, 17 nt, Human
ggugaguguccaggugg

SEQ ID NO: 840168 - RNA, 22 nt, Human
uuaugggagcaauuggggaggu

SEQ ID NO: 840169 - RNA, 22 nt, Human
uggcucagaggggaagugguuu

SEQ ID NO: 840170 - RNA, 22 nt, Human
gcaucuaauccaguccagcauc

SEQ ID NO: 840171 - RNA, 22 nt, Human
uggguuuaaacucaacucuaaa

SEQ ID NO: 840172 - RNA, 22 nt, Human
ugaguuuugucuugcuagaagu

SEQ ID NO: 840173 - RNA, 22 nt, Human
gacauuucaaucucauuauggg

SEQ ID NO: 840174 - RNA, 21 nt, Human
gcugucucuggcuccugggaa

SEQ ID NO: 840175 - RNA, 23 nt, Human
ugggggugcacgggccacaucuu

SEQ ID NO: 840176 - RNA, 22 nt, Human
ccuggaucagucacuguugcug

SEQ ID NO: 840177 - RNA, 22 nt, Human
gugucaugcacacucaguguug

SEQ ID NO: 840178 - RNA, 21 nt, Human
ccaagacucccaucuaguggu

SEQ ID NO: 840179 - RNA, 22 nt, Human
auugacaagacaauggcucuua

SEQ ID NO: 840180 - RNA, 22 nt, Human
uuguacaaauaggaaccucuga

SEQ ID NO: 840181 - RNA, 22 nt, Human
uaaguuuaaauguacaugaagc

SEQ ID NO: 840182 - RNA, 22 nt, Human
guacuuccagccaagugagaca

SEQ ID NO: 840183 - RNA, 22 nt, Human
aaggacuccaauucuuucaucu

SEQ ID NO: 840184 - RNA, 22 nt, Human
ucucucagucagaugcuaaaga

SEQ ID NO: 840185 - RNA, 22 nt, Human
acccaggauagagugcugcagu

SEQ ID NO: 840186 - RNA, 22 nt, Human
aaaguuugcaauuuauguuaau

SEQ ID NO: 840187 - RNA, 22 nt, Human
augaaaacuuuagccucauuag

SEQ ID NO: 840188 - RNA, 22 nt, Human
uaauuccaccuuuuuccaacuu

SEQ ID NO: 840189 - RNA, 22 nt, Human
gcuggcuguuggagguaccugc

SEQ ID NO: 840190 - RNA, 22 nt, Human
ucuggagcuuguuucagauggu

SEQ ID NO: 840191 - RNA, 22 nt, Human
ugaggcagugcugggaagccug

SEQ ID NO: 840192 - RNA, 20 nt, Human
gcuguucacauuauuaguag

SEQ ID NO: 840193 - RNA, 22 nt, Human
cugcccugcuugaugacagcga

SEQ ID NO: 840194 - RNA, 22 nt, Human
uggcuucugggacuugugagca

SEQ ID NO: 840195 - RNA, 22 nt, Human
gugcagugaaaaaagaaugucc

SEQ ID NO: 840196 - RNA, 19 nt, Human
uccuccuuacuuccucuug

SEQ ID NO: 840197 - RNA, 22 nt, Human
aggcagcuuucuggugcaccau

SEQ ID NO: 840198 - RNA, 22 nt, Human
cagagcuguugcggggcuuggc

SEQ ID NO: 840199 - RNA, 22 nt, Human
auuucaguguuuuaagaguuca

SEQ ID NO: 840200 - RNA, 19 nt, Human
ucucagagcccuagaggcc

SEQ ID NO: 840201 - RNA, 22 nt, Human
auguaugauauuuccaguauca

SEQ ID NO: 840202 - RNA, 19 nt, Human
gcuucccaccagccagccc

SEQ ID NO: 840203 - RNA, 22 nt, Human
ggauuugaauuguugaaaugau

SEQ ID NO: 840204 - RNA, 22 nt, Human
ucuggcucagggcucugaggga

SEQ ID NO: 840205 - RNA, 22 nt, Human
guccugggccugcugaggcuga

SEQ ID NO: 840206 - RNA, 22 nt, Human
gccagcagguugucaaggagcu

SEQ ID NO: 840207 - RNA, 22 nt, Human
uguguauuaccauuuuacagcu

SEQ ID NO: 840208 - RNA, 22 nt, Human
aacaaauguguuuuguaauuaa

SEQ ID NO: 840209 - RNA, 22 nt, Human
ggcuggaaguccaagaucaaga

SEQ ID NO: 840210 - RNA, 21 nt, Human
gcucucugcaugguggcucag

SEQ ID NO: 840211 - RNA, 22 nt, Human
cagagcagggugcaccuugggc

SEQ ID NO: 840212 - RNA, 22 nt, Human
acagccugagaguggagcuggc

SEQ ID NO: 840213 - RNA, 22 nt, Human
uuucaaguguccugauuaaugg

SEQ ID NO: 840214 - RNA, 22 nt, Human
gcuggcucagggacuagaguuu

SEQ ID NO: 840215 - RNA, 22 nt, Human
ugcauuauaacugaauguuguu

SEQ ID NO: 840216 - RNA, 22 nt, Human
aauuccaaguagcaucccauca

SEQ ID NO: 840217 - RNA, 19 nt, Human
accaggagacagugagcuu

SEQ ID NO: 840218 - RNA, 22 nt, Human
ccaccuccaccuauugccagcc

SEQ ID NO: 840219 - RNA, 18 nt, Human
agaguguucucagugaaa

SEQ ID NO: 840220 - RNA, 22 nt, Human
cagcaguguggaagcugagggg

SEQ ID NO: 840221 - RNA, 22 nt, Human
ccuguggcugccacuuggguga

SEQ ID NO: 840222 - RNA, 22 nt, Human
gcucuguccagcgugcacagaa

SEQ ID NO: 840223 - RNA, 22 nt, Human
aucuggcugcugugcuuaagcu

SEQ ID NO: 840224 - RNA, 22 nt, Human
cagcauuuucuuaauguaggug

SEQ ID NO: 840225 - RNA, 20 nt, Human
ccucucugaagaggucaucu

SEQ ID NO: 840226 - RNA, 22 nt, Human
ucaaggaggugcuuggcuucac

SEQ ID NO: 840227 - RNA, 22 nt, Human
uuagcucagaaaauuuaaacuu

SEQ ID NO: 840228 - RNA, 22 nt, Human
gguaugaaaugauuccauguua

SEQ ID NO: 840229 - RNA, 22 nt, Human
uugaauaauguguauguuguua

SEQ ID NO: 840230 - RNA, 22 nt, Human
gccuucaggaaaucaguccuug

SEQ ID NO: 840231 - RNA, 22 nt, Human
ggugcccaccugucuuccugga

SEQ ID NO: 840232 - RNA, 19 nt, Human
uagucuuuauucuuaauuu

SEQ ID NO: 840233 - RNA, 22 nt, Human
ucucuggggauggaccugggag

SEQ ID NO: 840234 - RNA, 22 nt, Human
gagcccagguucugcuuccagc

SEQ ID NO: 840235 - RNA, 22 nt, Human
gccaggagugucccacucauuu

SEQ ID NO: 840236 - RNA, 22 nt, Human
caccaucagcagcaggugucaa

SEQ ID NO: 840237 - RNA, 22 nt, Human
gucccuggaauggacucugcgc

SEQ ID NO: 840238 - RNA, 22 nt, Human
cugggacuuuacccuguggccc

SEQ ID NO: 840239 - RNA, 22 nt, Human
ucugagccaauuucugugucca

SEQ ID NO: 840240 - RNA, 22 nt, Human
aaaaaguuucaacugccaacuc

SEQ ID NO: 840241 - RNA, 22 nt, Human
cuugcugugugguguucucaga

SEQ ID NO: 840242 - RNA, 22 nt, Human
aaacugaauucccaagggcaug

SEQ ID NO: 840243 - RNA, 22 nt, Human
agaaaucaugucuuauuucuau

SEQ ID NO: 840244 - RNA, 19 nt, Human
ggaggccuggguauuugcc

SEQ ID NO: 840245 - RNA, 22 nt, Human
uugaagaaagucauauauaaug

SEQ ID NO: 840246 - RNA, 22 nt, Human
gcccagaaguugaggcugcagu

SEQ ID NO: 840247 - RNA, 22 nt, Human
ggaagagccuggggugucaggc

SEQ ID NO: 840248 - RNA, 22 nt, Human
cagcagugaugugugaggguuc

SEQ ID NO: 840249 - RNA, 22 nt, Human
ccucacucugcacccugcagca

SEQ ID NO: 840250 - RNA, 22 nt, Human
agagcccucucauuggcuuauu

SEQ ID NO: 840251 - RNA, 22 nt, Human
ugcaggugugguuccucagcca

SEQ ID NO: 840252 - RNA, 22 nt, Human
gcacccagccagcaucucagag

SEQ ID NO: 840253 - RNA, 22 nt, Human
uggcuccuaggauggugccugg

SEQ ID NO: 840254 - RNA, 22 nt, Human
cugcucuguuucuuagcugggu

SEQ ID NO: 840255 - RNA, 22 nt, Human
uggcucagagagggagugugga

SEQ ID NO: 840256 - RNA, 22 nt, Human
agccacagagguugaugugguu

SEQ ID NO: 840257 - RNA, 22 nt, Human
gcuugcucaacccccgucucuc

SEQ ID NO: 840258 - RNA, 22 nt, Human
agcccagcagaaaguccagccu

SEQ ID NO: 840259 - RNA, 22 nt, Human
uccaugagggacacuggaugcu

SEQ ID NO: 840260 - RNA, 22 nt, Human
uaagaacaguagaacaguaggu

SEQ ID NO: 840261 - RNA, 22 nt, Human
aaagcagacugauuugcaucac

SEQ ID NO: 840262 - RNA, 22 nt, Human
cccagcucaucaggagccgccc

SEQ ID NO: 840263 - RNA, 22 nt, Human
aaugaugguuaaacacuggagg

SEQ ID NO: 840264 - RNA, 22 nt, Human
aauaguguuguucacucaggag

SEQ ID NO: 840265 - RNA, 22 nt, Human
ccuggcugggccugauuucuca

SEQ ID NO: 840266 - RNA, 22 nt, Human
gccaggcugaggcucuggaaga

SEQ ID NO: 840267 - RNA, 22 nt, Human
ggaggaugccaagcugugcaca

SEQ ID NO: 840268 - RNA, 22 nt, Human
gccuggagggucccucucugga

SEQ ID NO: 840269 - RNA, 22 nt, Human
acucagaguuugcguuccauac

SEQ ID NO: 840270 - RNA, 22 nt, Human
augcuuuuccaggagaaauaua

SEQ ID NO: 840271 - RNA, 22 nt, Human
uucacaggauauaugugcaggg

SEQ ID NO: 840272 - RNA, 22 nt, Human
aagaauuauugcaauacuagau

SEQ ID NO: 840273 - RNA, 22 nt, Human
gaaaucugaacaacagcuguca

SEQ ID NO: 840274 - RNA, 22 nt, Human
auaaggcagugacuucaucuau

SEQ ID NO: 840275 - RNA, 22 nt, Human
ccugggcagguguggcuucccc

SEQ ID NO: 840276 - RNA, 21 nt, Human
acagacagggccagugucccc

SEQ ID NO: 840277 - RNA, 22 nt, Human
aucuggcucaccuggguaaaua

SEQ ID NO: 840278 - RNA, 22 nt, Human
aaaugucuuuaucucauguaac

SEQ ID NO: 840279 - RNA, 22 nt, Human
gccaggagaaaaggcgaaugau

SEQ ID NO: 840280 - RNA, 20 nt, Human
cuguccccgaggucaccagg

SEQ ID NO: 840281 - RNA, 23 nt, Human
guggccuccccggaaugccucgc

SEQ ID NO: 840282 - RNA, 22 nt, Human
ugaaaucugucccacuuuagcu

SEQ ID NO: 840283 - RNA, 19 nt, Human
auaaggcaauuggauuugg

SEQ ID NO: 840284 - RNA, 16 nt, Human
agcagggcgggaagga

SEQ ID NO: 840285 - RNA, 22 nt, Human
cugcucuggggaagccagaugu

SEQ ID NO: 840286 - RNA, 22 nt, Human
ggcagcaguaggagcuaaucuu

SEQ ID NO: 840287 - RNA, 22 nt, Human
aagacugugucuauggcuacuc

SEQ ID NO: 840288 - RNA, 22 nt, Human
uaagauaugguaggaaguuugg

SEQ ID NO: 840289 - RNA, 22 nt, Human
aguaggaggcgggagcaugaag

SEQ ID NO: 840290 - RNA, 22 nt, Human
ccugcaggggagagacuucuag

SEQ ID NO: 840291 - RNA, 22 nt, Human
aguguugucaaacggcucagca

SEQ ID NO: 840292 - RNA, 22 nt, Human
gcucccagaaccaaggcugggg

SEQ ID NO: 840293 - RNA, 22 nt, Human
caguccuuaaggaaacauuugu

SEQ ID NO: 840294 - RNA, 21 nt, Human
cgggcuggccgggcccucacc

SEQ ID NO: 840295 - RNA, 22 nt, Human
gaggcagcuggguccggucggg

SEQ ID NO: 840296 - RNA, 22 nt, Human
gcucaggacuggaggagcgggg

SEQ ID NO: 840297 - RNA, 16 nt, Human
ccuuucucugccuucc

SEQ ID NO: 840298 - RNA, 22 nt, Human
aaggagucucagcugggccuga

SEQ ID NO: 840299 - RNA, 22 nt, Human
ccuguucaccauggucacgugc

SEQ ID NO: 840300 - RNA, 22 nt, Human
aucucagggcuggagcccugga

SEQ ID NO: 840301 - RNA, 20 nt, Human
acuguucaagggccuggugg

SEQ ID NO: 840302 - RNA, 22 nt, Human
uggcuuaagauuuaugcuuuua

SEQ ID NO: 840303 - RNA, 22 nt, Human
cccugccuugggguccacaccg

SEQ ID NO: 840304 - RNA, 22 nt, Human
auaauaaaccaggaugggucug

SEQ ID NO: 840305 - RNA, 22 nt, Human
ggagccugggcauuaguaauuu

SEQ ID NO: 840306 - RNA, 20 nt, Human
caguagcaauaauuagaagc

SEQ ID NO: 840307 - RNA, 22 nt, Human
cagggcagggagcuuagaauga

SEQ ID NO: 840308 - RNA, 22 nt, Human
uggggagugaugccucggauaa

SEQ ID NO: 840309 - RNA, 22 nt, Human
agaaaugggccuugggacacaa

SEQ ID NO: 840310 - RNA, 22 nt, Human
ucacguuuuacugagugagaua

SEQ ID NO: 840311 - RNA, 19 nt, Human
ggcagaagguguaggggga

SEQ ID NO: 840312 - RNA, 22 nt, Human
aacuucuugguccugagcuguu

SEQ ID NO: 840313 - RNA, 22 nt, Human
agugaccauuuucagcuagagg

SEQ ID NO: 840314 - RNA, 22 nt, Human
cugagagccuccuguuggcuag

SEQ ID NO: 840315 - RNA, 22 nt, Human
ugccaggcccugugcuggaugc

SEQ ID NO: 840316 - RNA, 22 nt, Human
uggcugggagcuggaacugggc

SEQ ID NO: 840317 - RNA, 22 nt, Human
cauacauuuugcauauuuacca

SEQ ID NO: 840318 - RNA, 22 nt, Human
ugaaacuucuaauaugaauagu

SEQ ID NO: 840319 - RNA, 22 nt, Human
aaauaauguuaggccuuugcuc

SEQ ID NO: 840320 - RNA, 22 nt, Human
agagcugagaauguggcuuccu

SEQ ID NO: 840321 - RNA, 22 nt, Human
ugucccagacacaguaugcgcu

SEQ ID NO: 840322 - RNA, 22 nt, Human
agaggggaguccuaaucugauu

SEQ ID NO: 840323 - RNA, 22 nt, Human
ugggcagauuaaugcaguggcu

SEQ ID NO: 840324 - RNA, 22 nt, Human
uggacucagaaguguucuuuua

SEQ ID NO: 840325 - RNA, 22 nt, Human
accugaggccuccccagcagac

SEQ ID NO: 840326 - RNA, 22 nt, Human
acuggcucagaguuccuagaga

SEQ ID NO: 840327 - RNA, 21 nt, Human
agaagccuggguggagguggg

SEQ ID NO: 840328 - RNA, 22 nt, Human
cucuuuccaggguaccccaggu

SEQ ID NO: 840329 - RNA, 22 nt, Human
aguggcaguagaugagcugguu

SEQ ID NO: 840330 - RNA, 22 nt, Human
uccagccaccaccuugauugcc

SEQ ID NO: 840331 - RNA, 22 nt, Human
ucaucaaagucaaagaaugacu

SEQ ID NO: 840332 - RNA, 22 nt, Human
ccauaagguuuggggccaugca

SEQ ID NO: 840333 - RNA, 22 nt, Human
ugugucccuuggaaccucagcu

SEQ ID NO: 840334 - RNA, 22 nt, Human
auccaaaccuggacaugagugg

SEQ ID NO: 840335 - RNA, 22 nt, Human
aaguauuucuggccugugaaag

SEQ ID NO: 840336 - RNA, 23 nt, Human
ucaguuuuggcuguucaguguug

SEQ ID NO: 840337 - RNA, 22 nt, Human
uccaggaggacugagggggcug

SEQ ID NO: 840338 - RNA, 22 nt, Human
ucuggagcuggagggcaaggca

SEQ ID NO: 840339 - RNA, 19 nt, Human
gguaaaagugagcuucagg

SEQ ID NO: 840340 - RNA, 22 nt, Human
acuuuacaagcuuauagccuag

SEQ ID NO: 840341 - RNA, 19 nt, Human
uccaggaggcugccauuga

SEQ ID NO: 840342 - RNA, 21 nt, Human
ucacuuauaauguauuugcug

SEQ ID NO: 840343 - RNA, 22 nt, Human
gggcagcagcaggaggucucug

SEQ ID NO: 840344 - RNA, 22 nt, Human
auauacaggugguauguguaaa

SEQ ID NO: 840345 - RNA, 22 nt, Human
ggugaaggucagagcaggaaaa

SEQ ID NO: 840346 - RNA, 22 nt, Human
auaaagucauuaugaagaucua

SEQ ID NO: 840347 - RNA, 22 nt, Human
uguacaauggcuauaauacccu

SEQ ID NO: 840348 - RNA, 22 nt, Human
auaaacucaugccaagaaauga

SEQ ID NO: 840349 - RNA, 22 nt, Human
ggccuggcucuugcccagccug

SEQ ID NO: 840350 - RNA, 22 nt, Human
uggggcuggcacagucucuauu

SEQ ID NO: 840351 - RNA, 18 nt, Human
guucaaggucaagagaga

SEQ ID NO: 840352 - RNA, 19 nt, Human
ggaugagggucaggcauag

SEQ ID NO: 840353 - RNA, 22 nt, Human
gcucugagcacugugcggcugg

SEQ ID NO: 840354 - RNA, 22 nt, Human
ugucucugguauuaggugaaaa

SEQ ID NO: 840355 - RNA, 22 nt, Human
ugaagccuuguguggccucucu

SEQ ID NO: 840356 - RNA, 20 nt, Human
ugcguguguauuuauuuucu

SEQ ID NO: 840357 - RNA, 22 nt, Human
uagggaugagccaguggguagu

SEQ ID NO: 840358 - RNA, 22 nt, Human
ccugucagaugaaguaauugug

SEQ ID NO: 840359 - RNA, 22 nt, Human
uauuauuaaauggcagaauuuu

SEQ ID NO: 840360 - RNA, 19 nt, Human
acagaaauguaagugagac

SEQ ID NO: 840361 - RNA, 22 nt, Human
aagaagaugguuaacuuucagu

SEQ ID NO: 840362 - RNA, 18 nt, Human
uggagcagguaggcauga

SEQ ID NO: 840363 - RNA, 22 nt, Human
aggguggcugaguagauggaag

SEQ ID NO: 840364 - RNA, 22 nt, Human
uaacacauuaguucuccuagau

SEQ ID NO: 840365 - RNA, 22 nt, Human
ugcccugugugugcaagcacug

SEQ ID NO: 840366 - RNA, 22 nt, Human
ugagcccagagcccuuguaggg

SEQ ID NO: 840367 - RNA, 22 nt, Human
uggccugggcaugaagcaucgu

SEQ ID NO: 840368 - RNA, 22 nt, Human
aaagcaguauauugguaguugu

SEQ ID NO: 840369 - RNA, 22 nt, Human
gcucaggaaggcucaaccagga

SEQ ID NO: 840370 - RNA, 19 nt, Human
uggcaggcccaggauggac

SEQ ID NO: 840371 - RNA, 22 nt, Human
ugcagcauuauucacaguagcc

SEQ ID NO: 840372 - RNA, 22 nt, Human
ugagcccaggaguuggagaccg

SEQ ID NO: 840373 - RNA, 22 nt, Human
augagcugggccauccagugau

SEQ ID NO: 840374 - RNA, 22 nt, Human
auuuaaauuuucugauggagag

SEQ ID NO: 840375 - RNA, 19 nt, Human
ugaagcaggcagagaagau

SEQ ID NO: 840376 - RNA, 22 nt, Human
gcuggagcugaguucccugggc

SEQ ID NO: 840377 - RNA, 22 nt, Human
cugggcaggagggcucuaugga

SEQ ID NO: 840378 - RNA, 22 nt, Human
acauuucucuuagaguuggacu

SEQ ID NO: 840379 - RNA, 22 nt, Human
aggcacugugcuucuuauaugu

SEQ ID NO: 840380 - RNA, 22 nt, Human
gcucccagcaauugaggcagcc

SEQ ID NO: 840381 - RNA, 22 nt, Human
cugugugugucugcagcauacu

SEQ ID NO: 840382 - RNA, 22 nt, Human
aagggaggccagagguuuugca

SEQ ID NO: 840383 - RNA, 22 nt, Human
auuacagaaugcaguuccuuau

SEQ ID NO: 840384 - RNA, 22 nt, Human
acucuucuugcugcucauuaau

SEQ ID NO: 840385 - RNA, 20 nt, Human
ggggcccaagcccucuugcc

SEQ ID NO: 840386 - RNA, 22 nt, Human
gcugcaggcauuuuccugggca

SEQ ID NO: 840387 - RNA, 22 nt, Human
cucuucaauagauuguugaggg

SEQ ID NO: 840388 - RNA, 22 nt, Human
cauuucugcagaauugcucuuc

SEQ ID NO: 840389 - RNA, 23 nt, Human
ugcagccacucaggagcucagug

SEQ ID NO: 840390 - RNA, 22 nt, Human
ucucccagaggaucccagugga

SEQ ID NO: 840391 - RNA, 22 nt, Human
cagaaugagauaacccagauug

SEQ ID NO: 840392 - RNA, 22 nt, Human
ccacagaggacaacugccuggc

SEQ ID NO: 840393 - RNA, 22 nt, Human
ucccagagcaguacuccaggag

SEQ ID NO: 840394 - RNA, 22 nt, Human
gguacaaugguucauuuuaugu

SEQ ID NO: 840395 - RNA, 22 nt, Human
gaagcccagggcguggccgggc

SEQ ID NO: 840396 - RNA, 22 nt, Human
gccagacacuccccugggcagg

SEQ ID NO: 840397 - RNA, 22 nt, Human
agauuuagacugccuuaaucau

SEQ ID NO: 840398 - RNA, 22 nt, Human
ugguuuaaccugucucuuauua

SEQ ID NO: 840399 - RNA, 22 nt, Human
uccugagggcgauucagcaggu

SEQ ID NO: 840400 - RNA, 22 nt, Human
uacaggaaguaaguaaugaaau

SEQ ID NO: 840401 - RNA, 22 nt, Human
gauggcagcauauugacagcau

SEQ ID NO: 840402 - RNA, 22 nt, Human
ucagaggagaaguugggaaaau

SEQ ID NO: 840403 - RNA, 22 nt, Human
ucauucuuuaccaaguugucac

SEQ ID NO: 840404 - RNA, 22 nt, Human
uuucuagucucgaucucuuaau

SEQ ID NO: 840405 - RNA, 20 nt, Human
uuguuucugcuauuuucuaa

SEQ ID NO: 840406 - RNA, 22 nt, Human
ucccacacagcccgcucaccgg

SEQ ID NO: 840407 - RNA, 21 nt, Human
gccauuguuuucuaccuggag

SEQ ID NO: 840408 - RNA, 22 nt, Human
uuucaaacauagaucugaauau

SEQ ID NO: 840409 - RNA, 20 nt, Human
gaggaaaagcugccaggccu

SEQ ID NO: 840410 - RNA, 22 nt, Human
aguccuuaugugguggagagag

SEQ ID NO: 840411 - RNA, 22 nt, Human
uuguuucugaguuuucauguau

SEQ ID NO: 840412 - RNA, 22 nt, Human
ggagagcugguagcuggcucca

SEQ ID NO: 840413 - RNA, 22 nt, Human
cagcugccccuccagggcuggg

SEQ ID NO: 840414 - RNA, 22 nt, Human
ggaggccaaggaggagcuugcc

SEQ ID NO: 840415 - RNA, 22 nt, Human
augauacaucuucaugucagug

SEQ ID NO: 840416 - RNA, 22 nt, Human
ugugugcauucacaugcaugcc

SEQ ID NO: 840417 - RNA, 22 nt, Human
cugugcugauucagcacaggcc

SEQ ID NO: 840418 - RNA, 22 nt, Human
uaaaaugaucucucauguucuu

SEQ ID NO: 840419 - RNA, 22 nt, Human
aauguaugugauuauuccucua

SEQ ID NO: 840420 - RNA, 18 nt, Human
aguggucuguuauaucau

SEQ ID NO: 840421 - RNA, 22 nt, Human
ugagcuuacuucuguacacaga

SEQ ID NO: 840422 - RNA, 22 nt, Human
gcugcccaggagagguggggcu

SEQ ID NO: 840423 - RNA, 22 nt, Human
auuucugugcaguaaaugguga

SEQ ID NO: 840424 - RNA, 22 nt, Human
uuggcuucucuuaacccuaaag

SEQ ID NO: 840425 - RNA, 21 nt, Human
uggcaggcagcuggaagcuug

SEQ ID NO: 840426 - RNA, 22 nt, Human
aggggugaaagagggcccucaa

SEQ ID NO: 840427 - RNA, 22 nt, Human
caagggcuucaaguggccaaga

SEQ ID NO: 840428 - RNA, 17 nt, Human
ggccuuggggccucagu

SEQ ID NO: 840429 - RNA, 22 nt, Human
uuugcagcaaggagagagcauu

SEQ ID NO: 840430 - RNA, 22 nt, Human
uauuuagaacagacaauagaaa

SEQ ID NO: 840431 - RNA, 22 nt, Human
caggaggaaaugugacccugcu

SEQ ID NO: 840432 - RNA, 21 nt, Human
acuguucaucuguucagaagc

SEQ ID NO: 840433 - RNA, 22 nt, Human
aauuauccuuaaugcaguaagc

SEQ ID NO: 840434 - RNA, 22 nt, Human
cucuccuccaacagcccugccg

SEQ ID NO: 840435 - RNA, 22 nt, Human
acaaagucucuaauaaucuucu

SEQ ID NO: 840436 - RNA, 22 nt, Human
gaauuucaaagagguuaagagg

SEQ ID NO: 840437 - RNA, 22 nt, Human
gcagcugaauguccauugcugc

SEQ ID NO: 840438 - RNA, 22 nt, Human
ccugccugauuccaggauggcu

SEQ ID NO: 840439 - RNA, 22 nt, Human
gcaggaguguauuugcauguaa

SEQ ID NO: 840440 - RNA, 22 nt, Human
uggagaauuuugucaccagaca

SEQ ID NO: 840441 - RNA, 22 nt, Human
ucugggcucugucagcaccucu

SEQ ID NO: 840442 - RNA, 22 nt, Human
cuguuuucaaagagagagaaug

SEQ ID NO: 840443 - RNA, 22 nt, Human
cuggaagggucuacuuagcaga

SEQ ID NO: 840444 - RNA, 22 nt, Human
agggucccgaaggagacagcaa

SEQ ID NO: 840445 - RNA, 22 nt, Human
agggcagccauugagggauucu

SEQ ID NO: 840446 - RNA, 22 nt, Human
uagaaaagaauuuuauuugaua

SEQ ID NO: 840447 - RNA, 22 nt, Human
agcagugggugacagagcugag

SEQ ID NO: 840448 - RNA, 22 nt, Human
cuggccuguccugacccagccu

SEQ ID NO: 840449 - RNA, 22 nt, Human
cuuacauugugugcaugagggg

SEQ ID NO: 840450 - RNA, 22 nt, Human
uuguuacaucuuauguaagugg

SEQ ID NO: 840451 - RNA, 22 nt, Human
cugcugugcacccaggaaggcu

SEQ ID NO: 840452 - RNA, 22 nt, Human
auaucuuuguaugguucagcag

SEQ ID NO: 840453 - RNA, 18 nt, Human
agucucagcggaggagua

SEQ ID NO: 840454 - RNA, 22 nt, Human
ccaggcagagugcuccagaaag

SEQ ID NO: 840455 - RNA, 22 nt, Human
aaggcgacacaggcagcaggcc

SEQ ID NO: 840456 - RNA, 22 nt, Human
gaaacaacuacuauugauuucu

SEQ ID NO: 840457 - RNA, 22 nt, Human
uaggagaggugaauggcacacu

SEQ ID NO: 840458 - RNA, 22 nt, Human
cuggcagcuuccuuugcaucug

SEQ ID NO: 840459 - RNA, 22 nt, Human
uauugaaauccauuacguucuu

SEQ ID NO: 840460 - RNA, 22 nt, Human
ggagggugcauuuuacccugug

SEQ ID NO: 840461 - RNA, 22 nt, Human
cagaaaaccugacucuagaacu

SEQ ID NO: 840462 - RNA, 22 nt, Human
cagaaauguucuaaugauucag

SEQ ID NO: 840463 - RNA, 22 nt, Human
aaagccauuacaaaauuucaua

SEQ ID NO: 840464 - RNA, 22 nt, Human
ucugccuuggcaaccacagcuu

SEQ ID NO: 840465 - RNA, 22 nt, Human
uuuacagagaauguacauaaag

SEQ ID NO: 840466 - RNA, 22 nt, Human
uugcagagaucagcagguuuga

SEQ ID NO: 840467 - RNA, 22 nt, Human
ucccugggcaucacguugcuuc

SEQ ID NO: 840468 - RNA, 18 nt, Human
ugcuggcaacuacuauug

SEQ ID NO: 840469 - RNA, 22 nt, Human
cagggccagccgcagcauccac

SEQ ID NO: 840470 - RNA, 22 nt, Human
uagagaaaagcagggaucagga

SEQ ID NO: 840471 - RNA, 22 nt, Human
ugggcaggaugcguugauucuu

SEQ ID NO: 840472 - RNA, 22 nt, Human
caggcagcugaggacuuugcua

SEQ ID NO: 840473 - RNA, 22 nt, Human
cuguguuugaugagaagccacc

SEQ ID NO: 840474 - RNA, 22 nt, Human
uuucucuguucucuaacuguaa

SEQ ID NO: 840475 - RNA, 22 nt, Human
aggcugucugaccccagagccc

SEQ ID NO: 840476 - RNA, 22 nt, Human
cccauuuaaacacaagcuuuca

SEQ ID NO: 840477 - RNA, 22 nt, Human
caggugccgggaaugcagcaau

SEQ ID NO: 840478 - RNA, 22 nt, Human
gucucccaucguuugugaggaa

SEQ ID NO: 840479 - RNA, 22 nt, Human
cauacuuuugcccugacauucu

SEQ ID NO: 840480 - RNA, 22 nt, Human
acuuuguauaagacaauaaaga

SEQ ID NO: 840481 - RNA, 22 nt, Human
aggcaggcacuccggaaguguc

SEQ ID NO: 840482 - RNA, 22 nt, Human
caggugggagcggagacugauu

SEQ ID NO: 840483 - RNA, 22 nt, Human
agccaggacguugcucagcucc

SEQ ID NO: 840484 - RNA, 22 nt, Human
uggcucugugucucccagcagc

SEQ ID NO: 840485 - RNA, 22 nt, Human
uugagucaguaauuccauuucu

SEQ ID NO: 840486 - RNA, 22 nt, Human
aggaaagguagcgugccagcag

SEQ ID NO: 840487 - RNA, 22 nt, Human
agcauauaaauggacauauuug

SEQ ID NO: 840488 - RNA, 22 nt, Human
agagcagccugugaugaugcac

SEQ ID NO: 840489 - RNA, 22 nt, Human
cagaccugagguugaguaccag

SEQ ID NO: 840490 - RNA, 22 nt, Human
uuagccauauagaaaaagagcu

SEQ ID NO: 840491 - RNA, 22 nt, Human
aagggaggaggauuuauuguac

SEQ ID NO: 840492 - RNA, 22 nt, Human
caagggcucuuuugaggaaugu

SEQ ID NO: 840493 - RNA, 22 nt, Human
gugccugcugcagagucgcugu

SEQ ID NO: 840494 - RNA, 22 nt, Human
caccagggcucugagcucugaa

SEQ ID NO: 840495 - RNA, 22 nt, Human
cauaauaucuccgauuacuugc

SEQ ID NO: 840496 - RNA, 22 nt, Human
ucucucuugucaccccaucugc

SEQ ID NO: 840497 - RNA, 22 nt, Human
uggcuuuauaaauccacugguu

SEQ ID NO: 840498 - RNA, 22 nt, Human
agggcccucuggcaggccaggc

SEQ ID NO: 840499 - RNA, 22 nt, Human
aucucauaacucauuugaagac

SEQ ID NO: 840500 - RNA, 22 nt, Human
uagggcaguuauaacauuagug

SEQ ID NO: 840501 - RNA, 22 nt, Human
ccagggcacguugggacaguac

SEQ ID NO: 840502 - RNA, 22 nt, Human
agacccugucaguguuaggaaa

SEQ ID NO: 840503 - RNA, 22 nt, Human
gccaggaggcuuaacuggacag

SEQ ID NO: 840504 - RNA, 22 nt, Human
gaggccuggcugggaggaggug

SEQ ID NO: 840505 - RNA, 22 nt, Human
uggcagcagggccccuggagga

SEQ ID NO: 840506 - RNA, 22 nt, Human
cagccucuaagcacagccucuc

SEQ ID NO: 840507 - RNA, 22 nt, Human
auuccaguucuccucucuaaag

SEQ ID NO: 840508 - RNA, 22 nt, Human
ccugucuguauugguuugcuau

SEQ ID NO: 840509 - RNA, 16 nt, Human
auuuccagauuaugca

SEQ ID NO: 840510 - RNA, 22 nt, Human
aagcacagaaaaggagcaugga

SEQ ID NO: 840511 - RNA, 22 nt, Human
ucaggagauggucuuuauaggc

SEQ ID NO: 840512 - RNA, 21 nt, Human
ucucugggaggacuugugaga

SEQ ID NO: 840513 - RNA, 22 nt, Human
aaucuucauuuugacaagauuc

SEQ ID NO: 840514 - RNA, 21 nt, Human
gauuuuaaagagacugccaca

SEQ ID NO: 840515 - RNA, 22 nt, Human
cugagaggaugcugcaguggag

SEQ ID NO: 840516 - RNA, 19 nt, Human
cccaggagcaguauugaug

SEQ ID NO: 840517 - RNA, 22 nt, Human
ugccuggguucccaccccaaag

SEQ ID NO: 840518 - RNA, 21 nt, Human
ccagcuccaggaccuuggauc

SEQ ID NO: 840519 - RNA, 23 nt, Human
ucccaggaaucugcauuuuuaac

SEQ ID NO: 840520 - RNA, 22 nt, Human
gagcagugguugaacagaggca

SEQ ID NO: 840521 - RNA, 20 nt, Human
cagcucugggaaagaggcca

SEQ ID NO: 840522 - RNA, 22 nt, Human
ucaucugucauccacaaagcug

SEQ ID NO: 840523 - RNA, 22 nt, Human
cagagccauuauggagacuugc

SEQ ID NO: 840524 - RNA, 22 nt, Human
ugaaagaacuagcaucuucaag

SEQ ID NO: 840525 - RNA, 22 nt, Human
aagggcagggaguuugugucua

SEQ ID NO: 840526 - RNA, 19 nt, Human
cuuugucagaacaugcuuc

SEQ ID NO: 840527 - RNA, 22 nt, Human
uuugaagugggcauuagaaccu

SEQ ID NO: 840528 - RNA, 22 nt, Human
uccucagggcggccuccgucuu

SEQ ID NO: 840529 - RNA, 22 nt, Human
ugcauuucagaagaaaauucgg

SEQ ID NO: 840530 - RNA, 22 nt, Human
cugccuugaaaaugaagcuuua

SEQ ID NO: 840531 - RNA, 22 nt, Human
uuccauaauaggcuuaagugaa

SEQ ID NO: 840532 - RNA, 22 nt, Human
uuacaagauaaccugaugcugu

SEQ ID NO: 840533 - RNA, 22 nt, Human
gugcaguggcagauccuagcuc

SEQ ID NO: 840534 - RNA, 22 nt, Human
ggaggacaggggcugcagcaca

SEQ ID NO: 840535 - RNA, 22 nt, Human
augcuuaacuuccuagucuaua

SEQ ID NO: 840536 - RNA, 22 nt, Human
auuugcaugcuucuauugugaa

SEQ ID NO: 840537 - RNA, 22 nt, Human
acuauaaaaggauaaaccagaa

SEQ ID NO: 840538 - RNA, 22 nt, Human
ucauuuguucaucugcucuucu

SEQ ID NO: 840539 - RNA, 22 nt, Human
ccuuccagaguucagucugccc

SEQ ID NO: 840540 - RNA, 22 nt, Human
ucaguuuuuguuugccagauag

SEQ ID NO: 840541 - RNA, 20 nt, Human
ugccaugguaacagagugug

SEQ ID NO: 840542 - RNA, 22 nt, Human
uucaagucaaggaaagaggucu

SEQ ID NO: 840543 - RNA, 22 nt, Human
augggaggaucacuugaggcca

SEQ ID NO: 840544 - RNA, 22 nt, Human
ucaggcugugggcacuggccau

SEQ ID NO: 840545 - RNA, 22 nt, Human
aaggaagggaaauagugauguc

SEQ ID NO: 840546 - RNA, 20 nt, Human
uauuuguauuugggaaaguu

SEQ ID NO: 840547 - RNA, 22 nt, Human
uuguuaaaaauagauuuccagg

SEQ ID NO: 840548 - RNA, 22 nt, Human
ccugcugugaagccaggccugu

SEQ ID NO: 840549 - RNA, 22 nt, Human
acauacuaugaauacauguguc

SEQ ID NO: 840550 - RNA, 20 nt, Human
aacuuguucuaccuguuuca

SEQ ID NO: 840551 - RNA, 22 nt, Human
gcagguguggaguggggugagc

SEQ ID NO: 840552 - RNA, 22 nt, Human
aaauguagaccuauagggaccu

SEQ ID NO: 840553 - RNA, 22 nt, Human
uccucuggggucagggcacuac

SEQ ID NO: 840554 - RNA, 22 nt, Human
gugccagcaguuauggugauuu

SEQ ID NO: 840555 - RNA, 22 nt, Human
caaugaaagcaacugccuauaa

SEQ ID NO: 840556 - RNA, 22 nt, Human
acagagcaauucuuggguguuu

SEQ ID NO: 840557 - RNA, 22 nt, Human
gcagccacuaguuuuccuguuu

SEQ ID NO: 840558 - RNA, 22 nt, Human
cugcaucaguggauaugauggu

SEQ ID NO: 840559 - RNA, 22 nt, Human
uggcccuguguccugcugccag

SEQ ID NO: 840560 - RNA, 22 nt, Human
aaauucaguuuuaauaaucacu

SEQ ID NO: 840561 - RNA, 22 nt, Human
cccaggagaucuggaucucguc

SEQ ID NO: 840562 - RNA, 22 nt, Human
ccaggccuggccaggggaugcc

SEQ ID NO: 840563 - RNA, 22 nt, Human
agagacaaugccaaugcacacg

SEQ ID NO: 840564 - RNA, 22 nt, Human
ucuuuaauuguggaagagcagc

SEQ ID NO: 840565 - RNA, 21 nt, Human
gaugaagcaaucuuucuguug

SEQ ID NO: 840566 - RNA, 22 nt, Human
gccuguccacuaaacagccaag

SEQ ID NO: 840567 - RNA, 22 nt, Human
agcagggcagguaaggaucaga

SEQ ID NO: 840568 - RNA, 22 nt, Human
ccaggccugauugggaaucuug

SEQ ID NO: 840569 - RNA, 22 nt, Human
auuucacaaaccauccugauuu

SEQ ID NO: 840570 - RNA, 22 nt, Human
ugguggcaauguccuggagaag

SEQ ID NO: 840571 - RNA, 22 nt, Human
agcaccugccugcauuggcuau

SEQ ID NO: 840572 - RNA, 22 nt, Human
ggaugcugacuuuggagcaugg

SEQ ID NO: 840573 - RNA, 22 nt, Human
cugugcuucgcaacuccaaggu

SEQ ID NO: 840574 - RNA, 22 nt, Human
cugcugugugcuuacuuggguu

SEQ ID NO: 840575 - RNA, 22 nt, Human
ucagcagggcugugguguggcu

SEQ ID NO: 840576 - RNA, 22 nt, Human
cuucaagaagacagcagagcau

SEQ ID NO: 840577 - RNA, 22 nt, Human
aaggcacucagccuugggacag

SEQ ID NO: 840578 - RNA, 22 nt, Human
uagcugccauugcuccaggaag

SEQ ID NO: 840579 - RNA, 22 nt, Human
cccuggaagguucucuggcuca

SEQ ID NO: 840580 - RNA, 22 nt, Human
uucacacacagcuuccuauugu

SEQ ID NO: 840581 - RNA, 17 nt, Human
uagcuguguuucagcua

SEQ ID NO: 840582 - RNA, 22 nt, Human
ccagcagcagcguccaaggaga

SEQ ID NO: 840583 - RNA, 22 nt, Human
gugucaugggagucagaaguga

SEQ ID NO: 840584 - RNA, 22 nt, Human
ugcugcucuucaccauggccuc

SEQ ID NO: 840585 - RNA, 22 nt, Human
agaagccaauucugugugaguc

SEQ ID NO: 840586 - RNA, 22 nt, Human
gcuggccugaccagccacaggc

SEQ ID NO: 840587 - RNA, 22 nt, Human
cagggguguuuuuggccaggag

SEQ ID NO: 840588 - RNA, 22 nt, Human
gcaggaugaaggcagaggcuga

SEQ ID NO: 840589 - RNA, 22 nt, Human
agaggcuccuagccacuggcuu

SEQ ID NO: 840590 - RNA, 22 nt, Human
agucucagcuacuugggaggcu

SEQ ID NO: 840591 - RNA, 21 nt, Human
agacagaacaacugcucucca

SEQ ID NO: 840592 - RNA, 21 nt, Human
uucaaaaugguguguuugucu

SEQ ID NO: 840593 - RNA, 22 nt, Human
cuugcugucuugcauuuagagc

SEQ ID NO: 840594 - RNA, 22 nt, Human
gggagggaaggaccuuaugaau

SEQ ID NO: 840595 - RNA, 21 nt, Human
ucuuuccugcccaguugcccu

SEQ ID NO: 840596 - RNA, 22 nt, Human
uccuucagcuuauuucuuagga

SEQ ID NO: 840597 - RNA, 22 nt, Human
ggagccaggggaccuucacaga

SEQ ID NO: 840598 - RNA, 22 nt, Human
uccugccuguuuaccuguacuu

SEQ ID NO: 840599 - RNA, 22 nt, Human
uaaguucauuagacuacagaua

SEQ ID NO: 840600 - RNA, 22 nt, Human
ggccccugcggacugccuagag

SEQ ID NO: 840601 - RNA, 22 nt, Human
ggccugugagcccuugcaugua

SEQ ID NO: 840602 - RNA, 19 nt, Human
cugaggugcaguaagaggc

SEQ ID NO: 840603 - RNA, 22 nt, Human
gaauuuuucuggaagcaauuau

SEQ ID NO: 840604 - RNA, 22 nt, Human
uggcugaaucugcagcaggaag

SEQ ID NO: 840605 - RNA, 22 nt, Human
ucccacugugaauccaaggccu

SEQ ID NO: 840606 - RNA, 22 nt, Human
auuuaucucuggaaacuaagca

SEQ ID NO: 840607 - RNA, 20 nt, Human
uggcuccugcgguggaacca

SEQ ID NO: 840608 - RNA, 22 nt, Human
uaugaagacaaugauagcauga

SEQ ID NO: 840609 - RNA, 22 nt, Human
aauguguacuuuuucaugcuca

SEQ ID NO: 840610 - RNA, 22 nt, Human
guccacauaggaacccagcuuc

SEQ ID NO: 840611 - RNA, 22 nt, Human
ucugcgcugccuugauccuugg

SEQ ID NO: 840612 - RNA, 22 nt, Human
gaggcagcaggcugaggaggau

SEQ ID NO: 840613 - RNA, 22 nt, Human
uagaacuacaagcauuaaaagu

SEQ ID NO: 840614 - RNA, 17 nt, Human
ccuuucucuuucaucuc

SEQ ID NO: 840615 - RNA, 22 nt, Human
uuucuguauuuaaaagaucugg

SEQ ID NO: 840616 - RNA, 22 nt, Human
aggcucauucuugccucugagc

SEQ ID NO: 840617 - RNA, 22 nt, Human
aagacugucuuuucugagugac

SEQ ID NO: 840618 - RNA, 21 nt, Human
cugcucugacagugaggccag

SEQ ID NO: 840619 - RNA, 22 nt, Human
cauuuguaguuaaaaaugucuc

SEQ ID NO: 840620 - RNA, 21 nt, Human
gugucaugguugacuuuggca

SEQ ID NO: 840621 - RNA, 22 nt, Human
gggcugacucugcacugagcca

SEQ ID NO: 840622 - RNA, 22 nt, Human
caaaguuaucaacugcaacauu

SEQ ID NO: 840623 - RNA, 22 nt, Human
acuuccuggcguagcugacauu

SEQ ID NO: 840624 - RNA, 22 nt, Human
agccagacauggcuccugcucc

SEQ ID NO: 840625 - RNA, 22 nt, Human
ucaagagagugcugcuuggggu

SEQ ID NO: 840626 - RNA, 22 nt, Human
agaggcuccuucacucuggcac

SEQ ID NO: 840627 - RNA, 22 nt, Human
auuuucagagacaucuggacuu

SEQ ID NO: 840628 - RNA, 22 nt, Human
auauguguacgugcaguauaua

SEQ ID NO: 840629 - RNA, 22 nt, Human
gagagaagaauguuccgaggcc

SEQ ID NO: 840630 - RNA, 22 nt, Human
cugcagaggccucgccuccucu

SEQ ID NO: 840631 - RNA, 22 nt, Human
ucugggaacacacgucacuuca

SEQ ID NO: 840632 - RNA, 20 nt, Human
uggccuuuaaauaguauucc

SEQ ID NO: 840633 - RNA, 22 nt, Human
ucagagugugagacauauugga

SEQ ID NO: 840634 - RNA, 22 nt, Human
gccugggagggcagcagugugg

SEQ ID NO: 840635 - RNA, 22 nt, Human
caucagucuagauucuaguacc

SEQ ID NO: 840636 - RNA, 22 nt, Human
gcagauggcucagacacugggg

SEQ ID NO: 840637 - RNA, 22 nt, Human
agguggggaggagugucucuuu

SEQ ID NO: 840638 - RNA, 22 nt, Human
uuacaaagaguguucuuuucca

SEQ ID NO: 840639 - RNA, 22 nt, Human
uggcccugcuuaugucucucuu

SEQ ID NO: 840640 - RNA, 22 nt, Human
uucaaacaguguagaauauaug

SEQ ID NO: 840641 - RNA, 22 nt, Human
gugcaugucggggugcauguca

SEQ ID NO: 840642 - RNA, 22 nt, Human
uuacagaaaggaaggacugacu

SEQ ID NO: 840643 - RNA, 22 nt, Human
aguggcagaucucuggucugga

SEQ ID NO: 840644 - RNA, 22 nt, Human
ccuggcagaauauuaaagugca

SEQ ID NO: 840645 - RNA, 22 nt, Human
ggaggugguggcagugacaauu

SEQ ID NO: 840646 - RNA, 22 nt, Human
aauuaaauugguuuagagagga

SEQ ID NO: 840647 - RNA, 22 nt, Human
gcugccuggaauaacggcuggc

SEQ ID NO: 840648 - RNA, 22 nt, Human
uguguuccugccuggcucuggu

SEQ ID NO: 840649 - RNA, 22 nt, Human
gccucugcaacuccgccuuggu

SEQ ID NO: 840650 - RNA, 22 nt, Human
ccucccucuuucagucccacag

SEQ ID NO: 840651 - RNA, 22 nt, Human
cagaagccugccucagaugcac

SEQ ID NO: 840652 - RNA, 22 nt, Human
ucuuugcaacucccauuuccau

SEQ ID NO: 840653 - RNA, 22 nt, Human
gacaucauagggugggaggaaa

SEQ ID NO: 840654 - RNA, 22 nt, Human
ugaacuuagugggaauaucucu

SEQ ID NO: 840655 - RNA, 22 nt, Human
agaggcugaaugaugucaucau

SEQ ID NO: 840656 - RNA, 22 nt, Human
ggccccaggaccuccacggucc

SEQ ID NO: 840657 - RNA, 23 nt, Human
uugcuucugugcaauucaguacu

SEQ ID NO: 840658 - RNA, 22 nt, Human
cugaagaggacgcagcagcaag

SEQ ID NO: 840659 - RNA, 22 nt, Human
cuggaugcuuccucucugcuag

SEQ ID NO: 840660 - RNA, 22 nt, Human
aaacacaucauucaugucguca

SEQ ID NO: 840661 - RNA, 22 nt, Human
aucuuucagagcuccaucaggg

SEQ ID NO: 840662 - RNA, 22 nt, Human
uuuggacuuagccugcagaauu

SEQ ID NO: 840663 - RNA, 19 nt, Human
uccuucagucagaucuggg

SEQ ID NO: 840664 - RNA, 22 nt, Human
guggcugcagcccagcggcacg

SEQ ID NO: 840665 - RNA, 22 nt, Human
cugcccagaagccagaugggca

SEQ ID NO: 840666 - RNA, 22 nt, Human
augggaugcauggcuguggcca

SEQ ID NO: 840667 - RNA, 22 nt, Human
aauuauauuguggugugaaugu

SEQ ID NO: 840668 - RNA, 22 nt, Human
aacaugcugccuuucuacgagu

SEQ ID NO: 840669 - RNA, 22 nt, Human
gaggaggcuaagugggcucugg

SEQ ID NO: 840670 - RNA, 22 nt, Human
cacaugcaucugucauguuugg

SEQ ID NO: 840671 - RNA, 22 nt, Human
uggcacugagcagccgcggcag

SEQ ID NO: 840672 - RNA, 22 nt, Human
cugccaggcacgugcagcauca

SEQ ID NO: 840673 - RNA, 20 nt, Human
aggcacuggauuucuuauau

SEQ ID NO: 840674 - RNA, 22 nt, Human
auccugggcagugugucacucu

SEQ ID NO: 840675 - RNA, 22 nt, Human
gcccugucggaacugcgaccuc

SEQ ID NO: 840676 - RNA, 22 nt, Human
uuaauuacuaagcacaaugcaa

SEQ ID NO: 840677 - RNA, 22 nt, Human
aagccucuggggccucaucugu

SEQ ID NO: 840678 - RNA, 22 nt, Human
ucuuuaauauaaaggaaugaau

SEQ ID NO: 840679 - RNA, 22 nt, Human
agcaggagagcagugcgugguc

SEQ ID NO: 840680 - RNA, 22 nt, Human
aggugaaguugaggaggcagaa

SEQ ID NO: 840681 - RNA, 22 nt, Human
gguuugcacgauauuuccaugg

SEQ ID NO: 840682 - RNA, 22 nt, Human
augcacagcagugaguucagug

SEQ ID NO: 840683 - RNA, 22 nt, Human
ugucucaguauacgaaacacuu

SEQ ID NO: 840684 - RNA, 22 nt, Human
cugagauggaguuuugcucuug

SEQ ID NO: 840685 - RNA, 22 nt, Human
agacccagaaagcagcugcauu

SEQ ID NO: 840686 - RNA, 21 nt, Human
gggccacaccuucugcagacc

SEQ ID NO: 840687 - RNA, 22 nt, Human
ugggcagaaugugggauccaga

SEQ ID NO: 840688 - RNA, 22 nt, Human
cagcauuggguuaccuuuguuu

SEQ ID NO: 840689 - RNA, 22 nt, Human
uguucuucuagauugccuuuua

SEQ ID NO: 840690 - RNA, 22 nt, Human
uuugacaguaauaaagcacaag

SEQ ID NO: 840691 - RNA, 22 nt, Human
aguauucuggaauucuauguga

SEQ ID NO: 840692 - RNA, 22 nt, Human
ggcuggguuauuuauggccaag

SEQ ID NO: 840693 - RNA, 20 nt, Human
auacuuguuuucaggcuuuu

SEQ ID NO: 840694 - RNA, 22 nt, Human
aacuuucuuggaugucucaaca

SEQ ID NO: 840695 - RNA, 22 nt, Human
ggcugucucugugacugccacc

SEQ ID NO: 840696 - RNA, 22 nt, Human
cuggagagauccuccugaaaaa

SEQ ID NO: 840697 - RNA, 22 nt, Human
aucuucaaagggauguccaugg

SEQ ID NO: 840698 - RNA, 22 nt, Human
cauugcacagcccuguggugau

SEQ ID NO: 840699 - RNA, 22 nt, Human
uuugaacaggaguaucuauagu

SEQ ID NO: 840700 - RNA, 22 nt, Human
ucuuuacacaagacaagaauaa

SEQ ID NO: 840701 - RNA, 22 nt, Human
uccaggaguccuggguggcccc

SEQ ID NO: 840702 - RNA, 22 nt, Human
ggucccagcugcucaagaggcu

SEQ ID NO: 840703 - RNA, 22 nt, Human
guuaacacaggacucucugccu

SEQ ID NO: 840704 - RNA, 22 nt, Human
aggauccugcgcuuugggggag

SEQ ID NO: 840705 - RNA, 22 nt, Human
gcagggcuaauggggcaaguag

SEQ ID NO: 840706 - RNA, 22 nt, Human
ccugcuggccaguggagggcug

SEQ ID NO: 840707 - RNA, 22 nt, Human
uaucaauacauguuaucagugu

SEQ ID NO: 840708 - RNA, 22 nt, Human
cucaggaugaaagucaugguga

SEQ ID NO: 840709 - RNA, 22 nt, Human
aguacaauuauauuuagauggu

SEQ ID NO: 840710 - RNA, 22 nt, Human
gauuuuaauuauaggagguccu

SEQ ID NO: 840711 - RNA, 22 nt, Human
ggcagaagaaaggcuaagucuc

SEQ ID NO: 840712 - RNA, 22 nt, Human
cucugagaaagcugugagcuaa

SEQ ID NO: 840713 - RNA, 22 nt, Human
gccagcuggagugagagugggc

SEQ ID NO: 840714 - RNA, 22 nt, Human
auagaaauguauuuuggacuag

SEQ ID NO: 840715 - RNA, 22 nt, Human
gcucugaggcugggagcacucu

SEQ ID NO: 840716 - RNA, 22 nt, Human
agauggcagggguaccuggaag

SEQ ID NO: 840717 - RNA, 22 nt, Human
gggugcaggcagcccaggcagg

SEQ ID NO: 840718 - RNA, 19 nt, Human
ucccgcccacugagcgugc

SEQ ID NO: 840719 - RNA, 22 nt, Human
cggagcugccugccaagccugc

SEQ ID NO: 840720 - RNA, 22 nt, Human
ugcuggccaauggcagaggcgg

SEQ ID NO: 840721 - RNA, 22 nt, Human
gugcagcugugguggagccagg

SEQ ID NO: 840722 - RNA, 22 nt, Human
agggaggagaauggacuccuuc

SEQ ID NO: 840723 - RNA, 22 nt, Human
caggggcuuaagugacagaagg

SEQ ID NO: 840724 - RNA, 22 nt, Human
agaacagaggccuuauguuuca

SEQ ID NO: 840725 - RNA, 22 nt, Human
uauugaguuacagaaaauacuu

SEQ ID NO: 840726 - RNA, 22 nt, Human
ucacauuuuauaucucugguuu

SEQ ID NO: 840727 - RNA, 22 nt, Human
cucagaguccccacaucugggu

SEQ ID NO: 840728 - RNA, 22 nt, Human
aucacaaaggguuuucucugag

SEQ ID NO: 840729 - RNA, 22 nt, Human
uggcuucugcuuucaguggagg

SEQ ID NO: 840730 - RNA, 22 nt, Human
ucaggagaaucagggcuguccu

SEQ ID NO: 840731 - RNA, 22 nt, Human
cccugcagccuugcaugccuuc

SEQ ID NO: 840732 - RNA, 21 nt, Human
uucugggaaaugagcuggggc

SEQ ID NO: 840733 - RNA, 22 nt, Human
uagaaacaucagcuaaccaaaa

SEQ ID NO: 840734 - RNA, 22 nt, Human
ggugggcacccgagacuggauc

SEQ ID NO: 840735 - RNA, 22 nt, Human
augaauaaguaaacuccuuugg

SEQ ID NO: 840736 - RNA, 22 nt, Human
aucuucaaagcacaucguuugu

SEQ ID NO: 840737 - RNA, 22 nt, Human
uccuucagcucucuauuuagau

SEQ ID NO: 840738 - RNA, 22 nt, Human
acagcuuuucaauucugcugag

SEQ ID NO: 840739 - RNA, 22 nt, Human
agcauggggcuccgcaaugaac

SEQ ID NO: 840740 - RNA, 21 nt, Human
auccauccaucuuggccuaac

SEQ ID NO: 840741 - RNA, 22 nt, Human
augaaacaugcuuuguggauga

SEQ ID NO: 840742 - RNA, 22 nt, Human
ggcacugagcugccuuggggca

SEQ ID NO: 840743 - RNA, 22 nt, Human
ccugcagagccacgugccagcg

SEQ ID NO: 840744 - RNA, 22 nt, Human
uguccuuagaagaagugaaaga

SEQ ID NO: 840745 - RNA, 21 nt, Human
aucuuuauuacgcagagaaga

SEQ ID NO: 840746 - RNA, 18 nt, Human
caauuucaauggucugaa

SEQ ID NO: 840747 - RNA, 22 nt, Human
aaaguucagugccuucuauaca

SEQ ID NO: 840748 - RNA, 22 nt, Human
cugggccagggaggugucugua

SEQ ID NO: 840749 - RNA, 22 nt, Human
agcugucagugcugugccugua

SEQ ID NO: 840750 - RNA, 22 nt, Human
agauaucaccaguuuuacauac

SEQ ID NO: 840751 - RNA, 22 nt, Human
acaagcaugggcuuugacauca

SEQ ID NO: 840752 - RNA, 19 nt, Human
augucccaccgccccugag

SEQ ID NO: 840753 - RNA, 22 nt, Human
agccuucaguaaauccacugug

SEQ ID NO: 840754 - RNA, 22 nt, Human
acuguugucaggcugcuuugga

SEQ ID NO: 840755 - RNA, 22 nt, Human
uuccucuagcuucucacuaaca

SEQ ID NO: 840756 - RNA, 22 nt, Human
aguauuucuaguugguucuacu

SEQ ID NO: 840757 - RNA, 22 nt, Human
auaauaacaccugaauaggaaa

SEQ ID NO: 840758 - RNA, 22 nt, Human
cuuccugcauugugccagaguu

SEQ ID NO: 840759 - RNA, 22 nt, Human
uuguuacagcagugauuucaga

SEQ ID NO: 840760 - RNA, 17 nt, Human
uuccaguuuaguauugu

SEQ ID NO: 840761 - RNA, 22 nt, Human
cugagcugggacucaguagcaa

SEQ ID NO: 840762 - RNA, 22 nt, Human
gaggcucugugaugugccaggc

SEQ ID NO: 840763 - RNA, 22 nt, Human
ugccaggauggccagggggcca

SEQ ID NO: 840764 - RNA, 23 nt, Human
cccagcagauuguaaagugucca

SEQ ID NO: 840765 - RNA, 22 nt, Human
ugccaggaggaggugggacaga

SEQ ID NO: 840766 - RNA, 22 nt, Human
ucucccacugcaagcccaggcu

SEQ ID NO: 840767 - RNA, 22 nt, Human
auuuauguaucuguguagauca

SEQ ID NO: 840768 - RNA, 19 nt, Human
cuugcugggugguuucugc

SEQ ID NO: 840769 - RNA, 22 nt, Human
cauacaagcguucaauagaugu

SEQ ID NO: 840770 - RNA, 22 nt, Human
aauucaugaguagaaucuauau

SEQ ID NO: 840771 - RNA, 22 nt, Human
caugggcuuuggaggcuggagg

SEQ ID NO: 840772 - RNA, 18 nt, Human
acagaacucaggggcacc

SEQ ID NO: 840773 - RNA, 22 nt, Human
ccucugccugcacaucauccug

SEQ ID NO: 840774 - RNA, 20 nt, Human
uuugagaccagucugcccaa

SEQ ID NO: 840775 - RNA, 22 nt, Human
gccaggcagcagcgaggauggu

SEQ ID NO: 840776 - RNA, 22 nt, Human
guucuucagucacaucacagaa

SEQ ID NO: 840777 - RNA, 22 nt, Human
uggcagcuacagacagagguga

SEQ ID NO: 840778 - RNA, 22 nt, Human
aguggggagguccaggccaccc

SEQ ID NO: 840779 - RNA, 22 nt, Human
gccucugcccauccaccaucag

SEQ ID NO: 840780 - RNA, 22 nt, Human
acuuucuaggucucaguccuuu

SEQ ID NO: 840781 - RNA, 18 nt, Human
uggguggcuagggaguuu

SEQ ID NO: 840782 - RNA, 22 nt, Human
accagagcuggcucugagcacc

SEQ ID NO: 840783 - RNA, 22 nt, Human
uggcagcugcaggccuccugag

SEQ ID NO: 840784 - RNA, 22 nt, Human
gcccuggaaucucuccauggga

SEQ ID NO: 840785 - RNA, 19 nt, Human
uuccaaaaucaggauuuga

SEQ ID NO: 840786 - RNA, 22 nt, Human
ugagggagagggcgaaaaugaa

SEQ ID NO: 840787 - RNA, 17 nt, Human
ugcauuguuggaaauuu

SEQ ID NO: 840788 - RNA, 22 nt, Human
cagagcugcuucccaguuugug

SEQ ID NO: 840789 - RNA, 22 nt, Human
uacauucaacaugucacuaugu

SEQ ID NO: 840790 - RNA, 22 nt, Human
auggaucagaaucccgggaggg

SEQ ID NO: 840791 - RNA, 22 nt, Human
uuguaacaggcacucugugcca

SEQ ID NO: 840792 - RNA, 22 nt, Human
cuacauggagaagaaaauucuu

SEQ ID NO: 840793 - RNA, 22 nt, Human
gugucacaugguuuacugcagc

SEQ ID NO: 840794 - RNA, 22 nt, Human
aucuuguuauaagagauaaugg

SEQ ID NO: 840795 - RNA, 22 nt, Human
ccuccagguguuacauaugacu

SEQ ID NO: 840796 - RNA, 22 nt, Human
auaauuaauuucaguaaucucc

SEQ ID NO: 840797 - RNA, 22 nt, Human
ucaacacucuuuggcacaguua

SEQ ID NO: 840798 - RNA, 22 nt, Human
uuucacuagaacguucuuguuu

SEQ ID NO: 840799 - RNA, 23 nt, Human
guaaaauacgcagugcaguguga

SEQ ID NO: 840800 - RNA, 22 nt, Human
aaagcaaugaugguagacacgu

SEQ ID NO: 840801 - RNA, 22 nt, Human
agcugcucuugggugacuucaa

SEQ ID NO: 840802 - RNA, 22 nt, Human
gagugugucggucagcguggcg

SEQ ID NO: 840803 - RNA, 22 nt, Human
cugaaggagaaggccacuguuc

SEQ ID NO: 840804 - RNA, 22 nt, Human
uaucuugagagacaacacagca

SEQ ID NO: 840805 - RNA, 22 nt, Human
cuguuuaucuaggaguugcagg

SEQ ID NO: 840806 - RNA, 22 nt, Human
ucaaugauaucagcaggaugug

SEQ ID NO: 840807 - RNA, 22 nt, Human
cacagaaucugugacuccaaga

SEQ ID NO: 840808 - RNA, 22 nt, Human
agcugcccagcuaggaagaagg

SEQ ID NO: 840809 - RNA, 22 nt, Human
aucccuggacggcgccucccca

SEQ ID NO: 840810 - RNA, 22 nt, Human
gucagcagugucagcucugggg

SEQ ID NO: 840811 - RNA, 22 nt, Human
gcccaggcuagcguagagugca

SEQ ID NO: 840812 - RNA, 22 nt, Human
cccaggagguggagguugcagc

SEQ ID NO: 840813 - RNA, 22 nt, Human
agcagcugagccccagcuguga

SEQ ID NO: 840814 - RNA, 22 nt, Human
aaccaggacaauuugaauagaa

SEQ ID NO: 840815 - RNA, 22 nt, Human
acccaggagagagcuauaaaau

SEQ ID NO: 840816 - RNA, 22 nt, Human
uuuaauauuucuuuccugaagc

SEQ ID NO: 840817 - RNA, 22 nt, Human
gagcaggcuugcagagaagggg

SEQ ID NO: 840818 - RNA, 22 nt, Human
gcucugggcugcccucuggaca

SEQ ID NO: 840819 - RNA, 22 nt, Human
acuucauuguaauauuauagca

SEQ ID NO: 840820 - RNA, 22 nt, Human
aucagcaaucaaauugcagagu

SEQ ID NO: 840821 - RNA, 22 nt, Human
ugagugccugaacauagaguag

SEQ ID NO: 840822 - RNA, 22 nt, Human
ugucauaaaacacaagcuguug

SEQ ID NO: 840823 - RNA, 22 nt, Human
gccuggccugaacuaggaggug

SEQ ID NO: 840824 - RNA, 22 nt, Human
gccaggaguguguggcuauguu

SEQ ID NO: 840825 - RNA, 17 nt, Human
ggagagugggaauggcc

SEQ ID NO: 840826 - RNA, 22 nt, Human
guuauaaauaccuaauaggauu

SEQ ID NO: 840827 - RNA, 22 nt, Human
cugaggucuagacaccccaggg

SEQ ID NO: 840828 - RNA, 22 nt, Human
ucucuggaauuggcugaggcaa

SEQ ID NO: 840829 - RNA, 22 nt, Human
cuuaagauuugcgauaccuaau

SEQ ID NO: 840830 - RNA, 22 nt, Human
cccuuucccuucuggcucaggg

SEQ ID NO: 840831 - RNA, 22 nt, Human
aagauuucuuacuuauugaugc

SEQ ID NO: 840832 - RNA, 22 nt, Human
ccagguggugaaagugggcccu

SEQ ID NO: 840833 - RNA, 22 nt, Human
uggaggaaucagggcuuaggcu

SEQ ID NO: 840834 - RNA, 22 nt, Human
ggccuugguaaagggaugcaug

SEQ ID NO: 840835 - RNA, 22 nt, Human
aauacuauguagccaaaauaau

SEQ ID NO: 840836 - RNA, 22 nt, Human
cuguucauggaaaaauaguugg

SEQ ID NO: 840837 - RNA, 22 nt, Human
ggaccagagaagugagcaccug

SEQ ID NO: 840838 - RNA, 22 nt, Human
gcugugcacuaccuauacaucc

SEQ ID NO: 840839 - RNA, 22 nt, Human
uaguacaguuuaaauauuaaua

SEQ ID NO: 840840 - RNA, 22 nt, Human
cugaagcaaaggaucgagcuaa

SEQ ID NO: 840841 - RNA, 23 nt, Human
aggucagcaggcaaggaaauggc

SEQ ID NO: 840842 - RNA, 21 nt, Human
aaggaaaagcuuggucucuga

SEQ ID NO: 840843 - RNA, 22 nt, Human
uccacauccauugcuugacuuu

SEQ ID NO: 840844 - RNA, 22 nt, Human
gagguggugguggaggcauagc

SEQ ID NO: 840845 - RNA, 22 nt, Human
uccugggcuugcuccuccagcu

SEQ ID NO: 840846 - RNA, 22 nt, Human
agggcccauagaucgucagcuu

SEQ ID NO: 840847 - RNA, 22 nt, Human
acccaggaaaacauggugcaga

SEQ ID NO: 840848 - RNA, 19 nt, Human
acacugaauguagaauugg

SEQ ID NO: 840849 - RNA, 21 nt, Human
agcagccauggaugguaugua

SEQ ID NO: 840850 - RNA, 22 nt, Human
cauaugaaauaugaguugaaca

SEQ ID NO: 840851 - RNA, 22 nt, Human
ucuauacugaugggauacuauu

SEQ ID NO: 840852 - RNA, 22 nt, Human
cacaguggauugggugaugccc

SEQ ID NO: 840853 - RNA, 22 nt, Human
uauguaaaaauucaucaggcug

SEQ ID NO: 840854 - RNA, 20 nt, Human
cagccuccacucacucagcu

SEQ ID NO: 840855 - RNA, 22 nt, Human
aucagcaagcaugguuaggugu

SEQ ID NO: 840856 - RNA, 22 nt, Human
cagggcagggauguugcggcag

SEQ ID NO: 840857 - RNA, 22 nt, Human
cagggugcagugucgcugcuag

SEQ ID NO: 840858 - RNA, 22 nt, Human
uuagaaaucaccucugaagauc

SEQ ID NO: 840859 - RNA, 22 nt, Human
cagggagaucuuggcuccuggu

SEQ ID NO: 840860 - RNA, 22 nt, Human
aaagaauagccuuuguccaaau

SEQ ID NO: 840861 - RNA, 22 nt, Human
acauugaucagccucccaugca

SEQ ID NO: 840862 - RNA, 22 nt, Human
uuugcauaaaggagcauuucuc

SEQ ID NO: 840863 - RNA, 22 nt, Human
acccaggacacagagaugaccc

SEQ ID NO: 840864 - RNA, 22 nt, Human
ucaggagacuuaugucacagug

SEQ ID NO: 840865 - RNA, 22 nt, Human
gcaaaugcucuccuuggucagg

SEQ ID NO: 840866 - RNA, 22 nt, Human
agcugcucugauaaaccuacuu

SEQ ID NO: 840867 - RNA, 22 nt, Human
agugcuuuaccuagauaauguu

SEQ ID NO: 840868 - RNA, 22 nt, Human
cucacaggagaaagucaugguc

SEQ ID NO: 840869 - RNA, 20 nt, Human
aucagcaacugccacucagu

SEQ ID NO: 840870 - RNA, 22 nt, Human
cacauuuaauccuuuauaagua

SEQ ID NO: 840871 - RNA, 22 nt, Human
aaagguaguacuucuagaaggg

SEQ ID NO: 840872 - RNA, 22 nt, Human
uuaauuaugcaaaaggccccau

SEQ ID NO: 840873 - RNA, 22 nt, Human
aggcacugacagauucuguguc

SEQ ID NO: 840874 - RNA, 22 nt, Human
uacuacauuaauaaaacauuca

SEQ ID NO: 840875 - RNA, 22 nt, Human
ugcuuagacgucaaguacagcc

SEQ ID NO: 840876 - RNA, 22 nt, Human
uagaaagugaagguuaauuaau

SEQ ID NO: 840877 - RNA, 22 nt, Human
ucucauucauacccuacaugcu

SEQ ID NO: 840878 - RNA, 22 nt, Human
gucuaacaagcauuaggaaccc

SEQ ID NO: 840879 - RNA, 22 nt, Human
aaggcacugacugugcagggga

SEQ ID NO: 840880 - RNA, 22 nt, Human
caggggcucugagauugucuaa

SEQ ID NO: 840881 - RNA, 22 nt, Human
cuugcuggugguguuuucuaug

SEQ ID NO: 840882 - RNA, 22 nt, Human
aucuguuccccuaugcucucua

SEQ ID NO: 840883 - RNA, 22 nt, Human
auuaaagacagcagauggaugg

SEQ ID NO: 840884 - RNA, 22 nt, Human
acccaggaggcaagguugcagu

SEQ ID NO: 840885 - RNA, 20 nt, Human
ugaggcaggagaauggcaug

SEQ ID NO: 840886 - RNA, 22 nt, Human
gugcgccagcucaaggggaggc

SEQ ID NO: 840887 - RNA, 22 nt, Human
gcugagagaaaagugagguucu

SEQ ID NO: 840888 - RNA, 19 nt, Human
ccagagcccgccagauggg

SEQ ID NO: 840889 - RNA, 22 nt, Human
ccagcaccuugaucuuggaguu

SEQ ID NO: 840890 - RNA, 22 nt, Human
cugccugugccaccgccucauu

SEQ ID NO: 840891 - RNA, 22 nt, Human
gccucuggggcagcugagucau

SEQ ID NO: 840892 - RNA, 22 nt, Human
cccaggaggcagagauagcagu

SEQ ID NO: 840893 - RNA, 22 nt, Human
gaggcagcagggcugguuccuu

SEQ ID NO: 840894 - RNA, 22 nt, Human
auuccaaagccugaauaaugga

SEQ ID NO: 840895 - RNA, 22 nt, Human
cuggucugagggcucuugaggc

SEQ ID NO: 840896 - RNA, 22 nt, Human
aguacauauaguaauuuagcca

SEQ ID NO: 840897 - RNA, 22 nt, Human
cugcucugagaggcucuuccua

SEQ ID NO: 840898 - RNA, 22 nt, Human
aagggacuuugucagcuuucca

SEQ ID NO: 840899 - RNA, 22 nt, Human
cagaaauguacugacaugcagu

SEQ ID NO: 840900 - RNA, 22 nt, Human
uguauaaaccauggacagcuuu

SEQ ID NO: 840901 - RNA, 22 nt, Human
gcaacuuuagggccagcaagua

SEQ ID NO: 840902 - RNA, 22 nt, Human
ugccugucuuuccucccucgua

SEQ ID NO: 840903 - RNA, 23 nt, Human
gcugcagcuguggauguucucag

SEQ ID NO: 840904 - RNA, 22 nt, Human
acacugcagaugaaagcauaag

SEQ ID NO: 840905 - RNA, 22 nt, Human
ggagugggcagcacugcccugu

SEQ ID NO: 840906 - RNA, 22 nt, Human
ucugggggcgaccagggacugc

SEQ ID NO: 840907 - RNA, 22 nt, Human
aaacaaacaauuaguugugugg

SEQ ID NO: 840908 - RNA, 22 nt, Human
uggaggaaaaaaccaggcagag

SEQ ID NO: 840909 - RNA, 22 nt, Human
uuuuguuguaauauaccuaucc

SEQ ID NO: 840910 - RNA, 22 nt, Human
gccuucugauaucucuuggcau

SEQ ID NO: 840911 - RNA, 21 nt, Human
uuucuucacuuugccccaugu

SEQ ID NO: 840912 - RNA, 22 nt, Human
agcagccagagucugaacauua

SEQ ID NO: 840913 - RNA, 22 nt, Human
auuucaggauagccuaguuuug

SEQ ID NO: 840914 - RNA, 22 nt, Human
guuucauacagauuauucaugg

SEQ ID NO: 840915 - RNA, 22 nt, Human
ggccucugguucacagggagga

SEQ ID NO: 840916 - RNA, 22 nt, Human
ugaagcccugugucagcuucca

SEQ ID NO: 840917 - RNA, 22 nt, Human
cugagagucagcuucuccuccu

SEQ ID NO: 840918 - RNA, 22 nt, Human
ggcugugccucaaggcuacuca

SEQ ID NO: 840919 - RNA, 22 nt, Human
uggagcugagagccaggcuggc

SEQ ID NO: 840920 - RNA, 22 nt, Human
cuggagcuccagggucuccucu

SEQ ID NO: 840921 - RNA, 22 nt, Human
uagauaaauuagaaaguuuacu

SEQ ID NO: 840922 - RNA, 22 nt, Human
gucauuccuauccauuugauac

SEQ ID NO: 840923 - RNA, 22 nt, Human
cccuugcacauuugucuuuaau

SEQ ID NO: 840924 - RNA, 22 nt, Human
uuuauugcauacacaaauguca

SEQ ID NO: 840925 - RNA, 22 nt, Human
cccuggagggauuucucaauca

SEQ ID NO: 840926 - RNA, 22 nt, Human
ugaauaaucauguccauagugu

SEQ ID NO: 840927 - RNA, 22 nt, Human
agcugccaggccccugagaacc

SEQ ID NO: 840928 - RNA, 22 nt, Human
uuaaauauuauguugucugcaa

SEQ ID NO: 840929 - RNA, 22 nt, Human
ucagagugaggcccagcaaucu

SEQ ID NO: 840930 - RNA, 17 nt, Human
cuggagccuccaacucc

SEQ ID NO: 840931 - RNA, 22 nt, Human
ggccaggagaggagggcacuga

SEQ ID NO: 840932 - RNA, 22 nt, Human
acagggcagguggcuacugguc

SEQ ID NO: 840933 - RNA, 22 nt, Human
ucacuuuugaucccuaugcagu

SEQ ID NO: 840934 - RNA, 22 nt, Human
gccuggcccagggcucuuguug

SEQ ID NO: 840935 - RNA, 22 nt, Human
ugucaugcccaggagcaaggua

SEQ ID NO: 840936 - RNA, 21 nt, Human
ugcucaugcaaugcaugucca

SEQ ID NO: 840937 - RNA, 22 nt, Human
acauuucugcauguaggguaau

SEQ ID NO: 840938 - RNA, 22 nt, Human
uccuugaauccuagcauccuau

SEQ ID NO: 840939 - RNA, 22 nt, Human
caauuucauuaauagauauaga

SEQ ID NO: 840940 - RNA, 20 nt, Human
gaaaugugaccucuucugug

SEQ ID NO: 840941 - RNA, 22 nt, Human
ugcagaagcagagaguugccaa

SEQ ID NO: 840942 - RNA, 22 nt, Human
gggcagcugucuugguucucaa

SEQ ID NO: 840943 - RNA, 22 nt, Human
aucagcaucuuuaacaauuacc

SEQ ID NO: 840944 - RNA, 22 nt, Human
ucagggcaagauugguuaauaa

SEQ ID NO: 840945 - RNA, 22 nt, Human
cacaauguauauguauaucaaa

SEQ ID NO: 840946 - RNA, 20 nt, Human
uuucacaaugaacaugucuc

SEQ ID NO: 840947 - RNA, 23 nt, Human
ccugcagcugcuggggcuccacc

SEQ ID NO: 840948 - RNA, 20 nt, Human
uuuuuccuucucuacaggca

SEQ ID NO: 840949 - RNA, 22 nt, Human
aaagauuucacaucccaagccu

SEQ ID NO: 840950 - RNA, 22 nt, Human
ccacacagucaguuuccaagaa

SEQ ID NO: 840951 - RNA, 22 nt, Human
uuuagaaugugacuguauuuga

SEQ ID NO: 840952 - RNA, 17 nt, Human
gguguauggggagggaa

SEQ ID NO: 840953 - RNA, 22 nt, Human
auggccuggggagcaugggaag

SEQ ID NO: 840954 - RNA, 22 nt, Human
uuugaagucaggcuuucuaccc

SEQ ID NO: 840955 - RNA, 22 nt, Human
uuacagaaugugccauuugguc

SEQ ID NO: 840956 - RNA, 22 nt, Human
agccacagggggugagggacaa

SEQ ID NO: 840957 - RNA, 22 nt, Human
uguaccuuuuucugugcaugcu

SEQ ID NO: 840958 - RNA, 19 nt, Human
cugagagaugcuucacaca

SEQ ID NO: 840959 - RNA, 17 nt, Human
ucuguucaugcauaccu

SEQ ID NO: 840960 - RNA, 22 nt, Human
accccagcccugcuucugggag

SEQ ID NO: 840961 - RNA, 22 nt, Human
aagucacccacaggcagcagaa

SEQ ID NO: 840962 - RNA, 22 nt, Human
gagaaagauguaggcugggagg

SEQ ID NO: 840963 - RNA, 22 nt, Human
cggaggggauacauuuucugaa

SEQ ID NO: 840964 - RNA, 22 nt, Human
uauuucuguaugcauaaaagga

SEQ ID NO: 840965 - RNA, 22 nt, Human
accuuucacgguaucagacauc

SEQ ID NO: 840966 - RNA, 22 nt, Human
ccucauggaccucagacugucc

SEQ ID NO: 840967 - RNA, 22 nt, Human
ucauccaguucacauggugagu

SEQ ID NO: 840968 - RNA, 22 nt, Human
augaaauauuucagagcagagu

SEQ ID NO: 840969 - RNA, 22 nt, Human
auacauguucguguacauguuc

SEQ ID NO: 840970 - RNA, 22 nt, Human
augcugaauugaugcgagggag

SEQ ID NO: 840971 - RNA, 22 nt, Human
gauagaaagaauauagauucca

SEQ ID NO: 840972 - RNA, 22 nt, Human
ucaguagcagaaagcaaugagu

SEQ ID NO: 840973 - RNA, 22 nt, Human
uuuuccuaguaggccuauuaga

SEQ ID NO: 840974 - RNA, 23 nt, Human
aggcccugccugucccucuuuuu

SEQ ID NO: 840975 - RNA, 22 nt, Human
gccuggagacagcagaggcggc

SEQ ID NO: 840976 - RNA, 22 nt, Human
ucuggcucggauuugucuagca

SEQ ID NO: 840977 - RNA, 18 nt, Human
gcaggugccacugcuguu

SEQ ID NO: 840978 - RNA, 22 nt, Human
ucugcagcuuuuugguggggug

SEQ ID NO: 840979 - RNA, 22 nt, Human
ugaucugagagcagaucaccau

SEQ ID NO: 840980 - RNA, 22 nt, Human
cagcugccuaugaccuagccuc

SEQ ID NO: 840981 - RNA, 17 nt, Human
acacagccagguucucc

SEQ ID NO: 840982 - RNA, 22 nt, Human
agcugggaugauaaccucaguc

SEQ ID NO: 840983 - RNA, 22 nt, Human
uaacacauuuuaagccauuuua

SEQ ID NO: 840984 - RNA, 22 nt, Human
ccagagcccagggucaugcagg

SEQ ID NO: 840985 - RNA, 22 nt, Human
caugaaaucugaguauguuucc

SEQ ID NO: 840986 - RNA, 22 nt, Human
acuuucugcaguguuggaaaug

SEQ ID NO: 840987 - RNA, 22 nt, Human
gcacccaggcuugggcagcaac

SEQ ID NO: 840988 - RNA, 22 nt, Human
agagcccucuucacugccccuu

SEQ ID NO: 840989 - RNA, 19 nt, Human
acauauguggauauacaug

SEQ ID NO: 840990 - RNA, 22 nt, Human
ggagccuggccuggcucugugu

SEQ ID NO: 840991 - RNA, 22 nt, Human
acaaagguggaccauguggcuu

SEQ ID NO: 840992 - RNA, 22 nt, Human
aaugguuuucuagaacaugaaa

SEQ ID NO: 840993 - RNA, 22 nt, Human
ucagccaguuugauucuauuug

SEQ ID NO: 840994 - RNA, 22 nt, Human
gcccauggacacccaagugcca

SEQ ID NO: 840995 - RNA, 20 nt, Human
acaauagauuugagcaaagu

SEQ ID NO: 840996 - RNA, 22 nt, Human
cugcaggaauucaaagugagcu

SEQ ID NO: 840997 - RNA, 22 nt, Human
gaagcccaggcuuccuuggcuu

SEQ ID NO: 840998 - RNA, 22 nt, Human
cuggaaauuggagaugauguuu

SEQ ID NO: 840999 - RNA, 22 nt, Human
caguccuuggcuucauccgagu

SEQ ID NO: 841000 - RNA, 22 nt, Human
caaagucauggggaugcagguc

SEQ ID NO: 841001 - RNA, 22 nt, Human
guuaucaugcuucaucaucacu

SEQ ID NO: 841002 - RNA, 19 nt, Human
agauuuaccucauauaguu

SEQ ID NO: 841003 - RNA, 21 nt, Human
ccugggagaucagcugccuuc

SEQ ID NO: 841004 - RNA, 23 nt, Human
uugugggcagauuccauggggag

SEQ ID NO: 841005 - RNA, 22 nt, Human
aaguccuuguauacagaaucaa

SEQ ID NO: 841006 - RNA, 22 nt, Human
agugguaacuaaguccugcuua

SEQ ID NO: 841007 - RNA, 22 nt, Human
acauuucuuucuauucaguagc

SEQ ID NO: 841008 - RNA, 22 nt, Human
auccugggaagcugacauugaa

SEQ ID NO: 841009 - RNA, 22 nt, Human
uugcauugaucccagcuugggc

SEQ ID NO: 841010 - RNA, 22 nt, Human
agauuucccucuuguauuugca

SEQ ID NO: 841011 - RNA, 22 nt, Human
uugcauaaaagaguauaucuua

SEQ ID NO: 841012 - RNA, 22 nt, Human
auggcuuaagaaugcuuuugug

SEQ ID NO: 841013 - RNA, 22 nt, Human
auacauauaugguacuuccugg

SEQ ID NO: 841014 - RNA, 22 nt, Human
agaauaaaucaaauguccugag

SEQ ID NO: 841015 - RNA, 22 nt, Human
aucagcaagauugugucuugua

SEQ ID NO: 841016 - RNA, 22 nt, Human
cugagcugggcucucuugaggg

SEQ ID NO: 841017 - RNA, 22 nt, Human
cacacaugucucuccaugcucu

SEQ ID NO: 841018 - RNA, 22 nt, Human
agcacauucugccuugcuuugc

SEQ ID NO: 841019 - RNA, 22 nt, Human
cagcaucuaaucuucaugccgg

SEQ ID NO: 841020 - RNA, 22 nt, Human
ucuucucucauguaggagggaa

SEQ ID NO: 841021 - RNA, 22 nt, Human
acauuugaggauguuaagaaug

SEQ ID NO: 841022 - RNA, 21 nt, Human
gggugggaggacacagcaggc

SEQ ID NO: 841023 - RNA, 22 nt, Human
uaucagaaggcacauggagucu

SEQ ID NO: 841024 - RNA, 22 nt, Human
uucugucaaaugccaguagaga

SEQ ID NO: 841025 - RNA, 22 nt, Human
gcucuggguagccacugccugg

SEQ ID NO: 841026 - RNA, 22 nt, Human
uccagggccaagucauggaacc

SEQ ID NO: 841027 - RNA, 22 nt, Human
aucugucaagauagacucugca

SEQ ID NO: 841028 - RNA, 22 nt, Human
gagggcagagacagugauucac

SEQ ID NO: 841029 - RNA, 22 nt, Human
augaaaauguacauguguauaa

SEQ ID NO: 841030 - RNA, 22 nt, Human
ugugcucuggaguugccuucac

SEQ ID NO: 841031 - RNA, 22 nt, Human
acucucagaggguggcagcaau

SEQ ID NO: 841032 - RNA, 19 nt, Human
acuuucuccaggaccuguu

SEQ ID NO: 841033 - RNA, 22 nt, Human
cacugccuggaaggagagacau

SEQ ID NO: 841034 - RNA, 22 nt, Human
aaugcuagugugauauguaagg

SEQ ID NO: 841035 - RNA, 23 nt, Human
cuucucagaagucugugccagga

SEQ ID NO: 841036 - RNA, 19 nt, Human
agggagaauuccaagagga

SEQ ID NO: 841037 - RNA, 22 nt, Human
cccagcuccgagcuccgagccg

SEQ ID NO: 841038 - RNA, 22 nt, Human
uagcaucuguucuuucauuaaa

SEQ ID NO: 841039 - RNA, 22 nt, Human
aggauuuacuagcaaggauucu

SEQ ID NO: 841040 - RNA, 22 nt, Human
ucuuggagaauggcagagaagc

SEQ ID NO: 841041 - RNA, 22 nt, Human
agagccagagaccuggguucac

SEQ ID NO: 841042 - RNA, 23 nt, Human
aaauucaguccuucaacucugag

SEQ ID NO: 841043 - RNA, 18 nt, Human
uggacaggguggagaaaa

SEQ ID NO: 841044 - RNA, 22 nt, Human
ugagcuucaaaauaugugaauc

SEQ ID NO: 841045 - RNA, 22 nt, Human
ggccugucucacccccgggugc

SEQ ID NO: 841046 - RNA, 22 nt, Human
uggcagcugguacagugggucu

SEQ ID NO: 841047 - RNA, 22 nt, Human
cacaggguuguucugaggauuc

SEQ ID NO: 841048 - RNA, 20 nt, Human
caucagaaauccugacccac

SEQ ID NO: 841049 - RNA, 22 nt, Human
aagcaauaagccagauuuggau

SEQ ID NO: 841050 - RNA, 22 nt, Human
gaaagccaucuggcugcuggga

SEQ ID NO: 841051 - RNA, 22 nt, Human
cuggcagcguguuuaugaacau

SEQ ID NO: 841052 - RNA, 22 nt, Human
gguccccagcaguggcugcuuc

SEQ ID NO: 841053 - RNA, 22 nt, Human
gcugagaggcacuaucuccgga

SEQ ID NO: 841054 - RNA, 22 nt, Human
uguuuauuacaguucuuggaau

SEQ ID NO: 841055 - RNA, 22 nt, Human
augacaguucuacacuuaaucu

SEQ ID NO: 841056 - RNA, 22 nt, Human
gagaaacuuggaguuauucugg

SEQ ID NO: 841057 - RNA, 22 nt, Human
uuccaaaccucaaauaauuaau

SEQ ID NO: 841058 - RNA, 22 nt, Human
uguaaauaauuccuaggcuuuu

SEQ ID NO: 841059 - RNA, 22 nt, Human
auccuugacacacuccaguacu

SEQ ID NO: 841060 - RNA, 22 nt, Human
agcugguucagaaauuagaugg

SEQ ID NO: 841061 - RNA, 22 nt, Human
ucugccuggguguggagcagag

SEQ ID NO: 841062 - RNA, 22 nt, Human
aguggggacuuaugccagcauu

SEQ ID NO: 841063 - RNA, 17 nt, Human
uucucugagcuguauug

SEQ ID NO: 841064 - RNA, 22 nt, Human
uuucaaauagaaucuuuccaaa

SEQ ID NO: 841065 - RNA, 22 nt, Human
cagcaggguauacagggaauuu

SEQ ID NO: 841066 - RNA, 22 nt, Human
caccaggcugaaccagagggga

SEQ ID NO: 841067 - RNA, 22 nt, Human
gggccugacugagagcuccuca

SEQ ID NO: 841068 - RNA, 22 nt, Human
cugccucuccccagaguggccc

SEQ ID NO: 841069 - RNA, 22 nt, Human
aaugcugcucucauaauuauag

SEQ ID NO: 841070 - RNA, 22 nt, Human
ggccagcugggccaccaggugc

SEQ ID NO: 841071 - RNA, 22 nt, Human
cugucccuucauuauucacuac

SEQ ID NO: 841072 - RNA, 22 nt, Human
cugggguggaggagcuccccug

SEQ ID NO: 841073 - RNA, 22 nt, Human
cagagccucagaauccugugga

SEQ ID NO: 841074 - RNA, 22 nt, Human
cuugcugggguaagucugugcu

SEQ ID NO: 841075 - RNA, 21 nt, Human
cccagggaagccgcagucacc

SEQ ID NO: 841076 - RNA, 22 nt, Human
cugggccugggaggccaggucu

SEQ ID NO: 841077 - RNA, 22 nt, Human
ggccagcucugcacagcagcug

SEQ ID NO: 841078 - RNA, 21 nt, Human
agacagagugcagucuacaua

SEQ ID NO: 841079 - RNA, 22 nt, Human
uggcuggcuagugggcaggauu

SEQ ID NO: 841080 - RNA, 20 nt, Human
cugagcccccagccugcagg

SEQ ID NO: 841081 - RNA, 22 nt, Human
ccaggacagugaacauguaaga

SEQ ID NO: 841082 - RNA, 22 nt, Human
cugggcuacguguugacagcau

SEQ ID NO: 841083 - RNA, 22 nt, Human
cugcccugacugaccuuuugaa

SEQ ID NO: 841084 - RNA, 22 nt, Human
uagauuucucauucauagauug

SEQ ID NO: 841085 - RNA, 22 nt, Human
cauuuacauuuaagguuaauau

SEQ ID NO: 841086 - RNA, 22 nt, Human
auucagagcacuggguagaauu

SEQ ID NO: 841087 - RNA, 22 nt, Human
agagggagcccagucauagcug

SEQ ID NO: 841088 - RNA, 22 nt, Human
caauuuuuaaacuaugaaguug

SEQ ID NO: 841089 - RNA, 23 nt, Human
uggauaaagcugugcugcauagg

SEQ ID NO: 841090 - RNA, 22 nt, Human
gagugagggcagcaggggcugc

SEQ ID NO: 841091 - RNA, 22 nt, Human
ugggccugggcuccuguccucu

SEQ ID NO: 841092 - RNA, 22 nt, Human
gagagugaugaaugguuaaaca

SEQ ID NO: 841093 - RNA, 22 nt, Human
guuuauaaggcccaauauuucu

SEQ ID NO: 841094 - RNA, 22 nt, Human
ccaggagccacucaggcccaca

SEQ ID NO: 841095 - RNA, 22 nt, Human
ugagccuggggccugggcagcg

SEQ ID NO: 841096 - RNA, 19 nt, Human
gcacacccugcaccaccau

SEQ ID NO: 841097 - RNA, 22 nt, Human
ugaggccacuuccccacagccc

SEQ ID NO: 841098 - RNA, 22 nt, Human
ccagcugaggcagccacacagg

SEQ ID NO: 841099 - RNA, 22 nt, Human
cugccugugugugccugcagaa

SEQ ID NO: 841100 - RNA, 22 nt, Human
cugcucugaagccaggauucug

SEQ ID NO: 841101 - RNA, 22 nt, Human
cugaggcucaagggcagguggg

SEQ ID NO: 841102 - RNA, 22 nt, Human
ccuggcagcagcacaugccuuc

SEQ ID NO: 841103 - RNA, 17 nt, Human
ggccuguguggcugcag

SEQ ID NO: 841104 - RNA, 22 nt, Human
cucugggcaaguaugauagaaa

SEQ ID NO: 841105 - RNA, 22 nt, Human
ccugaggcccuggcugugcuga

SEQ ID NO: 841106 - RNA, 22 nt, Human
ggccacuccgcugcuacuggaa

SEQ ID NO: 841107 - RNA, 18 nt, Human
ugggcugccuggccucug

SEQ ID NO: 841108 - RNA, 22 nt, Human
acacagggggcauucuaggagu

SEQ ID NO: 841109 - RNA, 22 nt, Human
aggaggccgcugaugggcuccc

SEQ ID NO: 841110 - RNA, 23 nt, Human
gccugggacugguagugugaccu

SEQ ID NO: 841111 - RNA, 22 nt, Human
cccagcuccuuggaugggcagg

SEQ ID NO: 841112 - RNA, 22 nt, Human
uucagaauauuuguuuuacaug

SEQ ID NO: 841113 - RNA, 22 nt, Human
ggcuucagugagcugagcucac

SEQ ID NO: 841114 - RNA, 22 nt, Human
cagggccaugaggcacaggguc

SEQ ID NO: 841115 - RNA, 22 nt, Human
gugcugugcgcuuuuucuguau

SEQ ID NO: 841116 - RNA, 22 nt, Human
cccaggaagagugaguggcauu

SEQ ID NO: 841117 - RNA, 22 nt, Human
gaauguaauagucaguagaaca

SEQ ID NO: 841118 - RNA, 22 nt, Human
aaauuauuaugccccucuauaa

SEQ ID NO: 841119 - RNA, 22 nt, Human
aauaucuucuaaggauagaacu

SEQ ID NO: 841120 - RNA, 22 nt, Human
cuuucucugugugguaaagggc

SEQ ID NO: 841121 - RNA, 22 nt, Human
gcuuggaaguaggauugggaga

SEQ ID NO: 841122 - RNA, 18 nt, Human
aaaugcuaggcuacauga

SEQ ID NO: 841123 - RNA, 22 nt, Human
agauuccagaucccaaaaauga

SEQ ID NO: 841124 - RNA, 22 nt, Human
gcugcucuugaggggcucacug

SEQ ID NO: 841125 - RNA, 22 nt, Human
uuucauaauacuguacaugaaa

SEQ ID NO: 841126 - RNA, 22 nt, Human
acacagggaggaggugcugugc

SEQ ID NO: 841127 - RNA, 22 nt, Human
gcuucauuacugacagucugug

SEQ ID NO: 841128 - RNA, 17 nt, Human
gcugccaccuuuggagc

SEQ ID NO: 841129 - RNA, 22 nt, Human
gaagcacauggcuauagcuauu

SEQ ID NO: 841130 - RNA, 20 nt, Human
gagagcuggggaugaggcug

SEQ ID NO: 841131 - RNA, 22 nt, Human
ggaggggcagccauggaacucc

SEQ ID NO: 841132 - RNA, 22 nt, Human
guauccuuugcggaaauuucua

SEQ ID NO: 841133 - RNA, 20 nt, Human
agaguaacuggcacauaggg

SEQ ID NO: 841134 - RNA, 22 nt, Human
agaggagguccuuuucugaugu

SEQ ID NO: 841135 - RNA, 22 nt, Human
ggcucugcgcgguaaagugacu

SEQ ID NO: 841136 - RNA, 22 nt, Human
uuuggacaaguuacugguuucc

SEQ ID NO: 841137 - RNA, 22 nt, Human
ccuggggagaagagcuuccccc

SEQ ID NO: 841138 - RNA, 22 nt, Human
ccuuccuggcuguccgccugau

SEQ ID NO: 841139 - RNA, 22 nt, Human
gcaguucuacuuauccauagac

SEQ ID NO: 841140 - RNA, 22 nt, Human
ccucaggggugcccacagcugc

SEQ ID NO: 841141 - RNA, 22 nt, Human
guuugcauuuauuagucuucug

SEQ ID NO: 841142 - RNA, 22 nt, Human
gcaaacaagcugccugaagauu

SEQ ID NO: 841143 - RNA, 23 nt, Human
aggagaagagauuuccacaugca

SEQ ID NO: 841144 - RNA, 22 nt, Human
acccaggaggugacacagggcu

SEQ ID NO: 841145 - RNA, 22 nt, Human
uggcagcuggaucccaaggcag

SEQ ID NO: 841146 - RNA, 22 nt, Human
ucuuugaauuucugacugucuu

SEQ ID NO: 841147 - RNA, 22 nt, Human
acauuccaaaaacuagcagaua

SEQ ID NO: 841148 - RNA, 22 nt, Human
caggauccuggcugcauggacg

SEQ ID NO: 841149 - RNA, 22 nt, Human
agcagcugcagggagggucugc

SEQ ID NO: 841150 - RNA, 21 nt, Human
cucacaggaugcaguguuacu

SEQ ID NO: 841151 - RNA, 22 nt, Human
agaaaucugacugcugugcaca

SEQ ID NO: 841152 - RNA, 22 nt, Human
ucccaggacaugggcucugcuc

SEQ ID NO: 841153 - RNA, 22 nt, Human
cagagguagaaggcaugcagug

SEQ ID NO: 841154 - RNA, 22 nt, Human
cagggccacccucugcugggug

SEQ ID NO: 841155 - RNA, 22 nt, Human
ucaaugaugcugaagguagcgu

SEQ ID NO: 841156 - RNA, 22 nt, Human
gcuggccauggggagugaggag

SEQ ID NO: 841157 - RNA, 22 nt, Human
gccuggcaaggcccuguugacu

SEQ ID NO: 841158 - RNA, 22 nt, Human
ugccuaggaaaccucaugcuuc

SEQ ID NO: 841159 - RNA, 22 nt, Human
auggaaagcuaagccauuuacc

SEQ ID NO: 841160 - RNA, 22 nt, Human
uggcuggggccugaauccugca

SEQ ID NO: 841161 - RNA, 22 nt, Human
ucaaauaaugccauucaucauc

SEQ ID NO: 841162 - RNA, 22 nt, Human
aagcagcugauuucacagcuca

SEQ ID NO: 841163 - RNA, 22 nt, Human
aacucaguucuuuccacaaugc

SEQ ID NO: 841164 - RNA, 22 nt, Human
aagcaauagcaacaacuuuaca

SEQ ID NO: 841165 - RNA, 22 nt, Human
aaggcccuggccccagcuucuu

SEQ ID NO: 841166 - RNA, 22 nt, Human
ugcugccuugaccuccugggcu

SEQ ID NO: 841167 - RNA, 22 nt, Human
uucugggacaucuggacaguuu

SEQ ID NO: 841168 - RNA, 22 nt, Human
cuuaacagcaagaucuguguca

SEQ ID NO: 841169 - RNA, 22 nt, Human
uuucugaaaucucuuuugagga

SEQ ID NO: 841170 - RNA, 22 nt, Human
uggagucugugaugcucugggu

SEQ ID NO: 841171 - RNA, 22 nt, Human
acaguaauauugaugcucguca

SEQ ID NO: 841172 - RNA, 23 nt, Human
uggcucagcuaguuuuccauuuc

SEQ ID NO: 841173 - RNA, 22 nt, Human
agcagcugucccuuaacaucag

SEQ ID NO: 841174 - RNA, 22 nt, Human
uaacagaaaggcucaggugcuc

SEQ ID NO: 841175 - RNA, 22 nt, Human
guggccaggacauugccaggca

SEQ ID NO: 841176 - RNA, 22 nt, Human
gccuggagagcacugugcgcuu

SEQ ID NO: 841177 - RNA, 22 nt, Human
gagaaagacguaggcugggagg

SEQ ID NO: 841178 - RNA, 22 nt, Human
gcacaauaauuuuuuuaagagg

SEQ ID NO: 841179 - RNA, 22 nt, Human
agagaagacuuacagccacagu

SEQ ID NO: 841180 - RNA, 22 nt, Human
caggcugggaacgccacccgcu

SEQ ID NO: 841181 - RNA, 22 nt, Human
uaaauguguuguggaugaaguu

SEQ ID NO: 841182 - RNA, 22 nt, Human
guggccuggaguuugauguagg

SEQ ID NO: 841183 - RNA, 22 nt, Human
uuggaucagaugauaucuuugu

SEQ ID NO: 841184 - RNA, 22 nt, Human
aucugguuuggggauccuugug

SEQ ID NO: 841185 - RNA, 22 nt, Human
ggaggaugagcuacgaggagcu

SEQ ID NO: 841186 - RNA, 22 nt, Human
cucaggcccacagcagacccac

SEQ ID NO: 841187 - RNA, 22 nt, Human
ucagccugcgucauggugacac

SEQ ID NO: 841188 - RNA, 22 nt, Human
cugguccuccuugccuucagau

SEQ ID NO: 841189 - RNA, 22 nt, Human
agcccucauggaacagcuccua

SEQ ID NO: 841190 - RNA, 22 nt, Human
gcagaaggucuggcacuucagg

SEQ ID NO: 841191 - RNA, 22 nt, Human
cugggagagaagcgaagcuggg

SEQ ID NO: 841192 - RNA, 20 nt, Human
gauuucaaagcagaguggcc

SEQ ID NO: 841193 - RNA, 19 nt, Human
aaacacagauuucuuacca

SEQ ID NO: 841194 - RNA, 22 nt, Human
aaucagcuaaauaaacuaguca

SEQ ID NO: 841195 - RNA, 22 nt, Human
auuucaacacuuuuggaauuag

SEQ ID NO: 841196 - RNA, 22 nt, Human
ggagaggauguuuuaguaacuu

SEQ ID NO: 841197 - RNA, 22 nt, Human
uucauaaucaccaaaaacugga

SEQ ID NO: 841198 - RNA, 22 nt, Human
gagcuuccacucuagaaggagu

SEQ ID NO: 841199 - RNA, 22 nt, Human
gaggcugcuguuagcccugggc

SEQ ID NO: 841200 - RNA, 22 nt, Human
ucauagaagcaccagaagauau

SEQ ID NO: 841201 - RNA, 22 nt, Human
gcccugagggguggugucugua

SEQ ID NO: 841202 - RNA, 22 nt, Human
augaagcugaaaaaggcauaua

SEQ ID NO: 841203 - RNA, 22 nt, Human
cucugggcaggaccaguggacc

SEQ ID NO: 841204 - RNA, 22 nt, Human
uuugcaaagaaauuauugcugu

SEQ ID NO: 841205 - RNA, 22 nt, Human
ccaaggagaaaugcugugcuuu

SEQ ID NO: 841206 - RNA, 22 nt, Human
ucacagugaugacgugggagca

SEQ ID NO: 841207 - RNA, 22 nt, Human
gauaaaauucuuauuuuacccg

SEQ ID NO: 841208 - RNA, 22 nt, Human
uuuaagauucaguaaggcaaac

SEQ ID NO: 841209 - RNA, 22 nt, Human
agagccagccuucucagcuuac

SEQ ID NO: 841210 - RNA, 22 nt, Human
caugggcucuucuggacugcac

SEQ ID NO: 841211 - RNA, 22 nt, Human
augguuuuguccucuuugguuc

SEQ ID NO: 841212 - RNA, 22 nt, Human
augcauaauguauguauugacu

SEQ ID NO: 841213 - RNA, 23 nt, Human
gugcaugugucuuuacaguagca

SEQ ID NO: 841214 - RNA, 22 nt, Human
ggcaugcugcguacagaugaac

SEQ ID NO: 841215 - RNA, 22 nt, Human
gcguggugcugcccugcacaca

SEQ ID NO: 841216 - RNA, 22 nt, Human
uauucacaggcuggagugaugu

SEQ ID NO: 841217 - RNA, 22 nt, Human
aaggcagcaugaaucccuguac

SEQ ID NO: 841218 - RNA, 22 nt, Human
ggagauagacuuggugagccac

SEQ ID NO: 841219 - RNA, 22 nt, Human
aggccuggugaaugaaguaucu

SEQ ID NO: 841220 - RNA, 22 nt, Human
acaguaauaaguguuggugagg

SEQ ID NO: 841221 - RNA, 22 nt, Human
cuaaaugacuuccagugguuau

SEQ ID NO: 841222 - RNA, 22 nt, Human
aggccagcuuccagaggggcag

SEQ ID NO: 841223 - RNA, 22 nt, Human
cucacaggcaucucaucaggcu

SEQ ID NO: 841224 - RNA, 22 nt, Human
augcuguggaugccuugcccca

SEQ ID NO: 841225 - RNA, 22 nt, Human
cugggcugucaauggcccucug

SEQ ID NO: 841226 - RNA, 22 nt, Human
ugaugggaaaaugaggccuggg

SEQ ID NO: 841227 - RNA, 22 nt, Human
ucuggccagugaaaugcagaau

SEQ ID NO: 841228 - RNA, 22 nt, Human
gcagcagaugcuuucauggaca

SEQ ID NO: 841229 - RNA, 22 nt, Human
ucucaguguguuuucucucaga

SEQ ID NO: 841230 - RNA, 22 nt, Human
aauccagguggcggagguugug

SEQ ID NO: 841231 - RNA, 22 nt, Human
ccugccaggcuuugggcuucug

SEQ ID NO: 841232 - RNA, 22 nt, Human
uguauacauuuaacuagauaga

SEQ ID NO: 841233 - RNA, 22 nt, Human
aacagcauaaguauuuauuuca

SEQ ID NO: 841234 - RNA, 22 nt, Human
ggugaagguggaacgcagagca

SEQ ID NO: 841235 - RNA, 22 nt, Human
ugagaauuuuuugucaugcauu

SEQ ID NO: 841236 - RNA, 23 nt, Human
ggccuguguuuugucugaaguac

SEQ ID NO: 841237 - RNA, 22 nt, Human
uggccugggucacaccaggguc

SEQ ID NO: 841238 - RNA, 22 nt, Human
ccauuugucaccucugcacucc

SEQ ID NO: 841239 - RNA, 22 nt, Human
uggggcuguccuuagucugaga

SEQ ID NO: 841240 - RNA, 17 nt, Human
acacagggagagggagc

SEQ ID NO: 841241 - RNA, 22 nt, Human
ggcgcuggccacgguggcucug

SEQ ID NO: 841242 - RNA, 22 nt, Human
auugaaagcacaaagaacaagu

SEQ ID NO: 841243 - RNA, 22 nt, Human
agucauauguggcauuuucuaa

SEQ ID NO: 841244 - RNA, 22 nt, Human
aagccaggaagagagccuucac

SEQ ID NO: 841245 - RNA, 17 nt, Human
gccaaaggguuccaauc

SEQ ID NO: 841246 - RNA, 22 nt, Human
ugucugucugcaagccagaaag

SEQ ID NO: 841247 - RNA, 22 nt, Human
agcuggggcugcagagaacagg

SEQ ID NO: 841248 - RNA, 22 nt, Human
auuuccaggagaaaggauuuua

SEQ ID NO: 841249 - RNA, 22 nt, Human
ccuccagcgcgauccacuccgg

SEQ ID NO: 841250 - RNA, 23 nt, Human
ucuggcuccauccuuggggaucc

SEQ ID NO: 841251 - RNA, 22 nt, Human
cugccucuggccucaggcccag

SEQ ID NO: 841252 - RNA, 22 nt, Human
cugggcucagaugagaggaagg

SEQ ID NO: 841253 - RNA, 22 nt, Human
ggaguaggaguagaacucauca

SEQ ID NO: 841254 - RNA, 22 nt, Human
ugagccagaggaggcugugugg

SEQ ID NO: 841255 - RNA, 18 nt, Human
uugcuuuguaagcuugca

SEQ ID NO: 841256 - RNA, 22 nt, Human
ucucucagcuuugagaccugcu

SEQ ID NO: 841257 - RNA, 22 nt, Human
cccagcuccuuacagggccgaa

SEQ ID NO: 841258 - RNA, 22 nt, Human
ugacacagauuagagacauacc

SEQ ID NO: 841259 - RNA, 22 nt, Human
uuauuugcccauguuuagcaga

SEQ ID NO: 841260 - RNA, 22 nt, Human
ggguccagcuacaucagggugg

SEQ ID NO: 841261 - RNA, 22 nt, Human
cugcugugccucuuuucacgug

SEQ ID NO: 841262 - RNA, 22 nt, Human
uggcuuccuggacagaugcggu

SEQ ID NO: 841263 - RNA, 22 nt, Human
uugcuuccucgaggccagcgug

SEQ ID NO: 841264 - RNA, 18 nt, Human
cucugucauaagugucau

SEQ ID NO: 841265 - RNA, 22 nt, Human
aaggcacuugcccagagcugca

SEQ ID NO: 841266 - RNA, 22 nt, Human
ucauuuguaccauuuuuuaaga

SEQ ID NO: 841267 - RNA, 22 nt, Human
ugcagcauucuuggccacuacu

SEQ ID NO: 841268 - RNA, 22 nt, Human
aucaaaguggaaguuuacuagg

SEQ ID NO: 841269 - RNA, 21 nt, Human
gcugcccaacccugcaucucc

SEQ ID NO: 841270 - RNA, 22 nt, Human
uauacagauggaaagauacaca

SEQ ID NO: 841271 - RNA, 22 nt, Human
uacccaggagaaacagcagggc

SEQ ID NO: 841272 - RNA, 22 nt, Human
cccaggaguuggaggcuacggu

SEQ ID NO: 841273 - RNA, 22 nt, Human
caugcuuuaccaaagcagugau

SEQ ID NO: 841274 - RNA, 18 nt, Human
uggcagcuagguaaagaa

SEQ ID NO: 841275 - RNA, 22 nt, Human
auccuucaaggggcugacagcu

SEQ ID NO: 841276 - RNA, 22 nt, Human
ucuuuacaguccucugucaauc

SEQ ID NO: 841277 - RNA, 22 nt, Human
aggcccuggcacugccugggag

SEQ ID NO: 841278 - RNA, 22 nt, Human
cagccagagaaagggcacugcc

SEQ ID NO: 841279 - RNA, 22 nt, Human
cuggcaguguccagcucgugau

SEQ ID NO: 841280 - RNA, 22 nt, Human
gccaggagcccugggcaaguuc

SEQ ID NO: 841281 - RNA, 22 nt, Human
agggggugcuacuuccagaguu

SEQ ID NO: 841282 - RNA, 22 nt, Human
gaagcuucguggcucuucaaau

SEQ ID NO: 841283 - RNA, 22 nt, Human
auuuguagugaagugaaaauaa

SEQ ID NO: 841284 - RNA, 19 nt, Human
acuggcaguuucugcaugg

SEQ ID NO: 841285 - RNA, 22 nt, Human
aucuggcuugacuuugcgacuu

SEQ ID NO: 841286 - RNA, 22 nt, Human
uucacagggcagcagcugagcc

SEQ ID NO: 841287 - RNA, 22 nt, Human
cuggcucaggguggucuggguc

SEQ ID NO: 841288 - RNA, 17 nt, Human
cuuuuaauuuacuuccc

SEQ ID NO: 841289 - RNA, 22 nt, Human
uaggcagcauggauucugaaua

SEQ ID NO: 841290 - RNA, 22 nt, Human
aagggcaggcacccacccucac

SEQ ID NO: 841291 - RNA, 22 nt, Human
gccucaggacuggcauacucau

SEQ ID NO: 841292 - RNA, 22 nt, Human
ggcuuccuaauacucccuacac

SEQ ID NO: 841293 - RNA, 22 nt, Human
ccugagggaaggaugcuaccca

SEQ ID NO: 841294 - RNA, 22 nt, Human
ggcucugcccagaugaagagga

SEQ ID NO: 841295 - RNA, 22 nt, Human
aaugggaggauuuucucucuug

SEQ ID NO: 841296 - RNA, 22 nt, Human
ucaaaguuuguggcaauuuauu

SEQ ID NO: 841297 - RNA, 22 nt, Human
uggagugaaguaaagaggacaa

SEQ ID NO: 841298 - RNA, 22 nt, Human
ggagagcaggguccugagauac

SEQ ID NO: 841299 - RNA, 22 nt, Human
gaggcugcugagagcccuguuu

SEQ ID NO: 841300 - RNA, 22 nt, Human
aagacuuucucccaaauccuca

SEQ ID NO: 841301 - RNA, 22 nt, Human
gcugaagcugcagcaggaggaa

SEQ ID NO: 841302 - RNA, 22 nt, Human
guccucagggaauguggcgggu

SEQ ID NO: 841303 - RNA, 22 nt, Human
ugcuggcugggcugcuggagac

SEQ ID NO: 841304 - RNA, 19 nt, Human
agccuggagggcuggucac

SEQ ID NO: 841305 - RNA, 22 nt, Human
agagucugaggcagcugcagcc

SEQ ID NO: 841306 - RNA, 23 nt, Human
ucacagggcacuggcugggguug

SEQ ID NO: 841307 - RNA, 22 nt, Human
uggcugggccgggccuugugcc

SEQ ID NO: 841308 - RNA, 22 nt, Human
aggucagcaggccaggggcgaa

SEQ ID NO: 841309 - RNA, 22 nt, Human
ccucucucuccugcacacacac

SEQ ID NO: 841310 - RNA, 19 nt, Human
cugugcuuuaaacuccuau

SEQ ID NO: 841311 - RNA, 22 nt, Human
accucccagcucugagcuuggg

SEQ ID NO: 841312 - RNA, 22 nt, Human
gacagaguuguugauguaugcu

SEQ ID NO: 841313 - RNA, 22 nt, Human
gagaggagguggcuaugacagc

SEQ ID NO: 841314 - RNA, 22 nt, Human
gccuucugcgcucgugucuccg

SEQ ID NO: 841315 - RNA, 22 nt, Human
uugcagggcaggaccauggaca

SEQ ID NO: 841316 - RNA, 22 nt, Human
aagguacaguuuuaagaauaag

SEQ ID NO: 841317 - RNA, 22 nt, Human
ugcacacacgcggcacaucugu

SEQ ID NO: 841318 - RNA, 22 nt, Human
uuuucauuguuccucgagcauu

SEQ ID NO: 841319 - RNA, 22 nt, Human
uguucuuuggcuucacagcucu

SEQ ID NO: 841320 - RNA, 22 nt, Human
acagccagaggugguccugggu

SEQ ID NO: 841321 - RNA, 23 nt, Human
acagagguccaaacaguauaagc

SEQ ID NO: 841322 - RNA, 20 nt, Human
ccagagcagccacugaaguu

SEQ ID NO: 841323 - RNA, 22 nt, Human
agggagcugagcugugagcagc

SEQ ID NO: 841324 - RNA, 22 nt, Human
ucacugcucagucuguacuaca

SEQ ID NO: 841325 - RNA, 22 nt, Human
aguggggaagagcaugggcccu

SEQ ID NO: 841326 - RNA, 22 nt, Human
ucugcagguguuggaaggguca

SEQ ID NO: 841327 - RNA, 23 nt, Human
ggcuggcccggggcugcuccuga

SEQ ID NO: 841328 - RNA, 22 nt, Human
cuuaagauuugagauaccuaau

SEQ ID NO: 841329 - RNA, 22 nt, Human
cugggagauugcuagagaugca

SEQ ID NO: 841330 - RNA, 23 nt, Human
ugucauugugacuacagaaccag

SEQ ID NO: 841331 - RNA, 22 nt, Human
aaucuagucuccuuaagucuuu

SEQ ID NO: 841332 - RNA, 22 nt, Human
cauugcacucuggcuggaacgg

SEQ ID NO: 841333 - RNA, 22 nt, Human
guauucuugguuaucaaaauac

SEQ ID NO: 841334 - RNA, 22 nt, Human
uuuacagaugaggaaacugaga

SEQ ID NO: 841335 - RNA, 22 nt, Human
cccaccccuggacaggugagug

SEQ ID NO: 841336 - RNA, 22 nt, Human
gccaggcuguggggaacuugaa

SEQ ID NO: 841337 - RNA, 22 nt, Human
acagcacaaucugagucccaga

SEQ ID NO: 841338 - RNA, 22 nt, Human
ggcaccagccaccuauuucuag

SEQ ID NO: 841339 - RNA, 22 nt, Human
ugaaaugauguacaagaaggca

SEQ ID NO: 841340 - RNA, 22 nt, Human
cuguacaggugaggagggggcu

SEQ ID NO: 841341 - RNA, 22 nt, Human
uugggcaaaguguuucuggagc

SEQ ID NO: 841342 - RNA, 22 nt, Human
aaugcacacauuugguacugaa

SEQ ID NO: 841343 - RNA, 22 nt, Human
uccagggaagagcagaggcuac

SEQ ID NO: 841344 - RNA, 22 nt, Human
ccugucuguaucgguucagagu

SEQ ID NO: 841345 - RNA, 20 nt, Human
uguacacaguacuuuacaau

SEQ ID NO: 841346 - RNA, 17 nt, Human
aggugcagaggcagagc

SEQ ID NO: 841347 - RNA, 22 nt, Human
cagggagaggcaucauagggaa

SEQ ID NO: 841348 - RNA, 22 nt, Human
ggcagcauauauucagugggca

SEQ ID NO: 841349 - RNA, 22 nt, Human
gcaggaugggagcuucacuuug

SEQ ID NO: 841350 - RNA, 22 nt, Human
acagggccaggugagaggugcu

SEQ ID NO: 841351 - RNA, 22 nt, Human
caguaaauuaucucaucucugu

SEQ ID NO: 841352 - RNA, 22 nt, Human
uccagggacacagaguccuucu

SEQ ID NO: 841353 - RNA, 22 nt, Human
ggccagcuuugagcugcaggaa

SEQ ID NO: 841354 - RNA, 22 nt, Human
ggaugggagcagaggacgacca

SEQ ID NO: 841355 - RNA, 22 nt, Human
uuauacaguuuauacuuagaau

SEQ ID NO: 841356 - RNA, 22 nt, Human
auugacaauuagcccuuaggug

SEQ ID NO: 841357 - RNA, 22 nt, Human
ugugacaucgcugugucuguuu

SEQ ID NO: 841358 - RNA, 22 nt, Human
caagaaucaacauuauuuagug

SEQ ID NO: 841359 - RNA, 22 nt, Human
cuggccucaccucagacuuacu

SEQ ID NO: 841360 - RNA, 22 nt, Human
gggggcuggaauauccaucaac

SEQ ID NO: 841361 - RNA, 22 nt, Human
ggccagagaauaugccuuacgu

SEQ ID NO: 841362 - RNA, 22 nt, Human
ucuccuggauggaccuucucuu

SEQ ID NO: 841363 - RNA, 22 nt, Human
agugaaaugauucugagcaaga

SEQ ID NO: 841364 - RNA, 22 nt, Human
aacaucuacuaagugccaggca

SEQ ID NO: 841365 - RNA, 22 nt, Human
ucuguaucuaauuuuacaguag

SEQ ID NO: 841366 - RNA, 22 nt, Human
acagagccuccaggagugcugg

SEQ ID NO: 841367 - RNA, 22 nt, Human
gucacagaguuauuaauugugu

SEQ ID NO: 841368 - RNA, 18 nt, Human
auagaaaccuuuaaucag

SEQ ID NO: 841369 - RNA, 22 nt, Human
gcaggccuccccugcuggagcu

SEQ ID NO: 841370 - RNA, 20 nt, Human
ugcucugucuaaaacuuccc

SEQ ID NO: 841371 - RNA, 22 nt, Human
cacucugcagcugaagggcugg

SEQ ID NO: 841372 - RNA, 22 nt, Human
gggcaugguggugcacaccugu

SEQ ID NO: 841373 - RNA, 22 nt, Human
uacaaaaguaauuacgguuuuu

SEQ ID NO: 841374 - RNA, 21 nt, Human
uucuuuccccagaggacuaaa

SEQ ID NO: 841375 - RNA, 23 nt, Human
gccuggagaaaagcugcaguuca

SEQ ID NO: 841376 - RNA, 21 nt, Human
acagagccgggcacaaagcug

SEQ ID NO: 841377 - RNA, 22 nt, Human
auccuuaguuaagaacaggagu

SEQ ID NO: 841378 - RNA, 22 nt, Human
aaagccuugagauccuauaguu

SEQ ID NO: 841379 - RNA, 22 nt, Human
aaguucaaggcagguccugagg

SEQ ID NO: 841380 - RNA, 22 nt, Human
aggaagcugccugggaugggaa

SEQ ID NO: 841381 - RNA, 22 nt, Human
ucagagcuaaggggagagcaaa

SEQ ID NO: 841382 - RNA, 22 nt, Human
gagggcugauaacaggaauaca

SEQ ID NO: 841383 - RNA, 22 nt, Human
uggcucaguuugggggauugaa

SEQ ID NO: 841384 - RNA, 22 nt, Human
aggcucagauccuuguguccug

SEQ ID NO: 841385 - RNA, 20 nt, Human
gugccuggagaagaggcugu

SEQ ID NO: 841386 - RNA, 22 nt, Human
gaaacugugaggaucuuaacuu

SEQ ID NO: 841387 - RNA, 22 nt, Human
uaacaucuuuagcagcucgaac

SEQ ID NO: 841388 - RNA, 22 nt, Human
uucugucaaacucacaggccga

SEQ ID NO: 841389 - RNA, 22 nt, Human
uauuuugagguauuuuugagcu

SEQ ID NO: 841390 - RNA, 22 nt, Human
uaguaaaaguuuaguugaaagu

SEQ ID NO: 841391 - RNA, 22 nt, Human
cacacaggaugaagcagcagaa

SEQ ID NO: 841392 - RNA, 22 nt, Human
ucuugccucuuccccuuuccau

SEQ ID NO: 841393 - RNA, 22 nt, Human
cccagcuugcccaggacugagg

SEQ ID NO: 841394 - RNA, 22 nt, Human
ugaaggaaugaguauacuguuu

SEQ ID NO: 841395 - RNA, 22 nt, Human
uucucuuagcuguaaagucaau

SEQ ID NO: 841396 - RNA, 22 nt, Human
uguucauaucauuuugaaagcu

SEQ ID NO: 841397 - RNA, 22 nt, Human
aagcuggagaguuaggugaaua

SEQ ID NO: 841398 - RNA, 22 nt, Human
aaggcugaggagggccugcagg

SEQ ID NO: 841399 - RNA, 22 nt, Human
gcccaggaaauaaaagugggcu

SEQ ID NO: 841400 - RNA, 21 nt, Human
ccaggcagagcugugaguucu

SEQ ID NO: 841401 - RNA, 22 nt, Human
guaucuuuccacaucuucagua

SEQ ID NO: 841402 - RNA, 22 nt, Human
cugaaggagcauagucaguuuu

SEQ ID NO: 841403 - RNA, 22 nt, Human
agcagccaaaugaagauuuuac

SEQ ID NO: 841404 - RNA, 16 nt, Human
agaggccuugaggaag

SEQ ID NO: 841405 - RNA, 22 nt, Human
acaauauuguacccagaaguuu

SEQ ID NO: 841406 - RNA, 22 nt, Human
uuauuauaaugagggauaaaaa

SEQ ID NO: 841407 - RNA, 22 nt, Human
gcugggaggaauuuggggaaua

SEQ ID NO: 841408 - RNA, 22 nt, Human
agcagcauuaugauauaucuua

SEQ ID NO: 841409 - RNA, 22 nt, Human
ugggagaagcagcagccaagug

SEQ ID NO: 841410 - RNA, 22 nt, Human
ucuguccucuuugaagcugcuc

SEQ ID NO: 841411 - RNA, 22 nt, Human
caaaugcauaguuuauaagaag

SEQ ID NO: 841412 - RNA, 23 nt, Human
aggauuuaaaggcaaugcauuuu

SEQ ID NO: 841413 - RNA, 22 nt, Human
cuuuggcaugguccucacuaua

SEQ ID NO: 841414 - RNA, 22 nt, Human
cauuuauuggcauguaguaggu

SEQ ID NO: 841415 - RNA, 22 nt, Human
uguaggacauguacuuguaaca

SEQ ID NO: 841416 - RNA, 22 nt, Human
ucagaauuagagcucuucuuga

SEQ ID NO: 841417 - RNA, 22 nt, Human
auaaggcagaaaugauucuagu

SEQ ID NO: 841418 - RNA, 21 nt, Human
ucuccaguauccuucucugag

SEQ ID NO: 841419 - RNA, 22 nt, Human
ggcucuggguucugcaaugcgu

SEQ ID NO: 841420 - RNA, 22 nt, Human
aucaguuauuuuuaagcuauaa

SEQ ID NO: 841421 - RNA, 22 nt, Human
aguacagaccugucucuuccug

SEQ ID NO: 841422 - RNA, 22 nt, Human
ccuguucauuuuuugacucugc

SEQ ID NO: 841423 - RNA, 20 nt, Human
aguagcagugugacauugac

SEQ ID NO: 841424 - RNA, 16 nt, Human
uggaaggggucuccgg

SEQ ID NO: 841425 - RNA, 22 nt, Human
ucucagagggaggauuacugcc

SEQ ID NO: 841426 - RNA, 22 nt, Human
ugagccuguccugugcauguga

SEQ ID NO: 841427 - RNA, 22 nt, Human
uuucuguaaggacuuaaugcaa

SEQ ID NO: 841428 - RNA, 22 nt, Human
ccucagagguuuucauucugua

SEQ ID NO: 841429 - RNA, 22 nt, Human
gaaggagggugcggaucugagc

SEQ ID NO: 841430 - RNA, 22 nt, Human
cagugcuccugauguacccuug

SEQ ID NO: 841431 - RNA, 22 nt, Human
agcacuuuccuggcaaaugugg

SEQ ID NO: 841432 - RNA, 22 nt, Human
ggcugggcaaacaagacucuuc

SEQ ID NO: 841433 - RNA, 22 nt, Human
cuggccagacuacacaugugug

SEQ ID NO: 841434 - RNA, 22 nt, Human
gagagcugcaagguagggcggg

SEQ ID NO: 841435 - RNA, 22 nt, Human
acagagguguguguaggacagu

SEQ ID NO: 841436 - RNA, 22 nt, Human
ucaguuuuuaagaguuaugcga

SEQ ID NO: 841437 - RNA, 22 nt, Human
accuuuuuucagaacucuaaag

SEQ ID NO: 841438 - RNA, 18 nt, Human
ccauuucaugauuauuac

SEQ ID NO: 841439 - RNA, 22 nt, Human
cuccuucccuucaaguguuccu

SEQ ID NO: 841440 - RNA, 22 nt, Human
aaauggauggaaagcaauuuuu

SEQ ID NO: 841441 - RNA, 22 nt, Human
cugugauuguuaguuccuauac

SEQ ID NO: 841442 - RNA, 22 nt, Human
gaugaagccugacuucucggug

SEQ ID NO: 841443 - RNA, 22 nt, Human
auacagaagaccccuccgucau

SEQ ID NO: 841444 - RNA, 22 nt, Human
uacaucauaauaauacuuagaa

SEQ ID NO: 841445 - RNA, 22 nt, Human
cuugaaagucacaugcagcccu

SEQ ID NO: 841446 - RNA, 22 nt, Human
gcagagccagaauggccaggac

SEQ ID NO: 841447 - RNA, 22 nt, Human
ggaggaggggugacugaaugcu

SEQ ID NO: 841448 - RNA, 22 nt, Human
ugcuuuauuuauaaaauagcaa

SEQ ID NO: 841449 - RNA, 21 nt, Human
caugaagccgguucccuguuu

SEQ ID NO: 841450 - RNA, 22 nt, Human
gccagcuggagacuggcagggg

SEQ ID NO: 841451 - RNA, 22 nt, Human
aagcugccuagaguugaauguc

SEQ ID NO: 841452 - RNA, 22 nt, Human
aggcuauuuccacucuucucau

SEQ ID NO: 841453 - RNA, 22 nt, Human
gaauuucaggacaacuggaagg

SEQ ID NO: 841454 - RNA, 22 nt, Human
gaauuucaaaagccagaacggg

SEQ ID NO: 841455 - RNA, 22 nt, Human
ucagaggaauaaugcugcauuu

SEQ ID NO: 841456 - RNA, 22 nt, Human
gaguggagcaaaagagguagau

SEQ ID NO: 841457 - RNA, 22 nt, Human
cccugcagccggccagcucauu

SEQ ID NO: 841458 - RNA, 22 nt, Human
aaugggagguaguaugggaggu

SEQ ID NO: 841459 - RNA, 22 nt, Human
ugucaugccauuuaaaauguuu

SEQ ID NO: 841460 - RNA, 22 nt, Human
auguaucaauuaucugucugca

SEQ ID NO: 841461 - RNA, 22 nt, Human
cucaguuucugacauuaaaauc

SEQ ID NO: 841462 - RNA, 22 nt, Human
agggaauguagcaagaugccaa

SEQ ID NO: 841463 - RNA, 22 nt, Human
gguggcagaggugcaucagccc

SEQ ID NO: 841464 - RNA, 22 nt, Human
gguacaauccacuguggguuag

SEQ ID NO: 841465 - RNA, 22 nt, Human
ccagagccuaagaucugauccu

SEQ ID NO: 841466 - RNA, 22 nt, Human
ucagagcugcccaugcaagggg

SEQ ID NO: 841467 - RNA, 22 nt, Human
ugaaugaacuaaaucauaguuc

SEQ ID NO: 841468 - RNA, 19 nt, Human
agcagcuggagguggagug

SEQ ID NO: 841469 - RNA, 22 nt, Human
ugaucugaaggacaugggaccc

SEQ ID NO: 841470 - RNA, 22 nt, Human
gcacaauuauuuaugcaguaug

SEQ ID NO: 841471 - RNA, 20 nt, Human
ggcagcucacuacuuucugu

SEQ ID NO: 841472 - RNA, 22 nt, Human
aucauucugauggucaaugcua

SEQ ID NO: 841473 - RNA, 22 nt, Human
gagugcaucguggccauuuuaa

SEQ ID NO: 841474 - RNA, 23 nt, Human
agagcuuagggaauucacaugag

SEQ ID NO: 841475 - RNA, 22 nt, Human
uugcaaaagccgaggcacucca

SEQ ID NO: 841476 - RNA, 22 nt, Human
uagggauguggugagaacugag

SEQ ID NO: 841477 - RNA, 22 nt, Human
gcauccagucuuggcuccugga

SEQ ID NO: 841478 - RNA, 22 nt, Human
guuaggcaaauaacuguggagc

SEQ ID NO: 841479 - RNA, 22 nt, Human
uuuucagugggcaaugauguga

SEQ ID NO: 841480 - RNA, 22 nt, Human
ucaauauauuccauguuuucuc

SEQ ID NO: 841481 - RNA, 22 nt, Human
augccuggacugacaugcacug

SEQ ID NO: 841482 - RNA, 23 nt, Human
agccacuucuaucuugcuccugg

SEQ ID NO: 841483 - RNA, 22 nt, Human
cauugaaaccuaacauaggcug

SEQ ID NO: 841484 - RNA, 22 nt, Human
caaggccugccucuggcagaaa

SEQ ID NO: 841485 - RNA, 22 nt, Human
acaugcuucauauuauaaccaa

SEQ ID NO: 841486 - RNA, 22 nt, Human
cuggggcugcggacgggagccc

SEQ ID NO: 841487 - RNA, 22 nt, Human
aggggcugccuggcuuggcacu

SEQ ID NO: 841488 - RNA, 22 nt, Human
cauguacaaaaggcaaaugccu

SEQ ID NO: 841489 - RNA, 23 nt, Human
acaacuuuacagauacauuuugu

SEQ ID NO: 841490 - RNA, 20 nt, Human
cccucugcacauggcugugg

SEQ ID NO: 841491 - RNA, 22 nt, Human
ugcagggccagacuggguugga

SEQ ID NO: 841492 - RNA, 22 nt, Human
aaaguguugauaugugacaucc

SEQ ID NO: 841493 - RNA, 22 nt, Human
uauaauuaguaaauggcagauu

SEQ ID NO: 841494 - RNA, 22 nt, Human
uauuuauaaucugccaaagaga

SEQ ID NO: 841495 - RNA, 18 nt, Human
ucauagaagugaaucaga

SEQ ID NO: 841496 - RNA, 22 nt, Human
guccagggaaauagcgacaggg

SEQ ID NO: 841497 - RNA, 22 nt, Human
ggugagggaguggaacgaggug

SEQ ID NO: 841498 - RNA, 22 nt, Human
cagauaaaggcuuacuaguagu

SEQ ID NO: 841499 - RNA, 22 nt, Human
uguuagaaauuauuaguaauau

SEQ ID NO: 841500 - RNA, 22 nt, Human
gcuggggucugugaggagggcu

SEQ ID NO: 841501 - RNA, 22 nt, Human
acauaaguuauggauaaaaugu

SEQ ID NO: 841502 - RNA, 22 nt, Human
cuggcagcugugugaagaacug

SEQ ID NO: 841503 - RNA, 22 nt, Human
gcagacagccagacugcacugg

SEQ ID NO: 841504 - RNA, 22 nt, Human
aauaauuuccagccaacuggaa

SEQ ID NO: 841505 - RNA, 19 nt, Human
uggauuuauauucuuuauc

SEQ ID NO: 841506 - RNA, 22 nt, Human
agcuucuggaaggcaaggcuug

SEQ ID NO: 841507 - RNA, 22 nt, Human
aggcagcuuucuguaggggugu

SEQ ID NO: 841508 - RNA, 22 nt, Human
uggcuagcccuuguggggagag

SEQ ID NO: 841509 - RNA, 22 nt, Human
cccagccagccucuucccauau

SEQ ID NO: 841510 - RNA, 22 nt, Human
ugcuuggcuuucugagcuucug

SEQ ID NO: 841511 - RNA, 22 nt, Human
ccaaggaggccccaggucagcu

SEQ ID NO: 841512 - RNA, 22 nt, Human
uagucuuuugagaaguauaucu

SEQ ID NO: 841513 - RNA, 22 nt, Human
uguaugaaucucauuuguuuaa

SEQ ID NO: 841514 - RNA, 22 nt, Human
uucauucuugggaucagagagu

SEQ ID NO: 841515 - RNA, 22 nt, Human
ugacagcugagccccaggcaag

SEQ ID NO: 841516 - RNA, 22 nt, Human
uguaugaaguuacugagccucu

SEQ ID NO: 841517 - RNA, 22 nt, Human
caguccuuccuugccccuuggg

SEQ ID NO: 841518 - RNA, 22 nt, Human
cugagagugcucuuugauguca

SEQ ID NO: 841519 - RNA, 22 nt, Human
uagcagugccaggauuuugcug

SEQ ID NO: 841520 - RNA, 22 nt, Human
agguaugagauaaaucaaugaa

SEQ ID NO: 841521 - RNA, 22 nt, Human
ucccuggcugggggcugccuug

SEQ ID NO: 841522 - RNA, 22 nt, Human
agaggcaggagguugacuugag

SEQ ID NO: 841523 - RNA, 22 nt, Human
uauguuauuuucauacaacaga

SEQ ID NO: 841524 - RNA, 18 nt, Human
gcacuucacccagcuagu

SEQ ID NO: 841525 - RNA, 22 nt, Human
auaugugugccauuucagcagu

SEQ ID NO: 841526 - RNA, 22 nt, Human
gccuuaauuuuuuauaaucucu

SEQ ID NO: 841527 - RNA, 22 nt, Human
caucacagauguuguguggagu

SEQ ID NO: 841528 - RNA, 22 nt, Human
gcacacagauuaggaaacagaa

SEQ ID NO: 841529 - RNA, 22 nt, Human
ucuggccuuaucuguccaagcc

SEQ ID NO: 841530 - RNA, 22 nt, Human
auuuugaugcuaucuaaugaau

SEQ ID NO: 841531 - RNA, 22 nt, Human
augggcagcagcugccauucau

SEQ ID NO: 841532 - RNA, 22 nt, Human
ucucaccaaagccuugaccaua

SEQ ID NO: 841533 - RNA, 22 nt, Human
aauuugcaugaugagaacaaua

SEQ ID NO: 841534 - RNA, 22 nt, Human
guccugggcccaggggcugccu

SEQ ID NO: 841535 - RNA, 22 nt, Human
acuuugaaagccuuggccccgg

SEQ ID NO: 841536 - RNA, 22 nt, Human
aagccaggcaugcuuggacagu

SEQ ID NO: 841537 - RNA, 22 nt, Human
uccaaaguguugggauuauagg

SEQ ID NO: 841538 - RNA, 22 nt, Human
gccaggcagauaugugagcuua

SEQ ID NO: 841539 - RNA, 22 nt, Human
uuuccuguugccaucaagaaug

SEQ ID NO: 841540 - RNA, 22 nt, Human
gauagaaagagugguucuuuuu

SEQ ID NO: 841541 - RNA, 19 nt, Human
ucccuggcgccucucgggc

SEQ ID NO: 841542 - RNA, 22 nt, Human
accagagcuuacaugcuagaaa

SEQ ID NO: 841543 - RNA, 22 nt, Human
ccaauacacuuuauagaagaaa

SEQ ID NO: 841544 - RNA, 22 nt, Human
aaaauugaagugaucaggaacu

SEQ ID NO: 841545 - RNA, 22 nt, Human
uuaguaaauaaagucuacuuuc

SEQ ID NO: 841546 - RNA, 22 nt, Human
uggcucuggcgugaagcccaga

SEQ ID NO: 841547 - RNA, 22 nt, Human
acaguuucuccauuuacaccuu

SEQ ID NO: 841548 - RNA, 22 nt, Human
ggaggccaguccuggccgggcu

SEQ ID NO: 841549 - RNA, 22 nt, Human
ccacugggggcugcaggcacuc

SEQ ID NO: 841550 - RNA, 22 nt, Human
agagagcccgggccagggcaca

SEQ ID NO: 841551 - RNA, 22 nt, Human
auuugaauggcuuaacacaacg

SEQ ID NO: 841552 - RNA, 21 nt, Human
guuuuaagggagaaaaccuag

SEQ ID NO: 841553 - RNA, 22 nt, Human
gucccagaaacauauugcuggu

SEQ ID NO: 841554 - RNA, 22 nt, Human
ugauuuccuggcuuuggaguuc

SEQ ID NO: 841555 - RNA, 22 nt, Human
auauaauuguucugaaguguuu

SEQ ID NO: 841556 - RNA, 22 nt, Human
uaucuguuguccaugcagaaag

SEQ ID NO: 841557 - RNA, 22 nt, Human
aggcagugcagaguccucuucu

SEQ ID NO: 841558 - RNA, 22 nt, Human
gccuccccugcaauuguccuug

SEQ ID NO: 841559 - RNA, 22 nt, Human
gggccuggcaugcagccccguu

SEQ ID NO: 841560 - RNA, 22 nt, Human
cacaggcuuccaguccccagcu

SEQ ID NO: 841561 - RNA, 22 nt, Human
ggacagcugcuuucaggccaca

SEQ ID NO: 841562 - RNA, 22 nt, Human
auacauguuguaccauauguuu

SEQ ID NO: 841563 - RNA, 22 nt, Human
auuguggcuagacagucacaau

SEQ ID NO: 841564 - RNA, 23 nt, Human
uggaaagcggaccuggggcagag

SEQ ID NO: 841565 - RNA, 22 nt, Human
aggccuggcuuugguuugcuga

SEQ ID NO: 841566 - RNA, 22 nt, Human
gcuuccugucccucagccauga

SEQ ID NO: 841567 - RNA, 22 nt, Human
gaugauaacagcauuucaacug

SEQ ID NO: 841568 - RNA, 22 nt, Human
uucacauuagugguucuauaua

SEQ ID NO: 841569 - RNA, 22 nt, Human
gucccuggucuaccguggcuuc

SEQ ID NO: 841570 - RNA, 22 nt, Human
uauacagucuuuugcuauauuc

SEQ ID NO: 841571 - RNA, 22 nt, Human
cacagagagcuacgugcagcgu

SEQ ID NO: 841572 - RNA, 22 nt, Human
aggcuucugcugauauuucauu

SEQ ID NO: 841573 - RNA, 22 nt, Human
guggaggagaggcgccuugcgg

SEQ ID NO: 841574 - RNA, 22 nt, Human
uaugaagauauaucugaucucu

SEQ ID NO: 841575 - RNA, 22 nt, Human
ucuggagagucacagugccaga

SEQ ID NO: 841576 - RNA, 22 nt, Human
ccuccaaguuugacucaggaca

SEQ ID NO: 841577 - RNA, 19 nt, Human
gccagcagaaugaugaggc

SEQ ID NO: 841578 - RNA, 22 nt, Human
ugugaugguucacugggcauga

SEQ ID NO: 841579 - RNA, 20 nt, Human
uccuugaaagugggguauau

SEQ ID NO: 841580 - RNA, 22 nt, Human
ccacaggggcccacgagccgcu

SEQ ID NO: 841581 - RNA, 18 nt, Human
agcuggggccucuggucc

SEQ ID NO: 841582 - RNA, 22 nt, Human
ucaugaauauugaaugcuucau

SEQ ID NO: 841583 - RNA, 22 nt, Human
caugggagcuaucuccaucacu

SEQ ID NO: 841584 - RNA, 22 nt, Human
gaugguuugguaaaaguauguu

SEQ ID NO: 841585 - RNA, 22 nt, Human
aggagggacaccaauauauguu

SEQ ID NO: 841586 - RNA, 22 nt, Human
ugggccugauucuugaauccug

SEQ ID NO: 841587 - RNA, 18 nt, Human
guccugagcucugcugua

SEQ ID NO: 841588 - RNA, 22 nt, Human
guagaaauguaaccaggagaua

SEQ ID NO: 841589 - RNA, 22 nt, Human
cugaagccaugugcucacuggu

SEQ ID NO: 841590 - RNA, 22 nt, Human
aagcaccucuaugauugcuuuu

SEQ ID NO: 841591 - RNA, 20 nt, Human
agaaaucagaccacacacua

SEQ ID NO: 841592 - RNA, 22 nt, Human
gcaguggcuaagcucgcaugca

SEQ ID NO: 841593 - RNA, 21 nt, Human
ugaaagaaggugcagucugaa

SEQ ID NO: 841594 - RNA, 22 nt, Human
auaagcauguuagaauauuuga

SEQ ID NO: 841595 - RNA, 22 nt, Human
ucauuuugggguuugucaucuu

SEQ ID NO: 841596 - RNA, 23 nt, Human
uggugccucagaagcagugggcu

SEQ ID NO: 841597 - RNA, 22 nt, Human
agugaaaugauaguguaaauac

SEQ ID NO: 841598 - RNA, 22 nt, Human
uccauacauugaaauaccauuc

SEQ ID NO: 841599 - RNA, 21 nt, Human
cugcuuuacuucagaggaucu

SEQ ID NO: 841600 - RNA, 22 nt, Human
gagugaaaaaggaagggccaua

SEQ ID NO: 841601 - RNA, 22 nt, Human
augucuaaaagauaaaguuuaa

SEQ ID NO: 841602 - RNA, 22 nt, Human
guccucugggcagcugccccac

SEQ ID NO: 841603 - RNA, 22 nt, Human
gacaguccuugcccaguaucua

SEQ ID NO: 841604 - RNA, 22 nt, Human
ggcagagcuugcagugagccga

SEQ ID NO: 841605 - RNA, 22 nt, Human
guuggccugaauggucaagagg

SEQ ID NO: 841606 - RNA, 22 nt, Human
ucucagaguuuuuuuccaggac

SEQ ID NO: 841607 - RNA, 22 nt, Human
cuggcuuucauuucaagcacgu

SEQ ID NO: 841608 - RNA, 22 nt, Human
cccaggaguucgaggcuguagu

SEQ ID NO: 841609 - RNA, 22 nt, Human
uuuccaaagguggcaggaacaa

SEQ ID NO: 841610 - RNA, 22 nt, Human
gaggcagcugggcuggugguuu

SEQ ID NO: 841611 - RNA, 22 nt, Human
aggccugaggaccuucuggagg

SEQ ID NO: 841612 - RNA, 22 nt, Human
agaauaugaucggaauacagau

SEQ ID NO: 841613 - RNA, 22 nt, Human
ccagcuggagcucgcagauagg

SEQ ID NO: 841614 - RNA, 22 nt, Human
gauagaaagguguugaaaucca

SEQ ID NO: 841615 - RNA, 22 nt, Human
aggcacuguacuagguacaggg

SEQ ID NO: 841616 - RNA, 22 nt, Human
uguccugggaaugggaugcagu

SEQ ID NO: 841617 - RNA, 22 nt, Human
auaugccauuagcuagaaauaa

SEQ ID NO: 841618 - RNA, 22 nt, Human
gaggccugaggcugccuggagc

SEQ ID NO: 841619 - RNA, 22 nt, Human
acacaaauuguaggauaauugc

SEQ ID NO: 841620 - RNA, 22 nt, Human
ucaccagucuuucuuaccauug

SEQ ID NO: 841621 - RNA, 22 nt, Human
aggcaguggaaggagaaagcaa

SEQ ID NO: 841622 - RNA, 22 nt, Human
aagcugccauagaacgagaggu

SEQ ID NO: 841623 - RNA, 20 nt, Human
uacuggauuagggcucaccc

SEQ ID NO: 841624 - RNA, 22 nt, Human
aaguucaaggaagccuccaguu

SEQ ID NO: 841625 - RNA, 22 nt, Human
uguaugaagacuucuucugugu

SEQ ID NO: 841626 - RNA, 22 nt, Human
gagggcaggggucuugcacggu

SEQ ID NO: 841627 - RNA, 22 nt, Human
cagugucuccagaugcuccaau

SEQ ID NO: 841628 - RNA, 22 nt, Human
agcuuguuaaggaugcauauua

SEQ ID NO: 841629 - RNA, 22 nt, Human
ugggcuguggagcaccuuugca

SEQ ID NO: 841630 - RNA, 23 nt, Human
cccagcuuucccacugccgagag

SEQ ID NO: 841631 - RNA, 22 nt, Human
uuuuccuauaugcaaagaaugc

SEQ ID NO: 841632 - RNA, 23 nt, Human
gaaucaguggcuaacaaggaaac

SEQ ID NO: 841633 - RNA, 22 nt, Human
aagagcugcccaaggugaacag

SEQ ID NO: 841634 - RNA, 22 nt, Human
agcucagcuuccucuccaugcu

SEQ ID NO: 841635 - RNA, 22 nt, Human
gaguucuaaaggcagaacauaa

SEQ ID NO: 841636 - RNA, 22 nt, Human
acuggaucagaaucugauuuuu

SEQ ID NO: 841637 - RNA, 22 nt, Human
gugaaaucugaggcccaugaug

SEQ ID NO: 841638 - RNA, 22 nt, Human
cugggaggcacuauucaggagg

SEQ ID NO: 841639 - RNA, 22 nt, Human
aacugcauuugcauaaguccau

SEQ ID NO: 841640 - RNA, 22 nt, Human
uaagaaguacaaaaauuuucug

SEQ ID NO: 841641 - RNA, 22 nt, Human
ugcuagugcaggguuuucaguu

SEQ ID NO: 841642 - RNA, 22 nt, Human
uaaaugugucuuuuuaaggccu

SEQ ID NO: 841643 - RNA, 22 nt, Human
gaauuguagagggaacagaagc

SEQ ID NO: 841644 - RNA, 22 nt, Human
uacuuuuugucucuuugaaugu

SEQ ID NO: 841645 - RNA, 22 nt, Human
ccaggccugcaucugcugcgca

SEQ ID NO: 841646 - RNA, 22 nt, Human
cuauuacauuucuggacauuca

SEQ ID NO: 841647 - RNA, 22 nt, Human
cccucaggagaugucagcugga

SEQ ID NO: 841648 - RNA, 22 nt, Human
caaaauguucuggcaccuuuaa

SEQ ID NO: 841649 - RNA, 22 nt, Human
uacuuuagaaggaaauaaguuc

SEQ ID NO: 841650 - RNA, 22 nt, Human
ucaaauaccagcaauuucaugu

SEQ ID NO: 841651 - RNA, 22 nt, Human
uggccucugugggagcugagca

SEQ ID NO: 841652 - RNA, 22 nt, Human
gggagacacgcugcaggcauaa

SEQ ID NO: 841653 - RNA, 22 nt, Human
cucuguccacagguuugucccu

SEQ ID NO: 841654 - RNA, 22 nt, Human
cccagcauggagugaggacuca

SEQ ID NO: 841655 - RNA, 20 nt, Human
guucucacugaucugcaggg

SEQ ID NO: 841656 - RNA, 23 nt, Human
uuucaaauuacucugcagaugac

SEQ ID NO: 841657 - RNA, 22 nt, Human
ucccagccuuccuuguggugaa

SEQ ID NO: 841658 - RNA, 22 nt, Human
cugcccugugaggguccuuggg

SEQ ID NO: 841659 - RNA, 22 nt, Human
uuuuccucaggaaugcuaagcu

SEQ ID NO: 841660 - RNA, 22 nt, Human
caguguccucagccagcagcua

SEQ ID NO: 841661 - RNA, 22 nt, Human
acagcuguauccccagagcuca

SEQ ID NO: 841662 - RNA, 22 nt, Human
gagaaggggugauguggguaau

SEQ ID NO: 841663 - RNA, 22 nt, Human
cuacagaaguuucccuugcuua

SEQ ID NO: 841664 - RNA, 22 nt, Human
acauuucuuuucaucucuauau

SEQ ID NO: 841665 - RNA, 20 nt, Human
gucucagaauggauuugcau

SEQ ID NO: 841666 - RNA, 18 nt, Human
aaaaugcaggcgacaugg

SEQ ID NO: 841667 - RNA, 22 nt, Human
gagcucuguguagccugagggu

SEQ ID NO: 841668 - RNA, 22 nt, Human
agggccugggauguccuccuag

SEQ ID NO: 841669 - RNA, 22 nt, Human
agccaucauuucugucacuggc

SEQ ID NO: 841670 - RNA, 22 nt, Human
auccaguuuaugucauauucuu

SEQ ID NO: 841671 - RNA, 22 nt, Human
cuguggagcuuguggcaguggg

SEQ ID NO: 841672 - RNA, 22 nt, Human
aaauucaauuaacuuucaugcu

SEQ ID NO: 841673 - RNA, 22 nt, Human
acauugaugaaaagguaucauu

SEQ ID NO: 841674 - RNA, 22 nt, Human
ugcagccaggaaauauuugcug

SEQ ID NO: 841675 - RNA, 22 nt, Human
ugcauuauacuuuuagaaauuu

SEQ ID NO: 841676 - RNA, 22 nt, Human
ccccuuccuuccucagacagcc

SEQ ID NO: 841677 - RNA, 22 nt, Human
gugccucagcaccgccugcagc

SEQ ID NO: 841678 - RNA, 22 nt, Human
cucuggagguggagguugcagu

SEQ ID NO: 841679 - RNA, 22 nt, Human
ucagaaauagucuuuaaaauga

SEQ ID NO: 841680 - RNA, 22 nt, Human
cugccagcacugccuccugagg

SEQ ID NO: 841681 - RNA, 22 nt, Human
uggcucaguggcagccgcagcu

SEQ ID NO: 841682 - RNA, 22 nt, Human
agggaguguaaauggugcucag

SEQ ID NO: 841683 - RNA, 22 nt, Human
aaggcugccucugccagaggag

SEQ ID NO: 841684 - RNA, 22 nt, Human
caugcuccaaaaacaagagaau

SEQ ID NO: 841685 - RNA, 22 nt, Human
ggccuuggggaggauggugucc

SEQ ID NO: 841686 - RNA, 21 nt, Human
aacugguucaauucaacuaga

SEQ ID NO: 841687 - RNA, 22 nt, Human
gaagaaucaagcaguaauuugu

SEQ ID NO: 841688 - RNA, 22 nt, Human
aggaggccgggauucuggagau

SEQ ID NO: 841689 - RNA, 22 nt, Human
cuggcugcuuguagacucgacu

SEQ ID NO: 841690 - RNA, 22 nt, Human
ggcagcuauuccaagcagcacu

SEQ ID NO: 841691 - RNA, 22 nt, Human
ugcccaggguuucuaagagcag

SEQ ID NO: 841692 - RNA, 22 nt, Human
ugugcuucagguugucgccacg

SEQ ID NO: 841693 - RNA, 22 nt, Human
gagccagguuggaggcugcagu

SEQ ID NO: 841694 - RNA, 23 nt, Human
gagauuuagcagacaaagcucuu

SEQ ID NO: 841695 - RNA, 22 nt, Human
agaggcccucucucuccugaug

SEQ ID NO: 841696 - RNA, 22 nt, Human
ggucccagguugacagggagac

SEQ ID NO: 841697 - RNA, 22 nt, Human
ucuggcucuguguccucaccca

SEQ ID NO: 841698 - RNA, 22 nt, Human
uagugcuuuaaguuuacagaga

SEQ ID NO: 841699 - RNA, 22 nt, Human
gcacacagccagcugagggcua

SEQ ID NO: 841700 - RNA, 22 nt, Human
cagcuuggcuuccgcuuuacug

SEQ ID NO: 841701 - RNA, 22 nt, Human
ccugccugaaggucagccaccc

SEQ ID NO: 841702 - RNA, 22 nt, Human
agaggucagaacaggaaagugu

SEQ ID NO: 841703 - RNA, 22 nt, Human
ucugggcucuuaguguacccuc

SEQ ID NO: 841704 - RNA, 22 nt, Human
ugcugcuguauccuuaguguca

SEQ ID NO: 841705 - RNA, 22 nt, Human
cugcagaguggagccucggcug

SEQ ID NO: 841706 - RNA, 22 nt, Human
guucauuuuacuguaaauagca

SEQ ID NO: 841707 - RNA, 20 nt, Human
ucugucucugagcuagacuu

SEQ ID NO: 841708 - RNA, 22 nt, Human
cccaugagguggagguugcagu

SEQ ID NO: 841709 - RNA, 22 nt, Human
aaagaaucuauauaucaccacc

SEQ ID NO: 841710 - RNA, 22 nt, Human
uggcucagugacauuccuccca

SEQ ID NO: 841711 - RNA, 22 nt, Human
ccagggcauguaacuaauggug

SEQ ID NO: 841712 - RNA, 22 nt, Human
agaugagggguagaaaggacuu

SEQ ID NO: 841713 - RNA, 20 nt, Human
agacaaaaugacuucaugca

SEQ ID NO: 841714 - RNA, 22 nt, Human
uggagcagcuaagccucugaga

SEQ ID NO: 841715 - RNA, 22 nt, Human
ucaggggacagccagcuggagg

SEQ ID NO: 841716 - RNA, 22 nt, Human
aacaaaugauaccaguucucaa

SEQ ID NO: 841717 - RNA, 22 nt, Human
ccagcuggaagagugcagaacu

SEQ ID NO: 841718 - RNA, 22 nt, Human
uagaaguuaaaggaauacagaa

SEQ ID NO: 841719 - RNA, 22 nt, Human
gaggguggguuucuugcacguc

SEQ ID NO: 841720 - RNA, 22 nt, Human
cccuggcagaaugucucugggc

SEQ ID NO: 841721 - RNA, 22 nt, Human
gcugccaguaguuggagcucca

SEQ ID NO: 841722 - RNA, 22 nt, Human
acuguguggaaauuugugaggg

SEQ ID NO: 841723 - RNA, 22 nt, Human
augagcuguaagguggcuuccu

SEQ ID NO: 841724 - RNA, 22 nt, Human
gacagccucaugaggagcaaaa

SEQ ID NO: 841725 - RNA, 22 nt, Human
ggcucaggacugcagcguagag

SEQ ID NO: 841726 - RNA, 22 nt, Human
ggugggcacauucagucucugu

SEQ ID NO: 841727 - RNA, 22 nt, Human
uuaaaaugcagauucugauuca

SEQ ID NO: 841728 - RNA, 19 nt, Human
cuugguuaugguaugaugc

SEQ ID NO: 841729 - RNA, 22 nt, Human
uguaagauauucagcuuauuga

SEQ ID NO: 841730 - RNA, 22 nt, Human
augguuuacugaucuuuuuggu

SEQ ID NO: 841731 - RNA, 22 nt, Human
ucacacauucuagguauguuga

SEQ ID NO: 841732 - RNA, 20 nt, Human
aaucagaaagugugagcucu

SEQ ID NO: 841733 - RNA, 22 nt, Human
ucuuuccuaggugauaugcaau

SEQ ID NO: 841734 - RNA, 22 nt, Human
acaggcugcugggcuccgugcu

SEQ ID NO: 841735 - RNA, 22 nt, Human
augucuuucgcaucaguagcua

SEQ ID NO: 841736 - RNA, 20 nt, Human
auuuggcaugaaguauugau

SEQ ID NO: 841737 - RNA, 21 nt, Human
ugaggcaggggugcuuuuguc

SEQ ID NO: 841738 - RNA, 22 nt, Human
gcuucucuggccugcagggcau

SEQ ID NO: 841739 - RNA, 22 nt, Human
aggagcagaacuguuguggagg

SEQ ID NO: 841740 - RNA, 23 nt, Human
cccagcagagaugaggagggguc

SEQ ID NO: 841741 - RNA, 22 nt, Human
cagucccaugagcccagaacau

SEQ ID NO: 841742 - RNA, 22 nt, Human
ugaaacauugcacuguaugaau

SEQ ID NO: 841743 - RNA, 22 nt, Human
auguuaaaugguuuauuauuaa

SEQ ID NO: 841744 - RNA, 22 nt, Human
gccagagcagaauagaguggcc

SEQ ID NO: 841745 - RNA, 18 nt, Human
ucaagacaucaugaaaua

SEQ ID NO: 841746 - RNA, 22 nt, Human
uugggcugaacccugcagcuga

SEQ ID NO: 841747 - RNA, 22 nt, Human
ccuccuggugggcgcuucuggc

SEQ ID NO: 841748 - RNA, 22 nt, Human
uaacagaaacagauaaguguaa

SEQ ID NO: 841749 - RNA, 21 nt, Human
gacaggggaagaagcaaggag

SEQ ID NO: 841750 - RNA, 22 nt, Human
ugcauauuuuauaaagauggaa

SEQ ID NO: 841751 - RNA, 22 nt, Human
gccugcagauauauaggauggu

SEQ ID NO: 841752 - RNA, 22 nt, Human
uucuucaaugugcccuguuuuc

SEQ ID NO: 841753 - RNA, 22 nt, Human
gagagugagauaauuucacaua

SEQ ID NO: 841754 - RNA, 22 nt, Human
gcugcugcgcuugucuacuguu

SEQ ID NO: 841755 - RNA, 22 nt, Human
agcaccuguggcucaugcucgu

SEQ ID NO: 841756 - RNA, 22 nt, Human
uuagcugcauuaucaaaguuau

SEQ ID NO: 841757 - RNA, 22 nt, Human
aaaagcucuuucugcuguagau

SEQ ID NO: 841758 - RNA, 22 nt, Human
auugaaagcauggauuuggauu

SEQ ID NO: 841759 - RNA, 21 nt, Human
ccucuggcuugugcugugccc

SEQ ID NO: 841760 - RNA, 22 nt, Human
aaagaauuuguacacccuacua

SEQ ID NO: 841761 - RNA, 22 nt, Human
cagcccugagagaaccaucuau

SEQ ID NO: 841762 - RNA, 22 nt, Human
aaagaacagauguguggugcau

SEQ ID NO: 841763 - RNA, 22 nt, Human
gagggcugaugcuuacuuauuu

SEQ ID NO: 841764 - RNA, 22 nt, Human
agcaggagcugugggaagaugg

SEQ ID NO: 841765 - RNA, 22 nt, Human
uucaaucauuuuuacauagucc

SEQ ID NO: 841766 - RNA, 22 nt, Human
ugcuggggucauggggcgcccg

SEQ ID NO: 841767 - RNA, 20 nt, Human
gaggcucugggcauggcgcc

SEQ ID NO: 841768 - RNA, 22 nt, Human
aauacuauguugugacacauga

SEQ ID NO: 841769 - RNA, 22 nt, Human
uggcacugggaugcuacuguua

SEQ ID NO: 841770 - RNA, 22 nt, Human
augucaaaucaguuuuaucaga

SEQ ID NO: 841771 - RNA, 22 nt, Human
agaucaaagccaugagagauuu

SEQ ID NO: 841772 - RNA, 21 nt, Human
auacagaacauugauccaaga

SEQ ID NO: 841773 - RNA, 22 nt, Human
ucuucacauggaacaugaagcu

SEQ ID NO: 841774 - RNA, 22 nt, Human
uaggaggguuagagggaaauau

SEQ ID NO: 841775 - RNA, 22 nt, Human
uaagaacaucuguccccagauu

SEQ ID NO: 841776 - RNA, 22 nt, Human
caugguuuauuagagcuuauuu

SEQ ID NO: 841777 - RNA, 22 nt, Human
ucauugaacgaagagcuccauu

SEQ ID NO: 841778 - RNA, 22 nt, Human
ucuggcccagccccugagguca

SEQ ID NO: 841779 - RNA, 22 nt, Human
ugggcugcuucuauuggugguc

SEQ ID NO: 841780 - RNA, 21 nt, Human
ccuggcugcacaguugcuggu

SEQ ID NO: 841781 - RNA, 23 nt, Human
ugcuucucugcuugacaguucug

SEQ ID NO: 841782 - RNA, 22 nt, Human
gagagcuggccagcuucaguau

SEQ ID NO: 841783 - RNA, 22 nt, Human
gcuaccugagcaagagcuucaa

SEQ ID NO: 841784 - RNA, 22 nt, Human
ggccugagcuugggcagcguau

SEQ ID NO: 841785 - RNA, 17 nt, Human
gcaaucucagucuccuu

SEQ ID NO: 841786 - RNA, 22 nt, Human
ugcagaagaccuuccagggcug

SEQ ID NO: 841787 - RNA, 22 nt, Human
gaggagagggcugcgggcccac

SEQ ID NO: 841788 - RNA, 22 nt, Human
ggagccugugcccaagcccaga

SEQ ID NO: 841789 - RNA, 22 nt, Human
gcugccacucugagcuugcuuc

SEQ ID NO: 841790 - RNA, 22 nt, Human
acugugcuuucucuggaggcau

SEQ ID NO: 841791 - RNA, 22 nt, Human
acagagcaugcucaguguguga

SEQ ID NO: 841792 - RNA, 22 nt, Human
cucuucuugccugaugaggcag

SEQ ID NO: 841793 - RNA, 22 nt, Human
agggggcaucagguccuggcuc

SEQ ID NO: 841794 - RNA, 22 nt, Human
aaauuaguacauugcaaagucc

SEQ ID NO: 841795 - RNA, 22 nt, Human
ccaggaguuugaggcugcagug

SEQ ID NO: 841796 - RNA, 22 nt, Human
acauauuuccaugcagcauguc

SEQ ID NO: 841797 - RNA, 22 nt, Human
ucucuggaagcgcagaucuguu

SEQ ID NO: 841798 - RNA, 22 nt, Human
uacagaaaaacuggcauugaag

SEQ ID NO: 841799 - RNA, 22 nt, Human
uucauucccuuauauuagcauu

SEQ ID NO: 841800 - RNA, 22 nt, Human
agaauuucuggaagauugcaag

SEQ ID NO: 841801 - RNA, 22 nt, Human
ugcuuugggucucucuaguuuc

SEQ ID NO: 841802 - RNA, 22 nt, Human
uguaugaauauguuggggaggu

SEQ ID NO: 841803 - RNA, 17 nt, Human
uaaagccagucaaguca

SEQ ID NO: 841804 - RNA, 22 nt, Human
ggaggccaggguggguggaucg

SEQ ID NO: 841805 - RNA, 22 nt, Human
guacagaaaguacccauagaag

SEQ ID NO: 841806 - RNA, 22 nt, Human
uuauuauugugguugcauuauc

SEQ ID NO: 841807 - RNA, 22 nt, Human
aagcagcuuuugaagagugagg

SEQ ID NO: 841808 - RNA, 22 nt, Human
ucaacuuuaguguagcuauuua

SEQ ID NO: 841809 - RNA, 22 nt, Human
uguccacaucacucacuuguca

SEQ ID NO: 841810 - RNA, 22 nt, Human
gaguccuugacacauaguaggu

SEQ ID NO: 841811 - RNA, 21 nt, Human
aacugcuggucuuuucugucu

SEQ ID NO: 841812 - RNA, 21 nt, Human
cugugcuuuuuaagugugaug

SEQ ID NO: 841813 - RNA, 22 nt, Human
uucuucaaccaucuacauaaac

SEQ ID NO: 841814 - RNA, 17 nt, Human
agaugcuggccacaugu

SEQ ID NO: 841815 - RNA, 22 nt, Human
ugcugccaagcccgugcuccug

SEQ ID NO: 841816 - RNA, 22 nt, Human
cuguccccgcgaguccagagcu

SEQ ID NO: 841817 - RNA, 22 nt, Human
cugaggcaugaaugugggcuuu

SEQ ID NO: 841818 - RNA, 22 nt, Human
ugugccaggcacuugcccaggc

SEQ ID NO: 841819 - RNA, 22 nt, Human
caguagccacuagacacaugua

SEQ ID NO: 841820 - RNA, 22 nt, Human
auuugagaugguaaauaacuuu

SEQ ID NO: 841821 - RNA, 22 nt, Human
ccaaaauuaagccucuuauguu

SEQ ID NO: 841822 - RNA, 22 nt, Human
gguaacaguauguagaguaaga

SEQ ID NO: 841823 - RNA, 22 nt, Human
cugcagcuccccugagaucaag

SEQ ID NO: 841824 - RNA, 22 nt, Human
ugaaaucugcaugcaaaguccu

SEQ ID NO: 841825 - RNA, 22 nt, Human
aggccugggucucgugccuacc

SEQ ID NO: 841826 - RNA, 22 nt, Human
gaaguucaggugggaauugagc

SEQ ID NO: 841827 - RNA, 22 nt, Human
caacauuugaguaaagaaaugg

SEQ ID NO: 841828 - RNA, 22 nt, Human
aaggcacuacgcugcuggggcg

SEQ ID NO: 841829 - RNA, 19 nt, Human
uagaaugcccacuuaaaaa

SEQ ID NO: 841830 - RNA, 22 nt, Human
ggagcagagcauuucacagccu

SEQ ID NO: 841831 - RNA, 22 nt, Human
aacuuucaggcaaugaauauuu

SEQ ID NO: 841832 - RNA, 22 nt, Human
agcccaggaaguugaggcuugc

SEQ ID NO: 841833 - RNA, 22 nt, Human
caguggguaggaaaggcucuuc

SEQ ID NO: 841834 - RNA, 22 nt, Human
gggcacugugcuaggugcugag

SEQ ID NO: 841835 - RNA, 22 nt, Human
gggcagcugccacuccgcuugc

SEQ ID NO: 841836 - RNA, 19 nt, Human
ggcucucuuaaagcuguuu

SEQ ID NO: 841837 - RNA, 22 nt, Human
ucauuucccuccuacaaagagg

SEQ ID NO: 841838 - RNA, 22 nt, Human
ggcugccauaacagaguaccac

SEQ ID NO: 841839 - RNA, 22 nt, Human
ugaaaguugcacauaagagaau

SEQ ID NO: 841840 - RNA, 22 nt, Human
ccugugcauccgguggucauug

SEQ ID NO: 841841 - RNA, 22 nt, Human
gauuucuucauucauuagaugg

SEQ ID NO: 841842 - RNA, 22 nt, Human
gcugggagccccgagccagcgc

SEQ ID NO: 841843 - RNA, 22 nt, Human
caagauuugccaguggccaacu

SEQ ID NO: 841844 - RNA, 22 nt, Human
gaggaaaagagacagguuauug

SEQ ID NO: 841845 - RNA, 22 nt, Human
gccucugcucggacuuugccuc

SEQ ID NO: 841846 - RNA, 22 nt, Human
gaaaugugaccuacuuccuugu

SEQ ID NO: 841847 - RNA, 22 nt, Human
aggucauugaaguuauuuucuu

SEQ ID NO: 841848 - RNA, 22 nt, Human
ccagcuuguuugaagcucguca

SEQ ID NO: 841849 - RNA, 20 nt, Human
aggcacuggggauagguaag

SEQ ID NO: 841850 - RNA, 22 nt, Human
uuccuuagggucagccagaucu

SEQ ID NO: 841851 - RNA, 22 nt, Human
agggcucugggguggcagagau

SEQ ID NO: 841852 - RNA, 22 nt, Human
uaugcauagguaucuauacuca

SEQ ID NO: 841853 - RNA, 22 nt, Human
gggcugcugcccaggaggcacc

SEQ ID NO: 841854 - RNA, 22 nt, Human
caaaguauauuggauugaaugg

SEQ ID NO: 841855 - RNA, 22 nt, Human
ccacaaguuucagcacccagag

SEQ ID NO: 841856 - RNA, 22 nt, Human
cuggcugugcagucuuccagaa

SEQ ID NO: 841857 - RNA, 23 nt, Human
ggcagcucucaucugaugacuga

SEQ ID NO: 841858 - RNA, 18 nt, Human
ugaggcagucagugaugg

SEQ ID NO: 841859 - RNA, 22 nt, Human
aggaggcacucacucucagggu

SEQ ID NO: 841860 - RNA, 22 nt, Human
uuugcauuguuucaaaagugaa

SEQ ID NO: 841861 - RNA, 22 nt, Human
gcaggaagaugagcucagguaa

SEQ ID NO: 841862 - RNA, 22 nt, Human
uacaaacuuguuuuaaguaagu

SEQ ID NO: 841863 - RNA, 22 nt, Human
uucuuuuacauuaagauuucag

SEQ ID NO: 841864 - RNA, 22 nt, Human
guuagaaacacauucuuauuga

SEQ ID NO: 841865 - RNA, 21 nt, Human
aacauuucaggauccaaauug

SEQ ID NO: 841866 - RNA, 22 nt, Human
ucccagagaagagcuggaugga

SEQ ID NO: 841867 - RNA, 22 nt, Human
aggcaagcauugggaacagggc

SEQ ID NO: 841868 - RNA, 22 nt, Human
gucugaggaagaugcaggggga

SEQ ID NO: 841869 - RNA, 22 nt, Human
uuugaacuucuccauucugaug

SEQ ID NO: 841870 - RNA, 22 nt, Human
cuagccugggauuugaacuuau

SEQ ID NO: 841871 - RNA, 17 nt, Human
gcuguaguuugauaaga

SEQ ID NO: 841872 - RNA, 22 nt, Human
uguuuuauuucuccaagaggga

SEQ ID NO: 841873 - RNA, 22 nt, Human
agcuccugcacccagccuugag

SEQ ID NO: 841874 - RNA, 19 nt, Human
ggaagagaggaaaggugga

SEQ ID NO: 841875 - RNA, 22 nt, Human
uccuuccugcaggccaaguccu

SEQ ID NO: 841876 - RNA, 22 nt, Human
cagaagcagugagagaugugca

SEQ ID NO: 841877 - RNA, 22 nt, Human
gcagcuggugcaaaugucacuc

SEQ ID NO: 841878 - RNA, 22 nt, Human
ccacucugcugugcuccaugau

SEQ ID NO: 841879 - RNA, 22 nt, Human
uuuauuuggcauccagggagaa

SEQ ID NO: 841880 - RNA, 22 nt, Human
ugccugucuccucugcagggug

SEQ ID NO: 841881 - RNA, 22 nt, Human
aaacaaacauagguuugaaagu

SEQ ID NO: 841882 - RNA, 22 nt, Human
ucaguuaacaacuauuuauuga

SEQ ID NO: 841883 - RNA, 22 nt, Human
gagacugcauuguccaaggguu

SEQ ID NO: 841884 - RNA, 22 nt, Human
ggaagaggcugaggccaugcug

SEQ ID NO: 841885 - RNA, 22 nt, Human
uuuaggaaugugguuuuugagc

SEQ ID NO: 841886 - RNA, 22 nt, Human
uuauacauguguuuugagauga

SEQ ID NO: 841887 - RNA, 18 nt, Human
ggaaaaggagugucuagc

SEQ ID NO: 841888 - RNA, 22 nt, Human
aaucaaaaccuacagagguaau

SEQ ID NO: 841889 - RNA, 22 nt, Human
agacgagggccuggcacacagu

SEQ ID NO: 841890 - RNA, 22 nt, Human
gagccugagugcugccuccccu

SEQ ID NO: 841891 - RNA, 22 nt, Human
aggccuggccugggcggcauug

SEQ ID NO: 841892 - RNA, 22 nt, Human
uuuacuuugugucaagucaaga

SEQ ID NO: 841893 - RNA, 22 nt, Human
cagguacacucccuugugcuga

SEQ ID NO: 841894 - RNA, 22 nt, Human
accuggcacuacaggcaccugu

SEQ ID NO: 841895 - RNA, 22 nt, Human
gaggcagaaguugcagugagca

SEQ ID NO: 841896 - RNA, 22 nt, Human
ucaggagaacuuccuucuaccc

SEQ ID NO: 841897 - RNA, 22 nt, Human
ugaaaucuacccuauucagggu

SEQ ID NO: 841898 - RNA, 22 nt, Human
ccagcugcugugaggaccacag

SEQ ID NO: 841899 - RNA, 22 nt, Human
guggccugggguuuguucugag

SEQ ID NO: 841900 - RNA, 22 nt, Human
cuucaagagaaugcagggaugu

SEQ ID NO: 841901 - RNA, 22 nt, Human
ucugggaaccagugcggcuggg

SEQ ID NO: 841902 - RNA, 22 nt, Human
agugcuguccaguuucacaggu

SEQ ID NO: 841903 - RNA, 22 nt, Human
uccuucaggguugaggccgacu

SEQ ID NO: 841904 - RNA, 19 nt, Human
ggaaacaggggccagagga

SEQ ID NO: 841905 - RNA, 22 nt, Human
uauauucaaugauuaguaucag

SEQ ID NO: 841906 - RNA, 22 nt, Human
ggaggccaccugaccugcuguu

SEQ ID NO: 841907 - RNA, 22 nt, Human
aucuuucuauuucuaaaaacua

SEQ ID NO: 841908 - RNA, 21 nt, Human
ccaggguccagcugccauggu

SEQ ID NO: 841909 - RNA, 22 nt, Human
gcuggccauggccugcgccauc

SEQ ID NO: 841910 - RNA, 18 nt, Human
cucagggcaucagucugg

SEQ ID NO: 841911 - RNA, 22 nt, Human
ccucucuguguggccucuccau

SEQ ID NO: 841912 - RNA, 22 nt, Human
auuaaauuaaguggcuaauuua

SEQ ID NO: 841913 - RNA, 22 nt, Human
gaggagcuugaggcuaggagcc

SEQ ID NO: 841914 - RNA, 22 nt, Human
gcuccuggcuccaggcagccaa

SEQ ID NO: 841915 - RNA, 22 nt, Human
ggugggcagcucuuggcaggca

SEQ ID NO: 841916 - RNA, 22 nt, Human
guccucaggaaagcagauaaca

SEQ ID NO: 841917 - RNA, 22 nt, Human
uuucuaggucuuccauacugcc

SEQ ID NO: 841918 - RNA, 20 nt, Human
uuuuccagaaaguaucauug

SEQ ID NO: 841919 - RNA, 22 nt, Human
aaaugucugagacuucugaacu

SEQ ID NO: 841920 - RNA, 22 nt, Human
gccuggccgcuccgagcuccgc

SEQ ID NO: 841921 - RNA, 22 nt, Human
gcagcugaaagggaucucuaca

SEQ ID NO: 841922 - RNA, 22 nt, Human
aggcuucuaggguuggcagcgg

SEQ ID NO: 841923 - RNA, 22 nt, Human
gugauuucagguuuuucauacu

SEQ ID NO: 841924 - RNA, 22 nt, Human
aagaaaucagaaaagcauucgu

SEQ ID NO: 841925 - RNA, 22 nt, Human
uuguuuuggagaugagcuaaaa

SEQ ID NO: 841926 - RNA, 22 nt, Human
cuguaugaacccauauacuuau

SEQ ID NO: 841927 - RNA, 22 nt, Human
uuuauuguuguuagucauaagu

SEQ ID NO: 841928 - RNA, 23 nt, Human
uggagcugggcucagacccuggg

SEQ ID NO: 841929 - RNA, 22 nt, Human
gcucccaccuuugcuaucagua

SEQ ID NO: 841930 - RNA, 22 nt, Human
aaggcagcaggauuuggugacu

SEQ ID NO: 841931 - RNA, 19 nt, Human
ucgagucaagacacuaggc

SEQ ID NO: 841932 - RNA, 22 nt, Human
ccaggagcagggcuggcugcac

SEQ ID NO: 841933 - RNA, 23 nt, Human
ugcauuauccucucugaagacca

SEQ ID NO: 841934 - RNA, 22 nt, Human
cccaggaaaugggcucuugccu

SEQ ID NO: 841935 - RNA, 22 nt, Human
uggcaguggcucagagugcaga

SEQ ID NO: 841936 - RNA, 22 nt, Human
cacauggggcgcugcauuggcc

SEQ ID NO: 841937 - RNA, 22 nt, Human
cugcccugggauggucugugcg

SEQ ID NO: 841938 - RNA, 22 nt, Human
uccucacauggugagccacaca

SEQ ID NO: 841939 - RNA, 22 nt, Human
uaacaauaguguuugcuaguca

SEQ ID NO: 841940 - RNA, 22 nt, Human
uuguaugagcuccaggaacuca

SEQ ID NO: 841941 - RNA, 23 nt, Human
cccuggaguaaauucuuggaagg

SEQ ID NO: 841942 - RNA, 22 nt, Human
gucucagagagcuacucucuua

SEQ ID NO: 841943 - RNA, 22 nt, Human
aucaguuucugugaagaacaca

SEQ ID NO: 841944 - RNA, 22 nt, Human
gauuuacagaucuaagggucac

SEQ ID NO: 841945 - RNA, 22 nt, Human
gcugucccaugguugcaagaug

SEQ ID NO: 841946 - RNA, 22 nt, Human
gccugagcccaggugugcagag

SEQ ID NO: 841947 - RNA, 22 nt, Human
uggggguguccuggugcacaca

SEQ ID NO: 841948 - RNA, 22 nt, Human
gggcaguggcucacgccuguaa

SEQ ID NO: 841949 - RNA, 21 nt, Human
cugguguagcacucaggugcu

SEQ ID NO: 841950 - RNA, 22 nt, Human
aggcugccuguuccaaucuccu

SEQ ID NO: 841951 - RNA, 22 nt, Human
ugcauccuuaaccagcaucacu

SEQ ID NO: 841952 - RNA, 22 nt, Human
uuucaaagguggaagagugaau

SEQ ID NO: 841953 - RNA, 22 nt, Human
caucagaaucugagucucugcc

SEQ ID NO: 841954 - RNA, 22 nt, Human
agguggaacguucaggugcuag

SEQ ID NO: 841955 - RNA, 22 nt, Human
cuccaggaaaauagggaaugag

SEQ ID NO: 841956 - RNA, 22 nt, Human
ccuccuggcccugggccuggaa

SEQ ID NO: 841957 - RNA, 22 nt, Human
auaugugaaugauaucacuuug

SEQ ID NO: 841958 - RNA, 22 nt, Human
gaggaguguauuccacaccacu

SEQ ID NO: 841959 - RNA, 22 nt, Human
aauaugugagguauguucagug

SEQ ID NO: 841960 - RNA, 22 nt, Human
cagcucucuaaggucuugcuuu

SEQ ID NO: 841961 - RNA, 22 nt, Human
agccuucacugggaccuuggau

SEQ ID NO: 841962 - RNA, 22 nt, Human
ucaucacucauuggacaacaga

SEQ ID NO: 841963 - RNA, 18 nt, Human
aauuuccauaugaauugc

SEQ ID NO: 841964 - RNA, 22 nt, Human
uuagccaugcccuagaagagga

SEQ ID NO: 841965 - RNA, 23 nt, Human
uccaggagcaugcuggcuggcga

SEQ ID NO: 841966 - RNA, 22 nt, Human
uggcucaguuucaguccugguu

SEQ ID NO: 841967 - RNA, 21 nt, Human
agaggcaggcauuaaguacac

SEQ ID NO: 841968 - RNA, 22 nt, Human
auccuugagccuuaucuuuugu

SEQ ID NO: 841969 - RNA, 22 nt, Human
aggggcucaguuacuuuggcag

SEQ ID NO: 841970 - RNA, 22 nt, Human
aaggcacuguacuaguuaguua

SEQ ID NO: 841971 - RNA, 22 nt, Human
gagggaugguaguugacacuga

SEQ ID NO: 841972 - RNA, 20 nt, Human
caggccucugggggcccugg

SEQ ID NO: 841973 - RNA, 22 nt, Human
ugagccagucugucugggugaa

SEQ ID NO: 841974 - RNA, 22 nt, Human
gcagccaccucccauggcgggg

SEQ ID NO: 841975 - RNA, 21 nt, Human
guggcucugccaggacugaaa

SEQ ID NO: 841976 - RNA, 22 nt, Human
caucagaaugaauguucuggag

SEQ ID NO: 841977 - RNA, 22 nt, Human
aggggccuggacauggacgcgc

SEQ ID NO: 841978 - RNA, 22 nt, Human
cagagguagccgagugcaaucg

SEQ ID NO: 841979 - RNA, 22 nt, Human
ucugagcauugaauuuucuucc

SEQ ID NO: 841980 - RNA, 22 nt, Human
acaggcuuacaggcugcaagua

SEQ ID NO: 841981 - RNA, 22 nt, Human
gcaccacaucaaugaggggagc

SEQ ID NO: 841982 - RNA, 22 nt, Human
auacagaaguuuuccacuuauu

SEQ ID NO: 841983 - RNA, 22 nt, Human
aucagcaagauguaauuucuau

SEQ ID NO: 841984 - RNA, 22 nt, Human
ugaaaucuccucuuuauauauc

SEQ ID NO: 841985 - RNA, 22 nt, Human
agagcagaggcauggccguggg

SEQ ID NO: 841986 - RNA, 22 nt, Human
acagggucaagggugcuacaag

SEQ ID NO: 841987 - RNA, 22 nt, Human
uuuaggcagcacgggcagcccu

SEQ ID NO: 841988 - RNA, 22 nt, Human
ucagaacaauugggaaccauua

SEQ ID NO: 841989 - RNA, 22 nt, Human
agggagcucacaguccaguaga

SEQ ID NO: 841990 - RNA, 22 nt, Human
cagaaagcuuaggcaaguugga

SEQ ID NO: 841991 - RNA, 22 nt, Human
ggcuucugagugcucugcuguu

SEQ ID NO: 841992 - RNA, 22 nt, Human
uuuauguaaguggaaugaugcc

SEQ ID NO: 841993 - RNA, 22 nt, Human
uggagcaggcaucuuucucucu

SEQ ID NO: 841994 - RNA, 22 nt, Human
ggagggcucaauugacuccuga

SEQ ID NO: 841995 - RNA, 22 nt, Human
ggucauugaaaucagaaggguu

SEQ ID NO: 841996 - RNA, 22 nt, Human
agcucccagaagccagagucgg

SEQ ID NO: 841997 - RNA, 22 nt, Human
agcugcccugggcuggagaugg

SEQ ID NO: 841998 - RNA, 22 nt, Human
caaugucaugauuuuccauuag

SEQ ID NO: 841999 - RNA, 22 nt, Human
aaaaguauuuauggcuauguaa

SEQ ID NO: 842000 - RNA, 22 nt, Human
cacaggagagcugggaggugcc

SEQ ID NO: 842001 - RNA, 22 nt, Human
cacucugaugguuucuguucaa

SEQ ID NO: 842002 - RNA, 18 nt, Human
acauuucucucugcguga

SEQ ID NO: 842003 - RNA, 22 nt, Human
ucaaaguuacuugugguuuucu

SEQ ID NO: 842004 - RNA, 22 nt, Human
agugacugggcagggcagggcc

SEQ ID NO: 842005 - RNA, 22 nt, Human
cagcuugcaguacuuguuuuug

SEQ ID NO: 842006 - RNA, 20 nt, Human
gaggcugcggacugcuggac

SEQ ID NO: 842007 - RNA, 22 nt, Human
cugcauuagucaugcuuugcag

SEQ ID NO: 842008 - RNA, 22 nt, Human
aaacagcuggucucaaauguuc

SEQ ID NO: 842009 - RNA, 22 nt, Human
acuggcaggcugcuggccggcg

SEQ ID NO: 842010 - RNA, 22 nt, Human
ccugccugcguccucugagggc

SEQ ID NO: 842011 - RNA, 17 nt, Human
ucaggcugggugcagug

SEQ ID NO: 842012 - RNA, 22 nt, Human
agguggggugagcugcagacua

SEQ ID NO: 842013 - RNA, 22 nt, Human
aaaguuuuagaacuaggaagca

SEQ ID NO: 842014 - RNA, 22 nt, Human
agcaccaugaccuugccauuga

SEQ ID NO: 842015 - RNA, 22 nt, Human
aaccaggacaauuuugaaagua

SEQ ID NO: 842016 - RNA, 22 nt, Human
agucucugcaugaugcagcaca

SEQ ID NO: 842017 - RNA, 22 nt, Human
ugcugaggucaccuugcugcua

SEQ ID NO: 842018 - RNA, 19 nt, Human
agggaaggauucugucauu

SEQ ID NO: 842019 - RNA, 22 nt, Human
aggccugacuugaauuuagggc

SEQ ID NO: 842020 - RNA, 22 nt, Human
gacaauaaaaugaucuuacagu

SEQ ID NO: 842021 - RNA, 22 nt, Human
cagcccugagaaggaggaucuc

SEQ ID NO: 842022 - RNA, 21 nt, Human
ugcaugcuauguuuuuauuuc

SEQ ID NO: 842023 - RNA, 22 nt, Human
cauuucaagcauugacuucuau

SEQ ID NO: 842024 - RNA, 22 nt, Human
aucauucuauuguugagcugcc

SEQ ID NO: 842025 - RNA, 22 nt, Human
gaggcaggcagauugcuugagg

SEQ ID NO: 842026 - RNA, 22 nt, Human
caguauguuugggagacaugac

SEQ ID NO: 842027 - RNA, 22 nt, Human
ucugccuucgcugcucccugaa

SEQ ID NO: 842028 - RNA, 22 nt, Human
agugcacaccuuaguacaaagu

SEQ ID NO: 842029 - RNA, 22 nt, Human
gcucccaccaggcagaccuacc

SEQ ID NO: 842030 - RNA, 23 nt, Human
ucuguacacaucagcaucuccca

SEQ ID NO: 842031 - RNA, 22 nt, Human
gcucacagccggcuggcagggg

SEQ ID NO: 842032 - RNA, 22 nt, Human
ucuuuccauggccacacagucu

SEQ ID NO: 842033 - RNA, 22 nt, Human
agagugggugaucucuguuguc

SEQ ID NO: 842034 - RNA, 22 nt, Human
cacuggcaugugaggcgguggc

SEQ ID NO: 842035 - RNA, 22 nt, Human
aguauaauuagauaucaaaagu

SEQ ID NO: 842036 - RNA, 22 nt, Human
auauguguauuugguuagccua

SEQ ID NO: 842037 - RNA, 22 nt, Human
gcacacaggcaguuuccagcca

SEQ ID NO: 842038 - RNA, 22 nt, Human
cucaggacccgguccagguggg

SEQ ID NO: 842039 - RNA, 22 nt, Human
ucaggcacugcuuucugauaug

SEQ ID NO: 842040 - RNA, 22 nt, Human
ugggggugugccagggaccucc

SEQ ID NO: 842041 - RNA, 22 nt, Human
uccucaggauguggaguagaau

SEQ ID NO: 842042 - RNA, 22 nt, Human
gccugugcuuaacugacgugag

SEQ ID NO: 842043 - RNA, 17 nt, Human
agcugagcuggccaggg

SEQ ID NO: 842044 - RNA, 19 nt, Human
ugccuggcaccagcuccac

SEQ ID NO: 842045 - RNA, 22 nt, Human
ucugcaggcuuggaguggcagc

SEQ ID NO: 842046 - RNA, 22 nt, Human
guuccaaaguuagaguguauug

SEQ ID NO: 842047 - RNA, 22 nt, Human
gaugcugagagguggagggaac

SEQ ID NO: 842048 - RNA, 22 nt, Human
uccuggaguugugcagugcaca

SEQ ID NO: 842049 - RNA, 22 nt, Human
aagauaaacucuugauuucuga

SEQ ID NO: 842050 - RNA, 22 nt, Human
agucucugagguucagaugccu

SEQ ID NO: 842051 - RNA, 22 nt, Human
cugccugugcaugcagucagaa

SEQ ID NO: 842052 - RNA, 22 nt, Human
auuuagaaguuggagggcaaga

SEQ ID NO: 842053 - RNA, 22 nt, Human
uuugaaugcaggacauacagaa

SEQ ID NO: 842054 - RNA, 22 nt, Human
guacaauagucccuguuuggau

SEQ ID NO: 842055 - RNA, 22 nt, Human
cugggacacccaaggaaagagc

SEQ ID NO: 842056 - RNA, 22 nt, Human
auuuccagugcacugaauagaa

SEQ ID NO: 842057 - RNA, 22 nt, Human
aggagggagaugcccauccugg

SEQ ID NO: 842058 - RNA, 22 nt, Human
aacagacaacuccuguggcuca

SEQ ID NO: 842059 - RNA, 22 nt, Human
ggcugccugccuccaagccggg

SEQ ID NO: 842060 - RNA, 22 nt, Human
ccuggcagguggagguugcagu

SEQ ID NO: 842061 - RNA, 18 nt, Human
gggcucugauccuucacc

SEQ ID NO: 842062 - RNA, 22 nt, Human
caaauguguagagcuuuugggg

SEQ ID NO: 842063 - RNA, 22 nt, Human
aagagcugcaucuaagccauga

SEQ ID NO: 842064 - RNA, 22 nt, Human
agggacuggcucucugagcagg

SEQ ID NO: 842065 - RNA, 22 nt, Human
gggagcugagcuggaagagaau

SEQ ID NO: 842066 - RNA, 22 nt, Human
gcagaagcugggcagcgaggug

SEQ ID NO: 842067 - RNA, 22 nt, Human
gcuggugagcaaaggagaagga

SEQ ID NO: 842068 - RNA, 22 nt, Human
uggcagggaauacagauguuua

SEQ ID NO: 842069 - RNA, 22 nt, Human
gcccaggaaagauagggccuca

SEQ ID NO: 842070 - RNA, 22 nt, Human
cauuuacuuaaaucuuuacaag

SEQ ID NO: 842071 - RNA, 22 nt, Human
caagaaauguuuacugagcauc

SEQ ID NO: 842072 - RNA, 22 nt, Human
ugacaccacaacuagccauuga

SEQ ID NO: 842073 - RNA, 22 nt, Human
uuagugucuucuucauccucug

SEQ ID NO: 842074 - RNA, 22 nt, Human
agcagugggggaguguuaguuu

SEQ ID NO: 842075 - RNA, 22 nt, Human
gaaaaugugucaucccuacugu

SEQ ID NO: 842076 - RNA, 20 nt, Human
uguaacaaucuggauguugc

SEQ ID NO: 842077 - RNA, 22 nt, Human
ccagagcuccagggcuacagaa

SEQ ID NO: 842078 - RNA, 22 nt, Human
auuguauuuccagcuugaaugu

SEQ ID NO: 842079 - RNA, 22 nt, Human
uauuccagguuucuuguuguau

SEQ ID NO: 842080 - RNA, 22 nt, Human
gggcccuggacguggcggcaga

SEQ ID NO: 842081 - RNA, 22 nt, Human
ugaaaguuacaggaaaacagau

SEQ ID NO: 842082 - RNA, 22 nt, Human
caggucagagucccccuguccu

SEQ ID NO: 842083 - RNA, 22 nt, Human
gagcagcuuaugucaagccaga

SEQ ID NO: 842084 - RNA, 21 nt, Human
uaucuacuggugucuuucaga

SEQ ID NO: 842085 - RNA, 22 nt, Human
ggagcagagcugggcuuggcug

SEQ ID NO: 842086 - RNA, 21 nt, Human
gccucugcugucuuauuguga

SEQ ID NO: 842087 - RNA, 22 nt, Human
ccuaagaauuaaugaauacacc

SEQ ID NO: 842088 - RNA, 20 nt, Human
uuucugugcccaggucuguu

SEQ ID NO: 842089 - RNA, 22 nt, Human
aggccugagccccagguuuguu

SEQ ID NO: 842090 - RNA, 21 nt, Human
uggcucuggguaggagagugc

SEQ ID NO: 842091 - RNA, 22 nt, Human
aaguauuucguucugaaaaagu

SEQ ID NO: 842092 - RNA, 22 nt, Human
aggacucaucccugcuugucag

SEQ ID NO: 842093 - RNA, 19 nt, Human
ugaagcaauaccauuuuug

SEQ ID NO: 842094 - RNA, 22 nt, Human
gugggaugguagguagguaaua

SEQ ID NO: 842095 - RNA, 22 nt, Human
cucuguagaaacagggcagaag

SEQ ID NO: 842096 - RNA, 22 nt, Human
ugcagggcuuccucuuggaguu

SEQ ID NO: 842097 - RNA, 22 nt, Human
uggcagagucaucacaucugga

SEQ ID NO: 842098 - RNA, 22 nt, Human
agagugaaguucaucgugcagc

SEQ ID NO: 842099 - RNA, 22 nt, Human
uccuccaggucuaggguggcuu

SEQ ID NO: 842100 - RNA, 22 nt, Human
agguggagaagagaugggcagu

SEQ ID NO: 842101 - RNA, 19 nt, Human
uccucaggggcucacagac

SEQ ID NO: 842102 - RNA, 22 nt, Human
uggacagcgaaagugccuggga

SEQ ID NO: 842103 - RNA, 22 nt, Human
ucaaaauuaaaccaacguccag

SEQ ID NO: 842104 - RNA, 22 nt, Human
aguacaauuuaaugaagauagc

SEQ ID NO: 842105 - RNA, 22 nt, Human
auugucuuuccacugagaaguu

SEQ ID NO: 842106 - RNA, 22 nt, Human
gcagcacauauaaacaaagaga

SEQ ID NO: 842107 - RNA, 21 nt, Human
cuacagaagcucuccuaucca

SEQ ID NO: 842108 - RNA, 22 nt, Human
ucuggcaggcaaucggcucugg

SEQ ID NO: 842109 - RNA, 23 nt, Human
ccaaagucgaagucuaguccaga

SEQ ID NO: 842110 - RNA, 22 nt, Human
aggagggugauccgggcugguc

SEQ ID NO: 842111 - RNA, 22 nt, Human
caaagcaccacaaaccagguga

SEQ ID NO: 842112 - RNA, 18 nt, Human
uuugcaaaggaaguaugg

SEQ ID NO: 842113 - RNA, 22 nt, Human
aucauuacuccuguaaaauugu

SEQ ID NO: 842114 - RNA, 22 nt, Human
ucaaaugcugccuuugugugcc

SEQ ID NO: 842115 - RNA, 22 nt, Human
cucucccagucaggcucaggau

SEQ ID NO: 842116 - RNA, 22 nt, Human
uaaauuauguuccauguccuuu

SEQ ID NO: 842117 - RNA, 22 nt, Human
ugcuauaaguagacauucaaca

SEQ ID NO: 842118 - RNA, 22 nt, Human
ggagcugaugacgucaccaugg

SEQ ID NO: 842119 - RNA, 22 nt, Human
uuauccuggauuauauauguga

SEQ ID NO: 842120 - RNA, 22 nt, Human
ugccuuccuggagcugaaggcu

SEQ ID NO: 842121 - RNA, 19 nt, Human
ggacacagaaagcugcauu

SEQ ID NO: 842122 - RNA, 22 nt, Human
agcagccagugggagugauaca

SEQ ID NO: 842123 - RNA, 22 nt, Human
auuguacuuuuauuacauguag

SEQ ID NO: 842124 - RNA, 22 nt, Human
agccucugguccucccucagcu

SEQ ID NO: 842125 - RNA, 22 nt, Human
ucugccugaaauucacauguaa

SEQ ID NO: 842126 - RNA, 22 nt, Human
uaggcaggugugcacugcccac

SEQ ID NO: 842127 - RNA, 22 nt, Human
caggcaggugcagauuccucuu

SEQ ID NO: 842128 - RNA, 22 nt, Human
gguggcagcgucuaucugacau

SEQ ID NO: 842129 - RNA, 22 nt, Human
uuauuuaauuuucucacucaga

SEQ ID NO: 842130 - RNA, 22 nt, Human
uaaaugugcacagguuagaagg

SEQ ID NO: 842131 - RNA, 22 nt, Human
gcugugugacugagagccuggc

SEQ ID NO: 842132 - RNA, 22 nt, Human
uuuucagaggccuaagagguuu

SEQ ID NO: 842133 - RNA, 22 nt, Human
aaaauuauucauggcuuuugga

SEQ ID NO: 842134 - RNA, 22 nt, Human
uccaguggugguuugaagggca

SEQ ID NO: 842135 - RNA, 22 nt, Human
caauacuuccuuguuagaggca

SEQ ID NO: 842136 - RNA, 20 nt, Human
cugcuguguuauuguagaac

SEQ ID NO: 842137 - RNA, 22 nt, Human
caggaggaggugagguagaacu

SEQ ID NO: 842138 - RNA, 22 nt, Human
uaugcacagaaguuugcugaau

SEQ ID NO: 842139 - RNA, 22 nt, Human
uugugcauuucucugagugugu

SEQ ID NO: 842140 - RNA, 22 nt, Human
acaauacuauuuucaguauccu

SEQ ID NO: 842141 - RNA, 22 nt, Human
ucccagcauaacaaacugcccg

SEQ ID NO: 842142 - RNA, 22 nt, Human
aagacagaccacgugacagggc

SEQ ID NO: 842143 - RNA, 22 nt, Human
caggucccgccccgggcugacc

SEQ ID NO: 842144 - RNA, 22 nt, Human
acacauauucauauguacuuac

SEQ ID NO: 842145 - RNA, 22 nt, Human
guggccuuuccugaagaaauga

SEQ ID NO: 842146 - RNA, 22 nt, Human
aggcagcuuuguaguaaagcua

SEQ ID NO: 842147 - RNA, 20 nt, Human
gccagcccugacacaggagc

SEQ ID NO: 842148 - RNA, 22 nt, Human
ccugugugcacacgaggccaug

SEQ ID NO: 842149 - RNA, 22 nt, Human
aggagcugaagucucugcacuc

SEQ ID NO: 842150 - RNA, 22 nt, Human
acauuguagacuuuucauaugu

SEQ ID NO: 842151 - RNA, 22 nt, Human
cuccugggcucaagugauccuc

SEQ ID NO: 842152 - RNA, 21 nt, Human
gggcuggacaugguggcucau

SEQ ID NO: 842153 - RNA, 22 nt, Human
uacugaaaguggucaacagugg

SEQ ID NO: 842154 - RNA, 22 nt, Human
gucugcccucacgccagcuggg

SEQ ID NO: 842155 - RNA, 22 nt, Human
uagccgggugugguggaacucc

SEQ ID NO: 842156 - RNA, 22 nt, Human
uuugaagugcaaugaggauucu

SEQ ID NO: 842157 - RNA, 22 nt, Human
ggcuagaacuuuacacuuugca

SEQ ID NO: 842158 - RNA, 22 nt, Human
aggcuccuuguucaucauccau

SEQ ID NO: 842159 - RNA, 22 nt, Human
ugcucuggagggugaagcuuuu

SEQ ID NO: 842160 - RNA, 22 nt, Human
ugggcuccagcaccugugcucu

SEQ ID NO: 842161 - RNA, 22 nt, Human
aguggcaggaaaguggaagaga

SEQ ID NO: 842162 - RNA, 22 nt, Human
uuugaauguuuuagguacuuaa

SEQ ID NO: 842163 - RNA, 22 nt, Human
cagggcuggauccuccagacuc

SEQ ID NO: 842164 - RNA, 22 nt, Human
uuuauguuugacaaugaucugg

SEQ ID NO: 842165 - RNA, 22 nt, Human
cacugcuuuaaggcugaguaac

SEQ ID NO: 842166 - RNA, 22 nt, Human
gcguuaauaacauuaauaaugc

SEQ ID NO: 842167 - RNA, 22 nt, Human
aaucuuagguuuggcuucaucu

SEQ ID NO: 842168 - RNA, 22 nt, Human
aguuuuucugcuggucucacua

SEQ ID NO: 842169 - RNA, 22 nt, Human
uaaauguguguagccaucugug

SEQ ID NO: 842170 - RNA, 22 nt, Human
agccagucggggccaugcuggg

SEQ ID NO: 842171 - RNA, 22 nt, Human
ugcauuaucuuuaauguucuca

SEQ ID NO: 842172 - RNA, 22 nt, Human
ucaggggcuugaggugcauguc

SEQ ID NO: 842173 - RNA, 22 nt, Human
caggagacaaguuagcagcuga

SEQ ID NO: 842174 - RNA, 22 nt, Human
cugccuggcuaaacucaagucg

SEQ ID NO: 842175 - RNA, 22 nt, Human
cccaucacagacacuggguuau

SEQ ID NO: 842176 - RNA, 22 nt, Human
uggcagggugggcuucagcccc

SEQ ID NO: 842177 - RNA, 22 nt, Human
auugugcaaauauuaucuguag

SEQ ID NO: 842178 - RNA, 22 nt, Human
aaucagaaucaguugacacagc

SEQ ID NO: 842179 - RNA, 22 nt, Human
aaaguguugggauuacaggugu

SEQ ID NO: 842180 - RNA, 22 nt, Human
cagcauggagacaaagugggca

SEQ ID NO: 842181 - RNA, 22 nt, Human
ccucacuggccagccaggggug

SEQ ID NO: 842182 - RNA, 22 nt, Human
ggcugcugggaauaugccagcu

SEQ ID NO: 842183 - RNA, 22 nt, Human
ggaggggaggauuaaugacaaa

SEQ ID NO: 842184 - RNA, 19 nt, Human
ucaaagcaagcauguucug

SEQ ID NO: 842185 - RNA, 22 nt, Human
agucucagaaaauaugcuuuuu

SEQ ID NO: 842186 - RNA, 19 nt, Human
ccugucugucuucagcuag

SEQ ID NO: 842187 - RNA, 22 nt, Human
cuuaauuacccaaugugguagg

SEQ ID NO: 842188 - RNA, 22 nt, Human
cauuucaaacaguuacagcugc

SEQ ID NO: 842189 - RNA, 22 nt, Human
cucucugaggaaggagcaucug

SEQ ID NO: 842190 - RNA, 22 nt, Human
uccagugguacauggagacacu

SEQ ID NO: 842191 - RNA, 22 nt, Human
gcuguggcuguacagagaccau

SEQ ID NO: 842192 - RNA, 19 nt, Human
aauguaguguuaugucaac

SEQ ID NO: 842193 - RNA, 22 nt, Human
aggaggcugguucaggccauau

SEQ ID NO: 842194 - RNA, 22 nt, Human
cccaagagcuucuaggacgcug

SEQ ID NO: 842195 - RNA, 22 nt, Human
acagauguacacucauauauaa

SEQ ID NO: 842196 - RNA, 22 nt, Human
guacagaaggagcuuuggauuc

SEQ ID NO: 842197 - RNA, 22 nt, Human
acucagaaccauuuacucugag

SEQ ID NO: 842198 - RNA, 19 nt, Human
uucccaggaaaggggugca

SEQ ID NO: 842199 - RNA, 22 nt, Human
gagaggaguagacacuuugguu

SEQ ID NO: 842200 - RNA, 22 nt, Human
acaauucugaugguuucccagu

SEQ ID NO: 842201 - RNA, 22 nt, Human
ucaguuuucucaucuguaauuu

SEQ ID NO: 842202 - RNA, 20 nt, Human
cccucccagaugcuucccaa

SEQ ID NO: 842203 - RNA, 22 nt, Human
agauauuuguaucuugcuauug

SEQ ID NO: 842204 - RNA, 22 nt, Human
ccagcagaagcucccgcugggu

SEQ ID NO: 842205 - RNA, 18 nt, Human
gguggccuugacuucucu

SEQ ID NO: 842206 - RNA, 22 nt, Human
aaguucaaggcucuagaguucc

SEQ ID NO: 842207 - RNA, 22 nt, Human
ggcaaaaaccgcaauaacuucu

SEQ ID NO: 842208 - RNA, 22 nt, Human
ccacccagccagaugcaggaag

SEQ ID NO: 842209 - RNA, 19 nt, Human
uggcugggugccaauggcc

SEQ ID NO: 842210 - RNA, 22 nt, Human
agaacagaagggaggaaggccu

SEQ ID NO: 842211 - RNA, 20 nt, Human
uggagccaaggugugucugg

SEQ ID NO: 842212 - RNA, 22 nt, Human
cuaucuuucgauucuagcuuaa

SEQ ID NO: 842213 - RNA, 22 nt, Human
accucaggauguggacacagaa

SEQ ID NO: 842214 - RNA, 18 nt, Human
agggaguuuuagggaagg

SEQ ID NO: 842215 - RNA, 22 nt, Human
uggcucaggggucuggcucugu

SEQ ID NO: 842216 - RNA, 22 nt, Human
guuuggggucugcagagcggcg

SEQ ID NO: 842217 - RNA, 22 nt, Human
aaugauuuccccuacacagaag

SEQ ID NO: 842218 - RNA, 22 nt, Human
ugcagaggaccauuguccugga

SEQ ID NO: 842219 - RNA, 22 nt, Human
gcauucaucuuccuccaugcag

SEQ ID NO: 842220 - RNA, 22 nt, Human
auuuccucaugaucauaaugca

SEQ ID NO: 842221 - RNA, 22 nt, Human
cagagaaaaaauccugcucuca

SEQ ID NO: 842222 - RNA, 22 nt, Human
cucuggaguucucaugaggaac

SEQ ID NO: 842223 - RNA, 22 nt, Human
ucugcagcgugcaggcuggugc

SEQ ID NO: 842224 - RNA, 22 nt, Human
gagccaggcaccuucuguguug

SEQ ID NO: 842225 - RNA, 22 nt, Human
ccagagcccagcacacggugcu

SEQ ID NO: 842226 - RNA, 21 nt, Human
ucuauucauuacaguuauuug

SEQ ID NO: 842227 - RNA, 22 nt, Human
ucaguuuucucauuuaugagau

SEQ ID NO: 842228 - RNA, 22 nt, Human
uccucuggcucuuucccuagga

SEQ ID NO: 842229 - RNA, 22 nt, Human
gguggguauaguuagggccucu

SEQ ID NO: 842230 - RNA, 22 nt, Human
uugucugucccagcuugugcau

SEQ ID NO: 842231 - RNA, 22 nt, Human
aaguccuucuuuauaugagagu

SEQ ID NO: 842232 - RNA, 22 nt, Human
auuaggcagacaacguagccgg

SEQ ID NO: 842233 - RNA, 22 nt, Human
guaggaagcucugaggcuaguu

SEQ ID NO: 842234 - RNA, 22 nt, Human
gaaagaagcuuuagauggcuau

SEQ ID NO: 842235 - RNA, 22 nt, Human
caccagcuuugcccacugccca

SEQ ID NO: 842236 - RNA, 22 nt, Human
cagcuggguuuaguggggugug

SEQ ID NO: 842237 - RNA, 21 nt, Human
acaugcauagagagauuucug

SEQ ID NO: 842238 - RNA, 22 nt, Human
uggccugucuuguugugcuaga

SEQ ID NO: 842239 - RNA, 22 nt, Human
cacagaggcaaccuucuggggu

SEQ ID NO: 842240 - RNA, 22 nt, Human
gagaggcugaaaucacaggagc

SEQ ID NO: 842241 - RNA, 22 nt, Human
ucuggcuccugaguccaugcuc

SEQ ID NO: 842242 - RNA, 18 nt, Human
ggcucaggcuauccuaac

SEQ ID NO: 842243 - RNA, 22 nt, Human
cagcccagcagggucuggcccu

SEQ ID NO: 842244 - RNA, 22 nt, Human
agaaaagaggcuuucuaagcau

SEQ ID NO: 842245 - RNA, 22 nt, Human
uccauuuacuauucucauaucg

SEQ ID NO: 842246 - RNA, 22 nt, Human
ggcauuuaucuaauauaguuua

SEQ ID NO: 842247 - RNA, 22 nt, Human
ccugucuguccucucaugagcc

SEQ ID NO: 842248 - RNA, 22 nt, Human
cauuaagauuuuuuucuacugg

SEQ ID NO: 842249 - RNA, 22 nt, Human
cugcugugagugguucuugccu

SEQ ID NO: 842250 - RNA, 22 nt, Human
gcaaaugaguuguaacauaaaa

SEQ ID NO: 842251 - RNA, 22 nt, Human
gggacagacccaugggccaggu

SEQ ID NO: 842252 - RNA, 22 nt, Human
uauuucaagaacuucuauccau

SEQ ID NO: 842253 - RNA, 22 nt, Human
aaacacagggauauauauucca

SEQ ID NO: 842254 - RNA, 22 nt, Human
uucacauuauaaucaguucugc

SEQ ID NO: 842255 - RNA, 22 nt, Human
acugagcucuugacugggaguu

SEQ ID NO: 842256 - RNA, 19 nt, Human
agcaccugugagagccugg

SEQ ID NO: 842257 - RNA, 22 nt, Human
uuaaaauuauggcccauuugga

SEQ ID NO: 842258 - RNA, 22 nt, Human
uaaaauguuugcaagagaccag

SEQ ID NO: 842259 - RNA, 22 nt, Human
guuauguaucuugauugggugg

SEQ ID NO: 842260 - RNA, 22 nt, Human
gcagcguggggcugagucagcu

SEQ ID NO: 842261 - RNA, 22 nt, Human
cugcuuugggcagcuuuguggc

SEQ ID NO: 842262 - RNA, 22 nt, Human
gcagauggacuguaugaccuga

SEQ ID NO: 842263 - RNA, 22 nt, Human
ccuuggagcggucagcacuggu

SEQ ID NO: 842264 - RNA, 22 nt, Human
acauguguauagccuguauaga

SEQ ID NO: 842265 - RNA, 22 nt, Human
gaaggaagugcucauacuaguu

SEQ ID NO: 842266 - RNA, 22 nt, Human
gccugcuguuaacugcaggaau

SEQ ID NO: 842267 - RNA, 22 nt, Human
gacauucacagguaaacauucc

SEQ ID NO: 842268 - RNA, 19 nt, Human
ucuggagcugaugcaggug

SEQ ID NO: 842269 - RNA, 22 nt, Human
ccaaaauuauuacauuuguagg

SEQ ID NO: 842270 - RNA, 22 nt, Human
gcucagaaaagugaggcucagu

SEQ ID NO: 842271 - RNA, 22 nt, Human
cuuccuucugaagcauagaagc

SEQ ID NO: 842272 - RNA, 22 nt, Human
guggcugguuuccugcaugcaa

SEQ ID NO: 842273 - RNA, 22 nt, Human
gagagugagauccuccugggga

SEQ ID NO: 842274 - RNA, 22 nt, Human
ugugaaaggagccauagacagu

SEQ ID NO: 842275 - RNA, 22 nt, Human
ccaggccucccuuuuccagcca

SEQ ID NO: 842276 - RNA, 22 nt, Human
cagaguguuucuuugggugggu

SEQ ID NO: 842277 - RNA, 22 nt, Human
cccaguccuaaagcagacgcca

SEQ ID NO: 842278 - RNA, 22 nt, Human
cauuguuauagcauuacacacc

SEQ ID NO: 842279 - RNA, 22 nt, Human
uuuacagaaugucaauuucuau

SEQ ID NO: 842280 - RNA, 22 nt, Human
caggugccucaggaugagacaa

SEQ ID NO: 842281 - RNA, 18 nt, Human
ugagagugugugcucuug

SEQ ID NO: 842282 - RNA, 22 nt, Human
ucugucacucuagagauggcag

SEQ ID NO: 842283 - RNA, 22 nt, Human
ggagcugcuccuucagccaagu

SEQ ID NO: 842284 - RNA, 19 nt, Human
cagcucaguuugauucucu

SEQ ID NO: 842285 - RNA, 22 nt, Human
ggcagaggaaggaugaauucac

SEQ ID NO: 842286 - RNA, 22 nt, Human
aagcagaaguugaucuaccaua

SEQ ID NO: 842287 - RNA, 22 nt, Human
agggggugucucugauuggguu

SEQ ID NO: 842288 - RNA, 21 nt, Human
aggcugcuggcucaggguccu

SEQ ID NO: 842289 - RNA, 22 nt, Human
cacauguuuggcaugucaccaa

SEQ ID NO: 842290 - RNA, 21 nt, Human
gaauaguucuguggcagcagu

SEQ ID NO: 842291 - RNA, 18 nt, Human
acaggccucaguccugca

SEQ ID NO: 842292 - RNA, 22 nt, Human
aggcaggcccucuggaaaggua

SEQ ID NO: 842293 - RNA, 22 nt, Human
uuuagaaauucaucuauggccu

SEQ ID NO: 842294 - RNA, 22 nt, Human
aaugcaguuucauuuguagaau

SEQ ID NO: 842295 - RNA, 22 nt, Human
cagugggcugugauggauucac

SEQ ID NO: 842296 - RNA, 22 nt, Human
agaggcugcacuugcucaugau

SEQ ID NO: 842297 - RNA, 22 nt, Human
aggccuggcaugagaccugaga

SEQ ID NO: 842298 - RNA, 22 nt, Human
uaaucacaucaggguaaauggg

SEQ ID NO: 842299 - RNA, 22 nt, Human
ucccagcccagauuugugugac

SEQ ID NO: 842300 - RNA, 22 nt, Human
cuuucagagguuacucaggaaa

SEQ ID NO: 842301 - RNA, 22 nt, Human
ccacacugaaccucagugucuu

SEQ ID NO: 842302 - RNA, 22 nt, Human
gcucucugccauaugaggauac

SEQ ID NO: 842303 - RNA, 22 nt, Human
gcucucuguuauuaagaucuuu

SEQ ID NO: 842304 - RNA, 22 nt, Human
acuggacagaggaaauauggag

SEQ ID NO: 842305 - RNA, 22 nt, Human
ucagccuggcaggauggccugg

SEQ ID NO: 842306 - RNA, 22 nt, Human
acucugccaucccaggugcugu

SEQ ID NO: 842307 - RNA, 22 nt, Human
agagcugugaaaaugagguuug

SEQ ID NO: 842308 - RNA, 22 nt, Human
agcauucauugcuagaauguaa

SEQ ID NO: 842309 - RNA, 22 nt, Human
ggcucugcugguaagaugccuc

SEQ ID NO: 842310 - RNA, 22 nt, Human
agagccaggaugucuucugggg

SEQ ID NO: 842311 - RNA, 22 nt, Human
gagcuggcuaauacugacuuau

SEQ ID NO: 842312 - RNA, 22 nt, Human
auauaaaguguuuagaaagcug

SEQ ID NO: 842313 - RNA, 22 nt, Human
gcauccagagguagccacugug

SEQ ID NO: 842314 - RNA, 22 nt, Human
agugaaaugacugaaucagaua

SEQ ID NO: 842315 - RNA, 22 nt, Human
agagcugcaauuucauguggug

SEQ ID NO: 842316 - RNA, 22 nt, Human
ucaaaguccuugcuuuuucugu

SEQ ID NO: 842317 - RNA, 22 nt, Human
ugggccugccccaggcuucagc

SEQ ID NO: 842318 - RNA, 22 nt, Human
aguuauaugugaaaacacguau

SEQ ID NO: 842319 - RNA, 22 nt, Human
aaaagguaguugccaaauaagg

SEQ ID NO: 842320 - RNA, 22 nt, Human
uuuaaauuuguguuuagagggu

SEQ ID NO: 842321 - RNA, 22 nt, Human
ugagccuggcggaagcagcgug

SEQ ID NO: 842322 - RNA, 22 nt, Human
gccaggggacgcggagcgacga

SEQ ID NO: 842323 - RNA, 22 nt, Human
acccaggacuuggcaaccucau

SEQ ID NO: 842324 - RNA, 22 nt, Human
gugcuuccugccuggugccuuu

SEQ ID NO: 842325 - RNA, 22 nt, Human
ggcagcuggggcagugcccugu

SEQ ID NO: 842326 - RNA, 22 nt, Human
aggagcuggguuccuuuggugg

SEQ ID NO: 842327 - RNA, 22 nt, Human
ucagaggugguaaaggacagca

SEQ ID NO: 842328 - RNA, 22 nt, Human
agugcagugguuaggagccagg

SEQ ID NO: 842329 - RNA, 22 nt, Human
aauguauggauucaugucugug

SEQ ID NO: 842330 - RNA, 22 nt, Human
ugucaccucuuuggcugcagcu

SEQ ID NO: 842331 - RNA, 21 nt, Human
aagggagauaggaaucaggcc

SEQ ID NO: 842332 - RNA, 22 nt, Human
cucaaguaagaaacagaauugg

SEQ ID NO: 842333 - RNA, 23 nt, Human
ucuguacaauugagaagagaaca

SEQ ID NO: 842334 - RNA, 22 nt, Human
guuauugcaguauagaggucua

SEQ ID NO: 842335 - RNA, 22 nt, Human
uucugggagagaaagggccuug

SEQ ID NO: 842336 - RNA, 18 nt, Human
uacaugcauaaaugaagc

SEQ ID NO: 842337 - RNA, 22 nt, Human
cugaggugagcuucccugggcu

SEQ ID NO: 842338 - RNA, 22 nt, Human
uuuauuaugauggacaccuucg

SEQ ID NO: 842339 - RNA, 22 nt, Human
gcaaauucuuaacuggacugug

SEQ ID NO: 842340 - RNA, 22 nt, Human
uuuaggcagaagcccugcugau

SEQ ID NO: 842341 - RNA, 22 nt, Human
uuuccucacuucaugagaguuu

SEQ ID NO: 842342 - RNA, 18 nt, Human
acagacaaaauggaaaug

SEQ ID NO: 842343 - RNA, 22 nt, Human
ucagagccaaucauggugcauu

SEQ ID NO: 842344 - RNA, 22 nt, Human
cugggcugcagcgggagcgacg

SEQ ID NO: 842345 - RNA, 22 nt, Human
cagagcagagugauuguucugg

SEQ ID NO: 842346 - RNA, 22 nt, Human
uaaccauauuuuccauuaaguu

SEQ ID NO: 842347 - RNA, 22 nt, Human
ugaaucugauuucccuggaggc

SEQ ID NO: 842348 - RNA, 22 nt, Human
uucuugaaucacuuuagagaua

SEQ ID NO: 842349 - RNA, 22 nt, Human
gccuggguccacugaucaugcu

SEQ ID NO: 842350 - RNA, 22 nt, Human
agcagcugaccagugaguccug

SEQ ID NO: 842351 - RNA, 22 nt, Human
caguaaauacauaucagagaag

SEQ ID NO: 842352 - RNA, 22 nt, Human
uggaaauacuugccauaaaacu

SEQ ID NO: 842353 - RNA, 17 nt, Human
aagagaggcugagcugg

SEQ ID NO: 842354 - RNA, 22 nt, Human
ucagcugccucucccuggaaga

SEQ ID NO: 842355 - RNA, 22 nt, Human
aaguccuuucucauggaggaau

SEQ ID NO: 842356 - RNA, 20 nt, Human
ugcagcugcaggaggguggg

SEQ ID NO: 842357 - RNA, 22 nt, Human
gcucucugaggugcuggcagag

SEQ ID NO: 842358 - RNA, 22 nt, Human
gaaggcuggcuuucugagagca

SEQ ID NO: 842359 - RNA, 22 nt, Human
uggcagcugauuagauggugcc

SEQ ID NO: 842360 - RNA, 22 nt, Human
gcauugucaaaagugguaugac

SEQ ID NO: 842361 - RNA, 22 nt, Human
acagggcaaccucugggagacu

SEQ ID NO: 842362 - RNA, 22 nt, Human
uaugcauauagaugcacacaca

SEQ ID NO: 842363 - RNA, 22 nt, Human
caggaugggugucggccagcac

SEQ ID NO: 842364 - RNA, 22 nt, Human
ugucaccacauuugucaauauc

SEQ ID NO: 842365 - RNA, 22 nt, Human
ugagccaguggaagauggcagu

SEQ ID NO: 842366 - RNA, 22 nt, Human
gcaagcugcucuuauguggagg

SEQ ID NO: 842367 - RNA, 22 nt, Human
auaauuuacaacugcuuuuaau

SEQ ID NO: 842368 - RNA, 22 nt, Human
aaaaguaauugaugcaaucgua

SEQ ID NO: 842369 - RNA, 22 nt, Human
ccagaggugccacagaaagagc

SEQ ID NO: 842370 - RNA, 22 nt, Human
gcugccaugccacagcacucac

SEQ ID NO: 842371 - RNA, 20 nt, Human
cucaguguggccugaguguu

SEQ ID NO: 842372 - RNA, 22 nt, Human
gaugcagaaaguagacaccauc

SEQ ID NO: 842373 - RNA, 22 nt, Human
gacauguugaagaauauuugga

SEQ ID NO: 842374 - RNA, 22 nt, Human
ugcagcugaggccagcuaugcc

SEQ ID NO: 842375 - RNA, 20 nt, Human
gcacugaaauucaauguuug

SEQ ID NO: 842376 - RNA, 22 nt, Human
uggggccuggucagagcugcac

SEQ ID NO: 842377 - RNA, 22 nt, Human
uucuuucccagaagauauguuu

SEQ ID NO: 842378 - RNA, 22 nt, Human
caaugauguuuagauaaaaucc

SEQ ID NO: 842379 - RNA, 22 nt, Human
uuauccaacaugacuuaugucc

SEQ ID NO: 842380 - RNA, 20 nt, Human
cccaggagcugugccccauc

SEQ ID NO: 842381 - RNA, 22 nt, Human
gcaggagaacaaagcaagcugc

SEQ ID NO: 842382 - RNA, 22 nt, Human
cuaauuauguuguuauaaucaa

SEQ ID NO: 842383 - RNA, 20 nt, Human
cccagugaagcauggaagag

SEQ ID NO: 842384 - RNA, 22 nt, Human
uggagcugacucacaccagcua

SEQ ID NO: 842385 - RNA, 22 nt, Human
uagcacauacauaauagauaga

SEQ ID NO: 842386 - RNA, 22 nt, Human
cugggacagcugagacaggaga

SEQ ID NO: 842387 - RNA, 22 nt, Human
ucugagaguccaucuccaagcc

SEQ ID NO: 842388 - RNA, 22 nt, Human
ccucuuugugccugcaggcugc

SEQ ID NO: 842389 - RNA, 22 nt, Human
ugggggagauuagagcuucuua

SEQ ID NO: 842390 - RNA, 22 nt, Human
agcugcccuuaauaggcauuca

SEQ ID NO: 842391 - RNA, 22 nt, Human
ccagggcauguccaagacuuag

SEQ ID NO: 842392 - RNA, 19 nt, Human
aggccugggguuuugcacu

SEQ ID NO: 842393 - RNA, 22 nt, Human
agugacugacaccuguaauccc

SEQ ID NO: 842394 - RNA, 22 nt, Human
gcuuggcauugaccauuaucau

SEQ ID NO: 842395 - RNA, 22 nt, Human
ugcaugcagcuggugauaagaa

SEQ ID NO: 842396 - RNA, 22 nt, Human
ugggcagauguccucugaagug

SEQ ID NO: 842397 - RNA, 19 nt, Human
uacuuuuucaggacagagu

SEQ ID NO: 842398 - RNA, 21 nt, Human
ucucuggaguuagcagagaga

SEQ ID NO: 842399 - RNA, 22 nt, Human
ccaaaguccauaguuuacauaa

SEQ ID NO: 842400 - RNA, 22 nt, Human
gacagaggcaagaccagaagcc

SEQ ID NO: 842401 - RNA, 17 nt, Human
guuugcaugguguuaac

SEQ ID NO: 842402 - RNA, 22 nt, Human
cuggauuuuagaaggcuuccua

SEQ ID NO: 842403 - RNA, 22 nt, Human
aacaaaugauuguugguuggag

SEQ ID NO: 842404 - RNA, 22 nt, Human
aauuucaaacuaauaggaacca

SEQ ID NO: 842405 - RNA, 22 nt, Human
aguugaauaauuagacauaucu

SEQ ID NO: 842406 - RNA, 22 nt, Human
ucaggagucugugcaguuccac

SEQ ID NO: 842407 - RNA, 23 nt, Human
augguuuaugucacacuuuugau

SEQ ID NO: 842408 - RNA, 22 nt, Human
uccugggcccaggcugccaggg

SEQ ID NO: 842409 - RNA, 23 nt, Human
aggagccaggaaccagcuucccc

SEQ ID NO: 842410 - RNA, 22 nt, Human
caguguguggauccucccagga

SEQ ID NO: 842411 - RNA, 19 nt, Human
agaaaucucgagauuuguu

SEQ ID NO: 842412 - RNA, 22 nt, Human
uucaacucuucaagaucacauc

SEQ ID NO: 842413 - RNA, 22 nt, Human
gaaggagcuaaagggagcccug

SEQ ID NO: 842414 - RNA, 22 nt, Human
cucuggaaaaccacuagcagga

SEQ ID NO: 842415 - RNA, 22 nt, Human
augcaguaaauguuaagaaaaa

SEQ ID NO: 842416 - RNA, 18 nt, Human
ccagcaugccagaggcug

SEQ ID NO: 842417 - RNA, 22 nt, Human
auagacauuuugcauucaagca

SEQ ID NO: 842418 - RNA, 22 nt, Human
uguuccuaaauaugaauggaga

SEQ ID NO: 842419 - RNA, 22 nt, Human
gcuuccugauauucauacuguu

SEQ ID NO: 842420 - RNA, 22 nt, Human
ccuggagcacucucccuggcug

SEQ ID NO: 842421 - RNA, 22 nt, Human
acagcagcuaaaggugucuccu

SEQ ID NO: 842422 - RNA, 22 nt, Human
aauguuaaaaccuucagugcuu

SEQ ID NO: 842423 - RNA, 22 nt, Human
ggcuggaaaagacaaagcuauu

SEQ ID NO: 842424 - RNA, 22 nt, Human
acugagcugcaagucagggagg

SEQ ID NO: 842425 - RNA, 19 nt, Human
cugugcaggccgggcugag

SEQ ID NO: 842426 - RNA, 22 nt, Human
gggugaggagcugccagucaug

SEQ ID NO: 842427 - RNA, 22 nt, Human
uggaggaaguggcuggccagaa

SEQ ID NO: 842428 - RNA, 22 nt, Human
ucagcaguggcucucaugcagu

SEQ ID NO: 842429 - RNA, 22 nt, Human
aaucagaaagaucuugaugaga

SEQ ID NO: 842430 - RNA, 22 nt, Human
uugaacauuaacuucagucuau

SEQ ID NO: 842431 - RNA, 19 nt, Human
ccucuccgcccaccagccc

SEQ ID NO: 842432 - RNA, 21 nt, Human
uguaugcacgcacaugcacac

SEQ ID NO: 842433 - RNA, 22 nt, Human
cuguggcuaggaagcuguggga

SEQ ID NO: 842434 - RNA, 22 nt, Human
gugauaaagacgugucauaauu

SEQ ID NO: 842435 - RNA, 23 nt, Human
uuguuuuuagagguggcaugaga

SEQ ID NO: 842436 - RNA, 22 nt, Human
augagacuaccuguaauguggc

SEQ ID NO: 842437 - RNA, 22 nt, Human
guggcugcuacagagcuggagg

SEQ ID NO: 842438 - RNA, 22 nt, Human
uagagcugcuggacuguaacag

SEQ ID NO: 842439 - RNA, 22 nt, Human
uauacacaaggugugcauuugu

SEQ ID NO: 842440 - RNA, 22 nt, Human
cuucaguucuaaaguagaaugu

SEQ ID NO: 842441 - RNA, 22 nt, Human
uggguagagcaggcuggggcuu

SEQ ID NO: 842442 - RNA, 22 nt, Human
cugggagucuggccucuggucc

SEQ ID NO: 842443 - RNA, 19 nt, Human
gccugggaugggcagaacu

SEQ ID NO: 842444 - RNA, 22 nt, Human
acccaggagguggaggcugcag

SEQ ID NO: 842445 - RNA, 22 nt, Human
caggagacuauggcccaaggcc

SEQ ID NO: 842446 - RNA, 21 nt, Human
uaucagaagagaaagaaugau

SEQ ID NO: 842447 - RNA, 23 nt, Human
ccacagagcugccaauuccugug

SEQ ID NO: 842448 - RNA, 22 nt, Human
ucugcugugauuugcuaccugu

SEQ ID NO: 842449 - RNA, 22 nt, Human
uuccucucucuugccagaaugu

SEQ ID NO: 842450 - RNA, 22 nt, Human
ccagcuggagccaagguggacu

SEQ ID NO: 842451 - RNA, 22 nt, Human
uuccuuaguuauuugguccccu

SEQ ID NO: 842452 - RNA, 19 nt, Human
auuugaaagcugugcuugc

SEQ ID NO: 842453 - RNA, 22 nt, Human
gccuggugaaaggcagagagcg

SEQ ID NO: 842454 - RNA, 22 nt, Human
guguguuuagcauuagcagggg

SEQ ID NO: 842455 - RNA, 22 nt, Human
aggcaggcugcuauggaguaga

SEQ ID NO: 842456 - RNA, 22 nt, Human
aggauuuaccgucauuuagucu

SEQ ID NO: 842457 - RNA, 22 nt, Human
cagagacagggcagggagugug

SEQ ID NO: 842458 - RNA, 22 nt, Human
gccccucccagucaggagcacu

SEQ ID NO: 842459 - RNA, 22 nt, Human
gccuggugcuaugagggccagc

SEQ ID NO: 842460 - RNA, 22 nt, Human
ccaugagacagcaacugaaagu

SEQ ID NO: 842461 - RNA, 22 nt, Human
cagccaucaguaaagacagcuu

SEQ ID NO: 842462 - RNA, 22 nt, Human
uuugcaaauaccaugaaacuug

SEQ ID NO: 842463 - RNA, 22 nt, Human
cccucagcuucucccugcagcu

SEQ ID NO: 842464 - RNA, 22 nt, Human
gcucugcugucuucuugcaggc

SEQ ID NO: 842465 - RNA, 20 nt, Human
cccaggagugagcagcuuua

SEQ ID NO: 842466 - RNA, 22 nt, Human
ugagcuggucuugaguguagcu

SEQ ID NO: 842467 - RNA, 22 nt, Human
caguagcauguaauaaagacag

SEQ ID NO: 842468 - RNA, 22 nt, Human
uuugcauuauauuuauagaaga

SEQ ID NO: 842469 - RNA, 22 nt, Human
agccucugcuggcccuggcacu

SEQ ID NO: 842470 - RNA, 20 nt, Human
ugggccuguggcagaagucu

SEQ ID NO: 842471 - RNA, 22 nt, Human
uagccggguguugugucaugca

SEQ ID NO: 842472 - RNA, 22 nt, Human
cugggcuggcgcauccgacacg

SEQ ID NO: 842473 - RNA, 19 nt, Human
ccagcccugucacuucuug

SEQ ID NO: 842474 - RNA, 19 nt, Human
uccaaaggacccaccucca

SEQ ID NO: 842475 - RNA, 22 nt, Human
guuguuuugcaggauccuuaca

SEQ ID NO: 842476 - RNA, 22 nt, Human
cucugucagaguguugucccca

SEQ ID NO: 842477 - RNA, 22 nt, Human
ugcuuaauguacgugaguguac

SEQ ID NO: 842478 - RNA, 22 nt, Human
cucucugggcccaguuggcacc

SEQ ID NO: 842479 - RNA, 22 nt, Human
aaaguaguuagucaugugaaaa

SEQ ID NO: 842480 - RNA, 22 nt, Human
uuuuucuuaaauguggguuggc

SEQ ID NO: 842481 - RNA, 22 nt, Human
ugggcugcacccucagccucug

SEQ ID NO: 842482 - RNA, 22 nt, Human
caggacagagcccagacugugu

SEQ ID NO: 842483 - RNA, 22 nt, Human
uucccucucacuuaaagcuugg

SEQ ID NO: 842484 - RNA, 22 nt, Human
ggcauuaagaauaucauuaaaa

SEQ ID NO: 842485 - RNA, 22 nt, Human
cccaggcugaguuagagguguc

SEQ ID NO: 842486 - RNA, 22 nt, Human
uuauuccauuauuucacuuagg

SEQ ID NO: 842487 - RNA, 22 nt, Human
cccccagccagcagugcucagc

SEQ ID NO: 842488 - RNA, 23 nt, Human
gcagagcugcccuauugccuugg

SEQ ID NO: 842489 - RNA, 22 nt, Human
agccucugucaagcuuuucaaa

SEQ ID NO: 842490 - RNA, 22 nt, Human
uguuaaucaaucaacaguauua

SEQ ID NO: 842491 - RNA, 22 nt, Human
uguaugcaaauuuauuagcaca

SEQ ID NO: 842492 - RNA, 22 nt, Human
ggcccacacugacagcugagcu

SEQ ID NO: 842493 - RNA, 22 nt, Human
cuacccagcaccuaggcugccu

SEQ ID NO: 842494 - RNA, 22 nt, Human
ugcacacaguucucaggaaaga

SEQ ID NO: 842495 - RNA, 22 nt, Human
ccccaccugugcgucugccgca

SEQ ID NO: 842496 - RNA, 21 nt, Human
agggagcuggccacacagccu

SEQ ID NO: 842497 - RNA, 22 nt, Human
ucacaggagggagagacaccca

SEQ ID NO: 842498 - RNA, 22 nt, Human
cucaccacagagccuguccagc

SEQ ID NO: 842499 - RNA, 22 nt, Human
uaaucauggccucaaauuuuau

SEQ ID NO: 842500 - RNA, 22 nt, Human
cucuggaauguuuacaugcccu

SEQ ID NO: 842501 - RNA, 22 nt, Human
uagaucugauacaauucaucug

SEQ ID NO: 842502 - RNA, 22 nt, Human
uaauaguuucauaaugugcuuc

SEQ ID NO: 842503 - RNA, 22 nt, Human
uuacauuagacccacuuucaug

SEQ ID NO: 842504 - RNA, 22 nt, Human
auggcuuucagauggugaaaga

SEQ ID NO: 842505 - RNA, 22 nt, Human
ucacagaauagcacuguaagcg

SEQ ID NO: 842506 - RNA, 22 nt, Human
cuggagagaccgaaagaggcug

SEQ ID NO: 842507 - RNA, 22 nt, Human
uuagggcuuuucugaauaggcc

SEQ ID NO: 842508 - RNA, 22 nt, Human
ucugggugcccuuugcucuguu

SEQ ID NO: 842509 - RNA, 22 nt, Human
gcagagcucaagguguucagcu

SEQ ID NO: 842510 - RNA, 22 nt, Human
auuaguaaaacauuguauaugu

SEQ ID NO: 842511 - RNA, 22 nt, Human
cccagggauuauaaaggugaaa

SEQ ID NO: 842512 - RNA, 22 nt, Human
auaucaguaucuauguauuugu

SEQ ID NO: 842513 - RNA, 22 nt, Human
uuggaaauggcuguaguuauga

SEQ ID NO: 842514 - RNA, 22 nt, Human
uagcugccuaugugauaagaga

SEQ ID NO: 842515 - RNA, 22 nt, Human
uggcucaggaucuaagcagaau

SEQ ID NO: 842516 - RNA, 22 nt, Human
acugccuugucucuugccuguu

SEQ ID NO: 842517 - RNA, 22 nt, Human
aggaaaacacaguauugaugga

SEQ ID NO: 842518 - RNA, 22 nt, Human
uauaucuuauaugugcagguac

SEQ ID NO: 842519 - RNA, 22 nt, Human
ucagaguggugguuuugccuuc

SEQ ID NO: 842520 - RNA, 20 nt, Human
ucuguucaaaucuuaguucc

SEQ ID NO: 842521 - RNA, 22 nt, Human
caucagaagauggcucuggaaa

SEQ ID NO: 842522 - RNA, 22 nt, Human
cagccccucccucaggcaggug

SEQ ID NO: 842523 - RNA, 22 nt, Human
auuugucugcuugcugccuucc

SEQ ID NO: 842524 - RNA, 22 nt, Human
gccagucugcucccacaaguuc

SEQ ID NO: 842525 - RNA, 21 nt, Human
cccaggaggagcuccggcucc

SEQ ID NO: 842526 - RNA, 22 nt, Human
ccaggcugcuguugguguccgc

SEQ ID NO: 842527 - RNA, 22 nt, Human
ggcuucucucuucacauggcuu

SEQ ID NO: 842528 - RNA, 22 nt, Human
uauaguacauggaaucuucaua

SEQ ID NO: 842529 - RNA, 22 nt, Human
ggugacuggagggacccaggcc

SEQ ID NO: 842530 - RNA, 22 nt, Human
ggccugagucccaccuggcugu

SEQ ID NO: 842531 - RNA, 22 nt, Human
aggcuagcaaugggagaugagu

SEQ ID NO: 842532 - RNA, 22 nt, Human
cucagaguccccaguggguuug

SEQ ID NO: 842533 - RNA, 22 nt, Human
ugagaaaugggucugcugaaga

SEQ ID NO: 842534 - RNA, 22 nt, Human
ugggcugcccugaugguccuca

SEQ ID NO: 842535 - RNA, 21 nt, Human
aagagcuggaucaaggauaag

SEQ ID NO: 842536 - RNA, 22 nt, Human
ugucagugaguuaguugcaagu

SEQ ID NO: 842537 - RNA, 22 nt, Human
uggggacacagagccaaacuau

SEQ ID NO: 842538 - RNA, 19 nt, Human
agcauuuggaauucuacac

SEQ ID NO: 842539 - RNA, 22 nt, Human
cacaagucuguggucuccaaca

SEQ ID NO: 842540 - RNA, 22 nt, Human
ugauuuccaugaagcugaaggc

SEQ ID NO: 842541 - RNA, 22 nt, Human
ugcaauaacccaguaucuguga

SEQ ID NO: 842542 - RNA, 22 nt, Human
uuucacacugcagcaucagaga

SEQ ID NO: 842543 - RNA, 22 nt, Human
uuugugaagggaacagaagugu

SEQ ID NO: 842544 - RNA, 23 nt, Human
aaaguugauuugcaguuuaagag

SEQ ID NO: 842545 - RNA, 22 nt, Human
ugagccagaguggagugugccu

SEQ ID NO: 842546 - RNA, 22 nt, Human
aaaguguugggaagaaagugca

SEQ ID NO: 842547 - RNA, 22 nt, Human
auguaacuguuauauuuuguug

SEQ ID NO: 842548 - RNA, 22 nt, Human
gaaggaaaacagaucugccuga

SEQ ID NO: 842549 - RNA, 22 nt, Human
uauuucagguauggugugaaau

SEQ ID NO: 842550 - RNA, 22 nt, Human
ccuggagcuuuuccauccugga

SEQ ID NO: 842551 - RNA, 22 nt, Human
uccagccuaauguucuucccac

SEQ ID NO: 842552 - RNA, 22 nt, Human
cuuccaaagcacuuuauggacc

SEQ ID NO: 842553 - RNA, 21 nt, Human
gagccuucccucugcccuuuc

SEQ ID NO: 842554 - RNA, 22 nt, Human
cugccucuauaggaguccacca

SEQ ID NO: 842555 - RNA, 23 nt, Human
uuugcaaauuggacacaaccaca

SEQ ID NO: 842556 - RNA, 22 nt, Human
cuguccuccggccaccuacagu

SEQ ID NO: 842557 - RNA, 22 nt, Human
aggcacugcagauuacaggcgc

SEQ ID NO: 842558 - RNA, 22 nt, Human
caagauggacauaaggagagaa

SEQ ID NO: 842559 - RNA, 22 nt, Human
aggggcugacuggaaagugcca

SEQ ID NO: 842560 - RNA, 22 nt, Human
gcuggcagagacaagaagacua

SEQ ID NO: 842561 - RNA, 22 nt, Human
aggagagucuugagucacuggu

SEQ ID NO: 842562 - RNA, 22 nt, Human
cagagcugcacauucuaugaug

SEQ ID NO: 842563 - RNA, 22 nt, Human
ccagggucuuggagaggagugc

SEQ ID NO: 842564 - RNA, 22 nt, Human
cccaguuucaacuuuccagugg

SEQ ID NO: 842565 - RNA, 22 nt, Human
uggcucuggugcgggcuccugc

SEQ ID NO: 842566 - RNA, 22 nt, Human
uaugaaaugguaguaggaaggg

SEQ ID NO: 842567 - RNA, 22 nt, Human
ccagucccaucucugucgcuua

SEQ ID NO: 842568 - RNA, 22 nt, Human
caaugauggcuaggcagcugcu

SEQ ID NO: 842569 - RNA, 22 nt, Human
gaaaauguuuguccggagcuga

SEQ ID NO: 842570 - RNA, 22 nt, Human
uucacaggugacuggggauaac

SEQ ID NO: 842571 - RNA, 22 nt, Human
agucuccuuggccucaaugccu

SEQ ID NO: 842572 - RNA, 22 nt, Human
gggcuggaggagauccagaggc

SEQ ID NO: 842573 - RNA, 22 nt, Human
ugccucugaggaagauuguguu

SEQ ID NO: 842574 - RNA, 22 nt, Human
ugccuuggugcuucuucaugug

SEQ ID NO: 842575 - RNA, 18 nt, Human
gcagcuagccaggggggc

SEQ ID NO: 842576 - RNA, 22 nt, Human
gagagcaggaggcagcgggacg

SEQ ID NO: 842577 - RNA, 20 nt, Human
cccucugcuacacugggagc

SEQ ID NO: 842578 - RNA, 22 nt, Human
cuggagcaggcuugucccagcu

SEQ ID NO: 842579 - RNA, 22 nt, Human
uugaagcacaaugucuuuuauc

SEQ ID NO: 842580 - RNA, 22 nt, Human
agccuauuccaggaugagcuca

SEQ ID NO: 842581 - RNA, 21 nt, Human
ugaagccugaggcauagcccc

SEQ ID NO: 842582 - RNA, 22 nt, Human
caggccuggggcuggcuuccag

SEQ ID NO: 842583 - RNA, 22 nt, Human
agcagggcagugcuucagcucu

SEQ ID NO: 842584 - RNA, 22 nt, Human
ugggaaauguguuucuggacca

SEQ ID NO: 842585 - RNA, 22 nt, Human
aagcugccagauucagucugcu

SEQ ID NO: 842586 - RNA, 22 nt, Human
aggaagcuuagugaaaggacca

SEQ ID NO: 842587 - RNA, 22 nt, Human
aagagguugucugugaugaguu

SEQ ID NO: 842588 - RNA, 22 nt, Human
uuccagauuucuacacaagacc

SEQ ID NO: 842589 - RNA, 22 nt, Human
gcugucugggaggccuccacuu

SEQ ID NO: 842590 - RNA, 22 nt, Human
cccucugcucaggugcauaggc

SEQ ID NO: 842591 - RNA, 22 nt, Human
uuccaggaggcacugacagagg

SEQ ID NO: 842592 - RNA, 22 nt, Human
uagaaaugauuuugaugcuuca

SEQ ID NO: 842593 - RNA, 21 nt, Human
gugcucugggcagcagagggc

SEQ ID NO: 842594 - RNA, 22 nt, Human
agccacagcuccuugguggaga

SEQ ID NO: 842595 - RNA, 22 nt, Human
acuugcugguggcauuuacagu

SEQ ID NO: 842596 - RNA, 20 nt, Human
uggagccacagucagguucc

SEQ ID NO: 842597 - RNA, 22 nt, Human
ggaagaggcugagccagguccc

SEQ ID NO: 842598 - RNA, 19 nt, Human
gccugagccagccaugcaa

SEQ ID NO: 842599 - RNA, 22 nt, Human
aaaaugugcaguuuuuaagcug

SEQ ID NO: 842600 - RNA, 22 nt, Human
aaagaaucagaagucucaaaca

SEQ ID NO: 842601 - RNA, 22 nt, Human
agaggucagauuucuccuggug

SEQ ID NO: 842602 - RNA, 22 nt, Human
ccaccagcuuugccacccugcu

SEQ ID NO: 842603 - RNA, 22 nt, Human
gggcacuguggggcccaugcug

SEQ ID NO: 842604 - RNA, 22 nt, Human
acaaaguuaacaguuggauagu

SEQ ID NO: 842605 - RNA, 21 nt, Human
ucauuuuuauugcuaccuugc

SEQ ID NO: 842606 - RNA, 22 nt, Human
aaaaugacauuccagugauauu

SEQ ID NO: 842607 - RNA, 22 nt, Human
uaauaguugugacuuuguaaag

SEQ ID NO: 842608 - RNA, 21 nt, Human
ucccagggccaggugccauca

SEQ ID NO: 842609 - RNA, 22 nt, Human
uugggguguuggauggagcaag

SEQ ID NO: 842610 - RNA, 22 nt, Human
gcucccuguucucagccaugau

SEQ ID NO: 842611 - RNA, 22 nt, Human
cagaggcauacucccagucuug

SEQ ID NO: 842612 - RNA, 22 nt, Human
agcccaggagguggagguugca

SEQ ID NO: 842613 - RNA, 22 nt, Human
cugaauaaagcccucgcgcgcu

SEQ ID NO: 842614 - RNA, 22 nt, Human
uacuuccagcaaucugcauauu

SEQ ID NO: 842615 - RNA, 22 nt, Human
uuugaauaaucacugggcauua

SEQ ID NO: 842616 - RNA, 22 nt, Human
aggccuggccccaguugcuagg

SEQ ID NO: 842617 - RNA, 22 nt, Human
cugcucugacccuuucaccuuc

SEQ ID NO: 842618 - RNA, 22 nt, Human
ugcacacaaguuggagaaugaa

SEQ ID NO: 842619 - RNA, 22 nt, Human
cacugcuucuggaggaauuugg

SEQ ID NO: 842620 - RNA, 22 nt, Human
uggcucagauaauucaaggggc

SEQ ID NO: 842621 - RNA, 22 nt, Human
ccagggaguuuccaaucugaga

SEQ ID NO: 842622 - RNA, 22 nt, Human
gcacacaguauaugcucauuaa

SEQ ID NO: 842623 - RNA, 22 nt, Human
gagagaagggggauaugagccu

SEQ ID NO: 842624 - RNA, 22 nt, Human
cuacccagagugaaucucuuaa

SEQ ID NO: 842625 - RNA, 22 nt, Human
gagagugucgggggccccagga

SEQ ID NO: 842626 - RNA, 18 nt, Human
ccucaggggaccuggcag

SEQ ID NO: 842627 - RNA, 22 nt, Human
gguggccuccagggcauaggug

SEQ ID NO: 842628 - RNA, 22 nt, Human
agggcccuccccgcucagggca

SEQ ID NO: 842629 - RNA, 22 nt, Human
acuguucaagcaaaugacauug

SEQ ID NO: 842630 - RNA, 22 nt, Human
cuuugaauugccguuucaucug

SEQ ID NO: 842631 - RNA, 22 nt, Human
gugaauaaaacaccugccaaga

SEQ ID NO: 842632 - RNA, 22 nt, Human
acacaguauuacaauaggugcu

SEQ ID NO: 842633 - RNA, 22 nt, Human
uucauagugauuguucagauag

SEQ ID NO: 842634 - RNA, 22 nt, Human
cagcugccaagaaucuuuucua

SEQ ID NO: 842635 - RNA, 22 nt, Human
caugccaguuuugagaugcacc

SEQ ID NO: 842636 - RNA, 22 nt, Human
ugucacauaauuuaucuguagg

SEQ ID NO: 842637 - RNA, 22 nt, Human
caguggcuguuucuggaaggca

SEQ ID NO: 842638 - RNA, 22 nt, Human
gagcuucccucugcagucccug

SEQ ID NO: 842639 - RNA, 17 nt, Human
uauguaguacuuauaaa

SEQ ID NO: 842640 - RNA, 22 nt, Human
aggcugcucaguagauggagcu

SEQ ID NO: 842641 - RNA, 22 nt, Human
aagggcagcugacagaugcuua

SEQ ID NO: 842642 - RNA, 22 nt, Human
uuccaagaguaaauucaaauug

SEQ ID NO: 842643 - RNA, 22 nt, Human
agagccugugauugucaucacc

SEQ ID NO: 842644 - RNA, 22 nt, Human
ggcagcuccuccuagucugccc

SEQ ID NO: 842645 - RNA, 22 nt, Human
caggcacuggggaugcugggau

SEQ ID NO: 842646 - RNA, 22 nt, Human
cuggggcuucaaugcuucggug

SEQ ID NO: 842647 - RNA, 22 nt, Human
auguagaagugggcauuauaga

SEQ ID NO: 842648 - RNA, 22 nt, Human
gaaugaaaaccuuggcucaaau

SEQ ID NO: 842649 - RNA, 22 nt, Human
agugaaaacacuaguucuugcc

SEQ ID NO: 842650 - RNA, 22 nt, Human
cugaaggauuuaguucuuugcu

SEQ ID NO: 842651 - RNA, 22 nt, Human
agaauuguugggguaauaaaag

SEQ ID NO: 842652 - RNA, 22 nt, Human
cauucacucagcgaugccagua

SEQ ID NO: 842653 - RNA, 22 nt, Human
uccugccugcaaucccagcacu

SEQ ID NO: 842654 - RNA, 22 nt, Human
auucugucuuuuuaaaauaaua

SEQ ID NO: 842655 - RNA, 22 nt, Human
uguuuuaagagcgcacuuuaua

SEQ ID NO: 842656 - RNA, 22 nt, Human
acaacauucuuaaauacacuga

SEQ ID NO: 842657 - RNA, 22 nt, Human
uaucagaaaucaacacacagug

SEQ ID NO: 842658 - RNA, 22 nt, Human
gagugcagaugaacagaagauu

SEQ ID NO: 842659 - RNA, 22 nt, Human
gaaugugucacccugucccaug

SEQ ID NO: 842660 - RNA, 22 nt, Human
caggguggaagcuguagagugg

SEQ ID NO: 842661 - RNA, 22 nt, Human
ucuuugcaugcauuuucccuua

SEQ ID NO: 842662 - RNA, 22 nt, Human
gaccuggaggauccucuucuug

SEQ ID NO: 842663 - RNA, 22 nt, Human
auucauaacggcaaaugucacc

SEQ ID NO: 842664 - RNA, 22 nt, Human
acaggugugagaacaugccuug

SEQ ID NO: 842665 - RNA, 22 nt, Human
cagggccuccccggcagucuuu

SEQ ID NO: 842666 - RNA, 22 nt, Human
acagaaagaagguguauuugag

SEQ ID NO: 842667 - RNA, 22 nt, Human
cagagcaguccuugucaaucag

SEQ ID NO: 842668 - RNA, 22 nt, Human
aagauuauggcagauaacaauu

SEQ ID NO: 842669 - RNA, 22 nt, Human
agccugucugucuccaaagcug

SEQ ID NO: 842670 - RNA, 22 nt, Human
uugcauugauguuccuucuugc

SEQ ID NO: 842671 - RNA, 22 nt, Human
caggcagauuugcugcccucca

SEQ ID NO: 842672 - RNA, 22 nt, Human
gagagggauacugaguuuuggu

SEQ ID NO: 842673 - RNA, 22 nt, Human
caguuucucucaauaagcaucg

SEQ ID NO: 842674 - RNA, 22 nt, Human
aggcaagcgcagaagcggagga

SEQ ID NO: 842675 - RNA, 22 nt, Human
ugguacuuggaggcagaaaaau

SEQ ID NO: 842676 - RNA, 22 nt, Human
cauguacacucauguaacuaua

SEQ ID NO: 842677 - RNA, 22 nt, Human
ucugcaggacugaggccuguuu

SEQ ID NO: 842678 - RNA, 18 nt, Human
gcugagguggugucagag

SEQ ID NO: 842679 - RNA, 22 nt, Human
uucuucucagggucccacaugg

SEQ ID NO: 842680 - RNA, 22 nt, Human
gggcuggcucugucuagaaagg

SEQ ID NO: 842681 - RNA, 22 nt, Human
cagggugacugcccuggccacu

SEQ ID NO: 842682 - RNA, 22 nt, Human
gggugggguguaucggauccua

SEQ ID NO: 842683 - RNA, 22 nt, Human
guccucagucaguuuggugggg

SEQ ID NO: 842684 - RNA, 22 nt, Human
auaaaguuuaaaagucaauagu

SEQ ID NO: 842685 - RNA, 22 nt, Human
cuuauguauauuuggaacguac

SEQ ID NO: 842686 - RNA, 22 nt, Human
ugcacagugaccccuggugacu

SEQ ID NO: 842687 - RNA, 22 nt, Human
uauuggugggggcagagagaga

SEQ ID NO: 842688 - RNA, 22 nt, Human
gccagagccggcuucacaggau

SEQ ID NO: 842689 - RNA, 22 nt, Human
auaugaaaagaagucaccauug

SEQ ID NO: 842690 - RNA, 22 nt, Human
cccaggaggcggagguuguggu

SEQ ID NO: 842691 - RNA, 22 nt, Human
ccugggaggcggagguugcagu

SEQ ID NO: 842692 - RNA, 22 nt, Human
ucucuucuaauuuucccgagua

SEQ ID NO: 842693 - RNA, 22 nt, Human
ugaaacuaggccaaucaaauua

SEQ ID NO: 842694 - RNA, 23 nt, Human
cauuucugggagauuuauaaaau

SEQ ID NO: 842695 - RNA, 20 nt, Human
cacaggcuauaugagagcca

SEQ ID NO: 842696 - RNA, 22 nt, Human
cagcuuccaucuccacugcccu

SEQ ID NO: 842697 - RNA, 22 nt, Human
gagcagcucugugccuggagac

SEQ ID NO: 842698 - RNA, 22 nt, Human
cuuccucccggcccaugcucug

SEQ ID NO: 842699 - RNA, 22 nt, Human
uuccaaagugcuggaauuacau

SEQ ID NO: 842700 - RNA, 22 nt, Human
uucugucauccuuucuagaugu

SEQ ID NO: 842701 - RNA, 22 nt, Human
acagguggagugguuagcaggc

SEQ ID NO: 842702 - RNA, 22 nt, Human
cacagaauuaagggagaaauau

SEQ ID NO: 842703 - RNA, 22 nt, Human
gaggcaggcccugaaugaguca

SEQ ID NO: 842704 - RNA, 17 nt, Human
ggaaaaggaugauacag

SEQ ID NO: 842705 - RNA, 22 nt, Human
acccuggguucccgcagcacca

SEQ ID NO: 842706 - RNA, 20 nt, Human
agggcagagggauuacaggc

SEQ ID NO: 842707 - RNA, 22 nt, Human
agcucccugagaugccacagca

SEQ ID NO: 842708 - RNA, 22 nt, Human
ucccagagugugggcaucaagg

SEQ ID NO: 842709 - RNA, 22 nt, Human
cugcuguguuagcagguuuagu

SEQ ID NO: 842710 - RNA, 23 nt, Human
uugcuuucaucaugagaugcucc

SEQ ID NO: 842711 - RNA, 22 nt, Human
cauuugaaccuggauguucuua

SEQ ID NO: 842712 - RNA, 20 nt, Human
ugucaugcauuagaugaaga

SEQ ID NO: 842713 - RNA, 22 nt, Human
cggggacacacuggcagcuccu

SEQ ID NO: 842714 - RNA, 22 nt, Human
uagugcacacgcauguagcagu

SEQ ID NO: 842715 - RNA, 15 nt, Human
ugauuuccuacuaac

SEQ ID NO: 842716 - RNA, 22 nt, Human
uuuaaauuauaguuaaugucug

SEQ ID NO: 842717 - RNA, 22 nt, Human
cagggcaguaccgcccucuggc

SEQ ID NO: 842718 - RNA, 22 nt, Human
guggccucugugcuccugccua

SEQ ID NO: 842719 - RNA, 22 nt, Human
cagaggugcauacaggucauua

SEQ ID NO: 842720 - RNA, 20 nt, Human
gucucaaguaucucacaguc

SEQ ID NO: 842721 - RNA, 22 nt, Human
uaaauucugaucaaguuccuuc

SEQ ID NO: 842722 - RNA, 22 nt, Human
ggcaggcucagcagccaaggag

SEQ ID NO: 842723 - RNA, 22 nt, Human
caggggacauuaaagcuccaua

SEQ ID NO: 842724 - RNA, 22 nt, Human
auucaacggguagaagggucuu

SEQ ID NO: 842725 - RNA, 21 nt, Human
gcagagccggggcgagaaggc

SEQ ID NO: 842726 - RNA, 22 nt, Human
uuugcauugccucugacuuaug

SEQ ID NO: 842727 - RNA, 22 nt, Human
ucccagauuguugauggcuuaa

SEQ ID NO: 842728 - RNA, 22 nt, Human
caaggaaaacagaugaucaaca

SEQ ID NO: 842729 - RNA, 17 nt, Human
gcacugaacaauccugu

SEQ ID NO: 842730 - RNA, 22 nt, Human
auagcuuuacagaagaguuuag

SEQ ID NO: 842731 - RNA, 22 nt, Human
uuugaauagcauaggauuacau

SEQ ID NO: 842732 - RNA, 22 nt, Human
acagggcagugucuugaaaaau

SEQ ID NO: 842733 - RNA, 22 nt, Human
uggugccuugggccuacagcgc

SEQ ID NO: 842734 - RNA, 22 nt, Human
gggcugcacagaucuucaaggg

SEQ ID NO: 842735 - RNA, 22 nt, Human
ugcugccagccaggccauggag

SEQ ID NO: 842736 - RNA, 22 nt, Human
aaauaguuguuuggaucaauaa

SEQ ID NO: 842737 - RNA, 22 nt, Human
gcccaggaggcagagguugugg

SEQ ID NO: 842738 - RNA, 22 nt, Human
cagacuugacggcagcugcuuu

SEQ ID NO: 842739 - RNA, 22 nt, Human
agccaggauuggcugagccuua

SEQ ID NO: 842740 - RNA, 23 nt, Human
aaauuauugcucuucaauugccu

SEQ ID NO: 842741 - RNA, 22 nt, Human
uccuuuuuaagucguuguggua

SEQ ID NO: 842742 - RNA, 22 nt, Human
cccaggaugucgaggcugcagu

SEQ ID NO: 842743 - RNA, 22 nt, Human
cugugccuaagaugcaugucuc

SEQ ID NO: 842744 - RNA, 22 nt, Human
ugggaggacuugugggcuucau

SEQ ID NO: 842745 - RNA, 22 nt, Human
agcuucucaggagucugaggca

SEQ ID NO: 842746 - RNA, 20 nt, Human
uuucaguuaucuugaccuuc

SEQ ID NO: 842747 - RNA, 22 nt, Human
gcaaugauauugaagugaugaa

SEQ ID NO: 842748 - RNA, 22 nt, Human
gcagcccaauggacugagacag

SEQ ID NO: 842749 - RNA, 22 nt, Human
ucaucaaagcgcuuggaguagg

SEQ ID NO: 842750 - RNA, 22 nt, Human
gcaguaaaaaaggauaugugca

SEQ ID NO: 842751 - RNA, 22 nt, Human
aagugacaccucuucccuuucc

SEQ ID NO: 842752 - RNA, 22 nt, Human
guuccaaagcaaaggaggugag

SEQ ID NO: 842753 - RNA, 22 nt, Human
cauauucuuuaagcaaugcucu

SEQ ID NO: 842754 - RNA, 22 nt, Human
ggccuagggaguggccaugccu

SEQ ID NO: 842755 - RNA, 22 nt, Human
ucaauuaugccauugcaauauu

SEQ ID NO: 842756 - RNA, 22 nt, Human
gaaugcagauggcugguguaug

SEQ ID NO: 842757 - RNA, 22 nt, Human
caugaagcuugaagcaguccac

SEQ ID NO: 842758 - RNA, 22 nt, Human
gcucacuggccugaagaggacg

SEQ ID NO: 842759 - RNA, 22 nt, Human
ugucucaguacacuccgauguu

SEQ ID NO: 842760 - RNA, 23 nt, Human
gccugccugaccugugcaaaguc

SEQ ID NO: 842761 - RNA, 22 nt, Human
ccagcagcgauagggugagugc

SEQ ID NO: 842762 - RNA, 22 nt, Human
gaugagcauuguuucauguguu

SEQ ID NO: 842763 - RNA, 22 nt, Human
aucugacuucacgcccaugcca

SEQ ID NO: 842764 - RNA, 22 nt, Human
ugcugggcuagaagcugaggcc

SEQ ID NO: 842765 - RNA, 22 nt, Human
uaaaugugaccuucauuuuaua

SEQ ID NO: 842766 - RNA, 22 nt, Human
ucucauguauugcccuggugug

SEQ ID NO: 842767 - RNA, 22 nt, Human
uggccuggaaccuggcagggac

SEQ ID NO: 842768 - RNA, 20 nt, Human
aguguuccggaagacuggca

SEQ ID NO: 842769 - RNA, 22 nt, Human
cuggagcugcuguccuugggug

SEQ ID NO: 842770 - RNA, 22 nt, Human
caggccucaggggcucaggcug

SEQ ID NO: 842771 - RNA, 22 nt, Human
ugcauuugucuugucucaugaa

SEQ ID NO: 842772 - RNA, 22 nt, Human
ugucuguacaaauuuucugugu

SEQ ID NO: 842773 - RNA, 22 nt, Human
aguuuuuccguggcuacgauaa

SEQ ID NO: 842774 - RNA, 22 nt, Human
acacugaauauacaaugaauau

SEQ ID NO: 842775 - RNA, 22 nt, Human
ccacagagcauuagauuucaga

SEQ ID NO: 842776 - RNA, 19 nt, Human
ccugcagggaugagagguu

SEQ ID NO: 842777 - RNA, 22 nt, Human
gccuucugaucgcuggacugac

SEQ ID NO: 842778 - RNA, 22 nt, Human
ucugccuggauuccauucucca

SEQ ID NO: 842779 - RNA, 22 nt, Human
agaggucauaucucagaagaga

SEQ ID NO: 842780 - RNA, 22 nt, Human
uuuaagaugguauuuuauaaag

SEQ ID NO: 842781 - RNA, 19 nt, Human
uagcagcugccaaaggaga

SEQ ID NO: 842782 - RNA, 22 nt, Human
ccucugggugggaggccgggcg

SEQ ID NO: 842783 - RNA, 22 nt, Human
cuggcagguccagcuggacuca

SEQ ID NO: 842784 - RNA, 21 nt, Human
acagaguaguugaaacagaga

SEQ ID NO: 842785 - RNA, 22 nt, Human
cauuucugucacguucuuuuau

SEQ ID NO: 842786 - RNA, 22 nt, Human
ggcucaggacacagugguuuag

SEQ ID NO: 842787 - RNA, 22 nt, Human
agcugccugcuuaugagcucca

SEQ ID NO: 842788 - RNA, 22 nt, Human
ggcugcagcagagggacucacg

SEQ ID NO: 842789 - RNA, 22 nt, Human
cugaaggacuuggugauaguug

SEQ ID NO: 842790 - RNA, 22 nt, Human
aaaacuuucagggauacagaaa

SEQ ID NO: 842791 - RNA, 22 nt, Human
caagggcucacggucugcuggg

SEQ ID NO: 842792 - RNA, 22 nt, Human
uccaggaggccucauuuccugu

SEQ ID NO: 842793 - RNA, 22 nt, Human
ccuggcugggguagaagugagg

SEQ ID NO: 842794 - RNA, 19 nt, Human
uacauacuuauucuaaaag

SEQ ID NO: 842795 - RNA, 22 nt, Human
ugggcacuggaagccugcugug

SEQ ID NO: 842796 - RNA, 22 nt, Human
caggcagccugcggucugcaca

SEQ ID NO: 842797 - RNA, 22 nt, Human
ugcucugucaagaaaagaugcc

SEQ ID NO: 842798 - RNA, 22 nt, Human
aggccagguggucaugcuugcu

SEQ ID NO: 842799 - RNA, 22 nt, Human
aguugacauccagagacauucu

SEQ ID NO: 842800 - RNA, 23 nt, Human
ugagcccaggaggucaaggcugc

SEQ ID NO: 842801 - RNA, 22 nt, Human
ggcuggccuguguggccgccac

SEQ ID NO: 842802 - RNA, 22 nt, Human
uacaaagcuguauagccugguc

SEQ ID NO: 842803 - RNA, 22 nt, Human
cuggugccauucuguggccuag

SEQ ID NO: 842804 - RNA, 22 nt, Human
caugaguuuuuuaguucaugca

SEQ ID NO: 842805 - RNA, 22 nt, Human
ugaagaaucccagggaauuugg

SEQ ID NO: 842806 - RNA, 22 nt, Human
agcuggaggggccagcaggugu

SEQ ID NO: 842807 - RNA, 22 nt, Human
gccugccuagaauugcagcuuu

SEQ ID NO: 842808 - RNA, 23 nt, Human
gccucugcucugcguuggggacu

SEQ ID NO: 842809 - RNA, 22 nt, Human
aauucuguaacuuuacugaauu

SEQ ID NO: 842810 - RNA, 22 nt, Human
uuucaugauuaacuuagugaau

SEQ ID NO: 842811 - RNA, 22 nt, Human
gcagcuuggauuucuguaguuu

SEQ ID NO: 842812 - RNA, 22 nt, Human
aggcagcuuaagcccuggccca

SEQ ID NO: 842813 - RNA, 22 nt, Human
gcagugguccaguucacaccca

SEQ ID NO: 842814 - RNA, 22 nt, Human
ggcagccuugagggaggccugg

SEQ ID NO: 842815 - RNA, 22 nt, Human
gugcuaggauuacaggcauggg

SEQ ID NO: 842816 - RNA, 22 nt, Human
uauaaaauggcaucagcuccaa

SEQ ID NO: 842817 - RNA, 22 nt, Human
accagagauggggcuucucugu

SEQ ID NO: 842818 - RNA, 18 nt, Human
cggcagagugcuucuagc

SEQ ID NO: 842819 - RNA, 22 nt, Human
aguguuucucagaagggccuau

SEQ ID NO: 842820 - RNA, 22 nt, Human
cccuggaguccuggcaguugau

SEQ ID NO: 842821 - RNA, 22 nt, Human
accaggagguguuugcucaagu

SEQ ID NO: 842822 - RNA, 22 nt, Human
auguccuucuccucuuaccugc

SEQ ID NO: 842823 - RNA, 22 nt, Human
uccagggaucuuuagagucuuu

SEQ ID NO: 842824 - RNA, 22 nt, Human
uaacagaagaaaacauauugga

SEQ ID NO: 842825 - RNA, 22 nt, Human
cagcccuuuccuucucagcuuu

SEQ ID NO: 842826 - RNA, 22 nt, Human
auacacauauguguguauaugu

SEQ ID NO: 842827 - RNA, 22 nt, Human
uuggcagugaugcagcuuguuc

SEQ ID NO: 842828 - RNA, 22 nt, Human
uaccugagcccagugcagcaua

SEQ ID NO: 842829 - RNA, 19 nt, Human
cugcugggugcugagggag

SEQ ID NO: 842830 - RNA, 23 nt, Human
aucauucuccaaucuggagcagg

SEQ ID NO: 842831 - RNA, 23 nt, Human
cugcuguguuggucucgauggga

SEQ ID NO: 842832 - RNA, 22 nt, Human
gagauuggauuuaauggccaaa

SEQ ID NO: 842833 - RNA, 22 nt, Human
gagcucagcccaaagagcagug

SEQ ID NO: 842834 - RNA, 22 nt, Human
aagucacacuagacaacugagg

SEQ ID NO: 842835 - RNA, 22 nt, Human
cacugugucaguuugguuagac

SEQ ID NO: 842836 - RNA, 22 nt, Human
ucacacguccuugcuacuccuc

SEQ ID NO: 842837 - RNA, 22 nt, Human
cagugcauagauccugaggccu

SEQ ID NO: 842838 - RNA, 22 nt, Human
aauagguagccagauauauaaa

SEQ ID NO: 842839 - RNA, 22 nt, Human
aagauucagccaaauuguucau

SEQ ID NO: 842840 - RNA, 22 nt, Human
agcuagaaguacagccauauga

SEQ ID NO: 842841 - RNA, 22 nt, Human
acagccugcugccugcuucuug

SEQ ID NO: 842842 - RNA, 22 nt, Human
ugguuuuagaugccuuuacugc

SEQ ID NO: 842843 - RNA, 22 nt, Human
uuugaaaauuuaagugcuacac

SEQ ID NO: 842844 - RNA, 22 nt, Human
aaugaacaucaaaugccuacca

SEQ ID NO: 842845 - RNA, 22 nt, Human
uggacaggugagugacucaggg

SEQ ID NO: 842846 - RNA, 22 nt, Human
uuuuaucaaucauuaagacauu

SEQ ID NO: 842847 - RNA, 22 nt, Human
uggcuuuaggagcuauauaccu

SEQ ID NO: 842848 - RNA, 22 nt, Human
ccuggcugcuuucacuauggag

SEQ ID NO: 842849 - RNA, 22 nt, Human
guucuucacauuucauugagga

SEQ ID NO: 842850 - RNA, 22 nt, Human
gacagcuguggagaggcaugug

SEQ ID NO: 842851 - RNA, 21 nt, Human
acaggagaccgccuggcaguc

SEQ ID NO: 842852 - RNA, 22 nt, Human
caugcacaaagguaagaugcgu

SEQ ID NO: 842853 - RNA, 22 nt, Human
cacagcagaaauaugaaggcag

SEQ ID NO: 842854 - RNA, 22 nt, Human
uuaaauauuuucagcaggguca

SEQ ID NO: 842855 - RNA, 22 nt, Human
uccaugagacagauacuguaag

SEQ ID NO: 842856 - RNA, 22 nt, Human
aaaguccagagggcacacugaa

SEQ ID NO: 842857 - RNA, 22 nt, Human
uaccaggcagcugcacagaggc

SEQ ID NO: 842858 - RNA, 22 nt, Human
uggagggcaucuguggucaggc

SEQ ID NO: 842859 - RNA, 22 nt, Human
uauacagaacugcacgugcacg

SEQ ID NO: 842860 - RNA, 22 nt, Human
aucuggcucucucauuuacaaa

SEQ ID NO: 842861 - RNA, 17 nt, Human
uuuucucucuuggauuc

SEQ ID NO: 842862 - RNA, 21 nt, Human
uaaagaagaugaaugugauca

SEQ ID NO: 842863 - RNA, 22 nt, Human
agcacauaccagaaccacaggu

SEQ ID NO: 842864 - RNA, 22 nt, Human
guccucugcccaggucaagguu

SEQ ID NO: 842865 - RNA, 22 nt, Human
cagggcaguaacgggaacaucu

SEQ ID NO: 842866 - RNA, 22 nt, Human
ugaggcucaaggucugguggag

SEQ ID NO: 842867 - RNA, 22 nt, Human
auggacaggaacucccuuggca

SEQ ID NO: 842868 - RNA, 22 nt, Human
uugcagcagggugaauucacuc

SEQ ID NO: 842869 - RNA, 22 nt, Human
auucaguuaaaaacuguacuuc

SEQ ID NO: 842870 - RNA, 22 nt, Human
ggcugagcucaggggcagcagg

SEQ ID NO: 842871 - RNA, 22 nt, Human
agcaaagucaguggaaccaucc

SEQ ID NO: 842872 - RNA, 22 nt, Human
caaauacuggguaaguuaauuu

SEQ ID NO: 842873 - RNA, 22 nt, Human
caggaggcuccuagggcucugu

SEQ ID NO: 842874 - RNA, 23 nt, Human
uccaggagaauuccagggcccgg

SEQ ID NO: 842875 - RNA, 22 nt, Human
uccucagacuucccuuugugua

SEQ ID NO: 842876 - RNA, 23 nt, Human
uuucuguuggguauauauccaag

SEQ ID NO: 842877 - RNA, 20 nt, Human
agccagaagaaggcuggaga

SEQ ID NO: 842878 - RNA, 22 nt, Human
ggccuguccagccugccuggcu

SEQ ID NO: 842879 - RNA, 18 nt, Human
cccucuugcacaaagcaa

SEQ ID NO: 842880 - RNA, 22 nt, Human
gcagcuguguaaugagcccaca

SEQ ID NO: 842881 - RNA, 22 nt, Human
gugauuuucuccuccuagaagu

SEQ ID NO: 842882 - RNA, 22 nt, Human
gcacuaaaccaacauguaauaa

SEQ ID NO: 842883 - RNA, 20 nt, Human
cguaaggcaagugcugcauc

SEQ ID NO: 842884 - RNA, 22 nt, Human
ggccucuguuuggagccaggau

SEQ ID NO: 842885 - RNA, 22 nt, Human
acagcagcaauagcagugacau

SEQ ID NO: 842886 - RNA, 22 nt, Human
uaauuucaaguuuagggcucua

SEQ ID NO: 842887 - RNA, 22 nt, Human
uggccaggcagguagaacggcc

SEQ ID NO: 842888 - RNA, 22 nt, Human
gaggccuggaccagccacagag

SEQ ID NO: 842889 - RNA, 22 nt, Human
cccaggaggugugcccaacucg

SEQ ID NO: 842890 - RNA, 22 nt, Human
gaggcugguaggaaaggaaaca

SEQ ID NO: 842891 - RNA, 16 nt, Human
gagccaggugccuuga

SEQ ID NO: 842892 - RNA, 22 nt, Human
gcagagugaggaagagcuucca

SEQ ID NO: 842893 - RNA, 22 nt, Human
cagggccauaucuugugcacca

SEQ ID NO: 842894 - RNA, 22 nt, Human
cugauuccugauucaugcucuu

SEQ ID NO: 842895 - RNA, 22 nt, Human
gcuguucaagacuaggaaauuu

SEQ ID NO: 842896 - RNA, 22 nt, Human
ugccagcaguagcaguaggcca

SEQ ID NO: 842897 - RNA, 23 nt, Human
cacaccaggagccgucugggcca

SEQ ID NO: 842898 - RNA, 23 nt, Human
auauggcuguuguguguuaacau

SEQ ID NO: 842899 - RNA, 23 nt, Human
ugcagcugccucuggcgggccgg

SEQ ID NO: 842900 - RNA, 22 nt, Human
ugcaguggugguaaagaugcuc

SEQ ID NO: 842901 - RNA, 22 nt, Human
aggaaagggguagguguggacg

SEQ ID NO: 842902 - RNA, 22 nt, Human
ggaggcagaacuucccgucagu

SEQ ID NO: 842903 - RNA, 22 nt, Human
augauauuugcaaugugcuugc

SEQ ID NO: 842904 - RNA, 22 nt, Human
cauuucaauuauuugcucuucu

SEQ ID NO: 842905 - RNA, 22 nt, Human
uuauuuucuccucagaaagugg

SEQ ID NO: 842906 - RNA, 22 nt, Human
cuggcuuccucaggagcagugg

SEQ ID NO: 842907 - RNA, 22 nt, Human
agagccuggacuuuucugagcc

SEQ ID NO: 842908 - RNA, 22 nt, Human
agaggggacagccaccugcccg

SEQ ID NO: 842909 - RNA, 22 nt, Human
ucuucuuccucauuuauacaua

SEQ ID NO: 842910 - RNA, 22 nt, Human
ccaaagugcugagauuacaggu

SEQ ID NO: 842911 - RNA, 22 nt, Human
uguuuuuaaauaaugauagaaa

SEQ ID NO: 842912 - RNA, 22 nt, Human
accagccugucugagucguggg

SEQ ID NO: 842913 - RNA, 22 nt, Human
uggcagucggacuucuaucuca

SEQ ID NO: 842914 - RNA, 22 nt, Human
ugagcaguaggucugaauagug

SEQ ID NO: 842915 - RNA, 22 nt, Human
uuuacagaauguugaauuuggg

SEQ ID NO: 842916 - RNA, 22 nt, Human
uaauccacaauagagauuaucu

SEQ ID NO: 842917 - RNA, 22 nt, Human
ccuuggaggacugcugcuucuu

SEQ ID NO: 842918 - RNA, 22 nt, Human
agccucugacugucagcaaggu

SEQ ID NO: 842919 - RNA, 22 nt, Human
ucugagcuggagcccaucaccu

SEQ ID NO: 842920 - RNA, 22 nt, Human
uacaguaacauguuguacaagc

SEQ ID NO: 842921 - RNA, 22 nt, Human
ccuggcagcgugccgagcugcg

SEQ ID NO: 842922 - RNA, 22 nt, Human
agagccugucugccuuucuacc

SEQ ID NO: 842923 - RNA, 22 nt, Human
uggcucugggaaucuguugcuu

SEQ ID NO: 842924 - RNA, 22 nt, Human
ugauuuccaauaaggagaaugu

SEQ ID NO: 842925 - RNA, 22 nt, Human
gaggggcagaaugugaucaggg

SEQ ID NO: 842926 - RNA, 19 nt, Human
caaggguugggucugucau

SEQ ID NO: 842927 - RNA, 22 nt, Human
ggcugcuggaagacugaacaag

SEQ ID NO: 842928 - RNA, 22 nt, Human
auuucagcccaguaugagcccc

SEQ ID NO: 842929 - RNA, 22 nt, Human
cauuagaagaacaguuauauua

SEQ ID NO: 842930 - RNA, 22 nt, Human
aaaaucugguaauuugaaugug

SEQ ID NO: 842931 - RNA, 22 nt, Human
uugacacagaucaauauucaac

SEQ ID NO: 842932 - RNA, 21 nt, Human
uccucugcucucauaccacaa

SEQ ID NO: 842933 - RNA, 22 nt, Human
ccagcaugagacgaugaugaag

SEQ ID NO: 842934 - RNA, 22 nt, Human
aucuggcuuggguguggguagc

SEQ ID NO: 842935 - RNA, 22 nt, Human
gagccagguuugaaucucaguc

SEQ ID NO: 842936 - RNA, 17 nt, Human
gcagugaaaagagauca

SEQ ID NO: 842937 - RNA, 22 nt, Human
cugcuguguggugaaacucagu

SEQ ID NO: 842938 - RNA, 22 nt, Human
ugacccugcuucuuggugcagg

SEQ ID NO: 842939 - RNA, 22 nt, Human
uaugaacugugagugugauggg

SEQ ID NO: 842940 - RNA, 22 nt, Human
gcagauggugggggaggaguac

SEQ ID NO: 842941 - RNA, 23 nt, Human
ccaggcaguagcuauugaaguga

SEQ ID NO: 842942 - RNA, 22 nt, Human
uacuuagagcgauaauuuauac

SEQ ID NO: 842943 - RNA, 22 nt, Human
agucagugaaaacuagaauguu

SEQ ID NO: 842944 - RNA, 22 nt, Human
gcugccagcuuuccuuggcuga

SEQ ID NO: 842945 - RNA, 22 nt, Human
uccaguggguugcugagggagg

SEQ ID NO: 842946 - RNA, 22 nt, Human
uagacagauuucuuguuagaca

SEQ ID NO: 842947 - RNA, 22 nt, Human
agucucugcaugccugcugugc

SEQ ID NO: 842948 - RNA, 22 nt, Human
aacauucaaaacccaguucagu

SEQ ID NO: 842949 - RNA, 18 nt, Human
agcuucccucugagaggg

SEQ ID NO: 842950 - RNA, 22 nt, Human
agggccuggaacuggagaccac

SEQ ID NO: 842951 - RNA, 21 nt, Human
uugcaccaugauaaauucaga

SEQ ID NO: 842952 - RNA, 22 nt, Human
cuucagaagccugcagccuuug

SEQ ID NO: 842953 - RNA, 22 nt, Human
agagccacugggagacagagca

SEQ ID NO: 842954 - RNA, 22 nt, Human
uccaaauacauuuacuguauuu

SEQ ID NO: 842955 - RNA, 22 nt, Human
uucuucuuucccccugugguac

SEQ ID NO: 842956 - RNA, 22 nt, Human
agaggacagacggaaagugcca

SEQ ID NO: 842957 - RNA, 22 nt, Human
uuggaaauugcaagugauuugc

SEQ ID NO: 842958 - RNA, 18 nt, Human
cagggccccagaauuauc

SEQ ID NO: 842959 - RNA, 22 nt, Human
ugggcagaaaucaguaucagau

SEQ ID NO: 842960 - RNA, 22 nt, Human
guagcccaccuggggagggcga

SEQ ID NO: 842961 - RNA, 22 nt, Human
auauuaaauggauuuugggagc

SEQ ID NO: 842962 - RNA, 22 nt, Human
uccaggaguggggcagaggucu

SEQ ID NO: 842963 - RNA, 22 nt, Human
uccuugaaaggggcugcagggc

SEQ ID NO: 842964 - RNA, 22 nt, Human
ccuggcagcuccuccccggcgg

SEQ ID NO: 842965 - RNA, 22 nt, Human
aggcaagcugcagagaguccuu

SEQ ID NO: 842966 - RNA, 22 nt, Human
gacucagugauuugacaugccu

SEQ ID NO: 842967 - RNA, 21 nt, Human
agagcugggacuugccugaga

SEQ ID NO: 842968 - RNA, 22 nt, Human
auuaggcauucaugcagcuccu

SEQ ID NO: 842969 - RNA, 22 nt, Human
uccagucaagcuugagaauuuc

SEQ ID NO: 842970 - RNA, 19 nt, Human
gggcuccuugggccucucu

SEQ ID NO: 842971 - RNA, 20 nt, Human
acauugauuauguuuguaga

SEQ ID NO: 842972 - RNA, 18 nt, Human
ggcugccuguuccugaag

SEQ ID NO: 842973 - RNA, 22 nt, Human
aaucagaauuuguccccugagu

SEQ ID NO: 842974 - RNA, 22 nt, Human
aguuuagaguucaaauuaguuc

SEQ ID NO: 842975 - RNA, 22 nt, Human
uccuuuuuauaguuagagaaac

SEQ ID NO: 842976 - RNA, 22 nt, Human
gccaggcagcaggaagccagug

SEQ ID NO: 842977 - RNA, 22 nt, Human
uagagcugauaaugaggccaag

SEQ ID NO: 842978 - RNA, 22 nt, Human
uuuaguaaguucacugcaaagc

SEQ ID NO: 842979 - RNA, 22 nt, Human
auggcuuugcucaaguuuagcc

SEQ ID NO: 842980 - RNA, 22 nt, Human
ugcucuguaacaaauugacaug

SEQ ID NO: 842981 - RNA, 22 nt, Human
acucacuuuccauucaagcacc

SEQ ID NO: 842982 - RNA, 21 nt, Human
uuucagaccuaucuuugaagg

SEQ ID NO: 842983 - RNA, 22 nt, Human
ugauuuccugugcgcccuuagg

SEQ ID NO: 842984 - RNA, 22 nt, Human
guuugcauuccaauuuagggga

SEQ ID NO: 842985 - RNA, 22 nt, Human
cugaauaauauuccauuaugag

SEQ ID NO: 842986 - RNA, 22 nt, Human
gaaaggucaguuccacuuccau

SEQ ID NO: 842987 - RNA, 22 nt, Human
ggguguccugugccaagcuggg

SEQ ID NO: 842988 - RNA, 22 nt, Human
ucucccacuggccuuguaugau

SEQ ID NO: 842989 - RNA, 22 nt, Human
auugacaaauggauguugacau

SEQ ID NO: 842990 - RNA, 22 nt, Human
cacaggaggaggugcccgggcc

SEQ ID NO: 842991 - RNA, 22 nt, Human
cucagugugaaugcucaguaaa

SEQ ID NO: 842992 - RNA, 22 nt, Human
auucuucacaccuguuccuguu

SEQ ID NO: 842993 - RNA, 22 nt, Human
agggaaagguagugaggucaca

SEQ ID NO: 842994 - RNA, 22 nt, Human
gacccaggaagcuacuucuggu

SEQ ID NO: 842995 - RNA, 22 nt, Human
uagaaaagauaacauucugugc

SEQ ID NO: 842996 - RNA, 22 nt, Human
ugcagcagacugaguaugagaa

SEQ ID NO: 842997 - RNA, 22 nt, Human
cagagccagcaguggggacagg

SEQ ID NO: 842998 - RNA, 22 nt, Human
ggagcuguaacgagccauugcu

SEQ ID NO: 842999 - RNA, 22 nt, Human
aaauguguuccuuugcuacaga

SEQ ID NO: 843000 - RNA, 22 nt, Human
cucagaguggggcucccugagg

SEQ ID NO: 843001 - RNA, 21 nt, Human
agcuuguguguaucacagugu

SEQ ID NO: 843002 - RNA, 22 nt, Human
caacagcugaucuuugaugaag

SEQ ID NO: 843003 - RNA, 22 nt, Human
agucugcacucagguggagguc

SEQ ID NO: 843004 - RNA, 22 nt, Human
aaggcacugaaaaauugugugu

SEQ ID NO: 843005 - RNA, 22 nt, Human
uugcugugucauuuguuuaauc

SEQ ID NO: 843006 - RNA, 22 nt, Human
ccugggaggcugugggucugcu

SEQ ID NO: 843007 - RNA, 22 nt, Human
uuacaaaguguuaugauaaaca

SEQ ID NO: 843008 - RNA, 22 nt, Human
agggcugguauguccaugaaag

SEQ ID NO: 843009 - RNA, 22 nt, Human
uggagggcucuuucaccuggua

SEQ ID NO: 843010 - RNA, 22 nt, Human
ugugccuggaucucugugacaa

SEQ ID NO: 843011 - RNA, 22 nt, Human
gguguccaucaggcugugcuuc

SEQ ID NO: 843012 - RNA, 22 nt, Human
ccagcuccgggaguugcugcug

SEQ ID NO: 843013 - RNA, 22 nt, Human
uugcauuuuuagaugcuucugu

SEQ ID NO: 843014 - RNA, 22 nt, Human
ugguccaggguguaguacagag

SEQ ID NO: 843015 - RNA, 22 nt, Human
cccagagcuccgguccugccca

SEQ ID NO: 843016 - RNA, 22 nt, Human
uccaggcuggacaugaggcggg

SEQ ID NO: 843017 - RNA, 22 nt, Human
cuuauguaugcuacuuuguggu

SEQ ID NO: 843018 - RNA, 22 nt, Human
gagagaagaaagccaugguccu

SEQ ID NO: 843019 - RNA, 22 nt, Human
ugccaggagucaggccaggcag

SEQ ID NO: 843020 - RNA, 22 nt, Human
ggagcugcacgcucugaagccu

SEQ ID NO: 843021 - RNA, 22 nt, Human
uuuuagauaguuuaacugcacu

SEQ ID NO: 843022 - RNA, 22 nt, Human
gccuggcuccuaagagcacaac

SEQ ID NO: 843023 - RNA, 21 nt, Human
agaaaaaccagcauguuuuca

SEQ ID NO: 843024 - RNA, 22 nt, Human
guauacauagaugaugaacaag

SEQ ID NO: 843025 - RNA, 19 nt, Human
ugaggggaggagaggccug

SEQ ID NO: 843026 - RNA, 22 nt, Human
auuucuguauccugcugucaga

SEQ ID NO: 843027 - RNA, 22 nt, Human
gcuguucugcgucccaggcugg

SEQ ID NO: 843028 - RNA, 22 nt, Human
agaaagcacucugucuuuuacc

SEQ ID NO: 843029 - RNA, 22 nt, Human
ucaggggagguugaaucgucuc

SEQ ID NO: 843030 - RNA, 22 nt, Human
gcuggccugggcagaggcuaug

SEQ ID NO: 843031 - RNA, 17 nt, Human
gccuuccuuccuccaca

SEQ ID NO: 843032 - RNA, 22 nt, Human
gucugucaucugagauggagug

SEQ ID NO: 843033 - RNA, 19 nt, Human
ggcccaaguacugagugcc

SEQ ID NO: 843034 - RNA, 23 nt, Human
ucagagaaguuguaggcugggga

SEQ ID NO: 843035 - RNA, 22 nt, Human
gugccaggugcuaagcugugcu

SEQ ID NO: 843036 - RNA, 22 nt, Human
gggugggccugucuggccaugu

SEQ ID NO: 843037 - RNA, 22 nt, Human
acauacuuuuuaaaagauugcu

SEQ ID NO: 843038 - RNA, 22 nt, Human
aggcaggcuggucugaagagug

SEQ ID NO: 843039 - RNA, 22 nt, Human
agaggccuuucuguugagugaa

SEQ ID NO: 843040 - RNA, 22 nt, Human
gcaggggaguggaugauggauu

SEQ ID NO: 843041 - RNA, 22 nt, Human
aguaaaauuucugcugaggaga

SEQ ID NO: 843042 - RNA, 22 nt, Human
cauacuuucuuuuucacgcaua

SEQ ID NO: 843043 - RNA, 22 nt, Human
agauuucacaugcugcucuauu

SEQ ID NO: 843044 - RNA, 21 nt, Human
gccaccucgucucggagcagc

SEQ ID NO: 843045 - RNA, 22 nt, Human
gccucugcgccucagccgaccu

SEQ ID NO: 843046 - RNA, 22 nt, Human
ucuguucauuugccucggcucu

SEQ ID NO: 843047 - RNA, 22 nt, Human
gugauaaaauucaaauagcucu

SEQ ID NO: 843048 - RNA, 22 nt, Human
cauaaguuggguaauauaauga

SEQ ID NO: 843049 - RNA, 23 nt, Human
ggagccuggcauaugagacgcau

SEQ ID NO: 843050 - RNA, 23 nt, Human
cuggggcuuucaaaucugggcag

SEQ ID NO: 843051 - RNA, 22 nt, Human
uaaaucaguuucucuuauuggu

SEQ ID NO: 843052 - RNA, 22 nt, Human
cugggagaugacucagagcagg

SEQ ID NO: 843053 - RNA, 20 nt, Human
ccuggcugcauucaggacgg

SEQ ID NO: 843054 - RNA, 22 nt, Human
cuguuucaagugaagucagaca

SEQ ID NO: 843055 - RNA, 22 nt, Human
uucaguaaaacacugcaauguc

SEQ ID NO: 843056 - RNA, 22 nt, Human
uuuaccaagcuuuaauuacaua

SEQ ID NO: 843057 - RNA, 22 nt, Human
agaaugcaagauaaacuuuauu

SEQ ID NO: 843058 - RNA, 22 nt, Human
ccagagccggcucccucagcuu

SEQ ID NO: 843059 - RNA, 22 nt, Human
gcuggaucaaguccuucaccca

SEQ ID NO: 843060 - RNA, 22 nt, Human
aguaaaaauugaggugcaaaau

SEQ ID NO: 843061 - RNA, 22 nt, Human
acguuuucagugacugugcuuc

SEQ ID NO: 843062 - RNA, 22 nt, Human
gggcagccucggugccugcugc

SEQ ID NO: 843063 - RNA, 22 nt, Human
gucuauauauugcuugaauaau

SEQ ID NO: 843064 - RNA, 22 nt, Human
ucugagggcuugaggggaagua

SEQ ID NO: 843065 - RNA, 22 nt, Human
cucccaagggguaagggagcug

SEQ ID NO: 843066 - RNA, 22 nt, Human
uucucuuuugugaugugagaug

SEQ ID NO: 843067 - RNA, 22 nt, Human
auucuucaaagagugucaaagu

SEQ ID NO: 843068 - RNA, 22 nt, Human
caaauucagaaaauugguagag

SEQ ID NO: 843069 - RNA, 22 nt, Human
cugccucugcgucccacagagu

SEQ ID NO: 843070 - RNA, 22 nt, Human
augaaaauucuaugcaggccag

SEQ ID NO: 843071 - RNA, 22 nt, Human
cucaggauagcugcgcagccug

SEQ ID NO: 843072 - RNA, 22 nt, Human
ccccagcucagugcagggacau

SEQ ID NO: 843073 - RNA, 22 nt, Human
aguccagugaacuguaaauagg

SEQ ID NO: 843074 - RNA, 22 nt, Human
ccaggcuggagugcaauggugc

SEQ ID NO: 843075 - RNA, 22 nt, Human
gcagccugaugaucuggguugu

SEQ ID NO: 843076 - RNA, 20 nt, Human
cagcuuggaugagaggcuga

SEQ ID NO: 843077 - RNA, 22 nt, Human
cagggcaggacagauacauuac

SEQ ID NO: 843078 - RNA, 22 nt, Human
aaguucaaguaguguuacaugg

SEQ ID NO: 843079 - RNA, 22 nt, Human
aauuccagcuaggaaaagcuuc

SEQ ID NO: 843080 - RNA, 22 nt, Human
uccaugagaacccuuggagaua

SEQ ID NO: 843081 - RNA, 22 nt, Human
ucugucugcaccuaagcacagu

SEQ ID NO: 843082 - RNA, 22 nt, Human
caagaugccccugguagggauc

SEQ ID NO: 843083 - RNA, 22 nt, Human
aaaaauugcugagaacggaauu

SEQ ID NO: 843084 - RNA, 20 nt, Human
cacagcuugccuuuuaugac

SEQ ID NO: 843085 - RNA, 22 nt, Human
cagucacauugcccugcauuua

SEQ ID NO: 843086 - RNA, 20 nt, Human
acuggagccaucucagccua

SEQ ID NO: 843087 - RNA, 23 nt, Human
uugauuucaaaugcagagaacac

SEQ ID NO: 843088 - RNA, 22 nt, Human
uuugacauugccaauuugcuca

SEQ ID NO: 843089 - RNA, 22 nt, Human
gagggaaagguuaauacaugau

SEQ ID NO: 843090 - RNA, 20 nt, Human
gccugagcuauugccaggau

SEQ ID NO: 843091 - RNA, 22 nt, Human
uuuauccagcagcuauucaaaa

SEQ ID NO: 843092 - RNA, 22 nt, Human
gugugaaagcuuguccucugua

SEQ ID NO: 843093 - RNA, 22 nt, Human
agagccuggaccugagcuacaa

SEQ ID NO: 843094 - RNA, 19 nt, Human
ggucagcugggcuagaggc

SEQ ID NO: 843095 - RNA, 21 nt, Human
ugggaugggucugggaccagc

SEQ ID NO: 843096 - RNA, 22 nt, Human
aagaggaaaugauugacuauau

SEQ ID NO: 843097 - RNA, 22 nt, Human
uugagggucuggaucugcugcu

SEQ ID NO: 843098 - RNA, 22 nt, Human
gaaaugcaaauucucucucgcu

SEQ ID NO: 843099 - RNA, 22 nt, Human
uauaauccauucauugauuucu

SEQ ID NO: 843100 - RNA, 22 nt, Human
gucuuucuaugaugaacuguug

SEQ ID NO: 843101 - RNA, 22 nt, Human
gcaaaugcuaaaguguagagac

SEQ ID NO: 843102 - RNA, 22 nt, Human
cacguuuuaugacagaagaagc

SEQ ID NO: 843103 - RNA, 22 nt, Human
ccagcuccuucugucuguggag

SEQ ID NO: 843104 - RNA, 22 nt, Human
auucuucaccugagucagucua

SEQ ID NO: 843105 - RNA, 22 nt, Human
gggacuguaaauucauauggcc

SEQ ID NO: 843106 - RNA, 22 nt, Human
uagagcuguaucaaagagccuu

SEQ ID NO: 843107 - RNA, 22 nt, Human
gagucaccacugugauagucga

SEQ ID NO: 843108 - RNA, 22 nt, Human
guuaggcagugugguauagcag

SEQ ID NO: 843109 - RNA, 22 nt, Human
caucagaaccagcugggugagg

SEQ ID NO: 843110 - RNA, 22 nt, Human
agcugucuccagauacaggauu

SEQ ID NO: 843111 - RNA, 23 nt, Human
gggcaguuauguuguccuuggcu

SEQ ID NO: 843112 - RNA, 22 nt, Human
uccauuuuguagguaugcuaca

SEQ ID NO: 843113 - RNA, 22 nt, Human
gaagagcugugauucaggcuua

SEQ ID NO: 843114 - RNA, 22 nt, Human
acagaaauauucguggugcuug

SEQ ID NO: 843115 - RNA, 22 nt, Human
uggccugguccuugucaaggca

SEQ ID NO: 843116 - RNA, 22 nt, Human
agaggggcucauauccugucau

SEQ ID NO: 843117 - RNA, 22 nt, Human
gcagcugcaggcaggcuugcug

SEQ ID NO: 843118 - RNA, 22 nt, Human
ugcaguggaaagacucagacuu

SEQ ID NO: 843119 - RNA, 22 nt, Human
uguguuccuucgucuucccuuc

SEQ ID NO: 843120 - RNA, 22 nt, Human
ugaggcaguauucuccauucca

SEQ ID NO: 843121 - RNA, 22 nt, Human
uugccaggagcucaucugaggg

SEQ ID NO: 843122 - RNA, 22 nt, Human
uagggauguccugagacuuggc

SEQ ID NO: 843123 - RNA, 22 nt, Human
ccuggagguggagguugcagug

SEQ ID NO: 843124 - RNA, 22 nt, Human
gcucaggaucagccaccucuuu

SEQ ID NO: 843125 - RNA, 22 nt, Human
ccacagggauaggaauggggcu

SEQ ID NO: 843126 - RNA, 22 nt, Human
aggaggcuguggagcacuccau

SEQ ID NO: 843127 - RNA, 22 nt, Human
ggugaagggugucauggcauuu

SEQ ID NO: 843128 - RNA, 22 nt, Human
uucucugaaggccaugcucacu

SEQ ID NO: 843129 - RNA, 22 nt, Human
ccacagggccuuuccugcuggc

SEQ ID NO: 843130 - RNA, 22 nt, Human
uccccagggcugcagagggugu

SEQ ID NO: 843131 - RNA, 22 nt, Human
gccagggagucugggccacaga

SEQ ID NO: 843132 - RNA, 22 nt, Human
gggcugccuuucuucugggagc

SEQ ID NO: 843133 - RNA, 21 nt, Human
ugauuuccaucuuaaaauaaa

SEQ ID NO: 843134 - RNA, 22 nt, Human
uggauuagugcugaaaugaugg

SEQ ID NO: 843135 - RNA, 22 nt, Human
uagaacagaguuccagugauca

SEQ ID NO: 843136 - RNA, 22 nt, Human
auacuaaaguauagaacuuagu

SEQ ID NO: 843137 - RNA, 22 nt, Human
ggcaggcaggagcgugcuuggg

SEQ ID NO: 843138 - RNA, 21 nt, Human
aacauuucugggagaacucac

SEQ ID NO: 843139 - RNA, 22 nt, Human
ccugggcuuucaaaaccagccu

SEQ ID NO: 843140 - RNA, 22 nt, Human
uccugagauguggagcuccaug

SEQ ID NO: 843141 - RNA, 22 nt, Human
aauguacaaaagucagccaacu

SEQ ID NO: 843142 - RNA, 22 nt, Human
uggccugguuauauugcuauca

SEQ ID NO: 843143 - RNA, 22 nt, Human
agauuuagugguggaauuuugg

SEQ ID NO: 843144 - RNA, 22 nt, Human
acauaugugcuuauauccauga

SEQ ID NO: 843145 - RNA, 22 nt, Human
caggcacugugcaagggucucg

SEQ ID NO: 843146 - RNA, 20 nt, Human
aggcugccaggucucacauc

SEQ ID NO: 843147 - RNA, 22 nt, Human
agcugagcucaggcugauguaa

SEQ ID NO: 843148 - RNA, 19 nt, Human
cccucuugcacaaagcaaa

SEQ ID NO: 843149 - RNA, 22 nt, Human
gaucaaaagcuggguucuaaaa

SEQ ID NO: 843150 - RNA, 22 nt, Human
ccaccagcuucagcagccgcgg

SEQ ID NO: 843151 - RNA, 22 nt, Human
cccucccagaugggcuugaggu

SEQ ID NO: 843152 - RNA, 22 nt, Human
gggggcucugacucccucagcu

SEQ ID NO: 843153 - RNA, 22 nt, Human
uugggcuggcagagguggucuu

SEQ ID NO: 843154 - RNA, 21 nt, Human
ucuggagcccuaagcugagaa

SEQ ID NO: 843155 - RNA, 22 nt, Human
gggaaauugugugagaucuuug

SEQ ID NO: 843156 - RNA, 22 nt, Human
ucccuggcagcuaagggugguc

SEQ ID NO: 843157 - RNA, 22 nt, Human
uauaacacucagaaagaaucau

SEQ ID NO: 843158 - RNA, 22 nt, Human
agggccugggguagcuuacugc

SEQ ID NO: 843159 - RNA, 22 nt, Human
gaaaaaggauaaauacaguguu

SEQ ID NO: 843160 - RNA, 21 nt, Human
acagcaagccuucacaugagu

SEQ ID NO: 843161 - RNA, 19 nt, Human
cauguuaugcuguaguauc

SEQ ID NO: 843162 - RNA, 22 nt, Human
ugauuuccccagucuugcugcu

SEQ ID NO: 843163 - RNA, 23 nt, Human
uugcauagacauccucauagauu

SEQ ID NO: 843164 - RNA, 22 nt, Human
uaaguccuucaccuaauccuca

SEQ ID NO: 843165 - RNA, 22 nt, Human
agagugaaggccagguuacagu

SEQ ID NO: 843166 - RNA, 22 nt, Human
gcugcagcuuuaggauccagug

SEQ ID NO: 843167 - RNA, 21 nt, Human
uugaaggaucacuucuguacc

SEQ ID NO: 843168 - RNA, 22 nt, Human
ugaggcagaaaauagcaguuca

SEQ ID NO: 843169 - RNA, 19 nt, Human
ccauggcaaugaucugaug

SEQ ID NO: 843170 - RNA, 22 nt, Human
caggcacuucugcugcuugucu

SEQ ID NO: 843171 - RNA, 22 nt, Human
gcuggcagggacagcugcgugu

SEQ ID NO: 843172 - RNA, 17 nt, Human
caggcagacauguaagc

SEQ ID NO: 843173 - RNA, 22 nt, Human
aaguccuuuauccuaaaagguc

SEQ ID NO: 843174 - RNA, 22 nt, Human
ggaggagggguuuacauuggaa

SEQ ID NO: 843175 - RNA, 22 nt, Human
gcugccuucaguucugauucau

SEQ ID NO: 843176 - RNA, 20 nt, Human
uccucagaagacauuugggg

SEQ ID NO: 843177 - RNA, 22 nt, Human
ggcucaggccagaccacgacuc

SEQ ID NO: 843178 - RNA, 22 nt, Human
gcuuuaaugaagucacgcaaag

SEQ ID NO: 843179 - RNA, 22 nt, Human
cuguagccagaagcagaaggcc

SEQ ID NO: 843180 - RNA, 22 nt, Human
cccugcaggggaccugcagccu

SEQ ID NO: 843181 - RNA, 22 nt, Human
caggaacauuuaaccacagggu

SEQ ID NO: 843182 - RNA, 22 nt, Human
gucaacuuuaagaugaucuuuu

SEQ ID NO: 843183 - RNA, 22 nt, Human
cugccaggcagcagagggagaa

SEQ ID NO: 843184 - RNA, 22 nt, Human
caggagagauaugaguccccac

SEQ ID NO: 843185 - RNA, 22 nt, Human
ugaggggagguuggggcacauc

SEQ ID NO: 843186 - RNA, 22 nt, Human
ucauaaaaauagacucuaaagu

SEQ ID NO: 843187 - RNA, 22 nt, Human
cagggcccaggccacuggguug

SEQ ID NO: 843188 - RNA, 22 nt, Human
agcuuccuguugagagagggag

SEQ ID NO: 843189 - RNA, 22 nt, Human
uccagagcagguggucagaagg

SEQ ID NO: 843190 - RNA, 22 nt, Human
gacccaggguauccagagcugc

SEQ ID NO: 843191 - RNA, 22 nt, Human
cagacagacagccguggccacc

SEQ ID NO: 843192 - RNA, 22 nt, Human
ggcucuggugggaagguuagau

SEQ ID NO: 843193 - RNA, 22 nt, Human
ucucucuuuuuaaucauguaau

SEQ ID NO: 843194 - RNA, 21 nt, Human
agcagaggcugccuggugacu

SEQ ID NO: 843195 - RNA, 22 nt, Human
aggauuuagcaugaaaugugaa

SEQ ID NO: 843196 - RNA, 22 nt, Human
accaggaggcuacacuguccca

SEQ ID NO: 843197 - RNA, 22 nt, Human
aagagcuggcccaaucugagca

SEQ ID NO: 843198 - RNA, 22 nt, Human
gcugucugacuccaaguuggag

SEQ ID NO: 843199 - RNA, 17 nt, Human
ugcuuaauuuugacugg

SEQ ID NO: 843200 - RNA, 22 nt, Human
uggcaguccccugugccuggaa

SEQ ID NO: 843201 - RNA, 22 nt, Human
agguuauaugucauacugaagu

SEQ ID NO: 843202 - RNA, 22 nt, Human
uggcagcacaagguggcccaug

SEQ ID NO: 843203 - RNA, 22 nt, Human
cugacuguaauucuguucuuaa

SEQ ID NO: 843204 - RNA, 22 nt, Human
cucucugguuucagcgaagggg

SEQ ID NO: 843205 - RNA, 22 nt, Human
cagcugagaccagaaugcaggu

SEQ ID NO: 843206 - RNA, 22 nt, Human
ugggcucuccuggaggacaaca

SEQ ID NO: 843207 - RNA, 22 nt, Human
ucauuucuccgaccugcugucc

SEQ ID NO: 843208 - RNA, 19 nt, Human
aggugaugugacucuagaa

SEQ ID NO: 843209 - RNA, 22 nt, Human
acagaauauugguuacuguugc

SEQ ID NO: 843210 - RNA, 22 nt, Human
agggcagccaugagccuucagg

SEQ ID NO: 843211 - RNA, 22 nt, Human
aguguguguuugggcgguuuau

SEQ ID NO: 843212 - RNA, 22 nt, Human
uccagagggcgauggcuggggg

SEQ ID NO: 843213 - RNA, 22 nt, Human
guaacacagaaaugaaauucca

SEQ ID NO: 843214 - RNA, 22 nt, Human
uccaugaguuugaggaaaagag

SEQ ID NO: 843215 - RNA, 21 nt, Human
cccuguguuccacagcagaca

SEQ ID NO: 843216 - RNA, 22 nt, Human
ugcaggaaauuccaggguggcc

SEQ ID NO: 843217 - RNA, 17 nt, Human
ggcagcugugugcaugc

SEQ ID NO: 843218 - RNA, 22 nt, Human
gcuggcuguaucaccuggccag

SEQ ID NO: 843219 - RNA, 22 nt, Human
agguggguaucaugagagauua

SEQ ID NO: 843220 - RNA, 19 nt, Human
auacacauacguaaacuga

SEQ ID NO: 843221 - RNA, 22 nt, Human
cucaggguaaugaaagacgaau

SEQ ID NO: 843222 - RNA, 22 nt, Human
caggggcagucugugugcgugg

SEQ ID NO: 843223 - RNA, 22 nt, Human
ggcuccagggaguggagagaag

SEQ ID NO: 843224 - RNA, 19 nt, Human
uggcagggagaguuugaag

SEQ ID NO: 843225 - RNA, 21 nt, Human
agcagagugcuuugacuuugu

SEQ ID NO: 843226 - RNA, 22 nt, Human
gacagcaggagaucaugauaga

SEQ ID NO: 843227 - RNA, 22 nt, Human
acauuucuaucauccuguaaug

SEQ ID NO: 843228 - RNA, 22 nt, Human
caguaucugucaguaaucaggu

SEQ ID NO: 843229 - RNA, 22 nt, Human
gaggcagagugcaccccaggag

SEQ ID NO: 843230 - RNA, 20 nt, Human
ugaagcagccuugauucugu

SEQ ID NO: 843231 - RNA, 22 nt, Human
ggcacugaucugauuucccucc

SEQ ID NO: 843232 - RNA, 22 nt, Human
gacagaggcuggagcaccuccu

SEQ ID NO: 843233 - RNA, 22 nt, Human
agugcacagcgugauguauugg

SEQ ID NO: 843234 - RNA, 22 nt, Human
cagcuggcagcccuggcccugc

SEQ ID NO: 843235 - RNA, 22 nt, Human
aggaguggaauuacuggguucu

SEQ ID NO: 843236 - RNA, 22 nt, Human
ucagcaggcgguuccuuguggg

SEQ ID NO: 843237 - RNA, 22 nt, Human
ugggccuggaguuuguccagag

SEQ ID NO: 843238 - RNA, 22 nt, Human
ccuacucugagcgccuccgcau

SEQ ID NO: 843239 - RNA, 22 nt, Human
cccaggauggggcugcaguuau

SEQ ID NO: 843240 - RNA, 23 nt, Human
augcaguauaugucaguaguuua

SEQ ID NO: 843241 - RNA, 22 nt, Human
uacauauagacaguuacucuag

SEQ ID NO: 843242 - RNA, 22 nt, Human
aguaaugucccuuaaauguggu

SEQ ID NO: 843243 - RNA, 23 nt, Human
ugauuuccagugagucaguggga

SEQ ID NO: 843244 - RNA, 22 nt, Human
ugaauaauuccuuuuugucaag

SEQ ID NO: 843245 - RNA, 22 nt, Human
ucagcaguuuuauaugcagcuu

SEQ ID NO: 843246 - RNA, 22 nt, Human
ucccagcagcauagcucagaau

SEQ ID NO: 843247 - RNA, 22 nt, Human
aucuauacccaucaugauuuaa

SEQ ID NO: 843248 - RNA, 22 nt, Human
cuguccuugcuggccagguaug

SEQ ID NO: 843249 - RNA, 22 nt, Human
acaagagacaagagguucuucu

SEQ ID NO: 843250 - RNA, 22 nt, Human
ucaguuuucucaucugugaaau

SEQ ID NO: 843251 - RNA, 22 nt, Human
caguggguccuaaguacaguuc

SEQ ID NO: 843252 - RNA, 23 nt, Human
ugucccagagggagggauaggcu

SEQ ID NO: 843253 - RNA, 22 nt, Human
cuggagcccugaaugggcagga

SEQ ID NO: 843254 - RNA, 22 nt, Human
ccaggagcagauauggacauaa

SEQ ID NO: 843255 - RNA, 22 nt, Human
uguccuuaucuccaaacaauca

SEQ ID NO: 843256 - RNA, 22 nt, Human
cgcaccacugaauuccagccug

SEQ ID NO: 843257 - RNA, 23 nt, Human
aaagacugcugagaauuuuagga

SEQ ID NO: 843258 - RNA, 22 nt, Human
ggcagcuggguuggccagaaac

SEQ ID NO: 843259 - RNA, 22 nt, Human
cauugcaccacauugcaucccu

SEQ ID NO: 843260 - RNA, 22 nt, Human
ugugugacccccagugaagccu

SEQ ID NO: 843261 - RNA, 22 nt, Human
aggcagaugggagcuggaaguu

SEQ ID NO: 843262 - RNA, 22 nt, Human
cauggcuuuguucauauaauuu

SEQ ID NO: 843263 - RNA, 22 nt, Human
ugcugaugcuguucuguuagga

SEQ ID NO: 843264 - RNA, 22 nt, Human
agcucccagucuccucuccaug

SEQ ID NO: 843265 - RNA, 22 nt, Human
ugaaacagucuccagacuugga

SEQ ID NO: 843266 - RNA, 22 nt, Human
ucuggauccuaugcacuggacu

SEQ ID NO: 843267 - RNA, 22 nt, Human
aagccuuccugagugcaaggcc

SEQ ID NO: 843268 - RNA, 22 nt, Human
aggcagcccacaggacacagga

SEQ ID NO: 843269 - RNA, 21 nt, Human
gcucccugcucagcuccuggg

SEQ ID NO: 843270 - RNA, 22 nt, Human
cugcugugaguuuggaggucua

SEQ ID NO: 843271 - RNA, 22 nt, Human
ugccagggugucaggagagcua

SEQ ID NO: 843272 - RNA, 22 nt, Human
uaagcuauuccugaagaagguu

SEQ ID NO: 843273 - RNA, 19 nt, Human
auuucaagagguuuauugg

SEQ ID NO: 843274 - RNA, 22 nt, Human
gcagcagaguuugggagauggu

SEQ ID NO: 843275 - RNA, 22 nt, Human
caguaugucuacuggacaaagu

SEQ ID NO: 843276 - RNA, 22 nt, Human
cagggugggcacccagccucca

SEQ ID NO: 843277 - RNA, 22 nt, Human
ugucuuuggaauauuuagcuga

SEQ ID NO: 843278 - RNA, 22 nt, Human
caauauucaguggaaaagccau

SEQ ID NO: 843279 - RNA, 22 nt, Human
aggccagcaagaaagagagucu

SEQ ID NO: 843280 - RNA, 22 nt, Human
agggaugguggagguugcaagu

SEQ ID NO: 843281 - RNA, 22 nt, Human
aaggagcuuguucgccuuccuc

SEQ ID NO: 843282 - RNA, 21 nt, Human
aaugugugcuauuuaucuuuu

SEQ ID NO: 843283 - RNA, 22 nt, Human
ccagggugcucuguggcgucgc

SEQ ID NO: 843284 - RNA, 22 nt, Human
ggccuuuaagcaauugaaaaga

SEQ ID NO: 843285 - RNA, 22 nt, Human
cugcugggcagaggcugcauga

SEQ ID NO: 843286 - RNA, 22 nt, Human
cccaggagguagagguugcagu

SEQ ID NO: 843287 - RNA, 22 nt, Human
ccuggccuggcacucccucugc

SEQ ID NO: 843288 - RNA, 22 nt, Human
ccugggcucuauccugacccag

SEQ ID NO: 843289 - RNA, 22 nt, Human
cacagcugcccuacuccaugug

SEQ ID NO: 843290 - RNA, 22 nt, Human
uggaggcauaggccugggcccu

SEQ ID NO: 843291 - RNA, 22 nt, Human
ggaggagguggguuaaguugua

SEQ ID NO: 843292 - RNA, 22 nt, Human
caguccuugauccaauaguggg

SEQ ID NO: 843293 - RNA, 22 nt, Human
gagcacagccaaaguaagaagg

SEQ ID NO: 843294 - RNA, 22 nt, Human
uaagacuucauuaguaauaugg

SEQ ID NO: 843295 - RNA, 22 nt, Human
uucuucuccuaaggagaguccu

SEQ ID NO: 843296 - RNA, 22 nt, Human
acaugucuguaauuauuuuagg

SEQ ID NO: 843297 - RNA, 22 nt, Human
ggcagcucacgggcauggggug

SEQ ID NO: 843298 - RNA, 22 nt, Human
gagaggaguaggcugauggugc

SEQ ID NO: 843299 - RNA, 22 nt, Human
uucacagggccacuggcaggag

SEQ ID NO: 843300 - RNA, 22 nt, Human
agguaaaauagauaguauuucu

SEQ ID NO: 843301 - RNA, 22 nt, Human
ccuggccucagacagagggugg

SEQ ID NO: 843302 - RNA, 22 nt, Human
ugggggagccuucacaguagcu

SEQ ID NO: 843303 - RNA, 22 nt, Human
ugacuucaagguucagcaccuu

SEQ ID NO: 843304 - RNA, 22 nt, Human
gaaaguuucuucauuaagaugu

SEQ ID NO: 843305 - RNA, 22 nt, Human
cuucagagugcagaagauuggg

SEQ ID NO: 843306 - RNA, 22 nt, Human
ugcuggggagugauugaccauc

SEQ ID NO: 843307 - RNA, 22 nt, Human
agcagcucuggcacuguagcau

SEQ ID NO: 843308 - RNA, 22 nt, Human
guacauguugguuguuuccagu

SEQ ID NO: 843309 - RNA, 22 nt, Human
uggcauuucaguauuuucauaa

SEQ ID NO: 843310 - RNA, 22 nt, Human
agggcugccugacuccagagcc

SEQ ID NO: 843311 - RNA, 22 nt, Human
auuuuuccaugauacuuaucug

SEQ ID NO: 843312 - RNA, 19 nt, Human
aaaugugaugguacaauuc

SEQ ID NO: 843313 - RNA, 22 nt, Human
gacccagcuuaagucacauguu

SEQ ID NO: 843314 - RNA, 16 nt, Human
gggagggaguuggugg

SEQ ID NO: 843315 - RNA, 23 nt, Human
gaauaguuuuagaaauuggagaa

SEQ ID NO: 843316 - RNA, 22 nt, Human
gauucacucauauuuuacguuu

SEQ ID NO: 843317 - RNA, 17 nt, Human
ccagagcuacugagacu

SEQ ID NO: 843318 - RNA, 22 nt, Human
acacaggagauauguaauggcu

SEQ ID NO: 843319 - RNA, 22 nt, Human
gccagcaguauguccuggcagu

SEQ ID NO: 843320 - RNA, 21 nt, Human
cccacggaaugaugaggcacu

SEQ ID NO: 843321 - RNA, 22 nt, Human
ucuggaucaccacuucugccuc

SEQ ID NO: 843322 - RNA, 22 nt, Human
ucuucaaaugcuaguaauauca

SEQ ID NO: 843323 - RNA, 22 nt, Human
ucuguggauuuuaguguucaug

SEQ ID NO: 843324 - RNA, 21 nt, Human
uggcucaguugcugggcacag

SEQ ID NO: 843325 - RNA, 22 nt, Human
cugccagcaaugugaccaugcu

SEQ ID NO: 843326 - RNA, 22 nt, Human
augcacagacccaaaggccauc

SEQ ID NO: 843327 - RNA, 22 nt, Human
aggacccugagcgggcaugccg

SEQ ID NO: 843328 - RNA, 22 nt, Human
uuugcacuagcauuuguccaug

SEQ ID NO: 843329 - RNA, 15 nt, Human
uggcagcuuguuaag

SEQ ID NO: 843330 - RNA, 22 nt, Human
cucccaggguagggagagacua

SEQ ID NO: 843331 - RNA, 22 nt, Human
aaguauauuuuuugaagcauau

SEQ ID NO: 843332 - RNA, 22 nt, Human
aggggaugauccucccgcagcg

SEQ ID NO: 843333 - RNA, 22 nt, Human
acuuguucauugaguacauaug

SEQ ID NO: 843334 - RNA, 22 nt, Human
gccuaggaguggggauggcggu

SEQ ID NO: 843335 - RNA, 22 nt, Human
cacuggaauauggcguugaacc

SEQ ID NO: 843336 - RNA, 22 nt, Human
gugaauaaccuacuccaggccu

SEQ ID NO: 843337 - RNA, 22 nt, Human
ugaaugaauccuaacaaagaca

SEQ ID NO: 843338 - RNA, 22 nt, Human
uucuuuccccauggaguucgga

SEQ ID NO: 843339 - RNA, 22 nt, Human
ugggcaaguaucggacucugag

SEQ ID NO: 843340 - RNA, 22 nt, Human
cagaggcaggauaagaacugcg

SEQ ID NO: 843341 - RNA, 23 nt, Human
aagcugccagucugaagccuggg

SEQ ID NO: 843342 - RNA, 22 nt, Human
agaagugccauacuguggucca

SEQ ID NO: 843343 - RNA, 22 nt, Human
ucaggcugaggucaucugcauc

SEQ ID NO: 843344 - RNA, 22 nt, Human
gggcuggagccagcuguggcug

SEQ ID NO: 843345 - RNA, 22 nt, Human
uggcauuucuguuagacucuca

SEQ ID NO: 843346 - RNA, 22 nt, Human
gaaggccuagggaugcucugcg

SEQ ID NO: 843347 - RNA, 22 nt, Human
uuauugccugauugaggucauu

SEQ ID NO: 843348 - RNA, 22 nt, Human
ucaggagaaaauaucaggaagu

SEQ ID NO: 843349 - RNA, 22 nt, Human
agaauccugaugaaaaggagag

SEQ ID NO: 843350 - RNA, 20 nt, Human
gggugggagagucugagggu

SEQ ID NO: 843351 - RNA, 20 nt, Human
ccagguggugccuggagagg

SEQ ID NO: 843352 - RNA, 22 nt, Human
gcaaaauuaaacuuagcaucau

SEQ ID NO: 843353 - RNA, 22 nt, Human
aaaaacuguaauuacuuuugca

SEQ ID NO: 843354 - RNA, 22 nt, Human
uagaauaugauuaauuuucuua

SEQ ID NO: 843355 - RNA, 22 nt, Human
ucaugcuuaaaagacacuugag

SEQ ID NO: 843356 - RNA, 22 nt, Human
cuguucucuggcgguggcuguu

SEQ ID NO: 843357 - RNA, 22 nt, Human
auguuuccgugagcauccuuga

SEQ ID NO: 843358 - RNA, 23 nt, Human
cccuggagcuagucugagcagag

SEQ ID NO: 843359 - RNA, 22 nt, Human
agcuuguuagaaauguagacuc

SEQ ID NO: 843360 - RNA, 22 nt, Human
aguuacuugagacguuuaugaa

SEQ ID NO: 843361 - RNA, 22 nt, Human
cagguggggcagcugugggagc

SEQ ID NO: 843362 - RNA, 22 nt, Human
gugccugcagcaauccauggca

SEQ ID NO: 843363 - RNA, 22 nt, Human
gcagggacgccagggacagcaa

SEQ ID NO: 843364 - RNA, 22 nt, Human
aggccuguuggcgugggcucua

SEQ ID NO: 843365 - RNA, 22 nt, Human
cagcugcccaagccccagaugu

SEQ ID NO: 843366 - RNA, 22 nt, Human
ccccuuccgucucuugaguguc

SEQ ID NO: 843367 - RNA, 22 nt, Human
gagcucccuggagguucagaua

SEQ ID NO: 843368 - RNA, 22 nt, Human
uuaugcuaguauaguccuuaga

SEQ ID NO: 843369 - RNA, 20 nt, Human
agcaggaaugaugcuuucau

SEQ ID NO: 843370 - RNA, 22 nt, Human
gggacaggccccucgcuagcuu

SEQ ID NO: 843371 - RNA, 22 nt, Human
ugcugccauggucgcugguguc

SEQ ID NO: 843372 - RNA, 22 nt, Human
ggugucccaggccagcugugug

SEQ ID NO: 843373 - RNA, 22 nt, Human
uucauacuaaaguguaagaugu

SEQ ID NO: 843374 - RNA, 22 nt, Human
ucaguuuugaaaacauugaaug

SEQ ID NO: 843375 - RNA, 22 nt, Human
ugcauugcauuugucaugaaga

SEQ ID NO: 843376 - RNA, 22 nt, Human
ccugccagucacuaugucaccu

SEQ ID NO: 843377 - RNA, 22 nt, Human
ucucacugggucacagcagagg

SEQ ID NO: 843378 - RNA, 22 nt, Human
auuccaaacagugcugcagacu

SEQ ID NO: 843379 - RNA, 22 nt, Human
acauuuagaguucuuuacucca

SEQ ID NO: 843380 - RNA, 22 nt, Human
ucugguuagccaauaaugccaa

SEQ ID NO: 843381 - RNA, 22 nt, Human
cccagcucucgcacuuacuagc

SEQ ID NO: 843382 - RNA, 22 nt, Human
ggcuucugaaaucucugugcgu

SEQ ID NO: 843383 - RNA, 22 nt, Human
guuuuccugaaacugauggugu

SEQ ID NO: 843384 - RNA, 22 nt, Human
acuccagggcuccaucccuugu

SEQ ID NO: 843385 - RNA, 22 nt, Human
cagcuggaugggagaccauguu

SEQ ID NO: 843386 - RNA, 22 nt, Human
aaucagaaauugagggucuggu

SEQ ID NO: 843387 - RNA, 18 nt, Human
uucagcagcagacacacu

SEQ ID NO: 843388 - RNA, 22 nt, Human
ucacaugaguauuauuuuccaa

SEQ ID NO: 843389 - RNA, 18 nt, Human
uggagcaggaagccuggc

SEQ ID NO: 843390 - RNA, 22 nt, Human
cucacagguaccagcacccucc

SEQ ID NO: 843391 - RNA, 22 nt, Human
agcagccauuuaaaaugaauug

SEQ ID NO: 843392 - RNA, 22 nt, Human
aggcucaggcaggaauggcgga

SEQ ID NO: 843393 - RNA, 20 nt, Human
uauuccaaggguagagaaaa

SEQ ID NO: 843394 - RNA, 18 nt, Human
aggcuucccaggcaggcc

SEQ ID NO: 843395 - RNA, 22 nt, Human
agguaacacuacuuaguauacu

SEQ ID NO: 843396 - RNA, 22 nt, Human
aaucagaaccuugggucauaac

SEQ ID NO: 843397 - RNA, 22 nt, Human
ugcugugcuggcggcagaggcc

SEQ ID NO: 843398 - RNA, 22 nt, Human
gucccacaccuugaggggucuu

SEQ ID NO: 843399 - RNA, 22 nt, Human
uccuucaguucaauuaguccgu

SEQ ID NO: 843400 - RNA, 22 nt, Human
cuuaaagaugucaaggcuguuu

SEQ ID NO: 843401 - RNA, 22 nt, Human
ccuuucucuuggauaccgauug

SEQ ID NO: 843402 - RNA, 23 nt, Human
gccuggccaccccagggcugcuu

SEQ ID NO: 843403 - RNA, 22 nt, Human
aaggcagccaugugcuuugggu

SEQ ID NO: 843404 - RNA, 22 nt, Human
cccagcccccgagugucuggaa

SEQ ID NO: 843405 - RNA, 22 nt, Human
ggguguguuccuaaggaaacca

SEQ ID NO: 843406 - RNA, 21 nt, Human
caggaaaagcggaagucuagc

SEQ ID NO: 843407 - RNA, 22 nt, Human
ugcuuuaagagauuguuaguac

SEQ ID NO: 843408 - RNA, 22 nt, Human
ugcagaagaaaacagcugugug

SEQ ID NO: 843409 - RNA, 22 nt, Human
ugcaggagcugugcggugaggg

SEQ ID NO: 843410 - RNA, 22 nt, Human
uuuaggcacagaguugagggac

SEQ ID NO: 843411 - RNA, 19 nt, Human
gcacugaagaguuggucac

SEQ ID NO: 843412 - RNA, 22 nt, Human
uggcagagaauaaaucuugacu

SEQ ID NO: 843413 - RNA, 22 nt, Human
agggugguucuuuuaguggaag

SEQ ID NO: 843414 - RNA, 22 nt, Human
agaaauguuuauggcugccuau

SEQ ID NO: 843415 - RNA, 22 nt, Human
uugaaauacugcauuguucagu

SEQ ID NO: 843416 - RNA, 22 nt, Human
cucagggggaaucaggucacag

SEQ ID NO: 843417 - RNA, 21 nt, Human
auaaaguuuuacaggaaugca

SEQ ID NO: 843418 - RNA, 22 nt, Human
ccaggagaugauguuggggauu

SEQ ID NO: 843419 - RNA, 22 nt, Human
accagcuguguccuggcugcag

SEQ ID NO: 843420 - RNA, 22 nt, Human
aggcaccuugcgguccagugaa

SEQ ID NO: 843421 - RNA, 20 nt, Human
uacauucaaaacaaacucug

SEQ ID NO: 843422 - RNA, 22 nt, Human
aggcugaggcagguggaucacu

SEQ ID NO: 843423 - RNA, 22 nt, Human
uuucuucugagaucagggagaa

SEQ ID NO: 843424 - RNA, 22 nt, Human
cugcuguggccagccaggucaa

SEQ ID NO: 843425 - RNA, 22 nt, Human
uggcucagccuggcccuuucau

SEQ ID NO: 843426 - RNA, 19 nt, Human
acaggcagaauugggugug

SEQ ID NO: 843427 - RNA, 20 nt, Human
uucuggaggcuacaagucug

SEQ ID NO: 843428 - RNA, 22 nt, Human
cucccucugucuuguccagaaa

SEQ ID NO: 843429 - RNA, 22 nt, Human
ggcaucuguccaucucuccagc

SEQ ID NO: 843430 - RNA, 22 nt, Human
ucugucacccagagugcagugg

SEQ ID NO: 843431 - RNA, 22 nt, Human
aaauuuucagagcacuagagaa

SEQ ID NO: 843432 - RNA, 22 nt, Human
uucauuaauucauucagugacu

SEQ ID NO: 843433 - RNA, 22 nt, Human
aggcggcuccgggagugugggc

SEQ ID NO: 843434 - RNA, 22 nt, Human
ggaggcccagagaggugaagug

SEQ ID NO: 843435 - RNA, 22 nt, Human
uccugagaugagacagugcugc

SEQ ID NO: 843436 - RNA, 22 nt, Human
uucaacccaaguucuccauuuu

SEQ ID NO: 843437 - RNA, 22 nt, Human
acucucucacagcuuggcugau

SEQ ID NO: 843438 - RNA, 22 nt, Human
aggcacugguccauuuucugca

SEQ ID NO: 843439 - RNA, 22 nt, Human
uaauuucagugggcucugggcu

SEQ ID NO: 843440 - RNA, 19 nt, Human
ggcuggcaagugacagugu

SEQ ID NO: 843441 - RNA, 22 nt, Human
ucugcugcacaaauucaucucu

SEQ ID NO: 843442 - RNA, 20 nt, Human
gcaaaauaggcucuguuggu

SEQ ID NO: 843443 - RNA, 22 nt, Human
auaacagaugugaagugcuaau

SEQ ID NO: 843444 - RNA, 22 nt, Human
ucugcugucacucauuugcuuc

SEQ ID NO: 843445 - RNA, 22 nt, Human
gagagcuggguucaaguagcug

SEQ ID NO: 843446 - RNA, 22 nt, Human
gaaaguuuauagguuauauaau

SEQ ID NO: 843447 - RNA, 22 nt, Human
cucuaacaccacagugugguuu

SEQ ID NO: 843448 - RNA, 22 nt, Human
ugucccuggaacuauggcucca

SEQ ID NO: 843449 - RNA, 22 nt, Human
auguguaugcaugcacuaagau

SEQ ID NO: 843450 - RNA, 22 nt, Human
cugagaggugacagcgugcugg

SEQ ID NO: 843451 - RNA, 22 nt, Human
ugaagccaucccucagauggcc

SEQ ID NO: 843452 - RNA, 22 nt, Human
caacugugaauuuuaugauacc

SEQ ID NO: 843453 - RNA, 23 nt, Human
aagcugccuucgcaguuggucug

SEQ ID NO: 843454 - RNA, 22 nt, Human
ugcuucaaguugaaauauucuu

SEQ ID NO: 843455 - RNA, 22 nt, Human
ccucugagaccagcucugcacc

SEQ ID NO: 843456 - RNA, 22 nt, Human
cugccuggaccggcagcccucc

SEQ ID NO: 843457 - RNA, 21 nt, Human
uguccuuaaugcaauguccuu

SEQ ID NO: 843458 - RNA, 22 nt, Human
aaugcaaagcaagcagagauuu

SEQ ID NO: 843459 - RNA, 22 nt, Human
ucaaagucacaacucucuaauu

SEQ ID NO: 843460 - RNA, 22 nt, Human
uagugaaacaguuaucaaucug

SEQ ID NO: 843461 - RNA, 22 nt, Human
guuuccaaccccaccaaagugc

SEQ ID NO: 843462 - RNA, 22 nt, Human
agggaggauaguagucaguuua

SEQ ID NO: 843463 - RNA, 22 nt, Human
gcucaggaaauaguuuaguguu

SEQ ID NO: 843464 - RNA, 21 nt, Human
aucagcaaaugccugucuccc

SEQ ID NO: 843465 - RNA, 22 nt, Human
guuuucugauuagcaaaucuga

SEQ ID NO: 843466 - RNA, 18 nt, Human
gucuggaggucaggagcu

SEQ ID NO: 843467 - RNA, 22 nt, Human
ucagggcaaugucccucagaag

SEQ ID NO: 843468 - RNA, 22 nt, Human
aaauguguuuagaugguuuauu

SEQ ID NO: 843469 - RNA, 22 nt, Human
agagguagagguugcagugagc

SEQ ID NO: 843470 - RNA, 22 nt, Human
gccugcaguucugugcuaggca

SEQ ID NO: 843471 - RNA, 19 nt, Human
uuacaucugcaacacuggu

SEQ ID NO: 843472 - RNA, 22 nt, Human
augaugguuguccuaggugcau

SEQ ID NO: 843473 - RNA, 22 nt, Human
aggagaguaccauugggccgca

SEQ ID NO: 843474 - RNA, 22 nt, Human
accaggaggccuugguucugag

SEQ ID NO: 843475 - RNA, 22 nt, Human
auucagcauaaucaguagcuug

SEQ ID NO: 843476 - RNA, 22 nt, Human
aagagcuggauggaaucuggga

SEQ ID NO: 843477 - RNA, 22 nt, Human
aucugcuugaaugagcaacagg

SEQ ID NO: 843478 - RNA, 17 nt, Human
gcuuccucaugcaguuc

SEQ ID NO: 843479 - RNA, 22 nt, Human
gagcagcucgagaaggaagcag

SEQ ID NO: 843480 - RNA, 22 nt, Human
gagcaacaguuuaugguuuuuc

SEQ ID NO: 843481 - RNA, 22 nt, Human
auuucccagcuuugaucaguuu

SEQ ID NO: 843482 - RNA, 22 nt, Human
cagcagcugggaaggaggcuga

SEQ ID NO: 843483 - RNA, 22 nt, Human
aagaacaguugggaggugagcc

SEQ ID NO: 843484 - RNA, 23 nt, Human
uccucccaaauuucagccucauu

SEQ ID NO: 843485 - RNA, 19 nt, Human
agcagccaucgaccaugga

SEQ ID NO: 843486 - RNA, 22 nt, Human
ccugucucccuggcauggcuca

SEQ ID NO: 843487 - RNA, 22 nt, Human
cagcagcaaaucuagaagagga

SEQ ID NO: 843488 - RNA, 21 nt, Human
acagaacuguauagugauaaa

SEQ ID NO: 843489 - RNA, 22 nt, Human
aaggcacuagcaagcugccugg

SEQ ID NO: 843490 - RNA, 22 nt, Human
ucccagaagugaaauuucuaga

SEQ ID NO: 843491 - RNA, 22 nt, Human
gagccaggguuugaaacuagac

SEQ ID NO: 843492 - RNA, 22 nt, Human
cccaaggacacgggcagggaca

SEQ ID NO: 843493 - RNA, 19 nt, Human
cucuggccucuggaugcug

SEQ ID NO: 843494 - RNA, 22 nt, Human
ccugggagguggagguugcagu

SEQ ID NO: 843495 - RNA, 22 nt, Human
agagggcccauguugggcugcu

SEQ ID NO: 843496 - RNA, 21 nt, Human
uccagaaaagaggucauuagc

SEQ ID NO: 843497 - RNA, 22 nt, Human
aaaaaugcugugguagcugugu

SEQ ID NO: 843498 - RNA, 22 nt, Human
agcaggcuuguuaugucugaga

SEQ ID NO: 843499 - RNA, 22 nt, Human
cccacaggcuagggguagggca

SEQ ID NO: 843500 - RNA, 22 nt, Human
ggcuucucucccccagcuccac

SEQ ID NO: 843501 - RNA, 22 nt, Human
agauacauagcugugagcacac

SEQ ID NO: 843502 - RNA, 22 nt, Human
gauggcagcagcagccagggau

SEQ ID NO: 843503 - RNA, 22 nt, Human
ccucucaucauuaucgcuuugu

SEQ ID NO: 843504 - RNA, 22 nt, Human
uaguccuugguaaaauucuaug

SEQ ID NO: 843505 - RNA, 22 nt, Human
aagaggaggacgguucccagaa

SEQ ID NO: 843506 - RNA, 22 nt, Human
gaggggcuggcuguggucccau

SEQ ID NO: 843507 - RNA, 22 nt, Human
auaguaacuggcauguuuauga

SEQ ID NO: 843508 - RNA, 22 nt, Human
ugaugguuuuauuaauaggacc

SEQ ID NO: 843509 - RNA, 22 nt, Human
cauuugaaauucuuagaacaaa

SEQ ID NO: 843510 - RNA, 22 nt, Human
caggggcuguuugccucaggcc

SEQ ID NO: 843511 - RNA, 22 nt, Human
gcagggccagguacaagaagca

SEQ ID NO: 843512 - RNA, 22 nt, Human
cugcccugagucaugccagaug

SEQ ID NO: 843513 - RNA, 22 nt, Human
ucuucucccaucuccaggcagg

SEQ ID NO: 843514 - RNA, 22 nt, Human
gaguuguucaacgugugugaaa

SEQ ID NO: 843515 - RNA, 22 nt, Human
ggccugcucugcagccucuaca

SEQ ID NO: 843516 - RNA, 22 nt, Human
gguggaaggccuggaaggaggc

SEQ ID NO: 843517 - RNA, 22 nt, Human
caugcacuuaccugaaauucaa

SEQ ID NO: 843518 - RNA, 22 nt, Human
gccugggaacucugaucuccug

SEQ ID NO: 843519 - RNA, 22 nt, Human
gaaucauuuauuuuugacagca

SEQ ID NO: 843520 - RNA, 22 nt, Human
cccugccuuguuggagccuaug

SEQ ID NO: 843521 - RNA, 22 nt, Human
gugaaacacccuccaaugcaca

SEQ ID NO: 843522 - RNA, 22 nt, Human
aagccucaccuuuuagaagcua

SEQ ID NO: 843523 - RNA, 22 nt, Human
uugcauugaaugcacauuuuua

SEQ ID NO: 843524 - RNA, 22 nt, Human
cuggcuuucuauuuggugcuau

SEQ ID NO: 843525 - RNA, 22 nt, Human
gcucagaggagcaucauaagga

SEQ ID NO: 843526 - RNA, 22 nt, Human
ggagguggcagagggacauucu

SEQ ID NO: 843527 - RNA, 17 nt, Human
agcagaagucagaggga

SEQ ID NO: 843528 - RNA, 22 nt, Human
uaacacugauuuguucucaggg

SEQ ID NO: 843529 - RNA, 22 nt, Human
gggaagggagggaccucagucu

SEQ ID NO: 843530 - RNA, 22 nt, Human
ucaugacaacuauauuauucca

SEQ ID NO: 843531 - RNA, 22 nt, Human
agaugauggccauguccucucc

SEQ ID NO: 843532 - RNA, 22 nt, Human
gcucuaauugaaaaauacugca

SEQ ID NO: 843533 - RNA, 22 nt, Human
aggguagggcccggagacagac

SEQ ID NO: 843534 - RNA, 22 nt, Human
ggcucagguuaccagucccucc

SEQ ID NO: 843535 - RNA, 22 nt, Human
uuucacaaucaaauggugaaau

SEQ ID NO: 843536 - RNA, 22 nt, Human
ccuggcacgaagggcugagguu

SEQ ID NO: 843537 - RNA, 23 nt, Human
agucaguguaaguuuggaaugca

SEQ ID NO: 843538 - RNA, 22 nt, Human
gggccucucccuucucacgcau

SEQ ID NO: 843539 - RNA, 22 nt, Human
cugagggcaugaacauuccaua

SEQ ID NO: 843540 - RNA, 22 nt, Human
ggagugaguacuggaguagcug

SEQ ID NO: 843541 - RNA, 22 nt, Human
cugaaugucgaucagcuugggu

SEQ ID NO: 843542 - RNA, 22 nt, Human
gagcuuaggccagggacaggga

SEQ ID NO: 843543 - RNA, 21 nt, Human
gcaggaugcaucuuggugucu

SEQ ID NO: 843544 - RNA, 22 nt, Human
gaguuauuucagaaggaaagau

SEQ ID NO: 843545 - RNA, 22 nt, Human
ccagggugugagaaggaaguag

SEQ ID NO: 843546 - RNA, 22 nt, Human
acagaacugggaaaugcacaua

SEQ ID NO: 843547 - RNA, 22 nt, Human
gggccagagcuuggcagcuggg

SEQ ID NO: 843548 - RNA, 22 nt, Human
ccagggugggaggcugaaggcg

SEQ ID NO: 843549 - RNA, 22 nt, Human
aaauauaguaaaugcauaguuc

SEQ ID NO: 843550 - RNA, 19 nt, Human
cccaaggcccugggcaggc

SEQ ID NO: 843551 - RNA, 22 nt, Human
aggcaguggcugagaccagggg

SEQ ID NO: 843552 - RNA, 22 nt, Human
cccaggaaccuaccagcucgag

SEQ ID NO: 843553 - RNA, 22 nt, Human
acagguuuuuguggauauaugu

SEQ ID NO: 843554 - RNA, 22 nt, Human
cacugaagccacuggaagagga

SEQ ID NO: 843555 - RNA, 22 nt, Human
caggugcugcguggcggagcug

SEQ ID NO: 843556 - RNA, 18 nt, Human
ggcaucugcacagcagcc

SEQ ID NO: 843557 - RNA, 22 nt, Human
auauuguugacuauaagaguaa

SEQ ID NO: 843558 - RNA, 22 nt, Human
ugaaagcagcaccaauaccauu

SEQ ID NO: 843559 - RNA, 22 nt, Human
cauuucaauacuaucugagaau

SEQ ID NO: 843560 - RNA, 19 nt, Human
ugucucagugucccuuccu

SEQ ID NO: 843561 - RNA, 22 nt, Human
gggugggguucaggaaucuuca

SEQ ID NO: 843562 - RNA, 19 nt, Human
auauauguauacaaugugg

SEQ ID NO: 843563 - RNA, 22 nt, Human
cugcagcuuuggaaaccuguuu

SEQ ID NO: 843564 - RNA, 17 nt, Human
gggcagggacuccuggg

SEQ ID NO: 843565 - RNA, 22 nt, Human
guacagaaugcuugguaaggca

SEQ ID NO: 843566 - RNA, 22 nt, Human
gccugggagugcacagugaggu

SEQ ID NO: 843567 - RNA, 22 nt, Human
gggcugggauugcuugcuguga

SEQ ID NO: 843568 - RNA, 22 nt, Human
acauucacuauguccaaacucu

SEQ ID NO: 843569 - RNA, 22 nt, Human
uugaauaaaugagcagugaauu

SEQ ID NO: 843570 - RNA, 22 nt, Human
gcucagagcaucccagugaaug

SEQ ID NO: 843571 - RNA, 22 nt, Human
auuaggcaauucugggcaucuc

SEQ ID NO: 843572 - RNA, 22 nt, Human
ugcugccuuugggaccuggccu

SEQ ID NO: 843573 - RNA, 22 nt, Human
uggcagcagccauggaaggccc

SEQ ID NO: 843574 - RNA, 22 nt, Human
caggaacacaaguucagggaug

SEQ ID NO: 843575 - RNA, 22 nt, Human
ugcagagggacagccacagcuc

SEQ ID NO: 843576 - RNA, 22 nt, Human
cauagaaacuugcagcaagcac

SEQ ID NO: 843577 - RNA, 16 nt, Human
ccuggauccccugugg

SEQ ID NO: 843578 - RNA, 22 nt, Human
acuucacacagcaaauuuaucu

SEQ ID NO: 843579 - RNA, 22 nt, Human
agggacacugaugagaaauucu

SEQ ID NO: 843580 - RNA, 22 nt, Human
aagagcuggaguuugcagcccu

SEQ ID NO: 843581 - RNA, 22 nt, Human
ucugggagagcugcugucagag

SEQ ID NO: 843582 - RNA, 22 nt, Human
cuacauuuguucuauagcuuuu

SEQ ID NO: 843583 - RNA, 22 nt, Human
aguauuuagcauagugguuagu

SEQ ID NO: 843584 - RNA, 22 nt, Human
aaaguuuccugcuaagugcuau

SEQ ID NO: 843585 - RNA, 22 nt, Human
gaggcagagaccuucaggaccu

SEQ ID NO: 843586 - RNA, 22 nt, Human
aggcuucccaagcagcugcaaa

SEQ ID NO: 843587 - RNA, 22 nt, Human
gcugggagcaaguacucaucuu

SEQ ID NO: 843588 - RNA, 22 nt, Human
ucucuggagggcuccaggcggg

SEQ ID NO: 843589 - RNA, 22 nt, Human
agggagccagaguugggagcuc

SEQ ID NO: 843590 - RNA, 21 nt, Human
uucaaagacuugaugcugacc

SEQ ID NO: 843591 - RNA, 22 nt, Human
acugcagccuugaacucugggc

SEQ ID NO: 843592 - RNA, 20 nt, Human
agggcagcuugaggagccgg

SEQ ID NO: 843593 - RNA, 22 nt, Human
agccccaguaagggagggccug

SEQ ID NO: 843594 - RNA, 20 nt, Human
guggccucucacauucugag

SEQ ID NO: 843595 - RNA, 22 nt, Human
aaaauacuguggaguguugaaa

SEQ ID NO: 843596 - RNA, 22 nt, Human
uuuccuuccaaaugcccgggag

SEQ ID NO: 843597 - RNA, 22 nt, Human
guaacagaggguuugcagauau

SEQ ID NO: 843598 - RNA, 22 nt, Human
cagcccuggaacagcugacuca

SEQ ID NO: 843599 - RNA, 22 nt, Human
cauuuguagcuauuuacuguau

SEQ ID NO: 843600 - RNA, 22 nt, Human
agcugcccuucucuugcccuug

SEQ ID NO: 843601 - RNA, 20 nt, Human
cucugcugcccgccggcugc

SEQ ID NO: 843602 - RNA, 22 nt, Human
gaaagccauagcccagcuuuac

SEQ ID NO: 843603 - RNA, 22 nt, Human
ggcaguggaggacccugugucu

SEQ ID NO: 843604 - RNA, 22 nt, Human
ccuuucucuaucgacccaucgc

SEQ ID NO: 843605 - RNA, 22 nt, Human
augaauaaacaggugccucuuc

SEQ ID NO: 843606 - RNA, 22 nt, Human
gccagccccuuagggcucuccc

SEQ ID NO: 843607 - RNA, 22 nt, Human
ccagggugggguccaggaacca

SEQ ID NO: 843608 - RNA, 22 nt, Human
ugcugucugcaacaguacuaca

SEQ ID NO: 843609 - RNA, 22 nt, Human
caggagugaguuggggucuaca

SEQ ID NO: 843610 - RNA, 22 nt, Human
auccuugaacuuagacacuagg

SEQ ID NO: 843611 - RNA, 22 nt, Human
agauaugacuagaagcucauuu

SEQ ID NO: 843612 - RNA, 22 nt, Human
ggcacugagaacaggcugacuu

SEQ ID NO: 843613 - RNA, 21 nt, Human
cagcuuugucugucuucgggg

SEQ ID NO: 843614 - RNA, 23 nt, Human
uccuuccuuugagaggcuccauc

SEQ ID NO: 843615 - RNA, 22 nt, Human
ucuuccaguguagacaucugcc

SEQ ID NO: 843616 - RNA, 22 nt, Human
cugggcuggagugcaauggcgc

SEQ ID NO: 843617 - RNA, 22 nt, Human
ggcagcuggccuccucgcccac

SEQ ID NO: 843618 - RNA, 23 nt, Human
gacagagugagaccuugucuuac

SEQ ID NO: 843619 - RNA, 22 nt, Human
cagacccucgggugaguuggcc

SEQ ID NO: 843620 - RNA, 22 nt, Human
cuggggcucucuggaaugcuug

SEQ ID NO: 843621 - RNA, 22 nt, Human
aggaccugacuggcuccugcuu

SEQ ID NO: 843622 - RNA, 22 nt, Human
uuugcaaagugacuauuauaug

SEQ ID NO: 843623 - RNA, 22 nt, Human
aagagcauauuaauaguggaga

SEQ ID NO: 843624 - RNA, 22 nt, Human
gugccugguuuggggaauguuc

SEQ ID NO: 843625 - RNA, 22 nt, Human
cuggagccacugggucuuguau

SEQ ID NO: 843626 - RNA, 19 nt, Human
uaucuguuuccugcuuguc

SEQ ID NO: 843627 - RNA, 22 nt, Human
uugugugguagcuucauugaac

SEQ ID NO: 843628 - RNA, 22 nt, Human
gaaaaugugccuuuggguauug

SEQ ID NO: 843629 - RNA, 22 nt, Human
auuaaauuggaucugcauaguu

SEQ ID NO: 843630 - RNA, 22 nt, Human
ccagcgcuucccaucagggagg

SEQ ID NO: 843631 - RNA, 22 nt, Human
caguccuugcucugggaugaug

SEQ ID NO: 843632 - RNA, 23 nt, Human
agcagccauagggaagcaauaca

SEQ ID NO: 843633 - RNA, 22 nt, Human
aaaguuucaauagaggaagugg

SEQ ID NO: 843634 - RNA, 22 nt, Human
gcugccagucuaaugggaaaca

SEQ ID NO: 843635 - RNA, 22 nt, Human
cugucaccuguucacugcagca

SEQ ID NO: 843636 - RNA, 22 nt, Human
auuaggcauuauggggauaagg

SEQ ID NO: 843637 - RNA, 22 nt, Human
ugucccagacauaaguggacau

SEQ ID NO: 843638 - RNA, 22 nt, Human
uuucuugaccacuauguugaua

SEQ ID NO: 843639 - RNA, 22 nt, Human
auuguucaaagugcuuugcaug

SEQ ID NO: 843640 - RNA, 22 nt, Human
uggccugcagaggcuguggggc

SEQ ID NO: 843641 - RNA, 22 nt, Human
ggcaugggguguauguggcacg

SEQ ID NO: 843642 - RNA, 22 nt, Human
aggauuuaccuccagcuaggcu

SEQ ID NO: 843643 - RNA, 22 nt, Human
ggcagcuuucucacccaugacc

SEQ ID NO: 843644 - RNA, 22 nt, Human
uugaccauaccuccaggcaguu

SEQ ID NO: 843645 - RNA, 22 nt, Human
gcagggcugggugggagacaga

SEQ ID NO: 843646 - RNA, 22 nt, Human
caaauaguuuuucauguauuau

SEQ ID NO: 843647 - RNA, 22 nt, Human
augcugugauuguagaaauauu

SEQ ID NO: 843648 - RNA, 22 nt, Human
guucuucaguaaaauuaaaugu

SEQ ID NO: 843649 - RNA, 22 nt, Human
agacuucucaguuuuauuagua

SEQ ID NO: 843650 - RNA, 22 nt, Human
gcagaagucagaccaucugaau

SEQ ID NO: 843651 - RNA, 22 nt, Human
ugguaaaguguacugaauauga

SEQ ID NO: 843652 - RNA, 22 nt, Human
ucuucaaaaaauauccaucagu

SEQ ID NO: 843653 - RNA, 22 nt, Human
uagucaaaccucagaauacccc

SEQ ID NO: 843654 - RNA, 22 nt, Human
cagugcagaacacauggaaaau

SEQ ID NO: 843655 - RNA, 22 nt, Human
uggagcucaaaggccuguggga

SEQ ID NO: 843656 - RNA, 22 nt, Human
uacaugaaguugucuaaacugg

SEQ ID NO: 843657 - RNA, 22 nt, Human
uugauacaggcucuauuucauc

SEQ ID NO: 843658 - RNA, 22 nt, Human
auaaggaaugauguaucaguuu

SEQ ID NO: 843659 - RNA, 22 nt, Human
cuccucccucuuugccacacau

SEQ ID NO: 843660 - RNA, 22 nt, Human
uuuauguaguuacggacuauca

SEQ ID NO: 843661 - RNA, 21 nt, Human
ggagucauuagucauuuccuu

SEQ ID NO: 843662 - RNA, 22 nt, Human
cugggcugcaguuccugguccu

SEQ ID NO: 843663 - RNA, 22 nt, Human
cuggcucacaggugagaugcau

SEQ ID NO: 843664 - RNA, 22 nt, Human
gcucccagacugaccagaggug

SEQ ID NO: 843665 - RNA, 22 nt, Human
caggggacaguaugguggauga

SEQ ID NO: 843666 - RNA, 22 nt, Human
gcucuggaagcaucugagagga

SEQ ID NO: 843667 - RNA, 22 nt, Human
ucuuuccuguaacugcuguuca

SEQ ID NO: 843668 - RNA, 22 nt, Human
cugccucucagccugaccgcca

SEQ ID NO: 843669 - RNA, 20 nt, Human
aaaaucucccagaaacuuau

SEQ ID NO: 843670 - RNA, 22 nt, Human
gugcagggagcccagaaggucc

SEQ ID NO: 843671 - RNA, 22 nt, Human
uuggcugaagguuaagugcugg

SEQ ID NO: 843672 - RNA, 22 nt, Human
gucucagauucagacaucuaca

SEQ ID NO: 843673 - RNA, 22 nt, Human
auaucagacagaaagcauugac

SEQ ID NO: 843674 - RNA, 19 nt, Human
aggcucugagcuccuggag

SEQ ID NO: 843675 - RNA, 22 nt, Human
caaaugauagagccgauuauca

SEQ ID NO: 843676 - RNA, 22 nt, Human
uaacuacauuucacugcaauua

SEQ ID NO: 843677 - RNA, 22 nt, Human
cacucaggcugugucaggagga

SEQ ID NO: 843678 - RNA, 22 nt, Human
uuucaguuguccuguuaauagc

SEQ ID NO: 843679 - RNA, 21 nt, Human
ugcugccauagaccugaggga

SEQ ID NO: 843680 - RNA, 22 nt, Human
ugcuuauugcuuucaagacugu

SEQ ID NO: 843681 - RNA, 22 nt, Human
agucaguguagaaagcccaggc

SEQ ID NO: 843682 - RNA, 22 nt, Human
cccaggaaacccgaaggcgacc

SEQ ID NO: 843683 - RNA, 22 nt, Human
uaauaaacugcuacgcuuaguu

SEQ ID NO: 843684 - RNA, 22 nt, Human
ugaggggaacugaugcccauug

SEQ ID NO: 843685 - RNA, 22 nt, Human
acagccaggaggaacucaguga

SEQ ID NO: 843686 - RNA, 22 nt, Human
cugcuguggguuaagacacugu

SEQ ID NO: 843687 - RNA, 22 nt, Human
caaagguauucucauuuuggaa

SEQ ID NO: 843688 - RNA, 23 nt, Human
acagggcauugcuggccucgagg

SEQ ID NO: 843689 - RNA, 22 nt, Human
ccuggcaggcuggggacagugc

SEQ ID NO: 843690 - RNA, 22 nt, Human
aaauugcauuuuaaagguagau

SEQ ID NO: 843691 - RNA, 21 nt, Human
auugaaagucaacaaucaguu

SEQ ID NO: 843692 - RNA, 21 nt, Human
agcuggcagauauggugucug

SEQ ID NO: 843693 - RNA, 22 nt, Human
uugaaguuguaguucagugaag

SEQ ID NO: 843694 - RNA, 22 nt, Human
uuauuuugguaaauguuugccu

SEQ ID NO: 843695 - RNA, 22 nt, Human
gcuggccuuugaggaagcugcg

SEQ ID NO: 843696 - RNA, 22 nt, Human
cugagcugggaguagagacucu

SEQ ID NO: 843697 - RNA, 22 nt, Human
uccaggagguugagacugcagu

SEQ ID NO: 843698 - RNA, 22 nt, Human
ccaggagucaauaaaggaagcu

SEQ ID NO: 843699 - RNA, 22 nt, Human
uggcagcuuccugcucauagga

SEQ ID NO: 843700 - RNA, 22 nt, Human
ugggaggaaugucacugagcca

SEQ ID NO: 843701 - RNA, 22 nt, Human
caguguacuuggaauguaacag

SEQ ID NO: 843702 - RNA, 22 nt, Human
cuaauacacccuauugcuuguu

SEQ ID NO: 843703 - RNA, 22 nt, Human
guucacauccuugugaggauuu

SEQ ID NO: 843704 - RNA, 22 nt, Human
ugcucucucaggccuggcccac

SEQ ID NO: 843705 - RNA, 22 nt, Human
cacagggcuucucauggggugc

SEQ ID NO: 843706 - RNA, 23 nt, Human
gccucuggagccccagugcucag

SEQ ID NO: 843707 - RNA, 22 nt, Human
gaagcagcuggugagauggagc

SEQ ID NO: 843708 - RNA, 22 nt, Human
agugcuuugguauagaacuauu

SEQ ID NO: 843709 - RNA, 22 nt, Human
ccuucugcucccuggccagggc

SEQ ID NO: 843710 - RNA, 22 nt, Human
caggguacagaguuuucuaaac

SEQ ID NO: 843711 - RNA, 21 nt, Human
gcuauacagaauggccagagg

SEQ ID NO: 843712 - RNA, 22 nt, Human
guggccagcaagugcugccucu

SEQ ID NO: 843713 - RNA, 22 nt, Human
guacauuuuacuuuguuugaau

SEQ ID NO: 843714 - RNA, 22 nt, Human
uugcauuugagaaaguucuccu

SEQ ID NO: 843715 - RNA, 22 nt, Human
uaugcacgucuauuuaugaaga

SEQ ID NO: 843716 - RNA, 22 nt, Human
aauguaugaagguuccaguuuc

SEQ ID NO: 843717 - RNA, 22 nt, Human
cuggcuugcagcucaucauaaa

SEQ ID NO: 843718 - RNA, 22 nt, Human
cccaggagaauauuuuuggguc

SEQ ID NO: 843719 - RNA, 22 nt, Human
agccacagcauguguguaugua

SEQ ID NO: 843720 - RNA, 22 nt, Human
uggacucagugcugccauuccc

SEQ ID NO: 843721 - RNA, 22 nt, Human
aguugcagacgcagagauguug

SEQ ID NO: 843722 - RNA, 22 nt, Human
uacauggguagguuaagucaua

SEQ ID NO: 843723 - RNA, 22 nt, Human
ugguccugccccgugcacagag

SEQ ID NO: 843724 - RNA, 22 nt, Human
uucugucacagugcugguauca

SEQ ID NO: 843725 - RNA, 22 nt, Human
aggcugggcaccguuuugaucc

SEQ ID NO: 843726 - RNA, 19 nt, Human
aggcagcacccaguccuug

SEQ ID NO: 843727 - RNA, 22 nt, Human
ugcagaggagcuggaaggcugg

SEQ ID NO: 843728 - RNA, 22 nt, Human
cggcagcuccgcgccguaggac

SEQ ID NO: 843729 - RNA, 23 nt, Human
uggcaaggaaugggauggagacu

SEQ ID NO: 843730 - RNA, 22 nt, Human
uuauucuuuaaacauauauguu

SEQ ID NO: 843731 - RNA, 21 nt, Human
ugcauaaagaaauacaaauac

SEQ ID NO: 843732 - RNA, 22 nt, Human
uaugugcaguuugcucuuaaca

SEQ ID NO: 843733 - RNA, 22 nt, Human
agaauuagucacaauuauagga

SEQ ID NO: 843734 - RNA, 22 nt, Human
aggcucugcagaccccagcugu

SEQ ID NO: 843735 - RNA, 22 nt, Human
uaagaacagugucugucucaca

SEQ ID NO: 843736 - RNA, 22 nt, Human
ggagugggaacaaugacauggu

SEQ ID NO: 843737 - RNA, 22 nt, Human
uguacaaugccagggaacacca

SEQ ID NO: 843738 - RNA, 18 nt, Human
gaggccugagaaccaggu

SEQ ID NO: 843739 - RNA, 19 nt, Human
gagcagcugcacccauuga

SEQ ID NO: 843740 - RNA, 22 nt, Human
auuucuguuugcuacuauaagu

SEQ ID NO: 843741 - RNA, 22 nt, Human
ugcaucuuacguuuugaaaggg

SEQ ID NO: 843742 - RNA, 22 nt, Human
auggggcuguucucugcccugc

SEQ ID NO: 843743 - RNA, 22 nt, Human
cuuucauucuuagauauuagug

SEQ ID NO: 843744 - RNA, 22 nt, Human
aaugguauuugucaagcauagu

SEQ ID NO: 843745 - RNA, 22 nt, Human
cuguucaugcugauucuguaug

SEQ ID NO: 843746 - RNA, 22 nt, Human
uuucaaugacacaaaagagaaa

SEQ ID NO: 843747 - RNA, 22 nt, Human
uguauuuugugaggaucacucu

SEQ ID NO: 843748 - RNA, 22 nt, Human
ggucccaguccucucccugcua

SEQ ID NO: 843749 - RNA, 22 nt, Human
ccagggagccuggugugucagc

SEQ ID NO: 843750 - RNA, 22 nt, Human
gagcugucuggggacucugggu

SEQ ID NO: 843751 - RNA, 22 nt, Human
uuucaaacuuuacucuugaauc

SEQ ID NO: 843752 - RNA, 22 nt, Human
ugguggccuugauggcaucugc

SEQ ID NO: 843753 - RNA, 22 nt, Human
ugucucugagaugacucccacc

SEQ ID NO: 843754 - RNA, 21 nt, Human
augugaaaccuuccacgcuga

SEQ ID NO: 843755 - RNA, 22 nt, Human
aaauaguuacuucugcugucuu

SEQ ID NO: 843756 - RNA, 22 nt, Human
gcaggguauaauacuuagguga

SEQ ID NO: 843757 - RNA, 20 nt, Human
uucuauacauaucacugaaa

SEQ ID NO: 843758 - RNA, 22 nt, Human
uccugccuuagagcaaggaaaa

SEQ ID NO: 843759 - RNA, 20 nt, Human
accccagccccucuaucuga

SEQ ID NO: 843760 - RNA, 22 nt, Human
uacauucagaagaauggacacg

SEQ ID NO: 843761 - RNA, 22 nt, Human
uauuuuaaagugaagggucuug

SEQ ID NO: 843762 - RNA, 19 nt, Human
cauuuuaagcauccccagu

SEQ ID NO: 843763 - RNA, 22 nt, Human
acaggugaccugcucauaugaa

SEQ ID NO: 843764 - RNA, 22 nt, Human
acuucuggugucauacugcauu

SEQ ID NO: 843765 - RNA, 22 nt, Human
uggccugaauuauggcagaucu

SEQ ID NO: 843766 - RNA, 22 nt, Human
uggggcuggcuauugucucccu

SEQ ID NO: 843767 - RNA, 18 nt, Human
ccuggcagccaugcgcgc

SEQ ID NO: 843768 - RNA, 22 nt, Human
cauuguuaauugguaucuuaca

SEQ ID NO: 843769 - RNA, 22 nt, Human
cccaagcagggugcagaggcau

SEQ ID NO: 843770 - RNA, 22 nt, Human
ugccugagugauguggcagcca

SEQ ID NO: 843771 - RNA, 22 nt, Human
agaauucuggaguugggaggaa

SEQ ID NO: 843772 - RNA, 22 nt, Human
cuugugcauuucauuccucagg

SEQ ID NO: 843773 - RNA, 22 nt, Human
cuuaggcaagcagagcccaucc

SEQ ID NO: 843774 - RNA, 22 nt, Human
ucauaaaacacaccagguaguu

SEQ ID NO: 843775 - RNA, 22 nt, Human
uucugucacuugcaaucaagag

SEQ ID NO: 843776 - RNA, 22 nt, Human
gcuccacuugcagcuaggcuug

SEQ ID NO: 843777 - RNA, 22 nt, Human
caggggaagaugccaagggaga

SEQ ID NO: 843778 - RNA, 22 nt, Human
uucaacuaauguuuauuuuaug

SEQ ID NO: 843779 - RNA, 22 nt, Human
aagcacuuagaagagugccugc

SEQ ID NO: 843780 - RNA, 22 nt, Human
aaacuguaagagaauaaacuac

SEQ ID NO: 843781 - RNA, 22 nt, Human
uacaguaucuucuggcaagcau

SEQ ID NO: 843782 - RNA, 22 nt, Human
uaaauguguaaaccuccauuac

SEQ ID NO: 843783 - RNA, 22 nt, Human
ucugcucugggccagcuauuaa

SEQ ID NO: 843784 - RNA, 22 nt, Human
gcucucuuuuuccagugguggu

SEQ ID NO: 843785 - RNA, 22 nt, Human
ggcauuuauuugucucauucuu

SEQ ID NO: 843786 - RNA, 22 nt, Human
aaaucucaauuugaauuguagc

SEQ ID NO: 843787 - RNA, 22 nt, Human
cagcaauaagguaagcuucucc

SEQ ID NO: 843788 - RNA, 22 nt, Human
uagccaggcgaggucagugucg

SEQ ID NO: 843789 - RNA, 22 nt, Human
auucuuauuuaaauagagucug

SEQ ID NO: 843790 - RNA, 22 nt, Human
gagagugaggccugggaaucua

SEQ ID NO: 843791 - RNA, 22 nt, Human
gguacaauggaccauaaaagcu

SEQ ID NO: 843792 - RNA, 22 nt, Human
ccaggcagcucugauuuauguc

SEQ ID NO: 843793 - RNA, 22 nt, Human
uuucaacauauaccauaaugcc

SEQ ID NO: 843794 - RNA, 22 nt, Human
ucucccacagucucccauggcu

SEQ ID NO: 843795 - RNA, 22 nt, Human
agccacagcgaaccucucuucc

SEQ ID NO: 843796 - RNA, 22 nt, Human
ugaaaaggguagaucccuaagu

SEQ ID NO: 843797 - RNA, 22 nt, Human
gaagccaagugcaaaugccuua

SEQ ID NO: 843798 - RNA, 22 nt, Human
aauacaguaauuuugaugaguu

SEQ ID NO: 843799 - RNA, 22 nt, Human
gcuggccuucugcagaguucug

SEQ ID NO: 843800 - RNA, 23 nt, Human
auguaucucauccaaggaagcuc

SEQ ID NO: 843801 - RNA, 22 nt, Human
ugcuccagugagcuggccaucc

SEQ ID NO: 843802 - RNA, 22 nt, Human
acagcagcuggguucccaccau

SEQ ID NO: 843803 - RNA, 22 nt, Human
auuucuguugcuuauaaauuac

SEQ ID NO: 843804 - RNA, 22 nt, Human
acuuaaaaagaaucuuuucacg

SEQ ID NO: 843805 - RNA, 22 nt, Human
ugucaccaugccagcuucugcc

SEQ ID NO: 843806 - RNA, 22 nt, Human
ugaaagguagcuggccucauag

SEQ ID NO: 843807 - RNA, 22 nt, Human
cucagaguucuccugggaggug

SEQ ID NO: 843808 - RNA, 22 nt, Human
ucagccaguuuguuuauuccgg

SEQ ID NO: 843809 - RNA, 22 nt, Human
uggcucuggggacaguaagucc

SEQ ID NO: 843810 - RNA, 22 nt, Human
accaaggaagagauucucaguu

SEQ ID NO: 843811 - RNA, 22 nt, Human
agccacaccuguccugccagcu

SEQ ID NO: 843812 - RNA, 22 nt, Human
gagcccuggcagucugggaugg

SEQ ID NO: 843813 - RNA, 22 nt, Human
uuaaacagagucugaaauguaa

SEQ ID NO: 843814 - RNA, 21 nt, Human
ucagaacaauuccaugccucc

SEQ ID NO: 843815 - RNA, 22 nt, Human
ggcuagaauaauugacuucauu

SEQ ID NO: 843816 - RNA, 22 nt, Human
ugccuggcaacuguggugggcu

SEQ ID NO: 843817 - RNA, 22 nt, Human
gcugagugagguccagagcuug

SEQ ID NO: 843818 - RNA, 22 nt, Human
aggcagauuuaggagaaaagaa

SEQ ID NO: 843819 - RNA, 17 nt, Human
ggcugcugugcuggugc

SEQ ID NO: 843820 - RNA, 22 nt, Human
ucagcugagcuccagcucauag

SEQ ID NO: 843821 - RNA, 17 nt, Human
aggcauggucuggggug

SEQ ID NO: 843822 - RNA, 22 nt, Human
agcccagggacagggcggaugu

SEQ ID NO: 843823 - RNA, 22 nt, Human
uuguggcucgugagauguuagg

SEQ ID NO: 843824 - RNA, 22 nt, Human
guggcugcuguccucucugguu

SEQ ID NO: 843825 - RNA, 21 nt, Human
agccagucuguuuucuagugc

SEQ ID NO: 843826 - RNA, 20 nt, Human
aggacagcagcugccacuug

SEQ ID NO: 843827 - RNA, 22 nt, Human
agucccagaugacccagcuacu

SEQ ID NO: 843828 - RNA, 22 nt, Human
uugcucaggcuggugugcagug

SEQ ID NO: 843829 - RNA, 22 nt, Human
ucagcugcucaaauuuauguca

SEQ ID NO: 843830 - RNA, 22 nt, Human
agcaauauuuaaagguuugcaa

SEQ ID NO: 843831 - RNA, 22 nt, Human
auccaaagauggaaagaacuuu

SEQ ID NO: 843832 - RNA, 22 nt, Human
gaguguucccacaccccaguug

SEQ ID NO: 843833 - RNA, 20 nt, Human
ucagccagcuaacaugggga

SEQ ID NO: 843834 - RNA, 21 nt, Human
agucccauccgguaagcaagc

SEQ ID NO: 843835 - RNA, 22 nt, Human
ggucaugcugugaaucagugcu

SEQ ID NO: 843836 - RNA, 22 nt, Human
aaauguguuugauaggaauauu

SEQ ID NO: 843837 - RNA, 22 nt, Human
aggaagcucaaagccaugaugu

SEQ ID NO: 843838 - RNA, 22 nt, Human
aggccuagaggaauggccaggg

SEQ ID NO: 843839 - RNA, 22 nt, Human
acccaggagacggaggugcagu

SEQ ID NO: 843840 - RNA, 22 nt, Human
ugugauauuugaguauugucaa

SEQ ID NO: 843841 - RNA, 22 nt, Human
ugaggcagcuuuuucugugugu

SEQ ID NO: 843842 - RNA, 22 nt, Human
cagaaauggagcccaggaaucu

SEQ ID NO: 843843 - RNA, 22 nt, Human
ugcuugggaauguggagucaga

SEQ ID NO: 843844 - RNA, 22 nt, Human
ugcuucucccaaccagggccug

SEQ ID NO: 843845 - RNA, 22 nt, Human
guccugucccccaaggcugugg

SEQ ID NO: 843846 - RNA, 22 nt, Human
ucucagagcaucauuuucuuag

SEQ ID NO: 843847 - RNA, 22 nt, Human
aauguguacaugacagauagaa

SEQ ID NO: 843848 - RNA, 21 nt, Human
ucagaguguguuacagcaagc

SEQ ID NO: 843849 - RNA, 22 nt, Human
caguacuuaguucucaugguuu

SEQ ID NO: 843850 - RNA, 22 nt, Human
ccucgaccuccccaggcucagg

SEQ ID NO: 843851 - RNA, 22 nt, Human
cuggcucacuagcccugcccug

SEQ ID NO: 843852 - RNA, 22 nt, Human
acuguucacagauuagucgaug

SEQ ID NO: 843853 - RNA, 22 nt, Human
uggcucagagccuugagagcug

SEQ ID NO: 843854 - RNA, 22 nt, Human
ucccagagucuucuccuguaau

SEQ ID NO: 843855 - RNA, 22 nt, Human
uagcagcugugaguaaaagcca

SEQ ID NO: 843856 - RNA, 21 nt, Human
agcugccacccuagcuucuga

SEQ ID NO: 843857 - RNA, 22 nt, Human
agccccaguccgcugcgggcgg

SEQ ID NO: 843858 - RNA, 22 nt, Human
ggcugccuccugcugggcugga

SEQ ID NO: 843859 - RNA, 22 nt, Human
aggacccagaggcagaggacgu

SEQ ID NO: 843860 - RNA, 22 nt, Human
cuggccaggcuugggacagaca

SEQ ID NO: 843861 - RNA, 22 nt, Human
gugaggugguacaauauuaacu

SEQ ID NO: 843862 - RNA, 22 nt, Human
cugcuuuguguggucccuccag

SEQ ID NO: 843863 - RNA, 22 nt, Human
uuccuuaggggacagggggaua

SEQ ID NO: 843864 - RNA, 22 nt, Human
cucaggaggugguagaggcccu

SEQ ID NO: 843865 - RNA, 22 nt, Human
gagguagccacagauagagacu

SEQ ID NO: 843866 - RNA, 22 nt, Human
ccugccugucaucgccugcgcc

SEQ ID NO: 843867 - RNA, 22 nt, Human
ccugaagagcacucuagaguug

SEQ ID NO: 843868 - RNA, 22 nt, Human
acaauacuuaccaauguuuuug

SEQ ID NO: 843869 - RNA, 19 nt, Human
ucucuacacuacauuucua

SEQ ID NO: 843870 - RNA, 18 nt, Human
aagaggaggagcagguug

SEQ ID NO: 843871 - RNA, 22 nt, Human
aaggcacugaacuuaaauucug

SEQ ID NO: 843872 - RNA, 22 nt, Human
gcuguguuuuauguuagguuaa

SEQ ID NO: 843873 - RNA, 20 nt, Human
aggcaguuagaaggagauga

SEQ ID NO: 843874 - RNA, 22 nt, Human
uuugcauuucucguaaggaaac

SEQ ID NO: 843875 - RNA, 22 nt, Human
ugcagaagcagagccgguggcc

SEQ ID NO: 843876 - RNA, 22 nt, Human
gaaacauauuaauccagugaaa

SEQ ID NO: 843877 - RNA, 22 nt, Human
cugaggccuaagacaugaauga

SEQ ID NO: 843878 - RNA, 22 nt, Human
gugacaguggucacuuguaguu

SEQ ID NO: 843879 - RNA, 22 nt, Human
agauacaucauuuauaccuuca

SEQ ID NO: 843880 - RNA, 22 nt, Human
auaguuugaaggcuguucuacu

SEQ ID NO: 843881 - RNA, 22 nt, Human
ggaaagaggauaguggguaggu

SEQ ID NO: 843882 - RNA, 22 nt, Human
uuaauuacaaaacacauagguu

SEQ ID NO: 843883 - RNA, 22 nt, Human
aggcuucuucuuccuauuuagu

SEQ ID NO: 843884 - RNA, 22 nt, Human
gacagugcauuuccuggcaugg

SEQ ID NO: 843885 - RNA, 22 nt, Human
agggcugcaucugccuggugaa

SEQ ID NO: 843886 - RNA, 22 nt, Human
cuauugaauuaacuauuaaagu

SEQ ID NO: 843887 - RNA, 22 nt, Human
uucuucagucccacuagccaca

SEQ ID NO: 843888 - RNA, 22 nt, Human
aucuaaacagguguucuuuaga

SEQ ID NO: 843889 - RNA, 22 nt, Human
gaggcccaguccugcaagcacg

SEQ ID NO: 843890 - RNA, 22 nt, Human
gcugccaguguggcaugaugca

SEQ ID NO: 843891 - RNA, 22 nt, Human
gccuggcacauugcaguggauu

SEQ ID NO: 843892 - RNA, 22 nt, Human
uacauuuauaaggcuucucugu

SEQ ID NO: 843893 - RNA, 23 nt, Human
uuucauaugguguggaugaagaa

SEQ ID NO: 843894 - RNA, 22 nt, Human
uuugaaguggaaaaggauuuaa

SEQ ID NO: 843895 - RNA, 22 nt, Human
gcugauguuuaguugauguuac

SEQ ID NO: 843896 - RNA, 20 nt, Human
uguugauuggugucaucuca

SEQ ID NO: 843897 - RNA, 22 nt, Human
uggccgggccgggcgccuccac

SEQ ID NO: 843898 - RNA, 22 nt, Human
cuauagaaaauuguaucacacg

SEQ ID NO: 843899 - RNA, 23 nt, Human
auuucuaggggauuuucuggugc

SEQ ID NO: 843900 - RNA, 22 nt, Human
cagucccaccaggaucgcucuu

SEQ ID NO: 843901 - RNA, 22 nt, Human
uaagaaucaguagauauagauu

SEQ ID NO: 843902 - RNA, 22 nt, Human
agccugguguggggcugcagag

SEQ ID NO: 843903 - RNA, 22 nt, Human
agcaccauugcaaauauggcag

SEQ ID NO: 843904 - RNA, 22 nt, Human
ccaggaaaauaccaagcuuuaa

SEQ ID NO: 843905 - RNA, 22 nt, Human
ccaggaagcugucugauaugaa

SEQ ID NO: 843906 - RNA, 22 nt, Human
caugagcugcugggagccuguc

SEQ ID NO: 843907 - RNA, 22 nt, Human
auacaucuaugccuuucugaca

SEQ ID NO: 843908 - RNA, 22 nt, Human
gucucagggacugcuucugggg

SEQ ID NO: 843909 - RNA, 22 nt, Human
aauguaugcugugguaucuucu

SEQ ID NO: 843910 - RNA, 22 nt, Human
uuuuccucuguuauuaguguga

SEQ ID NO: 843911 - RNA, 20 nt, Human
ccuggcuuugcaucugugau

SEQ ID NO: 843912 - RNA, 17 nt, Human
ggccuugggcugcucuu

SEQ ID NO: 843913 - RNA, 20 nt, Human
aagagcugacucacaguggu

SEQ ID NO: 843914 - RNA, 22 nt, Human
uucuugauuucaugcaguuaag

SEQ ID NO: 843915 - RNA, 22 nt, Human
cucagagcccaggguacacccg

SEQ ID NO: 843916 - RNA, 22 nt, Human
aagcucugcucagcagacuagg

SEQ ID NO: 843917 - RNA, 22 nt, Human
uuuccauauucugcgucugcca

SEQ ID NO: 843918 - RNA, 22 nt, Human
aguacuuuacuucuuacaguuu

SEQ ID NO: 843919 - RNA, 22 nt, Human
cugcagugaaaucaggaagcaa

SEQ ID NO: 843920 - RNA, 22 nt, Human
ggugugccuggggcuuagcugc

SEQ ID NO: 843921 - RNA, 22 nt, Human
gagagcugcauucucagacaca

SEQ ID NO: 843922 - RNA, 22 nt, Human
gggcacagcugcuacccagugc

SEQ ID NO: 843923 - RNA, 22 nt, Human
caaagccauagaguagauaaga

SEQ ID NO: 843924 - RNA, 22 nt, Human
cauuucaaguaacagauugcuu

SEQ ID NO: 843925 - RNA, 22 nt, Human
ggaugcugcuaucaggcuucga

SEQ ID NO: 843926 - RNA, 22 nt, Human
uccuggaggcaaaugaagacuc

SEQ ID NO: 843927 - RNA, 22 nt, Human
gcuggcugcgucaucacagggc

SEQ ID NO: 843928 - RNA, 23 nt, Human
acacaauagaguacuauucagcc

SEQ ID NO: 843929 - RNA, 22 nt, Human
acaguaaugauucugagucucu

SEQ ID NO: 843930 - RNA, 22 nt, Human
uagggcagauucgguggaguuu

SEQ ID NO: 843931 - RNA, 22 nt, Human
cacaugaguccugccagguaug

SEQ ID NO: 843932 - RNA, 22 nt, Human
uuagaacugaagaagauuaagg

SEQ ID NO: 843933 - RNA, 21 nt, Human
agaugaggauacugaggccua

SEQ ID NO: 843934 - RNA, 17 nt, Human
uccagagcacagagcuc

SEQ ID NO: 843935 - RNA, 22 nt, Human
gcugccuugaacuuggccuggg

SEQ ID NO: 843936 - RNA, 22 nt, Human
augugaaacugaagcauccaua

SEQ ID NO: 843937 - RNA, 22 nt, Human
gcagagccccucaagccagccu

SEQ ID NO: 843938 - RNA, 22 nt, Human
uucauucuuugaaucugaggua

SEQ ID NO: 843939 - RNA, 22 nt, Human
ugguggcuguugcagaacugag

SEQ ID NO: 843940 - RNA, 22 nt, Human
gccuggagaauuaaaaggaagg

SEQ ID NO: 843941 - RNA, 22 nt, Human
aaacacauuuuaggaaaaucua

SEQ ID NO: 843942 - RNA, 22 nt, Human
uuuaagacuuagauuuauuggg

SEQ ID NO: 843943 - RNA, 22 nt, Human
cugcugcaggaugggcacucug

SEQ ID NO: 843944 - RNA, 22 nt, Human
uuuauccaaggguuuuaacugu

SEQ ID NO: 843945 - RNA, 23 nt, Human
ccuccugggcacaggccugaugg

SEQ ID NO: 843946 - RNA, 22 nt, Human
uacaaagucacauugaaaugaa

SEQ ID NO: 843947 - RNA, 22 nt, Human
auguaucagaaauagcauuggc

SEQ ID NO: 843948 - RNA, 22 nt, Human
aaucagucauuagcucugaccu

SEQ ID NO: 843949 - RNA, 22 nt, Human
uauguacaucguugaauucaaa

SEQ ID NO: 843950 - RNA, 22 nt, Human
ggcaggaggugaguggcgggug

SEQ ID NO: 843951 - RNA, 22 nt, Human
agcuuccuacaaccaucucaga

SEQ ID NO: 843952 - RNA, 22 nt, Human
uuuaggcaaauuucagaugugc

SEQ ID NO: 843953 - RNA, 22 nt, Human
gugauuuugagaccuauauagu

SEQ ID NO: 843954 - RNA, 22 nt, Human
gaugaaaaaagacgagcauaua

SEQ ID NO: 843955 - RNA, 23 nt, Human
uuucaacuccugccauuauuucu

SEQ ID NO: 843956 - RNA, 22 nt, Human
ucccccacucuaaaggagccuu

SEQ ID NO: 843957 - RNA, 22 nt, Human
aggccagcagcaugacggcauc

SEQ ID NO: 843958 - RNA, 22 nt, Human
acagccagguaaaggcauggca

SEQ ID NO: 843959 - RNA, 18 nt, Human
aguaguggguuuagcuuc

SEQ ID NO: 843960 - RNA, 22 nt, Human
acacagggcggaaagcaugaga

SEQ ID NO: 843961 - RNA, 22 nt, Human
ugaggggagaagcagcagccug

SEQ ID NO: 843962 - RNA, 22 nt, Human
ucuuggagacucuuguauauuu

SEQ ID NO: 843963 - RNA, 22 nt, Human
cugaggccucuguucaccagaa

SEQ ID NO: 843964 - RNA, 22 nt, Human
cacaaauggccguguucaaaga

SEQ ID NO: 843965 - RNA, 22 nt, Human
ucugucaccgagggcauccaaa

SEQ ID NO: 843966 - RNA, 22 nt, Human
aguaaagcagaguugcaguaca

SEQ ID NO: 843967 - RNA, 22 nt, Human
uggcagagaacacacaugauuc

SEQ ID NO: 843968 - RNA, 22 nt, Human
gaugguuuaugauagaugggaa

SEQ ID NO: 843969 - RNA, 22 nt, Human
uacagagauacucuagaucaaa

SEQ ID NO: 843970 - RNA, 22 nt, Human
acugcuuuucuaagauucugug

SEQ ID NO: 843971 - RNA, 22 nt, Human
uuccuauuuccaugaaacacaa

SEQ ID NO: 843972 - RNA, 22 nt, Human
caggagugaaaugaggcccagg

SEQ ID NO: 843973 - RNA, 22 nt, Human
aagauaauauucauuaacuaga

SEQ ID NO: 843974 - RNA, 22 nt, Human
uuugaauaucacaaacuuucaa

SEQ ID NO: 843975 - RNA, 22 nt, Human
cauugcuguuaauugucucuag

SEQ ID NO: 843976 - RNA, 22 nt, Human
gaguuauuaauggcugaguuug

SEQ ID NO: 843977 - RNA, 22 nt, Human
uucaaugaggauagaacuggau

SEQ ID NO: 843978 - RNA, 22 nt, Human
agaguguuucagucuuccuaga

SEQ ID NO: 843979 - RNA, 22 nt, Human
gggcuacauugugagagaaguu

SEQ ID NO: 843980 - RNA, 22 nt, Human
cuuugaaaacuuaaauaacagc

SEQ ID NO: 843981 - RNA, 22 nt, Human
guuauaaaaugcacaguuguuu

SEQ ID NO: 843982 - RNA, 22 nt, Human
auaccuuuuagacauguaguug

SEQ ID NO: 843983 - RNA, 22 nt, Human
agcagccaggaaucugcagagc

SEQ ID NO: 843984 - RNA, 19 nt, Human
uuugcagugguuccuuugu

SEQ ID NO: 843985 - RNA, 22 nt, Human
guacauuggcaacucucuuaga

SEQ ID NO: 843986 - RNA, 22 nt, Human
aaauauagcaauuaugccuacu

SEQ ID NO: 843987 - RNA, 19 nt, Human
ucugcuggcagaauucccu

SEQ ID NO: 843988 - RNA, 22 nt, Human
uuuauuugucuugccauuuagu

SEQ ID NO: 843989 - RNA, 22 nt, Human
auuaaauuagcaaacugugaaa

SEQ ID NO: 843990 - RNA, 22 nt, Human
ugucauuuaguccucugugugu

SEQ ID NO: 843991 - RNA, 22 nt, Human
aaaaguguccagauuaugaaga

SEQ ID NO: 843992 - RNA, 23 nt, Human
gccugggacucaggaggagcuca

SEQ ID NO: 843993 - RNA, 22 nt, Human
ccuuuugcucucccauccagaa

SEQ ID NO: 843994 - RNA, 22 nt, Human
gcagugaaucuggcaagaauuu

SEQ ID NO: 843995 - RNA, 22 nt, Human
augggaggaaggaggcccuuga

SEQ ID NO: 843996 - RNA, 22 nt, Human
cacaggcuccggccuugcagcc

SEQ ID NO: 843997 - RNA, 22 nt, Human
ucccagcagagccagcaagccg

SEQ ID NO: 843998 - RNA, 22 nt, Human
cagagaaacucagauagcugau

SEQ ID NO: 843999 - RNA, 22 nt, Human
cuggccugcugggugagguccu

SEQ ID NO: 844000 - RNA, 22 nt, Human
gaggccagcuaguccaggaagu

SEQ ID NO: 844001 - RNA, 22 nt, Human
ggcuggcucagggcuugagaga

SEQ ID NO: 844002 - RNA, 22 nt, Human
aggagagagaacacuugggucc

SEQ ID NO: 844003 - RNA, 22 nt, Human
acaaagugcacaagaugagaac

SEQ ID NO: 844004 - RNA, 22 nt, Human
auaaaacuuggguaugaucccu

SEQ ID NO: 844005 - RNA, 22 nt, Human
ugaagacagaccaaggagaaug

SEQ ID NO: 844006 - RNA, 22 nt, Human
uggcagcuauuacaaggaaguc

SEQ ID NO: 844007 - RNA, 22 nt, Human
ucuguggcacgauugcacugca

SEQ ID NO: 844008 - RNA, 22 nt, Human
ucagggacuuacaaaccagaag

SEQ ID NO: 844009 - RNA, 22 nt, Human
acagggccagccugggaccugg

SEQ ID NO: 844010 - RNA, 22 nt, Human
uuggccuuguuaaggaggcccu

SEQ ID NO: 844011 - RNA, 22 nt, Human
ggucccugcugaagccuuggug

SEQ ID NO: 844012 - RNA, 22 nt, Human
ucauacauaacuuguacaguga

SEQ ID NO: 844013 - RNA, 22 nt, Human
uauuucagcacaugggauaggu

SEQ ID NO: 844014 - RNA, 22 nt, Human
gcagcugcaauaggcaucaagc

SEQ ID NO: 844015 - RNA, 22 nt, Human
acagaguucccacuccagaagc

SEQ ID NO: 844016 - RNA, 22 nt, Human
ccuugcauauauuauaucuuug

SEQ ID NO: 844017 - RNA, 21 nt, Human
agauuguauggaggugagagg

SEQ ID NO: 844018 - RNA, 22 nt, Human
gaagcagcagcuggggacaguu

SEQ ID NO: 844019 - RNA, 22 nt, Human
uugcagcugcaguaaauguuca

SEQ ID NO: 844020 - RNA, 22 nt, Human
cugccuggguucaaguccuguu

SEQ ID NO: 844021 - RNA, 22 nt, Human
caaagucagcugccagucccaa

SEQ ID NO: 844022 - RNA, 22 nt, Human
gagucaguaauggauaugucau

SEQ ID NO: 844023 - RNA, 22 nt, Human
ggggauggaggcgugugguccu

SEQ ID NO: 844024 - RNA, 21 nt, Human
agcagcugcaguuucuaucug

SEQ ID NO: 844025 - RNA, 22 nt, Human
gccaggaggcugcuguguaggc

SEQ ID NO: 844026 - RNA, 22 nt, Human
cccaggaagaggggucaggugu

SEQ ID NO: 844027 - RNA, 22 nt, Human
uucagaaaggauaauuggaagg

SEQ ID NO: 844028 - RNA, 22 nt, Human
uggcagcuuuuuguuucaggcu

SEQ ID NO: 844029 - RNA, 22 nt, Human
gggagggauuaguucugccugg

SEQ ID NO: 844030 - RNA, 22 nt, Human
ggccuugggcuggcugcaguau

SEQ ID NO: 844031 - RNA, 22 nt, Human
ccagggcagugggagaaggugc

SEQ ID NO: 844032 - RNA, 22 nt, Human
guaacagaaagucaugcucauu

SEQ ID NO: 844033 - RNA, 22 nt, Human
uggcuuuagguugcauguuucu

SEQ ID NO: 844034 - RNA, 22 nt, Human
aggcagauuacuugaggccagg

SEQ ID NO: 844035 - RNA, 22 nt, Human
uucugucaugcucauguaauug

SEQ ID NO: 844036 - RNA, 22 nt, Human
ugcuuuggaucuauuugcugag

SEQ ID NO: 844037 - RNA, 22 nt, Human
agcagacaacccagaugaccca

SEQ ID NO: 844038 - RNA, 22 nt, Human
gccagagcaugcacugccugca

SEQ ID NO: 844039 - RNA, 22 nt, Human
cuuuccaaugcauuuccaaugu

SEQ ID NO: 844040 - RNA, 22 nt, Human
uucugugauugacauguggcuu

SEQ ID NO: 844041 - RNA, 22 nt, Human
cccacagguccccaugaacucg

SEQ ID NO: 844042 - RNA, 22 nt, Human
gcagauggcagcccaggcuggg

SEQ ID NO: 844043 - RNA, 21 nt, Human
agagccugagaucuuccagca

SEQ ID NO: 844044 - RNA, 22 nt, Human
cucaggagacaguguccacaug

SEQ ID NO: 844045 - RNA, 22 nt, Human
uuaaauuauuucuagugaggug

SEQ ID NO: 844046 - RNA, 22 nt, Human
gagccucguggcggccacugcg

SEQ ID NO: 844047 - RNA, 22 nt, Human
ugcagggcuaagucagagccug

SEQ ID NO: 844048 - RNA, 22 nt, Human
cccaggaggcagagcuugcagu

SEQ ID NO: 844049 - RNA, 22 nt, Human
aaaguguacuaugucaugaaca

SEQ ID NO: 844050 - RNA, 22 nt, Human
auacagaaaaugaugcagaguu

SEQ ID NO: 844051 - RNA, 22 nt, Human
ucccagagugagccaggggcag

SEQ ID NO: 844052 - RNA, 22 nt, Human
uauuauguagaguaaggguuaa

SEQ ID NO: 844053 - RNA, 22 nt, Human
ggcucuggugugaagcagccuc

SEQ ID NO: 844054 - RNA, 22 nt, Human
ggcuugcuucuuguccaggaau

SEQ ID NO: 844055 - RNA, 22 nt, Human
aaacacagauuucuuuguccca

SEQ ID NO: 844056 - RNA, 22 nt, Human
ucuggcuccaccuccuuuacua

SEQ ID NO: 844057 - RNA, 22 nt, Human
aguuauauuccauagauucaga

SEQ ID NO: 844058 - RNA, 21 nt, Human
ugucagaaauaagcaugugau

SEQ ID NO: 844059 - RNA, 22 nt, Human
gcugagucuugagcacugagca

SEQ ID NO: 844060 - RNA, 22 nt, Human
gagggaggugauacugaacgua

SEQ ID NO: 844061 - RNA, 22 nt, Human
guguccacggcugagaaugauu

SEQ ID NO: 844062 - RNA, 22 nt, Human
acagguuugucugauguaauga

SEQ ID NO: 844063 - RNA, 22 nt, Human
gccuguccuggaugcucugcaa

SEQ ID NO: 844064 - RNA, 22 nt, Human
ucagcuccucaugcaggggaua

SEQ ID NO: 844065 - RNA, 22 nt, Human
guuuaagaggguuucauuccca

SEQ ID NO: 844066 - RNA, 22 nt, Human
uuguaugaauguauccuaauuu

SEQ ID NO: 844067 - RNA, 23 nt, Human
uuugaaguugacugccuuccaga

SEQ ID NO: 844068 - RNA, 22 nt, Human
guuugcauuucuugaacuauau

SEQ ID NO: 844069 - RNA, 22 nt, Human
ucuggccugaaaguccaugcuu

SEQ ID NO: 844070 - RNA, 21 nt, Human
gcugagagguugggaaguuca

SEQ ID NO: 844071 - RNA, 20 nt, Human
auacacauauucuugcaacu

SEQ ID NO: 844072 - RNA, 22 nt, Human
ggaaagagcccagcagugcuug

SEQ ID NO: 844073 - RNA, 22 nt, Human
agcugccagggacugggcaugg

SEQ ID NO: 844074 - RNA, 20 nt, Human
ggcugccuccuuccuuuccu

SEQ ID NO: 844075 - RNA, 22 nt, Human
caagaauuguacaaacugggug

SEQ ID NO: 844076 - RNA, 19 nt, Human
augagcuggcauuucaggu

SEQ ID NO: 844077 - RNA, 22 nt, Human
acacacaacucauuguguaaua

SEQ ID NO: 844078 - RNA, 20 nt, Human
cuguggaauuuuaccaugcg

SEQ ID NO: 844079 - RNA, 22 nt, Human
caauguguguguuuuucucaac

SEQ ID NO: 844080 - RNA, 22 nt, Human
ccaggccuccugugaguggacc

SEQ ID NO: 844081 - RNA, 22 nt, Human
cuuccagagauagggccucaag

SEQ ID NO: 844082 - RNA, 22 nt, Human
uagaauaugugguaggaucugg

SEQ ID NO: 844083 - RNA, 22 nt, Human
acauuguauaaugauuaucaca

SEQ ID NO: 844084 - RNA, 17 nt, Human
uaaguccuaguuauuuu

SEQ ID NO: 844085 - RNA, 19 nt, Human
acuuugcaugugugucuaa

SEQ ID NO: 844086 - RNA, 22 nt, Human
agagcuggacgucugagcccua

SEQ ID NO: 844087 - RNA, 22 nt, Human
ucaguucaguauacacuauucu

SEQ ID NO: 844088 - RNA, 22 nt, Human
agcagcucugagaggccagcac

SEQ ID NO: 844089 - RNA, 19 nt, Human
cagcaauaaugccagaugg

SEQ ID NO: 844090 - RNA, 19 nt, Human
caguccuuuccgcuuucuc

SEQ ID NO: 844091 - RNA, 22 nt, Human
cuauacagagcauccuuaacuu

SEQ ID NO: 844092 - RNA, 22 nt, Human
aaauacuguagauaauagaguu

SEQ ID NO: 844093 - RNA, 22 nt, Human
gagccugaauuugaccugcuua

SEQ ID NO: 844094 - RNA, 22 nt, Human
cucucccccacagcagccuucu

SEQ ID NO: 844095 - RNA, 21 nt, Human
uccauuguuuucccaggguuu

SEQ ID NO: 844096 - RNA, 22 nt, Human
gccuggagaagauggaacuagc

SEQ ID NO: 844097 - RNA, 22 nt, Human
uccuucagugucccgcucaggu

SEQ ID NO: 844098 - RNA, 22 nt, Human
gaggcagcuuggggcugugggu

SEQ ID NO: 844099 - RNA, 22 nt, Human
auguucuuguucaaaugucagu

SEQ ID NO: 844100 - RNA, 22 nt, Human
gccaccagccccaugcgcugug

SEQ ID NO: 844101 - RNA, 22 nt, Human
ucccaggagcaccuuuugagcc

SEQ ID NO: 844102 - RNA, 22 nt, Human
gggcugcuuuuaagggucucag

SEQ ID NO: 844103 - RNA, 22 nt, Human
ccagaucuaaguccaaaguacu

SEQ ID NO: 844104 - RNA, 22 nt, Human
uaagcauaacuaaaaaugauuu

SEQ ID NO: 844105 - RNA, 22 nt, Human
gccaggcagcugggagggugcc

SEQ ID NO: 844106 - RNA, 22 nt, Human
cacauuucucuaccucacacaa

SEQ ID NO: 844107 - RNA, 22 nt, Human
cugucucugucuuaacucccag

SEQ ID NO: 844108 - RNA, 22 nt, Human
gggccacacagaaccuccuggu

SEQ ID NO: 844109 - RNA, 22 nt, Human
auaucauucugauguauaucuu

SEQ ID NO: 844110 - RNA, 20 nt, Human
ccugccugccucggcucauu

SEQ ID NO: 844111 - RNA, 22 nt, Human
caaugugucaggaaaagggcca

SEQ ID NO: 844112 - RNA, 22 nt, Human
cauuuguacagaacagcuuuau

SEQ ID NO: 844113 - RNA, 22 nt, Human
caggcagcucuaauggaaagug

SEQ ID NO: 844114 - RNA, 22 nt, Human
gagcagaacuacucacauaucg

SEQ ID NO: 844115 - RNA, 22 nt, Human
acugccaggauggcacuagagg

SEQ ID NO: 844116 - RNA, 22 nt, Human
ccagucccgcaugguccagaau

SEQ ID NO: 844117 - RNA, 22 nt, Human
aaacugcuuuccacaguggcua

SEQ ID NO: 844118 - RNA, 22 nt, Human
ccugccaggccagugagcuucc

SEQ ID NO: 844119 - RNA, 22 nt, Human
uggcagagaacacggcugaucu

SEQ ID NO: 844120 - RNA, 22 nt, Human
gggaucagaaacauagcccuga

SEQ ID NO: 844121 - RNA, 22 nt, Human
cacaggggcaaacuguagggga

SEQ ID NO: 844122 - RNA, 22 nt, Human
uggagaagucaaagugaacagg

SEQ ID NO: 844123 - RNA, 22 nt, Human
auguauguuaguguauuaucua

SEQ ID NO: 844124 - RNA, 22 nt, Human
uucauucuugucuuuguauagu

SEQ ID NO: 844125 - RNA, 22 nt, Human
aauaaugucuuuggcuugacca

SEQ ID NO: 844126 - RNA, 22 nt, Human
ggaaaaggccauuguuucucug

SEQ ID NO: 844127 - RNA, 22 nt, Human
uuggagguuugaaaauaugugu

SEQ ID NO: 844128 - RNA, 22 nt, Human
cuuccucacggugcaacaggaa

SEQ ID NO: 844129 - RNA, 22 nt, Human
cauaagaaauaaugaugaugac

SEQ ID NO: 844130 - RNA, 22 nt, Human
auucacaguuuccucauauucu

SEQ ID NO: 844131 - RNA, 22 nt, Human
gaggagcuugugagaagauguc

SEQ ID NO: 844132 - RNA, 22 nt, Human
aggacagcagugcuggcacuug

SEQ ID NO: 844133 - RNA, 22 nt, Human
gcugucaggaacaugccuuggu

SEQ ID NO: 844134 - RNA, 22 nt, Human
ugcagucuuccagcugcacaaa

SEQ ID NO: 844135 - RNA, 22 nt, Human
cagcucccgccaucgggaggca

SEQ ID NO: 844136 - RNA, 22 nt, Human
auucuucauaccuacugagguu

SEQ ID NO: 844137 - RNA, 22 nt, Human
aaugauguauuaguacaacaca

SEQ ID NO: 844138 - RNA, 22 nt, Human
ucucagagaacaguuggugcuu

SEQ ID NO: 844139 - RNA, 22 nt, Human
uauucacaaaaugagguccuca

SEQ ID NO: 844140 - RNA, 20 nt, Human
uuucugugagaaacacuguu

SEQ ID NO: 844141 - RNA, 22 nt, Human
aggcagccagauggcagccugc

SEQ ID NO: 844142 - RNA, 20 nt, Human
gcccaggaauuugcauuucu

SEQ ID NO: 844143 - RNA, 22 nt, Human
cuguaguugaugauuucugaua

SEQ ID NO: 844144 - RNA, 22 nt, Human
ugugucagaaggcaauggggau

SEQ ID NO: 844145 - RNA, 22 nt, Human
uuucaaagaccauuaacuauca

SEQ ID NO: 844146 - RNA, 22 nt, Human
uaguacuuaucucugucauugu

SEQ ID NO: 844147 - RNA, 22 nt, Human
gaggccagaguuccccgaguca

SEQ ID NO: 844148 - RNA, 22 nt, Human
ccaggagaugggaaaguagcag

SEQ ID NO: 844149 - RNA, 22 nt, Human
aauguaugugcaucauuuacau

SEQ ID NO: 844150 - RNA, 22 nt, Human
aucucuguaaaccauaaauuga

SEQ ID NO: 844151 - RNA, 22 nt, Human
gcucugugccacaugcaguguu

SEQ ID NO: 844152 - RNA, 22 nt, Human
cuucucagcaugguuacuguga

SEQ ID NO: 844153 - RNA, 22 nt, Human
uacaguucacaguaucauaaau

SEQ ID NO: 844154 - RNA, 22 nt, Human
uuaaauuccagccucauaauag

SEQ ID NO: 844155 - RNA, 22 nt, Human
aagugaaacauguaucucuuua

SEQ ID NO: 844156 - RNA, 21 nt, Human
cugcuguggcccccgacaugc

SEQ ID NO: 844157 - RNA, 22 nt, Human
uuugacaugcaaagcacuuuag

SEQ ID NO: 844158 - RNA, 22 nt, Human
uggcccugcuggccaaaggcua

SEQ ID NO: 844159 - RNA, 22 nt, Human
ucaaagucauggcaggcucaga

SEQ ID NO: 844160 - RNA, 21 nt, Human
uaacacauuuugguacuuugg

SEQ ID NO: 844161 - RNA, 22 nt, Human
uuauuaaugaguacaaguuauu

SEQ ID NO: 844162 - RNA, 22 nt, Human
gccuuugccugcgacguggcug

SEQ ID NO: 844163 - RNA, 22 nt, Human
cccuggagggacagcugcucua

SEQ ID NO: 844164 - RNA, 22 nt, Human
ugaauaauccacagucauucau

SEQ ID NO: 844165 - RNA, 20 nt, Human
uagaaaucuuauaaaagacu

SEQ ID NO: 844166 - RNA, 22 nt, Human
accaggaguugggggugggacc

SEQ ID NO: 844167 - RNA, 20 nt, Human
acaggagaucugaggaaagg

SEQ ID NO: 844168 - RNA, 22 nt, Human
gaguccuuaauacacuggugga

SEQ ID NO: 844169 - RNA, 22 nt, Human
gugucccaaagauuagaaauca

SEQ ID NO: 844170 - RNA, 22 nt, Human
acugcuuuuagaaaucuauaga

SEQ ID NO: 844171 - RNA, 22 nt, Human
uucacagagagaacucaaacca

SEQ ID NO: 844172 - RNA, 22 nt, Human
auccccagaaaauaggugccua

SEQ ID NO: 844173 - RNA, 22 nt, Human
uuccuuagcagaccugguaucc

SEQ ID NO: 844174 - RNA, 22 nt, Human
acguuuucuagagaauaugcag

SEQ ID NO: 844175 - RNA, 22 nt, Human
cagcuggcagaaccugcaucca

SEQ ID NO: 844176 - RNA, 22 nt, Human
uagcugccagaccauucuuacu

SEQ ID NO: 844177 - RNA, 22 nt, Human
ucacugaagacugggcucuaaa

SEQ ID NO: 844178 - RNA, 22 nt, Human
gagagcugauagaugagcuacu

SEQ ID NO: 844179 - RNA, 18 nt, Human
gcugccugcauuccucac

SEQ ID NO: 844180 - RNA, 22 nt, Human
ugagaaagugggugccuagcaa

SEQ ID NO: 844181 - RNA, 22 nt, Human
gaauagcuuccuuuuuuccaaa

SEQ ID NO: 844182 - RNA, 22 nt, Human
uugauuccuugaaauauccuug

SEQ ID NO: 844183 - RNA, 22 nt, Human
cucaguuucuucauauuguagg

SEQ ID NO: 844184 - RNA, 22 nt, Human
gcuguucacggaggaggauggg

SEQ ID NO: 844185 - RNA, 22 nt, Human
ccugccugcuuucugcuuugca

SEQ ID NO: 844186 - RNA, 22 nt, Human
uugcauuuccuguacuguuuga

SEQ ID NO: 844187 - RNA, 22 nt, Human
uaagagaacuggauagauagga

SEQ ID NO: 844188 - RNA, 22 nt, Human
ccucccagugccuccagagcag

SEQ ID NO: 844189 - RNA, 22 nt, Human
uuuccaagagcuuauuucugaa

SEQ ID NO: 844190 - RNA, 22 nt, Human
ggccugaggcaauagucagaca

SEQ ID NO: 844191 - RNA, 22 nt, Human
ccagcagacacacaggcguggg

SEQ ID NO: 844192 - RNA, 22 nt, Human
gcagggccagggcucaggcugu

SEQ ID NO: 844193 - RNA, 22 nt, Human
ucccugcucagcucaccuggca

SEQ ID NO: 844194 - RNA, 22 nt, Human
uccuguuuaucugugugacucg

SEQ ID NO: 844195 - RNA, 20 nt, Human
agguauaagaaaugugauuu

SEQ ID NO: 844196 - RNA, 22 nt, Human
gccaggcuggugcaaggauauu

SEQ ID NO: 844197 - RNA, 22 nt, Human
ccuggauccaugaaaaggcuac

SEQ ID NO: 844198 - RNA, 22 nt, Human
ugcccuuggguaacuugcugau

SEQ ID NO: 844199 - RNA, 22 nt, Human
cuuugcauacaauuuuuagaaa

SEQ ID NO: 844200 - RNA, 21 nt, Human
aggcagcuggaaggccuggcu

SEQ ID NO: 844201 - RNA, 22 nt, Human
aaugauggucauggcaacuuuu

SEQ ID NO: 844202 - RNA, 22 nt, Human
ucucagggugaggaaagaauuu

SEQ ID NO: 844203 - RNA, 18 nt, Human
gaaaugugauucuagggc

SEQ ID NO: 844204 - RNA, 22 nt, Human
aggcuggcgacaucuggcgggc

SEQ ID NO: 844205 - RNA, 22 nt, Human
ucagccugcuccaagugcugcc

SEQ ID NO: 844206 - RNA, 22 nt, Human
uucucuggaacugaaacaagau

SEQ ID NO: 844207 - RNA, 22 nt, Human
acccagcucuuugauggucuug

SEQ ID NO: 844208 - RNA, 22 nt, Human
agcagcugagaugguaagauuc

SEQ ID NO: 844209 - RNA, 22 nt, Human
gaggcugccccuuccucagcug

SEQ ID NO: 844210 - RNA, 22 nt, Human
uaggccagcccuuaguccuguc

SEQ ID NO: 844211 - RNA, 22 nt, Human
cugcgcagcaaucagagaggag

SEQ ID NO: 844212 - RNA, 22 nt, Human
uauuuccaaaagccuauuauga

SEQ ID NO: 844213 - RNA, 22 nt, Human
ggcagcucacugauuagcaauu

SEQ ID NO: 844214 - RNA, 22 nt, Human
cugggccuggcguuccaggcug

SEQ ID NO: 844215 - RNA, 22 nt, Human
uuugcauuccugccugcauuca

SEQ ID NO: 844216 - RNA, 22 nt, Human
gaguguggugaacaggagcacc

SEQ ID NO: 844217 - RNA, 22 nt, Human
ugaaaugaaugugauucgauag

SEQ ID NO: 844218 - RNA, 22 nt, Human
ucugaacuccagcccugcucuc

SEQ ID NO: 844219 - RNA, 22 nt, Human
augaacaaguauuugcaugagc

SEQ ID NO: 844220 - RNA, 22 nt, Human
gucccaggcagagucaggaggg

SEQ ID NO: 844221 - RNA, 22 nt, Human
gucuuucuuaauucaagugcuu

SEQ ID NO: 844222 - RNA, 20 nt, Human
cugcccagccacugagggau

SEQ ID NO: 844223 - RNA, 22 nt, Human
uaagaacaguguuucaucucua

SEQ ID NO: 844224 - RNA, 22 nt, Human
uggcugccuagucccucagccu

SEQ ID NO: 844225 - RNA, 22 nt, Human
aucaguuuggaacauucaggcc

SEQ ID NO: 844226 - RNA, 18 nt, Human
agggaucaucacugcagc

SEQ ID NO: 844227 - RNA, 22 nt, Human
agggccagggaagcuguauuuu

SEQ ID NO: 844228 - RNA, 22 nt, Human
guugggaaggcaagaaguagaa

SEQ ID NO: 844229 - RNA, 22 nt, Human
ucccuggguccugcuugcucuc

SEQ ID NO: 844230 - RNA, 22 nt, Human
ugcagcucauugcuggggucug

SEQ ID NO: 844231 - RNA, 22 nt, Human
ugaugauguuuaucuugguauu

SEQ ID NO: 844232 - RNA, 22 nt, Human
gagaacucagacgcaggucaug

SEQ ID NO: 844233 - RNA, 22 nt, Human
acagaguaggugcugucgacug

SEQ ID NO: 844234 - RNA, 22 nt, Human
guucuucaucuuaaccaucugu

SEQ ID NO: 844235 - RNA, 22 nt, Human
ggguggggcccaggaaaucuau

SEQ ID NO: 844236 - RNA, 20 nt, Human
cccuccagcaaccaggacuu

SEQ ID NO: 844237 - RNA, 19 nt, Human
ccugggaggcggagguugc

SEQ ID NO: 844238 - RNA, 22 nt, Human
agcugccauccuguucagcacc

SEQ ID NO: 844239 - RNA, 22 nt, Human
ggugcugguucaggguggcugu

SEQ ID NO: 844240 - RNA, 22 nt, Human
uuucacaagacagcuacuguug

SEQ ID NO: 844241 - RNA, 22 nt, Human
cuguacauauacauuuuuuucc

SEQ ID NO: 844242 - RNA, 22 nt, Human
cucccaggcacagggaggagcc

SEQ ID NO: 844243 - RNA, 22 nt, Human
cauaauuuuccaugguuugcua

SEQ ID NO: 844244 - RNA, 22 nt, Human
agcaguggcugaagauguuccu

SEQ ID NO: 844245 - RNA, 22 nt, Human
ugagcccaggaguuggaggcug

SEQ ID NO: 844246 - RNA, 22 nt, Human
aucaaaaugcuccagugauggu

SEQ ID NO: 844247 - RNA, 22 nt, Human
guccucuggaagaugaguucuu

SEQ ID NO: 844248 - RNA, 22 nt, Human
aaagacugguguguuacauaua

SEQ ID NO: 844249 - RNA, 22 nt, Human
acauuucuaguuguucaucucc

SEQ ID NO: 844250 - RNA, 22 nt, Human
caggggcuuuuccucuauaagg

SEQ ID NO: 844251 - RNA, 22 nt, Human
ccagcuucucucugaugcagcu

SEQ ID NO: 844252 - RNA, 22 nt, Human
cuuaaagaaauugaggagagga

SEQ ID NO: 844253 - RNA, 15 nt, Human
cccaggaguucgaga

SEQ ID NO: 844254 - RNA, 22 nt, Human
agggcugcuauguugauucaga

SEQ ID NO: 844255 - RNA, 22 nt, Human
gucuucaacaauaacuaccacu

SEQ ID NO: 844256 - RNA, 22 nt, Human
cuggcaggaaguuagaugguaa

SEQ ID NO: 844257 - RNA, 21 nt, Human
ucauucacaggguauuguaua

SEQ ID NO: 844258 - RNA, 22 nt, Human
gggcagcugccagaggccaugg

SEQ ID NO: 844259 - RNA, 22 nt, Human
uuacuuugaugaucaaugagcg

SEQ ID NO: 844260 - RNA, 20 nt, Human
agcuggagaagggcccuucc

SEQ ID NO: 844261 - RNA, 22 nt, Human
aggugcagaaaaaaguccuuua

SEQ ID NO: 844262 - RNA, 22 nt, Human
agggccagaaucccucagucua

SEQ ID NO: 844263 - RNA, 22 nt, Human
ugggcucauggcccagcacugg

SEQ ID NO: 844264 - RNA, 22 nt, Human
gacagccaugcacuucugcugu

SEQ ID NO: 844265 - RNA, 22 nt, Human
agcagaacauuuucagggcugu

SEQ ID NO: 844266 - RNA, 22 nt, Human
uucccaauauucugcuuuuaug

SEQ ID NO: 844267 - RNA, 22 nt, Human
acuguguccucauguggcagaa

SEQ ID NO: 844268 - RNA, 22 nt, Human
aggcccuggguuagggcccacu

SEQ ID NO: 844269 - RNA, 22 nt, Human
uggcugggcccccaccugccuc

SEQ ID NO: 844270 - RNA, 22 nt, Human
cacugggcaauucugagccuaa

SEQ ID NO: 844271 - RNA, 22 nt, Human
auguaaaucaagcagugcuggu

SEQ ID NO: 844272 - RNA, 22 nt, Human
guggagcccugccuugcucaug

SEQ ID NO: 844273 - RNA, 22 nt, Human
agucucuuccuucaaggcuggu

SEQ ID NO: 844274 - RNA, 22 nt, Human
cuggccuucagacucggacuga

SEQ ID NO: 844275 - RNA, 22 nt, Human
ggcccugggaugcucagcagug

SEQ ID NO: 844276 - RNA, 22 nt, Human
ccuucuucuguguggcccaaga

SEQ ID NO: 844277 - RNA, 22 nt, Human
ggauaagaaaauuguaauaacu

SEQ ID NO: 844278 - RNA, 22 nt, Human
ccagccuucugagcugccugga

SEQ ID NO: 844279 - RNA, 22 nt, Human
cuuacauuaaguaagagauuga

SEQ ID NO: 844280 - RNA, 22 nt, Human
ucauucagguugggcaaguguc

SEQ ID NO: 844281 - RNA, 22 nt, Human
auaguggugagcugcauuuaug

SEQ ID NO: 844282 - RNA, 20 nt, Human
aaacauucauguacaaguga

SEQ ID NO: 844283 - RNA, 22 nt, Human
uuuaaagagaaugugaaggagu

SEQ ID NO: 844284 - RNA, 18 nt, Human
uguuccaaggaaggaauc

SEQ ID NO: 844285 - RNA, 22 nt, Human
ucauugcaagcucauuuaucug

SEQ ID NO: 844286 - RNA, 22 nt, Human
ggcugccugugcccaggcacac

SEQ ID NO: 844287 - RNA, 22 nt, Human
auugacaauguauuuguaucug

SEQ ID NO: 844288 - RNA, 22 nt, Human
uggcagagagagugcagucgac

SEQ ID NO: 844289 - RNA, 22 nt, Human
uggcucaguagcagugugguca

SEQ ID NO: 844290 - RNA, 22 nt, Human
uggguaaacugggucuggagag

SEQ ID NO: 844291 - RNA, 22 nt, Human
cuggcucagugccuucagaagu

SEQ ID NO: 844292 - RNA, 22 nt, Human
ucuugggauugcccugcaguuc

SEQ ID NO: 844293 - RNA, 22 nt, Human
ucagaauucuacaauagaucag

SEQ ID NO: 844294 - RNA, 22 nt, Human
uucagcaaauggacuguucagg

SEQ ID NO: 844295 - RNA, 22 nt, Human
uagacauuucugguuauugaca

SEQ ID NO: 844296 - RNA, 22 nt, Human
auugaaaggcaaaguaggaagc

SEQ ID NO: 844297 - RNA, 22 nt, Human
gcuggucacucugggagcugcu

SEQ ID NO: 844298 - RNA, 22 nt, Human
ugggugggagcacccugucugg

SEQ ID NO: 844299 - RNA, 22 nt, Human
ggcaggcaaugaggaugggaag

SEQ ID NO: 844300 - RNA, 22 nt, Human
uuccuuaggcuguuugcagugc

SEQ ID NO: 844301 - RNA, 22 nt, Human
ccugggaagagcugacaggagg

SEQ ID NO: 844302 - RNA, 22 nt, Human
uccagggaccucccugagagcu

SEQ ID NO: 844303 - RNA, 22 nt, Human
ucugguaaccuuuaucccuccu

SEQ ID NO: 844304 - RNA, 22 nt, Human
gccucugcaucaucacuccagc

SEQ ID NO: 844305 - RNA, 22 nt, Human
aguacuuugcacuuugcucaga

SEQ ID NO: 844306 - RNA, 22 nt, Human
gcucccugcagcugagaguucc

SEQ ID NO: 844307 - RNA, 22 nt, Human
ucugcuguauuagguugaacug

SEQ ID NO: 844308 - RNA, 22 nt, Human
ucuuuaauaucugccccagagc

SEQ ID NO: 844309 - RNA, 22 nt, Human
agcucccauuaucuucugaaac

SEQ ID NO: 844310 - RNA, 22 nt, Human
ggcuccuguccuccuggagcuc

SEQ ID NO: 844311 - RNA, 22 nt, Human
aaagaugucauacacauuaaga

SEQ ID NO: 844312 - RNA, 22 nt, Human
gagaccaggaaguacagcagcc

SEQ ID NO: 844313 - RNA, 22 nt, Human
ucacagugagccaugucagaga

SEQ ID NO: 844314 - RNA, 22 nt, Human
agggccuggaacugugggcagg

SEQ ID NO: 844315 - RNA, 22 nt, Human
uacaaagugugcccaugcugag

SEQ ID NO: 844316 - RNA, 22 nt, Human
aaaaucuaaguagcgaguaagg

SEQ ID NO: 844317 - RNA, 22 nt, Human
aacagaaugcaggggaugcugc

SEQ ID NO: 844318 - RNA, 21 nt, Human
gcaggguccuuuccauuccua

SEQ ID NO: 844319 - RNA, 22 nt, Human
ugugaaaagcaggcuacuuucu

SEQ ID NO: 844320 - RNA, 22 nt, Human
aauuaaaugacaggggaagaug

SEQ ID NO: 844321 - RNA, 20 nt, Human
agugcaagaaagcacagcug

SEQ ID NO: 844322 - RNA, 22 nt, Human
agggcagagaucugagugggca

SEQ ID NO: 844323 - RNA, 22 nt, Human
agcaagcuaccuagauagucua

SEQ ID NO: 844324 - RNA, 22 nt, Human
agagugcagauaagagaauguu

SEQ ID NO: 844325 - RNA, 22 nt, Human
augucuuuggcuuugacauggc

SEQ ID NO: 844326 - RNA, 21 nt, Human
auuucagagcacacaaguaaa

SEQ ID NO: 844327 - RNA, 22 nt, Human
aaauugugcucacacugauauu

SEQ ID NO: 844328 - RNA, 22 nt, Human
ugccugccaugcagaaagcuga

SEQ ID NO: 844329 - RNA, 19 nt, Human
aggauuuauuaugugcuca

SEQ ID NO: 844330 - RNA, 22 nt, Human
aggcaacuguuugauaauguug

SEQ ID NO: 844331 - RNA, 22 nt, Human
ugaaagcacaaguucuaacagg

SEQ ID NO: 844332 - RNA, 22 nt, Human
ucaugccacuuacaaaauaaug

SEQ ID NO: 844333 - RNA, 23 nt, Human
acuuaaaugguucuuuaucucag

SEQ ID NO: 844334 - RNA, 22 nt, Human
auggcuuucagauuucuauguu

SEQ ID NO: 844335 - RNA, 22 nt, Human
agcagggcaaagucaggcuaac

SEQ ID NO: 844336 - RNA, 22 nt, Human
gacccugccaugagugacaggg

SEQ ID NO: 844337 - RNA, 22 nt, Human
ugcuuccuugagcucuccaauc

SEQ ID NO: 844338 - RNA, 22 nt, Human
uagacacauccguggaagcuuc

SEQ ID NO: 844339 - RNA, 22 nt, Human
uuucaucuucccagagaccuug

SEQ ID NO: 844340 - RNA, 22 nt, Human
caggccugugacaccgugucug

SEQ ID NO: 844341 - RNA, 22 nt, Human
gaugauuuuaugucuugucauu

SEQ ID NO: 844342 - RNA, 20 nt, Human
cccagccccuaccuguugcc

SEQ ID NO: 844343 - RNA, 22 nt, Human
aguguccccuacagaggcauuc

SEQ ID NO: 844344 - RNA, 22 nt, Human
cagaagaggacuggguagcuca

SEQ ID NO: 844345 - RNA, 22 nt, Human
augcuguguuugagaaccuagg

SEQ ID NO: 844346 - RNA, 22 nt, Human
ccugggagagccaucuguggcc

SEQ ID NO: 844347 - RNA, 22 nt, Human
caaguccaggucaauuuaaagc

SEQ ID NO: 844348 - RNA, 22 nt, Human
aaucucuugggaggaaugaauu

SEQ ID NO: 844349 - RNA, 22 nt, Human
ugagcccagucugucugacaug

SEQ ID NO: 844350 - RNA, 22 nt, Human
ggcaaaaaguucccaucagugu

SEQ ID NO: 844351 - RNA, 22 nt, Human
uugaacugguaguuggaaaucu

SEQ ID NO: 844352 - RNA, 22 nt, Human
gcccaggaugguguguaguggu

SEQ ID NO: 844353 - RNA, 22 nt, Human
caggacagcucaacaccuccuc

SEQ ID NO: 844354 - RNA, 22 nt, Human
uugaagauggaucgccacucuc

SEQ ID NO: 844355 - RNA, 22 nt, Human
uauucaaaguaccuucauugcc

SEQ ID NO: 844356 - RNA, 22 nt, Human
ucuggagaacuugcaagaggau

SEQ ID NO: 844357 - RNA, 22 nt, Human
auggaucacagugccgugggug

SEQ ID NO: 844358 - RNA, 22 nt, Human
gcccugcugucuucagaguaua

SEQ ID NO: 844359 - RNA, 22 nt, Human
ccugaggcuuaaucugucccaa

SEQ ID NO: 844360 - RNA, 22 nt, Human
gacagcauggugucuguucagg

SEQ ID NO: 844361 - RNA, 22 nt, Human
ccagccuccauguagauagcug

SEQ ID NO: 844362 - RNA, 22 nt, Human
uuucaguucaguuuauuauauc

SEQ ID NO: 844363 - RNA, 21 nt, Human
ugauuuccagaaaauuggccc

SEQ ID NO: 844364 - RNA, 22 nt, Human
uugcauugugauuacagaggug

SEQ ID NO: 844365 - RNA, 16 nt, Human
uguaugaacgucucca

SEQ ID NO: 844366 - RNA, 22 nt, Human
ucauugcagcuucagguguuca

SEQ ID NO: 844367 - RNA, 22 nt, Human
auagugguuggauaugucagag

SEQ ID NO: 844368 - RNA, 22 nt, Human
uacaaaguagaaauucaguaaa

SEQ ID NO: 844369 - RNA, 22 nt, Human
gaaggagagggucaaggauaau

SEQ ID NO: 844370 - RNA, 22 nt, Human
uagauuuaagacccugaauuug

SEQ ID NO: 844371 - RNA, 22 nt, Human
uaaguucaguuggucgaaguag

SEQ ID NO: 844372 - RNA, 22 nt, Human
gagccuccuccuggugugccga

SEQ ID NO: 844373 - RNA, 22 nt, Human
ggcagcagaacuggcccuguau

SEQ ID NO: 844374 - RNA, 22 nt, Human
uggcuuuacaucaaauugagua

SEQ ID NO: 844375 - RNA, 22 nt, Human
uuuacauuucccucugucaguu

SEQ ID NO: 844376 - RNA, 22 nt, Human
augugacaauauuuggucuuau

SEQ ID NO: 844377 - RNA, 22 nt, Human
ucaguuuuaagguuugagaauu

SEQ ID NO: 844378 - RNA, 22 nt, Human
agccaggaaccagcuacagucu

SEQ ID NO: 844379 - RNA, 22 nt, Human
gcagggugccgacuucagggau

SEQ ID NO: 844380 - RNA, 22 nt, Human
agcucuccacacauaggacuag

SEQ ID NO: 844381 - RNA, 22 nt, Human
caggccucuauggucagcugag

SEQ ID NO: 844382 - RNA, 22 nt, Human
uuggaauucaaguuguagcuua

SEQ ID NO: 844383 - RNA, 22 nt, Human
agcugagcuaguaguuccagug

SEQ ID NO: 844384 - RNA, 19 nt, Human
uuucagacucaucuccagc

SEQ ID NO: 844385 - RNA, 19 nt, Human
uuuggcacucugaaguguu

SEQ ID NO: 844386 - RNA, 22 nt, Human
uguacaauguguuuguuggcuu

SEQ ID NO: 844387 - RNA, 22 nt, Human
ugagcccuaagggucaagcagg

SEQ ID NO: 844388 - RNA, 22 nt, Human
cagggacaugacuggucucugu

SEQ ID NO: 844389 - RNA, 22 nt, Human
uuuugaaagccagguuuguaug

SEQ ID NO: 844390 - RNA, 20 nt, Human
ggcugugcccuuccguggcc

SEQ ID NO: 844391 - RNA, 22 nt, Human
uacagcauauacagaaugaaca

SEQ ID NO: 844392 - RNA, 22 nt, Human
uaucuguuugcucacagguguu

SEQ ID NO: 844393 - RNA, 22 nt, Human
aucaguuugauaauaaggcuug

SEQ ID NO: 844394 - RNA, 22 nt, Human
auuuaagauugcguauucaugu

SEQ ID NO: 844395 - RNA, 22 nt, Human
aaggcacugcuuugcugcgccc

SEQ ID NO: 844396 - RNA, 22 nt, Human
guucacaucacuucacugaacc

SEQ ID NO: 844397 - RNA, 22 nt, Human
ggcucagaaacuaaaggcgcug

SEQ ID NO: 844398 - RNA, 22 nt, Human
guggagacgggacagaagcuaa

SEQ ID NO: 844399 - RNA, 21 nt, Human
gggaaauuaggauugcucauc

SEQ ID NO: 844400 - RNA, 22 nt, Human
auggauuuggaugagauuacuu

SEQ ID NO: 844401 - RNA, 22 nt, Human
gugcugugugauccaugcuggc

SEQ ID NO: 844402 - RNA, 22 nt, Human
gucccuaguggaaagacaugau

SEQ ID NO: 844403 - RNA, 22 nt, Human
aauguguagggugccuguuuuu

SEQ ID NO: 844404 - RNA, 22 nt, Human
ccuggcuggcaagaucgugaag

SEQ ID NO: 844405 - RNA, 22 nt, Human
ugcagcuguaacagaggccuca

SEQ ID NO: 844406 - RNA, 22 nt, Human
ggugauuuucgaguuucauguu

SEQ ID NO: 844407 - RNA, 22 nt, Human
aagggcagcuauuaucgucauc

SEQ ID NO: 844408 - RNA, 22 nt, Human
agcaucuggcagaaagucagaa

SEQ ID NO: 844409 - RNA, 22 nt, Human
gaaaucugaaucuucuguuggu

SEQ ID NO: 844410 - RNA, 22 nt, Human
gggcugugcugaguaggaggug

SEQ ID NO: 844411 - RNA, 21 nt, Human
acccuggguucuccauacccu

SEQ ID NO: 844412 - RNA, 23 nt, Human
aaauaugucugagggcaaagaau

SEQ ID NO: 844413 - RNA, 22 nt, Human
ucagccacuacccaccuuaaca

SEQ ID NO: 844414 - RNA, 22 nt, Human
uacuuucuagcucuccccaguu

SEQ ID NO: 844415 - RNA, 22 nt, Human
ccuguucaaugcccuggcuuca

SEQ ID NO: 844416 - RNA, 22 nt, Human
ucccugggccacagcugugagc

SEQ ID NO: 844417 - RNA, 22 nt, Human
ugggccacaagccaugggacca

SEQ ID NO: 844418 - RNA, 20 nt, Human
acuugcugggcuuuguuacc

SEQ ID NO: 844419 - RNA, 22 nt, Human
ugagacaguuuuucuauuucca

SEQ ID NO: 844420 - RNA, 22 nt, Human
aaugaacacagcccucuacuuu

SEQ ID NO: 844421 - RNA, 17 nt, Human
ucaggcugugccuggua

SEQ ID NO: 844422 - RNA, 22 nt, Human
agcugguucauucauucauggu

SEQ ID NO: 844423 - RNA, 19 nt, Human
agguggucuaggcuggaga

SEQ ID NO: 844424 - RNA, 22 nt, Human
aaggagaaaugguagaugugca

SEQ ID NO: 844425 - RNA, 22 nt, Human
uagcacaucuucuuggccugca

SEQ ID NO: 844426 - RNA, 22 nt, Human
uggcagagcccagaacugagca

SEQ ID NO: 844427 - RNA, 22 nt, Human
gaagagcuguagccugcucuuu

SEQ ID NO: 844428 - RNA, 22 nt, Human
cugcuguguugccagugucacc

SEQ ID NO: 844429 - RNA, 22 nt, Human
uuggaaggagucaaccagcuga

SEQ ID NO: 844430 - RNA, 22 nt, Human
cagaggccucacuuccagccag

SEQ ID NO: 844431 - RNA, 22 nt, Human
aacuagaacgucuaguugcugg

SEQ ID NO: 844432 - RNA, 17 nt, Human
ugaaggaaggaugaugu

SEQ ID NO: 844433 - RNA, 22 nt, Human
caaauauuccagguacaucccu

SEQ ID NO: 844434 - RNA, 23 nt, Human
uggccucuccccaccuggcagaa

SEQ ID NO: 844435 - RNA, 22 nt, Human
uggcugcuuguuuuagugaggc

SEQ ID NO: 844436 - RNA, 22 nt, Human
caguagcaggcacucagcacgu

SEQ ID NO: 844437 - RNA, 22 nt, Human
cuccccagguucaggagguggg

SEQ ID NO: 844438 - RNA, 22 nt, Human
gaggugggaugugugugcuacu

SEQ ID NO: 844439 - RNA, 19 nt, Human
ggcagcuggacgcuguuca

SEQ ID NO: 844440 - RNA, 22 nt, Human
cucugagcccgcugcagcccca

SEQ ID NO: 844441 - RNA, 22 nt, Human
gcucccugccuacacggaccuu

SEQ ID NO: 844442 - RNA, 22 nt, Human
cuuaaauucuuaaugcccucau

SEQ ID NO: 844443 - RNA, 22 nt, Human
cugcagggcccgccugagcccu

SEQ ID NO: 844444 - RNA, 22 nt, Human
agggccugcucuaucacucuca

SEQ ID NO: 844445 - RNA, 22 nt, Human
uuaacagauguuuauggagcau

SEQ ID NO: 844446 - RNA, 22 nt, Human
ugcauuaugcuugugcuguaua

SEQ ID NO: 844447 - RNA, 22 nt, Human
ucugcagggaugugagggguga

SEQ ID NO: 844448 - RNA, 19 nt, Human
uuucccagcccuugcugug

SEQ ID NO: 844449 - RNA, 22 nt, Human
ccucagccuuggccccaggcag

SEQ ID NO: 844450 - RNA, 22 nt, Human
aucuaaaaggagcucuuuaucu

SEQ ID NO: 844451 - RNA, 22 nt, Human
ugggccugaguuugggaacugg

SEQ ID NO: 844452 - RNA, 22 nt, Human
guaaacaucagccacucuauuu

SEQ ID NO: 844453 - RNA, 22 nt, Human
caauuucacuaaugaugugggg

SEQ ID NO: 844454 - RNA, 22 nt, Human
agggaaaggcugaugcuguggg

SEQ ID NO: 844455 - RNA, 22 nt, Human
gaggccacgguuuuccuugggg

SEQ ID NO: 844456 - RNA, 22 nt, Human
uguauaaauuuaaauuccugcu

SEQ ID NO: 844457 - RNA, 22 nt, Human
uuuagaguugaguauucauugg

SEQ ID NO: 844458 - RNA, 22 nt, Human
augcuuuuaugucacaugguca

SEQ ID NO: 844459 - RNA, 21 nt, Human
agggccugugcucuccagguc

SEQ ID NO: 844460 - RNA, 22 nt, Human
ucuuagcacagcuauauaaguu

SEQ ID NO: 844461 - RNA, 21 nt, Human
augugaaauaucaucagagca

SEQ ID NO: 844462 - RNA, 22 nt, Human
aaauaaguaguuuaguguugug

SEQ ID NO: 844463 - RNA, 22 nt, Human
cuguggcuuucucugccuccuu

SEQ ID NO: 844464 - RNA, 22 nt, Human
ggcccacuugaaauggagcuca

SEQ ID NO: 844465 - RNA, 22 nt, Human
ucuggcaggucaaucauucuuu

SEQ ID NO: 844466 - RNA, 22 nt, Human
cuggccagcauuuuugcuuuag

SEQ ID NO: 844467 - RNA, 23 nt, Human
aucuguucaucugacacagauuc

SEQ ID NO: 844468 - RNA, 22 nt, Human
gaaaugcagaaccugagaccau

SEQ ID NO: 844469 - RNA, 22 nt, Human
gcuggggaggcagcagagaaca

SEQ ID NO: 844470 - RNA, 22 nt, Human
acaugcuuugcacuuacaucau

SEQ ID NO: 844471 - RNA, 22 nt, Human
aguccaggaguugggugacauu

SEQ ID NO: 844472 - RNA, 22 nt, Human
gucucagauaacauguauucua

SEQ ID NO: 844473 - RNA, 22 nt, Human
cuacauuuugugauuaugaaau

SEQ ID NO: 844474 - RNA, 22 nt, Human
gcaggcucuucuuucugcccag

SEQ ID NO: 844475 - RNA, 22 nt, Human
uuagucuucuuccuuauauguu

SEQ ID NO: 844476 - RNA, 22 nt, Human
ucuucagaggaagucagucuuu

SEQ ID NO: 844477 - RNA, 22 nt, Human
gaguccuuuucucuguccacug

SEQ ID NO: 844478 - RNA, 22 nt, Human
ucucacuuuguugcccagacuu

SEQ ID NO: 844479 - RNA, 22 nt, Human
ccucuucuagguuucagccugc

SEQ ID NO: 844480 - RNA, 22 nt, Human
ccuggcucucugcagauccugg

SEQ ID NO: 844481 - RNA, 21 nt, Human
uucaaagagugggcauuguca

SEQ ID NO: 844482 - RNA, 22 nt, Human
cuuagcaugugguguccuugua

SEQ ID NO: 844483 - RNA, 22 nt, Human
cugagccagggccacacaugga

SEQ ID NO: 844484 - RNA, 22 nt, Human
aaaauucugucauuaaauugug

SEQ ID NO: 844485 - RNA, 22 nt, Human
aggacuccauguguccuggaga

SEQ ID NO: 844486 - RNA, 22 nt, Human
ugagaaccaugaaaagcuguca

SEQ ID NO: 844487 - RNA, 22 nt, Human
ccuggaagauucaccacuacca

SEQ ID NO: 844488 - RNA, 19 nt, Human
ccaggccuccugggagguc

SEQ ID NO: 844489 - RNA, 22 nt, Human
ggcucaggcuggagugcagugg

SEQ ID NO: 844490 - RNA, 22 nt, Human
uuuaucuguuguacauuuaugc

SEQ ID NO: 844491 - RNA, 22 nt, Human
ugggcagcagcaaagccagacu

SEQ ID NO: 844492 - RNA, 22 nt, Human
cuccuuccugguuagcaccuua

SEQ ID NO: 844493 - RNA, 22 nt, Human
aagcaaaggcaggagcuuguga

SEQ ID NO: 844494 - RNA, 20 nt, Human
ucauccaggacaggaguggc

SEQ ID NO: 844495 - RNA, 22 nt, Human
gaggagcacaugaggcugaggg

SEQ ID NO: 844496 - RNA, 22 nt, Human
cuuugcaaacugucacacuuuc

SEQ ID NO: 844497 - RNA, 22 nt, Human
aggacugggugcagagggcauc

SEQ ID NO: 844498 - RNA, 22 nt, Human
augccaaagcccaaguucauca

SEQ ID NO: 844499 - RNA, 22 nt, Human
aggcccaguagugcugccuuua

SEQ ID NO: 844500 - RNA, 22 nt, Human
uuuccauauuuaaucaaaauaa

SEQ ID NO: 844501 - RNA, 22 nt, Human
acauugcugcauucuccuuccc

SEQ ID NO: 844502 - RNA, 22 nt, Human
ugucuucaucucagacacaguu

SEQ ID NO: 844503 - RNA, 22 nt, Human
agauuuccugcacugccuuuga

SEQ ID NO: 844504 - RNA, 22 nt, Human
ugagggaggcccuuugagcaga

SEQ ID NO: 844505 - RNA, 22 nt, Human
ccuuucucuuugcugaucaugu

SEQ ID NO: 844506 - RNA, 22 nt, Human
aggcuccuugcucacaggcuca

SEQ ID NO: 844507 - RNA, 22 nt, Human
cagggacauugguggccagguu

SEQ ID NO: 844508 - RNA, 22 nt, Human
gcagggcuguucaggagggugg

SEQ ID NO: 844509 - RNA, 22 nt, Human
aaggcagcuucaccacagcauu

SEQ ID NO: 844510 - RNA, 22 nt, Human
ugcauuccuccaccuccugcac

SEQ ID NO: 844511 - RNA, 22 nt, Human
cccaggaggcgcagguugcggu

SEQ ID NO: 844512 - RNA, 22 nt, Human
ccccggaggcggagguugcagu

SEQ ID NO: 844513 - RNA, 22 nt, Human
ucccagagccaagcuauggaug

SEQ ID NO: 844514 - RNA, 22 nt, Human
aauuaacagagggcuuauuacu

SEQ ID NO: 844515 - RNA, 22 nt, Human
ggcagcucaccucugguccagg

SEQ ID NO: 844516 - RNA, 22 nt, Human
agcauggggcaaugcaugugcu

SEQ ID NO: 844517 - RNA, 22 nt, Human
ugccacccagccaggaguggga

SEQ ID NO: 844518 - RNA, 22 nt, Human
caagagcuagacuuugucagga

SEQ ID NO: 844519 - RNA, 22 nt, Human
ucucaggcuaccuugcacaagg

SEQ ID NO: 844520 - RNA, 22 nt, Human
gaguccuuuguuccuugccaca

SEQ ID NO: 844521 - RNA, 22 nt, Human
acauuucugcaucucagagcua

SEQ ID NO: 844522 - RNA, 20 nt, Human
uacagacaugacaauaaugg

SEQ ID NO: 844523 - RNA, 20 nt, Human
ucacaggggaccaggagcag

SEQ ID NO: 844524 - RNA, 22 nt, Human
uccugccuagcaggugaccuau

SEQ ID NO: 844525 - RNA, 22 nt, Human
gggcauggaggucugucugcag

SEQ ID NO: 844526 - RNA, 22 nt, Human
gcugagugauugauauuuuagu

SEQ ID NO: 844527 - RNA, 22 nt, Human
acacugcucacuucuucccuug

SEQ ID NO: 844528 - RNA, 19 nt, Human
gcugucugaugcugagguc

SEQ ID NO: 844529 - RNA, 22 nt, Human
cucaggauucucgacacucaca

SEQ ID NO: 844530 - RNA, 22 nt, Human
uggcccugcuaugauccugcaa

SEQ ID NO: 844531 - RNA, 22 nt, Human
aggcagcucuguggccucccag

SEQ ID NO: 844532 - RNA, 21 nt, Human
gcccucaggggaggauggccu

SEQ ID NO: 844533 - RNA, 22 nt, Human
ucacaaauagcuauauuaagga

SEQ ID NO: 844534 - RNA, 22 nt, Human
augaaggauggcuggcugcccu

SEQ ID NO: 844535 - RNA, 22 nt, Human
aaggucauggcaaauuacuuuu

SEQ ID NO: 844536 - RNA, 22 nt, Human
uuuauucuugagagugagaaga

SEQ ID NO: 844537 - RNA, 22 nt, Human
gccuggguuccaugaucuccag

SEQ ID NO: 844538 - RNA, 19 nt, Human
aaaaacuuaguccagaaag

SEQ ID NO: 844539 - RNA, 22 nt, Human
ucuguaguagguuguaguucuu

SEQ ID NO: 844540 - RNA, 17 nt, Human
gccucugcuugugucau

SEQ ID NO: 844541 - RNA, 22 nt, Human
cuggccacaugugugcugagca

SEQ ID NO: 844542 - RNA, 22 nt, Human
uuugacauggaauaacucauuu

SEQ ID NO: 844543 - RNA, 22 nt, Human
aggucauuccagccauuccccu

SEQ ID NO: 844544 - RNA, 19 nt, Human
ccauggagagagaugcauu

SEQ ID NO: 844545 - RNA, 22 nt, Human
gaaaaaugagcugaugucaggg

SEQ ID NO: 844546 - RNA, 22 nt, Human
aagagguaaccauagcaaccac

SEQ ID NO: 844547 - RNA, 22 nt, Human
ugggcuggcguggagaguuuag

SEQ ID NO: 844548 - RNA, 22 nt, Human
ccagcucuggcuucuugcuggg

SEQ ID NO: 844549 - RNA, 22 nt, Human
uacauggugguggcacuugacu

SEQ ID NO: 844550 - RNA, 22 nt, Human
ugcaccccauuuuacauuuaca

SEQ ID NO: 844551 - RNA, 22 nt, Human
cagcagggggcagcgcagauca

SEQ ID NO: 844552 - RNA, 22 nt, Human
uccaggagugauaaggccacug

SEQ ID NO: 844553 - RNA, 22 nt, Human
cagcagagacgguaagcagaac

SEQ ID NO: 844554 - RNA, 22 nt, Human
ccaggaggcagagguuacagug

SEQ ID NO: 844555 - RNA, 22 nt, Human
ugcucagacaagcugaacagua

SEQ ID NO: 844556 - RNA, 22 nt, Human
ccuggaaggcaggcauggauug

SEQ ID NO: 844557 - RNA, 22 nt, Human
gcucagccgaacuucagagcag

SEQ ID NO: 844558 - RNA, 22 nt, Human
uccugucugcucacagagcugg

SEQ ID NO: 844559 - RNA, 22 nt, Human
cuggguggcuguccagccagcc

SEQ ID NO: 844560 - RNA, 22 nt, Human
gggcacugaaugccaagcuagg

SEQ ID NO: 844561 - RNA, 22 nt, Human
agugacucacuagcucucagug

SEQ ID NO: 844562 - RNA, 22 nt, Human
uuguauuagcuguaaauuuucu

SEQ ID NO: 844563 - RNA, 22 nt, Human
aaauugugagcuauagaucuag

SEQ ID NO: 844564 - RNA, 22 nt, Human
ucccaaggcacagggcagggac

SEQ ID NO: 844565 - RNA, 22 nt, Human
ugggggacugcacuggcgucag

SEQ ID NO: 844566 - RNA, 22 nt, Human
gccuggcaggccugggccagca

SEQ ID NO: 844567 - RNA, 22 nt, Human
uggccucuuaggacauccucua

SEQ ID NO: 844568 - RNA, 22 nt, Human
acauguaaaaggaacaugcaug

SEQ ID NO: 844569 - RNA, 22 nt, Human
ccucuccaguuuuaacgugacc

SEQ ID NO: 844570 - RNA, 21 nt, Human
aggucagcccagcucuggaag

SEQ ID NO: 844571 - RNA, 21 nt, Human
aaugcauuaacauaaagcuga

SEQ ID NO: 844572 - RNA, 19 nt, Human
ccuggcccugcugcgcggg

SEQ ID NO: 844573 - RNA, 22 nt, Human
gcugccugaagugucuacacug

SEQ ID NO: 844574 - RNA, 22 nt, Human
acagagaugcaaguguguauuu

SEQ ID NO: 844575 - RNA, 22 nt, Human
gggcuggcaggaccugggcuga

SEQ ID NO: 844576 - RNA, 22 nt, Human
ucaaaugcggucauggcuuuua

SEQ ID NO: 844577 - RNA, 22 nt, Human
ugacagaaagaauaugucaauc

SEQ ID NO: 844578 - RNA, 18 nt, Human
auggucucauacugggag

SEQ ID NO: 844579 - RNA, 22 nt, Human
acuggaucuaauugguuauagu

SEQ ID NO: 844580 - RNA, 22 nt, Human
guauuuauaggggaaugagagu

SEQ ID NO: 844581 - RNA, 22 nt, Human
auggccugggcccgcuucagau

SEQ ID NO: 844582 - RNA, 22 nt, Human
cagcugccuguauuguccucau

SEQ ID NO: 844583 - RNA, 22 nt, Human
acaauucucucauaucuuauua

SEQ ID NO: 844584 - RNA, 22 nt, Human
agcagaacugaugagacuugag

SEQ ID NO: 844585 - RNA, 22 nt, Human
acauucacgcucucaaagcuga

SEQ ID NO: 844586 - RNA, 22 nt, Human
ugugucagagguagagauggca

SEQ ID NO: 844587 - RNA, 22 nt, Human
cagcuucucagaaagcugaggu

SEQ ID NO: 844588 - RNA, 22 nt, Human
uggcccucagucuugcuccugc

SEQ ID NO: 844589 - RNA, 22 nt, Human
aaggcagcccuggcucagccug

SEQ ID NO: 844590 - RNA, 22 nt, Human
uucuucaacaaggacacuguua

SEQ ID NO: 844591 - RNA, 22 nt, Human
cauucacaaagcugauugaugg

SEQ ID NO: 844592 - RNA, 22 nt, Human
accaaggagccacauacaaccu

SEQ ID NO: 844593 - RNA, 22 nt, Human
aggguauguuuuuaucuacugu

SEQ ID NO: 844594 - RNA, 22 nt, Human
cugcugugcuuguggccacccg

SEQ ID NO: 844595 - RNA, 22 nt, Human
ucauaaaucauacuccauuugc

SEQ ID NO: 844596 - RNA, 20 nt, Human
cagaggcauuuucagacucu

SEQ ID NO: 844597 - RNA, 22 nt, Human
ccuucugcuggucaucccagug

SEQ ID NO: 844598 - RNA, 22 nt, Human
agccaggggauucaucagggac

SEQ ID NO: 844599 - RNA, 22 nt, Human
ugaaggaaugagggaguggguc

SEQ ID NO: 844600 - RNA, 22 nt, Human
caaaguuuaaaguagauuucag

SEQ ID NO: 844601 - RNA, 22 nt, Human
aaguaaauaucuguuuauagca

SEQ ID NO: 844602 - RNA, 22 nt, Human
cagagcuggagggaacccuggc

SEQ ID NO: 844603 - RNA, 22 nt, Human
aaguuuaagguggaaguggugg

SEQ ID NO: 844604 - RNA, 22 nt, Human
gcugcccagcaggccccagggg

SEQ ID NO: 844605 - RNA, 22 nt, Human
gaggaguggaguugcuggguug

SEQ ID NO: 844606 - RNA, 22 nt, Human
cagagcaggcccacugcccucc

SEQ ID NO: 844607 - RNA, 22 nt, Human
uaaagcacauaucuuacaauaa

SEQ ID NO: 844608 - RNA, 22 nt, Human
gcaggugggggucggugcaucu

SEQ ID NO: 844609 - RNA, 17 nt, Human
ugagaaguaggcaucau

SEQ ID NO: 844610 - RNA, 22 nt, Human
gcaggccagcugugcagauggg

SEQ ID NO: 844611 - RNA, 22 nt, Human
uagcacaucuggcgcuuauagg

SEQ ID NO: 844612 - RNA, 22 nt, Human
agcaugaaagcauaggacaguc

SEQ ID NO: 844613 - RNA, 22 nt, Human
aggaagcuggugugaggaugaa

SEQ ID NO: 844614 - RNA, 22 nt, Human
aggagaggcucuaacucugugu

SEQ ID NO: 844615 - RNA, 22 nt, Human
aggccagagaggggaccagccu

SEQ ID NO: 844616 - RNA, 22 nt, Human
cugucacacugauaucaggcuu

SEQ ID NO: 844617 - RNA, 22 nt, Human
agggucugacuccucuggcaag

SEQ ID NO: 844618 - RNA, 22 nt, Human
ucugaagauuaccagcuaaaug

SEQ ID NO: 844619 - RNA, 22 nt, Human
cuguaugaguugggaauagaau

SEQ ID NO: 844620 - RNA, 22 nt, Human
augcugugucuagcaggaacac

SEQ ID NO: 844621 - RNA, 22 nt, Human
aaagcuaugaggcaugcauuuc

SEQ ID NO: 844622 - RNA, 22 nt, Human
auucugauaucuuauucuagcu

SEQ ID NO: 844623 - RNA, 22 nt, Human
ccucugccaccucccacgaggc

SEQ ID NO: 844624 - RNA, 22 nt, Human
ugcuguggcaguuuauguauag

SEQ ID NO: 844625 - RNA, 22 nt, Human
aucuggcucacuuagucuagga

SEQ ID NO: 844626 - RNA, 22 nt, Human
aguucucaagacaauuaccugu

SEQ ID NO: 844627 - RNA, 22 nt, Human
uuagauauguuuuugcuaaugc

SEQ ID NO: 844628 - RNA, 22 nt, Human
ggcucuggaaaguguccuugau

SEQ ID NO: 844629 - RNA, 22 nt, Human
auuuccauagagcgucucacag

SEQ ID NO: 844630 - RNA, 19 nt, Human
agcuggggcgguguguguu

SEQ ID NO: 844631 - RNA, 22 nt, Human
aauucauccaugaacaauucca

SEQ ID NO: 844632 - RNA, 22 nt, Human
aguggccagugcugcucugggg

SEQ ID NO: 844633 - RNA, 22 nt, Human
caggguggcacucagcgcaucu

SEQ ID NO: 844634 - RNA, 22 nt, Human
cugccuggggaaugugaggauu

SEQ ID NO: 844635 - RNA, 22 nt, Human
gcagagcuucuguccuucagga

SEQ ID NO: 844636 - RNA, 22 nt, Human
acugggaggcaucuggagcuga

SEQ ID NO: 844637 - RNA, 22 nt, Human
ggaggccaugaggcucuaggug

SEQ ID NO: 844638 - RNA, 22 nt, Human
cccuggaggcggagcuugcagu

SEQ ID NO: 844639 - RNA, 22 nt, Human
gcccaggagaggccagggcuga

SEQ ID NO: 844640 - RNA, 21 nt, Human
aagaagcaauuuauuggaagg

SEQ ID NO: 844641 - RNA, 22 nt, Human
agaccacagucaggcuccuggu

SEQ ID NO: 844642 - RNA, 22 nt, Human
caggaaagaaaugagaacacca

SEQ ID NO: 844643 - RNA, 22 nt, Human
acaccauacucauguugguucc

SEQ ID NO: 844644 - RNA, 22 nt, Human
agccuggagcuugaguuaugag

SEQ ID NO: 844645 - RNA, 22 nt, Human
ggccagaggccacagcuguguc

SEQ ID NO: 844646 - RNA, 22 nt, Human
gcccucugcuggccucaccucg

SEQ ID NO: 844647 - RNA, 22 nt, Human
agaaggaguguacaggucaugc

SEQ ID NO: 844648 - RNA, 22 nt, Human
acuuugcaaugggcagaaccca

SEQ ID NO: 844649 - RNA, 22 nt, Human
cugcacagagcagggcagacac

SEQ ID NO: 844650 - RNA, 22 nt, Human
auacaguauuaccuguucagga

SEQ ID NO: 844651 - RNA, 22 nt, Human
agccagcuguucuggggcagca

SEQ ID NO: 844652 - RNA, 22 nt, Human
gugggcuucuguuagggaggcu

SEQ ID NO: 844653 - RNA, 22 nt, Human
aaaugcaggaaauuaugcuuuu

SEQ ID NO: 844654 - RNA, 22 nt, Human
uggccuguggcuuaaggucugu

SEQ ID NO: 844655 - RNA, 20 nt, Human
agagccuggaaaaagacauc

SEQ ID NO: 844656 - RNA, 22 nt, Human
ucauacaauucaaucucugauu

SEQ ID NO: 844657 - RNA, 22 nt, Human
cucaggaucgcuugcccuaggg

SEQ ID NO: 844658 - RNA, 22 nt, Human
ccugccuggcuuccagaagaga

SEQ ID NO: 844659 - RNA, 22 nt, Human
uggccugguuguugcugccguu

SEQ ID NO: 844660 - RNA, 22 nt, Human
gagauuucuuuugaugccuguc

SEQ ID NO: 844661 - RNA, 22 nt, Human
ugaaaugagauagauaaucagg

SEQ ID NO: 844662 - RNA, 22 nt, Human
agaggcagaaguguucaaaccc

SEQ ID NO: 844663 - RNA, 22 nt, Human
uuuauccaguguuggaauuuuu

SEQ ID NO: 844664 - RNA, 22 nt, Human
aguggcagagugcacucaggca

SEQ ID NO: 844665 - RNA, 22 nt, Human
acagcaagccagcuugucacug

SEQ ID NO: 844666 - RNA, 22 nt, Human
ccaggagcuggagggugcagug

SEQ ID NO: 844667 - RNA, 22 nt, Human
gagccugggacugggggucaug

SEQ ID NO: 844668 - RNA, 21 nt, Human
ucugucugguuuuagaguggc

SEQ ID NO: 844669 - RNA, 22 nt, Human
guggcagagguuccucagugug

SEQ ID NO: 844670 - RNA, 22 nt, Human
aggcacuggucuaccccuuagu

SEQ ID NO: 844671 - RNA, 22 nt, Human
caggggcucugggugaugugag

SEQ ID NO: 844672 - RNA, 22 nt, Human
ggcacugggcaccggcugaggg

SEQ ID NO: 844673 - RNA, 22 nt, Human
uagagcuggaauuugcagcaag

SEQ ID NO: 844674 - RNA, 22 nt, Human
agaagaaacugucggggauauu

SEQ ID NO: 844675 - RNA, 22 nt, Human
ggccaagauggaaggagagaug

SEQ ID NO: 844676 - RNA, 22 nt, Human
guccaugauucugugacacccu

SEQ ID NO: 844677 - RNA, 22 nt, Human
uuaaauuuuagaaacagacucu

SEQ ID NO: 844678 - RNA, 19 nt, Human
agcuccugggcucugggcc

SEQ ID NO: 844679 - RNA, 19 nt, Human
aacuggauaauggccacau

SEQ ID NO: 844680 - RNA, 22 nt, Human
ucuggccugggccugccggugc

SEQ ID NO: 844681 - RNA, 22 nt, Human
ccugucaguugcugucagggau

SEQ ID NO: 844682 - RNA, 22 nt, Human
ccagcugguuaaaauagagaaa

SEQ ID NO: 844683 - RNA, 22 nt, Human
augcuuuacaguuuuccaaaca

SEQ ID NO: 844684 - RNA, 22 nt, Human
cacauuuaaagguugaagcuga

SEQ ID NO: 844685 - RNA, 22 nt, Human
aggccagcuguuacuagagcca

SEQ ID NO: 844686 - RNA, 22 nt, Human
uggcucuguuuuaugaguacca

SEQ ID NO: 844687 - RNA, 22 nt, Human
uuuccauguuggugaaaugagg

SEQ ID NO: 844688 - RNA, 22 nt, Human
uugcagcuucgagucuaucugu

SEQ ID NO: 844689 - RNA, 22 nt, Human
gggccuggggacaccaccauga

SEQ ID NO: 844690 - RNA, 22 nt, Human
gcaaguuauuuccauuuaaagc

SEQ ID NO: 844691 - RNA, 22 nt, Human
uagcuuuacaaagugcugcacc

SEQ ID NO: 844692 - RNA, 21 nt, Human
cacaggugggucagugaggcc

SEQ ID NO: 844693 - RNA, 22 nt, Human
uuccuguaguugugcaauguac

SEQ ID NO: 844694 - RNA, 22 nt, Human
cugggaggcagucucucuagaa

SEQ ID NO: 844695 - RNA, 22 nt, Human
ugguuuauuucucugaaagguu

SEQ ID NO: 844696 - RNA, 22 nt, Human
aggguggagggagucccugagc

SEQ ID NO: 844697 - RNA, 22 nt, Human
guguaugaacgaaagaauggau

SEQ ID NO: 844698 - RNA, 22 nt, Human
ucucagagugguggucccucug

SEQ ID NO: 844699 - RNA, 22 nt, Human
agggcagcagcuccuccuagcu

SEQ ID NO: 844700 - RNA, 22 nt, Human
cagggcagagggaaacuccuuu

SEQ ID NO: 844701 - RNA, 22 nt, Human
cugggcaguuuuacaucauugc

SEQ ID NO: 844702 - RNA, 22 nt, Human
guaucuuuuacaccaggaaauu

SEQ ID NO: 844703 - RNA, 22 nt, Human
agcaguggcuggauggugugcu

SEQ ID NO: 844704 - RNA, 22 nt, Human
aagugacaaaaggguauccaaa

SEQ ID NO: 844705 - RNA, 19 nt, Human
acuguaaggcauuuuuuuc

SEQ ID NO: 844706 - RNA, 22 nt, Human
ggugaagggccuuaggagacag

SEQ ID NO: 844707 - RNA, 22 nt, Human
gccuggagcuacuggacacuga

SEQ ID NO: 844708 - RNA, 19 nt, Human
acccagagcccuuugcagg

SEQ ID NO: 844709 - RNA, 22 nt, Human
agcagcagaggucagaaaggua

SEQ ID NO: 844710 - RNA, 22 nt, Human
ccugggucacucaggcaggcgg

SEQ ID NO: 844711 - RNA, 22 nt, Human
augcuguguccuagugaaagaa

SEQ ID NO: 844712 - RNA, 17 nt, Human
cuguuaauucauuuccc

SEQ ID NO: 844713 - RNA, 22 nt, Human
aaucuggcauuugagaguagga

SEQ ID NO: 844714 - RNA, 22 nt, Human
ucuggcucucucaucacccaau

SEQ ID NO: 844715 - RNA, 22 nt, Human
agcugccaccucugccuuuggg

SEQ ID NO: 844716 - RNA, 22 nt, Human
uccaggagguagugcuuaauuu

SEQ ID NO: 844717 - RNA, 22 nt, Human
aaaguuaguuucuuauaugucu

SEQ ID NO: 844718 - RNA, 21 nt, Human
gccaggaguagauuacauuua

SEQ ID NO: 844719 - RNA, 22 nt, Human
ucugauuagcaguuuagggaaa

SEQ ID NO: 844720 - RNA, 22 nt, Human
agggacacacuccaguguuauu

SEQ ID NO: 844721 - RNA, 22 nt, Human
uccugggccuguacuccauccg

SEQ ID NO: 844722 - RNA, 17 nt, Human
gccaggagguuugagcu

SEQ ID NO: 844723 - RNA, 22 nt, Human
ccagggcagcgccccuccacgc

SEQ ID NO: 844724 - RNA, 22 nt, Human
uuauguacucugcaauguuuga

SEQ ID NO: 844725 - RNA, 22 nt, Human
gucucagaccacccucuuuggc

SEQ ID NO: 844726 - RNA, 22 nt, Human
cccaggagacauauagaaggac

SEQ ID NO: 844727 - RNA, 22 nt, Human
uucuacaauaugaauaaugaag

SEQ ID NO: 844728 - RNA, 22 nt, Human
uuucaugugcaauuagcaauau

SEQ ID NO: 844729 - RNA, 22 nt, Human
ucccagcauuaaugccugucag

SEQ ID NO: 844730 - RNA, 22 nt, Human
cuucacauguuggaguccuuug

SEQ ID NO: 844731 - RNA, 22 nt, Human
caugcacaacauacucaagagg

SEQ ID NO: 844732 - RNA, 22 nt, Human
cucccugguguccccuccagga

SEQ ID NO: 844733 - RNA, 22 nt, Human
cccaaggcauggcaugguggca

SEQ ID NO: 844734 - RNA, 22 nt, Human
uggcagggucuugcuguguugc

SEQ ID NO: 844735 - RNA, 22 nt, Human
gccuucugauugcuggacugac

SEQ ID NO: 844736 - RNA, 22 nt, Human
cugccaggcgauggauuggcug

SEQ ID NO: 844737 - RNA, 22 nt, Human
ugcugucccccgugucugggcu

SEQ ID NO: 844738 - RNA, 21 nt, Human
uggagcugaauuuuuggcauc

SEQ ID NO: 844739 - RNA, 22 nt, Human
gggcagcuggauaguuuuaaau

SEQ ID NO: 844740 - RNA, 22 nt, Human
auuucuuccucugucaguaacu

SEQ ID NO: 844741 - RNA, 22 nt, Human
gcugcucucucccuaaguuggg

SEQ ID NO: 844742 - RNA, 15 nt, Human
aaucuggcggcaagu

SEQ ID NO: 844743 - RNA, 19 nt, Human
cuguccuuggcugcacugu

SEQ ID NO: 844744 - RNA, 22 nt, Human
ugguaucagagccaucuguauu

SEQ ID NO: 844745 - RNA, 22 nt, Human
cuucuucaucuguaaaacuugg

SEQ ID NO: 844746 - RNA, 22 nt, Human
gcccaggaagugacucagaugu

SEQ ID NO: 844747 - RNA, 22 nt, Human
acagggucauuuuaugaucugu

SEQ ID NO: 844748 - RNA, 22 nt, Human
ggcugccucaaagcucaagcuc

SEQ ID NO: 844749 - RNA, 22 nt, Human
cagggcccauggcucagguagg

SEQ ID NO: 844750 - RNA, 22 nt, Human
ggcagcaguccauggcccaagg

SEQ ID NO: 844751 - RNA, 22 nt, Human
ugucccagaucacaggagggga

SEQ ID NO: 844752 - RNA, 22 nt, Human
acagccagggcauugucgccga

SEQ ID NO: 844753 - RNA, 22 nt, Human
gcucugagucucagcuaccaca

SEQ ID NO: 844754 - RNA, 22 nt, Human
cucucuggaagggggagcugau

SEQ ID NO: 844755 - RNA, 20 nt, Human
agcugaggcaccugagguua

SEQ ID NO: 844756 - RNA, 22 nt, Human
uuaauuuauguccaaaccagau

SEQ ID NO: 844757 - RNA, 22 nt, Human
ugccuggaaggcccaugggaag

SEQ ID NO: 844758 - RNA, 22 nt, Human
ggcugggagcuggacaggccgg

SEQ ID NO: 844759 - RNA, 22 nt, Human
agcagccauccuuagagaaaga

SEQ ID NO: 844760 - RNA, 22 nt, Human
ccagggcaauaggaacacuuuu

SEQ ID NO: 844761 - RNA, 22 nt, Human
uuggaggcaaugggaaggaggc

SEQ ID NO: 844762 - RNA, 22 nt, Human
ggcagcugaccuagcaccaucc

SEQ ID NO: 844763 - RNA, 22 nt, Human
gaagaacacuucaugauucauu

SEQ ID NO: 844764 - RNA, 22 nt, Human
cucaggggaccuggcuccgagu

SEQ ID NO: 844765 - RNA, 22 nt, Human
ugucaccaugcgaggcuaauuu

SEQ ID NO: 844766 - RNA, 22 nt, Human
auauucuucuuguucagacuau

SEQ ID NO: 844767 - RNA, 22 nt, Human
cacugcuuucacaguuuguucc

SEQ ID NO: 844768 - RNA, 23 nt, Human
uaugaacugcauugcuggugugu

SEQ ID NO: 844769 - RNA, 22 nt, Human
guccucugcuucaugcccugau

SEQ ID NO: 844770 - RNA, 22 nt, Human
aucauucuagcuguuguguuga

SEQ ID NO: 844771 - RNA, 22 nt, Human
ggcagcagcaagguuggagcug

SEQ ID NO: 844772 - RNA, 22 nt, Human
aaauuucaguuaccuuuacguu

SEQ ID NO: 844773 - RNA, 22 nt, Human
ccagggugaggaggcucccacg

SEQ ID NO: 844774 - RNA, 22 nt, Human
gaaacugugaucguguucuggg

SEQ ID NO: 844775 - RNA, 22 nt, Human
cacauuucugugagucaauauu

SEQ ID NO: 844776 - RNA, 22 nt, Human
gaauuucauuuguuuccuacca

SEQ ID NO: 844777 - RNA, 22 nt, Human
aaggagaguacaggaguuggua

SEQ ID NO: 844778 - RNA, 19 nt, Human
cagucccaaauucuuguca

SEQ ID NO: 844779 - RNA, 22 nt, Human
agagcagauggagcuggaagag

SEQ ID NO: 844780 - RNA, 22 nt, Human
agcagagcggggccuccggaag

SEQ ID NO: 844781 - RNA, 22 nt, Human
agcagcugggcucagagcuggg

SEQ ID NO: 844782 - RNA, 22 nt, Human
cuguuuauacgacagguggagg

SEQ ID NO: 844783 - RNA, 22 nt, Human
uaugaacuguaacccucaccgc

SEQ ID NO: 844784 - RNA, 20 nt, Human
cagagccaagagcagcaucu

SEQ ID NO: 844785 - RNA, 22 nt, Human
ggcccuguuagagcucccacaa

SEQ ID NO: 844786 - RNA, 22 nt, Human
gccagagccacuuuugggugau

SEQ ID NO: 844787 - RNA, 22 nt, Human
gggcuucucuuaugcuaacugg

SEQ ID NO: 844788 - RNA, 22 nt, Human
uccuuucccuuuccauccuggc

SEQ ID NO: 844789 - RNA, 22 nt, Human
agcauuuagucuuuauugcagc

SEQ ID NO: 844790 - RNA, 22 nt, Human
aauaucagcacuuuugugguau

SEQ ID NO: 844791 - RNA, 22 nt, Human
ugccaggcauauggccucuuug

SEQ ID NO: 844792 - RNA, 22 nt, Human
uuucaacuagccccuaaguccu

SEQ ID NO: 844793 - RNA, 22 nt, Human
agauaaugaaugccaugacauu

SEQ ID NO: 844794 - RNA, 22 nt, Human
caagagcuggagaggcagucua

SEQ ID NO: 844795 - RNA, 22 nt, Human
uuucauugaugggugauagaaa

SEQ ID NO: 844796 - RNA, 22 nt, Human
agccuggaggaggaguugagca

SEQ ID NO: 844797 - RNA, 22 nt, Human
uguuuauaccuugguauaacca

SEQ ID NO: 844798 - RNA, 22 nt, Human
ugcuucaggagaugucaccaug

SEQ ID NO: 844799 - RNA, 22 nt, Human
agcuguccuggcucaggcugug

SEQ ID NO: 844800 - RNA, 22 nt, Human
cccugagaugccucacccuagu

SEQ ID NO: 844801 - RNA, 22 nt, Human
ccaggggcuggugcugagcugg

SEQ ID NO: 844802 - RNA, 22 nt, Human
uuaugacauaugaguacaagua

SEQ ID NO: 844803 - RNA, 22 nt, Human
cuuccugguuugaagcucgccg

SEQ ID NO: 844804 - RNA, 19 nt, Human
ccucugcgcuguccugcuc

SEQ ID NO: 844805 - RNA, 22 nt, Human
uacagcauguccuuagcaaggc

SEQ ID NO: 844806 - RNA, 22 nt, Human
gagguucacaggcuaucacagu

SEQ ID NO: 844807 - RNA, 22 nt, Human
uuugguccugagcaaaacuaug

SEQ ID NO: 844808 - RNA, 22 nt, Human
uuauuuaaugugaucugaagag

SEQ ID NO: 844809 - RNA, 22 nt, Human
auucacagaauaguuuuaccag

SEQ ID NO: 844810 - RNA, 22 nt, Human
ccaaaugcuccacugacuuugg

SEQ ID NO: 844811 - RNA, 22 nt, Human
gaaacauacgauuuaggagaaa

SEQ ID NO: 844812 - RNA, 22 nt, Human
gagguggccucaagcagucuuc

SEQ ID NO: 844813 - RNA, 23 nt, Human
cccagcgcugagcccugcaggca

SEQ ID NO: 844814 - RNA, 22 nt, Human
ccuguucauuuguauuugucuu

SEQ ID NO: 844815 - RNA, 22 nt, Human
uucaugaaaguguaucuugugg

SEQ ID NO: 844816 - RNA, 22 nt, Human
uccuggauaucaaacaaacauu

SEQ ID NO: 844817 - RNA, 22 nt, Human
uagcugccuuugggcuccugcu

SEQ ID NO: 844818 - RNA, 22 nt, Human
cuggcccauggugagcucuggg

SEQ ID NO: 844819 - RNA, 22 nt, Human
cccaggcagccugcagggaagg

SEQ ID NO: 844820 - RNA, 22 nt, Human
ugcuggggauccguaccaaccc

SEQ ID NO: 844821 - RNA, 21 nt, Human
agccuggcccagggggaggcu

SEQ ID NO: 844822 - RNA, 22 nt, Human
ucuucagagacucugagccccu

SEQ ID NO: 844823 - RNA, 22 nt, Human
aauuucaaguggcaucuuugau

SEQ ID NO: 844824 - RNA, 22 nt, Human
auaaaugauucagcaggaaaua

SEQ ID NO: 844825 - RNA, 22 nt, Human
aggucacacaacugucagaggc

SEQ ID NO: 844826 - RNA, 22 nt, Human
acaaggcugaacagugaagccg

SEQ ID NO: 844827 - RNA, 22 nt, Human
aggagucauugagagggguccu

SEQ ID NO: 844828 - RNA, 23 nt, Human
uguaacaauuucauauacaugca

SEQ ID NO: 844829 - RNA, 22 nt, Human
cagccuccugggacacucaccg

SEQ ID NO: 844830 - RNA, 22 nt, Human
auuucagaugaccaaauggaaa

SEQ ID NO: 844831 - RNA, 22 nt, Human
ccuuugggugaauuccucucuu

SEQ ID NO: 844832 - RNA, 22 nt, Human
cuucaagauccauagauauugc

SEQ ID NO: 844833 - RNA, 21 nt, Human
cauuuacaugacagauugguu

SEQ ID NO: 844834 - RNA, 22 nt, Human
aaaugcuacauacacaucaggg

SEQ ID NO: 844835 - RNA, 22 nt, Human
ugcaagcacucaaugcaaacag

SEQ ID NO: 844836 - RNA, 22 nt, Human
cccaggagccaucugucuuggc

SEQ ID NO: 844837 - RNA, 22 nt, Human
ccaggacuuauuacaguauaac

SEQ ID NO: 844838 - RNA, 22 nt, Human
gagcagcuggacaggccucccu

SEQ ID NO: 844839 - RNA, 22 nt, Human
gugaggugggcuggccagagac

SEQ ID NO: 844840 - RNA, 22 nt, Human
gcagcugggccccagccucucc

SEQ ID NO: 844841 - RNA, 22 nt, Human
uacaaaugaaccaacuuugaug

SEQ ID NO: 844842 - RNA, 22 nt, Human
ugucaugcagguuuguuauaga

SEQ ID NO: 844843 - RNA, 21 nt, Human
ugaaaugagaaugcugagcac

SEQ ID NO: 844844 - RNA, 23 nt, Human
cagaagcaccuguugacugcugc

SEQ ID NO: 844845 - RNA, 22 nt, Human
uggccugauuuugcuaagagaa

SEQ ID NO: 844846 - RNA, 22 nt, Human
gcuuccuaaaugcacagggcag

SEQ ID NO: 844847 - RNA, 22 nt, Human
aguaaacauaauuuaccuguag

SEQ ID NO: 844848 - RNA, 22 nt, Human
ccagcuccucuucccaguguca

SEQ ID NO: 844849 - RNA, 22 nt, Human
uguaugcagcaaaacaauuagu

SEQ ID NO: 844850 - RNA, 22 nt, Human
ggccuuggugccauggccaguu

SEQ ID NO: 844851 - RNA, 22 nt, Human
ggauccuuaacuaucacaguga

SEQ ID NO: 844852 - RNA, 22 nt, Human
cugucagcacucuacuacagau

SEQ ID NO: 844853 - RNA, 22 nt, Human
uccacugcagcuucugauggaa

SEQ ID NO: 844854 - RNA, 22 nt, Human
caguucuuuguggggaguucuc

SEQ ID NO: 844855 - RNA, 22 nt, Human
uauccaauucaccauugauggg

SEQ ID NO: 844856 - RNA, 22 nt, Human
gaucagaauuuacuuauaauug

SEQ ID NO: 844857 - RNA, 20 nt, Human
uccugagauuuaagggguuc

SEQ ID NO: 844858 - RNA, 21 nt, Human
auacacauacacauaaaugug

SEQ ID NO: 844859 - RNA, 22 nt, Human
cugggccugucagggcuuuuug

SEQ ID NO: 844860 - RNA, 22 nt, Human
cagagccauccaggugccuguu

SEQ ID NO: 844861 - RNA, 22 nt, Human
ccuuuaauuuacaauguuaauu

SEQ ID NO: 844862 - RNA, 22 nt, Human
uaugacauugcuuuuuagaacu

SEQ ID NO: 844863 - RNA, 22 nt, Human
gucaggggccaugggccaagga

SEQ ID NO: 844864 - RNA, 22 nt, Human
aagaacauuuuguagaaugaca

SEQ ID NO: 844865 - RNA, 22 nt, Human
uacaaaguauauuucuagcugu

SEQ ID NO: 844866 - RNA, 22 nt, Human
uggcagcuagcuguuuucaugc

SEQ ID NO: 844867 - RNA, 17 nt, Human
agcagcugaagcagcca

SEQ ID NO: 844868 - RNA, 20 nt, Human
ccagcugagccaaggggaga

SEQ ID NO: 844869 - RNA, 22 nt, Human
uucaagauaauaggaaugaaaa

SEQ ID NO: 844870 - RNA, 22 nt, Human
cgcagggauuucaaggggccuu

SEQ ID NO: 844871 - RNA, 20 nt, Human
aucuucuuggccagcuugcu

SEQ ID NO: 844872 - RNA, 22 nt, Human
gaaauauacauugcaggaagag

SEQ ID NO: 844873 - RNA, 22 nt, Human
cuccucuggcuuccuggaggca

SEQ ID NO: 844874 - RNA, 22 nt, Human
aucagaaauagucauguuacuu

SEQ ID NO: 844875 - RNA, 22 nt, Human
uccuugaagaaugauucuugga

SEQ ID NO: 844876 - RNA, 22 nt, Human
ugaagcaggaaacuucuuguuu

SEQ ID NO: 844877 - RNA, 22 nt, Human
ucuguucaguuguaccuucccc

SEQ ID NO: 844878 - RNA, 22 nt, Human
aaggcacuagcagaauuaguga

SEQ ID NO: 844879 - RNA, 22 nt, Human
gagcuggcaggaggcuccccga

SEQ ID NO: 844880 - RNA, 20 nt, Human
agugccagggcaggugagag

SEQ ID NO: 844881 - RNA, 22 nt, Human
auaugcauaugucaaaacuuau

SEQ ID NO: 844882 - RNA, 22 nt, Human
agagacaggguuuugucguguu

SEQ ID NO: 844883 - RNA, 22 nt, Human
agccugagagccaagcugugca

SEQ ID NO: 844884 - RNA, 22 nt, Human
ccugggcaggaugggcccggug

SEQ ID NO: 844885 - RNA, 22 nt, Human
ggagacaguauggcuuguagcu

SEQ ID NO: 844886 - RNA, 22 nt, Human
ucugagaggcagaccuuccuaa

SEQ ID NO: 844887 - RNA, 22 nt, Human
gaguccuuuucauagcaguggg

SEQ ID NO: 844888 - RNA, 22 nt, Human
gaguuauuggguggaaagguag

SEQ ID NO: 844889 - RNA, 22 nt, Human
cuggacucugcagagaaaagua

SEQ ID NO: 844890 - RNA, 22 nt, Human
acagaaugggauuugaauauuu

SEQ ID NO: 844891 - RNA, 22 nt, Human
gcagggucuugagaggcagcca

SEQ ID NO: 844892 - RNA, 22 nt, Human
uauauguaagcuauguaagagu

SEQ ID NO: 844893 - RNA, 22 nt, Human
caggcagcugacugucagauau

SEQ ID NO: 844894 - RNA, 22 nt, Human
gcuccagguauuugcccuuuua

SEQ ID NO: 844895 - RNA, 22 nt, Human
gggcuucucccuaaggacucug

SEQ ID NO: 844896 - RNA, 22 nt, Human
cauagcuuagggguuaaacuca

SEQ ID NO: 844897 - RNA, 22 nt, Human
ccucaggcuuacgggcaaugga

SEQ ID NO: 844898 - RNA, 22 nt, Human
aggggaggagcuuuucuugccu

SEQ ID NO: 844899 - RNA, 22 nt, Human
ugugcaggugcaggaagggggc

SEQ ID NO: 844900 - RNA, 22 nt, Human
auguuugacugaguuuggcaga

SEQ ID NO: 844901 - RNA, 22 nt, Human
cacucugagaaguacaagcucc

SEQ ID NO: 844902 - RNA, 22 nt, Human
ugaggcagcccacuuuccuuag

SEQ ID NO: 844903 - RNA, 21 nt, Human
ucacaugcccauuacuggagc

SEQ ID NO: 844904 - RNA, 22 nt, Human
ucaucuugcugccauugcuuua

SEQ ID NO: 844905 - RNA, 22 nt, Human
ggggcagccuccaggaaagcug

SEQ ID NO: 844906 - RNA, 22 nt, Human
ccuggcaguuuugcccaggauu

SEQ ID NO: 844907 - RNA, 22 nt, Human
ccugacucuggccaggccagcu

SEQ ID NO: 844908 - RNA, 22 nt, Human
ucucuggaguauaaccagggau

SEQ ID NO: 844909 - RNA, 22 nt, Human
caggauccccaggucgccgucc

SEQ ID NO: 844910 - RNA, 22 nt, Human
agcugccaaguuucucaguuua

SEQ ID NO: 844911 - RNA, 22 nt, Human
ggucauuguucuuuucugugau

SEQ ID NO: 844912 - RNA, 22 nt, Human
uaauuauaacaguuacaucuua

SEQ ID NO: 844913 - RNA, 22 nt, Human
uuucagaaccgcuaaaauaaau

SEQ ID NO: 844914 - RNA, 22 nt, Human
ggccuggcauggggacuaaggg

SEQ ID NO: 844915 - RNA, 22 nt, Human
aagccagguguuuaggccagcg

SEQ ID NO: 844916 - RNA, 22 nt, Human
ucagagugguagccuauuuucu

SEQ ID NO: 844917 - RNA, 22 nt, Human
cagcugacuucauaggaagaca

SEQ ID NO: 844918 - RNA, 22 nt, Human
aaguugaagcaugaaccaaggu

SEQ ID NO: 844919 - RNA, 22 nt, Human
cccagcucugcagaccugcccu

SEQ ID NO: 844920 - RNA, 22 nt, Human
ugugcugguacaugugaggaug

SEQ ID NO: 844921 - RNA, 22 nt, Human
agagauucauguuuacuguagg

SEQ ID NO: 844922 - RNA, 22 nt, Human
agauacauuguucuaagcauug

SEQ ID NO: 844923 - RNA, 23 nt, Human
uggcuggcagaaacugaagcaug

SEQ ID NO: 844924 - RNA, 22 nt, Human
agagauaugaguaguugugaca

SEQ ID NO: 844925 - RNA, 20 nt, Human
uacuugaauguugcagcagu

SEQ ID NO: 844926 - RNA, 22 nt, Human
gccagaaacauacacaucacuu

SEQ ID NO: 844927 - RNA, 22 nt, Human
ugaagcaggcauugacugauga

SEQ ID NO: 844928 - RNA, 22 nt, Human
uggcucuguucgccaucaggag

SEQ ID NO: 844929 - RNA, 22 nt, Human
augcuuaacucuguacauaguu

SEQ ID NO: 844930 - RNA, 22 nt, Human
ucaaauaccagcuuuuccagaa

SEQ ID NO: 844931 - RNA, 22 nt, Human
cauuugaauuguucugugggaa

SEQ ID NO: 844932 - RNA, 22 nt, Human
cuucuugcaauuuucaucuuau

SEQ ID NO: 844933 - RNA, 22 nt, Human
agcagaaccugcagaccugucu

SEQ ID NO: 844934 - RNA, 22 nt, Human
uccugagagcagaguccaggug

SEQ ID NO: 844935 - RNA, 22 nt, Human
gugucaugggguuuguuauaca

SEQ ID NO: 844936 - RNA, 22 nt, Human
agaacuuaggaacaacagcuua

SEQ ID NO: 844937 - RNA, 20 nt, Human
agccugccagcuggcccaga

SEQ ID NO: 844938 - RNA, 22 nt, Human
accucugccacuuucuaacucu

SEQ ID NO: 844939 - RNA, 22 nt, Human
uugcaggaaacugagugugagc

SEQ ID NO: 844940 - RNA, 22 nt, Human
aggcuucuuagauuggcuggag

SEQ ID NO: 844941 - RNA, 22 nt, Human
aaaaaucacuuuuauaggcagc

SEQ ID NO: 844942 - RNA, 22 nt, Human
gucuggaguggggccugagaau

SEQ ID NO: 844943 - RNA, 22 nt, Human
cuacugaguccuucagcugcca

SEQ ID NO: 844944 - RNA, 22 nt, Human
ggccagaaguuggaaaagagcc

SEQ ID NO: 844945 - RNA, 22 nt, Human
aggcuggggaauugaauuugcu

SEQ ID NO: 844946 - RNA, 22 nt, Human
uuccagaagccuccauauuacu

SEQ ID NO: 844947 - RNA, 22 nt, Human
cucagcagcagggaagagguca

SEQ ID NO: 844948 - RNA, 22 nt, Human
cucagagucugcauuucuguca

SEQ ID NO: 844949 - RNA, 22 nt, Human
ccugccugcggcccgcggggag

SEQ ID NO: 844950 - RNA, 22 nt, Human
cugcccugggaguaccuguccu

SEQ ID NO: 844951 - RNA, 22 nt, Human
uaauaguuaugguugguucuca

SEQ ID NO: 844952 - RNA, 20 nt, Human
ggcagagcuaugucuguugc

SEQ ID NO: 844953 - RNA, 22 nt, Human
aaguguuaaaagauuaaaugcu

SEQ ID NO: 844954 - RNA, 22 nt, Human
uagcagggaagaugaucagaau

SEQ ID NO: 844955 - RNA, 22 nt, Human
cagccuguagaauacaguaaau

SEQ ID NO: 844956 - RNA, 22 nt, Human
caugagauaauuuuucuccagu

SEQ ID NO: 844957 - RNA, 20 nt, Human
cucucuggaaggugggagcc

SEQ ID NO: 844958 - RNA, 22 nt, Human
gucagaggggcagcugccaggc

SEQ ID NO: 844959 - RNA, 22 nt, Human
cagggcuccccgcaccgcagcc

SEQ ID NO: 844960 - RNA, 22 nt, Human
acauuucucauaggagagccac

SEQ ID NO: 844961 - RNA, 22 nt, Human
gggcugcugccaccagguggau

SEQ ID NO: 844962 - RNA, 22 nt, Human
gucccagaggcuuuggccacag

SEQ ID NO: 844963 - RNA, 22 nt, Human
aggcccaguuauccuacuuguu

SEQ ID NO: 844964 - RNA, 22 nt, Human
agccucucuguuagucacuggg

SEQ ID NO: 844965 - RNA, 20 nt, Human
aaaauauguauaacucuucu

SEQ ID NO: 844966 - RNA, 22 nt, Human
gcuguucacaucuggaccauuu

SEQ ID NO: 844967 - RNA, 22 nt, Human
aucugcaggaaugugugcagag

SEQ ID NO: 844968 - RNA, 22 nt, Human
uuccaugugaguacacugugau

SEQ ID NO: 844969 - RNA, 18 nt, Human
gugacagcugcuagcuca

SEQ ID NO: 844970 - RNA, 22 nt, Human
uaaaugcaaugugcuuuaccag

SEQ ID NO: 844971 - RNA, 22 nt, Human
auacauacauguaugcacauac

SEQ ID NO: 844972 - RNA, 22 nt, Human
cuggccuggggccucagcugcu

SEQ ID NO: 844973 - RNA, 19 nt, Human
auagucuuuccaauuauac

SEQ ID NO: 844974 - RNA, 22 nt, Human
gcacugaaauuauaugcauuug

SEQ ID NO: 844975 - RNA, 22 nt, Human
uaagaaucuauuaggaauaugu

SEQ ID NO: 844976 - RNA, 22 nt, Human
ugcauuaugcuacccagaagcu

SEQ ID NO: 844977 - RNA, 22 nt, Human
uacauuguucaugcaugagaaa

SEQ ID NO: 844978 - RNA, 22 nt, Human
aucuuucuccauauacaucuuu

SEQ ID NO: 844979 - RNA, 22 nt, Human
auggagggugguaagacagaga

SEQ ID NO: 844980 - RNA, 22 nt, Human
gaaauuuauuaucuacaucauu

SEQ ID NO: 844981 - RNA, 23 nt, Human
ucuguucaaggcuuucuccuuga

SEQ ID NO: 844982 - RNA, 22 nt, Human
aaguccuuggagaauagaaagg

SEQ ID NO: 844983 - RNA, 22 nt, Human
gauaaaauauguggccuuuagu

SEQ ID NO: 844984 - RNA, 22 nt, Human
cugugccuuuguagcugugccu

SEQ ID NO: 844985 - RNA, 22 nt, Human
gcugccugaucauacaccaggg

SEQ ID NO: 844986 - RNA, 22 nt, Human
aacuacauuguccuuucugaag

SEQ ID NO: 844987 - RNA, 22 nt, Human
ucaacagaagugauagcuauua

SEQ ID NO: 844988 - RNA, 20 nt, Human
uuucaguugguuaauggcau

SEQ ID NO: 844989 - RNA, 22 nt, Human
caucaaauggcaagugaaagcu

SEQ ID NO: 844990 - RNA, 22 nt, Human
ucuuugcagaauuuaacuuugc

SEQ ID NO: 844991 - RNA, 22 nt, Human
uuuuugaaggcugaugugauua

SEQ ID NO: 844992 - RNA, 22 nt, Human
ucuggagcuuccucauuuacag

SEQ ID NO: 844993 - RNA, 22 nt, Human
acuauacaccaaaauauuaagg

SEQ ID NO: 844994 - RNA, 19 nt, Human
uuccuuagaggaggcggug

SEQ ID NO: 844995 - RNA, 22 nt, Human
uggagcaggugccaggugugug

SEQ ID NO: 844996 - RNA, 22 nt, Human
ggcaugggagugagcaaccuua

SEQ ID NO: 844997 - RNA, 19 nt, Human
uccauaaugaagauagagg

SEQ ID NO: 844998 - RNA, 22 nt, Human
uuggccuucccuaccugggcca

SEQ ID NO: 844999 - RNA, 22 nt, Human
acauguuagaaaugcagaaucu

SEQ ID NO: 845000 - RNA, 22 nt, Human
caaaguuuggcucucaugacau

SEQ ID NO: 845001 - RNA, 22 nt, Human
agcugguggauuaugcuguaca

SEQ ID NO: 845002 - RNA, 22 nt, Human
gcagaggagaugaagauacuuu

SEQ ID NO: 845003 - RNA, 22 nt, Human
ucuggcucuccagugcucuuag

SEQ ID NO: 845004 - RNA, 22 nt, Human
cgggcagaucacacagggcuug

SEQ ID NO: 845005 - RNA, 22 nt, Human
aaucaagucaaccaucaugugc

SEQ ID NO: 845006 - RNA, 22 nt, Human
cagggccauuggcguggcuguc

SEQ ID NO: 845007 - RNA, 22 nt, Human
ucauuuguugcuguuaccugag

SEQ ID NO: 845008 - RNA, 22 nt, Human
aaaguguggagauugaacuaaa

SEQ ID NO: 845009 - RNA, 22 nt, Human
ucuucaucucagauuaacagga

SEQ ID NO: 845010 - RNA, 22 nt, Human
gcagaggauagcauaugaaccu

SEQ ID NO: 845011 - RNA, 22 nt, Human
aacuuuaaggcuauaaauuaug

SEQ ID NO: 845012 - RNA, 22 nt, Human
ggccucuggcaggcaggcccuc

SEQ ID NO: 845013 - RNA, 22 nt, Human
agcagagcuauucuugugcaau

SEQ ID NO: 845014 - RNA, 22 nt, Human
ugaacagaucaauagaacugac

SEQ ID NO: 845015 - RNA, 22 nt, Human
uggugcugauaauggcaggauu

SEQ ID NO: 845016 - RNA, 22 nt, Human
aacaugaaaguugcuaagugca

SEQ ID NO: 845017 - RNA, 22 nt, Human
aaacacauuagcccuguggaaa

SEQ ID NO: 845018 - RNA, 22 nt, Human
ugcauugcaguuaacucaguau

SEQ ID NO: 845019 - RNA, 21 nt, Human
acaggcucuggggaugcuggg

SEQ ID NO: 845020 - RNA, 22 nt, Human
gccugagagucugcauuucuaa

SEQ ID NO: 845021 - RNA, 22 nt, Human
aagccaggggcugcuuaggaga

SEQ ID NO: 845022 - RNA, 22 nt, Human
uccugagauucugcauuucuaa

SEQ ID NO: 845023 - RNA, 22 nt, Human
auccagucaaaauuaguaaggu

SEQ ID NO: 845024 - RNA, 22 nt, Human
gcagcugaagcugcaguuccag

SEQ ID NO: 845025 - RNA, 19 nt, Human
acauuuagaauguacuugc

SEQ ID NO: 845026 - RNA, 19 nt, Human
aggcagaggcuuggcuagc

SEQ ID NO: 845027 - RNA, 22 nt, Human
ucuggccaggauggcaagacca

SEQ ID NO: 845028 - RNA, 22 nt, Human
uuuucguuuauuugacauguaa

SEQ ID NO: 845029 - RNA, 22 nt, Human
gcucuggcuacuguggcuaccg

SEQ ID NO: 845030 - RNA, 22 nt, Human
aagcugccaaugguaagcugcu

SEQ ID NO: 845031 - RNA, 22 nt, Human
agccaaggcagcuagagcucug

SEQ ID NO: 845032 - RNA, 22 nt, Human
auugaaagauauacuguucuca

SEQ ID NO: 845033 - RNA, 22 nt, Human
uccucagaugcucuuggacgcc

SEQ ID NO: 845034 - RNA, 22 nt, Human
uuacaaaguucugaguucaaac

SEQ ID NO: 845035 - RNA, 22 nt, Human
aauguguagcauuuaaugcagu

SEQ ID NO: 845036 - RNA, 22 nt, Human
uaugcuguggaaaauacaaaga

SEQ ID NO: 845037 - RNA, 22 nt, Human
acccugccgugggcugcuugug

SEQ ID NO: 845038 - RNA, 22 nt, Human
uucaggagcuggcugcgaagga

SEQ ID NO: 845039 - RNA, 22 nt, Human
cauggcaggaggcugcuggcag

SEQ ID NO: 845040 - RNA, 22 nt, Human
ccucagaguaggucucagcugu

SEQ ID NO: 845041 - RNA, 18 nt, Human
aaauguacuguccauggc

SEQ ID NO: 845042 - RNA, 22 nt, Human
gcugcagcccggcgcgccugag

SEQ ID NO: 845043 - RNA, 20 nt, Human
agaagcugauacugauggaa

SEQ ID NO: 845044 - RNA, 20 nt, Human
aaagucuuaugguuaauuuu

SEQ ID NO: 845045 - RNA, 19 nt, Human
ucaggacugacuugaaguc

SEQ ID NO: 845046 - RNA, 22 nt, Human
ugggagagugcucaaugugcaa

SEQ ID NO: 845047 - RNA, 22 nt, Human
uuuuaauacugcuauuguagga

SEQ ID NO: 845048 - RNA, 22 nt, Human
ucaggcugagaaaaucuggacc

SEQ ID NO: 845049 - RNA, 22 nt, Human
uuucacaacugcuuauuugaga

SEQ ID NO: 845050 - RNA, 22 nt, Human
cuuacauugucuuaguuuucaa

SEQ ID NO: 845051 - RNA, 22 nt, Human
aggaccaguaugagagcaucug

SEQ ID NO: 845052 - RNA, 21 nt, Human
uuacuuuugcagcaaccuaau

SEQ ID NO: 845053 - RNA, 22 nt, Human
accugccuaguugguucugccc

SEQ ID NO: 845054 - RNA, 21 nt, Human
gagcucucaggcaagaagcag

SEQ ID NO: 845055 - RNA, 22 nt, Human
uuugacauuggcuuauucuguu

SEQ ID NO: 845056 - RNA, 22 nt, Human
ggcagugaaugaaacagaggcu

SEQ ID NO: 845057 - RNA, 22 nt, Human
ucucuuucuauugcaccaugcu

SEQ ID NO: 845058 - RNA, 22 nt, Human
ggggcagagagaaggaagcuug

SEQ ID NO: 845059 - RNA, 22 nt, Human
uuagaaaggaaucuucauuuca

SEQ ID NO: 845060 - RNA, 22 nt, Human
cugaggcuuggaggggucuggu

SEQ ID NO: 845061 - RNA, 21 nt, Human
ucccugcuuucuggcccaguc

SEQ ID NO: 845062 - RNA, 19 nt, Human
cagaguccuugaccagucc

SEQ ID NO: 845063 - RNA, 22 nt, Human
ggcagcugagcauggcuaccuu

SEQ ID NO: 845064 - RNA, 22 nt, Human
aauaacuuaagaaauuucccca

SEQ ID NO: 845065 - RNA, 18 nt, Human
cagaaguccuucaaggcc

SEQ ID NO: 845066 - RNA, 22 nt, Human
cuggccugugggcugucuccgg

SEQ ID NO: 845067 - RNA, 22 nt, Human
caagagcuggguggcaagcuag

SEQ ID NO: 845068 - RNA, 22 nt, Human
ucauauaacuggauauuuucaa

SEQ ID NO: 845069 - RNA, 22 nt, Human
gccugagaaggauaggaagcga

SEQ ID NO: 845070 - RNA, 22 nt, Human
gagggcagugaauuuugaagcu

SEQ ID NO: 845071 - RNA, 19 nt, Human
auguaugaggucuucugcu

SEQ ID NO: 845072 - RNA, 22 nt, Human
auguucuuucagccagugcauc

SEQ ID NO: 845073 - RNA, 22 nt, Human
uguauguaaaguuuguaauaga

SEQ ID NO: 845074 - RNA, 22 nt, Human
uggcagaaguacacaagcaugc

SEQ ID NO: 845075 - RNA, 22 nt, Human
auauacugauagcugcacuucu

SEQ ID NO: 845076 - RNA, 22 nt, Human
cuagguauucauguuucguggc

SEQ ID NO: 845077 - RNA, 22 nt, Human
uccugcagaccucagucagguc

SEQ ID NO: 845078 - RNA, 22 nt, Human
uaagacaugguugaucuagugu

SEQ ID NO: 845079 - RNA, 22 nt, Human
aaguccuugaagaaacaguucu

SEQ ID NO: 845080 - RNA, 19 nt, Human
caagugaagccugggaugg

SEQ ID NO: 845081 - RNA, 22 nt, Human
aucuggcugacuuugugggaca

SEQ ID NO: 845082 - RNA, 22 nt, Human
gacagcagacagaacuaccugc

SEQ ID NO: 845083 - RNA, 22 nt, Human
ugagagugguucagcucagaag

SEQ ID NO: 845084 - RNA, 22 nt, Human
caugcuuucuguccaaauguua

SEQ ID NO: 845085 - RNA, 22 nt, Human
ggaaccaguggaaugauaugcu

SEQ ID NO: 845086 - RNA, 22 nt, Human
ucuagacacuacuaguaaccgg

SEQ ID NO: 845087 - RNA, 22 nt, Human
agucccaggcagccgagccggu

SEQ ID NO: 845088 - RNA, 22 nt, Human
auguagcaugaggcacugugcc

SEQ ID NO: 845089 - RNA, 22 nt, Human
gcugccucuguagcuuuggacc

SEQ ID NO: 845090 - RNA, 22 nt, Human
gggaggucagggugccugcugg

SEQ ID NO: 845091 - RNA, 22 nt, Human
aaagacuagcauuuauauguac

SEQ ID NO: 845092 - RNA, 22 nt, Human
ggggcggggcucugagaagcau

SEQ ID NO: 845093 - RNA, 22 nt, Human
gguggagcuggaccaggagagg

SEQ ID NO: 845094 - RNA, 22 nt, Human
ucugggugaugaaaugcacugu

SEQ ID NO: 845095 - RNA, 22 nt, Human
ucccuggcuguguucaggugcg

SEQ ID NO: 845096 - RNA, 22 nt, Human
uuuugucuaagaacuuugcaaa

SEQ ID NO: 845097 - RNA, 22 nt, Human
auuuagaaauuccaaaaguauu

SEQ ID NO: 845098 - RNA, 22 nt, Human
agcuuuauauuuaaugaauucu

SEQ ID NO: 845099 - RNA, 18 nt, Human
caugggugacagguggau

SEQ ID NO: 845100 - RNA, 23 nt, Human
ggguccagagacaggcaugggug

SEQ ID NO: 845101 - RNA, 22 nt, Human
ggccucucuccagucagugcag

SEQ ID NO: 845102 - RNA, 22 nt, Human
uggccugcagcucucagggaag

SEQ ID NO: 845103 - RNA, 22 nt, Human
agagggagugaaauggaauaga

SEQ ID NO: 845104 - RNA, 22 nt, Human
gguacaaggagugaagguuugg

SEQ ID NO: 845105 - RNA, 22 nt, Human
caggugcccagcuccugcugug

SEQ ID NO: 845106 - RNA, 22 nt, Human
gcccucucggcauagcaggggc

SEQ ID NO: 845107 - RNA, 22 nt, Human
gaggggagacagggaaaucagu

SEQ ID NO: 845108 - RNA, 23 nt, Human
uuuggacuugugacucuucuccu

SEQ ID NO: 845109 - RNA, 22 nt, Human
agcaggcuccuuccuucucugg

SEQ ID NO: 845110 - RNA, 22 nt, Human
guaggcagucucucaggugauc

SEQ ID NO: 845111 - RNA, 22 nt, Human
uucuucuuuaucucaguauccu

SEQ ID NO: 845112 - RNA, 22 nt, Human
cccaggaaaugaacuucugauu

SEQ ID NO: 845113 - RNA, 22 nt, Human
gcuggugccuuguuguuguuac

SEQ ID NO: 845114 - RNA, 22 nt, Human
acagaauuuaaagcucuagacu

SEQ ID NO: 845115 - RNA, 22 nt, Human
cccuggagucagguuggccugg

SEQ ID NO: 845116 - RNA, 22 nt, Human
aauaacaggcucaucagaugcu

SEQ ID NO: 845117 - RNA, 22 nt, Human
agaagcagacucugaggcaagg

SEQ ID NO: 845118 - RNA, 18 nt, Human
uucacaggaaaugucuuu

SEQ ID NO: 845119 - RNA, 22 nt, Human
gucuuguuugggauguggaugg

SEQ ID NO: 845120 - RNA, 22 nt, Human
augcugugccuggaaagcggcu

SEQ ID NO: 845121 - RNA, 22 nt, Human
gcuguucacagacucugcucug

SEQ ID NO: 845122 - RNA, 22 nt, Human
uaaacauggauucugaucacag

SEQ ID NO: 845123 - RNA, 22 nt, Human
gucacuggggccacaugcagaa

SEQ ID NO: 845124 - RNA, 22 nt, Human
guuaggcaugaguguguauuaa

SEQ ID NO: 845125 - RNA, 21 nt, Human
gcagcaguguucuagaauacu

SEQ ID NO: 845126 - RNA, 20 nt, Human
ggucccugcccucugucauc

SEQ ID NO: 845127 - RNA, 22 nt, Human
uucagaaaaaacuucaauaagu

SEQ ID NO: 845128 - RNA, 22 nt, Human
gaagagcuuagacagaaucaaa

SEQ ID NO: 845129 - RNA, 22 nt, Human
ggccugcuccgggggcugagcu

SEQ ID NO: 845130 - RNA, 22 nt, Human
auucacagggacaaugggagag

SEQ ID NO: 845131 - RNA, 22 nt, Human
aggaaucccgcaccagcugcug

SEQ ID NO: 845132 - RNA, 22 nt, Human
ccaggccaaauucagucagcag

SEQ ID NO: 845133 - RNA, 22 nt, Human
ugaagaaucagauuggccugcg

SEQ ID NO: 845134 - RNA, 22 nt, Human
gagcagcuagauaaagcccuuc

SEQ ID NO: 845135 - RNA, 19 nt, Human
ugucucugaaagaugagcu

SEQ ID NO: 845136 - RNA, 22 nt, Human
uggccucuuacgacauagccuu

SEQ ID NO: 845137 - RNA, 22 nt, Human
agcaccugcuaugugucaggga

SEQ ID NO: 845138 - RNA, 22 nt, Human
cccaggaccgcgcggcugagcg

SEQ ID NO: 845139 - RNA, 22 nt, Human
uuucuaaaugguggcugcauug

SEQ ID NO: 845140 - RNA, 22 nt, Human
aaggagagagcuuugcuggaac

SEQ ID NO: 845141 - RNA, 22 nt, Human
auauauuugagaauauucauga

SEQ ID NO: 845142 - RNA, 22 nt, Human
ugaaauaauaucuggaucaauc

SEQ ID NO: 845143 - RNA, 22 nt, Human
cuccuuccugccccagugauaa

SEQ ID NO: 845144 - RNA, 22 nt, Human
ucccacucccaggcaggccucu

SEQ ID NO: 845145 - RNA, 22 nt, Human
gggcugccaagccugccugccu

SEQ ID NO: 845146 - RNA, 22 nt, Human
gaaauauuguacuggagauguu

SEQ ID NO: 845147 - RNA, 22 nt, Human
aaagcagaacugagagagcugg

SEQ ID NO: 845148 - RNA, 22 nt, Human
agcuuccugaugcaagagggcu

SEQ ID NO: 845149 - RNA, 22 nt, Human
gcagggcaaacccagguguuca

SEQ ID NO: 845150 - RNA, 19 nt, Human
uggccagguacugucugcu

SEQ ID NO: 845151 - RNA, 22 nt, Human
agaaauguuguggguuuuguua

SEQ ID NO: 845152 - RNA, 20 nt, Human
auuccauaguuggcacuuuu

SEQ ID NO: 845153 - RNA, 23 nt, Human
gccuucagcucgggaaggcuccc

SEQ ID NO: 845154 - RNA, 22 nt, Human
cucaggaugcaauuccaucaag

SEQ ID NO: 845155 - RNA, 22 nt, Human
ugcuggcccaguauggacugca

SEQ ID NO: 845156 - RNA, 22 nt, Human
gggcagcugccccucucugggc

SEQ ID NO: 845157 - RNA, 22 nt, Human
ggaggccaaggagggcggauca

SEQ ID NO: 845158 - RNA, 20 nt, Human
uggagcuguaaucuugucug

SEQ ID NO: 845159 - RNA, 22 nt, Human
acugggaguucuccaugucccu

SEQ ID NO: 845160 - RNA, 22 nt, Human
ucccagagcucugacaccagcu

SEQ ID NO: 845161 - RNA, 22 nt, Human
ucuggaguccagauccauuugg

SEQ ID NO: 845162 - RNA, 22 nt, Human
ggagcugcuuugaucugaagaa

SEQ ID NO: 845163 - RNA, 22 nt, Human
aaauaucauuuauaacuuuuaa

SEQ ID NO: 845164 - RNA, 22 nt, Human
gaggggaaagugugaggcugcg

SEQ ID NO: 845165 - RNA, 22 nt, Human
cuccauugaacauccucucaga

SEQ ID NO: 845166 - RNA, 22 nt, Human
uucugucaaauuugccauaugg

SEQ ID NO: 845167 - RNA, 22 nt, Human
acaaaugucuccucuuuuguua

SEQ ID NO: 845168 - RNA, 21 nt, Human
ggccucugccuugccccacuc

SEQ ID NO: 845169 - RNA, 22 nt, Human
gaacagaagaggcuggugccac

SEQ ID NO: 845170 - RNA, 22 nt, Human
uguguacacaaugauugcagag

SEQ ID NO: 845171 - RNA, 22 nt, Human
cccaggaacagcacagaacagc

SEQ ID NO: 845172 - RNA, 22 nt, Human
augaguugaagcuacaagaggc

SEQ ID NO: 845173 - RNA, 22 nt, Human
agggcagaccacgugcaaggau

SEQ ID NO: 845174 - RNA, 22 nt, Human
aggcuuccucgugccuuagaua

SEQ ID NO: 845175 - RNA, 22 nt, Human
ccagcugacgaugccuggucuc

SEQ ID NO: 845176 - RNA, 22 nt, Human
uggagcccagacacuggcauug

SEQ ID NO: 845177 - RNA, 22 nt, Human
acuccugguuuguguccuggcu

SEQ ID NO: 845178 - RNA, 22 nt, Human
gugucauggaaaauugcaaugg

SEQ ID NO: 845179 - RNA, 22 nt, Human
agagccaggugcugcuguuuga

SEQ ID NO: 845180 - RNA, 22 nt, Human
caguuuuuagauuaguuggugg

SEQ ID NO: 845181 - RNA, 19 nt, Human
gaagaagcuugagaaguag

SEQ ID NO: 845182 - RNA, 22 nt, Human
uuuaacagaugugaaauuuuca

SEQ ID NO: 845183 - RNA, 22 nt, Human
agauuucagguuggggcagaag

SEQ ID NO: 845184 - RNA, 22 nt, Human
cugaggaugguguggucuucuc

SEQ ID NO: 845185 - RNA, 22 nt, Human
gagagugaaggcuucccagcaa

SEQ ID NO: 845186 - RNA, 22 nt, Human
cucucugagugagggacaagcu

SEQ ID NO: 845187 - RNA, 22 nt, Human
uuucacaaguuucaggauucug

SEQ ID NO: 845188 - RNA, 22 nt, Human
aagagcuggcucuugcagcagc

SEQ ID NO: 845189 - RNA, 18 nt, Human
cugcccagagcacuugug

SEQ ID NO: 845190 - RNA, 22 nt, Human
auuucagguaccugugggaucc

SEQ ID NO: 845191 - RNA, 23 nt, Human
gcagauggccccagagugcugcc

SEQ ID NO: 845192 - RNA, 22 nt, Human
gagguacagaguguuccaaugu

SEQ ID NO: 845193 - RNA, 22 nt, Human
auaucaaacgaaguuauuuuaa

SEQ ID NO: 845194 - RNA, 22 nt, Human
cagcuccccucuguggggcagu

SEQ ID NO: 845195 - RNA, 22 nt, Human
uauguacauguuaaagggcaaa

SEQ ID NO: 845196 - RNA, 22 nt, Human
ugcucugguaacucacuuccau

SEQ ID NO: 845197 - RNA, 22 nt, Human
gugggugauguacuggaggcca

SEQ ID NO: 845198 - RNA, 22 nt, Human
uucuaguguccuuggacuugcu

SEQ ID NO: 845199 - RNA, 22 nt, Human
agugaaauuuguuuagauaggu

SEQ ID NO: 845200 - RNA, 22 nt, Human
gccuggagggcucuagagaggc

SEQ ID NO: 845201 - RNA, 22 nt, Human
agagccagcaacucuagcccug

SEQ ID NO: 845202 - RNA, 22 nt, Human
uucucagagcucacuguaguaa

SEQ ID NO: 845203 - RNA, 22 nt, Human
uguggcucucagauccuccaau

SEQ ID NO: 845204 - RNA, 22 nt, Human
ugcauauuguccuugauauuau

SEQ ID NO: 845205 - RNA, 22 nt, Human
uuuccucuucuggcaggcaggg

SEQ ID NO: 845206 - RNA, 22 nt, Human
uaagaacuucggacauguuauc

SEQ ID NO: 845207 - RNA, 22 nt, Human
gcucagggaacuuuuugcaggc

SEQ ID NO: 845208 - RNA, 22 nt, Human
uaauuucuagggacuaaggugc

SEQ ID NO: 845209 - RNA, 22 nt, Human
ucuggcuccaggaccgggcaca

SEQ ID NO: 845210 - RNA, 22 nt, Human
cagccagguaugggcgugcggg

SEQ ID NO: 845211 - RNA, 22 nt, Human
uucaagaucuggguuuucagcu

SEQ ID NO: 845212 - RNA, 22 nt, Human
aguguguccagaaaucuguauu

SEQ ID NO: 845213 - RNA, 22 nt, Human
gagcugcuucugugugccgggu

SEQ ID NO: 845214 - RNA, 22 nt, Human
auuauucuuaugucaucauggc

SEQ ID NO: 845215 - RNA, 22 nt, Human
uuaacacagggggagacaaagu

SEQ ID NO: 845216 - RNA, 22 nt, Human
ugugugaaggagccacuguuca

SEQ ID NO: 845217 - RNA, 22 nt, Human
aaguuucaaauauaaaauuaca

SEQ ID NO: 845218 - RNA, 22 nt, Human
cuggagagggagcccuggcagu

SEQ ID NO: 845219 - RNA, 22 nt, Human
cauuuguaucauauguaucuua

SEQ ID NO: 845220 - RNA, 23 nt, Human
uuuauauuccuaaugucuugagc

SEQ ID NO: 845221 - RNA, 22 nt, Human
gugcuuccaucuagagggucac

SEQ ID NO: 845222 - RNA, 22 nt, Human
agcucuggaauaaugaugugau

SEQ ID NO: 845223 - RNA, 22 nt, Human
ucauagaaugaguuaaugaacu

SEQ ID NO: 845224 - RNA, 22 nt, Human
agggcagcagcggcccaggccu

SEQ ID NO: 845225 - RNA, 22 nt, Human
gggacgggcaguccaagggguc

SEQ ID NO: 845226 - RNA, 22 nt, Human
ugcaaucucggcacuuugggag

SEQ ID NO: 845227 - RNA, 22 nt, Human
uccagccuuucuacucacugag

SEQ ID NO: 845228 - RNA, 22 nt, Human
acuguucauuuguccuguaucu

SEQ ID NO: 845229 - RNA, 22 nt, Human
aagcgccacgagaagcuggacc

SEQ ID NO: 845230 - RNA, 22 nt, Human
cucucugcuguauccuuaggcu

SEQ ID NO: 845231 - RNA, 22 nt, Human
uaggaaauggcucaguuacugc

SEQ ID NO: 845232 - RNA, 22 nt, Human
cagagcugguguuacaagucca

SEQ ID NO: 845233 - RNA, 22 nt, Human
aguucuucauaaccuuacugug

SEQ ID NO: 845234 - RNA, 22 nt, Human
ccagaggcauguucaaagcaau

SEQ ID NO: 845235 - RNA, 22 nt, Human
cagacagaccugcaagggcaca

SEQ ID NO: 845236 - RNA, 22 nt, Human
aggagcugcauggauaccuggu

SEQ ID NO: 845237 - RNA, 22 nt, Human
ucauuauuuuggacuggagugu

SEQ ID NO: 845238 - RNA, 22 nt, Human
ugcagucuccaccuccugggug

SEQ ID NO: 845239 - RNA, 22 nt, Human
caucauaaaauugagauaacug

SEQ ID NO: 845240 - RNA, 22 nt, Human
cucugagagcggucuguggcuu

SEQ ID NO: 845241 - RNA, 22 nt, Human
ugggcagagucguggggaauag

SEQ ID NO: 845242 - RNA, 22 nt, Human
ggccucugaggacagccuuggc

SEQ ID NO: 845243 - RNA, 22 nt, Human
ccaggccuuccaguacgcagaa

SEQ ID NO: 845244 - RNA, 22 nt, Human
aagaaaucugauauuuguuuca

SEQ ID NO: 845245 - RNA, 22 nt, Human
auccaugaucaauuuauuacua

SEQ ID NO: 845246 - RNA, 22 nt, Human
agggcagccugagugcuggccc

SEQ ID NO: 845247 - RNA, 22 nt, Human
agaagcugccuacaugaccagc

SEQ ID NO: 845248 - RNA, 22 nt, Human
aaauuuaagaagugugugcgug

SEQ ID NO: 845249 - RNA, 22 nt, Human
ugcauuguugaccaguugugca

SEQ ID NO: 845250 - RNA, 22 nt, Human
gggcuggucuggcuuagucagg

SEQ ID NO: 845251 - RNA, 22 nt, Human
gaaagagaaccugggccuagau

SEQ ID NO: 845252 - RNA, 22 nt, Human
aaaguccuugcaguuuccucuu

SEQ ID NO: 845253 - RNA, 22 nt, Human
augcaguacagauaauucuaca

SEQ ID NO: 845254 - RNA, 22 nt, Human
ugguccuggggaucugcaguga

SEQ ID NO: 845255 - RNA, 22 nt, Human
aguaugaaaguuaaucaauuua

SEQ ID NO: 845256 - RNA, 22 nt, Human
aggucaaguuuagauagaguua

SEQ ID NO: 845257 - RNA, 22 nt, Human
gaggcagccagagguucucauu

SEQ ID NO: 845258 - RNA, 22 nt, Human
ccagggccaagagaccucgagg

SEQ ID NO: 845259 - RNA, 22 nt, Human
gagccuggauugaagugggugg

SEQ ID NO: 845260 - RNA, 22 nt, Human
acagaacuuccugcuggagugg

SEQ ID NO: 845261 - RNA, 22 nt, Human
ucuguucaugucuuuuuaagug

SEQ ID NO: 845262 - RNA, 22 nt, Human
agaggccagguccagaguuugu

SEQ ID NO: 845263 - RNA, 22 nt, Human
agcaggguauguuagagcugua

SEQ ID NO: 845264 - RNA, 22 nt, Human
ggcagcugcaaaucugcucugu

SEQ ID NO: 845265 - RNA, 22 nt, Human
uuacaguuuaguccaagccaga

SEQ ID NO: 845266 - RNA, 22 nt, Human
ccagccagccuugaucugagua

SEQ ID NO: 845267 - RNA, 22 nt, Human
cuuaaacugaaagcuacaagau

SEQ ID NO: 845268 - RNA, 22 nt, Human
uacauguaggugacauuuuaau

SEQ ID NO: 845269 - RNA, 22 nt, Human
accaggaguaacagugaguggu

SEQ ID NO: 845270 - RNA, 22 nt, Human
uauuuaucgagugucuacuaug

SEQ ID NO: 845271 - RNA, 22 nt, Human
gagggaggggagcuccacccuc

SEQ ID NO: 845272 - RNA, 22 nt, Human
aggagggagcuuaagccaggca

SEQ ID NO: 845273 - RNA, 22 nt, Human
gauuuccauuuucaacuccugc

SEQ ID NO: 845274 - RNA, 22 nt, Human
uauguacacauacacuuguaau

SEQ ID NO: 845275 - RNA, 22 nt, Human
ucaaagucucugcuucuguaac

SEQ ID NO: 845276 - RNA, 22 nt, Human
accugggagucacaccugagaa

SEQ ID NO: 845277 - RNA, 22 nt, Human
uagaacauaagucauucauuug

SEQ ID NO: 845278 - RNA, 22 nt, Human
uggcuggcaaggcuggagucag

SEQ ID NO: 845279 - RNA, 22 nt, Human
ggucccaguugcccaggucagg

SEQ ID NO: 845280 - RNA, 22 nt, Human
uucuuucagaacacaagugauu

SEQ ID NO: 845281 - RNA, 22 nt, Human
ccugggcucaagugauccuccu

SEQ ID NO: 845282 - RNA, 22 nt, Human
aucuaagaguuaacaucaagaa

SEQ ID NO: 845283 - RNA, 22 nt, Human
aagaugauagaucugucaaugu

SEQ ID NO: 845284 - RNA, 22 nt, Human
cacagcagagggagccauugaa

SEQ ID NO: 845285 - RNA, 22 nt, Human
gcuagaucucucauaaauucca

SEQ ID NO: 845286 - RNA, 22 nt, Human
caaagcucaugcucuuagccau

SEQ ID NO: 845287 - RNA, 22 nt, Human
gcagccacagaggagggaugca

SEQ ID NO: 845288 - RNA, 22 nt, Human
gcagagccugacgggauuuuuc

SEQ ID NO: 845289 - RNA, 21 nt, Human
ggccucugucauccugggaag

SEQ ID NO: 845290 - RNA, 22 nt, Human
gagcucauccccaugguccguc

SEQ ID NO: 845291 - RNA, 18 nt, Human
cugcugcaggcacucagg

SEQ ID NO: 845292 - RNA, 22 nt, Human
cugucuccuccacugcauggga

SEQ ID NO: 845293 - RNA, 22 nt, Human
ggcuucaccaggugcaugcaug

SEQ ID NO: 845294 - RNA, 22 nt, Human
gcucugaggcugugaggugcug

SEQ ID NO: 845295 - RNA, 22 nt, Human
agugaaauaugcccauugcugu

SEQ ID NO: 845296 - RNA, 22 nt, Human
ccuggugcuuaccagagcuuuu

SEQ ID NO: 845297 - RNA, 22 nt, Human
agcugagcauuugauccaccuc

SEQ ID NO: 845298 - RNA, 22 nt, Human
cuagggaguggcagagcuggga

SEQ ID NO: 845299 - RNA, 22 nt, Human
acaaacuaccuacagauguuca

SEQ ID NO: 845300 - RNA, 22 nt, Human
aagcagcauaauugcuauuuua

SEQ ID NO: 845301 - RNA, 22 nt, Human
cuggagcugucuucacaggccu

SEQ ID NO: 845302 - RNA, 22 nt, Human
ugcucuggggagcuccucugcg

SEQ ID NO: 845303 - RNA, 22 nt, Human
cccaggagaccugugaaaggac

SEQ ID NO: 845304 - RNA, 22 nt, Human
agucucuuauucccuauugcug

SEQ ID NO: 845305 - RNA, 22 nt, Human
ugacacagaaauuaagcuguca

SEQ ID NO: 845306 - RNA, 22 nt, Human
gagcauuugguuauaguaauuu

SEQ ID NO: 845307 - RNA, 22 nt, Human
cucagagucccuucccucgugg

SEQ ID NO: 845308 - RNA, 22 nt, Human
ggcucuggagacauguggagag

SEQ ID NO: 845309 - RNA, 22 nt, Human
uuucuuauauucugucauuguu

SEQ ID NO: 845310 - RNA, 22 nt, Human
agaauccucuucaguaaauucu

SEQ ID NO: 845311 - RNA, 22 nt, Human
caccagcagaagacugagggug

SEQ ID NO: 845312 - RNA, 22 nt, Human
cgaggcaggcaggcggaggaua

SEQ ID NO: 845313 - RNA, 22 nt, Human
gcagauggaaagugcuugaggg

SEQ ID NO: 845314 - RNA, 22 nt, Human
uagggcuauaagagaauaagac

SEQ ID NO: 845315 - RNA, 21 nt, Human
aauaaaacaguuggugucaau

SEQ ID NO: 845316 - RNA, 22 nt, Human
uugauuaaucccaugugaguag

SEQ ID NO: 845317 - RNA, 22 nt, Human
cugcccaggaaggagaggaugg

SEQ ID NO: 845318 - RNA, 22 nt, Human
uggagccaugccuggccuuucc

SEQ ID NO: 845319 - RNA, 22 nt, Human
ggcaggaggaagaguuagcacc

SEQ ID NO: 845320 - RNA, 22 nt, Human
aggcagagcugauguucuguga

SEQ ID NO: 845321 - RNA, 22 nt, Human
aggcugggaagguaaaguugua

SEQ ID NO: 845322 - RNA, 22 nt, Human
uaacagaauagcagaaacagaa

SEQ ID NO: 845323 - RNA, 20 nt, Human
caccacagaauuggggacag

SEQ ID NO: 845324 - RNA, 22 nt, Human
acaacuuugacccuuguucuua

SEQ ID NO: 845325 - RNA, 22 nt, Human
cccuccccacaaagcuucacac

SEQ ID NO: 845326 - RNA, 22 nt, Human
acacaaugcauauuuuuccaga

SEQ ID NO: 845327 - RNA, 22 nt, Human
ccagccaguccagcauuggugu

SEQ ID NO: 845328 - RNA, 22 nt, Human
gcuggagauaguaggauccaua

SEQ ID NO: 845329 - RNA, 21 nt, Human
ugcugaugucagagaagcaag

SEQ ID NO: 845330 - RNA, 22 nt, Human
caggguccaucuuucaucacug

SEQ ID NO: 845331 - RNA, 22 nt, Human
ugacucuguaccugucugccuu

SEQ ID NO: 845332 - RNA, 22 nt, Human
cugucugcuagaacaucuauac

SEQ ID NO: 845333 - RNA, 22 nt, Human
caggccugucugcacaugaggc

SEQ ID NO: 845334 - RNA, 22 nt, Human
caauuucaagauucuguucuuu

SEQ ID NO: 845335 - RNA, 22 nt, Human
cuggcugggagcgagcugcuca

SEQ ID NO: 845336 - RNA, 22 nt, Human
guggaauguccuugaucauaag

SEQ ID NO: 845337 - RNA, 22 nt, Human
gcugguuaggugagggugcgcc

SEQ ID NO: 845338 - RNA, 22 nt, Human
ucugggcacugcugagccugua

SEQ ID NO: 845339 - RNA, 20 nt, Human
augugaaagaucaguugucu

SEQ ID NO: 845340 - RNA, 22 nt, Human
uugacagcaaagauugugccua

SEQ ID NO: 845341 - RNA, 22 nt, Human
ucugaggcuauguucaggcuaa

SEQ ID NO: 845342 - RNA, 20 nt, Human
ucauugcacauaauggaagc

SEQ ID NO: 845343 - RNA, 22 nt, Human
uuugaaucugauauggcagcau

SEQ ID NO: 845344 - RNA, 22 nt, Human
uaaguccuagaugauucacaga

SEQ ID NO: 845345 - RNA, 22 nt, Human
caggaggaagaacucugcaaca

SEQ ID NO: 845346 - RNA, 22 nt, Human
acagggcaugugcaagagacau

SEQ ID NO: 845347 - RNA, 22 nt, Human
ugucccagggaaggcccagcac

SEQ ID NO: 845348 - RNA, 23 nt, Human
cauaaaauauuaguaugguagca

SEQ ID NO: 845349 - RNA, 22 nt, Human
ucauucuccucuggaaaaggca

SEQ ID NO: 845350 - RNA, 22 nt, Human
ggagggagcauccccuugcuga

SEQ ID NO: 845351 - RNA, 22 nt, Human
guggagcccugguagggacccc

SEQ ID NO: 845352 - RNA, 22 nt, Human
ccucuggcaacuucacagccca

SEQ ID NO: 845353 - RNA, 22 nt, Human
gaucuguuauaaucucuuuuau

SEQ ID NO: 845354 - RNA, 22 nt, Human
caaggaaaaagcgagcucgggg

SEQ ID NO: 845355 - RNA, 22 nt, Human
ucaggcaggcagagggcaaaug

SEQ ID NO: 845356 - RNA, 22 nt, Human
uccuucaaagcuccuagugagc

SEQ ID NO: 845357 - RNA, 22 nt, Human
gguugccggggcaggacuggaa

SEQ ID NO: 845358 - RNA, 22 nt, Human
ugcuuggccuacuuguccuuug

SEQ ID NO: 845359 - RNA, 22 nt, Human
aaguccauucuuccagccagcu

SEQ ID NO: 845360 - RNA, 22 nt, Human
ugcaccauacccauuccccucu

SEQ ID NO: 845361 - RNA, 22 nt, Human
uggccuuguguuuuagagaaag

SEQ ID NO: 845362 - RNA, 22 nt, Human
uggcagcauuuuuuccagaaca

SEQ ID NO: 845363 - RNA, 22 nt, Human
uaaguucauaagcuuauucuua

SEQ ID NO: 845364 - RNA, 22 nt, Human
ugugugucagagucuccauggu

SEQ ID NO: 845365 - RNA, 21 nt, Human
gagauuuagaaggaucaauuu

SEQ ID NO: 845366 - RNA, 22 nt, Human
cuugcuucauuagugucuuagu

SEQ ID NO: 845367 - RNA, 17 nt, Human
cccacggaggugugaaa

SEQ ID NO: 845368 - RNA, 22 nt, Human
ggcagcucugcuccacaugagu

SEQ ID NO: 845369 - RNA, 23 nt, Human
gggcugcuccaggccaaggcugg

SEQ ID NO: 845370 - RNA, 22 nt, Human
aagaacauguuaaaagauucac

SEQ ID NO: 845371 - RNA, 22 nt, Human
cuuuuauuuugaauuaagggcu

SEQ ID NO: 845372 - RNA, 22 nt, Human
gagggaauggugugcaagaggu

SEQ ID NO: 845373 - RNA, 22 nt, Human
acacagccgugaaucugcuucu

SEQ ID NO: 845374 - RNA, 22 nt, Human
aagguucuaagggaagccaugc

SEQ ID NO: 845375 - RNA, 22 nt, Human
auuauguagguuaggugguugu

SEQ ID NO: 845376 - RNA, 22 nt, Human
agucauaauuauaaacaucagu

SEQ ID NO: 845377 - RNA, 17 nt, Human
cugaggcccagggccca

SEQ ID NO: 845378 - RNA, 20 nt, Human
cagaccugcacccacuucga

SEQ ID NO: 845379 - RNA, 22 nt, Human
aagacuuucaaguaugcaugca

SEQ ID NO: 845380 - RNA, 22 nt, Human
aauuaugagguagauaucacau

SEQ ID NO: 845381 - RNA, 22 nt, Human
guaagggauuugaacauagguu

SEQ ID NO: 845382 - RNA, 18 nt, Human
ucucagaggccauccuag

SEQ ID NO: 845383 - RNA, 22 nt, Human
agccugagugcuuaggacuguu

SEQ ID NO: 845384 - RNA, 22 nt, Human
aggcugggaaaccugaaguugu

SEQ ID NO: 845385 - RNA, 22 nt, Human
uucaguuucagucuugcaaaaa

SEQ ID NO: 845386 - RNA, 22 nt, Human
gaggugagaagggggucagaug

SEQ ID NO: 845387 - RNA, 22 nt, Human
cuuaagaauauugaaguugugg

SEQ ID NO: 845388 - RNA, 22 nt, Human
ggcucaggaugagccuucucau

SEQ ID NO: 845389 - RNA, 22 nt, Human
ggagcugggacccugucaucug

SEQ ID NO: 845390 - RNA, 22 nt, Human
gcaggggcaggagaucucaggc

SEQ ID NO: 845391 - RNA, 22 nt, Human
aucagcaagacuaggggaauac

SEQ ID NO: 845392 - RNA, 21 nt, Human
ccugcugugaucuuagugagu

SEQ ID NO: 845393 - RNA, 22 nt, Human
uaggcagcuuagguuagaagug

SEQ ID NO: 845394 - RNA, 22 nt, Human
cagagcugacccaaggauugaa

SEQ ID NO: 845395 - RNA, 22 nt, Human
uuuguagaggguaauugacaga

SEQ ID NO: 845396 - RNA, 22 nt, Human
acucagaaugacugaugcugug

SEQ ID NO: 845397 - RNA, 21 nt, Human
cagagguggccugaccucuga

SEQ ID NO: 845398 - RNA, 22 nt, Human
ucagggcaaaagggaaaccauu

SEQ ID NO: 845399 - RNA, 23 nt, Human
caugggagugagaaugccagcuc

SEQ ID NO: 845400 - RNA, 22 nt, Human
accaucagucacauguagagaa

SEQ ID NO: 845401 - RNA, 22 nt, Human
uggcuggcaguaggcuaguggc

SEQ ID NO: 845402 - RNA, 21 nt, Human
aggggacagaguagcuccagg

SEQ ID NO: 845403 - RNA, 22 nt, Human
cauggagauaaacugaaauauu

SEQ ID NO: 845404 - RNA, 22 nt, Human
gagcugugagggacacauugcu

SEQ ID NO: 845405 - RNA, 22 nt, Human
uucucagagcacugcugacaaa

SEQ ID NO: 845406 - RNA, 22 nt, Human
ccugcuguucuguuuagugaac

SEQ ID NO: 845407 - RNA, 22 nt, Human
ucugucacuauuggccagaaca

SEQ ID NO: 845408 - RNA, 22 nt, Human
cccucugccucugaguaggaca

SEQ ID NO: 845409 - RNA, 22 nt, Human
ccuagagcucugcuuuaucuaa

SEQ ID NO: 845410 - RNA, 22 nt, Human
gagcagugagugaauguugccu

SEQ ID NO: 845411 - RNA, 22 nt, Human
ggcucaggagaggggcuaaaag

SEQ ID NO: 845412 - RNA, 22 nt, Human
gaggcugcggggaggagccugc

SEQ ID NO: 845413 - RNA, 22 nt, Human
uuauagaacagccuccucuaga

SEQ ID NO: 845414 - RNA, 22 nt, Human
ucuuuaaucauaaccaagaugg

SEQ ID NO: 845415 - RNA, 22 nt, Human
ugaggcagauauuuauuggguu

SEQ ID NO: 845416 - RNA, 22 nt, Human
auacuuacuuuucuucagacua

SEQ ID NO: 845417 - RNA, 18 nt, Human
accugccuguucuucucu

SEQ ID NO: 845418 - RNA, 22 nt, Human
agugcuguuagguuaauauagu

SEQ ID NO: 845419 - RNA, 22 nt, Human
aaaugcacaaaguaaguguaau

SEQ ID NO: 845420 - RNA, 22 nt, Human
uccaggagaaggccauccagcg

SEQ ID NO: 845421 - RNA, 22 nt, Human
uggcacugggacagaugcucuc

SEQ ID NO: 845422 - RNA, 21 nt, Human
aguucauacugaguaacaaaa

SEQ ID NO: 845423 - RNA, 19 nt, Human
cagaguacaccagauagga

SEQ ID NO: 845424 - RNA, 22 nt, Human
auucugucuuuuuauacaucua

SEQ ID NO: 845425 - RNA, 22 nt, Human
gaguccaguuguucacagaggc

SEQ ID NO: 845426 - RNA, 22 nt, Human
cagcugagcucccaggccauca

SEQ ID NO: 845427 - RNA, 22 nt, Human
aggcagcaugggcccagagucc

SEQ ID NO: 845428 - RNA, 21 nt, Human
agaauucuuaaguauucuaau

SEQ ID NO: 845429 - RNA, 22 nt, Human
cuuucaacuacauacaggcgau

SEQ ID NO: 845430 - RNA, 22 nt, Human
ggcagugacuguucagacgucc

SEQ ID NO: 845431 - RNA, 22 nt, Human
ucugagagucucugaggcagau

SEQ ID NO: 845432 - RNA, 22 nt, Human
ugaaugaaugaauuaauagagu

SEQ ID NO: 845433 - RNA, 22 nt, Human
auguuuccauuuucuuguauca

SEQ ID NO: 845434 - RNA, 22 nt, Human
agagugaaaagcuagagcagua

SEQ ID NO: 845435 - RNA, 22 nt, Human
auucaagagcccauguuuccug

SEQ ID NO: 845436 - RNA, 22 nt, Human
ggcaucuccaaaacaugaacuc

SEQ ID NO: 845437 - RNA, 22 nt, Human
auacauaauuacuuccgauguu

SEQ ID NO: 845438 - RNA, 22 nt, Human
ugcaggcuguaaucugaggcua

SEQ ID NO: 845439 - RNA, 22 nt, Human
cucaggauuuaaaggggcacuc

SEQ ID NO: 845440 - RNA, 22 nt, Human
uaacagaauccuguuauugcca

SEQ ID NO: 845441 - RNA, 22 nt, Human
uguauuagagcaguagaauuau

SEQ ID NO: 845442 - RNA, 22 nt, Human
gugucccaggagaggagacaau

SEQ ID NO: 845443 - RNA, 22 nt, Human
uucuucaauuauuggaaagaaa

SEQ ID NO: 845444 - RNA, 22 nt, Human
agguacaguagacagacaguua

SEQ ID NO: 845445 - RNA, 22 nt, Human
uguaacaaaauaccuuggauug

SEQ ID NO: 845446 - RNA, 23 nt, Human
gaagcagaugucugaguaggcag

SEQ ID NO: 845447 - RNA, 22 nt, Human
gcagcugcuguggcaucaagcu

SEQ ID NO: 845448 - RNA, 22 nt, Human
ggaggccaaggugggcggauca

SEQ ID NO: 845449 - RNA, 22 nt, Human
uaucuaaauggaauauuccaga

SEQ ID NO: 845450 - RNA, 22 nt, Human
agcagggcuugccgcuuguccu

SEQ ID NO: 845451 - RNA, 22 nt, Human
ugcagugggccggaggccaggg

SEQ ID NO: 845452 - RNA, 22 nt, Human
accauuuaauaaguauuuccau

SEQ ID NO: 845453 - RNA, 22 nt, Human
cagcauggggaucacuguaggc

SEQ ID NO: 845454 - RNA, 22 nt, Human
accagagaaaacacagcaggcu

SEQ ID NO: 845455 - RNA, 22 nt, Human
ggucccaggaagugcggcggcg

SEQ ID NO: 845456 - RNA, 21 nt, Human
ccugccaggaaacugaguguc

SEQ ID NO: 845457 - RNA, 21 nt, Human
ugaaacaaucagacagagucu

SEQ ID NO: 845458 - RNA, 22 nt, Human
aguggcagagcugugucuugaa

SEQ ID NO: 845459 - RNA, 22 nt, Human
ccucagagguguggcaucucug

SEQ ID NO: 845460 - RNA, 20 nt, Human
gcaaggcacagugaggaggg

SEQ ID NO: 845461 - RNA, 22 nt, Human
ugccugaugcaggaguaucaga

SEQ ID NO: 845462 - RNA, 22 nt, Human
agggaaauuaaugugagcaaug

SEQ ID NO: 845463 - RNA, 22 nt, Human
agaaacuucagcuauucuuuug

SEQ ID NO: 845464 - RNA, 22 nt, Human
uauuucuaagagauaucuguac

SEQ ID NO: 845465 - RNA, 22 nt, Human
cucucugaggcaggccuguggg

SEQ ID NO: 845466 - RNA, 22 nt, Human
gcugccucccccauggcuggaa

SEQ ID NO: 845467 - RNA, 22 nt, Human
gcuggcagguccaagauagagc

SEQ ID NO: 845468 - RNA, 22 nt, Human
auaucacaaacaagucuguacu

SEQ ID NO: 845469 - RNA, 22 nt, Human
cuucuucauguauugauagucu

SEQ ID NO: 845470 - RNA, 22 nt, Human
ggagaaugauauauagcucagu

SEQ ID NO: 845471 - RNA, 22 nt, Human
ggucagggggaucugugaggua

SEQ ID NO: 845472 - RNA, 22 nt, Human
gcuggcuuugcacugggugcau

SEQ ID NO: 845473 - RNA, 23 nt, Human
uggagcugacagucagagggagg

SEQ ID NO: 845474 - RNA, 22 nt, Human
cuuguacaggaauccaugguau

SEQ ID NO: 845475 - RNA, 22 nt, Human
acagggcauuuccucuaugugu

SEQ ID NO: 845476 - RNA, 22 nt, Human
agcuagaauauugaucugaaau

SEQ ID NO: 845477 - RNA, 22 nt, Human
gcccucagaguuccccacagug

SEQ ID NO: 845478 - RNA, 22 nt, Human
agccagugcaacagcagugaag

SEQ ID NO: 845479 - RNA, 22 nt, Human
cuggcaggucucgcugacgugu

SEQ ID NO: 845480 - RNA, 22 nt, Human
cagcagcccacgcgugcugucc

SEQ ID NO: 845481 - RNA, 22 nt, Human
gccucugcugacaagauggaca

SEQ ID NO: 845482 - RNA, 22 nt, Human
cucugaagggagggccaagccc

SEQ ID NO: 845483 - RNA, 22 nt, Human
cccagaggugcuucagaggugc

SEQ ID NO: 845484 - RNA, 21 nt, Human
ggcccugguuacgccuccucu

SEQ ID NO: 845485 - RNA, 23 nt, Human
cuccucguaacucuguggugggu

SEQ ID NO: 845486 - RNA, 21 nt, Human
ccuucucuugcuucagcuuca

SEQ ID NO: 845487 - RNA, 22 nt, Human
gauuucaauccagcuuucuucu

SEQ ID NO: 845488 - RNA, 23 nt, Human
ucagaaugcacugaauuuacccu

SEQ ID NO: 845489 - RNA, 23 nt, Human
aguacaauaaguauaauucuuuc

SEQ ID NO: 845490 - RNA, 22 nt, Human
cuacauuuuucaccgagccucu

SEQ ID NO: 845491 - RNA, 22 nt, Human
uucaugugauaaaugugugacu

SEQ ID NO: 845492 - RNA, 22 nt, Human
agagggauaauauguauuguaa

SEQ ID NO: 845493 - RNA, 18 nt, Human
acauuucuaugcuucugg

SEQ ID NO: 845494 - RNA, 22 nt, Human
agagcugcaccuaugcagaccu

SEQ ID NO: 845495 - RNA, 22 nt, Human
auugaaucugcacuaguauuuu

SEQ ID NO: 845496 - RNA, 22 nt, Human
auuugcuugugcuaugaaaguu

SEQ ID NO: 845497 - RNA, 22 nt, Human
auuuuuccaauuaggauaaaga

SEQ ID NO: 845498 - RNA, 22 nt, Human
uacuaaacaucuggcauuaaau

SEQ ID NO: 845499 - RNA, 22 nt, Human
cuggugagacgguugacaggag

SEQ ID NO: 845500 - RNA, 22 nt, Human
ggcagcuuguccuucaggagag

SEQ ID NO: 845501 - RNA, 22 nt, Human
ucagcaguguaguuuaucauuc

SEQ ID NO: 845502 - RNA, 22 nt, Human
ccugucuggccaccagggcgau

SEQ ID NO: 845503 - RNA, 22 nt, Human
ccagauaaggcuuuuuaaaagc

SEQ ID NO: 845504 - RNA, 22 nt, Human
cugcucuggucucuucauguuu

SEQ ID NO: 845505 - RNA, 22 nt, Human
gcugagcuagcuaucucagucu

SEQ ID NO: 845506 - RNA, 22 nt, Human
cucccagggucuaggcugcugg

SEQ ID NO: 845507 - RNA, 22 nt, Human
uauuuugacuauuaaaccaaca

SEQ ID NO: 845508 - RNA, 22 nt, Human
ggcugcagagcugggugggccu

SEQ ID NO: 845509 - RNA, 22 nt, Human
cagucuuuguucccauuacuga

SEQ ID NO: 845510 - RNA, 22 nt, Human
cacccagccuucacacaggagu

SEQ ID NO: 845511 - RNA, 22 nt, Human
aggccagcucacccuggcuccu

SEQ ID NO: 845512 - RNA, 22 nt, Human
ucugggcugggagcguguggac

SEQ ID NO: 845513 - RNA, 22 nt, Human
ugcugucccuaagucucuucaa

SEQ ID NO: 845514 - RNA, 19 nt, Human
uggcucugucgaaggcaca

SEQ ID NO: 845515 - RNA, 22 nt, Human
uuguaaauaguaguaagaugcc

SEQ ID NO: 845516 - RNA, 22 nt, Human
uucauacuguguuuccaaguuu

SEQ ID NO: 845517 - RNA, 22 nt, Human
aucaaaguaggcauauguuuuu

SEQ ID NO: 845518 - RNA, 22 nt, Human
agcaauaugacauugcuacauc

SEQ ID NO: 845519 - RNA, 22 nt, Human
aauguaugggugagaaaguuga

SEQ ID NO: 845520 - RNA, 22 nt, Human
cacugggcguguccugggugag

SEQ ID NO: 845521 - RNA, 22 nt, Human
aagaguuuucuauaaucuuggc

SEQ ID NO: 845522 - RNA, 22 nt, Human
uagcucuucaaucacugucucc

SEQ ID NO: 845523 - RNA, 20 nt, Human
aucugcuugccuguccucgg

SEQ ID NO: 845524 - RNA, 22 nt, Human
ugccugggccucugaggaaggc

SEQ ID NO: 845525 - RNA, 22 nt, Human
uggcucagaugcucuuccagug

SEQ ID NO: 845526 - RNA, 22 nt, Human
cuggcucccguuguccuugaag

SEQ ID NO: 845527 - RNA, 22 nt, Human
aagacauuacuggaaucugacu

SEQ ID NO: 845528 - RNA, 22 nt, Human
ucaggagacauucuuaaaguag

SEQ ID NO: 845529 - RNA, 22 nt, Human
cccugcagaaccacagacaaac

SEQ ID NO: 845530 - RNA, 19 nt, Human
ccuggaggugaagguucuc

SEQ ID NO: 845531 - RNA, 22 nt, Human
ggauucagugucuguuaauagu

SEQ ID NO: 845532 - RNA, 22 nt, Human
cuggagaggccccaagauauuu

SEQ ID NO: 845533 - RNA, 22 nt, Human
auucuuggagcagucaaagaag

SEQ ID NO: 845534 - RNA, 22 nt, Human
ucccuggggauguuggccugcc

SEQ ID NO: 845535 - RNA, 22 nt, Human
gaaggaaaucugugauuuaugc

SEQ ID NO: 845536 - RNA, 22 nt, Human
uccagggguaccggccaggcag

SEQ ID NO: 845537 - RNA, 22 nt, Human
gugcagugacccuggagagcug

SEQ ID NO: 845538 - RNA, 22 nt, Human
ugcuuauuuauagucaauagag

SEQ ID NO: 845539 - RNA, 22 nt, Human
uuuggaauguaguuuaaucauc

SEQ ID NO: 845540 - RNA, 22 nt, Human
cagaggcucuuccucacugccc

SEQ ID NO: 845541 - RNA, 22 nt, Human
caauagcagcuucugaaugcaa

SEQ ID NO: 845542 - RNA, 22 nt, Human
aggcagguuggugagaagacug

SEQ ID NO: 845543 - RNA, 22 nt, Human
uggcucaguaaucgagucuccu

SEQ ID NO: 845544 - RNA, 22 nt, Human
ucaggagacaaagggugcggag

SEQ ID NO: 845545 - RNA, 22 nt, Human
ggagccuugggcgcucucccau

SEQ ID NO: 845546 - RNA, 22 nt, Human
ccuuuggguucaaucucggucu

SEQ ID NO: 845547 - RNA, 22 nt, Human
agcagccauagauagcaugcaa

SEQ ID NO: 845548 - RNA, 22 nt, Human
cuggagccauguauagccuaug

SEQ ID NO: 845549 - RNA, 22 nt, Human
gccuggaguuguggugaagcca

SEQ ID NO: 845550 - RNA, 22 nt, Human
caaauguaaauucuuuugaagc

SEQ ID NO: 845551 - RNA, 22 nt, Human
cugcugugccuuaaaaugcaag

SEQ ID NO: 845552 - RNA, 22 nt, Human
uaggaaaaauacagaauuauau

SEQ ID NO: 845553 - RNA, 22 nt, Human
uaacacaugguucugucaggaa

SEQ ID NO: 845554 - RNA, 22 nt, Human
aaauuucaagcaaaguagcuau

SEQ ID NO: 845555 - RNA, 22 nt, Human
cugagccagagggagucggguc

SEQ ID NO: 845556 - RNA, 22 nt, Human
cuguaauucacuagggucagcg

SEQ ID NO: 845557 - RNA, 22 nt, Human
caagaaucagaccugucagggu

SEQ ID NO: 845558 - RNA, 22 nt, Human
uccuggagggaggcggugcuac

SEQ ID NO: 845559 - RNA, 22 nt, Human
caggcugucugaauggaggccc

SEQ ID NO: 845560 - RNA, 22 nt, Human
uuugggaacucuaucauggaaa

SEQ ID NO: 845561 - RNA, 22 nt, Human
uggaaggagacugggaagugug

SEQ ID NO: 845562 - RNA, 22 nt, Human
agauaacuuuuggguauucaug

SEQ ID NO: 845563 - RNA, 22 nt, Human
cgccugggaguccacaccugcu

SEQ ID NO: 845564 - RNA, 22 nt, Human
uugcuauuuugagagucauagu

SEQ ID NO: 845565 - RNA, 22 nt, Human
auuuggaaacaauuauauucuu

SEQ ID NO: 845566 - RNA, 22 nt, Human
ggcccagcacagugcuuggggg

SEQ ID NO: 845567 - RNA, 22 nt, Human
ugcugcucaaugagaugccauc

SEQ ID NO: 845568 - RNA, 22 nt, Human
gcugucaggccaugugggccuu

SEQ ID NO: 845569 - RNA, 22 nt, Human
auccuuagguggugcaucaggg

SEQ ID NO: 845570 - RNA, 22 nt, Human
gcugcccagacauugaaucagg

SEQ ID NO: 845571 - RNA, 21 nt, Human
gccaccccuggcacaggugcu

SEQ ID NO: 845572 - RNA, 22 nt, Human
ucauccaguaccauggaaggca

SEQ ID NO: 845573 - RNA, 22 nt, Human
cacaugcauaaggauaauuacu

SEQ ID NO: 845574 - RNA, 22 nt, Human
aggcagugcugugcccugaacc

SEQ ID NO: 845575 - RNA, 22 nt, Human
cuagaaaugcucaagagaaagu

SEQ ID NO: 845576 - RNA, 22 nt, Human
gggcagaggggcgcuucccucu

SEQ ID NO: 845577 - RNA, 21 nt, Human
aaauguguuccauaaugcuuu

SEQ ID NO: 845578 - RNA, 22 nt, Human
agaucauaugaaaaauuucaag

SEQ ID NO: 845579 - RNA, 22 nt, Human
uuucugugguggguaguucaga

SEQ ID NO: 845580 - RNA, 22 nt, Human
cuucuggggauggagcccagaa

SEQ ID NO: 845581 - RNA, 22 nt, Human
cuacuuuaauuuucugcagaga

SEQ ID NO: 845582 - RNA, 22 nt, Human
gccaggcauuuguuaggugcug

SEQ ID NO: 845583 - RNA, 22 nt, Human
gugaccaucagagaauaacaaa

SEQ ID NO: 845584 - RNA, 22 nt, Human
accagagcgcucaagccuuccc

SEQ ID NO: 845585 - RNA, 22 nt, Human
caaaggcaggcccccugugcag

SEQ ID NO: 845586 - RNA, 22 nt, Human
cuucuucaguugcauguauugg

SEQ ID NO: 845587 - RNA, 22 nt, Human
agcccugggaggccagcuugua

SEQ ID NO: 845588 - RNA, 22 nt, Human
ccugauggagcccugcugcaug

SEQ ID NO: 845589 - RNA, 22 nt, Human
gggauggggggaagcguccaug

SEQ ID NO: 845590 - RNA, 22 nt, Human
acaggcugcugagccauuugcu

SEQ ID NO: 845591 - RNA, 22 nt, Human
acucacauuucaucaggccaag

SEQ ID NO: 845592 - RNA, 22 nt, Human
cagacacagcaauucuguguug

SEQ ID NO: 845593 - RNA, 22 nt, Human
cagguggcaugacugccuacaa

SEQ ID NO: 845594 - RNA, 22 nt, Human
guuagaauaaaaggucagagag

SEQ ID NO: 845595 - RNA, 22 nt, Human
caguccuuagauuuuacugcca

SEQ ID NO: 845596 - RNA, 22 nt, Human
ccaggcugggcggggaaccugg

SEQ ID NO: 845597 - RNA, 22 nt, Human
gugagggguggcugagcaguuu

SEQ ID NO: 845598 - RNA, 23 nt, Human
gccaggcuccggucuguggccac

SEQ ID NO: 845599 - RNA, 22 nt, Human
uuucaaaccuacuuguauguuu

SEQ ID NO: 845600 - RNA, 22 nt, Human
ugggccuguugccugaguccau

SEQ ID NO: 845601 - RNA, 22 nt, Human
uuuaggcagcagugaggaugaa

SEQ ID NO: 845602 - RNA, 22 nt, Human
acugcuuacccggccugacuuc

SEQ ID NO: 845603 - RNA, 22 nt, Human
ugcaguggaagagguggagauc

SEQ ID NO: 845604 - RNA, 22 nt, Human
uacaaaugaguuguaugaacca

SEQ ID NO: 845605 - RNA, 22 nt, Human
guaaugaaugaaagaaacuggg

SEQ ID NO: 845606 - RNA, 20 nt, Human
agcugccccugggcacugcc

SEQ ID NO: 845607 - RNA, 22 nt, Human
cugagauggaguuucgcucuuc

SEQ ID NO: 845608 - RNA, 22 nt, Human
cuucugggcauucagcugcaca

SEQ ID NO: 845609 - RNA, 22 nt, Human
auaaaaguuuccaaucaugccu

SEQ ID NO: 845610 - RNA, 22 nt, Human
augcuuaaugaggguauauaug

SEQ ID NO: 845611 - RNA, 22 nt, Human
uuuaaauuuagaagaaacacug

SEQ ID NO: 845612 - RNA, 22 nt, Human
caggaaaaaugccaggagucag

SEQ ID NO: 845613 - RNA, 22 nt, Human
gggcugggauggcuugaagauu

SEQ ID NO: 845614 - RNA, 22 nt, Human
uauuuuguuaauaauccagucc

SEQ ID NO: 845615 - RNA, 22 nt, Human
accuggccauccagcuggcauc

SEQ ID NO: 845616 - RNA, 21 nt, Human
gagcugggcgaggcuccgggg

SEQ ID NO: 845617 - RNA, 22 nt, Human
caaguccucgcuucuagcugug

SEQ ID NO: 845618 - RNA, 22 nt, Human
ucauuugugugagugauuugac

SEQ ID NO: 845619 - RNA, 22 nt, Human
gcucucagguacaaagcugugu

SEQ ID NO: 845620 - RNA, 22 nt, Human
cauggccucaaaggacugcaga

SEQ ID NO: 845621 - RNA, 22 nt, Human
ugugccuucucaguccugcuca

SEQ ID NO: 845622 - RNA, 22 nt, Human
guuuaagaaaauucauguuguu

SEQ ID NO: 845623 - RNA, 22 nt, Human
ccaggagaagcaucugagugua

SEQ ID NO: 845624 - RNA, 22 nt, Human
cacagaauaaauugguaucaga

SEQ ID NO: 845625 - RNA, 22 nt, Human
ggcuuggaaauugcaggacaca

SEQ ID NO: 845626 - RNA, 22 nt, Human
gccugaaguuucaugccucuau

SEQ ID NO: 845627 - RNA, 19 nt, Human
gcuccugggccucacucau

SEQ ID NO: 845628 - RNA, 18 nt, Human
ugacagaaccuggagccu

SEQ ID NO: 845629 - RNA, 22 nt, Human
aaugaaacuguauauagacugu

SEQ ID NO: 845630 - RNA, 22 nt, Human
ugcuggguuaccuaagccuaaa

SEQ ID NO: 845631 - RNA, 22 nt, Human
ccauggcucuagagauugaaaa

SEQ ID NO: 845632 - RNA, 22 nt, Human
caaagccucugauuucacuugu

SEQ ID NO: 845633 - RNA, 22 nt, Human
gccuggagggauagaaugcaag

SEQ ID NO: 845634 - RNA, 22 nt, Human
cuggauuugccuauggugcuuu

SEQ ID NO: 845635 - RNA, 22 nt, Human
ggcaccuggauguagcagugaa

SEQ ID NO: 845636 - RNA, 22 nt, Human
uuacacaacaucuguauuauua

SEQ ID NO: 845637 - RNA, 22 nt, Human
cagcagagcugggcuuugaauu

SEQ ID NO: 845638 - RNA, 22 nt, Human
uaaaugcagcaguuucuguucu

SEQ ID NO: 845639 - RNA, 22 nt, Human
caauuucauggauaaaagaugu

SEQ ID NO: 845640 - RNA, 17 nt, Human
uccauacaauucucucu

SEQ ID NO: 845641 - RNA, 22 nt, Human
cuggcucuaucuccaaggcugg

SEQ ID NO: 845642 - RNA, 22 nt, Human
ggauccuucuuugaccucacag

SEQ ID NO: 845643 - RNA, 22 nt, Human
uggacaggaucugagacugaga

SEQ ID NO: 845644 - RNA, 22 nt, Human
ucccagagauuuccucuccuuc

SEQ ID NO: 845645 - RNA, 22 nt, Human
ugaggcaguugagcuuccugag

SEQ ID NO: 845646 - RNA, 22 nt, Human
caaagccaggcuuucuaaugua

SEQ ID NO: 845647 - RNA, 22 nt, Human
aacacuuugggcauggccuucc

SEQ ID NO: 845648 - RNA, 22 nt, Human
uagaaauguuagauguauugag

SEQ ID NO: 845649 - RNA, 21 nt, Human
ucuuguccuugcucucccacu

SEQ ID NO: 845650 - RNA, 22 nt, Human
gcagagcugucuaagucacuuc

SEQ ID NO: 845651 - RNA, 20 nt, Human
uccagccacuuccgcugguc

SEQ ID NO: 845652 - RNA, 22 nt, Human
uguuuaaucuauaaaauggaga

SEQ ID NO: 845653 - RNA, 22 nt, Human
aggaugagaagauuggaaucuu

SEQ ID NO: 845654 - RNA, 22 nt, Human
gcucagagggaacaaggggcug

SEQ ID NO: 845655 - RNA, 22 nt, Human
gggauggcuuuguggcugacuc

SEQ ID NO: 845656 - RNA, 22 nt, Human
agguauaagucucauuucuguu

SEQ ID NO: 845657 - RNA, 22 nt, Human
agcccccaaaagugcuuaugau

SEQ ID NO: 845658 - RNA, 22 nt, Human
caggguggaaaagcuaguugga

SEQ ID NO: 845659 - RNA, 22 nt, Human
cagaucuguaguaaaagaucuc

SEQ ID NO: 845660 - RNA, 22 nt, Human
gcacccagggacuuggcuggcc

SEQ ID NO: 845661 - RNA, 22 nt, Human
ucagaaaugaucguuauucauu

SEQ ID NO: 845662 - RNA, 22 nt, Human
uggcucuggauuaaucuaggaa

SEQ ID NO: 845663 - RNA, 22 nt, Human
uuucaacuugaagaauugauac

SEQ ID NO: 845664 - RNA, 22 nt, Human
aggagcugucagagugccagag

SEQ ID NO: 845665 - RNA, 21 nt, Human
gcacagggacagaucaucaca

SEQ ID NO: 845666 - RNA, 22 nt, Human
cagucccagacccagaaggugg

SEQ ID NO: 845667 - RNA, 22 nt, Human
cuggcagcauggagccugugcu

SEQ ID NO: 845668 - RNA, 22 nt, Human
guggcucuccauugacauggaa

SEQ ID NO: 845669 - RNA, 22 nt, Human
ucuucaauuagauuuaccaauu

SEQ ID NO: 845670 - RNA, 22 nt, Human
caggggccggcuguccgugccc

SEQ ID NO: 845671 - RNA, 22 nt, Human
ugucacauugaauaugauuuau

SEQ ID NO: 845672 - RNA, 23 nt, Human
ugcucccaggugacgcugcuguu

SEQ ID NO: 845673 - RNA, 23 nt, Human
ucccuggaggcagguccagggcc

SEQ ID NO: 845674 - RNA, 22 nt, Human
aauucuguuacuaaugugaugu

SEQ ID NO: 845675 - RNA, 22 nt, Human
gcuggccacacugcugauggag

SEQ ID NO: 845676 - RNA, 22 nt, Human
cugcaggcucgaagacacggau

SEQ ID NO: 845677 - RNA, 22 nt, Human
accaucagucauugucaguggg

SEQ ID NO: 845678 - RNA, 22 nt, Human
cauuucaaugccuucaacauag

SEQ ID NO: 845679 - RNA, 22 nt, Human
ccaggccagcaggcacaccugc

SEQ ID NO: 845680 - RNA, 22 nt, Human
ugccugcugcuaagcucuuugu

SEQ ID NO: 845681 - RNA, 22 nt, Human
ugccucugguuaucugguaccu

SEQ ID NO: 845682 - RNA, 22 nt, Human
cagcagaggcacgucugugaau

SEQ ID NO: 845683 - RNA, 22 nt, Human
aagccagggauuccugagggag

SEQ ID NO: 845684 - RNA, 22 nt, Human
cucccagggccaucgagucacu

SEQ ID NO: 845685 - RNA, 22 nt, Human
gaagcccacguuuggugaugua

SEQ ID NO: 845686 - RNA, 22 nt, Human
uaucuacuccucuuucagaugc

SEQ ID NO: 845687 - RNA, 22 nt, Human
ugccugggccuucccaccucug

SEQ ID NO: 845688 - RNA, 22 nt, Human
agcagaagaaagccacaugacu

SEQ ID NO: 845689 - RNA, 22 nt, Human
ucccagagaaagucaaggucuu

SEQ ID NO: 845690 - RNA, 22 nt, Human
cccuggcauaaaacuucuccag

SEQ ID NO: 845691 - RNA, 22 nt, Human
ucuguucagaagaggugaaagu

SEQ ID NO: 845692 - RNA, 22 nt, Human
ucugaaaugcaaauuugacuga

SEQ ID NO: 845693 - RNA, 22 nt, Human
agugaggcuaauaggcaauggu

SEQ ID NO: 845694 - RNA, 22 nt, Human
ucaauaauggcaggauaaauuu

SEQ ID NO: 845695 - RNA, 22 nt, Human
aauuuagauugauaaacaugga

SEQ ID NO: 845696 - RNA, 22 nt, Human
agagccuggucugagauaggac

SEQ ID NO: 845697 - RNA, 22 nt, Human
acugggccuggauuggcguguc

SEQ ID NO: 845698 - RNA, 21 nt, Human
agccuguugguuuacugcuca

SEQ ID NO: 845699 - RNA, 22 nt, Human
uacacaugaucauuuaguagca

SEQ ID NO: 845700 - RNA, 22 nt, Human
agacugaauaacaagcaaauaa

SEQ ID NO: 845701 - RNA, 22 nt, Human
guguaucaaagcacagacuuca

SEQ ID NO: 845702 - RNA, 22 nt, Human
cugucaguucuuccagauagag

SEQ ID NO: 845703 - RNA, 22 nt, Human
agaggcaguauacaauccgagc

SEQ ID NO: 845704 - RNA, 23 nt, Human
cagugcagggcaacucagacucc

SEQ ID NO: 845705 - RNA, 22 nt, Human
agggagaaugaccaagguauau

SEQ ID NO: 845706 - RNA, 22 nt, Human
uauauauucuuaaguaguguag

SEQ ID NO: 845707 - RNA, 22 nt, Human
uucuuuggggaauauucugguu

SEQ ID NO: 845708 - RNA, 22 nt, Human
cccaggagagggaaccaaaugu

SEQ ID NO: 845709 - RNA, 22 nt, Human
ugggguggauagaaagugaugu

SEQ ID NO: 845710 - RNA, 22 nt, Human
cacugcaguuccccagugcgca

SEQ ID NO: 845711 - RNA, 22 nt, Human
agaugaaagauuuuuauagaga

SEQ ID NO: 845712 - RNA, 22 nt, Human
ugcauaguucuccuuccuccuc

SEQ ID NO: 845713 - RNA, 16 nt, Human
aaggagggaagagaau

SEQ ID NO: 845714 - RNA, 22 nt, Human
cauuuacuguugaaucccuagc

SEQ ID NO: 845715 - RNA, 22 nt, Human
augcuuuagugucaaguuuggg

SEQ ID NO: 845716 - RNA, 22 nt, Human
uacuuacagaaggaagcaauug

SEQ ID NO: 845717 - RNA, 22 nt, Human
uagaugcuguagaaauacuuau

SEQ ID NO: 845718 - RNA, 22 nt, Human
uagcauuuauggucaugugucc

SEQ ID NO: 845719 - RNA, 22 nt, Human
gaugggauuuuuuauguguuca

SEQ ID NO: 845720 - RNA, 17 nt, Human
ggugagaccucccacuc

SEQ ID NO: 845721 - RNA, 22 nt, Human
guggugcaggccagcaggggcg

SEQ ID NO: 845722 - RNA, 22 nt, Human
uauucacaugaaaacaaauuuu

SEQ ID NO: 845723 - RNA, 19 nt, Human
gcccugcaggagguggggc

SEQ ID NO: 845724 - RNA, 22 nt, Human
aguaauaauuuauauuagggag

SEQ ID NO: 845725 - RNA, 21 nt, Human
aggugccaaggagaagcaggc

SEQ ID NO: 845726 - RNA, 22 nt, Human
agaaaacauuacauaggugugu

SEQ ID NO: 845727 - RNA, 22 nt, Human
uugucuguccaggcaccccaag

SEQ ID NO: 845728 - RNA, 22 nt, Human
ucuucagauggccaguuguccc

SEQ ID NO: 845729 - RNA, 22 nt, Human
cagccagggagggcaaaugaga

SEQ ID NO: 845730 - RNA, 19 nt, Human
cuggugcuugagugaguca

SEQ ID NO: 845731 - RNA, 22 nt, Human
gcaggagacuggcugugguagu

SEQ ID NO: 845732 - RNA, 22 nt, Human
gcuauacaaguguagaauagag

SEQ ID NO: 845733 - RNA, 19 nt, Human
ugucccagacuccgugucu

SEQ ID NO: 845734 - RNA, 22 nt, Human
gcccucagcuccuggacacaug

SEQ ID NO: 845735 - RNA, 22 nt, Human
gauuuauuggucuuucauuggu

SEQ ID NO: 845736 - RNA, 22 nt, Human
uggaggccagagguacugggac

SEQ ID NO: 845737 - RNA, 19 nt, Human
ggucacagggguuacaagg

SEQ ID NO: 845738 - RNA, 22 nt, Human
uauuccagguauucuucaagag

SEQ ID NO: 845739 - RNA, 22 nt, Human
ugccucuguggaaauggugguc

SEQ ID NO: 845740 - RNA, 21 nt, Human
gccacguuucagucuucucag

SEQ ID NO: 845741 - RNA, 22 nt, Human
cauuucugugacacuuccaucu

SEQ ID NO: 845742 - RNA, 22 nt, Human
ucuguuccauguuuuguuccau

SEQ ID NO: 845743 - RNA, 22 nt, Human
ccucccacuucuugcugagguc

SEQ ID NO: 845744 - RNA, 22 nt, Human
aucuggcuggauucuuagcguu

SEQ ID NO: 845745 - RNA, 22 nt, Human
ggacccugggcuugcuccuggg

SEQ ID NO: 845746 - RNA, 20 nt, Human
ucugcucagcccucaguggc

SEQ ID NO: 845747 - RNA, 22 nt, Human
uauaacaguuuaggugguguca

SEQ ID NO: 845748 - RNA, 22 nt, Human
ugggcucugaagucagucugcu

SEQ ID NO: 845749 - RNA, 22 nt, Human
acaaagucuuuuacaacaguca

SEQ ID NO: 845750 - RNA, 22 nt, Human
augcucuggaguacgugaaauu

SEQ ID NO: 845751 - RNA, 22 nt, Human
accccagcucugagccacacca

SEQ ID NO: 845752 - RNA, 17 nt, Human
uuucaucugggaccacc

SEQ ID NO: 845753 - RNA, 22 nt, Human
uacaaaaaauugauacugacga

SEQ ID NO: 845754 - RNA, 18 nt, Human
aaguaacagaagagcaca

SEQ ID NO: 845755 - RNA, 22 nt, Human
ucuuugcaggagcccuuugaac

SEQ ID NO: 845756 - RNA, 22 nt, Human
caugggagguuggcuuggcaug

SEQ ID NO: 845757 - RNA, 22 nt, Human
ugggauggcauccugggccuug

SEQ ID NO: 845758 - RNA, 22 nt, Human
caaaugcuaacuucuuuccaaa

SEQ ID NO: 845759 - RNA, 22 nt, Human
gagucccaugaugauagccaca

SEQ ID NO: 845760 - RNA, 22 nt, Human
agcagccaguucucugugguag

SEQ ID NO: 845761 - RNA, 22 nt, Human
gauuauauaauggaagcucuug

SEQ ID NO: 845762 - RNA, 22 nt, Human
ccaggacuucgaggcuacagug

SEQ ID NO: 845763 - RNA, 22 nt, Human
gagggagagugauggaccauug

SEQ ID NO: 845764 - RNA, 18 nt, Human
ggagagugagaucaaaca

SEQ ID NO: 845765 - RNA, 22 nt, Human
auuuuacuacuccaauuaauga

SEQ ID NO: 845766 - RNA, 22 nt, Human
gaggcaugucuggccuguccca

SEQ ID NO: 845767 - RNA, 22 nt, Human
uccaggagcucauccacgucaa

SEQ ID NO: 845768 - RNA, 21 nt, Human
ugcuucucuagaucaacuacu

SEQ ID NO: 845769 - RNA, 22 nt, Human
ugcauuguugaauauuucauag

SEQ ID NO: 845770 - RNA, 22 nt, Human
gcuaugcaggagccuaaugaca

SEQ ID NO: 845771 - RNA, 22 nt, Human
gaaauauacaugaagucggcug

SEQ ID NO: 845772 - RNA, 22 nt, Human
cugcuuccaugcaauggcaguc

SEQ ID NO: 845773 - RNA, 22 nt, Human
ugaaguuguuaagguugccauu

SEQ ID NO: 845774 - RNA, 22 nt, Human
ugcagggccgcuggaggucaug

SEQ ID NO: 845775 - RNA, 23 nt, Human
ucagugauguugaaccuagcagu

SEQ ID NO: 845776 - RNA, 21 nt, Human
uggagcugccacuuguccucc

SEQ ID NO: 845777 - RNA, 22 nt, Human
uggcagcuggcucugcgcaggc

SEQ ID NO: 845778 - RNA, 22 nt, Human
gagcuuccugaugccgaccagu

SEQ ID NO: 845779 - RNA, 22 nt, Human
auuccaaagacagaagcagcug

SEQ ID NO: 845780 - RNA, 22 nt, Human
cggcagagacggcgcuuugaac

SEQ ID NO: 845781 - RNA, 22 nt, Human
cccagcaggucggugcugccug

SEQ ID NO: 845782 - RNA, 22 nt, Human
cuugaaagauuuggccucugug

SEQ ID NO: 845783 - RNA, 22 nt, Human
gcauuauuaauagcugcaugag

SEQ ID NO: 845784 - RNA, 22 nt, Human
aaggucauuuuuuccucuguug

SEQ ID NO: 845785 - RNA, 22 nt, Human
uacuuacagagcuuauaaguua

SEQ ID NO: 845786 - RNA, 22 nt, Human
agcuucuugggcuuuacacaaa

SEQ ID NO: 845787 - RNA, 22 nt, Human
gcagggucgcucuaggagauca

SEQ ID NO: 845788 - RNA, 22 nt, Human
ucacuguauuugcugaugcaua

SEQ ID NO: 845789 - RNA, 22 nt, Human
uaaggcacccauguucauacag

SEQ ID NO: 845790 - RNA, 22 nt, Human
guucuucaggcugugcucuaga

SEQ ID NO: 845791 - RNA, 22 nt, Human
agcucccagaguccucugccca

SEQ ID NO: 845792 - RNA, 22 nt, Human
acagcagcuugcgugucugguc

SEQ ID NO: 845793 - RNA, 22 nt, Human
aaucagaaaggcuaaggaagca

SEQ ID NO: 845794 - RNA, 22 nt, Human
cugccagcucucuggaggcucu

SEQ ID NO: 845795 - RNA, 22 nt, Human
cacagggcuaaaugaaggguug

SEQ ID NO: 845796 - RNA, 22 nt, Human
cacaggagcuguggggcagugu

SEQ ID NO: 845797 - RNA, 22 nt, Human
uccugccucuuuucuuauucca

SEQ ID NO: 845798 - RNA, 19 nt, Human
gaggucagcaagaaguauu

SEQ ID NO: 845799 - RNA, 22 nt, Human
agguggccggugccagccgggc

SEQ ID NO: 845800 - RNA, 23 nt, Human
cauguacacacagcuguacagug

SEQ ID NO: 845801 - RNA, 22 nt, Human
ggagccuguggccgucacgacu

SEQ ID NO: 845802 - RNA, 22 nt, Human
cagcagggcccccgggugcgcc

SEQ ID NO: 845803 - RNA, 22 nt, Human
gccugagagacccauggggcaa

SEQ ID NO: 845804 - RNA, 22 nt, Human
ccgggcgggggcucucgucacc

SEQ ID NO: 845805 - RNA, 22 nt, Human
auagacauagccguaauuuauu

SEQ ID NO: 845806 - RNA, 22 nt, Human
uuccuuagcuccucauggccug

SEQ ID NO: 845807 - RNA, 22 nt, Human
ggcuggcaagugucugcucaug

SEQ ID NO: 845808 - RNA, 22 nt, Human
agcagagcccuuccauggccuu

SEQ ID NO: 845809 - RNA, 22 nt, Human
ggagccugugggaugagaugug

SEQ ID NO: 845810 - RNA, 22 nt, Human
ggaugcaggaguugaagaagga

SEQ ID NO: 845811 - RNA, 22 nt, Human
gaucuguuucauucacagucug

SEQ ID NO: 845812 - RNA, 22 nt, Human
ggccauggaccccgagcugacc

SEQ ID NO: 845813 - RNA, 22 nt, Human
cuucugugauuugguuaggaua

SEQ ID NO: 845814 - RNA, 22 nt, Human
cagcuggaucccugcagaacuu

SEQ ID NO: 845815 - RNA, 22 nt, Human
aggccugucuggggcucagcca

SEQ ID NO: 845816 - RNA, 22 nt, Human
ugccucagaguugucccuacca

SEQ ID NO: 845817 - RNA, 22 nt, Human
cugcugagcaucagggcugccc

SEQ ID NO: 845818 - RNA, 22 nt, Human
gaugauggacaaagcauuggug

SEQ ID NO: 845819 - RNA, 22 nt, Human
acauauuuugaaagcuuucuaa

SEQ ID NO: 845820 - RNA, 22 nt, Human
aguuuuuccugauuuuacagaa

SEQ ID NO: 845821 - RNA, 22 nt, Human
ucagcaaugugauacugugcaa

SEQ ID NO: 845822 - RNA, 20 nt, Human
cuucuucagccuaugcuuca

SEQ ID NO: 845823 - RNA, 22 nt, Human
aagcagugcgcucaucuaaggg

SEQ ID NO: 845824 - RNA, 22 nt, Human
acauaauaccuaggacaguuug

SEQ ID NO: 845825 - RNA, 22 nt, Human
cggcuggguagaggugccgggu

SEQ ID NO: 845826 - RNA, 22 nt, Human
ucauaacagcuaagucccuuuc

SEQ ID NO: 845827 - RNA, 22 nt, Human
gcugucugcugugcacugagca

SEQ ID NO: 845828 - RNA, 22 nt, Human
gcugaagggagugcugagucug

SEQ ID NO: 845829 - RNA, 22 nt, Human
caguguuccaggcggcagugaa

SEQ ID NO: 845830 - RNA, 19 nt, Human
cugaggcccauguaccaug

SEQ ID NO: 845831 - RNA, 22 nt, Human
ggugaaggucuacugugugcca

SEQ ID NO: 845832 - RNA, 22 nt, Human
aaagccaugaauguuauagagg

SEQ ID NO: 845833 - RNA, 22 nt, Human
agcagggccaacaguaaacacc

SEQ ID NO: 845834 - RNA, 22 nt, Human
uauuucugaggcccaggaagug

SEQ ID NO: 845835 - RNA, 22 nt, Human
cuagaaaaauacuuuauuguga

SEQ ID NO: 845836 - RNA, 19 nt, Human
agucucaguguacagaggc

SEQ ID NO: 845837 - RNA, 22 nt, Human
aagucauugguagcuugauagg

SEQ ID NO: 845838 - RNA, 22 nt, Human
uagggcagccuuauagcuccca

SEQ ID NO: 845839 - RNA, 22 nt, Human
cagggcagggccacacccccug

SEQ ID NO: 845840 - RNA, 22 nt, Human
gacggcagaaacucaugagguc

SEQ ID NO: 845841 - RNA, 22 nt, Human
auuguauuagcacaauacaauu

SEQ ID NO: 845842 - RNA, 22 nt, Human
auuaaaauuccaagguaugcca

SEQ ID NO: 845843 - RNA, 22 nt, Human
aaaugcacaauaaaguaaaggc

SEQ ID NO: 845844 - RNA, 22 nt, Human
aguccuuagaacagugccuggg

SEQ ID NO: 845845 - RNA, 22 nt, Human
cuggagcucuguguguuccuga

SEQ ID NO: 845846 - RNA, 22 nt, Human
agggagguaggagcuucuagcu

SEQ ID NO: 845847 - RNA, 22 nt, Human
uauuucaacguaugaaaagcug

SEQ ID NO: 845848 - RNA, 22 nt, Human
cugaauaauacagacuagcuuc

SEQ ID NO: 845849 - RNA, 17 nt, Human
aggcugcugggccaggg

SEQ ID NO: 845850 - RNA, 22 nt, Human
gccuaggagacaagcgugaaag

SEQ ID NO: 845851 - RNA, 22 nt, Human
gcagagcugggucuguauccaa

SEQ ID NO: 845852 - RNA, 22 nt, Human
aauucacaaaaguuagauccau

SEQ ID NO: 845853 - RNA, 22 nt, Human
augggcuguccuaguccagccc

SEQ ID NO: 845854 - RNA, 22 nt, Human
cagcugcuguuacugcuuauua

SEQ ID NO: 845855 - RNA, 22 nt, Human
ccugucaggguuugccucagaa

SEQ ID NO: 845856 - RNA, 22 nt, Human
agucccagcuucccccaugcag

SEQ ID NO: 845857 - RNA, 22 nt, Human
cagggacugagauccagacugu

SEQ ID NO: 845858 - RNA, 22 nt, Human
acaacauuauacauagaaagcu

SEQ ID NO: 845859 - RNA, 22 nt, Human
cuucucagcauuuugucagucu

SEQ ID NO: 845860 - RNA, 22 nt, Human
ucuuagaaguuuauggcacgga

SEQ ID NO: 845861 - RNA, 22 nt, Human
aauuucaagucuugaagaagua

SEQ ID NO: 845862 - RNA, 22 nt, Human
uccugagagcagcugcuuugga

SEQ ID NO: 845863 - RNA, 22 nt, Human
uuuauccagaaucaggauuuuu

SEQ ID NO: 845864 - RNA, 22 nt, Human
ccaggcucugcgcuggacaugg

SEQ ID NO: 845865 - RNA, 22 nt, Human
ggccugagaaccauggggccaa

SEQ ID NO: 845866 - RNA, 22 nt, Human
aaauugcagaugcuaaaugacu

SEQ ID NO: 845867 - RNA, 22 nt, Human
cugacccauauaagaguggagg

SEQ ID NO: 845868 - RNA, 22 nt, Human
uaaaguucuggugagagguaag

SEQ ID NO: 845869 - RNA, 22 nt, Human
cauuacaugguccaggauauau

SEQ ID NO: 845870 - RNA, 22 nt, Human
ggauguugauugaauggccauu

SEQ ID NO: 845871 - RNA, 22 nt, Human
ccuuuccuuuuuagugugggag

SEQ ID NO: 845872 - RNA, 18 nt, Human
uggcucuggacuugcucc

SEQ ID NO: 845873 - RNA, 22 nt, Human
gcugcucugaaaaugacuguug

SEQ ID NO: 845874 - RNA, 18 nt, Human
cugccuguugcugagagg

SEQ ID NO: 845875 - RNA, 22 nt, Human
uggcucagauuuuuguaggcuu

SEQ ID NO: 845876 - RNA, 22 nt, Human
uaaagccacgcuggaaaucagg

SEQ ID NO: 845877 - RNA, 22 nt, Human
cagucccaguuugagacucugg

SEQ ID NO: 845878 - RNA, 22 nt, Human
augguuuaaagaguaugacuuu

SEQ ID NO: 845879 - RNA, 22 nt, Human
agagggaucacccuguuucugg

SEQ ID NO: 845880 - RNA, 22 nt, Human
cucccaggacucagaggagaag

SEQ ID NO: 845881 - RNA, 22 nt, Human
agcugccaaguuggaguagcaa

SEQ ID NO: 845882 - RNA, 22 nt, Human
gccucccuggcccacagcagcg

SEQ ID NO: 845883 - RNA, 22 nt, Human
caguccagcccccugcuaaaag

SEQ ID NO: 845884 - RNA, 22 nt, Human
cuucagaaugggacuguguuug

SEQ ID NO: 845885 - RNA, 22 nt, Human
acauuucuccuugcaggaguca

SEQ ID NO: 845886 - RNA, 22 nt, Human
uuucaguguaagguuuccagga

SEQ ID NO: 845887 - RNA, 22 nt, Human
uccagggaugccagccauguug

SEQ ID NO: 845888 - RNA, 22 nt, Human
gcagcaggagaguuuguccugc

SEQ ID NO: 845889 - RNA, 17 nt, Human
gcagcagagagacccuc

SEQ ID NO: 845890 - RNA, 22 nt, Human
ccaggaaauggcuugcuucuuu

SEQ ID NO: 845891 - RNA, 22 nt, Human
cugaauaauuuucuguuguaug

SEQ ID NO: 845892 - RNA, 22 nt, Human
cacaguggcagguguggguugu

SEQ ID NO: 845893 - RNA, 22 nt, Human
aaucacaauuacuuuugcacca

SEQ ID NO: 845894 - RNA, 22 nt, Human
ccaggugguucaggucaccaua

SEQ ID NO: 845895 - RNA, 22 nt, Human
gcagggcucugcuguaguccua

SEQ ID NO: 845896 - RNA, 22 nt, Human
cagcagagcuuauguuggguca

SEQ ID NO: 845897 - RNA, 22 nt, Human
acaugcuuuucccacaauuaua

SEQ ID NO: 845898 - RNA, 22 nt, Human
agucaguguucuccggagaggc

SEQ ID NO: 845899 - RNA, 22 nt, Human
agaaaagguugaaaguaggauu

SEQ ID NO: 845900 - RNA, 22 nt, Human
aacaucagaauauccauguugg

SEQ ID NO: 845901 - RNA, 22 nt, Human
uccucaggugacuagguaucuu

SEQ ID NO: 845902 - RNA, 22 nt, Human
uguaugaauauguauuuucaua

SEQ ID NO: 845903 - RNA, 22 nt, Human
cagcugccagcuucucuccauc

SEQ ID NO: 845904 - RNA, 17 nt, Human
acagggcagaaacagcu

SEQ ID NO: 845905 - RNA, 22 nt, Human
aaaugcuguguuuuaacauaga

SEQ ID NO: 845906 - RNA, 22 nt, Human
ucuggcuccacaccucacugca

SEQ ID NO: 845907 - RNA, 22 nt, Human
gcagagcauguccucaggacag

SEQ ID NO: 845908 - RNA, 22 nt, Human
caguagcacuagauaugugugg

SEQ ID NO: 845909 - RNA, 22 nt, Human
cugaagagcucuccuguccccu

SEQ ID NO: 845910 - RNA, 22 nt, Human
cugucucagcaggaagucauca

SEQ ID NO: 845911 - RNA, 18 nt, Human
aaagaaggauuggagagc

SEQ ID NO: 845912 - RNA, 18 nt, Human
ugcucuguuuaaugauuu

SEQ ID NO: 845913 - RNA, 22 nt, Human
uggucucugacucugaagaccc

SEQ ID NO: 845914 - RNA, 22 nt, Human
gcacccagaauaaggacaggac

SEQ ID NO: 845915 - RNA, 22 nt, Human
ugccuggcaagaggggcuggcu

SEQ ID NO: 845916 - RNA, 22 nt, Human
cauugacaguucuuuaaguugc

SEQ ID NO: 845917 - RNA, 23 nt, Human
ucucaggacacacaugucuauca

SEQ ID NO: 845918 - RNA, 22 nt, Human
gcuggggagggcgucaaggcca

SEQ ID NO: 845919 - RNA, 18 nt, Human
ucuggcucaggacugaac

SEQ ID NO: 845920 - RNA, 19 nt, Human
agcagagcccugaagaucc

SEQ ID NO: 845921 - RNA, 22 nt, Human
uagauuucaggcuggcuugcgg

SEQ ID NO: 845922 - RNA, 22 nt, Human
uggcuuccugcauggauccucu

SEQ ID NO: 845923 - RNA, 22 nt, Human
uauuaaauuauggauuuaggag

SEQ ID NO: 845924 - RNA, 22 nt, Human
ccugucuggccuuccacggggg

SEQ ID NO: 845925 - RNA, 22 nt, Human
ucacaugcucaccuaagccaca

SEQ ID NO: 845926 - RNA, 22 nt, Human
auuguacaugcagugagucauc

SEQ ID NO: 845927 - RNA, 22 nt, Human
agacaacaucacuaaagcugag

SEQ ID NO: 845928 - RNA, 22 nt, Human
uggauaaacucacuguaaguug

SEQ ID NO: 845929 - RNA, 22 nt, Human
ugucaccaaguugaugaaugca

SEQ ID NO: 845930 - RNA, 22 nt, Human
ccucccacauugaggacaugcu

SEQ ID NO: 845931 - RNA, 22 nt, Human
augaacugcaguauaaacuugg

SEQ ID NO: 845932 - RNA, 22 nt, Human
ugaacaguuucaagaaaacuuu

SEQ ID NO: 845933 - RNA, 22 nt, Human
agugcuuuagagaaauggugcu

SEQ ID NO: 845934 - RNA, 22 nt, Human
aaggacagggaugguugauugu

SEQ ID NO: 845935 - RNA, 22 nt, Human
uugacaagaaucguugccuugg

SEQ ID NO: 845936 - RNA, 22 nt, Human
gugcauuugugcaugcacaugu

SEQ ID NO: 845937 - RNA, 22 nt, Human
uaagaacaagauguuccuguuu

SEQ ID NO: 845938 - RNA, 22 nt, Human
agcagccuuugaucaucuggga

SEQ ID NO: 845939 - RNA, 22 nt, Human
cugggaugucuauagaacacuu

SEQ ID NO: 845940 - RNA, 22 nt, Human
agacagagauacuauguuguca

SEQ ID NO: 845941 - RNA, 22 nt, Human
gguggccugcccugaucccugg

SEQ ID NO: 845942 - RNA, 22 nt, Human
uauacaauggcugaaucaucca

SEQ ID NO: 845943 - RNA, 22 nt, Human
ggcccagcugugcuuccagccc

SEQ ID NO: 845944 - RNA, 22 nt, Human
gcuguucauuagaaauagaaug

SEQ ID NO: 845945 - RNA, 23 nt, Human
acagaaaucauuuguaagguacc

SEQ ID NO: 845946 - RNA, 22 nt, Human
accugagcaugccaggagagug

SEQ ID NO: 845947 - RNA, 22 nt, Human
ggggcugguggugguuucucca

SEQ ID NO: 845948 - RNA, 22 nt, Human
agauuucaaugugagcauuagu

SEQ ID NO: 845949 - RNA, 22 nt, Human
cucccuggcacagcgagagguu

SEQ ID NO: 845950 - RNA, 22 nt, Human
cauguacaguuuuucuguccug

SEQ ID NO: 845951 - RNA, 22 nt, Human
ggccucuggucaagacaagcau

SEQ ID NO: 845952 - RNA, 22 nt, Human
uaaacauguugacaucuuaccu

SEQ ID NO: 845953 - RNA, 22 nt, Human
agaugcugugaggaagcuagga

SEQ ID NO: 845954 - RNA, 22 nt, Human
ugugaagcuggauccuggagcu

SEQ ID NO: 845955 - RNA, 22 nt, Human
gucuggaggaggaagaaggcac

SEQ ID NO: 845956 - RNA, 22 nt, Human
aguguuguaugggaugacugcu

SEQ ID NO: 845957 - RNA, 22 nt, Human
gacaguuuuuaauccuuucaug

SEQ ID NO: 845958 - RNA, 22 nt, Human
agggaagagcuugcaagaaacc

SEQ ID NO: 845959 - RNA, 22 nt, Human
gcuggccugcaaagcccggcug

SEQ ID NO: 845960 - RNA, 22 nt, Human
cagagauuauuauaacuaauua

SEQ ID NO: 845961 - RNA, 21 nt, Human
ucaggagagcccaucuacaaa

SEQ ID NO: 845962 - RNA, 22 nt, Human
uagcccagaagagggaagcaac

SEQ ID NO: 845963 - RNA, 21 nt, Human
ccugugugucugacugggcua

SEQ ID NO: 845964 - RNA, 22 nt, Human
gcuacugauugaccuuggagag

SEQ ID NO: 845965 - RNA, 22 nt, Human
cccagggacagcuagguggggc

SEQ ID NO: 845966 - RNA, 22 nt, Human
gagggaggcaucaugaauccag

SEQ ID NO: 845967 - RNA, 22 nt, Human
aagccaaugagagaggccucag

SEQ ID NO: 845968 - RNA, 19 nt, Human
augauggucccauucaccu

SEQ ID NO: 845969 - RNA, 22 nt, Human
auccuugagaaaauaaaugacc

SEQ ID NO: 845970 - RNA, 22 nt, Human
acuuuaauuaaugaacuguggc

SEQ ID NO: 845971 - RNA, 22 nt, Human
aaagagcuaacauugccgagau

SEQ ID NO: 845972 - RNA, 22 nt, Human
cugagauggccacugggucuca

SEQ ID NO: 845973 - RNA, 22 nt, Human
uuuccucuucuucccaugucau

SEQ ID NO: 845974 - RNA, 22 nt, Human
ugcagccauuuucugccaaugc

SEQ ID NO: 845975 - RNA, 22 nt, Human
gaggggcugggcagucccugga

SEQ ID NO: 845976 - RNA, 22 nt, Human
agucccagugagaugaaccagg

SEQ ID NO: 845977 - RNA, 22 nt, Human
uggccucucuaccaggcagccu

SEQ ID NO: 845978 - RNA, 22 nt, Human
gaauaguucuauggcugcaggg

SEQ ID NO: 845979 - RNA, 22 nt, Human
aaguuacaggagaaagagauca

SEQ ID NO: 845980 - RNA, 23 nt, Human
ggacagggcccugcccuauggcc

SEQ ID NO: 845981 - RNA, 22 nt, Human
aauauccacacugugucccugc

SEQ ID NO: 845982 - RNA, 22 nt, Human
ucaugaacauggaauaucuuuu

SEQ ID NO: 845983 - RNA, 22 nt, Human
cauuuagacauuugauuugggg

SEQ ID NO: 845984 - RNA, 22 nt, Human
cauggacucugguuuggggagc

SEQ ID NO: 845985 - RNA, 22 nt, Human
auuugcuucugugaaaucaagu

SEQ ID NO: 845986 - RNA, 22 nt, Human
aggagccaagauggggcaagua

SEQ ID NO: 845987 - RNA, 22 nt, Human
aaugggauaggucuucaggaau

SEQ ID NO: 845988 - RNA, 22 nt, Human
cagccagguucaaguccuuaua

SEQ ID NO: 845989 - RNA, 22 nt, Human
ccuggcugucguuuugugaaau

SEQ ID NO: 845990 - RNA, 22 nt, Human
acaugucuuuuaaagucuaaua

SEQ ID NO: 845991 - RNA, 22 nt, Human
uguccucaaggagcuucagucu

SEQ ID NO: 845992 - RNA, 22 nt, Human
uccuuagagauacugucuugaa

SEQ ID NO: 845993 - RNA, 22 nt, Human
gcuccaggagagggaagcagau

SEQ ID NO: 845994 - RNA, 22 nt, Human
ucucagggccccaaaggcuagu

SEQ ID NO: 845995 - RNA, 22 nt, Human
agcagccacagucugggacagg

SEQ ID NO: 845996 - RNA, 18 nt, Human
cucucugggugaggacaa

SEQ ID NO: 845997 - RNA, 21 nt, Human
ccaccaggucuucugcucggg

SEQ ID NO: 845998 - RNA, 23 nt, Human
uguaugaauaugccacaguuuaa

SEQ ID NO: 845999 - RNA, 23 nt, Human
gggaccagcuagggcugugaccu

SEQ ID NO: 846000 - RNA, 22 nt, Human
cacagggccuggggcagcugcu

SEQ ID NO: 846001 - RNA, 22 nt, Human
auucuucauguugaagcuguca

SEQ ID NO: 846002 - RNA, 22 nt, Human
uaucuuguaauagguccacuug

SEQ ID NO: 846003 - RNA, 17 nt, Human
cagggcugucugccuag

SEQ ID NO: 846004 - RNA, 22 nt, Human
aagacaagcaucaaaucaggca

SEQ ID NO: 846005 - RNA, 22 nt, Human
cugaaggaagcagaagcgaggu

SEQ ID NO: 846006 - RNA, 22 nt, Human
ccauuguaaagaguauacuuug

SEQ ID NO: 846007 - RNA, 22 nt, Human
ugaagaugucagcagggguggu

SEQ ID NO: 846008 - RNA, 22 nt, Human
aaaaguuaccucuguaauauaa

SEQ ID NO: 846009 - RNA, 22 nt, Human
gcugccagccaacuugcugugc

SEQ ID NO: 846010 - RNA, 22 nt, Human
uucuguguggguagcuccuguu

SEQ ID NO: 846011 - RNA, 22 nt, Human
gcucugcuguguuuguucagca

SEQ ID NO: 846012 - RNA, 22 nt, Human
aauagcucacugauuucucuuu

SEQ ID NO: 846013 - RNA, 21 nt, Human
gaguccuuccaauguccucag

SEQ ID NO: 846014 - RNA, 22 nt, Human
acugugugggccgcucacuggg

SEQ ID NO: 846015 - RNA, 22 nt, Human
ugggcuggagcuuguugcuucc

SEQ ID NO: 846016 - RNA, 22 nt, Human
gcucugcucuaacauuccugac

SEQ ID NO: 846017 - RNA, 22 nt, Human
auuugcaaagucguaucuguga

SEQ ID NO: 846018 - RNA, 22 nt, Human
uccguauuugacuauugcaccg

SEQ ID NO: 846019 - RNA, 22 nt, Human
ucccaggauguuuauggcuggu

SEQ ID NO: 846020 - RNA, 22 nt, Human
ggaggaccugcuggcccugcaa

SEQ ID NO: 846021 - RNA, 22 nt, Human
ucuccuuuaagauuuccucagg

SEQ ID NO: 846022 - RNA, 19 nt, Human
cauuuagaaguacauauua

SEQ ID NO: 846023 - RNA, 22 nt, Human
gagggcagagucuaaugaugca

SEQ ID NO: 846024 - RNA, 22 nt, Human
uuccuuccauagcaaaacaugc

SEQ ID NO: 846025 - RNA, 22 nt, Human
cauguuuacuaccaggagaaug

SEQ ID NO: 846026 - RNA, 21 nt, Human
gggccuggcugcgcaggacgg

SEQ ID NO: 846027 - RNA, 22 nt, Human
cccagggcccuggacagcuaca

SEQ ID NO: 846028 - RNA, 22 nt, Human
ccugggaguggcacucacagca

SEQ ID NO: 846029 - RNA, 22 nt, Human
ccaguugguuucaaugggacag

SEQ ID NO: 846030 - RNA, 22 nt, Human
uaacauuagguagacauaagcc

SEQ ID NO: 846031 - RNA, 22 nt, Human
acagagccacuuuggugccuac

SEQ ID NO: 846032 - RNA, 22 nt, Human
ucugcuggccuuagcaggucua

SEQ ID NO: 846033 - RNA, 22 nt, Human
cugggcagugcagcuauagaac

SEQ ID NO: 846034 - RNA, 22 nt, Human
guaaacaacacaaaucauuuga

SEQ ID NO: 846035 - RNA, 22 nt, Human
gugucacaagagcccaggaaac

SEQ ID NO: 846036 - RNA, 22 nt, Human
cagagcugggaucccaugggcg

SEQ ID NO: 846037 - RNA, 22 nt, Human
ggcugccaggagaagcucagug

SEQ ID NO: 846038 - RNA, 18 nt, Human
uuccauaauguauguaac

SEQ ID NO: 846039 - RNA, 22 nt, Human
gagcagaacaggccggguggga

SEQ ID NO: 846040 - RNA, 22 nt, Human
gcagcuggaagugacacucugu

SEQ ID NO: 846041 - RNA, 22 nt, Human
cagaauuuaaguggauuauucu

SEQ ID NO: 846042 - RNA, 22 nt, Human
cucaggccauucuuccagcugc

SEQ ID NO: 846043 - RNA, 23 nt, Human
ugccucugccucccuagucugca

SEQ ID NO: 846044 - RNA, 22 nt, Human
ggucucagcccucgccagcagc

SEQ ID NO: 846045 - RNA, 22 nt, Human
ugcuggcuguauaugugagagu

SEQ ID NO: 846046 - RNA, 18 nt, Human
uccugccugugccccagg

SEQ ID NO: 846047 - RNA, 22 nt, Human
acagcugggugcugcucagagc

SEQ ID NO: 846048 - RNA, 22 nt, Human
cuggguggcagagccugcagug

SEQ ID NO: 846049 - RNA, 22 nt, Human
gaagcccauuuguacagcacau

SEQ ID NO: 846050 - RNA, 22 nt, Human
uugaagcagagaaauacuugaa

SEQ ID NO: 846051 - RNA, 22 nt, Human
ucccaggguccucuucuggaau

SEQ ID NO: 846052 - RNA, 22 nt, Human
agacaacaccaaaugcuagugu

SEQ ID NO: 846053 - RNA, 23 nt, Human
gggcagcuuaagcuuguuuuucu

SEQ ID NO: 846054 - RNA, 23 nt, Human
acuuuauugaccccaggucaguu

SEQ ID NO: 846055 - RNA, 18 nt, Human
gguggcucagucaugggg

SEQ ID NO: 846056 - RNA, 21 nt, Human
ucuuugcaucaguuguuuucu

SEQ ID NO: 846057 - RNA, 22 nt, Human
aggcagucuaucucuggagccu

SEQ ID NO: 846058 - RNA, 22 nt, Human
agggggcaggagagaccugcug

SEQ ID NO: 846059 - RNA, 23 nt, Human
ucuauacauacugcagccucugg

SEQ ID NO: 846060 - RNA, 20 nt, Human
agugucuggugcagggccuc

SEQ ID NO: 846061 - RNA, 22 nt, Human
auguaaacaagguuauugucca

SEQ ID NO: 846062 - RNA, 22 nt, Human
uggccuuggcagugagaagagu

SEQ ID NO: 846063 - RNA, 22 nt, Human
aagauuuccauuucuagcucau

SEQ ID NO: 846064 - RNA, 22 nt, Human
ugcuucagaggaaaggcaaaag

SEQ ID NO: 846065 - RNA, 23 nt, Human
ucucagaggauuccugggccuug

SEQ ID NO: 846066 - RNA, 22 nt, Human
aaagguuaguucuuagaagugc

SEQ ID NO: 846067 - RNA, 22 nt, Human
acugcuuacaaaaggaaagaau

SEQ ID NO: 846068 - RNA, 22 nt, Human
gcuggcaucacuggcuucggug

SEQ ID NO: 846069 - RNA, 22 nt, Human
uagcugucagcaaucaaguggu

SEQ ID NO: 846070 - RNA, 22 nt, Human
uacaauacuuaaccuauuuugc

SEQ ID NO: 846071 - RNA, 22 nt, Human
ugcaagagguaaaaugaaagga

SEQ ID NO: 846072 - RNA, 23 nt, Human
cugaggccugcugcguucagguu

SEQ ID NO: 846073 - RNA, 22 nt, Human
acuuccugggcaugcagagucc

SEQ ID NO: 846074 - RNA, 22 nt, Human
ugguauaaaacuuuuuauugaa

SEQ ID NO: 846075 - RNA, 22 nt, Human
ucccagaggucucugcugguuc

SEQ ID NO: 846076 - RNA, 20 nt, Human
uccaguuuuggagacauucu

SEQ ID NO: 846077 - RNA, 22 nt, Human
caggccuccacuccacgcagac

SEQ ID NO: 846078 - RNA, 22 nt, Human
gccaccagugggggccugggca

SEQ ID NO: 846079 - RNA, 22 nt, Human
auucauuuagguauucacuuac

SEQ ID NO: 846080 - RNA, 20 nt, Human
aagagcauaguacaggaaga

SEQ ID NO: 846081 - RNA, 19 nt, Human
ggcucagggcgcugccgcc

SEQ ID NO: 846082 - RNA, 21 nt, Human
uggcacugcuuagcagguucc

SEQ ID NO: 846083 - RNA, 22 nt, Human
gggacuggaacuacuggugcag

SEQ ID NO: 846084 - RNA, 22 nt, Human
ucauuucuauugcuacugucug

SEQ ID NO: 846085 - RNA, 22 nt, Human
cacaaugugguuugucaucuuu

SEQ ID NO: 846086 - RNA, 22 nt, Human
ccucagggaggccucuguggcu

SEQ ID NO: 846087 - RNA, 22 nt, Human
cagaggcucaccagccuuucac

SEQ ID NO: 846088 - RNA, 22 nt, Human
uuagacaagggcuccuuaaaag

SEQ ID NO: 846089 - RNA, 23 nt, Human
aaucuggcugauguuuuuucucu

SEQ ID NO: 846090 - RNA, 22 nt, Human
ccugggcaaaugccagagacaa

SEQ ID NO: 846091 - RNA, 22 nt, Human
cacugcucgcugcagcauggcc

SEQ ID NO: 846092 - RNA, 22 nt, Human
agcccuggcccggcugugcuuu

SEQ ID NO: 846093 - RNA, 22 nt, Human
agcucagggcgaucugucucgg

SEQ ID NO: 846094 - RNA, 22 nt, Human
uugcccagaguccacagcguac

SEQ ID NO: 846095 - RNA, 22 nt, Human
cacccugggcugggccuguuaa

SEQ ID NO: 846096 - RNA, 22 nt, Human
cagauuucagcucauauauuau

SEQ ID NO: 846097 - RNA, 22 nt, Human
agggcuggaggguacuaguuua

SEQ ID NO: 846098 - RNA, 22 nt, Human
agaaaugcucaggucaacuuaa

SEQ ID NO: 846099 - RNA, 22 nt, Human
ccaggagaauaauggcagauua

SEQ ID NO: 846100 - RNA, 23 nt, Human
aggaggaaaaguuaucugcugag

SEQ ID NO: 846101 - RNA, 22 nt, Human
gcuggcaggagccuuucccuuu

SEQ ID NO: 846102 - RNA, 22 nt, Human
agaaucugguagaaccaaggau

SEQ ID NO: 846103 - RNA, 22 nt, Human
gcccaggccggagagcagugcu

SEQ ID NO: 846104 - RNA, 21 nt, Human
agcagaggggacauguuugau

SEQ ID NO: 846105 - RNA, 22 nt, Human
aaaacugaaauacgauccaaug

SEQ ID NO: 846106 - RNA, 22 nt, Human
guggccaggccgacugccaggc

SEQ ID NO: 846107 - RNA, 22 nt, Human
ugcuuuaacauaagauaucuuu

SEQ ID NO: 846108 - RNA, 22 nt, Human
cucuggagcgcugcuucccgcg

SEQ ID NO: 846109 - RNA, 22 nt, Human
gccaggcuccaggcccuccuga

SEQ ID NO: 846110 - RNA, 23 nt, Human
aacaauagguuuuggcagaauag

SEQ ID NO: 846111 - RNA, 22 nt, Human
uggagaggagcaccauggccau

SEQ ID NO: 846112 - RNA, 22 nt, Human
ucaguuuugauuccugguucuc

SEQ ID NO: 846113 - RNA, 22 nt, Human
ccuccaggaacuugagagacac

SEQ ID NO: 846114 - RNA, 22 nt, Human
gcaaggaccuuugagcgugcca

SEQ ID NO: 846115 - RNA, 22 nt, Human
gaggccagaagugccucgggcu

SEQ ID NO: 846116 - RNA, 19 nt, Human
ugagaaggcaguggggagc

SEQ ID NO: 846117 - RNA, 22 nt, Human
gugccagggggcacugaacaga

SEQ ID NO: 846118 - RNA, 21 nt, Human
guggcccugccgcagugucca

SEQ ID NO: 846119 - RNA, 22 nt, Human
ccugagggaggguauaggcugu

SEQ ID NO: 846120 - RNA, 22 nt, Human
agaauuuccuaugagagauucc

SEQ ID NO: 846121 - RNA, 22 nt, Human
uaaagccauacugaaagccacu

SEQ ID NO: 846122 - RNA, 22 nt, Human
agcaguggccuggggcucugug

SEQ ID NO: 846123 - RNA, 22 nt, Human
ugggcaggauaauaucucaugu

SEQ ID NO: 846124 - RNA, 22 nt, Human
uucauguaauuccauaagguaa

SEQ ID NO: 846125 - RNA, 20 nt, Human
ccugccuguguuugugauga

SEQ ID NO: 846126 - RNA, 20 nt, Human
acugagcugcauggagagga

SEQ ID NO: 846127 - RNA, 22 nt, Human
gccuaauaacuagcuguguaac

SEQ ID NO: 846128 - RNA, 22 nt, Human
aaaugcauggcuguuuuaaagc

SEQ ID NO: 846129 - RNA, 22 nt, Human
ccucagaggugaacaucagugc

SEQ ID NO: 846130 - RNA, 22 nt, Human
caaagguaguauauauauuguu

SEQ ID NO: 846131 - RNA, 22 nt, Human
cagcuuugauucuuucugccau

SEQ ID NO: 846132 - RNA, 22 nt, Human
ugcauggaggaagaugaaugca

SEQ ID NO: 846133 - RNA, 22 nt, Human
acacuuuguuguggcauauacg

SEQ ID NO: 846134 - RNA, 22 nt, Human
ucuggcucaucucuccagguaa

SEQ ID NO: 846135 - RNA, 22 nt, Human
uaaucugaagaaacaggacuug

SEQ ID NO: 846136 - RNA, 22 nt, Human
ugcucugggcaacagccucccu

SEQ ID NO: 846137 - RNA, 15 nt, Human
aaucagaaguguggc

SEQ ID NO: 846138 - RNA, 22 nt, Human
uauuucagcccuacuacuuggc

SEQ ID NO: 846139 - RNA, 22 nt, Human
ugagagugauugguucgaaugu

SEQ ID NO: 846140 - RNA, 22 nt, Human
gcuuucucuucacugauguuca

SEQ ID NO: 846141 - RNA, 22 nt, Human
agaauucuguucuucgggugug

SEQ ID NO: 846142 - RNA, 22 nt, Human
ggggcagaguagcuggggugug

SEQ ID NO: 846143 - RNA, 22 nt, Human
caggcuggagugaguguagugg

SEQ ID NO: 846144 - RNA, 22 nt, Human
ggcagcuaguuuaagaaagagg

SEQ ID NO: 846145 - RNA, 22 nt, Human
agagcugugcuuugcaccacgu

SEQ ID NO: 846146 - RNA, 22 nt, Human
aggccuggguguucaccagaag

SEQ ID NO: 846147 - RNA, 22 nt, Human
uggcucagucuggguugacuga

SEQ ID NO: 846148 - RNA, 22 nt, Human
cuggaaggcucugcugccuguc

SEQ ID NO: 846149 - RNA, 22 nt, Human
uugaggagucaggggcacggaa

SEQ ID NO: 846150 - RNA, 22 nt, Human
accugccuauggagccacaugg

SEQ ID NO: 846151 - RNA, 22 nt, Human
cuggaagaggaagccagcugga

SEQ ID NO: 846152 - RNA, 22 nt, Human
auauaaguuaguggucauguuu

SEQ ID NO: 846153 - RNA, 19 nt, Human
uuucaauggcuuagagaaa

SEQ ID NO: 846154 - RNA, 22 nt, Human
uggagccaggagccugggaguc

SEQ ID NO: 846155 - RNA, 22 nt, Human
uuaaaaucuaaagcaguugucu

SEQ ID NO: 846156 - RNA, 22 nt, Human
uugcaccauuucacuuccauua

SEQ ID NO: 846157 - RNA, 22 nt, Human
uaugacauuauaaaggauuauu

SEQ ID NO: 846158 - RNA, 22 nt, Human
gaaaugcagauucugauucugu

SEQ ID NO: 846159 - RNA, 22 nt, Human
uuccuccacgugacaggagcca

SEQ ID NO: 846160 - RNA, 22 nt, Human
ucacagacaauuguuuuggugu

SEQ ID NO: 846161 - RNA, 22 nt, Human
uucuauacaaagauuucucaca

SEQ ID NO: 846162 - RNA, 22 nt, Human
uggauuuaccacagggccacag

SEQ ID NO: 846163 - RNA, 22 nt, Human
aacccuggggcagcugcuaggg

SEQ ID NO: 846164 - RNA, 22 nt, Human
gggcuaggcuuggccagcacug

SEQ ID NO: 846165 - RNA, 22 nt, Human
auaugagaauuggaaaauauca

SEQ ID NO: 846166 - RNA, 22 nt, Human
gcagggaccugccacugcuguc

SEQ ID NO: 846167 - RNA, 22 nt, Human
gccuuggcugaugugcgaauga

SEQ ID NO: 846168 - RNA, 22 nt, Human
ccugagcuggaagagcuugugc

SEQ ID NO: 846169 - RNA, 22 nt, Human
aucugucaucagcaccacaggu

SEQ ID NO: 846170 - RNA, 22 nt, Human
uggagaggaaagugcaguuuug

SEQ ID NO: 846171 - RNA, 22 nt, Human
ccugccagggccuuggaagaaa

SEQ ID NO: 846172 - RNA, 22 nt, Human
agcaccugcuuaaugugcagug

SEQ ID NO: 846173 - RNA, 22 nt, Human
uacuguauuugauaagugaagu

SEQ ID NO: 846174 - RNA, 23 nt, Human
gggagaauaugaggaugauggug

SEQ ID NO: 846175 - RNA, 22 nt, Human
ccggggacuuaaagugaaggaa

SEQ ID NO: 846176 - RNA, 22 nt, Human
aacauacauauuucagugucca

SEQ ID NO: 846177 - RNA, 22 nt, Human
uacagcuaggcaaaaaugacau

SEQ ID NO: 846178 - RNA, 22 nt, Human
ccaggaagccucagaugcugag

SEQ ID NO: 846179 - RNA, 22 nt, Human
cuauaauuaugcucaaaaugua

SEQ ID NO: 846180 - RNA, 22 nt, Human
cacucccuucaggagccuagga

SEQ ID NO: 846181 - RNA, 22 nt, Human
ccugaggacacacgcugcagga

SEQ ID NO: 846182 - RNA, 22 nt, Human
uggaggagggcuggugucugua

SEQ ID NO: 846183 - RNA, 22 nt, Human
caugcuuaugauuugcuaagcc

SEQ ID NO: 846184 - RNA, 22 nt, Human
gcuggcagucccaucagcuggg

SEQ ID NO: 846185 - RNA, 22 nt, Human
agguagagcuccaguagaaaau

SEQ ID NO: 846186 - RNA, 22 nt, Human
uuggcugagagaggaaaagggc

SEQ ID NO: 846187 - RNA, 19 nt, Human
gcugcucugggucucaucu

SEQ ID NO: 846188 - RNA, 22 nt, Human
agaaguuguagguuugcauauu

SEQ ID NO: 846189 - RNA, 22 nt, Human
ccagcuggucugugcucauguu

SEQ ID NO: 846190 - RNA, 23 nt, Human
ucugcucugaaguucggcugagc

SEQ ID NO: 846191 - RNA, 22 nt, Human
agaggccuccgaaaggugggcu

SEQ ID NO: 846192 - RNA, 22 nt, Human
ggagacagugguagggccuaag

SEQ ID NO: 846193 - RNA, 18 nt, Human
aggcccuggccucgaaca

SEQ ID NO: 846194 - RNA, 22 nt, Human
cugcagaggucuugcugauggu

SEQ ID NO: 846195 - RNA, 22 nt, Human
acaugcuuugauguauuuugca

SEQ ID NO: 846196 - RNA, 22 nt, Human
cagccugcuagggcaaugccuu

SEQ ID NO: 846197 - RNA, 22 nt, Human
agcuggcccucgagagccaauu

SEQ ID NO: 846198 - RNA, 22 nt, Human
cuccaguaucuguaggaaaagg

SEQ ID NO: 846199 - RNA, 22 nt, Human
cugccuugaggagguuguggga

SEQ ID NO: 846200 - RNA, 22 nt, Human
augauucagcaauuuuauaucu

SEQ ID NO: 846201 - RNA, 22 nt, Human
gaugcacugcaguauauacugu

SEQ ID NO: 846202 - RNA, 19 nt, Human
gagcgcagagggcagggga

SEQ ID NO: 846203 - RNA, 22 nt, Human
gcacccagcccagggcgugaug

SEQ ID NO: 846204 - RNA, 22 nt, Human
agcugccuguccuaggccauca

SEQ ID NO: 846205 - RNA, 22 nt, Human
ugccagggcugcuacuggcuga

SEQ ID NO: 846206 - RNA, 22 nt, Human
aagagcuggucacagguccauu

SEQ ID NO: 846207 - RNA, 20 nt, Human
gugggcagaugugugcaugg

SEQ ID NO: 846208 - RNA, 23 nt, Human
uccuccuuuugcuugugcuuccc

SEQ ID NO: 846209 - RNA, 22 nt, Human
cugccugcugccuguggagggu

SEQ ID NO: 846210 - RNA, 22 nt, Human
auaacaugagccagauugaaag

SEQ ID NO: 846211 - RNA, 22 nt, Human
uggaaagaugaagauguuuaag

SEQ ID NO: 846212 - RNA, 22 nt, Human
gcccaggaguugguggcugcag

SEQ ID NO: 846213 - RNA, 22 nt, Human
uccucuggauauaagccucacc

SEQ ID NO: 846214 - RNA, 22 nt, Human
acccagaggcggagguugcagu

SEQ ID NO: 846215 - RNA, 22 nt, Human
agugucauaugccacugcaucc

SEQ ID NO: 846216 - RNA, 22 nt, Human
gcauggcugguguccugaggga

SEQ ID NO: 846217 - RNA, 22 nt, Human
auugucugaauccaaagcucug

SEQ ID NO: 846218 - RNA, 22 nt, Human
gggcagcagaggaucccuuaau

SEQ ID NO: 846219 - RNA, 22 nt, Human
cugccagcagaggccagcgcug

SEQ ID NO: 846220 - RNA, 22 nt, Human
ugggcucugugccagguuggug

SEQ ID NO: 846221 - RNA, 17 nt, Human
ugcauuguaggcuagcc

SEQ ID NO: 846222 - RNA, 22 nt, Human
ggcucaagcagucugccugccu

SEQ ID NO: 846223 - RNA, 22 nt, Human
augcaaaauaaggcagaaacau

SEQ ID NO: 846224 - RNA, 22 nt, Human
ucuggcucauaggaaggccauu

SEQ ID NO: 846225 - RNA, 22 nt, Human
aguguccaacucagcuugucaa

SEQ ID NO: 846226 - RNA, 22 nt, Human
ugggcagacgcuguuggaaggc

SEQ ID NO: 846227 - RNA, 22 nt, Human
aagauuucugcuccugagagaa

SEQ ID NO: 846228 - RNA, 22 nt, Human
aaaaguauuggccaccauuucu

SEQ ID NO: 846229 - RNA, 22 nt, Human
uaaagguacgaagugagggauu

SEQ ID NO: 846230 - RNA, 22 nt, Human
guaugaaaauuguaaaguucuu

SEQ ID NO: 846231 - RNA, 22 nt, Human
augucccagcugagagacaacu

SEQ ID NO: 846232 - RNA, 22 nt, Human
agauuuacugagaacugauuac

SEQ ID NO: 846233 - RNA, 21 nt, Human
agggagcuauuuauaguaagc

SEQ ID NO: 846234 - RNA, 22 nt, Human
ccaugcacaccagcaggcagac

SEQ ID NO: 846235 - RNA, 22 nt, Human
aaaugguauuuacucuguauua

SEQ ID NO: 846236 - RNA, 22 nt, Human
guuugucuuaauuaggcaucga

SEQ ID NO: 846237 - RNA, 23 nt, Human
uuuauccaacucuguaaucucuc

SEQ ID NO: 846238 - RNA, 22 nt, Human
ccagagucuuuauauuccugaa

SEQ ID NO: 846239 - RNA, 22 nt, Human
agagaaaagaguucaggcuuug

SEQ ID NO: 846240 - RNA, 22 nt, Human
auugcuguacacuucuagaucu

SEQ ID NO: 846241 - RNA, 22 nt, Human
agcagcaacuuauuuuucuuau

SEQ ID NO: 846242 - RNA, 22 nt, Human
ggcauggcuggguucuggugag

SEQ ID NO: 846243 - RNA, 22 nt, Human
cagaggcugggaccucaggcau

SEQ ID NO: 846244 - RNA, 19 nt, Human
uucuccagccugaccugag

SEQ ID NO: 846245 - RNA, 22 nt, Human
caaaugauacuguuuuuagucu

SEQ ID NO: 846246 - RNA, 22 nt, Human
acagggccauuaucuguucuag

SEQ ID NO: 846247 - RNA, 22 nt, Human
auuauuauuguugauguuaggg

SEQ ID NO: 846248 - RNA, 20 nt, Human
agacccuguguccuguggcc

SEQ ID NO: 846249 - RNA, 22 nt, Human
cccagcccaucucaaaggucua

SEQ ID NO: 846250 - RNA, 22 nt, Human
uugaauaauaugcuucguucuc

SEQ ID NO: 846251 - RNA, 22 nt, Human
aacuuucagcaaguaauucugg

SEQ ID NO: 846252 - RNA, 22 nt, Human
agagccaggaucuguuuugggg

SEQ ID NO: 846253 - RNA, 22 nt, Human
cuuggcagagggcugggcucag

SEQ ID NO: 846254 - RNA, 22 nt, Human
gugcuaaaggguuaugaacaag

SEQ ID NO: 846255 - RNA, 22 nt, Human
gggagccaaggagagaggccuu

SEQ ID NO: 846256 - RNA, 22 nt, Human
uggcacugccuggcagggcccc

SEQ ID NO: 846257 - RNA, 22 nt, Human
auauuucaugggguuccauacu

SEQ ID NO: 846258 - RNA, 20 nt, Human
gcccuggagccuuguccugg

SEQ ID NO: 846259 - RNA, 22 nt, Human
uuuaagaaguuauguuauaaau

SEQ ID NO: 846260 - RNA, 22 nt, Human
ucuaggagcaugaagggaaggc

SEQ ID NO: 846261 - RNA, 22 nt, Human
ggcucagggaaugaggaagaau

SEQ ID NO: 846262 - RNA, 22 nt, Human
gcccucagaggacagcugacuu

SEQ ID NO: 846263 - RNA, 20 nt, Human
uuccagagaucugcauuuua

SEQ ID NO: 846264 - RNA, 17 nt, Human
gccuggcccagccuggc

SEQ ID NO: 846265 - RNA, 22 nt, Human
uuucucaguuacuagcuguggu

SEQ ID NO: 846266 - RNA, 22 nt, Human
ggagagaauuccauggacaugu

SEQ ID NO: 846267 - RNA, 22 nt, Human
uccucuggcccagcugccucug

SEQ ID NO: 846268 - RNA, 22 nt, Human
uuuuccuguccaggcaauuauu

SEQ ID NO: 846269 - RNA, 22 nt, Human
ccagggcaugggaagaacugaa

SEQ ID NO: 846270 - RNA, 22 nt, Human
gcugggagugggcaagaugaga

SEQ ID NO: 846271 - RNA, 22 nt, Human
cucaggauuuacuaauuucaag

SEQ ID NO: 846272 - RNA, 21 nt, Human
ggcagcccgcccucuccuggc

SEQ ID NO: 846273 - RNA, 22 nt, Human
cucagcagagaccagggaggaa

SEQ ID NO: 846274 - RNA, 22 nt, Human
uaaggcacccgugagcugccag

SEQ ID NO: 846275 - RNA, 22 nt, Human
aaaauugagagucuugugcaag

SEQ ID NO: 846276 - RNA, 22 nt, Human
agccucucugaugugacagcua

SEQ ID NO: 846277 - RNA, 22 nt, Human
ggagauuuauagcacacuucag

SEQ ID NO: 846278 - RNA, 22 nt, Human
cugugagcuggguggccaggac

SEQ ID NO: 846279 - RNA, 22 nt, Human
uucauucccaagaguaaacaua

SEQ ID NO: 846280 - RNA, 19 nt, Human
gccacuccugaugcugccc

SEQ ID NO: 846281 - RNA, 22 nt, Human
aacuuuguguguuuaauauggc

SEQ ID NO: 846282 - RNA, 22 nt, Human
guguaauugaaauugagaacca

SEQ ID NO: 846283 - RNA, 22 nt, Human
cugggcagccucacacaauguu

SEQ ID NO: 846284 - RNA, 21 nt, Human
agcagaggcagaauguaugca

SEQ ID NO: 846285 - RNA, 22 nt, Human
uaaggcacccuucugaguagag

SEQ ID NO: 846286 - RNA, 19 nt, Human
gcauaaaaugucaaugugu

SEQ ID NO: 846287 - RNA, 22 nt, Human
uucucuuugacauuauucaggu

SEQ ID NO: 846288 - RNA, 22 nt, Human
cagguggaucucuaaggacuga

SEQ ID NO: 846289 - RNA, 22 nt, Human
ccagguggacggcgaguacagg

SEQ ID NO: 846290 - RNA, 22 nt, Human
ucacacgugagguucuauccug

SEQ ID NO: 846291 - RNA, 22 nt, Human
agaauucugacaauagaauugg

SEQ ID NO: 846292 - RNA, 22 nt, Human
agaaacauuuagauuauauguc

SEQ ID NO: 846293 - RNA, 22 nt, Human
ggaaaguggugguggaaagagg

SEQ ID NO: 846294 - RNA, 21 nt, Human
ucagggcagugggagguuccu

SEQ ID NO: 846295 - RNA, 22 nt, Human
ccaaggagcaaggcucaacaag

SEQ ID NO: 846296 - RNA, 18 nt, Human
uccucucuuuccccaggg

SEQ ID NO: 846297 - RNA, 23 nt, Human
acuauaaaguuguucugauuuac

SEQ ID NO: 846298 - RNA, 22 nt, Human
uggcucugccacuaacuuggua

SEQ ID NO: 846299 - RNA, 22 nt, Human
gaagcccuauccucuccuggga

SEQ ID NO: 846300 - RNA, 22 nt, Human
ccuggccucagccuagggcuga

SEQ ID NO: 846301 - RNA, 22 nt, Human
gaaggaggcguuagcccuagga

SEQ ID NO: 846302 - RNA, 22 nt, Human
uguaaauaguuagcuugccucu

SEQ ID NO: 846303 - RNA, 22 nt, Human
aggcagcuggacauaacuaacc

SEQ ID NO: 846304 - RNA, 22 nt, Human
gccugccuuuguaugacccuga

SEQ ID NO: 846305 - RNA, 22 nt, Human
caugggaggucugcaaggugcu

SEQ ID NO: 846306 - RNA, 22 nt, Human
gccagggaggcuguaggguccu

SEQ ID NO: 846307 - RNA, 22 nt, Human
uggaaggcaugggaacuguucu

SEQ ID NO: 846308 - RNA, 22 nt, Human
ugcacccucaucagucaaaugg

SEQ ID NO: 846309 - RNA, 22 nt, Human
caccagacagguguaugcauau

SEQ ID NO: 846310 - RNA, 22 nt, Human
gagauggggaauaggagcaagc

SEQ ID NO: 846311 - RNA, 22 nt, Human
cacagucacauaucuaugugug

SEQ ID NO: 846312 - RNA, 22 nt, Human
cagcaggguuaagugacucacc

SEQ ID NO: 846313 - RNA, 22 nt, Human
aaguuugagaagcuuauagaua

SEQ ID NO: 846314 - RNA, 21 nt, Human
ucuguacaucauugagucccc

SEQ ID NO: 846315 - RNA, 17 nt, Human
agauggcaggaggcaga

SEQ ID NO: 846316 - RNA, 22 nt, Human
gcucugagauugagccuuuggu

SEQ ID NO: 846317 - RNA, 22 nt, Human
ucucaggaucuaauacauggua

SEQ ID NO: 846318 - RNA, 22 nt, Human
ugagagucucagaccuccuggu

SEQ ID NO: 846319 - RNA, 22 nt, Human
agguacagggugaaaguuuaug

SEQ ID NO: 846320 - RNA, 22 nt, Human
gcugcucugcuguguaagcagg

SEQ ID NO: 846321 - RNA, 22 nt, Human
acagcagagacacucaggaggc

SEQ ID NO: 846322 - RNA, 22 nt, Human
ugcauggacucaucagacaaga

SEQ ID NO: 846323 - RNA, 22 nt, Human
agagcugaaaaagcugacccgg

SEQ ID NO: 846324 - RNA, 22 nt, Human
gguuggggcgagcuggaggccc

SEQ ID NO: 846325 - RNA, 22 nt, Human
ccaggcugccgaggaaagaaag

SEQ ID NO: 846326 - RNA, 22 nt, Human
gccuuucaguuccaucaaagga

SEQ ID NO: 846327 - RNA, 22 nt, Human
agcuugaguuuuggaugaagug

SEQ ID NO: 846328 - RNA, 22 nt, Human
ccagucacagguguguuuauau

SEQ ID NO: 846329 - RNA, 22 nt, Human
ggcagaggaagcuggaaguggg

SEQ ID NO: 846330 - RNA, 20 nt, Human
accaggagauggaggcaggg

SEQ ID NO: 846331 - RNA, 22 nt, Human
ugugccaugaggcucugauaug

SEQ ID NO: 846332 - RNA, 21 nt, Human
aaggagccuaggaggcucagg

SEQ ID NO: 846333 - RNA, 22 nt, Human
gccaggagccagcuucuuagca

SEQ ID NO: 846334 - RNA, 20 nt, Human
ccagcauguacacaugugga

SEQ ID NO: 846335 - RNA, 22 nt, Human
cacuacuugaaagaauuacaga

SEQ ID NO: 846336 - RNA, 22 nt, Human
cugagccaaggggacagugaca

SEQ ID NO: 846337 - RNA, 22 nt, Human
aaauauagugacacuuauaguc

SEQ ID NO: 846338 - RNA, 22 nt, Human
ucucagagaagugaugagcaau

SEQ ID NO: 846339 - RNA, 22 nt, Human
aauaaauguuaagauugucuca

SEQ ID NO: 846340 - RNA, 22 nt, Human
aggagaaagacuggacagccaa

SEQ ID NO: 846341 - RNA, 22 nt, Human
uaguccagccuuggguguagcc

SEQ ID NO: 846342 - RNA, 22 nt, Human
ucacugcagacaaccucaguca

SEQ ID NO: 846343 - RNA, 22 nt, Human
uugaauucauuucucauugagu

SEQ ID NO: 846344 - RNA, 21 nt, Human
aaauacagaaacuuguuuuca

SEQ ID NO: 846345 - RNA, 22 nt, Human
acuuagaacaggcagaauucca

SEQ ID NO: 846346 - RNA, 22 nt, Human
auacagaauucacuacaguuuc

SEQ ID NO: 846347 - RNA, 22 nt, Human
uggagagguuuaaacaaaaguu

SEQ ID NO: 846348 - RNA, 22 nt, Human
cugcccaggcugaaggaacauc

SEQ ID NO: 846349 - RNA, 22 nt, Human
cucucuucccgugaguguugca

SEQ ID NO: 846350 - RNA, 22 nt, Human
acuauacaguauguacgugcac

SEQ ID NO: 846351 - RNA, 22 nt, Human
gcugcugucagugguggcaguu

SEQ ID NO: 846352 - RNA, 21 nt, Human
cucaggauggcggccuggugg

SEQ ID NO: 846353 - RNA, 22 nt, Human
gcagaggccuagguggaaggcc

SEQ ID NO: 846354 - RNA, 22 nt, Human
uacaguauguucuugaauuugg

SEQ ID NO: 846355 - RNA, 22 nt, Human
cuuauuauaaaauccuguuuga

SEQ ID NO: 846356 - RNA, 22 nt, Human
cacagaagaaucaugcuguguu

SEQ ID NO: 846357 - RNA, 22 nt, Human
cagggagaaaucuccaggaggu

SEQ ID NO: 846358 - RNA, 22 nt, Human
aggagggaccuaggaauauugc

SEQ ID NO: 846359 - RNA, 22 nt, Human
ucugucugagggagugacauuu

SEQ ID NO: 846360 - RNA, 22 nt, Human
agagagcauugaggaaaucuuc

SEQ ID NO: 846361 - RNA, 22 nt, Human
agggacaguuacaucaucagac

SEQ ID NO: 846362 - RNA, 22 nt, Human
aguuuauguaaaauuaguaaug

SEQ ID NO: 846363 - RNA, 22 nt, Human
aaugaacaaaauaugcuuugca

SEQ ID NO: 846364 - RNA, 19 nt, Human
augcuuuauguuauuucuu

SEQ ID NO: 846365 - RNA, 22 nt, Human
gcagggcuauuggaaggagaug

SEQ ID NO: 846366 - RNA, 22 nt, Human
gaagugaagguuacucuagauu

SEQ ID NO: 846367 - RNA, 22 nt, Human
ccugggcauaaaucacuccaag

SEQ ID NO: 846368 - RNA, 22 nt, Human
cacuguaucuuuuccaaagucu

SEQ ID NO: 846369 - RNA, 22 nt, Human
acauuucuauagugcaucuguu

SEQ ID NO: 846370 - RNA, 22 nt, Human
aaucuggcucagaagaagauga

SEQ ID NO: 846371 - RNA, 22 nt, Human
uuuauacauggagaauuuuugc

SEQ ID NO: 846372 - RNA, 22 nt, Human
cuggagccggcgagccccagcc

SEQ ID NO: 846373 - RNA, 19 nt, Human
agcaaauacaucaaaauug

SEQ ID NO: 846374 - RNA, 22 nt, Human
ugcagcagcagggaggaggcuc

SEQ ID NO: 846375 - RNA, 22 nt, Human
aggagucauaaaugugaacaaa

SEQ ID NO: 846376 - RNA, 22 nt, Human
ucacaggguaucugggauggau

SEQ ID NO: 846377 - RNA, 22 nt, Human
auuguaaguagaaauguuaugg

SEQ ID NO: 846378 - RNA, 22 nt, Human
uuuacagaucuguugauuuguu

SEQ ID NO: 846379 - RNA, 19 nt, Human
uuggaaggagccagagugg

SEQ ID NO: 846380 - RNA, 22 nt, Human
aggggccugguuggccucuguu

SEQ ID NO: 846381 - RNA, 22 nt, Human
uauuucuggcuuugagggugau

SEQ ID NO: 846382 - RNA, 22 nt, Human
uuucuucacaggguauugggug

SEQ ID NO: 846383 - RNA, 22 nt, Human
ccacugucagaggggcugugcc

SEQ ID NO: 846384 - RNA, 22 nt, Human
ggcuuccuuucacuacccucag

SEQ ID NO: 846385 - RNA, 22 nt, Human
ggcugcaggcaggguauccacu

SEQ ID NO: 846386 - RNA, 22 nt, Human
ggcagcuucuuaauauggagac

SEQ ID NO: 846387 - RNA, 22 nt, Human
cacacucauuagucauuucucu

SEQ ID NO: 846388 - RNA, 22 nt, Human
caggcagcucugcuuuuccuaa

SEQ ID NO: 846389 - RNA, 22 nt, Human
uguaacaguaagccugugagcu

SEQ ID NO: 846390 - RNA, 22 nt, Human
uuguuaaaaugcauauucuggu

SEQ ID NO: 846391 - RNA, 22 nt, Human
aaguugaaugcguacgugacau

SEQ ID NO: 846392 - RNA, 22 nt, Human
cagcugagcaucacuagucugg

SEQ ID NO: 846393 - RNA, 22 nt, Human
agagccagcauuugggcccugc

SEQ ID NO: 846394 - RNA, 22 nt, Human
caaauaucuuuggcaaagagaa

SEQ ID NO: 846395 - RNA, 22 nt, Human
uggccucuggcugaggacuaac

SEQ ID NO: 846396 - RNA, 22 nt, Human
uaaaguuuggcagacaauaaca

SEQ ID NO: 846397 - RNA, 22 nt, Human
uuucucaucuggaaacagugcu

SEQ ID NO: 846398 - RNA, 22 nt, Human
uggcucaggugugagcugaaga

SEQ ID NO: 846399 - RNA, 22 nt, Human
cuacagaaucuaccucaagcca

SEQ ID NO: 846400 - RNA, 22 nt, Human
uguucucacuggaugcuucaca

SEQ ID NO: 846401 - RNA, 22 nt, Human
ucucuggaauuuugagagugac

SEQ ID NO: 846402 - RNA, 22 nt, Human
uggcagcugaauggcuggaugg

SEQ ID NO: 846403 - RNA, 22 nt, Human
gccugugcauagcagcggacuc

SEQ ID NO: 846404 - RNA, 22 nt, Human
aggagagggguaggauuaauuu

SEQ ID NO: 846405 - RNA, 19 nt, Human
agaaguuagacauugcaau

SEQ ID NO: 846406 - RNA, 22 nt, Human
auacagaauacuaauuccugag

SEQ ID NO: 846407 - RNA, 22 nt, Human
ggugccaggcucccagcucagg

SEQ ID NO: 846408 - RNA, 22 nt, Human
gcugcccugucugcagcaggac

SEQ ID NO: 846409 - RNA, 22 nt, Human
ucuccugugcacccucccugug

SEQ ID NO: 846410 - RNA, 22 nt, Human
guccucuggccuuucccaggac

SEQ ID NO: 846411 - RNA, 22 nt, Human
cugaggcugcccagggccaggu

SEQ ID NO: 846412 - RNA, 22 nt, Human
ccagagcaauucucacagaacu

SEQ ID NO: 846413 - RNA, 22 nt, Human
ucccagccugacagugcaucaa

SEQ ID NO: 846414 - RNA, 22 nt, Human
ugagccagauaagggcucacgc

SEQ ID NO: 846415 - RNA, 20 nt, Human
cagucccaauccagggccag

SEQ ID NO: 846416 - RNA, 22 nt, Human
cgaggcagggaagcugcaaaag

SEQ ID NO: 846417 - RNA, 22 nt, Human
gugggcuggacccuccugcucc

SEQ ID NO: 846418 - RNA, 22 nt, Human
uuccauaaugagauucccagcc

SEQ ID NO: 846419 - RNA, 22 nt, Human
agccauugaguuuuaugugcua

SEQ ID NO: 846420 - RNA, 22 nt, Human
gaggccagggaugcaaugagag

SEQ ID NO: 846421 - RNA, 22 nt, Human
auguaguguagagauuagucuc

SEQ ID NO: 846422 - RNA, 22 nt, Human
cccagccugucuuucccaauga

SEQ ID NO: 846423 - RNA, 22 nt, Human
ggccgggcaggucucagccagc

SEQ ID NO: 846424 - RNA, 22 nt, Human
uguuaacaucuuggacucguga

SEQ ID NO: 846425 - RNA, 22 nt, Human
uccaugaggaccaaauucguag

SEQ ID NO: 846426 - RNA, 22 nt, Human
ugccuugguucucuacuuggag

SEQ ID NO: 846427 - RNA, 22 nt, Human
uccaggagacacaagguacaua

SEQ ID NO: 846428 - RNA, 18 nt, Human
cacaggcucccagugagg

SEQ ID NO: 846429 - RNA, 22 nt, Human
aaaguuugucacuuggcuagaa

SEQ ID NO: 846430 - RNA, 20 nt, Human
ugcagcuucaccugugucau

SEQ ID NO: 846431 - RNA, 22 nt, Human
augcuuuaaaugucuuuugcuu

SEQ ID NO: 846432 - RNA, 22 nt, Human
uaaugcaguacugauauaaaca

SEQ ID NO: 846433 - RNA, 22 nt, Human
guucucucugcuuccaagaugg

SEQ ID NO: 846434 - RNA, 22 nt, Human
aaugucauugguaaagauuagg

SEQ ID NO: 846435 - RNA, 22 nt, Human
ugccucuguugagccuuggcug

SEQ ID NO: 846436 - RNA, 22 nt, Human
cagagugaaauaggggaucaag

SEQ ID NO: 846437 - RNA, 22 nt, Human
cuggcucuucagugcuugguuc

SEQ ID NO: 846438 - RNA, 22 nt, Human
gaauuucagggucugguaggaa

SEQ ID NO: 846439 - RNA, 22 nt, Human
caagaauccuguucuugaagau

SEQ ID NO: 846440 - RNA, 22 nt, Human
acaggcucuggggcaggauggc

SEQ ID NO: 846441 - RNA, 22 nt, Human
cauugaaaaacguugacugagu

SEQ ID NO: 846442 - RNA, 22 nt, Human
cauggaaggcaaaagacacaga

SEQ ID NO: 846443 - RNA, 21 nt, Human
auuuccaaauaaggucacauu

SEQ ID NO: 846444 - RNA, 23 nt, Human
agcuggguggccugcgugaagcu

SEQ ID NO: 846445 - RNA, 22 nt, Human
aaauaauugaguuggucaauau

SEQ ID NO: 846446 - RNA, 22 nt, Human
ucaggagaaagccaauuagagu

SEQ ID NO: 846447 - RNA, 22 nt, Human
agcugcaguaaagcucuccagg

SEQ ID NO: 846448 - RNA, 22 nt, Human
gcaggaugggagcuucacucug

SEQ ID NO: 846449 - RNA, 22 nt, Human
cuucuucacacuggucugaagc

SEQ ID NO: 846450 - RNA, 22 nt, Human
aauguugaggauaucagaaaau

SEQ ID NO: 846451 - RNA, 22 nt, Human
ggugguggagccagcugggagu

SEQ ID NO: 846452 - RNA, 22 nt, Human
ggccuggaagaggacagagaaa

SEQ ID NO: 846453 - RNA, 22 nt, Human
aagcaaagaguuuaguggguga

SEQ ID NO: 846454 - RNA, 22 nt, Human
gagggagucugugcaaagaauu

SEQ ID NO: 846455 - RNA, 21 nt, Human
ugccagggauuuacagagccu

SEQ ID NO: 846456 - RNA, 22 nt, Human
ucccagaguauuagcaauugcu

SEQ ID NO: 846457 - RNA, 22 nt, Human
ggcuucaccgcgggguugcagg

SEQ ID NO: 846458 - RNA, 22 nt, Human
aggcagaggaaggguggauuug

SEQ ID NO: 846459 - RNA, 22 nt, Human
uuuuucuugugcuggaucuaau

SEQ ID NO: 846460 - RNA, 22 nt, Human
cccugccugugggcaucaacau

SEQ ID NO: 846461 - RNA, 22 nt, Human
gggcuucuagaccagcagugag

SEQ ID NO: 846462 - RNA, 22 nt, Human
gaaauauugggacucagagcuu

SEQ ID NO: 846463 - RNA, 22 nt, Human
auuccaaaaggauguuagaaug

SEQ ID NO: 846464 - RNA, 22 nt, Human
ggggcagaaagcccacagagug

SEQ ID NO: 846465 - RNA, 22 nt, Human
cuccaugaauuugagcuuugug

SEQ ID NO: 846466 - RNA, 22 nt, Human
gggcuuggcacaugggcucagc

SEQ ID NO: 846467 - RNA, 22 nt, Human
gaacacauuagucugaguuggc

SEQ ID NO: 846468 - RNA, 22 nt, Human
cauggccuugagugacugcacu

SEQ ID NO: 846469 - RNA, 22 nt, Human
acacaugcauaagccuucccuu

SEQ ID NO: 846470 - RNA, 22 nt, Human
uaacacauauuucaagaguagu

SEQ ID NO: 846471 - RNA, 22 nt, Human
acccaggagccgugagagguua

SEQ ID NO: 846472 - RNA, 22 nt, Human
ugcagaagugagucaugaggaa

SEQ ID NO: 846473 - RNA, 22 nt, Human
caagaaaugggauuugacugcc

SEQ ID NO: 846474 - RNA, 22 nt, Human
cuggagccugcaguuuucacuu

SEQ ID NO: 846475 - RNA, 22 nt, Human
ggagagcagggaggcugcucug

SEQ ID NO: 846476 - RNA, 22 nt, Human
ggaucauuaacacauccaucac

SEQ ID NO: 846477 - RNA, 22 nt, Human
auuuucaucauggguuuaacau

SEQ ID NO: 846478 - RNA, 22 nt, Human
auauacugaggagacuuuauau

SEQ ID NO: 846479 - RNA, 22 nt, Human
cagcugugcuguauuaagcucu

SEQ ID NO: 846480 - RNA, 22 nt, Human
aaguuucauguggagguagacu

SEQ ID NO: 846481 - RNA, 21 nt, Human
auacagaagguggcaaaguac

SEQ ID NO: 846482 - RNA, 22 nt, Human
uuauguaauuuguuugcucuuc

SEQ ID NO: 846483 - RNA, 22 nt, Human
auucuucauacagacaaguccu

SEQ ID NO: 846484 - RNA, 22 nt, Human
ccugagagcagcuuccugcuua

SEQ ID NO: 846485 - RNA, 22 nt, Human
cacaccuguaauaccagcuacu

SEQ ID NO: 846486 - RNA, 22 nt, Human
guuugcauguguacuuaauugg

SEQ ID NO: 846487 - RNA, 22 nt, Human
ggccugcuucucagugagcuug

SEQ ID NO: 846488 - RNA, 22 nt, Human
gucuucaauagagccucaauuu

SEQ ID NO: 846489 - RNA, 22 nt, Human
gccaggagaaugcuagcagagg

SEQ ID NO: 846490 - RNA, 22 nt, Human
ucagagaacacagaggugaugu

SEQ ID NO: 846491 - RNA, 22 nt, Human
uagauuucgcugcaucucaauc

SEQ ID NO: 846492 - RNA, 22 nt, Human
cuggccuggucuggccucucca

SEQ ID NO: 846493 - RNA, 22 nt, Human
uagaggugucacuuugggaagu

SEQ ID NO: 846494 - RNA, 22 nt, Human
cuccagaagacccauccucaug

SEQ ID NO: 846495 - RNA, 21 nt, Human
aauguauguuuaucucacagu

SEQ ID NO: 846496 - RNA, 22 nt, Human
agaggaugauuuuaaggacacu

SEQ ID NO: 846497 - RNA, 22 nt, Human
ugcucuggaguggcuugugcac

SEQ ID NO: 846498 - RNA, 22 nt, Human
ccuggaucccgauggcugugag

SEQ ID NO: 846499 - RNA, 22 nt, Human
cagcagcugauggggaagugau

SEQ ID NO: 846500 - RNA, 22 nt, Human
cauuuguaguaucuguuuauau

SEQ ID NO: 846501 - RNA, 22 nt, Human
ccacccuuggguucggaggccg

SEQ ID NO: 846502 - RNA, 22 nt, Human
ccucacuuuccuuucuccuggg

SEQ ID NO: 846503 - RNA, 22 nt, Human
gagaggaguuacuauuuccgag

SEQ ID NO: 846504 - RNA, 19 nt, Human
ccagguggaacugagguag

SEQ ID NO: 846505 - RNA, 22 nt, Human
agugcauuauauguuucaaugg

SEQ ID NO: 846506 - RNA, 22 nt, Human
aguauugugacucaaguauucu

SEQ ID NO: 846507 - RNA, 21 nt, Human
gagugcaggucugaugccauc

SEQ ID NO: 846508 - RNA, 22 nt, Human
cacauuugaaggaauuagcauu

SEQ ID NO: 846509 - RNA, 22 nt, Human
gugucccagccccacaggccug

SEQ ID NO: 846510 - RNA, 19 nt, Human
aggucauugauagugcagg

SEQ ID NO: 846511 - RNA, 22 nt, Human
agcugcucaggagagccagguc

SEQ ID NO: 846512 - RNA, 22 nt, Human
cagaggccuuucuacagugaua

SEQ ID NO: 846513 - RNA, 22 nt, Human
acacaugcugauaagaauauaa

SEQ ID NO: 846514 - RNA, 22 nt, Human
gagaagcaauuuccaacugugc

SEQ ID NO: 846515 - RNA, 22 nt, Human
cugucugucaaguucaucucca

SEQ ID NO: 846516 - RNA, 20 nt, Human
uugauucaagggcugaugga

SEQ ID NO: 846517 - RNA, 22 nt, Human
aaugaacaggugaaugucagau

SEQ ID NO: 846518 - RNA, 22 nt, Human
cuuccaaauguaaauaaguuuc

SEQ ID NO: 846519 - RNA, 22 nt, Human
gauggcagguaguggucucauc

SEQ ID NO: 846520 - RNA, 22 nt, Human
acaaagugaauugcaucgaguu

SEQ ID NO: 846521 - RNA, 22 nt, Human
aauacugagaucccacaaagca

SEQ ID NO: 846522 - RNA, 22 nt, Human
aucuuucaguuucauaccaauu

SEQ ID NO: 846523 - RNA, 22 nt, Human
acaugaaaaauguuugcaguuu

SEQ ID NO: 846524 - RNA, 22 nt, Human
cucuggaguuagugaucugggc

SEQ ID NO: 846525 - RNA, 22 nt, Human
guuauguaaucuaacacucagu

SEQ ID NO: 846526 - RNA, 22 nt, Human
cagaguguuagcgcugguuggg

SEQ ID NO: 846527 - RNA, 22 nt, Human
ucuggcucacuucaggcuucac

SEQ ID NO: 846528 - RNA, 22 nt, Human
aacuagaaaacaagaugcugau

SEQ ID NO: 846529 - RNA, 22 nt, Human
gcuggccugcgagggcaggcug

SEQ ID NO: 846530 - RNA, 22 nt, Human
ggugcagaggagccagcugggg

SEQ ID NO: 846531 - RNA, 22 nt, Human
cagccaggcccccgagucguug

SEQ ID NO: 846532 - RNA, 23 nt, Human
uggggccaagugaggaagggucu

SEQ ID NO: 846533 - RNA, 22 nt, Human
gggcacuggaaggcucucaggc

SEQ ID NO: 846534 - RNA, 22 nt, Human
auuugcagagcucugaauuuug

SEQ ID NO: 846535 - RNA, 22 nt, Human
cagcaaaauuugaggauugccu

SEQ ID NO: 846536 - RNA, 22 nt, Human
caggcugcagugcaguggcuau

SEQ ID NO: 846537 - RNA, 22 nt, Human
ggcucugccugcccagcagcac

SEQ ID NO: 846538 - RNA, 22 nt, Human
cacaauuuguuuuaucaguauu

SEQ ID NO: 846539 - RNA, 22 nt, Human
cugccgaguacagccauagaaa

SEQ ID NO: 846540 - RNA, 22 nt, Human
gauggcacacagacauccccgc

SEQ ID NO: 846541 - RNA, 22 nt, Human
acauauauuacuaguaaagaca

SEQ ID NO: 846542 - RNA, 22 nt, Human
uuccggaagguucucuagaauu

SEQ ID NO: 846543 - RNA, 22 nt, Human
uacuuuuagccuauuugauucu

SEQ ID NO: 846544 - RNA, 22 nt, Human
gagcagcugagcuggaaugaga

SEQ ID NO: 846545 - RNA, 22 nt, Human
uuagaaaugauuucaccucuuu

SEQ ID NO: 846546 - RNA, 22 nt, Human
aagcagccaccucaucuccacu

SEQ ID NO: 846547 - RNA, 22 nt, Human
ccuggagaccagaggauacuuc

SEQ ID NO: 846548 - RNA, 22 nt, Human
acagggcccuugccagcacaag

SEQ ID NO: 846549 - RNA, 22 nt, Human
aucaguuuuguucacuacuaua

SEQ ID NO: 846550 - RNA, 22 nt, Human
uggggaagggcacccuggagac

SEQ ID NO: 846551 - RNA, 22 nt, Human
ccaggcugcuuagccuuaucuu

SEQ ID NO: 846552 - RNA, 22 nt, Human
gcagcaaucuucacagugucau

SEQ ID NO: 846553 - RNA, 22 nt, Human
uuauuuuuaaaaguucacacag

SEQ ID NO: 846554 - RNA, 22 nt, Human
acagaggaaggcugagcugccc

SEQ ID NO: 846555 - RNA, 22 nt, Human
ucagccagguaauguggagaug

SEQ ID NO: 846556 - RNA, 22 nt, Human
uaaagguaugucuuaaucaaac

SEQ ID NO: 846557 - RNA, 22 nt, Human
uggcuggcgccgggcuagccac

SEQ ID NO: 846558 - RNA, 22 nt, Human
guuccuauauagccuuaaggau

SEQ ID NO: 846559 - RNA, 22 nt, Human
gcucagagaugucugcugccuu

SEQ ID NO: 846560 - RNA, 22 nt, Human
agcccaugcaacaggccuagcg

SEQ ID NO: 846561 - RNA, 21 nt, Human
auucagaguaauucaucuuua

SEQ ID NO: 846562 - RNA, 22 nt, Human
uaaguccuagcuuugguaggaa

SEQ ID NO: 846563 - RNA, 22 nt, Human
cuggccagcugacagcagggcu

SEQ ID NO: 846564 - RNA, 22 nt, Human
gcaggcuccaggccggccccuu

SEQ ID NO: 846565 - RNA, 22 nt, Human
ugaagccagcuuuggaagacac

SEQ ID NO: 846566 - RNA, 22 nt, Human
cauaaaauggcuuguucuuuaa

SEQ ID NO: 846567 - RNA, 22 nt, Human
uucuucaguuugguaaauguaa

SEQ ID NO: 846568 - RNA, 22 nt, Human
uuugacagcuuguuacaaaguu

SEQ ID NO: 846569 - RNA, 22 nt, Human
uguaaaaccaaaucaaucuagu

SEQ ID NO: 846570 - RNA, 22 nt, Human
agcuggagaugcccagcaccgg

SEQ ID NO: 846571 - RNA, 22 nt, Human
ucagagugcagggaguagcagc

SEQ ID NO: 846572 - RNA, 22 nt, Human
ggucccaggagaauaggugcaa

SEQ ID NO: 846573 - RNA, 22 nt, Human
gccagcucagugccaggccccu

SEQ ID NO: 846574 - RNA, 22 nt, Human
aagcagccuggcaugaugcuuu

SEQ ID NO: 846575 - RNA, 22 nt, Human
aacaugcucuguuucuuggaug

SEQ ID NO: 846576 - RNA, 22 nt, Human
cucuuccucucaugcggucaua

SEQ ID NO: 846577 - RNA, 22 nt, Human
cugugcaguaggucagggcugg

SEQ ID NO: 846578 - RNA, 22 nt, Human
aaggcccuggcaggaagcagga

SEQ ID NO: 846579 - RNA, 22 nt, Human
uaaguccuaauggcagaagucu

SEQ ID NO: 846580 - RNA, 22 nt, Human
ggcugccagugagugcagaccg

SEQ ID NO: 846581 - RNA, 22 nt, Human
cuuaaauuuucaucuacaagaa

SEQ ID NO: 846582 - RNA, 22 nt, Human
ccauggaguuccucuggucuau

SEQ ID NO: 846583 - RNA, 22 nt, Human
caggaaccuaaugaaggcucac

SEQ ID NO: 846584 - RNA, 22 nt, Human
aggcacugggaauaugcugagg

SEQ ID NO: 846585 - RNA, 22 nt, Human
auuuuucucucacacuuaccag

SEQ ID NO: 846586 - RNA, 22 nt, Human
gaagcagcugccagagaugucu

SEQ ID NO: 846587 - RNA, 22 nt, Human
auggggcugggauucuccucgg

SEQ ID NO: 846588 - RNA, 22 nt, Human
ugaagcagcaccauuuuagagc

SEQ ID NO: 846589 - RNA, 22 nt, Human
uaaaugugcacuuuacuuuuca

SEQ ID NO: 846590 - RNA, 22 nt, Human
ucagaagcauguggggagccug

SEQ ID NO: 846591 - RNA, 22 nt, Human
acaggcagggaccuuggcuaag

SEQ ID NO: 846592 - RNA, 22 nt, Human
cccaggagcuucucucugccuc

SEQ ID NO: 846593 - RNA, 22 nt, Human
ccaguggguaggccauggugag

SEQ ID NO: 846594 - RNA, 22 nt, Human
caaaagucuuccuauucucuua

SEQ ID NO: 846595 - RNA, 22 nt, Human
aaaaugaugcuguaauuuggca

SEQ ID NO: 846596 - RNA, 22 nt, Human
uuuccucuuugugacacagcug

SEQ ID NO: 846597 - RNA, 23 nt, Human
uggcucagggucucuuaugaagu

SEQ ID NO: 846598 - RNA, 20 nt, Human
aggcagcuggccaggcaggu

SEQ ID NO: 846599 - RNA, 22 nt, Human
accaggagcauuuuuuauuagu

SEQ ID NO: 846600 - RNA, 22 nt, Human
cuuugaagauggcaaauuuaga

SEQ ID NO: 846601 - RNA, 22 nt, Human
uggcugaauaauauucuguugu

SEQ ID NO: 846602 - RNA, 22 nt, Human
auuucauagauuguaaaucccu

SEQ ID NO: 846603 - RNA, 22 nt, Human
ccuggcuuccuggagcucacaa

SEQ ID NO: 846604 - RNA, 21 nt, Human
uccacaaguuagaaggaaauu

SEQ ID NO: 846605 - RNA, 22 nt, Human
cugcagagcuaggcugagugaa

SEQ ID NO: 846606 - RNA, 22 nt, Human
aaaacauguccauacagaaacu

SEQ ID NO: 846607 - RNA, 23 nt, Human
gagguacagcaccagugaauagg

SEQ ID NO: 846608 - RNA, 22 nt, Human
aggcagcagucaugaggaaaga

SEQ ID NO: 846609 - RNA, 22 nt, Human
uggccugggccugccggugcaa

SEQ ID NO: 846610 - RNA, 23 nt, Human
acaaaugcccauacaucuaguuc

SEQ ID NO: 846611 - RNA, 22 nt, Human
ucuguuuaggcaaaauagcuac

SEQ ID NO: 846612 - RNA, 20 nt, Human
ccaagagcaugcaugaggaa

SEQ ID NO: 846613 - RNA, 22 nt, Human
ucugaagaacugaguaaacaug

SEQ ID NO: 846614 - RNA, 22 nt, Human
uuucauguuuauggaaaaugag

SEQ ID NO: 846615 - RNA, 22 nt, Human
gccugucugcgucacgcuuauu

SEQ ID NO: 846616 - RNA, 22 nt, Human
agugauggagcuuccucugcua

SEQ ID NO: 846617 - RNA, 22 nt, Human
ggaggagacccugugucaguuu

SEQ ID NO: 846618 - RNA, 22 nt, Human
caggaugagguagaggcagaua

SEQ ID NO: 846619 - RNA, 22 nt, Human
cccugggcaagcccuauuuucc

SEQ ID NO: 846620 - RNA, 22 nt, Human
uggcucagcauucacuggucuu

SEQ ID NO: 846621 - RNA, 22 nt, Human
caguaaaugcagauauagauac

SEQ ID NO: 846622 - RNA, 22 nt, Human
uggcugccuagugucugagcag

SEQ ID NO: 846623 - RNA, 22 nt, Human
uagaugcuacaauuuuguacuc

SEQ ID NO: 846624 - RNA, 22 nt, Human
aacaaacaaacauuuugucauc

SEQ ID NO: 846625 - RNA, 22 nt, Human
agaaagaacguugguuaucuua

SEQ ID NO: 846626 - RNA, 22 nt, Human
gggccccaaaaugccaggcucu

SEQ ID NO: 846627 - RNA, 22 nt, Human
guacaguuuucaguguucacug

SEQ ID NO: 846628 - RNA, 18 nt, Human
uggcagccagcugcuccu

SEQ ID NO: 846629 - RNA, 22 nt, Human
uccagaguacggaagagucauc

SEQ ID NO: 846630 - RNA, 22 nt, Human
ugcuggguagaaguauuagucu

SEQ ID NO: 846631 - RNA, 22 nt, Human
gcccagcaggacagagugguuu

SEQ ID NO: 846632 - RNA, 22 nt, Human
ugagaggcagaauggugccugc

SEQ ID NO: 846633 - RNA, 22 nt, Human
ugcugaggagguggcugugcuu

SEQ ID NO: 846634 - RNA, 22 nt, Human
ucaaacuguuuacagugagaua

SEQ ID NO: 846635 - RNA, 22 nt, Human
ucaguguauggagugcuggauu

SEQ ID NO: 846636 - RNA, 22 nt, Human
cagcagagguuggaacaguucu

SEQ ID NO: 846637 - RNA, 22 nt, Human
aaagccuuugucucaggcucug

SEQ ID NO: 846638 - RNA, 22 nt, Human
uggccugguaccacauagauuu

SEQ ID NO: 846639 - RNA, 18 nt, Human
auauguuaauuagguagg

SEQ ID NO: 846640 - RNA, 23 nt, Human
uugcacauuggagcuggucuucu

SEQ ID NO: 846641 - RNA, 22 nt, Human
cucuggcuucuaccuugcaguu

SEQ ID NO: 846642 - RNA, 19 nt, Human
cagaccuguccagccugug

SEQ ID NO: 846643 - RNA, 20 nt, Human
ccagucccugagcaccaggg

SEQ ID NO: 846644 - RNA, 22 nt, Human
aaucuucacagagaaaauuagg

SEQ ID NO: 846645 - RNA, 22 nt, Human
gacagcuggcaguggaaaggug

SEQ ID NO: 846646 - RNA, 22 nt, Human
ccugguguugugaaguagccgu

SEQ ID NO: 846647 - RNA, 22 nt, Human
uuggaucacucugaagccuuac

SEQ ID NO: 846648 - RNA, 22 nt, Human
ucaggcaguagaauugcuugaa

SEQ ID NO: 846649 - RNA, 22 nt, Human
ggcugaguugagaggauuacuu

SEQ ID NO: 846650 - RNA, 22 nt, Human
uuuaggcauugggugcucaagu

SEQ ID NO: 846651 - RNA, 22 nt, Human
aauauaaugcuguuuuaugcca

SEQ ID NO: 846652 - RNA, 18 nt, Human
agcagagcccaugcauuc

SEQ ID NO: 846653 - RNA, 22 nt, Human
cucaggauguacuacagaaggc

SEQ ID NO: 846654 - RNA, 22 nt, Human
auuguuaugaaaauaagauguu

SEQ ID NO: 846655 - RNA, 22 nt, Human
cagguggagcugacugagggca

SEQ ID NO: 846656 - RNA, 22 nt, Human
aguacaacauuagaguaucuua

SEQ ID NO: 846657 - RNA, 22 nt, Human
aggaagcugcuggaguagugug

SEQ ID NO: 846658 - RNA, 22 nt, Human
cagcucugaagaaaggugucua

SEQ ID NO: 846659 - RNA, 22 nt, Human
gccagguggcugagugacugag

SEQ ID NO: 846660 - RNA, 22 nt, Human
uaaggcacacaguugcugcaug

SEQ ID NO: 846661 - RNA, 22 nt, Human
aagcccagcaucccugcaccag

SEQ ID NO: 846662 - RNA, 22 nt, Human
cacagaaaaaggcuugaaaauc

SEQ ID NO: 846663 - RNA, 22 nt, Human
aagcuguucucuaaguuucaug

SEQ ID NO: 846664 - RNA, 22 nt, Human
uuccuuagugccucuuccgcug

SEQ ID NO: 846665 - RNA, 22 nt, Human
uaucauaaguuaauuaaacagu

SEQ ID NO: 846666 - RNA, 22 nt, Human
cacagcuuccauuagaaugaga

SEQ ID NO: 846667 - RNA, 22 nt, Human
caaagugcugagauuacaggua

SEQ ID NO: 846668 - RNA, 22 nt, Human
ucagagaugcagugccaccuac

SEQ ID NO: 846669 - RNA, 22 nt, Human
cuggcagcucugagucccuucu

SEQ ID NO: 846670 - RNA, 17 nt, Human
aagacagaagccaugag

SEQ ID NO: 846671 - RNA, 22 nt, Human
cauaauuugugguaguggggga

SEQ ID NO: 846672 - RNA, 22 nt, Human
ggcugcuguuucagagacuguu

SEQ ID NO: 846673 - RNA, 18 nt, Human
ugucauugccagggaagc

SEQ ID NO: 846674 - RNA, 20 nt, Human
ggaggguggaagaaagcaag

SEQ ID NO: 846675 - RNA, 22 nt, Human
gugcaugugucuuuauaguagc

SEQ ID NO: 846676 - RNA, 19 nt, Human
uuagaaacuguugacacug

SEQ ID NO: 846677 - RNA, 22 nt, Human
caggcacagaguuauucauuua

SEQ ID NO: 846678 - RNA, 22 nt, Human
caagugucuauaucagugcuug

SEQ ID NO: 846679 - RNA, 22 nt, Human
ggcuuggaaaugguaaugagcu

SEQ ID NO: 846680 - RNA, 22 nt, Human
agcuguguguuuccacugagcu

SEQ ID NO: 846681 - RNA, 22 nt, Human
ggggaggcugaugugggcaaag

SEQ ID NO: 846682 - RNA, 22 nt, Human
uucauuccugagcccauauuua

SEQ ID NO: 846683 - RNA, 22 nt, Human
uccugggcugugugccacucug

SEQ ID NO: 846684 - RNA, 20 nt, Human
acaaaugcauucugugacau

SEQ ID NO: 846685 - RNA, 22 nt, Human
ucugagccguauggcuuggcua

SEQ ID NO: 846686 - RNA, 22 nt, Human
caagggaguuacugagggcggg

SEQ ID NO: 846687 - RNA, 21 nt, Human
gagacagacuuucguccccug

SEQ ID NO: 846688 - RNA, 22 nt, Human
uauuugaaaguguacaaaaacu

SEQ ID NO: 846689 - RNA, 22 nt, Human
caggagcucuuaaggaugugau

SEQ ID NO: 846690 - RNA, 18 nt, Human
caggagcaggaguugaac

SEQ ID NO: 846691 - RNA, 22 nt, Human
aauucuuguuguuaguauauuu

SEQ ID NO: 846692 - RNA, 23 nt, Human
ggccauggagacuuagaaugggc

SEQ ID NO: 846693 - RNA, 22 nt, Human
uacugcauaacuggcauguggg

SEQ ID NO: 846694 - RNA, 23 nt, Human
agcacacuuguacaaugcccuag

SEQ ID NO: 846695 - RNA, 22 nt, Human
aucaaauauaauaauuuucgcu

SEQ ID NO: 846696 - RNA, 22 nt, Human
aauuaauggaaaguaaggaagg

SEQ ID NO: 846697 - RNA, 22 nt, Human
cugggaggcaccgcgucgugcu

SEQ ID NO: 846698 - RNA, 22 nt, Human
ugccuggguguaaagggccaac

SEQ ID NO: 846699 - RNA, 22 nt, Human
cagcagcuggugagacacagcc

SEQ ID NO: 846700 - RNA, 18 nt, Human
cugaaggauccaggugua

SEQ ID NO: 846701 - RNA, 22 nt, Human
agguacaaaagaguauaugaga

SEQ ID NO: 846702 - RNA, 22 nt, Human
aggagcugcaaauauuaguaau

SEQ ID NO: 846703 - RNA, 22 nt, Human
cuuccugaacaaugccaucaau

SEQ ID NO: 846704 - RNA, 16 nt, Human
gccuggaguggcaggg

SEQ ID NO: 846705 - RNA, 22 nt, Human
agccagagcugaugucauucuc

SEQ ID NO: 846706 - RNA, 22 nt, Human
aggccuggccuuuauguucaag

SEQ ID NO: 846707 - RNA, 22 nt, Human
auuacacuuguucaucaucacc

SEQ ID NO: 846708 - RNA, 22 nt, Human
gcugucagaaggugaaggguaa

SEQ ID NO: 846709 - RNA, 22 nt, Human
ugucacauguguggcauuuuuc

SEQ ID NO: 846710 - RNA, 22 nt, Human
uuaacagacauauauauuugua

SEQ ID NO: 846711 - RNA, 22 nt, Human
guucuucagcauuagaagucau

SEQ ID NO: 846712 - RNA, 22 nt, Human
uucuucuuaauguccugggaac

SEQ ID NO: 846713 - RNA, 22 nt, Human
cuggcuuccaugcuguaguggc

SEQ ID NO: 846714 - RNA, 20 nt, Human
caaugcacacagcugcuucu

SEQ ID NO: 846715 - RNA, 22 nt, Human
cccuggaggcaaagguugcagu

SEQ ID NO: 846716 - RNA, 22 nt, Human
uucucagaggagucgggagcug

SEQ ID NO: 846717 - RNA, 22 nt, Human
cuguuuauaaauagaggggagu

SEQ ID NO: 846718 - RNA, 22 nt, Human
agggaagcccuggcugagaccc

SEQ ID NO: 846719 - RNA, 23 nt, Human
acuuuauccuauaucuuuguucu

SEQ ID NO: 846720 - RNA, 20 nt, Human
aggaacuggaagggaggaaa

SEQ ID NO: 846721 - RNA, 22 nt, Human
agauggguaacuggagucugcu

SEQ ID NO: 846722 - RNA, 22 nt, Human
guaucuuucccaccaaucacaa

SEQ ID NO: 846723 - RNA, 22 nt, Human
uucucugaguacguuucagugu

SEQ ID NO: 846724 - RNA, 22 nt, Human
gugcauuggugcgccacuucac

SEQ ID NO: 846725 - RNA, 22 nt, Human
uggguggaauaaaucaguucug

SEQ ID NO: 846726 - RNA, 21 nt, Human
uacagaaugcgcuucagucug

SEQ ID NO: 846727 - RNA, 22 nt, Human
gggcagagacucagaaacagaa

SEQ ID NO: 846728 - RNA, 22 nt, Human
ucagaagcaaacaucacucuag

SEQ ID NO: 846729 - RNA, 22 nt, Human
ccagcucuuuuggcugagugag

SEQ ID NO: 846730 - RNA, 22 nt, Human
agcugcccagauaggaggaggc

SEQ ID NO: 846731 - RNA, 22 nt, Human
gaggccaggggccuggagauga

SEQ ID NO: 846732 - RNA, 22 nt, Human
ucucaggguuuccugggggcug

SEQ ID NO: 846733 - RNA, 22 nt, Human
cauuucaaaagaauugccagaa

SEQ ID NO: 846734 - RNA, 19 nt, Human
agacacacuugauaugugu

SEQ ID NO: 846735 - RNA, 22 nt, Human
gucaugccuggcuucuuagaca

SEQ ID NO: 846736 - RNA, 22 nt, Human
augacucuuagcuaaagguaag

SEQ ID NO: 846737 - RNA, 21 nt, Human
ccagcagcucaaggaucucuu

SEQ ID NO: 846738 - RNA, 22 nt, Human
gccuggcaggccuguuggggcu

SEQ ID NO: 846739 - RNA, 22 nt, Human
ugguuucccauuaucugcagga

SEQ ID NO: 846740 - RNA, 22 nt, Human
aaauacauacacuguacguggc

SEQ ID NO: 846741 - RNA, 22 nt, Human
cagcuugggaguuugguuuuau

SEQ ID NO: 846742 - RNA, 22 nt, Human
gcuggccucgcaggcaggaugu

SEQ ID NO: 846743 - RNA, 22 nt, Human
uuuaaauucugucugccgcuua

SEQ ID NO: 846744 - RNA, 22 nt, Human
cugcuuuggacaacuauucuug

SEQ ID NO: 846745 - RNA, 20 nt, Human
acaauacagguugugucuga

SEQ ID NO: 846746 - RNA, 22 nt, Human
aaacuuugguauguagcaaaac

SEQ ID NO: 846747 - RNA, 22 nt, Human
ggcacugagcgggcucugagcg

SEQ ID NO: 846748 - RNA, 22 nt, Human
aguuuguaucaauuugcuuuau

SEQ ID NO: 846749 - RNA, 22 nt, Human
cuccuggacauggagcggagga

SEQ ID NO: 846750 - RNA, 22 nt, Human
gggggcuggacuuucccacaca

SEQ ID NO: 846751 - RNA, 22 nt, Human
aggccuccugcagggaugagug

SEQ ID NO: 846752 - RNA, 22 nt, Human
agagaauuacagaagaauguca

SEQ ID NO: 846753 - RNA, 22 nt, Human
uaugcacauugguuuccucauu

SEQ ID NO: 846754 - RNA, 22 nt, Human
uaacacauagauauuuuaacuu

SEQ ID NO: 846755 - RNA, 22 nt, Human
ccugcagcuguaggagaaggcg

SEQ ID NO: 846756 - RNA, 22 nt, Human
cagccagcugaauguaccauga

SEQ ID NO: 846757 - RNA, 22 nt, Human
agaaaucauucccaaacccaua

SEQ ID NO: 846758 - RNA, 22 nt, Human
uauuuagaugcauuuggauugc

SEQ ID NO: 846759 - RNA, 20 nt, Human
gagccugggaagucuaaggu

SEQ ID NO: 846760 - RNA, 22 nt, Human
uucaaucauuagaaucucaggc

SEQ ID NO: 846761 - RNA, 22 nt, Human
aaauucagcagugaaaugcccc

SEQ ID NO: 846762 - RNA, 17 nt, Human
aaaauucuguaaagagg

SEQ ID NO: 846763 - RNA, 18 nt, Human
ucaggagacacagacgca

SEQ ID NO: 846764 - RNA, 22 nt, Human
uugaaaacuuucuagaccaaga

SEQ ID NO: 846765 - RNA, 22 nt, Human
cccauuuagauaacaguucaaa

SEQ ID NO: 846766 - RNA, 22 nt, Human
aguguauugauuggaacagccu

SEQ ID NO: 846767 - RNA, 20 nt, Human
uaggcagagcugugcagccu

SEQ ID NO: 846768 - RNA, 22 nt, Human
cuuaauuacuguccaauaugca

SEQ ID NO: 846769 - RNA, 22 nt, Human
gaggacagugugaucugccagc

SEQ ID NO: 846770 - RNA, 22 nt, Human
uggcucagcugucacagccugg

SEQ ID NO: 846771 - RNA, 22 nt, Human
aaaugcauaucaaagacuugaa

SEQ ID NO: 846772 - RNA, 22 nt, Human
ggcauuuaguuuucauauucug

SEQ ID NO: 846773 - RNA, 22 nt, Human
ccaaggagcugcaggcacuugu

SEQ ID NO: 846774 - RNA, 17 nt, Human
gaaagguccuagaaauc

SEQ ID NO: 846775 - RNA, 22 nt, Human
ucagggcucaccagccucugcc

SEQ ID NO: 846776 - RNA, 22 nt, Human
cuggaucaugcauugcuugucc

SEQ ID NO: 846777 - RNA, 22 nt, Human
agggauggaagacuugaagacc

SEQ ID NO: 846778 - RNA, 22 nt, Human
agauaauuugaguaaauuaauu

SEQ ID NO: 846779 - RNA, 22 nt, Human
uuugaaauuaagauauugucca

SEQ ID NO: 846780 - RNA, 22 nt, Human
aaaugucuaucuggcauauucc

SEQ ID NO: 846781 - RNA, 22 nt, Human
aaauacugggcucaaaaggguu

SEQ ID NO: 846782 - RNA, 22 nt, Human
agccuggcacugaggcagggcg

SEQ ID NO: 846783 - RNA, 22 nt, Human
cugugcuggagaugggccagag

SEQ ID NO: 846784 - RNA, 22 nt, Human
uaugagcuuccaguguugcaug

SEQ ID NO: 846785 - RNA, 22 nt, Human
uugauaaaaugauaucuucuuu

SEQ ID NO: 846786 - RNA, 22 nt, Human
ggagccaguuuagaccucaguu

SEQ ID NO: 846787 - RNA, 22 nt, Human
uggcccugaggggcugugcccc

SEQ ID NO: 846788 - RNA, 22 nt, Human
ucagagagccucaggcacugcc

SEQ ID NO: 846789 - RNA, 22 nt, Human
augugucuuugagacucugcua

SEQ ID NO: 846790 - RNA, 22 nt, Human
gagcagcuccagccgcaugacu

SEQ ID NO: 846791 - RNA, 22 nt, Human
uguauaaacuuaagcaggaacc

SEQ ID NO: 846792 - RNA, 22 nt, Human
uucaaaggcaggauagcagcug

SEQ ID NO: 846793 - RNA, 22 nt, Human
ggagccugcgggagcucccauu

SEQ ID NO: 846794 - RNA, 22 nt, Human
gcuugcuggugccugcaggcuc

SEQ ID NO: 846795 - RNA, 22 nt, Human
aagugacacauggcacuucuau

SEQ ID NO: 846796 - RNA, 22 nt, Human
cagaagaaaguggggagacaag

SEQ ID NO: 846797 - RNA, 22 nt, Human
ggccaugguuggggaagacaug

SEQ ID NO: 846798 - RNA, 22 nt, Human
cagcagagggagccauugaaau

SEQ ID NO: 846799 - RNA, 22 nt, Human
agucccagcucugccacuuacu

SEQ ID NO: 846800 - RNA, 22 nt, Human
gucaaacaaauuaacauaucca

SEQ ID NO: 846801 - RNA, 22 nt, Human
agagccuggggauuggcaaggg

SEQ ID NO: 846802 - RNA, 22 nt, Human
ccucugagagaaggccuucagc

SEQ ID NO: 846803 - RNA, 22 nt, Human
uaaugugugucaucaguagagu

SEQ ID NO: 846804 - RNA, 22 nt, Human
ggcugccucugaugugcagacg

SEQ ID NO: 846805 - RNA, 22 nt, Human
ggggcuguuuuuggaauggcug

SEQ ID NO: 846806 - RNA, 22 nt, Human
aaaaaugucauuauggaacuga

SEQ ID NO: 846807 - RNA, 22 nt, Human
cuguacaucccgagagccagua

SEQ ID NO: 846808 - RNA, 22 nt, Human
gaggcaggcacuguuaucagca

SEQ ID NO: 846809 - RNA, 22 nt, Human
caguggcaugguugacugcagu

SEQ ID NO: 846810 - RNA, 22 nt, Human
cucagaaguucagccuagagua

SEQ ID NO: 846811 - RNA, 22 nt, Human
ugcuuccugaggccgucuucuc

SEQ ID NO: 846812 - RNA, 22 nt, Human
augggagugacagggccacugg

SEQ ID NO: 846813 - RNA, 22 nt, Human
auuuccagcagcauauuugucu

SEQ ID NO: 846814 - RNA, 22 nt, Human
aucaaaguucguaacugauaac

SEQ ID NO: 846815 - RNA, 22 nt, Human
ugagagagccugaaucucuuac

SEQ ID NO: 846816 - RNA, 22 nt, Human
guuucaaauagguuucagcaaa

SEQ ID NO: 846817 - RNA, 22 nt, Human
uaagaacaagcuggggguucca

SEQ ID NO: 846818 - RNA, 22 nt, Human
uacccaggggcugagcagaggu

SEQ ID NO: 846819 - RNA, 22 nt, Human
ugucacauaggcaaaauguuuu

SEQ ID NO: 846820 - RNA, 22 nt, Human
gguacaauucugggguaugcuc

SEQ ID NO: 846821 - RNA, 22 nt, Human
acaugcauacaagcacauguag

SEQ ID NO: 846822 - RNA, 22 nt, Human
uuucuguaauuaaaagggcagg

SEQ ID NO: 846823 - RNA, 22 nt, Human
agcugccagcaucccggaaggg

SEQ ID NO: 846824 - RNA, 22 nt, Human
uugcaccaaaugaguuaaaauu

SEQ ID NO: 846825 - RNA, 22 nt, Human
aggcagacucaauggcuagaua

SEQ ID NO: 846826 - RNA, 22 nt, Human
aaggcagccauagcaccaucca

SEQ ID NO: 846827 - RNA, 22 nt, Human
agucccagugagaugagccacg

SEQ ID NO: 846828 - RNA, 22 nt, Human
gaggaagcagggcuuggcugag

SEQ ID NO: 846829 - RNA, 22 nt, Human
cagaagaauggugucugagcuc

SEQ ID NO: 846830 - RNA, 22 nt, Human
uagcugucaccagaaauggcca

SEQ ID NO: 846831 - RNA, 22 nt, Human
uuacagaaguuucagcguuuua

SEQ ID NO: 846832 - RNA, 22 nt, Human
uggggcugaggagccucacucu

SEQ ID NO: 846833 - RNA, 22 nt, Human
gaaugcacucacccaucacuca

SEQ ID NO: 846834 - RNA, 22 nt, Human
guggcaggagacuggaagaugg

SEQ ID NO: 846835 - RNA, 19 nt, Human
ggcugucuggcguguggau

SEQ ID NO: 846836 - RNA, 22 nt, Human
acuagaaacuaauggauuauua

SEQ ID NO: 846837 - RNA, 22 nt, Human
cuuacagagaagaaaauguagu

SEQ ID NO: 846838 - RNA, 22 nt, Human
uagaaaucagcaggcauaugua

SEQ ID NO: 846839 - RNA, 18 nt, Human
uuaagagcugaaagggga

SEQ ID NO: 846840 - RNA, 22 nt, Human
caugauuuugucuuguguuaau

SEQ ID NO: 846841 - RNA, 22 nt, Human
agacagaacagaauaauuguug

SEQ ID NO: 846842 - RNA, 22 nt, Human
ccagcugcaggggagcagugga

SEQ ID NO: 846843 - RNA, 22 nt, Human
uacauuguuuuuucuugccauc

SEQ ID NO: 846844 - RNA, 22 nt, Human
ucaaauguucccuguacuggcc

SEQ ID NO: 846845 - RNA, 22 nt, Human
gcaggcuggaggcuguucuggg

SEQ ID NO: 846846 - RNA, 22 nt, Human
ugcagcugcuggcccaggugcu

SEQ ID NO: 846847 - RNA, 22 nt, Human
uuuacagaugaggauacugagg

SEQ ID NO: 846848 - RNA, 22 nt, Human
agcugcagagguuugugcaaca

SEQ ID NO: 846849 - RNA, 22 nt, Human
cucugugggggagaggcagcug

SEQ ID NO: 846850 - RNA, 22 nt, Human
aaguaugaaucaaagacuaucu

SEQ ID NO: 846851 - RNA, 22 nt, Human
ggaaggaggggcaaagcaguuc

SEQ ID NO: 846852 - RNA, 22 nt, Human
aaaguccuagcgauccacagaa

SEQ ID NO: 846853 - RNA, 22 nt, Human
uggguagaggaauugggcuacc

SEQ ID NO: 846854 - RNA, 22 nt, Human
gucuugaucuccugaccuugug

SEQ ID NO: 846855 - RNA, 22 nt, Human
gagcuuccauggacgccaucug

SEQ ID NO: 846856 - RNA, 19 nt, Human
uucauucuuucuacuuacc

SEQ ID NO: 846857 - RNA, 21 nt, Human
auuauuauaaagaccacaggg

SEQ ID NO: 846858 - RNA, 22 nt, Human
cugggugguucuaacuguugau

SEQ ID NO: 846859 - RNA, 22 nt, Human
uggcuuucucccccagcuucuc

SEQ ID NO: 846860 - RNA, 22 nt, Human
uggcagggccuaccccaauauc

SEQ ID NO: 846861 - RNA, 22 nt, Human
gaaggcuugcagcucuguggca

SEQ ID NO: 846862 - RNA, 22 nt, Human
cugugcuugacagugggaagca

SEQ ID NO: 846863 - RNA, 22 nt, Human
ucuggcucuauaacuccuagcu

SEQ ID NO: 846864 - RNA, 22 nt, Human
aacucagcauccugcacagaga

SEQ ID NO: 846865 - RNA, 22 nt, Human
aucagugcuaaagcaaaugccc

SEQ ID NO: 846866 - RNA, 22 nt, Human
cucuguccuaugcuugauagaa

SEQ ID NO: 846867 - RNA, 22 nt, Human
caaauacuaaacauaagauuuu

SEQ ID NO: 846868 - RNA, 22 nt, Human
ggucaggggcugcucuacagag

SEQ ID NO: 846869 - RNA, 22 nt, Human
acagaguaucuaucaggaguau

SEQ ID NO: 846870 - RNA, 22 nt, Human
ggaguucacugugcaggcucug

SEQ ID NO: 846871 - RNA, 22 nt, Human
ggccucagaccggagcuggcca

SEQ ID NO: 846872 - RNA, 22 nt, Human
aggagcugcagauucugccuug

SEQ ID NO: 846873 - RNA, 22 nt, Human
gucugucucucuccagagugca

SEQ ID NO: 846874 - RNA, 22 nt, Human
ugcugcuccugccuggcuccca

SEQ ID NO: 846875 - RNA, 16 nt, Human
ccacagggcaaggggc

SEQ ID NO: 846876 - RNA, 21 nt, Human
aaagaaucauggguaauuuca

SEQ ID NO: 846877 - RNA, 22 nt, Human
uguuaaauguuccuuuacugga

SEQ ID NO: 846878 - RNA, 22 nt, Human
gauuuucauuugcacucuagaa

SEQ ID NO: 846879 - RNA, 22 nt, Human
uuugaagacagaucaauauaag

SEQ ID NO: 846880 - RNA, 19 nt, Human
gcugugccucucuccugcu

SEQ ID NO: 846881 - RNA, 23 nt, Human
uggcucuguggaucccucaggag

SEQ ID NO: 846882 - RNA, 22 nt, Human
gugcauuuggugacucucaccc

SEQ ID NO: 846883 - RNA, 22 nt, Human
uucuggaggccccuuccuucuc

SEQ ID NO: 846884 - RNA, 22 nt, Human
guuaaagaagaauaguuccuuu

SEQ ID NO: 846885 - RNA, 21 nt, Human
ccagacuggccuaugugguag

SEQ ID NO: 846886 - RNA, 22 nt, Human
caguugaugggacucauguggg

SEQ ID NO: 846887 - RNA, 22 nt, Human
acuuugcacuaaguuacucauu

SEQ ID NO: 846888 - RNA, 22 nt, Human
agucaccaggguuugcuggguu

SEQ ID NO: 846889 - RNA, 22 nt, Human
ccagcagaggggcggagugcag

SEQ ID NO: 846890 - RNA, 22 nt, Human
agagcagcacguuguccccaca

SEQ ID NO: 846891 - RNA, 23 nt, Human
aauaucaaggugauguucccaga

SEQ ID NO: 846892 - RNA, 22 nt, Human
uagagugguuaacaguuuagaa

SEQ ID NO: 846893 - RNA, 22 nt, Human
cugcagagguugguucuaagau

SEQ ID NO: 846894 - RNA, 22 nt, Human
agacagcaugauacaugaugcu

SEQ ID NO: 846895 - RNA, 22 nt, Human
ucucaggguuuguacaagugua

SEQ ID NO: 846896 - RNA, 20 nt, Human
uuuuccuucugaguauguug

SEQ ID NO: 846897 - RNA, 22 nt, Human
uccuugaaugaauguucucucc

SEQ ID NO: 846898 - RNA, 22 nt, Human
uuaaugcagaaaucaaacugac

SEQ ID NO: 846899 - RNA, 22 nt, Human
cccuccagcucaaagcaaccgg

SEQ ID NO: 846900 - RNA, 22 nt, Human
uaacacaugucugggaugugaa

SEQ ID NO: 846901 - RNA, 22 nt, Human
agcagcauguugggaugugaaa

SEQ ID NO: 846902 - RNA, 22 nt, Human
cugucccagauguucucagcac

SEQ ID NO: 846903 - RNA, 22 nt, Human
cuggagcccaggccuggugucu

SEQ ID NO: 846904 - RNA, 22 nt, Human
aggcucugcagugcuggaggac

SEQ ID NO: 846905 - RNA, 18 nt, Human
cagcagagacauucaaaa

SEQ ID NO: 846906 - RNA, 22 nt, Human
aaagcagagcagggcacuuaug

SEQ ID NO: 846907 - RNA, 20 nt, Human
agucucuguagugccugaga

SEQ ID NO: 846908 - RNA, 22 nt, Human
uagaaauaaaucugcagcuggg

SEQ ID NO: 846909 - RNA, 22 nt, Human
cagagcugggcauggugaaagg

SEQ ID NO: 846910 - RNA, 20 nt, Human
ccagacagcaccugccuggu

SEQ ID NO: 846911 - RNA, 22 nt, Human
aagagcugauuaagucaugagg

SEQ ID NO: 846912 - RNA, 22 nt, Human
auaacagaguugggaagugaaa

SEQ ID NO: 846913 - RNA, 22 nt, Human
uacaugcaugucacagaaugaa

SEQ ID NO: 846914 - RNA, 22 nt, Human
uacccagcuucaagucaggacu

SEQ ID NO: 846915 - RNA, 22 nt, Human
aacaugaaguuuucuauaguga

SEQ ID NO: 846916 - RNA, 22 nt, Human
aaucagugguucccagcccagg

SEQ ID NO: 846917 - RNA, 17 nt, Human
ugaggccugcaucagug

SEQ ID NO: 846918 - RNA, 22 nt, Human
gcagagcccuggggguauggug

SEQ ID NO: 846919 - RNA, 22 nt, Human
ucaggcagaggauggggagcgu

SEQ ID NO: 846920 - RNA, 21 nt, Human
ggcuccugcuuugugaggggc

SEQ ID NO: 846921 - RNA, 22 nt, Human
uugaaaggugaacaugaugcac

SEQ ID NO: 846922 - RNA, 22 nt, Human
cuggguggaucgcagccccagg

SEQ ID NO: 846923 - RNA, 22 nt, Human
uucugagacaauugagagucua

SEQ ID NO: 846924 - RNA, 22 nt, Human
caucacuguccucagcauucca

SEQ ID NO: 846925 - RNA, 22 nt, Human
gaggugaguggaucacgagguc

SEQ ID NO: 846926 - RNA, 22 nt, Human
ggggacaguuaaagaccaagac

SEQ ID NO: 846927 - RNA, 22 nt, Human
uggcucaguuaggucagaaaca

SEQ ID NO: 846928 - RNA, 22 nt, Human
ggcagauggagaagcagcaggu

SEQ ID NO: 846929 - RNA, 22 nt, Human
uugaacuguaagcaugucugcc

SEQ ID NO: 846930 - RNA, 22 nt, Human
guuuacauauuuuaauugguga

SEQ ID NO: 846931 - RNA, 22 nt, Human
cucugggcaccaaagagcagcu

SEQ ID NO: 846932 - RNA, 22 nt, Human
uauguacagggauagaacuuga

SEQ ID NO: 846933 - RNA, 22 nt, Human
uccuugaagcaacgugcagaca

SEQ ID NO: 846934 - RNA, 22 nt, Human
uacaaaugaccauagccacuua

SEQ ID NO: 846935 - RNA, 22 nt, Human
cccaggcugauguucagcgggu

SEQ ID NO: 846936 - RNA, 22 nt, Human
cagggccagccauccugcuggg

SEQ ID NO: 846937 - RNA, 22 nt, Human
uggagccauaacccuuucguac

SEQ ID NO: 846938 - RNA, 21 nt, Human
ugagagccuccaaccggcuac

SEQ ID NO: 846939 - RNA, 22 nt, Human
gccaggcacaguucuaggugcu

SEQ ID NO: 846940 - RNA, 22 nt, Human
caggagcuacucagguuggguu

SEQ ID NO: 846941 - RNA, 20 nt, Human
uucuucucuaguuaucuuca

SEQ ID NO: 846942 - RNA, 22 nt, Human
cuggugugauugagcccaggug

SEQ ID NO: 846943 - RNA, 22 nt, Human
guuacacaggaaaacauuagca

SEQ ID NO: 846944 - RNA, 22 nt, Human
gacacauagaucuaucucacuc

SEQ ID NO: 846945 - RNA, 22 nt, Human
uggcagcugccauguccacgug

SEQ ID NO: 846946 - RNA, 22 nt, Human
guguuccauguuugagguaguu

SEQ ID NO: 846947 - RNA, 22 nt, Human
acuggaagccaguugacaauca

SEQ ID NO: 846948 - RNA, 22 nt, Human
caguagcacucugucagugaag

SEQ ID NO: 846949 - RNA, 22 nt, Human
uacauuugcuuugauuuucagc

SEQ ID NO: 846950 - RNA, 22 nt, Human
aauacauauggaauuccauguu

SEQ ID NO: 846951 - RNA, 22 nt, Human
ggcuucccagcagagggcgcac

SEQ ID NO: 846952 - RNA, 22 nt, Human
acacugaaugcuguuuagaaau

SEQ ID NO: 846953 - RNA, 22 nt, Human
ccugcucugguuuagucagucu

SEQ ID NO: 846954 - RNA, 22 nt, Human
gaaaagagaacaucugaggauc

SEQ ID NO: 846955 - RNA, 22 nt, Human
gaggagagccugcacuuugacc

SEQ ID NO: 846956 - RNA, 22 nt, Human
ccagcccuccuccaucagagga

SEQ ID NO: 846957 - RNA, 22 nt, Human
auuuuacuuugugaauauugac

SEQ ID NO: 846958 - RNA, 22 nt, Human
ggaggggauuuaguagaugcua

SEQ ID NO: 846959 - RNA, 22 nt, Human
caggugaccuuuguccuaaguu

SEQ ID NO: 846960 - RNA, 22 nt, Human
agaagugagugugacucagcag

SEQ ID NO: 846961 - RNA, 22 nt, Human
gcccacacaccagcucaggagg

SEQ ID NO: 846962 - RNA, 20 nt, Human
agugugcauuuagagucugc

SEQ ID NO: 846963 - RNA, 22 nt, Human
agagcuggguggacuuguaguu

SEQ ID NO: 846964 - RNA, 22 nt, Human
aucuauacuacaaauggcuggu

SEQ ID NO: 846965 - RNA, 22 nt, Human
aaauagcagccuuuaguuaaca

SEQ ID NO: 846966 - RNA, 17 nt, Human
ccuguguuugcuccuuc

SEQ ID NO: 846967 - RNA, 22 nt, Human
uauggcuuuaaacaacuuaggu

SEQ ID NO: 846968 - RNA, 22 nt, Human
cauguaaaacacucagaacagu

SEQ ID NO: 846969 - RNA, 22 nt, Human
ucugcugugggucuauauuuua

SEQ ID NO: 846970 - RNA, 22 nt, Human
cuaugaaaggauuuggaguugu

SEQ ID NO: 846971 - RNA, 22 nt, Human
caggccugggcuucggggcuga

SEQ ID NO: 846972 - RNA, 22 nt, Human
acuuuauuuccuauugcaucca

SEQ ID NO: 846973 - RNA, 22 nt, Human
gcucccugacucaguuccugag

SEQ ID NO: 846974 - RNA, 22 nt, Human
cuacuucugugaugaaacuaca

SEQ ID NO: 846975 - RNA, 22 nt, Human
gaagagcugcucagaacaugau

SEQ ID NO: 846976 - RNA, 22 nt, Human
aggucccaggcauagcuggucu

SEQ ID NO: 846977 - RNA, 22 nt, Human
ucuggagcaacagagcaggaca

SEQ ID NO: 846978 - RNA, 22 nt, Human
uagagcuauuuagagcauuuua

SEQ ID NO: 846979 - RNA, 22 nt, Human
uucacauuggugauauguuucu

SEQ ID NO: 846980 - RNA, 22 nt, Human
gagagugauucccucccauaga

SEQ ID NO: 846981 - RNA, 22 nt, Human
uggcccuguggaggucagugag

SEQ ID NO: 846982 - RNA, 22 nt, Human
gggaccaggugggugcauuccg

SEQ ID NO: 846983 - RNA, 22 nt, Human
aaggcagccagauccuuugggu

SEQ ID NO: 846984 - RNA, 22 nt, Human
aucuagaacuuaaagucaguca

SEQ ID NO: 846985 - RNA, 22 nt, Human
cuuaaauuggaugaguuaaguu

SEQ ID NO: 846986 - RNA, 22 nt, Human
gcuggcccagggucaccuagga

SEQ ID NO: 846987 - RNA, 22 nt, Human
uguaguaagugcgcaauaaaua

SEQ ID NO: 846988 - RNA, 22 nt, Human
ggccugcacagagguggcucua

SEQ ID NO: 846989 - RNA, 22 nt, Human
uagcacauuguugaccagaagg

SEQ ID NO: 846990 - RNA, 22 nt, Human
aucuggcuauuucuggucgggg

SEQ ID NO: 846991 - RNA, 22 nt, Human
gccuggcaggggccugggagug

SEQ ID NO: 846992 - RNA, 22 nt, Human
caguuucuguuuuaaauagcag

SEQ ID NO: 846993 - RNA, 22 nt, Human
augaugguggguaauguguaaa

SEQ ID NO: 846994 - RNA, 22 nt, Human
gcaagcaguuguggcuucugag

SEQ ID NO: 846995 - RNA, 19 nt, Human
cucugccucccuccugggu

SEQ ID NO: 846996 - RNA, 22 nt, Human
uaaaauguguuucuguaugguu

SEQ ID NO: 846997 - RNA, 22 nt, Human
ggaugcaggacggcauggaugu

SEQ ID NO: 846998 - RNA, 22 nt, Human
guuagaaagugucugcuugggu

SEQ ID NO: 846999 - RNA, 22 nt, Human
ggcacugggagaggugagacgg

SEQ ID NO: 847000 - RNA, 18 nt, Human
augggaggggccaagaga

SEQ ID NO: 847001 - RNA, 22 nt, Human
caaugguggugucagaagagau

SEQ ID NO: 847002 - RNA, 19 nt, Human
gccaggagggcucuggcug

SEQ ID NO: 847003 - RNA, 22 nt, Human
ggcuucccaaggagccaggaug

SEQ ID NO: 847004 - RNA, 19 nt, Human
cuguggcugaccucuggcc

SEQ ID NO: 847005 - RNA, 22 nt, Human
aaaaucaguacacuuuauuuug

SEQ ID NO: 847006 - RNA, 22 nt, Human
uggcagcaaguucuugggaggu

SEQ ID NO: 847007 - RNA, 22 nt, Human
agggcugcaccggggcuucgcg

SEQ ID NO: 847008 - RNA, 22 nt, Human
ugucccaguucccaggguugcu

SEQ ID NO: 847009 - RNA, 22 nt, Human
ugggccugacucaccugccucc

SEQ ID NO: 847010 - RNA, 22 nt, Human
gagggccagcagccucagcaug

SEQ ID NO: 847011 - RNA, 22 nt, Human
ucucagaggcccgacguucucc

SEQ ID NO: 847012 - RNA, 22 nt, Human
cuggcucaugugaugagggcaa

SEQ ID NO: 847013 - RNA, 20 nt, Human
uugauucccucuaaacucgc

SEQ ID NO: 847014 - RNA, 22 nt, Human
ggaggcagaauagagugugggu

SEQ ID NO: 847015 - RNA, 22 nt, Human
ucagguggcuucggggaguggc

SEQ ID NO: 847016 - RNA, 22 nt, Human
gaucugaagagcaaugaaauau

SEQ ID NO: 847017 - RNA, 22 nt, Human
acaugcauaggagaagucuuua

SEQ ID NO: 847018 - RNA, 22 nt, Human
ucacgagaggcacagaauagag

SEQ ID NO: 847019 - RNA, 22 nt, Human
gcuggccuccugcuagauggaa

SEQ ID NO: 847020 - RNA, 22 nt, Human
cauuaaaauaucucaugguguu

SEQ ID NO: 847021 - RNA, 22 nt, Human
agcugccauccgaggugucaga

SEQ ID NO: 847022 - RNA, 22 nt, Human
accuggagucauuugaggagua

SEQ ID NO: 847023 - RNA, 20 nt, Human
augugucuguaaacaacucu

SEQ ID NO: 847024 - RNA, 22 nt, Human
uggaaauauacaaugugucucu

SEQ ID NO: 847025 - RNA, 22 nt, Human
uggagcagccaugaugacagag

SEQ ID NO: 847026 - RNA, 22 nt, Human
ucaaugauaguacaaucagccu

SEQ ID NO: 847027 - RNA, 22 nt, Human
acagaaguuggaauuagauacu

SEQ ID NO: 847028 - RNA, 22 nt, Human
auguucuuccaaaucuguaaca

SEQ ID NO: 847029 - RNA, 22 nt, Human
ugcagcugauuaaagggcagac

SEQ ID NO: 847030 - RNA, 22 nt, Human
gcagagccgugaauggauuuca

SEQ ID NO: 847031 - RNA, 22 nt, Human
uccaaauucuagggccuugguu

SEQ ID NO: 847032 - RNA, 22 nt, Human
ccugagggcgccgagcucccag

SEQ ID NO: 847033 - RNA, 22 nt, Human
ccuguccuccaagagcacaucu

SEQ ID NO: 847034 - RNA, 22 nt, Human
gagugugggcacgggggccuug

SEQ ID NO: 847035 - RNA, 22 nt, Human
aggagaaguaaggcuagaugau

SEQ ID NO: 847036 - RNA, 22 nt, Human
aacaggagaguaaauauaugau

SEQ ID NO: 847037 - RNA, 22 nt, Human
agcugccugggcuuguacaccu

SEQ ID NO: 847038 - RNA, 22 nt, Human
ccacaggggucucuguagcuga

SEQ ID NO: 847039 - RNA, 22 nt, Human
ucugucacuuauuaagauggau

SEQ ID NO: 847040 - RNA, 22 nt, Human
gcugcagcucgccuuccggccu

SEQ ID NO: 847041 - RNA, 22 nt, Human
ggggaugguagaccggugacgu

SEQ ID NO: 847042 - RNA, 20 nt, Human
ggaccagguggggcgguggc

SEQ ID NO: 847043 - RNA, 22 nt, Human
ucuggaaguuagaggaggaaag

SEQ ID NO: 847044 - RNA, 22 nt, Human
uuccaugaaggagacugagaag

SEQ ID NO: 847045 - RNA, 22 nt, Human
uguaaucauuacaguacaugga

SEQ ID NO: 847046 - RNA, 22 nt, Human
agggagcuuccgaacuacagcu

SEQ ID NO: 847047 - RNA, 22 nt, Human
aggucacacuuggaucauagaa

SEQ ID NO: 847048 - RNA, 22 nt, Human
aggguggccaugagggagagau

SEQ ID NO: 847049 - RNA, 22 nt, Human
aaauauguauggaguucaugaa

SEQ ID NO: 847050 - RNA, 22 nt, Human
uuuaacagguaaaguaaaugug

SEQ ID NO: 847051 - RNA, 22 nt, Human
ccugccagcauggcuuaucucc

SEQ ID NO: 847052 - RNA, 22 nt, Human
uggcuuccaaaggaaugggccu

SEQ ID NO: 847053 - RNA, 22 nt, Human
ccagagagaaauggauuugagu

SEQ ID NO: 847054 - RNA, 22 nt, Human
guuguuuuuguucucuauagcu

SEQ ID NO: 847055 - RNA, 22 nt, Human
ucaaaugcucuuugcagagagg

SEQ ID NO: 847056 - RNA, 22 nt, Human
ucacaggcuccagggccuggau

SEQ ID NO: 847057 - RNA, 22 nt, Human
uggccuggcagagcaaggccug

SEQ ID NO: 847058 - RNA, 22 nt, Human
ugaagcagcuucuuucugucaa

SEQ ID NO: 847059 - RNA, 22 nt, Human
ugacuagaccuauaucuuuuug

SEQ ID NO: 847060 - RNA, 22 nt, Human
gucccuuggcucacaaacagcu

SEQ ID NO: 847061 - RNA, 22 nt, Human
ggcuggccucaggguccucgcu

SEQ ID NO: 847062 - RNA, 22 nt, Human
gccaggcuggaaagaacagaca

SEQ ID NO: 847063 - RNA, 22 nt, Human
ucacugcaaccucugccuuccg

SEQ ID NO: 847064 - RNA, 22 nt, Human
ccugcucagagcgucuugugug

SEQ ID NO: 847065 - RNA, 19 nt, Human
ucauaaggagagaggaaau

SEQ ID NO: 847066 - RNA, 22 nt, Human
ugcauuuccagauuucuggagu

SEQ ID NO: 847067 - RNA, 22 nt, Human
aaguccuuaggaagcagucguu

SEQ ID NO: 847068 - RNA, 22 nt, Human
cagaggcacaagaaagcaaggc

SEQ ID NO: 847069 - RNA, 22 nt, Human
uuuucauuuuuguagaugcaag

SEQ ID NO: 847070 - RNA, 22 nt, Human
gcuuccuucuaccacaucaugc

SEQ ID NO: 847071 - RNA, 22 nt, Human
auuuccaguccuaaugaucugg

SEQ ID NO: 847072 - RNA, 22 nt, Human
agggucuguggaugcaucuggg

SEQ ID NO: 847073 - RNA, 22 nt, Human
gggagggguugcauguuugagu

SEQ ID NO: 847074 - RNA, 22 nt, Human
gaggcaguguuuacugcccugu

SEQ ID NO: 847075 - RNA, 22 nt, Human
auuuccauacacccauuucuga

SEQ ID NO: 847076 - RNA, 23 nt, Human
ccaggccucucagagggugugcc

SEQ ID NO: 847077 - RNA, 22 nt, Human
agucucugugagcucccaaugg

SEQ ID NO: 847078 - RNA, 22 nt, Human
augcaguagauaggcacuuuua

SEQ ID NO: 847079 - RNA, 22 nt, Human
ucugcaggaaaaaagugccugg

SEQ ID NO: 847080 - RNA, 18 nt, Human
gggcaucauucacaaagu

SEQ ID NO: 847081 - RNA, 22 nt, Human
gaggcaacacauuuggaaagca

SEQ ID NO: 847082 - RNA, 22 nt, Human
ggcuccuggcaucuggugggua

SEQ ID NO: 847083 - RNA, 22 nt, Human
accucugccaagaugugcuccc

SEQ ID NO: 847084 - RNA, 21 nt, Human
ggcagccucuguggaagggga

SEQ ID NO: 847085 - RNA, 22 nt, Human
ucccagagccucugccacucug

SEQ ID NO: 847086 - RNA, 22 nt, Human
uuugcauuuauaaguuggugga

SEQ ID NO: 847087 - RNA, 22 nt, Human
acacuaaugagaaaggaauuaa

SEQ ID NO: 847088 - RNA, 22 nt, Human
ucucagggccucccucuguuuc

SEQ ID NO: 847089 - RNA, 22 nt, Human
auagucuuagaucagauaaagu

SEQ ID NO: 847090 - RNA, 22 nt, Human
uaugugaauacagcaguggaug

SEQ ID NO: 847091 - RNA, 22 nt, Human
uguuacacagcagaauagcaag

SEQ ID NO: 847092 - RNA, 22 nt, Human
aaaguucugggggagaagaacg

SEQ ID NO: 847093 - RNA, 22 nt, Human
caggcacuguguuaggcacugu

SEQ ID NO: 847094 - RNA, 22 nt, Human
ccagcuauugcuguguaacagu

SEQ ID NO: 847095 - RNA, 20 nt, Human
agagcagcaguuggugaggu

SEQ ID NO: 847096 - RNA, 22 nt, Human
auucuucacauggauaggaucu

SEQ ID NO: 847097 - RNA, 22 nt, Human
cagcagaggugguucacauugu

SEQ ID NO: 847098 - RNA, 22 nt, Human
acaccagggccuagccagggcg

SEQ ID NO: 847099 - RNA, 22 nt, Human
ucaggaucaggggccuuuccuu

SEQ ID NO: 847100 - RNA, 22 nt, Human
ugcacagcgggugucugucagg

SEQ ID NO: 847101 - RNA, 21 nt, Human
ugcuccuuagcugccccugcc

SEQ ID NO: 847102 - RNA, 22 nt, Human
caguauuuauggcuugaguauu

SEQ ID NO: 847103 - RNA, 22 nt, Human
aaagcagucacuccagugugau

SEQ ID NO: 847104 - RNA, 22 nt, Human
agggguggagaguguugccagu

SEQ ID NO: 847105 - RNA, 22 nt, Human
aggcuucccagcugagcucagc

SEQ ID NO: 847106 - RNA, 22 nt, Human
uggcucaggccacuucuuuuau

SEQ ID NO: 847107 - RNA, 22 nt, Human
ggcuggcuugccaagcucaggg

SEQ ID NO: 847108 - RNA, 22 nt, Human
gccagccugugcuuggccaggc

SEQ ID NO: 847109 - RNA, 23 nt, Human
uggggagaguuacccuggaagcg

SEQ ID NO: 847110 - RNA, 22 nt, Human
ccagagaccagaacauggggau

SEQ ID NO: 847111 - RNA, 22 nt, Human
cucuccagaucugcugagccag

SEQ ID NO: 847112 - RNA, 22 nt, Human
cugaggucucuuuccauaguga

SEQ ID NO: 847113 - RNA, 22 nt, Human
gcucugcuugcaucaugacugc

SEQ ID NO: 847114 - RNA, 22 nt, Human
cugcugugagcacuccagccug

SEQ ID NO: 847115 - RNA, 22 nt, Human
caggggcucuaaugcaugauca

SEQ ID NO: 847116 - RNA, 22 nt, Human
uuacaggggacauuggggacau

SEQ ID NO: 847117 - RNA, 22 nt, Human
ucuggaucccaccgccacacac

SEQ ID NO: 847118 - RNA, 22 nt, Human
acccucccauuuccauguagca

SEQ ID NO: 847119 - RNA, 22 nt, Human
guaucuuuugguggaaaaauaa

SEQ ID NO: 847120 - RNA, 22 nt, Human
gccaaagcagucuugccucugc

SEQ ID NO: 847121 - RNA, 22 nt, Human
auacuuuggggguuaguguaga

SEQ ID NO: 847122 - RNA, 22 nt, Human
cuguuuaucucuaaccuguuua

SEQ ID NO: 847123 - RNA, 22 nt, Human
ugcagcuucuccaucuccuugu

SEQ ID NO: 847124 - RNA, 22 nt, Human
agaaaucacaggaggcagaagg

SEQ ID NO: 847125 - RNA, 22 nt, Human
uuaacauacaucaugaacaaug

SEQ ID NO: 847126 - RNA, 23 nt, Human
ugcuguccaacagacuggccaug

SEQ ID NO: 847127 - RNA, 22 nt, Human
agggccagcccauaaugccaaa

SEQ ID NO: 847128 - RNA, 22 nt, Human
guggcucucgccagccugcggg

SEQ ID NO: 847129 - RNA, 22 nt, Human
uggccuggcugcccugucugga

SEQ ID NO: 847130 - RNA, 22 nt, Human
uggcucagaaggcugccuucac

SEQ ID NO: 847131 - RNA, 22 nt, Human
uuucauaaggguuucuagacuu

SEQ ID NO: 847132 - RNA, 22 nt, Human
cugggaggugcagcaaaaauca

SEQ ID NO: 847133 - RNA, 22 nt, Human
cacagcuucuccuugauaucgc

SEQ ID NO: 847134 - RNA, 22 nt, Human
agggcagagaaauguaguugag

SEQ ID NO: 847135 - RNA, 22 nt, Human
gcucuguacgcaggaugagggg

SEQ ID NO: 847136 - RNA, 22 nt, Human
gcagccacccucaaggcugaau

SEQ ID NO: 847137 - RNA, 22 nt, Human
aaaggucagcugccaucguucu

SEQ ID NO: 847138 - RNA, 22 nt, Human
ggggacccucaggacugcgucu

SEQ ID NO: 847139 - RNA, 22 nt, Human
aucagcuuuucucaucagaaau

SEQ ID NO: 847140 - RNA, 22 nt, Human
cagaaguaagauuacugugagu

SEQ ID NO: 847141 - RNA, 22 nt, Human
cauugacaucaggcuuggccaa

SEQ ID NO: 847142 - RNA, 23 nt, Human
auuuccuacuauaaaagagguaa

SEQ ID NO: 847143 - RNA, 22 nt, Human
uccuggaggcaaaugagcacau

SEQ ID NO: 847144 - RNA, 22 nt, Human
uaagagaauguuguggcuaggu

SEQ ID NO: 847145 - RNA, 22 nt, Human
ggcuuggaccagucacaguggu

SEQ ID NO: 847146 - RNA, 22 nt, Human
cauuguauugaggauacuuaag

SEQ ID NO: 847147 - RNA, 22 nt, Human
ccagcagcuguggcuuugccuc

SEQ ID NO: 847148 - RNA, 22 nt, Human
gaagcagcgaaguggaagggac

SEQ ID NO: 847149 - RNA, 22 nt, Human
ggucagguuuuuaggagugacc

SEQ ID NO: 847150 - RNA, 22 nt, Human
ccagcauggcaccugagaugag

SEQ ID NO: 847151 - RNA, 22 nt, Human
aggcagcagugauaagauagga

SEQ ID NO: 847152 - RNA, 22 nt, Human
cagcucugggugacaggagggc

SEQ ID NO: 847153 - RNA, 22 nt, Human
gcaggggcugcugggaacucgg

SEQ ID NO: 847154 - RNA, 22 nt, Human
ugcuggcccuggcucagggaac

SEQ ID NO: 847155 - RNA, 22 nt, Human
caaaguuuuaguaaacauauau

SEQ ID NO: 847156 - RNA, 22 nt, Human
acacuuuacagcuuccuuugca

SEQ ID NO: 847157 - RNA, 22 nt, Human
gccagcaguccugcugugugcc

SEQ ID NO: 847158 - RNA, 22 nt, Human
agagcuguggauaguccuggau

SEQ ID NO: 847159 - RNA, 22 nt, Human
uuauuucauguaaaauuuaugu

SEQ ID NO: 847160 - RNA, 22 nt, Human
agauguuccagccaaugggaau

SEQ ID NO: 847161 - RNA, 22 nt, Human
ccucagggccaucucugucccu

SEQ ID NO: 847162 - RNA, 22 nt, Human
ucugaaauagaagugucuuucu

SEQ ID NO: 847163 - RNA, 22 nt, Human
uucaaugauuuuuagggaucau

SEQ ID NO: 847164 - RNA, 22 nt, Human
ggcugagccuggagcaucuggu

SEQ ID NO: 847165 - RNA, 22 nt, Human
acagauuuuugguaaauaauuu

SEQ ID NO: 847166 - RNA, 22 nt, Human
gaaugaaagauuugcauucuau

SEQ ID NO: 847167 - RNA, 22 nt, Human
caaggagaguaauugaaugaga

SEQ ID NO: 847168 - RNA, 22 nt, Human
uccauguguuuuccuguccaca

SEQ ID NO: 847169 - RNA, 22 nt, Human
ucuacccagagcuaugaccuga

SEQ ID NO: 847170 - RNA, 22 nt, Human
uguacaaagguacuuugauguu

SEQ ID NO: 847171 - RNA, 22 nt, Human
uguggcugcucaggugcagacc

SEQ ID NO: 847172 - RNA, 22 nt, Human
aaaugcaauuguauguacucca

SEQ ID NO: 847173 - RNA, 22 nt, Human
augacaugaccugguagagaca

SEQ ID NO: 847174 - RNA, 22 nt, Human
cagcccugcacgcugccuccgc

SEQ ID NO: 847175 - RNA, 22 nt, Human
agagccugcaucaggcuugggg

SEQ ID NO: 847176 - RNA, 22 nt, Human
uauacagauuaacagauuuaaa

SEQ ID NO: 847177 - RNA, 22 nt, Human
uccucaggaugugggguagaau

SEQ ID NO: 847178 - RNA, 22 nt, Human
cagcugcaggaacaaaaaugug

SEQ ID NO: 847179 - RNA, 22 nt, Human
agggauguaaauucuucuucuu

SEQ ID NO: 847180 - RNA, 22 nt, Human
uguaggaauguuuuuaaguugg

SEQ ID NO: 847181 - RNA, 22 nt, Human
aguaaaaucaccaucucuuugu

SEQ ID NO: 847182 - RNA, 22 nt, Human
uuguuuuggaagaacuuacucu

SEQ ID NO: 847183 - RNA, 22 nt, Human
ccagcugcugugcagggaggcu

SEQ ID NO: 847184 - RNA, 22 nt, Human
uggcugcugagaaggcagcugu

SEQ ID NO: 847185 - RNA, 22 nt, Human
ucccagaggacuguuggugcua

SEQ ID NO: 847186 - RNA, 22 nt, Human
gugcucuguguauuaggauguc

SEQ ID NO: 847187 - RNA, 22 nt, Human
aagggcagagggaaucccacau

SEQ ID NO: 847188 - RNA, 22 nt, Human
gcugaagcccacguggcuugua

SEQ ID NO: 847189 - RNA, 19 nt, Human
uugguggugguuuugguuc

SEQ ID NO: 847190 - RNA, 22 nt, Human
cccucugaccuccugccacagu

SEQ ID NO: 847191 - RNA, 22 nt, Human
auaaggcagucacuggaauguu

SEQ ID NO: 847192 - RNA, 22 nt, Human
gaaugcacacgugugugcaugc

SEQ ID NO: 847193 - RNA, 22 nt, Human
ggcagggcuugucucugugaug

SEQ ID NO: 847194 - RNA, 22 nt, Human
guguuuccucacuucucugacu

SEQ ID NO: 847195 - RNA, 22 nt, Human
guuuacauguacucauuauacu

SEQ ID NO: 847196 - RNA, 22 nt, Human
aauguuuuaaaagagauugaga

SEQ ID NO: 847197 - RNA, 22 nt, Human
cuggcccagucucagaguguca

SEQ ID NO: 847198 - RNA, 22 nt, Human
auggcagccuguggacagucaa

SEQ ID NO: 847199 - RNA, 22 nt, Human
gcagggcucauucuaguacaau

SEQ ID NO: 847200 - RNA, 21 nt, Human
gcaugccugcaucuuaguguu

SEQ ID NO: 847201 - RNA, 19 nt, Human
agcaaauauaauaguguuc

SEQ ID NO: 847202 - RNA, 22 nt, Human
cugugcuuccaggauggcagcu

SEQ ID NO: 847203 - RNA, 22 nt, Human
guguuuccucuagaagccaugg

SEQ ID NO: 847204 - RNA, 22 nt, Human
auucaguucuaaggucagugcc

SEQ ID NO: 847205 - RNA, 22 nt, Human
cugggcugucccaaccccaucc

SEQ ID NO: 847206 - RNA, 22 nt, Human
cagcagguauguuuguucagca

SEQ ID NO: 847207 - RNA, 21 nt, Human
uagcacuucgcuguaauuggg

SEQ ID NO: 847208 - RNA, 22 nt, Human
ggccuuggugcucuguguugca

SEQ ID NO: 847209 - RNA, 22 nt, Human
cagaauaaaagucccaaggcau

SEQ ID NO: 847210 - RNA, 22 nt, Human
uguauacaggcauaagagauac

SEQ ID NO: 847211 - RNA, 21 nt, Human
gagugucuaauccaggcuguc

SEQ ID NO: 847212 - RNA, 20 nt, Human
gggcagcuccccucauucug

SEQ ID NO: 847213 - RNA, 22 nt, Human
uugcauuugaucuuggguucuc

SEQ ID NO: 847214 - RNA, 22 nt, Human
gcagacuggucuucagccuugg

SEQ ID NO: 847215 - RNA, 17 nt, Human
ugauaguucauuuuaag

SEQ ID NO: 847216 - RNA, 22 nt, Human
ugcccugucuaagcugucagua

SEQ ID NO: 847217 - RNA, 22 nt, Human
uggcccugcuguaucaucugcu

SEQ ID NO: 847218 - RNA, 22 nt, Human
cuggcuccaucacugggugaug

SEQ ID NO: 847219 - RNA, 19 nt, Human
uggaggagaggaaaaguca

SEQ ID NO: 847220 - RNA, 22 nt, Human
auuuacagaugaugcuauuuga

SEQ ID NO: 847221 - RNA, 22 nt, Human
gggagggaucugcuaggcaaug

SEQ ID NO: 847222 - RNA, 22 nt, Human
gcagggacaaggcagguguucu

SEQ ID NO: 847223 - RNA, 22 nt, Human
uaaaugugagugaugcggugaa

SEQ ID NO: 847224 - RNA, 22 nt, Human
uuugaacuucuaccugucauau

SEQ ID NO: 847225 - RNA, 22 nt, Human
uacauuccauguguguguauuc

SEQ ID NO: 847226 - RNA, 22 nt, Human
augaagucuagcaagcauugaa

SEQ ID NO: 847227 - RNA, 20 nt, Human
auacacauucauagaaaaau

SEQ ID NO: 847228 - RNA, 17 nt, Human
agugaaauuuacauugc

SEQ ID NO: 847229 - RNA, 22 nt, Human
guguggcugccagccaagaggc

SEQ ID NO: 847230 - RNA, 22 nt, Human
agggcagaaaccaccuugaugg

SEQ ID NO: 847231 - RNA, 22 nt, Human
aaaucauguuggcacaauaaaa

SEQ ID NO: 847232 - RNA, 22 nt, Human
ucugggcuugguuagggcuguu

SEQ ID NO: 847233 - RNA, 22 nt, Human
aggcucagagaugaguaagcac

SEQ ID NO: 847234 - RNA, 22 nt, Human
uguaauauuguagugacaguac

SEQ ID NO: 847235 - RNA, 22 nt, Human
aaggccaugaccacuugcugug

SEQ ID NO: 847236 - RNA, 22 nt, Human
gcauaauauacaugcuugaucc

SEQ ID NO: 847237 - RNA, 22 nt, Human
gcaaaaaaugcuuguugcuuag

SEQ ID NO: 847238 - RNA, 20 nt, Human
caggccagagguuugauggc

SEQ ID NO: 847239 - RNA, 22 nt, Human
aauguacaauaagacaaagagg

SEQ ID NO: 847240 - RNA, 22 nt, Human
ucaguuuuguauguuguaaguc

SEQ ID NO: 847241 - RNA, 22 nt, Human
uauccaaaguuucucagaaacu

SEQ ID NO: 847242 - RNA, 22 nt, Human
aagcugcccucauucccagugc

SEQ ID NO: 847243 - RNA, 22 nt, Human
uccuucaggccucauucucaua

SEQ ID NO: 847244 - RNA, 18 nt, Human
acagaaauagcugugccu

SEQ ID NO: 847245 - RNA, 22 nt, Human
gcccaggauaaugcugucccug

SEQ ID NO: 847246 - RNA, 22 nt, Human
caacuuuaugauugguuuguca

SEQ ID NO: 847247 - RNA, 21 nt, Human
uaaauaauaaguugcugagau

SEQ ID NO: 847248 - RNA, 22 nt, Human
ccucugaguccucccugguugc

SEQ ID NO: 847249 - RNA, 22 nt, Human
aauguguauacuggcaauuaag

SEQ ID NO: 847250 - RNA, 22 nt, Human
cagggacagccuugggguggcg

SEQ ID NO: 847251 - RNA, 22 nt, Human
uucagagcaucucuaaagccag

SEQ ID NO: 847252 - RNA, 22 nt, Human
auguacauuuagaucauuucug

SEQ ID NO: 847253 - RNA, 22 nt, Human
gagguggguguaucacagguca

SEQ ID NO: 847254 - RNA, 22 nt, Human
acuggcaguggcagcagaaaga

SEQ ID NO: 847255 - RNA, 20 nt, Human
gccaggagggugugaugagc

SEQ ID NO: 847256 - RNA, 22 nt, Human
caguccuuucugaaauccuaua

SEQ ID NO: 847257 - RNA, 22 nt, Human
uguuccauaaguggugcuuugu

SEQ ID NO: 847258 - RNA, 22 nt, Human
auauucguggucaaguaaggcc

SEQ ID NO: 847259 - RNA, 22 nt, Human
uauuuccaggccccacucuaga

SEQ ID NO: 847260 - RNA, 22 nt, Human
agcugucuuucugccuccugau

SEQ ID NO: 847261 - RNA, 22 nt, Human
gaggcgagaagcuggagauggu

SEQ ID NO: 847262 - RNA, 22 nt, Human
aaugugaucgcuuuagaagcuu

SEQ ID NO: 847263 - RNA, 22 nt, Human
ccuggagcaaaaaucuaaggag

SEQ ID NO: 847264 - RNA, 22 nt, Human
agaaaucauugaauuauuugcu

SEQ ID NO: 847265 - RNA, 22 nt, Human
uucucagagugaccaagucuuu

SEQ ID NO: 847266 - RNA, 22 nt, Human
augcaguacauacaaacacuga

SEQ ID NO: 847267 - RNA, 22 nt, Human
uggggacaggagacuuacagcu

SEQ ID NO: 847268 - RNA, 22 nt, Human
ccugugccauccugagcauccc

SEQ ID NO: 847269 - RNA, 22 nt, Human
gccugcagccucaagggcugag

SEQ ID NO: 847270 - RNA, 22 nt, Human
uuggcucaggaccccugugacu

SEQ ID NO: 847271 - RNA, 22 nt, Human
guguggcugugggagauguuca

SEQ ID NO: 847272 - RNA, 22 nt, Human
uccugcagagccgcccucaggu

SEQ ID NO: 847273 - RNA, 22 nt, Human
gaugaaaaauugcugugucaua

SEQ ID NO: 847274 - RNA, 20 nt, Human
uccagcugucuuucagagac

SEQ ID NO: 847275 - RNA, 22 nt, Human
uggauuaguuaagaaauguuag

SEQ ID NO: 847276 - RNA, 22 nt, Human
uaacagaaauagaaaugagagu

SEQ ID NO: 847277 - RNA, 22 nt, Human
acugucugcuggccccugguua

SEQ ID NO: 847278 - RNA, 22 nt, Human
agcugucuaccugcagaguccu

SEQ ID NO: 847279 - RNA, 20 nt, Human
aggagggaccuggauuggcg

SEQ ID NO: 847280 - RNA, 22 nt, Human
gggugacauuucccaaugagcc

SEQ ID NO: 847281 - RNA, 21 nt, Human
aagaaguuuggauuuuguccu

SEQ ID NO: 847282 - RNA, 22 nt, Human
acccaggagcaggcugggcagu

SEQ ID NO: 847283 - RNA, 19 nt, Human
gcagcugugggaagagcca

SEQ ID NO: 847284 - RNA, 22 nt, Human
agaaggccuaacuugggggcaa

SEQ ID NO: 847285 - RNA, 22 nt, Human
ucaggagacuggcagugcccac

SEQ ID NO: 847286 - RNA, 22 nt, Human
guacagaaggauuucuaguagu

SEQ ID NO: 847287 - RNA, 22 nt, Human
ccugggcuucugucuagauguu

SEQ ID NO: 847288 - RNA, 22 nt, Human
ugggccugaaggagcugcgccc

SEQ ID NO: 847289 - RNA, 22 nt, Human
aaguaaaagcuuuaccaugcgc

SEQ ID NO: 847290 - RNA, 22 nt, Human
uuugaagucagacacugcuuug

SEQ ID NO: 847291 - RNA, 22 nt, Human
uuuuaagaugcuaguauuucag

SEQ ID NO: 847292 - RNA, 22 nt, Human
uacaagagguauauagaaacag

SEQ ID NO: 847293 - RNA, 22 nt, Human
aagcagggcuuuaagcgguuuu

SEQ ID NO: 847294 - RNA, 22 nt, Human
aggcugcucugcgaagucagcu

SEQ ID NO: 847295 - RNA, 22 nt, Human
gccaggagacuccauucauuug

SEQ ID NO: 847296 - RNA, 22 nt, Human
aaugaaauguagcuuauccaua

SEQ ID NO: 847297 - RNA, 22 nt, Human
aaacuguauauuuauggcaugu

SEQ ID NO: 847298 - RNA, 22 nt, Human
agugccaggagcaaggagcucc

SEQ ID NO: 847299 - RNA, 22 nt, Human
augcaagauguauagaagacuu

SEQ ID NO: 847300 - RNA, 22 nt, Human
auucucaauggcuacuuucaua

SEQ ID NO: 847301 - RNA, 22 nt, Human
ucagccaguugccccaguuagu

SEQ ID NO: 847302 - RNA, 23 nt, Human
ugcucugggaggcccuggagagc

SEQ ID NO: 847303 - RNA, 17 nt, Human
uaucagaauguguuuac

SEQ ID NO: 847304 - RNA, 22 nt, Human
aacauguugcuuuaauaauauu

SEQ ID NO: 847305 - RNA, 22 nt, Human
gccuccuggauuuuagugccau

SEQ ID NO: 847306 - RNA, 22 nt, Human
aggcucugguuggcaaguaaag

SEQ ID NO: 847307 - RNA, 22 nt, Human
caggagcucucaucgucagggc

SEQ ID NO: 847308 - RNA, 22 nt, Human
aagaggaagucuccauggagag

SEQ ID NO: 847309 - RNA, 22 nt, Human
ugggcugcagagcccggccuuc

SEQ ID NO: 847310 - RNA, 22 nt, Human
agucccagccuaggcugugcug

SEQ ID NO: 847311 - RNA, 22 nt, Human
agacagcuaauaaaugagugug

SEQ ID NO: 847312 - RNA, 22 nt, Human
ugagccugcaauaagcacagcc

SEQ ID NO: 847313 - RNA, 22 nt, Human
aguauuucugcucaugaaagag

SEQ ID NO: 847314 - RNA, 22 nt, Human
aaugcuuuuugcgaaaugugca

SEQ ID NO: 847315 - RNA, 19 nt, Human
cugguccugacugaggggu

SEQ ID NO: 847316 - RNA, 22 nt, Human
auucauaaguaaaugauuaccu

SEQ ID NO: 847317 - RNA, 19 nt, Human
gaucuuugccaauuuaagc

SEQ ID NO: 847318 - RNA, 22 nt, Human
agcugcuaugacaacaccagcc

SEQ ID NO: 847319 - RNA, 22 nt, Human
cacagggcagugauuguccaca

SEQ ID NO: 847320 - RNA, 22 nt, Human
aagggcugaaugaaggguugaa

SEQ ID NO: 847321 - RNA, 20 nt, Human
uggggccuguuucugugguu

SEQ ID NO: 847322 - RNA, 22 nt, Human
uggcaccugaacuuagaggugu

SEQ ID NO: 847323 - RNA, 22 nt, Human
uuugcauuuguucaaguauuga

SEQ ID NO: 847324 - RNA, 22 nt, Human
ccugggcaacauagugagaccu

SEQ ID NO: 847325 - RNA, 22 nt, Human
uguuucaugauugcugucauuu

SEQ ID NO: 847326 - RNA, 22 nt, Human
uaucaagugacuaucacagaac

SEQ ID NO: 847327 - RNA, 17 nt, Human
cucugcagugcauggcu

SEQ ID NO: 847328 - RNA, 20 nt, Human
ucucccaggcucagggaaga

SEQ ID NO: 847329 - RNA, 19 nt, Human
gcuggggccugaccagaca

SEQ ID NO: 847330 - RNA, 22 nt, Human
uuaauucuaguuuaacacuuag

SEQ ID NO: 847331 - RNA, 22 nt, Human
gagagcugggggacuguggaug

SEQ ID NO: 847332 - RNA, 22 nt, Human
uggcucugggcaccguguccac

SEQ ID NO: 847333 - RNA, 22 nt, Human
cccagagccucauucuguuggg

SEQ ID NO: 847334 - RNA, 22 nt, Human
caggagaggaggcuacuucuua

SEQ ID NO: 847335 - RNA, 22 nt, Human
gcagcguggggacaggagcuca

SEQ ID NO: 847336 - RNA, 19 nt, Human
aauacaguguuauagaauu

SEQ ID NO: 847337 - RNA, 23 nt, Human
uuuuaauuuggacauaagaagau

SEQ ID NO: 847338 - RNA, 22 nt, Human
gaggcagugucgguggcaggau

SEQ ID NO: 847339 - RNA, 20 nt, Human
aauuuacucacagaaugaau

SEQ ID NO: 847340 - RNA, 22 nt, Human
aguuauaaucugcuacugauau

SEQ ID NO: 847341 - RNA, 22 nt, Human
ucagccagaggcuucuugguuu

SEQ ID NO: 847342 - RNA, 22 nt, Human
gccugguguccagaggcgagug

SEQ ID NO: 847343 - RNA, 22 nt, Human
uccaaacacccuccaugcugca

SEQ ID NO: 847344 - RNA, 22 nt, Human
augcccaaugucacaauuuuug

SEQ ID NO: 847345 - RNA, 22 nt, Human
uggcagaaguucacuaguagcu

SEQ ID NO: 847346 - RNA, 22 nt, Human
gcccugagacugagcauggguu

SEQ ID NO: 847347 - RNA, 22 nt, Human
agucucuuuaaucacagugucu

SEQ ID NO: 847348 - RNA, 22 nt, Human
ugccaggggaccuagggauguc

SEQ ID NO: 847349 - RNA, 22 nt, Human
agguaaggcuguaagcuaagcc

SEQ ID NO: 847350 - RNA, 23 nt, Human
uccagcagccaagaaggguagaa

SEQ ID NO: 847351 - RNA, 22 nt, Human
aauguaugacaguucuaguggu

SEQ ID NO: 847352 - RNA, 22 nt, Human
ggauuuccucuugacucuaaag

SEQ ID NO: 847353 - RNA, 22 nt, Human
cuucuuaaugacagauuaaaau

SEQ ID NO: 847354 - RNA, 17 nt, Human
ucaggauccaggguucu

SEQ ID NO: 847355 - RNA, 22 nt, Human
aaguucaagcucugccuaaaau

SEQ ID NO: 847356 - RNA, 19 nt, Human
ugcagcucagggcaggggc

SEQ ID NO: 847357 - RNA, 22 nt, Human
gaggccugcuuuggcacucugg

SEQ ID NO: 847358 - RNA, 20 nt, Human
gagauuuccaaucaugccca

SEQ ID NO: 847359 - RNA, 22 nt, Human
uaauuucaauagcuugcauaau

SEQ ID NO: 847360 - RNA, 22 nt, Human
ugcagcugcuugauucaucuug

SEQ ID NO: 847361 - RNA, 22 nt, Human
uuuccuaggagauugaucacau

SEQ ID NO: 847362 - RNA, 18 nt, Human
cuuucagauggauaugcu

SEQ ID NO: 847363 - RNA, 22 nt, Human
gcucuuccauuucucuugaacu

SEQ ID NO: 847364 - RNA, 22 nt, Human
uggcucugucacugugagcuau

SEQ ID NO: 847365 - RNA, 22 nt, Human
uccauuggucucugugcccagg

SEQ ID NO: 847366 - RNA, 22 nt, Human
uguacuaaggcuguguagaugu

SEQ ID NO: 847367 - RNA, 22 nt, Human
auggauuugcuuauacacaugu

SEQ ID NO: 847368 - RNA, 22 nt, Human
aggucauuaaaguuaaaugagg

SEQ ID NO: 847369 - RNA, 22 nt, Human
gagggcagaaaauuaugcggug

SEQ ID NO: 847370 - RNA, 22 nt, Human
guucuaauaggagaaaagacag

SEQ ID NO: 847371 - RNA, 22 nt, Human
caagagcugcaaauagcgugac

SEQ ID NO: 847372 - RNA, 20 nt, Human
aagagaagaagucuuugaaa

SEQ ID NO: 847373 - RNA, 22 nt, Human
aaaaaugcuuggacuuaauaaa

SEQ ID NO: 847374 - RNA, 22 nt, Human
uucuuuccaaccagauauuggu

SEQ ID NO: 847375 - RNA, 22 nt, Human
ccuuccuggagcccaugcagau

SEQ ID NO: 847376 - RNA, 22 nt, Human
agucaccagguuuuagagaccu

SEQ ID NO: 847377 - RNA, 22 nt, Human
acagaauugaaaguauaaucug

SEQ ID NO: 847378 - RNA, 22 nt, Human
aucuacaggauuuuacagaguu

SEQ ID NO: 847379 - RNA, 22 nt, Human
agauuguagaaacuguagcauu

SEQ ID NO: 847380 - RNA, 22 nt, Human
gaggcacuggaggaaaggagaa

SEQ ID NO: 847381 - RNA, 22 nt, Human
acugaaggguaaugugggagcc

SEQ ID NO: 847382 - RNA, 22 nt, Human
cccccaggcucugacacaggag

SEQ ID NO: 847383 - RNA, 22 nt, Human
gaaaauguuuccuguuauuugc

SEQ ID NO: 847384 - RNA, 22 nt, Human
cuauuucugccuaaugaccugu

SEQ ID NO: 847385 - RNA, 22 nt, Human
acucugggccccagguggagcu

SEQ ID NO: 847386 - RNA, 22 nt, Human
agggggaggcugugcugcgucu

SEQ ID NO: 847387 - RNA, 22 nt, Human
agauacauugaguuuccuccug

SEQ ID NO: 847388 - RNA, 22 nt, Human
ugcuggcuggccuggccuggac

SEQ ID NO: 847389 - RNA, 22 nt, Human
uguuguuuucucauggagaaua

SEQ ID NO: 847390 - RNA, 22 nt, Human
acagaauugauggaaaucucag

SEQ ID NO: 847391 - RNA, 22 nt, Human
gagucaccacacggugcugacu

SEQ ID NO: 847392 - RNA, 22 nt, Human
aucagcaaguccuguuaauucu

SEQ ID NO: 847393 - RNA, 22 nt, Human
aggcuucugugagcucauacaa

SEQ ID NO: 847394 - RNA, 22 nt, Human
cccagcaggaggagguugcagu

SEQ ID NO: 847395 - RNA, 22 nt, Human
ucagagcuuaucucuugcugga

SEQ ID NO: 847396 - RNA, 22 nt, Human
ggagaggagcuauugggggcuc

SEQ ID NO: 847397 - RNA, 22 nt, Human
ugcacaaacuugugucccaggg

SEQ ID NO: 847398 - RNA, 22 nt, Human
caggggcaagaaugcugucagc

SEQ ID NO: 847399 - RNA, 22 nt, Human
gcuuuuucaaaugaaagcuggu

SEQ ID NO: 847400 - RNA, 22 nt, Human
cccaggccccagggcuugucag

SEQ ID NO: 847401 - RNA, 22 nt, Human
aagaacaguguccugggacucg

SEQ ID NO: 847402 - RNA, 22 nt, Human
ccugccugcaccuucucugggg

SEQ ID NO: 847403 - RNA, 22 nt, Human
uaaaugcaguuaguacuugcca

SEQ ID NO: 847404 - RNA, 19 nt, Human
ucuggcuccgccucuuagu

SEQ ID NO: 847405 - RNA, 22 nt, Human
cugcagggcagggccuccuggc

SEQ ID NO: 847406 - RNA, 22 nt, Human
ggcagucagugugguucauaaa

SEQ ID NO: 847407 - RNA, 22 nt, Human
agagaaggucacuaaggaccca

SEQ ID NO: 847408 - RNA, 22 nt, Human
uaugcacaauaugaucuauuug

SEQ ID NO: 847409 - RNA, 22 nt, Human
guggccuggaaaggcuggucug

SEQ ID NO: 847410 - RNA, 22 nt, Human
cugcuuugcauagcugccagag

SEQ ID NO: 847411 - RNA, 22 nt, Human
aaagccagguugugugcaggaa

SEQ ID NO: 847412 - RNA, 22 nt, Human
ucagcuuggacagcuugguuga

SEQ ID NO: 847413 - RNA, 22 nt, Human
augggaggcaggcucagaaccg

SEQ ID NO: 847414 - RNA, 22 nt, Human
ccuggcaguggugaagaagagg

SEQ ID NO: 847415 - RNA, 22 nt, Human
uggcaggguuggccaccuuacc

SEQ ID NO: 847416 - RNA, 20 nt, Human
cuguuaaaagguaugaauuc

SEQ ID NO: 847417 - RNA, 22 nt, Human
auugacaaggaaacuauaccag

SEQ ID NO: 847418 - RNA, 22 nt, Human
gugauuucaaauauagagugag

SEQ ID NO: 847419 - RNA, 22 nt, Human
gcuggcuccucuguccucacgg

SEQ ID NO: 847420 - RNA, 22 nt, Human
ugcagcuucuuguccugugauu

SEQ ID NO: 847421 - RNA, 22 nt, Human
cugcugcauuccucuuuaugag

SEQ ID NO: 847422 - RNA, 22 nt, Human
ugaagcagaggggucuugagcu

SEQ ID NO: 847423 - RNA, 22 nt, Human
ucugaggcccugcaggcagugu

SEQ ID NO: 847424 - RNA, 22 nt, Human
ggcugcagauagccagccacca

SEQ ID NO: 847425 - RNA, 22 nt, Human
ugggccagcaauugcugcucag

SEQ ID NO: 847426 - RNA, 22 nt, Human
caaucaguuucuguuguauaau

SEQ ID NO: 847427 - RNA, 22 nt, Human
gaggcagcugaaggagugacag

SEQ ID NO: 847428 - RNA, 22 nt, Human
gccuggaguacuccuugaagug

SEQ ID NO: 847429 - RNA, 20 nt, Human
ucucaggguucagcaaagua

SEQ ID NO: 847430 - RNA, 22 nt, Human
ugccuugcacauaauauacauu

SEQ ID NO: 847431 - RNA, 22 nt, Human
acagccauagaugcuuauguaa

SEQ ID NO: 847432 - RNA, 21 nt, Human
agcagccauuucacagagacu

SEQ ID NO: 847433 - RNA, 22 nt, Human
gcugagagugagcacuggauau

SEQ ID NO: 847434 - RNA, 19 nt, Human
ccuguucaugacucugucc

SEQ ID NO: 847435 - RNA, 20 nt, Human
uggaaguucuguugcauugg

SEQ ID NO: 847436 - RNA, 22 nt, Human
uguuucauuaguacugacaaua

SEQ ID NO: 847437 - RNA, 22 nt, Human
uggcagcugucuguggggucuc

SEQ ID NO: 847438 - RNA, 22 nt, Human
aguuuuucuccccuggcuucau

SEQ ID NO: 847439 - RNA, 22 nt, Human
cagcauuuaaugcagugcuucc

SEQ ID NO: 847440 - RNA, 22 nt, Human
cagggcagaaggcacucuacuc

SEQ ID NO: 847441 - RNA, 22 nt, Human
acccaggagacagguugcagug

SEQ ID NO: 847442 - RNA, 22 nt, Human
gagcaggcucugccuguguguc

SEQ ID NO: 847443 - RNA, 20 nt, Human
cugggcugcccagcuauggg

SEQ ID NO: 847444 - RNA, 22 nt, Human
agucuacaaucuuaaaugaacu

SEQ ID NO: 847445 - RNA, 22 nt, Human
guuauaaaggugauaaugguca

SEQ ID NO: 847446 - RNA, 22 nt, Human
acauuucuggaguuucucaaca

SEQ ID NO: 847447 - RNA, 22 nt, Human
uaauuuuuccacguacacuggg

SEQ ID NO: 847448 - RNA, 22 nt, Human
uaauuauuaugacaacaauugc

SEQ ID NO: 847449 - RNA, 22 nt, Human
guguacaugagaaaucaacuuu

SEQ ID NO: 847450 - RNA, 18 nt, Human
agagaugguguagaguuu

SEQ ID NO: 847451 - RNA, 21 nt, Human
uggaggaauaaagcacagaag

SEQ ID NO: 847452 - RNA, 22 nt, Human
aggcaggcucaggcccaugcuu

SEQ ID NO: 847453 - RNA, 22 nt, Human
gcccaggauggagaauaguggu

SEQ ID NO: 847454 - RNA, 17 nt, Human
agguggguggaucaccu

SEQ ID NO: 847455 - RNA, 22 nt, Human
cuggcagcuggaggcuagaggc

SEQ ID NO: 847456 - RNA, 22 nt, Human
uucauucuuauuugugaucugg

SEQ ID NO: 847457 - RNA, 22 nt, Human
uggugcugacaguucugagugc

SEQ ID NO: 847458 - RNA, 22 nt, Human
ggccucuguucugcauuccucc

SEQ ID NO: 847459 - RNA, 19 nt, Human
auuuacugccuaaaaucuc

SEQ ID NO: 847460 - RNA, 22 nt, Human
ccaagggcugcugaggugucca

SEQ ID NO: 847461 - RNA, 22 nt, Human
aggcugcuuucauggccgcccc

SEQ ID NO: 847462 - RNA, 22 nt, Human
uuguaaaugaccuuuucuaauu

SEQ ID NO: 847463 - RNA, 22 nt, Human
ccuuuuucaauauagaauugca

SEQ ID NO: 847464 - RNA, 22 nt, Human
guuguauagagggcaugaaucu

SEQ ID NO: 847465 - RNA, 22 nt, Human
acaacuuuaauggguuucagcu

SEQ ID NO: 847466 - RNA, 22 nt, Human
ccaggagauaagcugaguuuau

SEQ ID NO: 847467 - RNA, 22 nt, Human
ucuagaauuuugccauauagcu

SEQ ID NO: 847468 - RNA, 22 nt, Human
uuauuuauggcccucaccugau

SEQ ID NO: 847469 - RNA, 22 nt, Human
cacauauuugaugaagcuuugu

SEQ ID NO: 847470 - RNA, 23 nt, Human
gcaggugguucgaacagaaguuu

SEQ ID NO: 847471 - RNA, 22 nt, Human
gccuggcaggccucaugagggg

SEQ ID NO: 847472 - RNA, 22 nt, Human
guagcuuauuagggauaauagu

SEQ ID NO: 847473 - RNA, 22 nt, Human
ugcuucaggaagaaacgccagg

SEQ ID NO: 847474 - RNA, 22 nt, Human
ggcacugacugugcagcgcacc

SEQ ID NO: 847475 - RNA, 21 nt, Human
ugcccacagcaaaugcagagg

SEQ ID NO: 847476 - RNA, 22 nt, Human
gaauacaugauacaugaacugc

SEQ ID NO: 847477 - RNA, 22 nt, Human
cugcuuugaggggcucuguaua

SEQ ID NO: 847478 - RNA, 22 nt, Human
uuucaaaguugggaauuguaau

SEQ ID NO: 847479 - RNA, 22 nt, Human
ggcugggccagggccuguggac

SEQ ID NO: 847480 - RNA, 22 nt, Human
acauuucucuugaugucucuau

SEQ ID NO: 847481 - RNA, 22 nt, Human
auucucaaacaagugguuugau

SEQ ID NO: 847482 - RNA, 22 nt, Human
ccagcuccagguagaugggcag

SEQ ID NO: 847483 - RNA, 22 nt, Human
cuggcaggagcauucacagagg

SEQ ID NO: 847484 - RNA, 22 nt, Human
caguguggagggagagagccug

SEQ ID NO: 847485 - RNA, 22 nt, Human
gcagcccaaaaaagagguagau

SEQ ID NO: 847486 - RNA, 22 nt, Human
ucacauaaauuauacaauuuca

SEQ ID NO: 847487 - RNA, 22 nt, Human
ccuccugggacaggcuggcaca

SEQ ID NO: 847488 - RNA, 22 nt, Human
agcaggaaagaaaaaucugugu

SEQ ID NO: 847489 - RNA, 22 nt, Human
cuuauguaaaacggaaagggaa

SEQ ID NO: 847490 - RNA, 22 nt, Human
agccagcugugggcucaggcgg

SEQ ID NO: 847491 - RNA, 22 nt, Human
aggcagcaugggccccagcucc

SEQ ID NO: 847492 - RNA, 22 nt, Human
gcucucugucguuaugcuucau

SEQ ID NO: 847493 - RNA, 22 nt, Human
uuacagaaaauguguuuuaacu

SEQ ID NO: 847494 - RNA, 19 nt, Human
uggcagcauugguaccuug

SEQ ID NO: 847495 - RNA, 22 nt, Human
cagaucuguuugccagaucagc

SEQ ID NO: 847496 - RNA, 22 nt, Human
ucuuagaaugucaacugauguu

SEQ ID NO: 847497 - RNA, 22 nt, Human
acccacgaagaugagcggcaug

SEQ ID NO: 847498 - RNA, 22 nt, Human
uggcagagcaaaaagauagaau

SEQ ID NO: 847499 - RNA, 22 nt, Human
ggcugccugcucaggugcggcg

SEQ ID NO: 847500 - RNA, 22 nt, Human
cccuggaggagcuuagagcuug

SEQ ID NO: 847501 - RNA, 22 nt, Human
guacuuccguggacuaauuguu

SEQ ID NO: 847502 - RNA, 22 nt, Human
gcuguucacauuuugggccaaa

SEQ ID NO: 847503 - RNA, 22 nt, Human
gcugccuuugugagccaagggg

SEQ ID NO: 847504 - RNA, 22 nt, Human
ugcuugagacacauaugaauuu

SEQ ID NO: 847505 - RNA, 22 nt, Human
caucagaauguuagagaaggga

SEQ ID NO: 847506 - RNA, 22 nt, Human
cagcccuggccccagguggucu

SEQ ID NO: 847507 - RNA, 19 nt, Human
uggcuucuguuuucauguu

SEQ ID NO: 847508 - RNA, 22 nt, Human
gagggauggugugagaggcuca

SEQ ID NO: 847509 - RNA, 20 nt, Human
agaggcuuccuugggaggag

SEQ ID NO: 847510 - RNA, 18 nt, Human
caaagcucacguuccauc

SEQ ID NO: 847511 - RNA, 22 nt, Human
aucugucaggagcaaggacuac

SEQ ID NO: 847512 - RNA, 22 nt, Human
agccccaggcccggacgccucu

SEQ ID NO: 847513 - RNA, 22 nt, Human
aacuggauuaacuggcucaaau

SEQ ID NO: 847514 - RNA, 22 nt, Human
aauuuacaggugcacucgccau

SEQ ID NO: 847515 - RNA, 22 nt, Human
gagccuggauagccuuguucca

SEQ ID NO: 847516 - RNA, 22 nt, Human
ucaggcagagcuguggagcucu

SEQ ID NO: 847517 - RNA, 22 nt, Human
cauuaauauuguucuucuuuag

SEQ ID NO: 847518 - RNA, 22 nt, Human
ggugcuggacacguggcacucc

SEQ ID NO: 847519 - RNA, 22 nt, Human
aaggcccuaauagagcacauau

SEQ ID NO: 847520 - RNA, 22 nt, Human
ccagccuggguguuagaagaca

SEQ ID NO: 847521 - RNA, 22 nt, Human
gucagcaggguccccuugagug

SEQ ID NO: 847522 - RNA, 22 nt, Human
cuugcacacauguacaugugua

SEQ ID NO: 847523 - RNA, 22 nt, Human
aacagcaauagcacuauucauu

SEQ ID NO: 847524 - RNA, 22 nt, Human
uccaauauggauaaaaggggcc

SEQ ID NO: 847525 - RNA, 23 nt, Human
aaacugcuuccaauuccugccau

SEQ ID NO: 847526 - RNA, 22 nt, Human
aagaauguuaguuucugauaca

SEQ ID NO: 847527 - RNA, 22 nt, Human
cacacauugaauucauucuugu

SEQ ID NO: 847528 - RNA, 22 nt, Human
cugggcagaauuuuaggauggc

SEQ ID NO: 847529 - RNA, 22 nt, Human
uggcagcaaaaccagaaucaga

SEQ ID NO: 847530 - RNA, 22 nt, Human
uagggcagagcuuguacacgau

SEQ ID NO: 847531 - RNA, 21 nt, Human
uucuucaaagaagaaggcaca

SEQ ID NO: 847532 - RNA, 22 nt, Human
acauuucucagggaguuuugcu

SEQ ID NO: 847533 - RNA, 22 nt, Human
uggcagcaauuagcuagagcug

SEQ ID NO: 847534 - RNA, 22 nt, Human
agcagcugguaggaguggccac

SEQ ID NO: 847535 - RNA, 22 nt, Human
acuguucacuagugaggguuga

SEQ ID NO: 847536 - RNA, 22 nt, Human
guggccugaugccagcccugug

SEQ ID NO: 847537 - RNA, 22 nt, Human
cugggcugcgggcgccccucca

SEQ ID NO: 847538 - RNA, 23 nt, Human
agaggggagcaucugcuggcuga

SEQ ID NO: 847539 - RNA, 22 nt, Human
uacaaaguaauguauaauaucg

SEQ ID NO: 847540 - RNA, 22 nt, Human
cuggcaggaagaggaaagguca

SEQ ID NO: 847541 - RNA, 22 nt, Human
auuuccagacuuuuuccaggaa

SEQ ID NO: 847542 - RNA, 19 nt, Human
ggcugcugguuacagaggc

SEQ ID NO: 847543 - RNA, 22 nt, Human
guggccugccagcagauggcgc

SEQ ID NO: 847544 - RNA, 22 nt, Human
accaggagccacaggaggagcc

SEQ ID NO: 847545 - RNA, 22 nt, Human
agcugcuguggggcucggccug

SEQ ID NO: 847546 - RNA, 16 nt, Human
gcaacuuugggguuga

SEQ ID NO: 847547 - RNA, 22 nt, Human
aauuccaggcagaaaugugagu

SEQ ID NO: 847548 - RNA, 22 nt, Human
ggaggccaaggcagguggaucg

SEQ ID NO: 847549 - RNA, 22 nt, Human
ggcaauuucaugugguuuaaac

SEQ ID NO: 847550 - RNA, 22 nt, Human
gugcauuugacgaauacucacu

SEQ ID NO: 847551 - RNA, 22 nt, Human
ggaggugggauuaggaccuaaa

SEQ ID NO: 847552 - RNA, 22 nt, Human
aguaccaugcuuccugacuggu

SEQ ID NO: 847553 - RNA, 22 nt, Human
ugaggcaggaguuaaugugcuc

SEQ ID NO: 847554 - RNA, 22 nt, Human
gguggcuggaggagcugaugga

SEQ ID NO: 847555 - RNA, 22 nt, Human
uuagauaacaguagaauaucaa

SEQ ID NO: 847556 - RNA, 22 nt, Human
cugggcugcaucaaagaggcau

SEQ ID NO: 847557 - RNA, 22 nt, Human
gagggucccgagcccugucaga

SEQ ID NO: 847558 - RNA, 22 nt, Human
aaugauggauuuagacaagcug

SEQ ID NO: 847559 - RNA, 22 nt, Human
ugcagggcccucauuccugucc

SEQ ID NO: 847560 - RNA, 20 nt, Human
ccugggguacacuggcaugu

SEQ ID NO: 847561 - RNA, 22 nt, Human
gagggcugauaaaugcgcaugg

SEQ ID NO: 847562 - RNA, 22 nt, Human
gaauaaucaugaaauucaguga

SEQ ID NO: 847563 - RNA, 20 nt, Human
uccagcugggaacagcugau

SEQ ID NO: 847564 - RNA, 22 nt, Human
ggggcagagaauaaaaaccuaa

SEQ ID NO: 847565 - RNA, 22 nt, Human
gcuguggucugugagcuccaaa

SEQ ID NO: 847566 - RNA, 22 nt, Human
agcuccuccugugccaggccag

SEQ ID NO: 847567 - RNA, 22 nt, Human
caguccuuagucuggauggcuu

SEQ ID NO: 847568 - RNA, 22 nt, Human
ggccaccuuccaguugccugca

SEQ ID NO: 847569 - RNA, 22 nt, Human
uccuggguccauggcagccgaa

SEQ ID NO: 847570 - RNA, 22 nt, Human
uacauguauguguacgugcaug

SEQ ID NO: 847571 - RNA, 22 nt, Human
cagcaauaagccagguuagaca

SEQ ID NO: 847572 - RNA, 22 nt, Human
ugaaucaguauaaauucucaaa

SEQ ID NO: 847573 - RNA, 22 nt, Human
uagucaccugugagcugcguag

SEQ ID NO: 847574 - RNA, 22 nt, Human
guguggcuaccucagaggagca

SEQ ID NO: 847575 - RNA, 22 nt, Human
gagacacacacaggagguggca

SEQ ID NO: 847576 - RNA, 22 nt, Human
agugcugucccgacaacugagg

SEQ ID NO: 847577 - RNA, 22 nt, Human
agggcagcacaaggcauggacu

SEQ ID NO: 847578 - RNA, 22 nt, Human
uucugucagcgucagaaauucu

SEQ ID NO: 847579 - RNA, 22 nt, Human
gucuucuuuaaccuacuaaagc

SEQ ID NO: 847580 - RNA, 22 nt, Human
gagugcagaugccagccccagu

SEQ ID NO: 847581 - RNA, 22 nt, Human
uauaauuuggggaaaguggugu

SEQ ID NO: 847582 - RNA, 22 nt, Human
ugugaaaggggucacagggaaa

SEQ ID NO: 847583 - RNA, 22 nt, Human
cccaggaaugaggggcggaggc

SEQ ID NO: 847584 - RNA, 22 nt, Human
uuucacaaaugucuuuaacuug

SEQ ID NO: 847585 - RNA, 22 nt, Human
ugcuuuaagacacuaaguuuga

SEQ ID NO: 847586 - RNA, 22 nt, Human
gccaggagcaugucauuguuga

SEQ ID NO: 847587 - RNA, 22 nt, Human
gagauauguuagaaagcuauug

SEQ ID NO: 847588 - RNA, 22 nt, Human
ccuccugguccagcaucucuuu

SEQ ID NO: 847589 - RNA, 18 nt, Human
acagaggcagacauguau

SEQ ID NO: 847590 - RNA, 22 nt, Human
uucccaggcugugcuaccagag

SEQ ID NO: 847591 - RNA, 22 nt, Human
caaaugauaccuauuacuaggc

SEQ ID NO: 847592 - RNA, 22 nt, Human
agagcccugaagcagagcuaaa

SEQ ID NO: 847593 - RNA, 22 nt, Human
ggccugagucacaucaggagag

SEQ ID NO: 847594 - RNA, 22 nt, Human
augcugcacaagccacauguag

SEQ ID NO: 847595 - RNA, 22 nt, Human
acagcagcauaaacugacuaag

SEQ ID NO: 847596 - RNA, 22 nt, Human
gguuugcauucugaaaggcuca

SEQ ID NO: 847597 - RNA, 22 nt, Human
ccagggcagcagaauuggggca

SEQ ID NO: 847598 - RNA, 22 nt, Human
ugaggcagcaauuguauuguau

SEQ ID NO: 847599 - RNA, 22 nt, Human
cccuugcaucccauguguggcc

SEQ ID NO: 847600 - RNA, 22 nt, Human
caagaugaucccugaaggcagc

SEQ ID NO: 847601 - RNA, 22 nt, Human
cagagcugcgcuuuuuccuggu

SEQ ID NO: 847602 - RNA, 22 nt, Human
caaauucaaauuucaucagugu

SEQ ID NO: 847603 - RNA, 22 nt, Human
ugucaccaguuccaggaaauaa

SEQ ID NO: 847604 - RNA, 22 nt, Human
ucugucaaaugagcaaguaacu

SEQ ID NO: 847605 - RNA, 22 nt, Human
agaggugacauaggagaggcuc

SEQ ID NO: 847606 - RNA, 22 nt, Human
gccacguugccacccgggugac

SEQ ID NO: 847607 - RNA, 22 nt, Human
ucaggugguccuaagugccauc

SEQ ID NO: 847608 - RNA, 22 nt, Human
ugcagaagaauguaggcauaag

SEQ ID NO: 847609 - RNA, 22 nt, Human
uccuugaagcuuguaucuaaua

SEQ ID NO: 847610 - RNA, 20 nt, Human
cuucuucaguaguuuguucu

SEQ ID NO: 847611 - RNA, 22 nt, Human
uucaagaucgaguuuaaaguga

SEQ ID NO: 847612 - RNA, 22 nt, Human
aaaguguggucguucauuuugu

SEQ ID NO: 847613 - RNA, 19 nt, Human
ccagucccauacaggagau

SEQ ID NO: 847614 - RNA, 22 nt, Human
uagauauaagguccuuagaaca

SEQ ID NO: 847615 - RNA, 23 nt, Human
ucuaauacaugaaaccuagaugu

SEQ ID NO: 847616 - RNA, 22 nt, Human
agauggggcucaguguggaggc

SEQ ID NO: 847617 - RNA, 22 nt, Human
ugcauguguuugccacagugag

SEQ ID NO: 847618 - RNA, 22 nt, Human
uagcagcuuaaguaauuagaau

SEQ ID NO: 847619 - RNA, 22 nt, Human
cuggggugagcagaaacagggg

SEQ ID NO: 847620 - RNA, 22 nt, Human
cucauacauaugccauuccugc

SEQ ID NO: 847621 - RNA, 22 nt, Human
ucaggaguccugccugcagccu

SEQ ID NO: 847622 - RNA, 21 nt, Human
gcacagugccaggcacacagu

SEQ ID NO: 847623 - RNA, 22 nt, Human
ugcagaagaaugagcuuggagu

SEQ ID NO: 847624 - RNA, 21 nt, Human
gcagggacaaagcuucaggag

SEQ ID NO: 847625 - RNA, 22 nt, Human
ucagaauuuuuguuacccuuga

SEQ ID NO: 847626 - RNA, 22 nt, Human
uauuccaaaauaguuaagcacu

SEQ ID NO: 847627 - RNA, 22 nt, Human
gagugcaggccugagcaccauc

SEQ ID NO: 847628 - RNA, 22 nt, Human
acagggcagaaauguugcaucu

SEQ ID NO: 847629 - RNA, 22 nt, Human
gauaaugaugacaaugacaacc

SEQ ID NO: 847630 - RNA, 22 nt, Human
ccuggcagcgccgaagcuggcc

SEQ ID NO: 847631 - RNA, 22 nt, Human
aggcagcuggcaaauucuagag

SEQ ID NO: 847632 - RNA, 21 nt, Human
gcuccuggugcugcguggcgc

SEQ ID NO: 847633 - RNA, 22 nt, Human
aaaucaaaagacauguguuuua

SEQ ID NO: 847634 - RNA, 22 nt, Human
ugccaggcuaaguggaggacuu

SEQ ID NO: 847635 - RNA, 22 nt, Human
gcugucagugaggugagacaug

SEQ ID NO: 847636 - RNA, 22 nt, Human
aaaucacuaaguuauagugugg

SEQ ID NO: 847637 - RNA, 22 nt, Human
auuucaggagcaguuucagugg

SEQ ID NO: 847638 - RNA, 22 nt, Human
gcaagcaagcagguagagcuga

SEQ ID NO: 847639 - RNA, 22 nt, Human
gccugagcuacuagggagucug

SEQ ID NO: 847640 - RNA, 22 nt, Human
guucuucaggccauccucccag

SEQ ID NO: 847641 - RNA, 22 nt, Human
aauaauuuuagcucagaguugu

SEQ ID NO: 847642 - RNA, 22 nt, Human
ggcagagcuuguuccuucuguu

SEQ ID NO: 847643 - RNA, 22 nt, Human
gacccaggguggucaccugaaa

SEQ ID NO: 847644 - RNA, 22 nt, Human
uuacagaacugucuugaaauuu

SEQ ID NO: 847645 - RNA, 22 nt, Human
agagcugggugaagugccauca

SEQ ID NO: 847646 - RNA, 22 nt, Human
ugggcugcuuccucagcugaga

SEQ ID NO: 847647 - RNA, 22 nt, Human
cagcacugcugcuguacacaca

SEQ ID NO: 847648 - RNA, 22 nt, Human
uggcucucagcucccagcagcc

SEQ ID NO: 847649 - RNA, 22 nt, Human
uggggacacagagguucguugg

SEQ ID NO: 847650 - RNA, 22 nt, Human
uggguagagacacagucugggg

SEQ ID NO: 847651 - RNA, 22 nt, Human
acagggcaccugagguaggaag

SEQ ID NO: 847652 - RNA, 22 nt, Human
ucccuuaaaacucauguguugu

SEQ ID NO: 847653 - RNA, 22 nt, Human
uagcaguggaaucuuuugucca

SEQ ID NO: 847654 - RNA, 19 nt, Human
acaaaugauguugcacuga

SEQ ID NO: 847655 - RNA, 22 nt, Human
ccucugcucugguccaugugcu

SEQ ID NO: 847656 - RNA, 22 nt, Human
acagaugauuuuuaugaaaaca

SEQ ID NO: 847657 - RNA, 22 nt, Human
gccacccccaaguagguggucu

SEQ ID NO: 847658 - RNA, 22 nt, Human
gaucuucuauguaaugaagugu

SEQ ID NO: 847659 - RNA, 22 nt, Human
uuucacaaguaaaguccuaagu

SEQ ID NO: 847660 - RNA, 22 nt, Human
agcagagguuuguuggaaaccu

SEQ ID NO: 847661 - RNA, 22 nt, Human
gccucugcaauuacauugugcc

SEQ ID NO: 847662 - RNA, 22 nt, Human
aagauuucagaguuugggggaa

SEQ ID NO: 847663 - RNA, 22 nt, Human
aauauucaaguuauucuuucuu

SEQ ID NO: 847664 - RNA, 22 nt, Human
uagaaacauauaggauggcagg

SEQ ID NO: 847665 - RNA, 21 nt, Human
cucuggagucaagagcuucca

SEQ ID NO: 847666 - RNA, 23 nt, Human
cuggcucauccugguugcagugg

SEQ ID NO: 847667 - RNA, 22 nt, Human
uccaguggagugugggggugaa

SEQ ID NO: 847668 - RNA, 20 nt, Human
ugcuugucaugcacucaggc

SEQ ID NO: 847669 - RNA, 22 nt, Human
uacauucuacuuuuucacuccc

SEQ ID NO: 847670 - RNA, 22 nt, Human
ucucacuggguauaaaugagua

SEQ ID NO: 847671 - RNA, 22 nt, Human
guaaaguucuacuagaaucaac

SEQ ID NO: 847672 - RNA, 22 nt, Human
cucuaauccuuugucccugggu

SEQ ID NO: 847673 - RNA, 22 nt, Human
ucagcagaggggaaggcaucug

SEQ ID NO: 847674 - RNA, 22 nt, Human
cuggaucaugggaaagggauca

SEQ ID NO: 847675 - RNA, 22 nt, Human
cagccagggucaggcagcuucu

SEQ ID NO: 847676 - RNA, 22 nt, Human
augcuguguuuuaaauggaaau

SEQ ID NO: 847677 - RNA, 22 nt, Human
agaggaggcagcuuaacucagu

SEQ ID NO: 847678 - RNA, 22 nt, Human
acagcagcuaaccccugggcca

SEQ ID NO: 847679 - RNA, 22 nt, Human
augccaggccccacgcugggca

SEQ ID NO: 847680 - RNA, 22 nt, Human
ucucagagcucacaccuccugg

SEQ ID NO: 847681 - RNA, 22 nt, Human
auuuugaaaccaaguuauuucc

SEQ ID NO: 847682 - RNA, 22 nt, Human
gacaugcaacaauuuggcauuu

SEQ ID NO: 847683 - RNA, 22 nt, Human
gccaggugggagacagacagca

SEQ ID NO: 847684 - RNA, 22 nt, Human
ugauacagucagcucacaauug

SEQ ID NO: 847685 - RNA, 22 nt, Human
gacaggaggcagagcucaggug

SEQ ID NO: 847686 - RNA, 22 nt, Human
ucuucagacuccaaauguuuua

SEQ ID NO: 847687 - RNA, 22 nt, Human
gcugcaggggggucuggacuug

SEQ ID NO: 847688 - RNA, 22 nt, Human
ucucuucuaauuaggguccaug

SEQ ID NO: 847689 - RNA, 22 nt, Human
uuguuuucuccacugcaucuua

SEQ ID NO: 847690 - RNA, 22 nt, Human
aauuucaaagcucacuggcaua

SEQ ID NO: 847691 - RNA, 22 nt, Human
ucaaugauagacaagaucuaag

SEQ ID NO: 847692 - RNA, 22 nt, Human
acagguggggaggcugagguuc

SEQ ID NO: 847693 - RNA, 22 nt, Human
aaaaauguuaucuacuguccga

SEQ ID NO: 847694 - RNA, 22 nt, Human
accacugcccauggugaaaacu

SEQ ID NO: 847695 - RNA, 22 nt, Human
cauaauuuuuuuaagucagaac

SEQ ID NO: 847696 - RNA, 22 nt, Human
cccagccucagcuuuacuucca

SEQ ID NO: 847697 - RNA, 20 nt, Human
caauuucaucauuuccugug

SEQ ID NO: 847698 - RNA, 22 nt, Human
auaguuugugaaacacagcagu

SEQ ID NO: 847699 - RNA, 22 nt, Human
cauaauauacuacauugaugaa

SEQ ID NO: 847700 - RNA, 22 nt, Human
ugcauauuauguguaucugucu

SEQ ID NO: 847701 - RNA, 22 nt, Human
caggaggcaucauggagcggac

SEQ ID NO: 847702 - RNA, 22 nt, Human
caggauggucagaugcauuguc

SEQ ID NO: 847703 - RNA, 22 nt, Human
aagucuguuugagugucacacu

SEQ ID NO: 847704 - RNA, 15 nt, Human
ugggcagaucacuug

SEQ ID NO: 847705 - RNA, 22 nt, Human
uuacaaagagaaguuguagaau

SEQ ID NO: 847706 - RNA, 22 nt, Human
caccagcuacagacuacugugu

SEQ ID NO: 847707 - RNA, 22 nt, Human
uuccauuguuucugucuucacu

SEQ ID NO: 847708 - RNA, 21 nt, Human
cagaggcugagagggcaaucu

SEQ ID NO: 847709 - RNA, 22 nt, Human
agcagcucaaagccugcaagga

SEQ ID NO: 847710 - RNA, 22 nt, Human
aagagcuguaugccauaugauu

SEQ ID NO: 847711 - RNA, 22 nt, Human
caacuuugugugaccuagauag

SEQ ID NO: 847712 - RNA, 23 nt, Human
ucuuuacauacugaugaguucuc

SEQ ID NO: 847713 - RNA, 22 nt, Human
cagggcagaacauauagauagu

SEQ ID NO: 847714 - RNA, 22 nt, Human
ccaggcaggcagcguucucagg

SEQ ID NO: 847715 - RNA, 21 nt, Human
aaaaugugagcgugaugcuua

SEQ ID NO: 847716 - RNA, 22 nt, Human
gccaggcuguuuuuauuacugu

SEQ ID NO: 847717 - RNA, 22 nt, Human
cugagucucccggcaguggagg

SEQ ID NO: 847718 - RNA, 22 nt, Human
uccaugaggcagggaggcuggc

SEQ ID NO: 847719 - RNA, 22 nt, Human
acaggcuuuuuuagaaugacau

SEQ ID NO: 847720 - RNA, 22 nt, Human
aggcugccaaagcuucugucuc

SEQ ID NO: 847721 - RNA, 21 nt, Human
uccaggaguucuaauaggugu

SEQ ID NO: 847722 - RNA, 22 nt, Human
uaugcacauuaucuaauccauu

SEQ ID NO: 847723 - RNA, 22 nt, Human
uacuaaacccucgauggaucuu

SEQ ID NO: 847724 - RNA, 22 nt, Human
ugucacuucaggaaugcaggga

SEQ ID NO: 847725 - RNA, 22 nt, Human
uacauguauugauuucucuucu

SEQ ID NO: 847726 - RNA, 22 nt, Human
gucuucuuuucagucugcuugu

SEQ ID NO: 847727 - RNA, 21 nt, Human
agguggggcugcaccucugcu

SEQ ID NO: 847728 - RNA, 22 nt, Human
acacagggcugcgccugacccc

SEQ ID NO: 847729 - RNA, 22 nt, Human
ggccuucacgugaccuggcgug

SEQ ID NO: 847730 - RNA, 22 nt, Human
gcugggcaccggagagacccca

SEQ ID NO: 847731 - RNA, 22 nt, Human
gcuggccagggcugcucgcgga

SEQ ID NO: 847732 - RNA, 22 nt, Human
cugccugggccggccacccucu

SEQ ID NO: 847733 - RNA, 22 nt, Human
uggcauuugcucccuuguguuc

SEQ ID NO: 847734 - RNA, 22 nt, Human
gggcagauggggcacaggcuga

SEQ ID NO: 847735 - RNA, 22 nt, Human
agggagcuaggauccugaaggu

SEQ ID NO: 847736 - RNA, 22 nt, Human
ggaggcugcugccucacguggg

SEQ ID NO: 847737 - RNA, 22 nt, Human
cugggcuguaauguggcacuga

SEQ ID NO: 847738 - RNA, 22 nt, Human
uaauuucacaguucaacgcaca

SEQ ID NO: 847739 - RNA, 22 nt, Human
caaaugcagucccuuuguugcu

SEQ ID NO: 847740 - RNA, 22 nt, Human
gcagagccaugggagguuuuug

SEQ ID NO: 847741 - RNA, 22 nt, Human
gaggcauggccugaggcuagga

SEQ ID NO: 847742 - RNA, 21 nt, Human
ccuccaggugauuccgugcuc

SEQ ID NO: 847743 - RNA, 22 nt, Human
auacaaauuuauagaugcauuu

SEQ ID NO: 847744 - RNA, 22 nt, Human
ugccucugugggccuuccuggc

SEQ ID NO: 847745 - RNA, 22 nt, Human
aggcaguuguugcugagcagcu

SEQ ID NO: 847746 - RNA, 22 nt, Human
ucaucuaagagucuuacauuua

SEQ ID NO: 847747 - RNA, 22 nt, Human
acagugcuaaacacuucuugaa

SEQ ID NO: 847748 - RNA, 22 nt, Human
cuuggggcugucacucuggcau

SEQ ID NO: 847749 - RNA, 22 nt, Human
ccuggcagucaggggaguccuu

SEQ ID NO: 847750 - RNA, 22 nt, Human
cccagggcuuuucucacuagac

SEQ ID NO: 847751 - RNA, 22 nt, Human
ccaggguggaggcuggauggag

SEQ ID NO: 847752 - RNA, 22 nt, Human
gcucccagcuggagccucaaca

SEQ ID NO: 847753 - RNA, 22 nt, Human
caguccuucuccauuaaggcuc

SEQ ID NO: 847754 - RNA, 22 nt, Human
gcaggcugauagaggauuccau

SEQ ID NO: 847755 - RNA, 22 nt, Human
ucuuuccucugagcuccuguag

SEQ ID NO: 847756 - RNA, 22 nt, Human
cuggcuguauuaguuugauccu

SEQ ID NO: 847757 - RNA, 22 nt, Human
gauguagagggaagauuuuaaa

SEQ ID NO: 847758 - RNA, 22 nt, Human
aggcacuguucccaguuauccu

SEQ ID NO: 847759 - RNA, 22 nt, Human
auuguguaauuuucagcucaua

SEQ ID NO: 847760 - RNA, 22 nt, Human
auccugucaucauaguacuuga

SEQ ID NO: 847761 - RNA, 22 nt, Human
uggcauuucuggccauuugugu

SEQ ID NO: 847762 - RNA, 22 nt, Human
uccagcucuaacaugcugggcc

SEQ ID NO: 847763 - RNA, 22 nt, Human
aauucuagcauugugaaaauau

SEQ ID NO: 847764 - RNA, 22 nt, Human
acuugauuuugaaccuuucuac

SEQ ID NO: 847765 - RNA, 22 nt, Human
cauuuacauaacaguaacgcug

SEQ ID NO: 847766 - RNA, 22 nt, Human
gccucugcccuccugggacugc

SEQ ID NO: 847767 - RNA, 22 nt, Human
gucccagggaagaaggcagcac

SEQ ID NO: 847768 - RNA, 22 nt, Human
aggauccuuuggccacuucuua

SEQ ID NO: 847769 - RNA, 22 nt, Human
ggagccagugcccucuggugga

SEQ ID NO: 847770 - RNA, 20 nt, Human
gcugggggugugcugaguga

SEQ ID NO: 847771 - RNA, 22 nt, Human
cccugccuucuuggccuuuaaa

SEQ ID NO: 847772 - RNA, 22 nt, Human
agagcuggauggucaagauggc

SEQ ID NO: 847773 - RNA, 22 nt, Human
aacucagucauaaagcgaaugc

SEQ ID NO: 847774 - RNA, 22 nt, Human
uagauauaucugucauacuggu

SEQ ID NO: 847775 - RNA, 23 nt, Human
ggaaagagaggaguugugcauag

SEQ ID NO: 847776 - RNA, 20 nt, Human
aagcaauauagugcaaaugu

SEQ ID NO: 847777 - RNA, 22 nt, Human
gaggcagcaauaaaaagaauuu

SEQ ID NO: 847778 - RNA, 22 nt, Human
uucucuagguuuuagaugaaga

SEQ ID NO: 847779 - RNA, 22 nt, Human
aaaguccuguuaacuguuaaca

SEQ ID NO: 847780 - RNA, 22 nt, Human
cauagaaaucaggugagaaucu

SEQ ID NO: 847781 - RNA, 22 nt, Human
gauggcuuugugcaccaugauu

SEQ ID NO: 847782 - RNA, 22 nt, Human
ucuguuccaguagaaaggugca

SEQ ID NO: 847783 - RNA, 22 nt, Human
gaggucaggggagaggcugaug

SEQ ID NO: 847784 - RNA, 22 nt, Human
gucauugcaguggcaaaucaca

SEQ ID NO: 847785 - RNA, 22 nt, Human
cacugaagaugcgacuagugcu

SEQ ID NO: 847786 - RNA, 22 nt, Human
ggaagagagggcugggccucaa

SEQ ID NO: 847787 - RNA, 22 nt, Human
uaaagccaauauaccuagcaua

SEQ ID NO: 847788 - RNA, 23 nt, Human
acaagauagggauaaaaagauaa

SEQ ID NO: 847789 - RNA, 22 nt, Human
gccucugccaagggggcugcgg

SEQ ID NO: 847790 - RNA, 22 nt, Human
ugcuacaauucacaucuggaua

SEQ ID NO: 847791 - RNA, 22 nt, Human
acaaaaguguaggaauuccuua

SEQ ID NO: 847792 - RNA, 22 nt, Human
ccucccacauccuagcucugcu

SEQ ID NO: 847793 - RNA, 22 nt, Human
uggcagcaguggagguagaaag

SEQ ID NO: 847794 - RNA, 22 nt, Human
cuguguggccucaagccagccu

SEQ ID NO: 847795 - RNA, 22 nt, Human
ggcagaggaggggugaauuugc

SEQ ID NO: 847796 - RNA, 22 nt, Human
gugcagcugugugagagcucca

SEQ ID NO: 847797 - RNA, 22 nt, Human
uugcuguguaacuccuggccug

SEQ ID NO: 847798 - RNA, 22 nt, Human
uggcagagcuggcugcggauga

SEQ ID NO: 847799 - RNA, 22 nt, Human
cacugaagcuuucauucucuug

SEQ ID NO: 847800 - RNA, 22 nt, Human
uccagggauguccuguagcacu

SEQ ID NO: 847801 - RNA, 22 nt, Human
cagaggccaccuguggccacug

SEQ ID NO: 847802 - RNA, 22 nt, Human
gcauuuagcuuuaaaauauuuc

SEQ ID NO: 847803 - RNA, 22 nt, Human
agcccagguucuaaagccaaac

SEQ ID NO: 847804 - RNA, 22 nt, Human
ugcugucuuccaggauggugaa

SEQ ID NO: 847805 - RNA, 20 nt, Human
gggguuggcuggcacaggga

SEQ ID NO: 847806 - RNA, 22 nt, Human
uuugcaguagacaucuuauuuu

SEQ ID NO: 847807 - RNA, 22 nt, Human
auauauaaccuggauaaggcuu

SEQ ID NO: 847808 - RNA, 22 nt, Human
aaguuacacauuuucauuguaa

SEQ ID NO: 847809 - RNA, 18 nt, Human
gcccagaggucugggccc

SEQ ID NO: 847810 - RNA, 22 nt, Human
uuaaaauagccagugccccucu

SEQ ID NO: 847811 - RNA, 22 nt, Human
guggcuucugcggugugcgcag

SEQ ID NO: 847812 - RNA, 22 nt, Human
ugugugaaggaauauauacuca

SEQ ID NO: 847813 - RNA, 22 nt, Human
gcaggggcuaaggacacagaga

SEQ ID NO: 847814 - RNA, 18 nt, Human
uugagggaggggcagagu

SEQ ID NO: 847815 - RNA, 22 nt, Human
uuucauuacguguuugacuugu

SEQ ID NO: 847816 - RNA, 22 nt, Human
gcaggcaguugcaguuuucuag

SEQ ID NO: 847817 - RNA, 22 nt, Human
ucagaauugcagggagggcagg

SEQ ID NO: 847818 - RNA, 22 nt, Human
cuggagcucuccagagccccgu

SEQ ID NO: 847819 - RNA, 22 nt, Human
ucugucaggagauuggcagcug

SEQ ID NO: 847820 - RNA, 22 nt, Human
cagcugaauucuucagacucca

SEQ ID NO: 847821 - RNA, 22 nt, Human
ugagccaggcucaagugauccu

SEQ ID NO: 847822 - RNA, 22 nt, Human
ucccaggaggugcuuccuagga

SEQ ID NO: 847823 - RNA, 22 nt, Human
aagcagccucauuugugguaag

SEQ ID NO: 847824 - RNA, 22 nt, Human
uuucuucagccacuccaaacug

SEQ ID NO: 847825 - RNA, 22 nt, Human
gauggacagccuggaaggaaag

SEQ ID NO: 847826 - RNA, 22 nt, Human
uaaaugugggggccacgggcuu

SEQ ID NO: 847827 - RNA, 22 nt, Human
cuguguccucccgcugcaccca

SEQ ID NO: 847828 - RNA, 22 nt, Human
acagaaggcggggacaaggcgg

SEQ ID NO: 847829 - RNA, 22 nt, Human
agcugcugaaugacacugcaag

SEQ ID NO: 847830 - RNA, 22 nt, Human
ugaggugaccgcagaugggaag

SEQ ID NO: 847831 - RNA, 22 nt, Human
ggcuccugauaggagaaugcgg

SEQ ID NO: 847832 - RNA, 22 nt, Human
cugcugugauugggagaaaccg

SEQ ID NO: 847833 - RNA, 22 nt, Human
cugggggcaagcagacagcugu

SEQ ID NO: 847834 - RNA, 18 nt, Human
aggcuucuuggcucaguc

SEQ ID NO: 847835 - RNA, 22 nt, Human
ccugucucuuucaaucugagag

SEQ ID NO: 847836 - RNA, 22 nt, Human
ucugggaaaugcuguuccuugu

SEQ ID NO: 847837 - RNA, 22 nt, Human
ugaaagcacucacuucugcucu

SEQ ID NO: 847838 - RNA, 22 nt, Human
ucagaggucacacagcaaguuu

SEQ ID NO: 847839 - RNA, 22 nt, Human
auugacaagcaguaugucuuag

SEQ ID NO: 847840 - RNA, 22 nt, Human
agcagggcucuguggagggugg

SEQ ID NO: 847841 - RNA, 23 nt, Human
uccuucagagccucccuccaagc

SEQ ID NO: 847842 - RNA, 22 nt, Human
ggcacugaaguggguguugggu

SEQ ID NO: 847843 - RNA, 20 nt, Human
uuaucugucaaucugucuca

SEQ ID NO: 847844 - RNA, 22 nt, Human
ucagaauuuugguuugguuggu

SEQ ID NO: 847845 - RNA, 22 nt, Human
agccaggauggucucgaucggc

SEQ ID NO: 847846 - RNA, 22 nt, Human
ugucagggcaugcgguccagcc

SEQ ID NO: 847847 - RNA, 22 nt, Human
cagagugaaaacugagcucaaa

SEQ ID NO: 847848 - RNA, 22 nt, Human
uuccaugaagggcagccucuca

SEQ ID NO: 847849 - RNA, 21 nt, Human
uaauaauuccacuacagagua

SEQ ID NO: 847850 - RNA, 22 nt, Human
aagcagggugucuugacccaug

SEQ ID NO: 847851 - RNA, 22 nt, Human
ugccugggagugaccaagacuc

SEQ ID NO: 847852 - RNA, 20 nt, Human
agagaauucccuuuggagau

SEQ ID NO: 847853 - RNA, 22 nt, Human
cucaggauccaucuccugcccu

SEQ ID NO: 847854 - RNA, 18 nt, Human
ucugucucuguccuugcu

SEQ ID NO: 847855 - RNA, 22 nt, Human
uggagcugaacuuugaggccag

SEQ ID NO: 847856 - RNA, 22 nt, Human
gaccugccugagcugccucugc

SEQ ID NO: 847857 - RNA, 22 nt, Human
ccuggagcgcgggucaagcugg

SEQ ID NO: 847858 - RNA, 22 nt, Human
agggagaaaauuggaugcacaa

SEQ ID NO: 847859 - RNA, 22 nt, Human
cuccuuccccuacucagcaucc

SEQ ID NO: 847860 - RNA, 22 nt, Human
gaggagaggccaucguuguuau

SEQ ID NO: 847861 - RNA, 22 nt, Human
gggucucucucggcuccacgcg

SEQ ID NO: 847862 - RNA, 22 nt, Human
ggcaaaaaccacaauuacuuuu

SEQ ID NO: 847863 - RNA, 22 nt, Human
agcugguguccuccuggagcug

SEQ ID NO: 847864 - RNA, 22 nt, Human
gcagcuggagcaucuucucauc

SEQ ID NO: 847865 - RNA, 22 nt, Human
ugaaaugauaucugauaacaaa

SEQ ID NO: 847866 - RNA, 22 nt, Human
cagcaggagcagucagacuccu

SEQ ID NO: 847867 - RNA, 23 nt, Human
agggcccaagccuggacagcagg

SEQ ID NO: 847868 - RNA, 22 nt, Human
gugugccaacaaaagacagugc

SEQ ID NO: 847869 - RNA, 22 nt, Human
gaucagaauucuuguguguuuc

SEQ ID NO: 847870 - RNA, 22 nt, Human
uugaacaguuuugucagguuca

SEQ ID NO: 847871 - RNA, 22 nt, Human
cuucccacuaguaucacagagc

SEQ ID NO: 847872 - RNA, 22 nt, Human
aaggccugaacaugaggagaug

SEQ ID NO: 847873 - RNA, 22 nt, Human
auucagcaguuccugcuucagu

SEQ ID NO: 847874 - RNA, 22 nt, Human
gggcugugggacccggcacuuu

SEQ ID NO: 847875 - RNA, 22 nt, Human
uuuauguacauauccacaagga

SEQ ID NO: 847876 - RNA, 19 nt, Human
ggcaggcuggauagagagg

SEQ ID NO: 847877 - RNA, 22 nt, Human
aauaauauuugaagcuucaaag

SEQ ID NO: 847878 - RNA, 22 nt, Human
caguggaggccuugggaccuuu

SEQ ID NO: 847879 - RNA, 22 nt, Human
uagugcuuaauaaauuucagaa

SEQ ID NO: 847880 - RNA, 22 nt, Human
aggacuuagaacauuauguacu

SEQ ID NO: 847881 - RNA, 22 nt, Human
gccuucugugcuccuggccuuu

SEQ ID NO: 847882 - RNA, 22 nt, Human
aaaauaacuucuacuauuugca

SEQ ID NO: 847883 - RNA, 22 nt, Human
ucuuuccuagaggcugaugagu

SEQ ID NO: 847884 - RNA, 22 nt, Human
acaauacaggcuucuggacuua

SEQ ID NO: 847885 - RNA, 22 nt, Human
ucucucagggggaaggcugaag

SEQ ID NO: 847886 - RNA, 22 nt, Human
agaugaaaauacgugacuuuaa

SEQ ID NO: 847887 - RNA, 22 nt, Human
acagaauuaaaguguuugugga

SEQ ID NO: 847888 - RNA, 22 nt, Human
cugcccuggcagccuaccaugg

SEQ ID NO: 847889 - RNA, 22 nt, Human
ggagaguggauuccagcuguau

SEQ ID NO: 847890 - RNA, 22 nt, Human
uuugcauugcagugguuuacag

SEQ ID NO: 847891 - RNA, 22 nt, Human
ugagaauuacaaaugagucaca

SEQ ID NO: 847892 - RNA, 22 nt, Human
auguguaggugaaucgaggcug

SEQ ID NO: 847893 - RNA, 22 nt, Human
cagggccugagggcugcucugc

SEQ ID NO: 847894 - RNA, 22 nt, Human
gucccaggugggcuccaccucu

SEQ ID NO: 847895 - RNA, 22 nt, Human
gcagggccagugcagagaggaa

SEQ ID NO: 847896 - RNA, 22 nt, Human
gugaauaaagggaguuuucaaa

SEQ ID NO: 847897 - RNA, 22 nt, Human
uagacacaucaaguauaguuaa

SEQ ID NO: 847898 - RNA, 22 nt, Human
aagccaggcugcacuugcuggg

SEQ ID NO: 847899 - RNA, 22 nt, Human
aggagcuguuuuguucagcaaa

SEQ ID NO: 847900 - RNA, 22 nt, Human
ugguuuugcuccaguauaaaua

SEQ ID NO: 847901 - RNA, 22 nt, Human
uggcagcugagugcacccccuc

SEQ ID NO: 847902 - RNA, 22 nt, Human
uuauagugggcccaacauggcg

SEQ ID NO: 847903 - RNA, 22 nt, Human
ucugagagccucuagccuaagu

SEQ ID NO: 847904 - RNA, 22 nt, Human
uaauuuuaugacaguguauuuu

SEQ ID NO: 847905 - RNA, 22 nt, Human
cuggcugcgucugcucugacag

SEQ ID NO: 847906 - RNA, 22 nt, Human
aaucagaaaauucaguggaauu

SEQ ID NO: 847907 - RNA, 22 nt, Human
uggauuagguacuaugaauaua

SEQ ID NO: 847908 - RNA, 23 nt, Human
auggagcugguacuagcuaccuc

SEQ ID NO: 847909 - RNA, 22 nt, Human
cuggaggcugaguugggucucc

SEQ ID NO: 847910 - RNA, 17 nt, Human
aggaaacauuuucuuuc

SEQ ID NO: 847911 - RNA, 22 nt, Human
uuccagaaaucuuucagcucaa

SEQ ID NO: 847912 - RNA, 22 nt, Human
gucccagaggacagggucacau

SEQ ID NO: 847913 - RNA, 22 nt, Human
ugaagccacagagcaucugccu

SEQ ID NO: 847914 - RNA, 22 nt, Human
uaaucuaccacuauugcaauau

SEQ ID NO: 847915 - RNA, 22 nt, Human
cagagugagggccugcaccugc

SEQ ID NO: 847916 - RNA, 22 nt, Human
uaugccugauaacugugucucu

SEQ ID NO: 847917 - RNA, 22 nt, Human
agccacagcaacaagugcaauu

SEQ ID NO: 847918 - RNA, 20 nt, Human
aagagaggaaguuauacuag

SEQ ID NO: 847919 - RNA, 22 nt, Human
agucucugcugguugugccuau

SEQ ID NO: 847920 - RNA, 18 nt, Human
acauuucuccuucugacc

SEQ ID NO: 847921 - RNA, 22 nt, Human
ugucaugccaggaaauaguccc

SEQ ID NO: 847922 - RNA, 22 nt, Human
auggcaggcccagguguucauu

SEQ ID NO: 847923 - RNA, 22 nt, Human
gcuuccaaaucuguucaaaaug

SEQ ID NO: 847924 - RNA, 22 nt, Human
aaauaguuuagcucucauuuca

SEQ ID NO: 847925 - RNA, 22 nt, Human
cccugagcccauaguugacauu

SEQ ID NO: 847926 - RNA, 22 nt, Human
ccucaugguacuuacuguagcu

SEQ ID NO: 847927 - RNA, 22 nt, Human
gguggagcuguggacaggaagg

SEQ ID NO: 847928 - RNA, 22 nt, Human
uugauacuauuaagcacugggc

SEQ ID NO: 847929 - RNA, 22 nt, Human
cagcugaguuuccaagucugcc

SEQ ID NO: 847930 - RNA, 22 nt, Human
cuaauguaucauggcucucagc

SEQ ID NO: 847931 - RNA, 22 nt, Human
aaggcucucugauggcagcagu

SEQ ID NO: 847932 - RNA, 22 nt, Human
ggcagcucugugucugggaagc

SEQ ID NO: 847933 - RNA, 22 nt, Human
gucacacucagaaugacuagag

SEQ ID NO: 847934 - RNA, 22 nt, Human
uggaaagaaaguaaaggcguau

SEQ ID NO: 847935 - RNA, 22 nt, Human
ugcugcacaauuggaaaguauc

SEQ ID NO: 847936 - RNA, 22 nt, Human
uagucaccagcuacaggacagc

SEQ ID NO: 847937 - RNA, 22 nt, Human
gugugccagacaugaugcuaug

SEQ ID NO: 847938 - RNA, 22 nt, Human
gggcacugcuuugcucugucac

SEQ ID NO: 847939 - RNA, 22 nt, Human
aggcagcuaagauggauaauga

SEQ ID NO: 847940 - RNA, 23 nt, Human
cuuuuaacuugaucugagaccag

SEQ ID NO: 847941 - RNA, 20 nt, Human
aggauuuacuacuaccugcu

SEQ ID NO: 847942 - RNA, 22 nt, Human
uaagaacagugacagccaacau

SEQ ID NO: 847943 - RNA, 22 nt, Human
uuuucucuuguuaauguacuga

SEQ ID NO: 847944 - RNA, 22 nt, Human
aggucauuguuaagucaccaua

SEQ ID NO: 847945 - RNA, 22 nt, Human
acuguagcugccacuggaugca

SEQ ID NO: 847946 - RNA, 22 nt, Human
ggcuggcuuucucuccgcaccu

SEQ ID NO: 847947 - RNA, 23 nt, Human
cuguggcugaguccuguuggagu

SEQ ID NO: 847948 - RNA, 22 nt, Human
gagacagcacaggccacuggga

SEQ ID NO: 847949 - RNA, 22 nt, Human
gcagguggcagaggugggaucu

SEQ ID NO: 847950 - RNA, 21 nt, Human
auggagccuaagaguggaggu

SEQ ID NO: 847951 - RNA, 22 nt, Human
cggcagcugauugcagagcacc

SEQ ID NO: 847952 - RNA, 22 nt, Human
ucuuugcacugugcaagcagaa

SEQ ID NO: 847953 - RNA, 22 nt, Human
cagcagcugcgugcccaggccg

SEQ ID NO: 847954 - RNA, 22 nt, Human
gagcugcccugagcuuugcaug

SEQ ID NO: 847955 - RNA, 22 nt, Human
acuuucucccacccacccgucu

SEQ ID NO: 847956 - RNA, 22 nt, Human
caggaugagaagggcucuuacg

SEQ ID NO: 847957 - RNA, 20 nt, Human
cugccaugauugauagagug

SEQ ID NO: 847958 - RNA, 22 nt, Human
gaguccuugucauaauucagug

SEQ ID NO: 847959 - RNA, 22 nt, Human
ugacagaacagguugggagcaa

SEQ ID NO: 847960 - RNA, 22 nt, Human
ugaggcaggagaauggcgggaa

SEQ ID NO: 847961 - RNA, 22 nt, Human
uuggagcccugaggaucuggau

SEQ ID NO: 847962 - RNA, 22 nt, Human
caaguccaucagauaagcaaga

SEQ ID NO: 847963 - RNA, 22 nt, Human
cugaauaauuuuauaguugcug

SEQ ID NO: 847964 - RNA, 22 nt, Human
auguagaauggugauuggcagg

SEQ ID NO: 847965 - RNA, 22 nt, Human
cagagcugguaagugguagagg

SEQ ID NO: 847966 - RNA, 22 nt, Human
gcaggagcuggaaagugauguu

SEQ ID NO: 847967 - RNA, 22 nt, Human
ccagcucucagcgggagacuca

SEQ ID NO: 847968 - RNA, 22 nt, Human
aauauuaucaaaagcuuuuuca

SEQ ID NO: 847969 - RNA, 20 nt, Human
uguuccaugacuauuuggau

SEQ ID NO: 847970 - RNA, 22 nt, Human
uuaaacagucccagaggcugac

SEQ ID NO: 847971 - RNA, 22 nt, Human
gaaaucugcggugaggccugag

SEQ ID NO: 847972 - RNA, 22 nt, Human
gcuggggcugggcugaggaaga

SEQ ID NO: 847973 - RNA, 22 nt, Human
ucuggccuacuggaguccauga

SEQ ID NO: 847974 - RNA, 20 nt, Human
cugcugugauucccuccucc

SEQ ID NO: 847975 - RNA, 22 nt, Human
gacccaggagugcagagagugg

SEQ ID NO: 847976 - RNA, 22 nt, Human
ccugucugaggaggugcucuuu

SEQ ID NO: 847977 - RNA, 22 nt, Human
agggagcucuaaguagagggac

SEQ ID NO: 847978 - RNA, 22 nt, Human
ccugggaggcagagguugcagu

SEQ ID NO: 847979 - RNA, 22 nt, Human
ucccuguccugggcaaucccag

SEQ ID NO: 847980 - RNA, 22 nt, Human
uugauacauagcacaguuuagg

SEQ ID NO: 847981 - RNA, 22 nt, Human
ucaguaaaugguugcuguuauu

SEQ ID NO: 847982 - RNA, 22 nt, Human
caucaaauaggaauauuuggca

SEQ ID NO: 847983 - RNA, 21 nt, Human
uucuucaguuuaauauaaaau

SEQ ID NO: 847984 - RNA, 22 nt, Human
aagcaggcauuccagagacaau

SEQ ID NO: 847985 - RNA, 22 nt, Human
cugagcuuggccaggaaugaau

SEQ ID NO: 847986 - RNA, 22 nt, Human
uauggcuuuuaacugucguaug

SEQ ID NO: 847987 - RNA, 22 nt, Human
uaaacauggcuguuucaguuau

SEQ ID NO: 847988 - RNA, 22 nt, Human
auaauucagguuuucuggcaca

SEQ ID NO: 847989 - RNA, 19 nt, Human
gaggcgaggcgugcaggag

SEQ ID NO: 847990 - RNA, 22 nt, Human
uccuggcccacuaugccagcau

SEQ ID NO: 847991 - RNA, 22 nt, Human
ccaggguggggcaggcccacug

SEQ ID NO: 847992 - RNA, 18 nt, Human
cuggcuuucuuauccauc

SEQ ID NO: 847993 - RNA, 22 nt, Human
ucucagagaccugaacucccug

SEQ ID NO: 847994 - RNA, 22 nt, Human
ucugggaagcugcgugccuguu

SEQ ID NO: 847995 - RNA, 22 nt, Human
ucugucacugagcucaggauuc

SEQ ID NO: 847996 - RNA, 22 nt, Human
ccugccagauccccugagcuga

SEQ ID NO: 847997 - RNA, 22 nt, Human
augaacaagagagggaagauuc

SEQ ID NO: 847998 - RNA, 22 nt, Human
ccuauacagccucagcugagau

SEQ ID NO: 847999 - RNA, 22 nt, Human
aacccagccguguagcugccgc

SEQ ID NO: 848000 - RNA, 22 nt, Human
caucacccggaacugugucugc

SEQ ID NO: 848001 - RNA, 22 nt, Human
uuuaggcaagaacucacugaga

SEQ ID NO: 848002 - RNA, 22 nt, Human
gccuucaguaguauccucauga

SEQ ID NO: 848003 - RNA, 22 nt, Human
uuucuagggcucuugucuucug

SEQ ID NO: 848004 - RNA, 22 nt, Human
cucugucacuucuccagcugag

SEQ ID NO: 848005 - RNA, 22 nt, Human
gccuggagccucagcaaggagg

SEQ ID NO: 848006 - RNA, 22 nt, Human
ugccaggcccagcuccagagcu

SEQ ID NO: 848007 - RNA, 22 nt, Human
cugaagccacgauagcuuccua

SEQ ID NO: 848008 - RNA, 23 nt, Human
uuccagaguccacaucugccacc

SEQ ID NO: 848009 - RNA, 22 nt, Human
uuaaagauucugaggcugauua

SEQ ID NO: 848010 - RNA, 22 nt, Human
cucagggcuugaguguccagga

SEQ ID NO: 848011 - RNA, 22 nt, Human
cagcugucuaaguugagcagga

SEQ ID NO: 848012 - RNA, 22 nt, Human
ucuggcuccacuuucuucauuu

SEQ ID NO: 848013 - RNA, 22 nt, Human
gggagggaggugcugguucacg

SEQ ID NO: 848014 - RNA, 22 nt, Human
gcuggccauucucuuugagaug

SEQ ID NO: 848015 - RNA, 22 nt, Human
agggcuggccacaugauuuggu

SEQ ID NO: 848016 - RNA, 22 nt, Human
gcagcugggacacugaggccag

SEQ ID NO: 848017 - RNA, 22 nt, Human
ggacagaggguugacagaguau

SEQ ID NO: 848018 - RNA, 22 nt, Human
cugcuuuggcucagugacauca

SEQ ID NO: 848019 - RNA, 22 nt, Human
cugucucuguugccuguaggug

SEQ ID NO: 848020 - RNA, 22 nt, Human
aaguuaugaaauuuggacagcu

SEQ ID NO: 848021 - RNA, 22 nt, Human
acagcuguggggacucuugccc

SEQ ID NO: 848022 - RNA, 22 nt, Human
acuuaguauuuuucagcuuuga

SEQ ID NO: 848023 - RNA, 22 nt, Human
cugcucuggcuguguacuucag

SEQ ID NO: 848024 - RNA, 18 nt, Human
aaacuggcuuggccugug

SEQ ID NO: 848025 - RNA, 22 nt, Human
gagcuuugcuggaagccugggg

SEQ ID NO: 848026 - RNA, 22 nt, Human
auguaugaagcuuuguuuggga

SEQ ID NO: 848027 - RNA, 22 nt, Human
cauugcacgggcgucugucugu

SEQ ID NO: 848028 - RNA, 20 nt, Human
gugcauuucaccuguacugu

SEQ ID NO: 848029 - RNA, 17 nt, Human
aggcaggcagagcggga

SEQ ID NO: 848030 - RNA, 22 nt, Human
ccaaagucugcauuuuaacaug

SEQ ID NO: 848031 - RNA, 22 nt, Human
aagcacaaugaacaucuuagau

SEQ ID NO: 848032 - RNA, 20 nt, Human
cccaggaguuugcucuuacu

SEQ ID NO: 848033 - RNA, 22 nt, Human
uguuuuaugagccauauaaccu

SEQ ID NO: 848034 - RNA, 22 nt, Human
gaauucuuuucuuucugaaagu

SEQ ID NO: 848035 - RNA, 22 nt, Human
aaagaaggaugggagaaauccu

SEQ ID NO: 848036 - RNA, 22 nt, Human
aguaaacaguaucuuuaguguc

SEQ ID NO: 848037 - RNA, 22 nt, Human
uggcuuaagcgcaacucugucu

SEQ ID NO: 848038 - RNA, 22 nt, Human
uguguguauaugcauuuaucua

SEQ ID NO: 848039 - RNA, 22 nt, Human
acacagauuuuacauguuaugc

SEQ ID NO: 848040 - RNA, 22 nt, Human
acagagauguggaugagggauu

SEQ ID NO: 848041 - RNA, 22 nt, Human
uuucacagcuggguggcagagu

SEQ ID NO: 848042 - RNA, 22 nt, Human
gugccuggcacacagaaggcaa

SEQ ID NO: 848043 - RNA, 22 nt, Human
aaagcagauucugaugcaguag

SEQ ID NO: 848044 - RNA, 22 nt, Human
cucuccagaauaugccgccgug

SEQ ID NO: 848045 - RNA, 21 nt, Human
cccaggagaagaaaagaugca

SEQ ID NO: 848046 - RNA, 22 nt, Human
aggacuucuccgauaagucaga

SEQ ID NO: 848047 - RNA, 22 nt, Human
auacagaacucucaguuguaua

SEQ ID NO: 848048 - RNA, 22 nt, Human
ucauuuguugaacuuuagugcg

SEQ ID NO: 848049 - RNA, 22 nt, Human
uaauuucagugcaagcucacgg

SEQ ID NO: 848050 - RNA, 22 nt, Human
cuuauaguaugauguugagaau

SEQ ID NO: 848051 - RNA, 22 nt, Human
ugucucaggggcauugaaauaa

SEQ ID NO: 848052 - RNA, 22 nt, Human
ggcuucccuuuccgagaggaga

SEQ ID NO: 848053 - RNA, 22 nt, Human
aagggaggggauguaagccugg

SEQ ID NO: 848054 - RNA, 22 nt, Human
ugcagcccuuccuuccucuggg

SEQ ID NO: 848055 - RNA, 22 nt, Human
uucagcagugcagacacccagu

SEQ ID NO: 848056 - RNA, 22 nt, Human
cccaggaguuagagguuguggu

SEQ ID NO: 848057 - RNA, 23 nt, Human
cagcugaagcagccugggcugga

SEQ ID NO: 848058 - RNA, 22 nt, Human
ccagggugugggcgucggcacg

SEQ ID NO: 848059 - RNA, 22 nt, Human
ggacuggacucucaggcucaca

SEQ ID NO: 848060 - RNA, 17 nt, Human
cccugccaccaggaagc

SEQ ID NO: 848061 - RNA, 22 nt, Human
ggucauugucagagccuguacu

SEQ ID NO: 848062 - RNA, 22 nt, Human
gcugaagagagaugcguccagc

SEQ ID NO: 848063 - RNA, 22 nt, Human
ugaaaucaaugucuucugucuc

SEQ ID NO: 848064 - RNA, 19 nt, Human
aaucagaaauaucgaggcc

SEQ ID NO: 848065 - RNA, 22 nt, Human
caggcccugggcaggaucagcc

SEQ ID NO: 848066 - RNA, 22 nt, Human
ccccaggaagccucagauuugc

SEQ ID NO: 848067 - RNA, 22 nt, Human
cugcagcuauauuuucccacag

SEQ ID NO: 848068 - RNA, 22 nt, Human
auguuauaguuauaaaaugagg

SEQ ID NO: 848069 - RNA, 22 nt, Human
gcugagguaggagguugcagug

SEQ ID NO: 848070 - RNA, 22 nt, Human
ucugccuggaugauggcagggc

SEQ ID NO: 848071 - RNA, 21 nt, Human
aggugcagagccagggaccag

SEQ ID NO: 848072 - RNA, 22 nt, Human
cugggcacacagugacucugca

SEQ ID NO: 848073 - RNA, 23 nt, Human
uggcucucucagugcugcagagg

SEQ ID NO: 848074 - RNA, 22 nt, Human
agggaagaaaauccaucgcugc

SEQ ID NO: 848075 - RNA, 22 nt, Human
ugggccuccaauuccagcggga

SEQ ID NO: 848076 - RNA, 22 nt, Human
uuauuauuggugaguuaaggaa

SEQ ID NO: 848077 - RNA, 19 nt, Human
uacuaaacaugcauauugg

SEQ ID NO: 848078 - RNA, 22 nt, Human
auguguaaaaagugcuuaauau

SEQ ID NO: 848079 - RNA, 22 nt, Human
acacaaacugcuagaaaauugg

SEQ ID NO: 848080 - RNA, 22 nt, Human
gcagacagcauguugggcuauu

SEQ ID NO: 848081 - RNA, 22 nt, Human
auaugcacacucugcccacaga

SEQ ID NO: 848082 - RNA, 22 nt, Human
ucugaggcauacccaggccccc

SEQ ID NO: 848083 - RNA, 22 nt, Human
aauaagauccugaagauauguu

SEQ ID NO: 848084 - RNA, 22 nt, Human
aaggcacuuuucuaaagaccuu

SEQ ID NO: 848085 - RNA, 22 nt, Human
gcugccugcacagagcugcuuu

SEQ ID NO: 848086 - RNA, 22 nt, Human
guggccagaagacugcaaugcu

SEQ ID NO: 848087 - RNA, 21 nt, Human
gagacagcccagugccagggc

SEQ ID NO: 848088 - RNA, 22 nt, Human
acauuucuuccuaauuaucccu

SEQ ID NO: 848089 - RNA, 22 nt, Human
uccuucaguuaaagaucucaca

SEQ ID NO: 848090 - RNA, 23 nt, Human
agaaaagcuuggacacauggccu

SEQ ID NO: 848091 - RNA, 22 nt, Human
uucacaauggcaaaccauuaaa

SEQ ID NO: 848092 - RNA, 21 nt, Human
uauuucuuugacucucucccu

SEQ ID NO: 848093 - RNA, 22 nt, Human
ucaggcagcuccaggaauggua

SEQ ID NO: 848094 - RNA, 22 nt, Human
ucacuuaaaaauucuaguuaug

SEQ ID NO: 848095 - RNA, 22 nt, Human
acuucuucuucagcugggggau

SEQ ID NO: 848096 - RNA, 22 nt, Human
uguagaaccuguuuauuauaga

SEQ ID NO: 848097 - RNA, 22 nt, Human
guccuuaguuacuuuucauguc

SEQ ID NO: 848098 - RNA, 22 nt, Human
uauguacuacacuagaacauuu

SEQ ID NO: 848099 - RNA, 22 nt, Human
uccaggagugcugguuagagua

SEQ ID NO: 848100 - RNA, 22 nt, Human
uccuuuuugguccaaggugacc

SEQ ID NO: 848101 - RNA, 22 nt, Human
gaggaggccaguggaaggaagc

SEQ ID NO: 848102 - RNA, 22 nt, Human
ucccacugcuuugcucugcuca

SEQ ID NO: 848103 - RNA, 22 nt, Human
gcaggggaguggcaggcccgga

SEQ ID NO: 848104 - RNA, 22 nt, Human
aaacugcugguugcuggccagc

SEQ ID NO: 848105 - RNA, 22 nt, Human
cuggcuggcaaguagaacacaa

SEQ ID NO: 848106 - RNA, 22 nt, Human
agggucugacaaugugacuuag

SEQ ID NO: 848107 - RNA, 20 nt, Human
ugacucugcaaccgucucuc

SEQ ID NO: 848108 - RNA, 22 nt, Human
ggcuuugccuggaauuuccuug

SEQ ID NO: 848109 - RNA, 22 nt, Human
aaagcucuuauagcagagugug

SEQ ID NO: 848110 - RNA, 16 nt, Human
gcccaggacgggaggc

SEQ ID NO: 848111 - RNA, 22 nt, Human
caucagaaaccuugaggaaacu

SEQ ID NO: 848112 - RNA, 22 nt, Human
cccagggucccugcucucugug

SEQ ID NO: 848113 - RNA, 22 nt, Human
aggagccccucuucaguccugg

SEQ ID NO: 848114 - RNA, 22 nt, Human
cccagccuuugcuuccugguuc

SEQ ID NO: 848115 - RNA, 22 nt, Human
cagcaggcagccauuucacugu

SEQ ID NO: 848116 - RNA, 22 nt, Human
ucuauacaaguuucacuuugac

SEQ ID NO: 848117 - RNA, 22 nt, Human
aggcaguggaugucaggaaugg

SEQ ID NO: 848118 - RNA, 18 nt, Human
ugaaacaagaauggugca

SEQ ID NO: 848119 - RNA, 22 nt, Human
agugaaauagcauuuaugaagc

SEQ ID NO: 848120 - RNA, 22 nt, Human
gcaaggcuuugugaauuuuaaa

SEQ ID NO: 848121 - RNA, 22 nt, Human
uuacauuuggcuauguccucua

SEQ ID NO: 848122 - RNA, 22 nt, Human
guucuucagauuccauuucagu

SEQ ID NO: 848123 - RNA, 22 nt, Human
aguguggguuuuauggagcccu

SEQ ID NO: 848124 - RNA, 22 nt, Human
uggcagccacaucucguggauu

SEQ ID NO: 848125 - RNA, 22 nt, Human
guucuguacuccaagcucuucc

SEQ ID NO: 848126 - RNA, 22 nt, Human
agaaauuccuaagguacacaag

SEQ ID NO: 848127 - RNA, 22 nt, Human
auucucuuuguauaacaucuug

SEQ ID NO: 848128 - RNA, 22 nt, Human
agcaucuggugagggccuaguu

SEQ ID NO: 848129 - RNA, 22 nt, Human
cuagagaggcagauguccugug

SEQ ID NO: 848130 - RNA, 22 nt, Human
aaagauuugaguucugcuuaua

SEQ ID NO: 848131 - RNA, 22 nt, Human
cucagaaucugccaaguucagg

SEQ ID NO: 848132 - RNA, 22 nt, Human
uuucuuccuuaccuuacuagag

SEQ ID NO: 848133 - RNA, 22 nt, Human
ugcguugcgcuccugcagcagg

SEQ ID NO: 848134 - RNA, 22 nt, Human
ccacagggacuguuaaaacccu

SEQ ID NO: 848135 - RNA, 22 nt, Human
aagagagggguugcauggaaau

SEQ ID NO: 848136 - RNA, 22 nt, Human
uuucaguuacugcuauaucauu

SEQ ID NO: 848137 - RNA, 22 nt, Human
acaguggagaaggcaugaggcu

SEQ ID NO: 848138 - RNA, 22 nt, Human
gccuuggccuuccuaggccuga

SEQ ID NO: 848139 - RNA, 22 nt, Human
acagccuggacuggcucucugc

SEQ ID NO: 848140 - RNA, 22 nt, Human
ccuggccucuccgaguaaccug

SEQ ID NO: 848141 - RNA, 22 nt, Human
ccacagggucagccacucugca

SEQ ID NO: 848142 - RNA, 17 nt, Human
uagcugccccgaaugcu

SEQ ID NO: 848143 - RNA, 22 nt, Human
guuaggcaauaccucuuacacc

SEQ ID NO: 848144 - RNA, 22 nt, Human
agugcauauaugaagaguauga

SEQ ID NO: 848145 - RNA, 22 nt, Human
uccucuggggcgugguccugga

SEQ ID NO: 848146 - RNA, 22 nt, Human
uuucuucucacccaggacagag

SEQ ID NO: 848147 - RNA, 22 nt, Human
gcuguguccucacacagccuuu

SEQ ID NO: 848148 - RNA, 22 nt, Human
uuucaaaauuuugcagugguaa

SEQ ID NO: 848149 - RNA, 22 nt, Human
caguggguggcuaaguggcuga

SEQ ID NO: 848150 - RNA, 22 nt, Human
acuagauaauuauaaaagguag

SEQ ID NO: 848151 - RNA, 22 nt, Human
cccagggaaugacucuggccuu

SEQ ID NO: 848152 - RNA, 22 nt, Human
cagcaggcccagaguuucaugg

SEQ ID NO: 848153 - RNA, 22 nt, Human
cuuauacacccucuucccaggc

SEQ ID NO: 848154 - RNA, 22 nt, Human
caagcagacaguaggccuagaa

SEQ ID NO: 848155 - RNA, 22 nt, Human
cugcuuugaaaauaaacuuguc

SEQ ID NO: 848156 - RNA, 22 nt, Human
gaggaggcacuugagcagaugu

SEQ ID NO: 848157 - RNA, 22 nt, Human
aggcugcagugcagguaggauu

SEQ ID NO: 848158 - RNA, 22 nt, Human
cuggccuggcaggggaccucua

SEQ ID NO: 848159 - RNA, 22 nt, Human
uucaagauggccccagugagcc

SEQ ID NO: 848160 - RNA, 22 nt, Human
ccuggcagacagcacugaagcu

SEQ ID NO: 848161 - RNA, 22 nt, Human
ccucauggccuugagcugaggg

SEQ ID NO: 848162 - RNA, 22 nt, Human
uuccucagagggcgcuggggaa

SEQ ID NO: 848163 - RNA, 22 nt, Human
gcucccagggcagcgcagaaga

SEQ ID NO: 848164 - RNA, 22 nt, Human
cugggaggcccacguugggaag

SEQ ID NO: 848165 - RNA, 22 nt, Human
gaaacaauuuuuguugucuaag

SEQ ID NO: 848166 - RNA, 22 nt, Human
aguaugaauugcuuugccugua

SEQ ID NO: 848167 - RNA, 23 nt, Human
aaaguguagccagguuaagaacc

SEQ ID NO: 848168 - RNA, 22 nt, Human
cuguggcugcagccuugguccu

SEQ ID NO: 848169 - RNA, 22 nt, Human
uggcaaggccacaggugcaguu

SEQ ID NO: 848170 - RNA, 22 nt, Human
aggcagucuaguccccaggcaa

SEQ ID NO: 848171 - RNA, 22 nt, Human
cagggccuucguaaguguccgg

SEQ ID NO: 848172 - RNA, 22 nt, Human
gcauuuauuucuuuacugcauc

SEQ ID NO: 848173 - RNA, 22 nt, Human
aagacccacaaggcugaauguu

SEQ ID NO: 848174 - RNA, 22 nt, Human
cccagguggguuggccucuguc

SEQ ID NO: 848175 - RNA, 20 nt, Human
cucugcuuuaggagagucag

SEQ ID NO: 848176 - RNA, 22 nt, Human
ugauuuccuaggucuggagaag

SEQ ID NO: 848177 - RNA, 22 nt, Human
agagcuguucagcagccagguu

SEQ ID NO: 848178 - RNA, 19 nt, Human
uguuuuguuaaagcagucc

SEQ ID NO: 848179 - RNA, 22 nt, Human
ccaggagagcucucguucagug

SEQ ID NO: 848180 - RNA, 20 nt, Human
ggccugagcauggcuggcag

SEQ ID NO: 848181 - RNA, 22 nt, Human
ccagagccucgcccggagccuc

SEQ ID NO: 848182 - RNA, 22 nt, Human parechovirus 2
aaggauaugguacuaucaguau

SEQ ID NO: 848183 - RNA, 22 nt, Human parechovirus 2
aaugcuuuagguuauuuacugu

SEQ ID NO: 848184 - RNA, 22 nt, Human parechovirus 2
cacgcaaggacgaaccaccauc

SEQ ID NO: 848185 - RNA, 22 nt, Human parechovirus 2
ccaaauuucuucuuucccuuac

SEQ ID NO: 848186 - RNA, 23 nt, Human parechovirus 2
guaaauauagaggagauuuggca

SEQ ID NO: 848187 - RNA, 22 nt, Human parechovirus 2
auuacaaagugaauucagaacu

SEQ ID NO: 848188 - RNA, 21 nt, Human parechovirus 2
auagagauauuccuuagcuug

SEQ ID NO: 848189 - RNA, 22 nt, Human
ccugggcaggccggacgcuggg

SEQ ID NO: 848190 - RNA, 22 nt, Human
ggggccccucggacacgugcgg

SEQ ID NO: 848191 - RNA, 22 nt, Human
ucugugccaccucuccaguguc

SEQ ID NO: 848192 - RNA, 23 nt, Human
cuucucagaagucugugccagga

SEQ ID NO: 848193 - RNA, 21 nt, Human
gaccccagaccagcagacaca

SEQ ID NO: 848194 - RNA, 22 nt, Human
uaauaucuacuucauagaguuu

SEQ ID NO: 848195 - RNA, 19 nt, Human
ggcugagcgccuuggcugc

SEQ ID NO: 848196 - RNA, 22 nt, Human
uccaggagauacacugcaccag

SEQ ID NO: 848197 - RNA, 22 nt, Human
gagugucagugccuggcuuguu

SEQ ID NO: 848198 - RNA, 21 nt, Human
uuauugagacauuuguggaaa

SEQ ID NO: 848199 - RNA, 20 nt, Human
uuucacagucccuguuuccu

SEQ ID NO: 848200 - RNA, 21 nt, Human
uucuucaugaugauuaauggc

SEQ ID NO: 848201 - RNA, 20 nt, Human
caggaugauuggacacgaug

SEQ ID NO: 848202 - RNA, 22 nt, Human
ggagguggcagagggacauucu

SEQ ID NO: 848203 - RNA, 22 nt, Human
ccuccuggagcauuggugagga

SEQ ID NO: 848204 - RNA, 22 nt, Human
aaaguaacaauaagguucuauu

SEQ ID NO: 848205 - RNA, 22 nt, Human
gauaaugaugacaaugacaacc

SEQ ID NO: 848206 - RNA, 22 nt, Human
uuuauauagagauuugugcaug

SEQ ID NO: 848207 - RNA, 22 nt, Human
cagagcuguccaaacccugaca

SEQ ID NO: 848208 - RNA, 21 nt, Human
gccaccccuggcacaggugcu

SEQ ID NO: 848209 - RNA, 22 nt, Human
gcugccuguggcccuucugggu

SEQ ID NO: 848210 - RNA, 21 nt, Human
gcuccuggugcugcguggcgc

SEQ ID NO: 848211 - RNA, 22 nt, Human
uccauguguuuuccuguccaca

SEQ ID NO: 848212 - RNA, 22 nt, Human
ccugagguuauccaucuaccug

SEQ ID NO: 848213 - RNA, 22 nt, Human
uucuucuucauuucugacgaug

SEQ ID NO: 848214 - RNA, 20 nt, Human
caucaucacaugagccaauu

SEQ ID NO: 848215 - RNA, 22 nt, Human
gcagcuccuccugggcuggaga

SEQ ID NO: 848216 - RNA, 22 nt, Human
accuacaucaagggagugguag

SEQ ID NO: 848217 - RNA, 22 nt, Human
agucagauuuagauguagcaag

SEQ ID NO: 848218 - RNA, 22 nt, Human
cuuguccccagcagguugguuu

SEQ ID NO: 848219 - RNA, 22 nt, Human
ucaggaggccaccaggaccugu

SEQ ID NO: 848220 - RNA, 20 nt, Human
ucucuucuggggagauaaaa

SEQ ID NO: 848221 - RNA, 22 nt, Human
uuaaauauuauguugucugcaa

SEQ ID NO: 848222 - RNA, 22 nt, Human
gagggagugccagagggccagc

SEQ ID NO: 848223 - RNA, 22 nt, Human
aaaaugaagcaaaggcauucag

SEQ ID NO: 848224 - RNA, 22 nt, Human
gaggcacugcaguacagugacu

SEQ ID NO: 848225 - RNA, 22 nt, Human
aaaauuauucauggcuuuugga

SEQ ID NO: 848226 - RNA, 22 nt, Human
uccaggagagguguggggacug

SEQ ID NO: 848227 - RNA, 22 nt, Human
ucuggccaggggucccugaagg

SEQ ID NO: 848228 - RNA, 22 nt, Human
agugcuuuagcauccaacuguc

SEQ ID NO: 848229 - RNA, 22 nt, Human
uggcuucugagcauugaaacgu

SEQ ID NO: 848230 - RNA, 22 nt, Human
cccaggaccgcgcggcugagcg

SEQ ID NO: 848231 - RNA, 22 nt, Human
auacaucuuccuuuuaaaaugc

SEQ ID NO: 848232 - RNA, 22 nt, Human
agcagcuguggggacaagggua

SEQ ID NO: 848233 - RNA, 22 nt, Human
agcaguuacuaguuaaaugcau

SEQ ID NO: 848234 - RNA, 22 nt, Human
uuucacuagaacguucuuguuu

SEQ ID NO: 848235 - RNA, 22 nt, Human
caugucuguguacacaugcaca

SEQ ID NO: 848236 - RNA, 22 nt, Human
uaacugccuacugugcaaauau

SEQ ID NO: 848237 - RNA, 22 nt, Human
caaauaguuuuucauguauuau

SEQ ID NO: 848238 - RNA, 23 nt, Human
ucuccuccuagauacagucaugg

SEQ ID NO: 848239 - RNA, 19 nt, Human
gugucaggaugugcagggg

SEQ ID NO: 848240 - RNA, 22 nt, Human
cucaggauuaaggaaucuaaau

SEQ ID NO: 848241 - RNA, 22 nt, Human
uuaacaauagaguuucuucagg

SEQ ID NO: 848242 - RNA, 19 nt, Human
aggcagcaggccagggaug

SEQ ID NO: 848243 - RNA, 22 nt, Human
agcugaggcauggacaggcugc

SEQ ID NO: 848244 - RNA, 22 nt, Human
cugcuguggugucaagcaucuc

SEQ ID NO: 848245 - RNA, 22 nt, Human
cuaggcugagcugggcugagcu

SEQ ID NO: 848246 - RNA, 22 nt, Human
uugcuggcuugaagauagagga

SEQ ID NO: 848247 - RNA, 22 nt, Human
uacauaguauucacauuguuuu

SEQ ID NO: 848248 - RNA, 22 nt, Human
uuccaugaaagugaaauggagc

SEQ ID NO: 848249 - RNA, 22 nt, Human
uaacugguauaucaguguacac

SEQ ID NO: 848250 - RNA, 22 nt, Human
ugagccuguccugugcauguga

SEQ ID NO: 848251 - RNA, 22 nt, Human
gaaguuuagaguguuguaauuu

SEQ ID NO: 848252 - RNA, 23 nt, Human
agaggcaggaguggcuugcccgg

SEQ ID NO: 848253 - RNA, 23 nt, Human
uugaaagguagcuggcagcuaga

SEQ ID NO: 848254 - RNA, 22 nt, Human
aacaucuacuaagugccaggca

SEQ ID NO: 848255 - RNA, 22 nt, Human
uaaagugguggugcuaauguau

SEQ ID NO: 848256 - RNA, 22 nt, Human
auguuucagauacagaucaaau

SEQ ID NO: 848257 - RNA, 22 nt, Human
cugcugugcuuguggccacccg

SEQ ID NO: 848258 - RNA, 18 nt, Human
cugaggcuggcaggagcc

SEQ ID NO: 848259 - RNA, 22 nt, Human
agcaagaugaaggauucaagac

SEQ ID NO: 848260 - RNA, 21 nt, Human
uggaccaaaguaauuugccuu

SEQ ID NO: 848261 - RNA, 22 nt, Human
agagggcugcugcacagugcuc

SEQ ID NO: 848262 - RNA, 22 nt, Human
ugcuucuggaaacaguggcugu

SEQ ID NO: 848263 - RNA, 21 nt, Human
uccuggccagggcacuaggca

SEQ ID NO: 848264 - RNA, 22 nt, Human
uucuuuuccuacacagcgauuu

SEQ ID NO: 848265 - RNA, 22 nt, Human
cacaaaugugcagaaaugugag

SEQ ID NO: 848266 - RNA, 22 nt, Human
auugaaagauuuugggcucaug

SEQ ID NO: 848267 - RNA, 22 nt, Human
ggauggcauguugggcucuguu

SEQ ID NO: 848268 - RNA, 22 nt, Human
ugaggucugcagggcugugcau

SEQ ID NO: 848269 - RNA, 22 nt, Human
cccaggcagccugcagggaagg

SEQ ID NO: 848270 - RNA, 22 nt, Human
auuuaguuuaggaaaaguaggu

SEQ ID NO: 848271 - RNA, 22 nt, Human
gaucuguuucauucacagucug

SEQ ID NO: 848272 - RNA, 22 nt, Human
auggagggugguaagacagaga

SEQ ID NO: 848273 - RNA, 20 nt, Human
ucucaguuucuagagucagg

SEQ ID NO: 848274 - RNA, 22 nt, Human
ucaguucugcuagaaaaacagu

SEQ ID NO: 848275 - RNA, 22 nt, Human
gcugaggaaaccaaugcucaga

SEQ ID NO: 848276 - RNA, 22 nt, Human
uuggaugaagucuagcuuuagu

SEQ ID NO: 848277 - RNA, 22 nt, Human
acacuuuuagcuaugaguuaau

SEQ ID NO: 848278 - RNA, 22 nt, Human
ugaggcagcaauuguauuguau

SEQ ID NO: 848279 - RNA, 22 nt, Human
ucugcaucauuuuucagagccg

SEQ ID NO: 848280 - RNA, 22 nt, Human
ggcugcggaucuaaggcuggga

SEQ ID NO: 848281 - RNA, 22 nt, Human
agagguagagguugcagugagc

SEQ ID NO: 848282 - RNA, 22 nt, Human
cccaggugcugcgugaagccuc

SEQ ID NO: 848283 - RNA, 22 nt, Human
ggcagcuucuuaauauggagac

SEQ ID NO: 848284 - RNA, 22 nt, Human
gccucaguugaucugugugagc

SEQ ID NO: 848285 - RNA, 22 nt, Human
aggaagcuccuggagagccagu

SEQ ID NO: 848286 - RNA, 22 nt, Human
ugccuggauucgguuguuguca

SEQ ID NO: 848287 - RNA, 22 nt, Human
gcagaggccuagguggaaggcc

SEQ ID NO: 848288 - RNA, 22 nt, Human
acaaaugucuccucuuuuguua

SEQ ID NO: 848289 - RNA, 22 nt, Human
cugccaggcacgugcagcauca

SEQ ID NO: 848290 - RNA, 22 nt, Human
uaauuauaacaguuacaucuua

SEQ ID NO: 848291 - RNA, 22 nt, Human
aggcaagcccccagugaggcuc

SEQ ID NO: 848292 - RNA, 22 nt, Human
ugucaaauuuuuauugcaguau

SEQ ID NO: 848293 - RNA, 22 nt, Human
augcagcugucagggagaacau

SEQ ID NO: 848294 - RNA, 21 nt, Human
ugaaaugagaaugcugagcac

SEQ ID NO: 848295 - RNA, 22 nt, Human
ggaagaggcugagccagguccc

SEQ ID NO: 848296 - RNA, 22 nt, Human
gcaggcuguagacaccaaacua

SEQ ID NO: 848297 - RNA, 19 nt, Human
gcuccuggaugaccugugg

SEQ ID NO: 848298 - RNA, 20 nt, Human
agggcugagaagggacuagc

SEQ ID NO: 848299 - RNA, 22 nt, Human
gcugccugguuucucagcugca

SEQ ID NO: 848300 - RNA, 22 nt, Human
uaaaugaagaaauggagauugu

SEQ ID NO: 848301 - RNA, 22 nt, Human
caggguggcacucagcgcaucu

SEQ ID NO: 848302 - RNA, 22 nt, Human
aaggaaccauuugugugcaugg

SEQ ID NO: 848303 - RNA, 22 nt, Human
gcucugggcugaaucauuuauc

SEQ ID NO: 848304 - RNA, 22 nt, Human
ggaggcagaacuucccgucagu

SEQ ID NO: 848305 - RNA, 22 nt, Human
gaggccaaucaauagggcaaua

SEQ ID NO: 848306 - RNA, 22 nt, Human
cugaggccccucucuugagcuu

SEQ ID NO: 848307 - RNA, 22 nt, Human
gagagggauacugaguuuuggu

SEQ ID NO: 848308 - RNA, 22 nt, Human
uagggcuguuuaaaagugaggu

SEQ ID NO: 848309 - RNA, 22 nt, Human
gcugagcugaggcagggcuggg

SEQ ID NO: 848310 - RNA, 22 nt, Human
gaggagaggggcucccaagagc

SEQ ID NO: 848311 - RNA, 22 nt, Human
uggaguuccuuugaaaggcucu

SEQ ID NO: 848312 - RNA, 22 nt, Human
uaauuauaacaugcuuucuggc

SEQ ID NO: 848313 - RNA, 22 nt, Human
ugaggcagauauuuauuggguu

SEQ ID NO: 848314 - RNA, 22 nt, Human
uuucuucagagagagcuuuccc

SEQ ID NO: 848315 - RNA, 22 nt, Human
aggcuggagacccgccaagaaa

SEQ ID NO: 848316 - RNA, 22 nt, Human
agccacagcauguguguaugua

SEQ ID NO: 848317 - RNA, 22 nt, Human
acagagcuuaggaugacuccca

SEQ ID NO: 848318 - RNA, 22 nt, Human
gcugcuggggccuucccucggg

SEQ ID NO: 848319 - RNA, 22 nt, Human
cuggugguucaggagaauggcu

SEQ ID NO: 848320 - RNA, 23 nt, Human
uucuuauuuacuuuggaaucucc

SEQ ID NO: 848321 - RNA, 22 nt, Human
uucagaaauaaaauaucccaac

SEQ ID NO: 848322 - RNA, 22 nt, Human
ucuccuggagcaggaagguggg

SEQ ID NO: 848323 - RNA, 22 nt, Human
cuacacuuugguugacuuugug

SEQ ID NO: 848324 - RNA, 22 nt, Human
aguccaaggagagacagcauuu

SEQ ID NO: 848325 - RNA, 22 nt, Human
cccaggagauggugcguggucu

SEQ ID NO: 848326 - RNA, 22 nt, Human
aggcagcucuguggccucccag

SEQ ID NO: 848327 - RNA, 22 nt, Human
uggcuacaaguguguuuaguuu

SEQ ID NO: 848328 - RNA, 22 nt, Human
agaggcagcagucauacuacag

SEQ ID NO: 848329 - RNA, 19 nt, Human
cacaauuaugagacacuua

SEQ ID NO: 848330 - RNA, 22 nt, Human
cccugggcucagagcagguagc

SEQ ID NO: 848331 - RNA, 22 nt, Human
aaaggccauuacuugcuuuuag

SEQ ID NO: 848332 - RNA, 22 nt, Human
aacugguagaaagcaguaagug

SEQ ID NO: 848333 - RNA, 22 nt, Human
agggcagcccuucugggagggc

SEQ ID NO: 848334 - RNA, 22 nt, Human
uucuaugccauguucagcuacu

SEQ ID NO: 848335 - RNA, 22 nt, Human
cagcaagauggugaaugagacg

SEQ ID NO: 848336 - RNA, 22 nt, Human
cucccaggacucagaggagaag

SEQ ID NO: 848337 - RNA, 22 nt, Human
ggcugaguucucuugcugaauc

SEQ ID NO: 848338 - RNA, 22 nt, Human
ccucacugcuauguguuugcuc

SEQ ID NO: 848339 - RNA, 22 nt, Human
uuauuauagauuaugcaagauu

SEQ ID NO: 848340 - RNA, 22 nt, Human
augcuguguauuuuacucuuuc

SEQ ID NO: 848341 - RNA, 22 nt, Human
agagcugaauucaagugcuggc

SEQ ID NO: 848342 - RNA, 22 nt, Human
aaggcagcaacuaauggaucuc

SEQ ID NO: 848343 - RNA, 22 nt, Human
aguaaagcagaguugcaguaca

SEQ ID NO: 848344 - RNA, 22 nt, Human
cacugguagcaguuaaguuagg

SEQ ID NO: 848345 - RNA, 20 nt, Human
aggagggaccuggauuggcg

SEQ ID NO: 848346 - RNA, 22 nt, Human
aucaggauucaccccagagcug

SEQ ID NO: 848347 - RNA, 20 nt, Human
cucaggauacugcaaaguug

SEQ ID NO: 848348 - RNA, 22 nt, Human
agggagcucacaguccaguaga

SEQ ID NO: 848349 - RNA, 22 nt, Human
uuaugaaguuccuguuacagug

SEQ ID NO: 848350 - RNA, 22 nt, Human
uuagccauauagaaaaagagcu

SEQ ID NO: 848351 - RNA, 22 nt, Human
uaacugguacucugguagccug

SEQ ID NO: 848352 - RNA, 22 nt, Human
acugagguuuacuugaaggaga

SEQ ID NO: 848353 - RNA, 22 nt, Human
ggggcagcuaccggaaguaggg

SEQ ID NO: 848354 - RNA, 22 nt, Human
augaggcauuccacucaaacuc

SEQ ID NO: 848355 - RNA, 22 nt, Human
aagacaauuugauacuaguugc

SEQ ID NO: 848356 - RNA, 22 nt, Human
cucugcauuuuaacagaugauu

SEQ ID NO: 848357 - RNA, 22 nt, Human
caaaucuauauguugauauucu

SEQ ID NO: 848358 - RNA, 20 nt, Human
gcugaggauuccuggccccu

SEQ ID NO: 848359 - RNA, 22 nt, Human
caaggccaaagggccacuguca

SEQ ID NO: 848360 - RNA, 22 nt, Human
aggcugaugcuggcugaggcug

SEQ ID NO: 848361 - RNA, 22 nt, Human
aaggcagcaugaaucccuguac

SEQ ID NO: 848362 - RNA, 22 nt, Human
uuagggaaauaaaauuaucagu

SEQ ID NO: 848363 - RNA, 22 nt, Human
cccauugugguuguugaggaua

SEQ ID NO: 848364 - RNA, 22 nt, Human
uggcuucuaguuugaggaaaaa

SEQ ID NO: 848365 - RNA, 22 nt, Human
uagaacugcucucauacuugcu

SEQ ID NO: 848366 - RNA, 22 nt, Human
uagaaaguacuaaauuuaacug

SEQ ID NO: 848367 - RNA, 22 nt, Human
aauuaggaaaugagaguauuug

SEQ ID NO: 848368 - RNA, 20 nt, Human
gacaugucuuucucacacaa

SEQ ID NO: 848369 - RNA, 22 nt, Human
cacuguaauagcauuauaagug

SEQ ID NO: 848370 - RNA, 22 nt, Human
agaaaggagaccagcucugccc

SEQ ID NO: 848371 - RNA, 22 nt, Human
uaaccauauuuuccauuaaguu

SEQ ID NO: 848372 - RNA, 22 nt, Human
ggccacagcaaugcugugaugu

SEQ ID NO: 848373 - RNA, 20 nt, Human
uuucuugucggcuguugcug

SEQ ID NO: 848374 - RNA, 22 nt, Human
uuugacauugccaauuugcuca

SEQ ID NO: 848375 - RNA, 22 nt, Human
cuggguccuggugcugaguucu

SEQ ID NO: 848376 - RNA, 22 nt, Human
aaacuacuaugggaauguacuu

SEQ ID NO: 848377 - RNA, 22 nt, Human
uauuagguagauuuuacugauu

SEQ ID NO: 848378 - RNA, 22 nt, Human
uccaggagagguagaggguucc

SEQ ID NO: 848379 - RNA, 18 nt, Human
uugagggaggggcagagu

SEQ ID NO: 848380 - RNA, 22 nt, Human
ggacugaggcccacuugaggga

SEQ ID NO: 848381 - RNA, 22 nt, Human
aaagccaugaauguuauagagg

SEQ ID NO: 848382 - RNA, 21 nt, Human
cacucaggguaugugccaggc

SEQ ID NO: 848383 - RNA, 22 nt, Human
cuuauuagugucugucugaguu

SEQ ID NO: 848384 - RNA, 22 nt, Human
aagugaguucagcauucacucg

SEQ ID NO: 848385 - RNA, 22 nt, Human
auauaauacaaccugcuaagug

SEQ ID NO: 848386 - RNA, 22 nt, Human
uaauuauuaugacaacaauugc

SEQ ID NO: 848387 - RNA, 22 nt, Human
augaggucaucuugaaguaggg

SEQ ID NO: 848388 - RNA, 22 nt, Human
cugcuucacccugccugagaac

SEQ ID NO: 848389 - RNA, 22 nt, Human
gccugaccucuucugcccuggg

SEQ ID NO: 848390 - RNA, 22 nt, Human
cccaggaaugaggggcggaggc

SEQ ID NO: 848391 - RNA, 22 nt, Human
acaauguguuuuuauacauuug

SEQ ID NO: 848392 - RNA, 22 nt, Human
caggaaaugggguuuaguuauu

SEQ ID NO: 848393 - RNA, 22 nt, Human
cagugugaggaauuagugucca

SEQ ID NO: 848394 - RNA, 22 nt, Human
gacugaggagguaagguuugaa

SEQ ID NO: 848395 - RNA, 22 nt, Human
ugaggcccaucugagauuuuga

SEQ ID NO: 848396 - RNA, 21 nt, Human
cuugaaagguagagucuacag

SEQ ID NO: 848397 - RNA, 22 nt, Human
uaaaauagcaugugcagugaaa

SEQ ID NO: 848398 - RNA, 22 nt, Human
caugcuguguguuuuagcucca

SEQ ID NO: 848399 - RNA, 22 nt, Human
ugaggcaguugagcuuccugag

SEQ ID NO: 848400 - RNA, 22 nt, Human
cauauaaauacaacauguguua

SEQ ID NO: 848401 - RNA, 22 nt, Human
ucccuucacagaugcgauguuu

SEQ ID NO: 848402 - RNA, 20 nt, Human
cugcuguguuauuguagaac

SEQ ID NO: 848403 - RNA, 22 nt, Human
acugacuuuggaauauuucuag

SEQ ID NO: 848404 - RNA, 22 nt, Human
uaucaauacauguuaucagugu

SEQ ID NO: 848405 - RNA, 22 nt, Human
uaggcagauguuaacaggaaaa

SEQ ID NO: 848406 - RNA, 22 nt, Human
gcugagguccagcauucgccua

SEQ ID NO: 848407 - RNA, 22 nt, Human
acccaggacacagagaugaccc

SEQ ID NO: 848408 - RNA, 22 nt, Human
uuuauaaguacuuugucugcuu

SEQ ID NO: 848409 - RNA, 23 nt, Human
uagagcagggaaaucugucagag

SEQ ID NO: 848410 - RNA, 22 nt, Human
gcugcuguugauuuaguccaau

SEQ ID NO: 848411 - RNA, 21 nt, Human
uccuggcccacucuaucccca

SEQ ID NO: 848412 - RNA, 19 nt, Human
aagggcugggcaccucacu

SEQ ID NO: 848413 - RNA, 22 nt, Human
guauaucuucagaaauuauagg

SEQ ID NO: 848414 - RNA, 22 nt, Human
acgguaacagauaccacagacu

SEQ ID NO: 848415 - RNA, 22 nt, Human
ggugguggagccagcugggagu

SEQ ID NO: 848416 - RNA, 22 nt, Human
uucagcaaauggacuguucagg

SEQ ID NO: 848417 - RNA, 22 nt, Human
gagggucccugcucagggccag

SEQ ID NO: 848418 - RNA, 22 nt, Human
cccaggaugucgaggcugcagu

SEQ ID NO: 848419 - RNA, 22 nt, Human
uaguccagguuaaucccugccu

SEQ ID NO: 848420 - RNA, 22 nt, Human
cuucuucaucuguaaaacuugg

SEQ ID NO: 848421 - RNA, 22 nt, Human
ggcugcugggucaugaugcaga

SEQ ID NO: 848422 - RNA, 22 nt, Human
caaggcugcugcgggucgcacc

SEQ ID NO: 848423 - RNA, 22 nt, Human
cuaaauuauuugcacauuagag

SEQ ID NO: 848424 - RNA, 22 nt, Human
accuugaugccuuuccaagaug

SEQ ID NO: 848425 - RNA, 22 nt, Human
uaggcugagcuaagagagcuua

SEQ ID NO: 848426 - RNA, 22 nt, Human
acagucuggaagcagggggcaa

SEQ ID NO: 848427 - RNA, 20 nt, Human
uugauaggcagcuugucagg

SEQ ID NO: 848428 - RNA, 22 nt, Human
ccaggcuggagugcaauggugc

SEQ ID NO: 848429 - RNA, 22 nt, Human
gaaguuacucucguuaaauaug

SEQ ID NO: 848430 - RNA, 22 nt, Human
cccaggaaaguggaggcggcug

SEQ ID NO: 848431 - RNA, 22 nt, Human
aucacauuguuagcauagacug

SEQ ID NO: 848432 - RNA, 22 nt, Human
aagcaagaggaaauguggaccu

SEQ ID NO: 848433 - RNA, 22 nt, Human
aagcgccaugguuccugcgcag

SEQ ID NO: 848434 - RNA, 22 nt, Human
uacuggguauacaaagaugaau

SEQ ID NO: 848435 - RNA, 22 nt, Human
aagcaccuggguuauaucuuag

SEQ ID NO: 848436 - RNA, 22 nt, Human
cuugaaagcuuugcgucuucua

SEQ ID NO: 848437 - RNA, 22 nt, Human
aggugagggugccagugcaugg

SEQ ID NO: 848438 - RNA, 22 nt, Human
gaggcugaaguguacaugggug

SEQ ID NO: 848439 - RNA, 22 nt, Human
gcccugaggcaaaagaacaguc

SEQ ID NO: 848440 - RNA, 20 nt, Human
uucuaauuugauggaguagc

SEQ ID NO: 848441 - RNA, 22 nt, Human
ucagucuucccuccagugcaac

SEQ ID NO: 848442 - RNA, 22 nt, Human
guggcagagcaggagacaggac

SEQ ID NO: 848443 - RNA, 22 nt, Human
cugucuaguuaggaugccagca

SEQ ID NO: 848444 - RNA, 22 nt, Human
uucuucagucccacuagccaca

SEQ ID NO: 848445 - RNA, 22 nt, Human
uggcagcuugaaugcagucuuu

SEQ ID NO: 848446 - RNA, 21 nt, Human
ccauaccuaccucaccugguu

SEQ ID NO: 848447 - RNA, 22 nt, Human
agagagggcauagaaaaaggga

SEQ ID NO: 848448 - RNA, 22 nt, Human
ucagaaaagaccacauuauucu

SEQ ID NO: 848449 - RNA, 19 nt, Human
uccaggagcaaagccaguu

SEQ ID NO: 848450 - RNA, 22 nt, Human
auacaucuagagucauaaaaac

SEQ ID NO: 848451 - RNA, 22 nt, Human
agucaauucuuuucaacucaag

SEQ ID NO: 848452 - RNA, 22 nt, Human
acaccuuuuauucgccaggcac

SEQ ID NO: 848453 - RNA, 22 nt, Human
gacuuucugcuauacuuucugu

SEQ ID NO: 848454 - RNA, 22 nt, Human
auucuucaaagagugucaaagu

SEQ ID NO: 848455 - RNA, 22 nt, Human
ugcaggcucucugcugccagau

SEQ ID NO: 848456 - RNA, 22 nt, Human
aguucucagcuuaguaugcugu

SEQ ID NO: 848457 - RNA, 22 nt, Human
uagaagaacaugucaaacuaua

SEQ ID NO: 848458 - RNA, 23 nt, Human
ucaguuuguauaauccauaugca

SEQ ID NO: 848459 - RNA, 22 nt, Human
uggcagcagccauggaaggccc

SEQ ID NO: 848460 - RNA, 22 nt, Human
aguucagaguaaauguugaagg

SEQ ID NO: 848461 - RNA, 22 nt, Human
uaacucuagucccaggcaugaa

SEQ ID NO: 848462 - RNA, 22 nt, Human
auuggaaauacaguagaaaaau

SEQ ID NO: 848463 - RNA, 22 nt, Human
cgagcaugaugacggcuguggc

SEQ ID NO: 848464 - RNA, 22 nt, Human
cagcaggaccauugaggcauca

SEQ ID NO: 848465 - RNA, 22 nt, Human
uggucaaaaaggccuagacaca

SEQ ID NO: 848466 - RNA, 22 nt, Human
cacucaggguacaauggagggc

SEQ ID NO: 848467 - RNA, 22 nt, Human
aagcugaggcuccccugaggga

SEQ ID NO: 848468 - RNA, 22 nt, Human
ugagggagagggcgaaaaugaa

SEQ ID NO: 848469 - RNA, 22 nt, Human
cuugcuggugguguuuucuaug

SEQ ID NO: 848470 - RNA, 22 nt, Human
ggaaaugacuuggugcuucguu

SEQ ID NO: 848471 - RNA, 22 nt, Human
acuauacaccaaaauauuaagg

SEQ ID NO: 848472 - RNA, 22 nt, Human
agucucugccagcuuguccucu

SEQ ID NO: 848473 - RNA, 19 nt, Human
uuuaggauaaagucuggac

SEQ ID NO: 848474 - RNA, 22 nt, Human
gaggccagcuaguccaggaagu

SEQ ID NO: 848475 - RNA, 22 nt, Human
uucuucuugaaacuuuagguug

SEQ ID NO: 848476 - RNA, 22 nt, Human
caggcugcagcagcaguggccc

SEQ ID NO: 848477 - RNA, 22 nt, Human
uggaaggagacugggaagugug

SEQ ID NO: 848478 - RNA, 20 nt, Human
uauuuacaacuuagagccuc

SEQ ID NO: 848479 - RNA, 22 nt, Human
ggccuucugccuuucagcaaug

SEQ ID NO: 848480 - RNA, 22 nt, Human
uugaggucccugccuugccuuc

SEQ ID NO: 848481 - RNA, 22 nt, Human
acacagaagaucucuuaaugcu

SEQ ID NO: 848482 - RNA, 22 nt, Human
uggcacauagcagguacucagu

SEQ ID NO: 848483 - RNA, 22 nt, Human
ucaggcugugucuuuaaacaau

SEQ ID NO: 848484 - RNA, 22 nt, Human
gaauacaccaaggaaucagaau

SEQ ID NO: 848485 - RNA, 22 nt, Human
uacauguaagacaugagacucu

SEQ ID NO: 848486 - RNA, 22 nt, Human
ugggagcccaagggagcugccg

SEQ ID NO: 848487 - RNA, 19 nt, Human
aguggcagaucuggaagua

SEQ ID NO: 848488 - RNA, 22 nt, Human
uuaggaaaaugaaauuaccugu

SEQ ID NO: 848489 - RNA, 22 nt, Human
cugagccccucugaccucagag

SEQ ID NO: 848490 - RNA, 22 nt, Human
cucaggaugcaggucacaggac

SEQ ID NO: 848491 - RNA, 20 nt, Human
gcucccagccugcagucccc

SEQ ID NO: 848492 - RNA, 22 nt, Human
uaagauaaguggguugagaugg

SEQ ID NO: 848493 - RNA, 22 nt, Human
uugcucagcacuggagccagcu

SEQ ID NO: 848494 - RNA, 22 nt, Human
cugaggucaggaguucaagcug

SEQ ID NO: 848495 - RNA, 22 nt, Human
ugaauaguccuuggaauaacug

SEQ ID NO: 848496 - RNA, 22 nt, Human
gucuuugcugucuuugcucuca

SEQ ID NO: 848497 - RNA, 22 nt, Human
ccugguugugaguugaguugag

SEQ ID NO: 848498 - RNA, 17 nt, Human
uaaauacacaaggguau

SEQ ID NO: 848499 - RNA, 22 nt, Human
cugcugugagugguucuugccu

SEQ ID NO: 848500 - RNA, 22 nt, Human
gaggcaguuugccaugccagga

SEQ ID NO: 848501 - RNA, 20 nt, Human
auuaggauuuuaggucauca

SEQ ID NO: 848502 - RNA, 22 nt, Human
cugcccaggaaccagaggggca

SEQ ID NO: 848503 - RNA, 22 nt, Human
ccugggugacagagugagaccu

SEQ ID NO: 848504 - RNA, 22 nt, Human
uucugagccucauucaugaggc

SEQ ID NO: 848505 - RNA, 22 nt, Human
cuccaugaauuugagcuuugug

SEQ ID NO: 848506 - RNA, 22 nt, Human
cugacuuugcucauaggucaaa

SEQ ID NO: 848507 - RNA, 22 nt, Human
guugaaagaucauguggcugcc

SEQ ID NO: 848508 - RNA, 22 nt, Human
uagggcugcuuuguauucugcu

SEQ ID NO: 848509 - RNA, 22 nt, Human
ugaguuuugucuugcuagaagu

SEQ ID NO: 848510 - RNA, 22 nt, Human
gcugagguuuucugccugcuca

SEQ ID NO: 848511 - RNA, 22 nt, Human
uucauucugggcucuaaggaac

SEQ ID NO: 848512 - RNA, 22 nt, Human
uagacuuugauauuguacaccc

SEQ ID NO: 848513 - RNA, 23 nt, Human
uuggcagcgggucaggcuguggg

SEQ ID NO: 848514 - RNA, 22 nt, Human
ucucuucuaacacuagaaauuc

SEQ ID NO: 848515 - RNA, 22 nt, Human
uuacaguuuaguccaagccaga

SEQ ID NO: 848516 - RNA, 22 nt, Human
uuuguuaauucuuauguuagag

SEQ ID NO: 848517 - RNA, 22 nt, Human
ggagaggaaaugccagcacuuc

SEQ ID NO: 848518 - RNA, 22 nt, Human
agaaauucaauucuaauuagcu

SEQ ID NO: 848519 - RNA, 22 nt, Human
cagugcuggcuguuaggacagu

SEQ ID NO: 848520 - RNA, 22 nt, Human
uggacaaaugauuucuaccuuu

SEQ ID NO: 848521 - RNA, 22 nt, Human
agaggccaugcuagaggccugg

SEQ ID NO: 848522 - RNA, 22 nt, Human
uucacaaaacacuauuuucugg

SEQ ID NO: 848523 - RNA, 22 nt, Human
aucuuucuauuucuaaaaacua

SEQ ID NO: 848524 - RNA, 22 nt, Human
ugcugaggagggcacccggggg

SEQ ID NO: 848525 - RNA, 22 nt, Human
aucaaugacaguugaauucuac

SEQ ID NO: 848526 - RNA, 22 nt, Human
gcccaggaguugguggcugcag

SEQ ID NO: 848527 - RNA, 22 nt, Human
uaacuguauauuaagguggccc

SEQ ID NO: 848528 - RNA, 22 nt, Human
aggacagggauucaaacuccca

SEQ ID NO: 848529 - RNA, 22 nt, Human
uccauuuucuugcucuagguaa

SEQ ID NO: 848530 - RNA, 22 nt, Human
agcugcccuuaauaggcauuca

SEQ ID NO: 848531 - RNA, 22 nt, Human
aacauucuauuuugcuaaaaca

SEQ ID NO: 848532 - RNA, 22 nt, Human
cccaaggacacgggcagggaca

SEQ ID NO: 848533 - RNA, 22 nt, Human
uaugaaacauucauacaaauaa

SEQ ID NO: 848534 - RNA, 22 nt, Human
agggaagcccuggcugagaccc

SEQ ID NO: 848535 - RNA, 22 nt, Human
uaaauuauggcuggcagagcag

SEQ ID NO: 848536 - RNA, 22 nt, Human
gccugccugcugucaucugccu

SEQ ID NO: 848537 - RNA, 22 nt, Human
auccaugauuaguaggauaaag

SEQ ID NO: 848538 - RNA, 22 nt, Human
ggaccuggcaauuugcaucucu

SEQ ID NO: 848539 - RNA, 23 nt, Human
aaacugcuuccaauuccugccau

SEQ ID NO: 848540 - RNA, 22 nt, Human
aaaaacuguaauuacuuuugca

SEQ ID NO: 848541 - RNA, 22 nt, Human
ccaugagcuucaacugacacag

SEQ ID NO: 848542 - RNA, 22 nt, Human
guagauaaggauugauuuuuau

SEQ ID NO: 848543 - RNA, 23 nt, Human
cugcccugaucuugaucuauugu

SEQ ID NO: 848544 - RNA, 20 nt, Human
aguuacgcuauuacucuccu

SEQ ID NO: 848545 - RNA, 22 nt, Human
acaaauauuuacugaauccacu

SEQ ID NO: 848546 - RNA, 22 nt, Human
acuuggcaaguaucuauaaagu

SEQ ID NO: 848547 - RNA, 22 nt, Human
acagaagugucuuuuucauuca

SEQ ID NO: 848548 - RNA, 22 nt, Human
acuggccagguucaaaauacag

SEQ ID NO: 848549 - RNA, 22 nt, Human
uaggauguagcuaugucaucau

SEQ ID NO: 848550 - RNA, 22 nt, Human
agugcuguuagguuaauauagu

SEQ ID NO: 848551 - RNA, 22 nt, Human
uuggccaagacucauguccuau

SEQ ID NO: 848552 - RNA, 22 nt, Human
agggauggaagacuugaagacc

SEQ ID NO: 848553 - RNA, 22 nt, Human
acaggcugccuaccaaguauca

SEQ ID NO: 848554 - RNA, 22 nt, Human
gggaggugauuaggaccaugua

SEQ ID NO: 848555 - RNA, 22 nt, Human
ugagccaaacuucuccuugguc

SEQ ID NO: 848556 - RNA, 20 nt, Human
uggcaucucucaauuguagg

SEQ ID NO: 848557 - RNA, 21 nt, Human
auacauucuauuaagcauuua

SEQ ID NO: 848558 - RNA, 22 nt, Human
uucuacaauaugaauaaugaag

SEQ ID NO: 848559 - RNA, 22 nt, Human
caaggccagggaauuuuucugg

SEQ ID NO: 848560 - RNA, 20 nt, Human
ucaggaugugcugagugaag

SEQ ID NO: 848561 - RNA, 22 nt, Human
gaccaggaaagagugugacuaa

SEQ ID NO: 848562 - RNA, 22 nt, Human
cauuuguuggucagauuguagu

SEQ ID NO: 848563 - RNA, 22 nt, Human
cccaggagguggagguugcagc

SEQ ID NO: 848564 - RNA, 22 nt, Human
aagggcuggcccugggaagagu

SEQ ID NO: 848565 - RNA, 22 nt, Human
uuugaacuucuaccugucauau

SEQ ID NO: 848566 - RNA, 17 nt, Human
gacugagguaaggugag

SEQ ID NO: 848567 - RNA, 22 nt, Human
uucaacuaauguuuauuuuaug

SEQ ID NO: 848568 - RNA, 22 nt, Human
cuuaggauuuaauuucagacuc

SEQ ID NO: 848569 - RNA, 22 nt, Human
uuauucaggcucucuuuggcua

SEQ ID NO: 848570 - RNA, 22 nt, Human
caccaggcuggagugcagaggu

SEQ ID NO: 848571 - RNA, 18 nt, Human
gagagcccagcagguggu

SEQ ID NO: 848572 - RNA, 22 nt, Human
guuauauauaguauuucucuga

SEQ ID NO: 848573 - RNA, 22 nt, Human
aauuaggaaauucagccauuuu

SEQ ID NO: 848574 - RNA, 22 nt, Human
acagugaggaagcagcugugcu

SEQ ID NO: 848575 - RNA, 22 nt, Human
uccuggccgcuggccccugaga

SEQ ID NO: 848576 - RNA, 22 nt, Human
agugcagcaugcuggggaggcu

SEQ ID NO: 848577 - RNA, 22 nt, Human
uggcaucucaaacaggcagauu

SEQ ID NO: 848578 - RNA, 22 nt, Human
aauacaguagguaauaguucau

SEQ ID NO: 848579 - RNA, 22 nt, Human
uugagaaauguuuuuuaagcug

SEQ ID NO: 848580 - RNA, 22 nt, Human
uucugagagugccagaaguucu

SEQ ID NO: 848581 - RNA, 22 nt, Human
cuuauuagaaagaaaagacaug

SEQ ID NO: 848582 - RNA, 22 nt, Human
cugaggacauugaugaggcaau

SEQ ID NO: 848583 - RNA, 22 nt, Human
ucuuggcuguaccauugacuag

SEQ ID NO: 848584 - RNA, 22 nt, Human
cccaggagaauauuuuuggguc

SEQ ID NO: 848585 - RNA, 22 nt, Human
uggcuucuccagaaaucuuggu

SEQ ID NO: 848586 - RNA, 22 nt, Human
gucuucuuuaaccuacuaaagc

SEQ ID NO: 848587 - RNA, 22 nt, Human
agugacagggaaaaugacacug

SEQ ID NO: 848588 - RNA, 22 nt, Human
uucaaacaguguagaauauaug

SEQ ID NO: 848589 - RNA, 23 nt, Human
ucguugaauagcaauagcacaac

SEQ ID NO: 848590 - RNA, 22 nt, Human
cugggccacaagccugugugau

SEQ ID NO: 848591 - RNA, 22 nt, Human
accuguuuggaggagguguuag

SEQ ID NO: 848592 - RNA, 22 nt, Human
ccaccagagggcagacugugau

SEQ ID NO: 848593 - RNA, 22 nt, Human
cugaggcuggcguuugaggaag

SEQ ID NO: 848594 - RNA, 22 nt, Human
gucuccugagacugcagucacc

SEQ ID NO: 848595 - RNA, 22 nt, Human
agauggagaccuuggaugaacu

SEQ ID NO: 848596 - RNA, 21 nt, Human
ggauggauagggaagagauuu

SEQ ID NO: 848597 - RNA, 22 nt, Human
gcauucuuuuuaggagguuccu

SEQ ID NO: 848598 - RNA, 22 nt, Human
ccagagcuaaacacacaggcug

SEQ ID NO: 848599 - RNA, 22 nt, Human
uugaaaguuuauggagucugca

SEQ ID NO: 848600 - RNA, 22 nt, Human
ccuaggcccauuaauuccccuu

SEQ ID NO: 848601 - RNA, 23 nt, Human
agacaaaagccucagucuuaggc

SEQ ID NO: 848602 - RNA, 22 nt, Human
aucuccaggcauuucaagagac

SEQ ID NO: 848603 - RNA, 22 nt, Human
gaaggaggugucaguuggacug

SEQ ID NO: 848604 - RNA, 22 nt, Human
agcuacccgaggacaggcuaag

SEQ ID NO: 848605 - RNA, 22 nt, Human
ucauggauggccgggaggugau

SEQ ID NO: 848606 - RNA, 22 nt, Human
cuugcaggauuuugcugcugua

SEQ ID NO: 848607 - RNA, 22 nt, Human
uuaggaaaggaacauugaaacg

SEQ ID NO: 848608 - RNA, 22 nt, Human
ccaggcugcucacaagcugccc

SEQ ID NO: 848609 - RNA, 22 nt, Human
cugaggucuauuuugaaacugc

SEQ ID NO: 848610 - RNA, 22 nt, Human
ucuucuucccaucccucaaaug

SEQ ID NO: 848611 - RNA, 23 nt, Human
cuuuuaacuugaucugagaccag

SEQ ID NO: 848612 - RNA, 22 nt, Human
agggggugcauuugugaaugaa

SEQ ID NO: 848613 - RNA, 22 nt, Human
ucucagucuuugcaaggaugcu

SEQ ID NO: 848614 - RNA, 18 nt, Human
ggagcccagaggacagga

SEQ ID NO: 848615 - RNA, 22 nt, Human
uguacauagaucuugaaaauua

SEQ ID NO: 848616 - RNA, 22 nt, Human
ggcugagccacugcgccuggcu

SEQ ID NO: 848617 - RNA, 22 nt, Human
auuuccaguccuaaugaucugg

SEQ ID NO: 848618 - RNA, 22 nt, Human
cauguuuacuaccaggagaaug

SEQ ID NO: 848619 - RNA, 22 nt, Human
uaggcagccagcaucaguuggg

SEQ ID NO: 848620 - RNA, 21 nt, Human
ccugggccaaauucccuggac

SEQ ID NO: 848621 - RNA, 22 nt, Human
ucuuugcacugugcaagcagaa

SEQ ID NO: 848622 - RNA, 22 nt, Human
cugcuguguggauucaauggcu

SEQ ID NO: 848623 - RNA, 22 nt, Human
uuaggaaacgcugcuauugacu

SEQ ID NO: 848624 - RNA, 20 nt, Human
agcuucuucugucuaauuuu

SEQ ID NO: 848625 - RNA, 22 nt, Human
ggccucaguuucuucaacugua

SEQ ID NO: 848626 - RNA, 22 nt, Human
aagggcuggagacugggucuuc

SEQ ID NO: 848627 - RNA, 22 nt, Human
caaauacuaaacauaagauuuu

SEQ ID NO: 848628 - RNA, 22 nt, Human
cucaggauguacuacagaaggc

SEQ ID NO: 848629 - RNA, 22 nt, Human
gagggcugcaaugagacagaga

SEQ ID NO: 848630 - RNA, 22 nt, Human
uuccuggccucucucugagcag

SEQ ID NO: 848631 - RNA, 22 nt, Human
auaucaguaucuauguauuugu

SEQ ID NO: 848632 - RNA, 22 nt, Human
ucuagaaauuuugccuuguauu

SEQ ID NO: 848633 - RNA, 22 nt, Human
ucuccuggccuuuagguuaagg

SEQ ID NO: 848634 - RNA, 22 nt, Human
augcuguguuugagaaccuagg

SEQ ID NO: 848635 - RNA, 18 nt, Human
uggcagagugucuguucu

SEQ ID NO: 848636 - RNA, 22 nt, Human
uucagaaacagagugagugagu

SEQ ID NO: 848637 - RNA, 22 nt, Human
aguuuucacacucaccaaaagg

SEQ ID NO: 848638 - RNA, 22 nt, Human
uggcagcuguuaauguuuuguu

SEQ ID NO: 848639 - RNA, 19 nt, Human
cuggccaggccaggggccc

SEQ ID NO: 848640 - RNA, 22 nt, Human
cugagauggccacugggucuca

SEQ ID NO: 848641 - RNA, 22 nt, Human
ggcugaaggaugaaagcugcag

SEQ ID NO: 848642 - RNA, 22 nt, Human
gcaggcugaaacucggggucua

SEQ ID NO: 848643 - RNA, 22 nt, Human
cagaggaguucaguacacagcc

SEQ ID NO: 848644 - RNA, 22 nt, Human
gcugcccaggagagguggggcu

SEQ ID NO: 848645 - RNA, 22 nt, Human
ggcugcaggaacgacggagggg

SEQ ID NO: 848646 - RNA, 22 nt, Human
uggcaggcagugugggagcugg

SEQ ID NO: 848647 - RNA, 23 nt, Human
gcagacagagcagacuaagacaa

SEQ ID NO: 848648 - RNA, 18 nt, Human
guaggucaguaccaagca

SEQ ID NO: 848649 - RNA, 22 nt, Human
uccaggaggccucauuuccugu

SEQ ID NO: 848650 - RNA, 22 nt, Human
uucagcaaacacgaugcuuguu

SEQ ID NO: 848651 - RNA, 22 nt, Human
gaggcugaugcugccucacaga

SEQ ID NO: 848652 - RNA, 22 nt, Human
cagcugacccagugaggaggca

SEQ ID NO: 848653 - RNA, 22 nt, Human
cuguccuggccgcccuugugag

SEQ ID NO: 848654 - RNA, 22 nt, Human
aagcaagacagaaguuacugcc

SEQ ID NO: 848655 - RNA, 22 nt, Human
uguauuuuuagaccuuuagacc

SEQ ID NO: 848656 - RNA, 22 nt, Human
aggcuccaugcaaaggcuguuu

SEQ ID NO: 848657 - RNA, 22 nt, Human
gugagggguggcugagcaguuu

SEQ ID NO: 848658 - RNA, 22 nt, Human
aguguguccagaaaucuguauu

SEQ ID NO: 848659 - RNA, 19 nt, Human
cauuaggauuagagacaag

SEQ ID NO: 848660 - RNA, 22 nt, Human
agaggggaggcgaaccagaguc

SEQ ID NO: 848661 - RNA, 22 nt, Human
auguucuuguucaaaugucagu

SEQ ID NO: 848662 - RNA, 22 nt, Human
aacauguugaguugaaaguagc

SEQ ID NO: 848663 - RNA, 22 nt, Human
cagaguggcacucugcuggaug

SEQ ID NO: 848664 - RNA, 22 nt, Human
gcuuugaagacuuuuccagggu

SEQ ID NO: 848665 - RNA, 22 nt, Human
acugaggucaugcauaguuucu

SEQ ID NO: 848666 - RNA, 22 nt, Human
cuucucagaggccagaagcuau

SEQ ID NO: 848667 - RNA, 22 nt, Human
ucaccgccuugcccggccgggc

SEQ ID NO: 848668 - RNA, 22 nt, Human
uccaggagaaaacugacggugg

SEQ ID NO: 848669 - RNA, 22 nt, Human
ggccaggagcugcacagggcuc

SEQ ID NO: 848670 - RNA, 22 nt, Human
caagauggaguccgggaaugug

SEQ ID NO: 848671 - RNA, 22 nt, Human
ggcagucaagagggagucugaa

SEQ ID NO: 848672 - RNA, 22 nt, Human
accauccugaaaccuucaugcu

SEQ ID NO: 848673 - RNA, 22 nt, Human
aauacaguaauuuugaugaguu

SEQ ID NO: 848674 - RNA, 22 nt, Human
uggcagagugcagaagaggcau

SEQ ID NO: 848675 - RNA, 22 nt, Human
aggggaugauccucccgcagcg

SEQ ID NO: 848676 - RNA, 22 nt, Human
uaacauauuguguggcacuagg

SEQ ID NO: 848677 - RNA, 23 nt, Human
aagaacugcgaauggagaaagua

SEQ ID NO: 848678 - RNA, 22 nt, Human
guuuuucuuugugugaagacaa

SEQ ID NO: 848679 - RNA, 22 nt, Human
uacccagggcuuuucugaugca

SEQ ID NO: 848680 - RNA, 22 nt, Human
aagaacuuccuaauauauuuuc

SEQ ID NO: 848681 - RNA, 22 nt, Human
uugaaaguccuucuugaguuac

SEQ ID NO: 848682 - RNA, 22 nt, Human
auuagguaaucuuuagauacac

SEQ ID NO: 848683 - RNA, 22 nt, Human
acacauauucauauguacuuac

SEQ ID NO: 848684 - RNA, 22 nt, Human
uuaggcauuggaaggucagcuu

SEQ ID NO: 848685 - RNA, 22 nt, Human
gcccaggaguucaagucuagug

SEQ ID NO: 848686 - RNA, 22 nt, Human
uaucuaaaggauuuaauuuagu

SEQ ID NO: 848687 - RNA, 22 nt, Human
caccagcuccaccagggcaggu

SEQ ID NO: 848688 - RNA, 22 nt, Human
cagggcuggauuucauuucuag

SEQ ID NO: 848689 - RNA, 22 nt, Human
ucaggagagaguuggguaggcu

SEQ ID NO: 848690 - RNA, 22 nt, Human
augguacaaaauguauaaaguc

SEQ ID NO: 848691 - RNA, 22 nt, Human
uacagagauacucuagaucaaa

SEQ ID NO: 848692 - RNA, 22 nt, Human
uuuuaguguagucaccgugggu

SEQ ID NO: 848693 - RNA, 18 nt, Human
uccuggccacacuaccuu

SEQ ID NO: 848694 - RNA, 22 nt, Human
auguggcacagcacaguaagag

SEQ ID NO: 848695 - RNA, 23 nt, Human
gugcugugagccccuuggccucc

SEQ ID NO: 848696 - RNA, 22 nt, Human
cugggccaaaagaaguguucuu

SEQ ID NO: 848697 - RNA, 23 nt, Human
uuaaguggucaguuuuagacaac

SEQ ID NO: 848698 - RNA, 22 nt, Human
aggcaguggagcuggaauaggc

SEQ ID NO: 848699 - RNA, 22 nt, Human
uauuucagguauggugugaaau

SEQ ID NO: 848700 - RNA, 22 nt, Human
ugaggcagaaauuccuguuuuc

SEQ ID NO: 848701 - RNA, 22 nt, Human
uggcagcucccagagcuuccaa

SEQ ID NO: 848702 - RNA, 22 nt, Human
gccaggagcaugucauuguuga

SEQ ID NO: 848703 - RNA, 22 nt, Human
ucccaggacaugggcucugcuc

SEQ ID NO: 848704 - RNA, 22 nt, Human
uccugagcuucaaaacacuuug

SEQ ID NO: 848705 - RNA, 22 nt, Human
aguaaacagaaagcaagaugau

SEQ ID NO: 848706 - RNA, 22 nt, Human
cuucagaaugggacuguguuug

SEQ ID NO: 848707 - RNA, 22 nt, Human
aacuuacaaggaugauagcugc

SEQ ID NO: 848708 - RNA, 17 nt, Human
aagacagaagccaugag

SEQ ID NO: 848709 - RNA, 22 nt, Human
guauuaguuaucuacugcugug

SEQ ID NO: 848710 - RNA, 22 nt, Human
aagggcuguuauguuuuuauac

SEQ ID NO: 848711 - RNA, 22 nt, Human
uucucagagugaccaagucuuu

SEQ ID NO: 848712 - RNA, 22 nt, Human
ggcagccaugcacgcugccugg

SEQ ID NO: 848713 - RNA, 22 nt, Human
ugugauauuugaguauugucaa

SEQ ID NO: 848714 - RNA, 22 nt, Human
gaggcugacggcaccaucuucu

SEQ ID NO: 848715 - RNA, 22 nt, Human
uccuuagagauacugucuugaa

SEQ ID NO: 848716 - RNA, 22 nt, Human
cuuuguagcugcuucugauuua

SEQ ID NO: 848717 - RNA, 22 nt, Human
cccaggaaccuaccagcucgag

SEQ ID NO: 848718 - RNA, 20 nt, Human
ucauuucuugggguuccaag

SEQ ID NO: 848719 - RNA, 19 nt, Human
cuucuucuuggcagccaag

SEQ ID NO: 848720 - RNA, 22 nt, Human
aguuugaaauguuggcaauauu

SEQ ID NO: 848721 - RNA, 22 nt, Human
uuugaaaggaauuaggaugaca

SEQ ID NO: 848722 - RNA, 22 nt, Human
gcccacuggcuggagugcuggu

SEQ ID NO: 848723 - RNA, 22 nt, Human
ccuccuggguucaagcgauucu

SEQ ID NO: 848724 - RNA, 22 nt, Human
uguccucuuccagugcuccuuc

SEQ ID NO: 848725 - RNA, 22 nt, Human
uaaggccaauuaacaaccaggg

SEQ ID NO: 848726 - RNA, 22 nt, Human
uuagagucaagcugcauguucu

SEQ ID NO: 848727 - RNA, 22 nt, Human
gucuauauauugcuugaauaau

SEQ ID NO: 848728 - RNA, 19 nt, Human
aaacuaaggggaaauguuu

SEQ ID NO: 848729 - RNA, 22 nt, Human
aguguuugagacacauuucacu

SEQ ID NO: 848730 - RNA, 22 nt, Human
ucaagugcuugugagguauuug

SEQ ID NO: 848731 - RNA, 22 nt, Human
gaccaaggaagaggggagccag

SEQ ID NO: 848732 - RNA, 22 nt, Human
ccuuuuauacucagugauauca

SEQ ID NO: 848733 - RNA, 22 nt, Human
gaguccaggcuguugcucaucu

SEQ ID NO: 848734 - RNA, 20 nt, Human
cugcugugauucccuccucc

SEQ ID NO: 848735 - RNA, 22 nt, Human
aaggcagcaccgccuccugaaa

SEQ ID NO: 848736 - RNA, 22 nt, Human
ucucuucuagcuucuugugguu

SEQ ID NO: 848737 - RNA, 22 nt, Human
gagggagggacuagcauucucu

SEQ ID NO: 848738 - RNA, 22 nt, Human
accaggagaggcacuugcaaug

SEQ ID NO: 848739 - RNA, 22 nt, Human
acuguggccaaagccucuggga

SEQ ID NO: 848740 - RNA, 22 nt, Human
ucuuagaaauuccccaguggcu

SEQ ID NO: 848741 - RNA, 22 nt, Human
ucccaggaauccguccucuaga

SEQ ID NO: 848742 - RNA, 22 nt, Human
aguaacaucuuugacauuuguu

SEQ ID NO: 848743 - RNA, 22 nt, Human
ccaggagcagauauggacauaa

SEQ ID NO: 848744 - RNA, 22 nt, Human
ugaggcaggaaguuauauaaug

SEQ ID NO: 848745 - RNA, 22 nt, Human
ucuugcuaaagaccaacacauu

SEQ ID NO: 848746 - RNA, 22 nt, Human
gaggagagaugguagauugggu

SEQ ID NO: 848747 - RNA, 22 nt, Human
gccaggagugucccacucauuu

SEQ ID NO: 848748 - RNA, 22 nt, Human
ccucuccuugcacccgucccgc

SEQ ID NO: 848749 - RNA, 22 nt, Human
aggcugagcaaagggccuuacc

SEQ ID NO: 848750 - RNA, 23 nt, Human
ucagagagcuguugagagcugcc

SEQ ID NO: 848751 - RNA, 22 nt, Human
acugccugcucauaacauugcu

SEQ ID NO: 848752 - RNA, 22 nt, Human
uuucauuauaaaaaguuggcuu

SEQ ID NO: 848753 - RNA, 21 nt, Human
uuugaaagcuacaucuauagc

SEQ ID NO: 848754 - RNA, 22 nt, Human
caaauacugagcacgcaaucaa

SEQ ID NO: 848755 - RNA, 22 nt, Human
caaaauuagaaaugcagcuguu

SEQ ID NO: 848756 - RNA, 22 nt, Human
gcucagggucccuuggugcugg

SEQ ID NO: 848757 - RNA, 22 nt, Human
cucagaauuuagggcucugagg

SEQ ID NO: 848758 - RNA, 22 nt, Human
cugaggcuucucuaguucagcu

SEQ ID NO: 848759 - RNA, 22 nt, Human
uaaauacuuuuacuccacugau

SEQ ID NO: 848760 - RNA, 22 nt, Human
cagaacugggcucgcucugguu

SEQ ID NO: 848761 - RNA, 22 nt, Human
gcccaggaaaugccccguggug

SEQ ID NO: 848762 - RNA, 22 nt, Human
acauguuuaaguuuaaugaaaa

SEQ ID NO: 848763 - RNA, 20 nt, Human
agauuauuccuaagauuucu

SEQ ID NO: 848764 - RNA, 17 nt, Human
ucugaagccagucugcu

SEQ ID NO: 848765 - RNA, 22 nt, Human
acugagguauaauugacauaac

SEQ ID NO: 848766 - RNA, 22 nt, Human
gggauggggagcuggaaagggg

SEQ ID NO: 848767 - RNA, 22 nt, Human
acaaguuaccaaaaaagauuca

SEQ ID NO: 848768 - RNA, 22 nt, Human
aaggcagcuuuaaaaaagaugc

SEQ ID NO: 848769 - RNA, 22 nt, Human
ugccuggcccugacagcccugg

SEQ ID NO: 848770 - RNA, 23 nt, Human
ggacccuguggagggugagaguc

SEQ ID NO: 848771 - RNA, 22 nt, Human
uccuggccuugcuccugaugcc

SEQ ID NO: 848772 - RNA, 22 nt, Human
caggcagccugagggaucuggg

SEQ ID NO: 848773 - RNA, 20 nt, Human
ccacaggaguccagucgacc

SEQ ID NO: 848774 - RNA, 22 nt, Human
aggcucagaggugagcaucugc

SEQ ID NO: 848775 - RNA, 22 nt, Human
uagaaagaucuguaggcaagag

SEQ ID NO: 848776 - RNA, 18 nt, Human
ccuaagcuccagccccag

SEQ ID NO: 848777 - RNA, 22 nt, Human
agaggaugguugaggaagaccu

SEQ ID NO: 848778 - RNA, 22 nt, Human
ucccaggauuuuaggcucucag

SEQ ID NO: 848779 - RNA, 22 nt, Human
cuguucucuggcgguggcuguu

SEQ ID NO: 848780 - RNA, 22 nt, Human
gauagucaccucccuuaacuuu

SEQ ID NO: 848781 - RNA, 22 nt, Human
acagagcuaauguugcauaggc

SEQ ID NO: 848782 - RNA, 22 nt, Human
gcugcccagacauugaaucagg

SEQ ID NO: 848783 - RNA, 22 nt, Human
uuuggaaugguaccuucaguug

SEQ ID NO: 848784 - RNA, 22 nt, Human
uuuuauucuaaguaugauggga

SEQ ID NO: 848785 - RNA, 22 nt, Human
cagaguggcgacccccucagcu

SEQ ID NO: 848786 - RNA, 22 nt, Human
uggcugagaaaaaagagcuaua

SEQ ID NO: 848787 - RNA, 22 nt, Human
gucuuucuaugaugaacuguug

SEQ ID NO: 848788 - RNA, 21 nt, Human
ccugagguuucuggccucugu

SEQ ID NO: 848789 - RNA, 20 nt, Human
acacacuuugaucuugagcc

SEQ ID NO: 848790 - RNA, 18 nt, Human
aggcagacacuagagguc

SEQ ID NO: 848791 - RNA, 22 nt, Human
uagggcuguuaguaauucucag

SEQ ID NO: 848792 - RNA, 20 nt, Human
ugcugcugccuccgccucug

SEQ ID NO: 848793 - RNA, 20 nt, Human
agggccuguugcaagcguuu

SEQ ID NO: 848794 - RNA, 20 nt, Human
auuagagcuacauggcuaca

SEQ ID NO: 848795 - RNA, 22 nt, Human
aaaauuaagugucugggaagcc

SEQ ID NO: 848796 - RNA, 22 nt, Human
gcuuuauuuugugagggauuac

SEQ ID NO: 848797 - RNA, 22 nt, Human
gaaaauuauugaaaauggcucu

SEQ ID NO: 848798 - RNA, 22 nt, Human
gccaggagagcuccuucagguu

SEQ ID NO: 848799 - RNA, 22 nt, Human
auguucuguuuuguaauucaua

SEQ ID NO: 848800 - RNA, 22 nt, Human
gaggcgagaagcuggagauggu

SEQ ID NO: 848801 - RNA, 23 nt, Human
agugcugaauugaaagcuccagg

SEQ ID NO: 848802 - RNA, 22 nt, Human
guaggcagugguuggaagagaa

SEQ ID NO: 848803 - RNA, 22 nt, Human
acagagcugggaucugaaccca

SEQ ID NO: 848804 - RNA, 22 nt, Human
agcugccaucugaagaacugca

SEQ ID NO: 848805 - RNA, 22 nt, Human
cucagagaggcaguggaaguca

SEQ ID NO: 848806 - RNA, 22 nt, Human
uagcaagaaaacacaagaauua

SEQ ID NO: 848807 - RNA, 22 nt, Human
aaauuaguacauugcaaagucc

SEQ ID NO: 848808 - RNA, 22 nt, Human
uggcugagaaaaugguuuuagg

SEQ ID NO: 848809 - RNA, 22 nt, Human
agaccuggauuccaauccuacc

SEQ ID NO: 848810 - RNA, 22 nt, Human
gagugcaguaugagaggcugcu

SEQ ID NO: 848811 - RNA, 22 nt, Human
aagggcugaaugaaggguugaa

SEQ ID NO: 848812 - RNA, 22 nt, Human
gcauacagagaggauguggcau

SEQ ID NO: 848813 - RNA, 22 nt, Human
aaguuacaguuauuauuuaaaa

SEQ ID NO: 848814 - RNA, 22 nt, Human
cagcuaauccucucuauccaag

SEQ ID NO: 848815 - RNA, 23 nt, Human
accaggagaaaagcuuugcggga

SEQ ID NO: 848816 - RNA, 22 nt, Human
aggcuggagcaagggggcauau

SEQ ID NO: 848817 - RNA, 22 nt, Human
ucccaggacccaggcauucaca

SEQ ID NO: 848818 - RNA, 22 nt, Human
gcccaggaguugaagggcugac

SEQ ID NO: 848819 - RNA, 22 nt, Human
aaaggccacacugcucuuucuc

SEQ ID NO: 848820 - RNA, 22 nt, Human
ggcuagaguggaacuggagcgg

SEQ ID NO: 848821 - RNA, 22 nt, Human
cagacaggcaggugcugcuuug

SEQ ID NO: 848822 - RNA, 22 nt, Human
acuacauuucucaguaccugaa

SEQ ID NO: 848823 - RNA, 22 nt, Human
aauuauacaugaaggcauuaua

SEQ ID NO: 848824 - RNA, 22 nt, Human
cccaggagagggaaccaaaugu

SEQ ID NO: 848825 - RNA, 22 nt, Human
agacucaagacugcagaagacg

SEQ ID NO: 848826 - RNA, 22 nt, Human
uuccaugacaccgagggaaguc

SEQ ID NO: 848827 - RNA, 22 nt, Human
auuaaauacugcaggcuaagca

SEQ ID NO: 848828 - RNA, 22 nt, Human
agacccagaaagcagcugcauu

SEQ ID NO: 848829 - RNA, 22 nt, Human
gguccaccuccaagcuggggac

SEQ ID NO: 848830 - RNA, 19 nt, Human
uauggcaggccgaggcacu

SEQ ID NO: 848831 - RNA, 22 nt, Human
auuauucuuaugucaucauggc

SEQ ID NO: 848832 - RNA, 22 nt, Human
uuugaaagucaaccuuccaguu

SEQ ID NO: 848833 - RNA, 22 nt, Human
aggcagaugggagcuggaaguu

SEQ ID NO: 848834 - RNA, 22 nt, Human
cuggucaaggagagucucugca

SEQ ID NO: 848835 - RNA, 22 nt, Human
uuuauuauguacaggcacuaua

SEQ ID NO: 848836 - RNA, 22 nt, Human
gccaggagggaaaggacaauuu

SEQ ID NO: 848837 - RNA, 17 nt, Human
ucccaggaacagggaau

SEQ ID NO: 848838 - RNA, 22 nt, Human
uuuuauauggcacauugguugg

SEQ ID NO: 848839 - RNA, 22 nt, Human
accgaaggaaacuggaaccguu

SEQ ID NO: 848840 - RNA, 22 nt, Human
uuggcacacaguaagcccuaag

SEQ ID NO: 848841 - RNA, 22 nt, Human
cccauucauccucgcuuccuuc

SEQ ID NO: 848842 - RNA, 22 nt, Human
aacauauaaacucuuaaguuca

SEQ ID NO: 848843 - RNA, 22 nt, Human
gcuuaguccccaagagagacca

SEQ ID NO: 848844 - RNA, 17 nt, Human
gccaggagguuugagcu

SEQ ID NO: 848845 - RNA, 20 nt, Human
gagcugaguguggucauggg

SEQ ID NO: 848846 - RNA, 22 nt, Human
auucauuugcuauuguguaugg

SEQ ID NO: 848847 - RNA, 23 nt, Human
agacugaggcugccagggucaga

SEQ ID NO: 848848 - RNA, 22 nt, Human
gcuggagcugcagccugggccu

SEQ ID NO: 848849 - RNA, 22 nt, Human
acccaggaggcagagguugcag

SEQ ID NO: 848850 - RNA, 22 nt, Human
uccuggcccuguggccugcagu

SEQ ID NO: 848851 - RNA, 22 nt, Human
uagcaagaagggagaugggguu

SEQ ID NO: 848852 - RNA, 22 nt, Human
auuuccagugcacugaauagaa

SEQ ID NO: 848853 - RNA, 22 nt, Human
gcugccuccgccggcuccacag

SEQ ID NO: 848854 - RNA, 22 nt, Human
cugcccucuagggaugcacugg

SEQ ID NO: 848855 - RNA, 18 nt, Human
ggcagggaaaagauaggg

SEQ ID NO: 848856 - RNA, 22 nt, Human
ugcauuuccagauuucuggagu

SEQ ID NO: 848857 - RNA, 22 nt, Human
ucugcccucauugcugccugga

SEQ ID NO: 848858 - RNA, 22 nt, Human
gaaauauugggacucagagcuu

SEQ ID NO: 848859 - RNA, 22 nt, Human
ucugagguucccucaacuaccu

SEQ ID NO: 848860 - RNA, 22 nt, Human
cauuuguaguaucuguuuauau

SEQ ID NO: 848861 - RNA, 22 nt, Human
aguauugugacucaaguauucu

SEQ ID NO: 848862 - RNA, 22 nt, Human
ucccagaggucucugcugguuc

SEQ ID NO: 848863 - RNA, 22 nt, Human
cuguaacucugccaagaaggcu

SEQ ID NO: 848864 - RNA, 22 nt, Human
ucccaggaagaucccagggacc

SEQ ID NO: 848865 - RNA, 22 nt, Human
aucuacccacugaacacaauau

SEQ ID NO: 848866 - RNA, 22 nt, Human
ugcuggcuuugcgagaugcauu

SEQ ID NO: 848867 - RNA, 22 nt, Human
ggcugagcccccucugcguagg

SEQ ID NO: 848868 - RNA, 22 nt, Human
ucuucacaggagccugccugcc

SEQ ID NO: 848869 - RNA, 22 nt, Human
uccccagaggugaggcagcuuu

SEQ ID NO: 848870 - RNA, 22 nt, Human
cacugguguauuagagcuagaa

SEQ ID NO: 848871 - RNA, 22 nt, Human
ugcugcugacauuuggggcuug

SEQ ID NO: 848872 - RNA, 22 nt, Human
acaggcuggaggaggaccaaga

SEQ ID NO: 848873 - RNA, 22 nt, Human
agaccaugggcucugaagagca

SEQ ID NO: 848874 - RNA, 22 nt, Human
ucuccuggauagauacuaucca

SEQ ID NO: 848875 - RNA, 22 nt, Human
ccaggcugaauauguuccaggg

SEQ ID NO: 848876 - RNA, 21 nt, Human
uuuauuuauauaggacacaug

SEQ ID NO: 848877 - RNA, 22 nt, Human
cugaggcucaagggcagguggg

SEQ ID NO: 848878 - RNA, 22 nt, Human
uacaaaguagaaauucaguaaa

SEQ ID NO: 848879 - RNA, 22 nt, Human
uagcaagagugggcuuuguggg

SEQ ID NO: 848880 - RNA, 22 nt, Human
agaggcaggaagagcugauuuu

SEQ ID NO: 848881 - RNA, 22 nt, Human
uagugugguaaauaaauguuuu

SEQ ID NO: 848882 - RNA, 22 nt, Human
cuuaauaauaggugaggcuaug

SEQ ID NO: 848883 - RNA, 22 nt, Human
uccaugaggcagggaggcuggc

SEQ ID NO: 848884 - RNA, 22 nt, Human
caggagaaauguggcugcuacc

SEQ ID NO: 848885 - RNA, 22 nt, Human
uggccucagauuauugcacagu

SEQ ID NO: 848886 - RNA, 22 nt, Human
guggccaagaaaauagaugcau

SEQ ID NO: 848887 - RNA, 23 nt, Human
agcacacuuguacaaugcccuag

SEQ ID NO: 848888 - RNA, 20 nt, Human
agacaggagcccccauucag

SEQ ID NO: 848889 - RNA, 22 nt, Human
ccuguuuagugaggugaggagu

SEQ ID NO: 848890 - RNA, 22 nt, Human
gugguuuucuccaacccagaac

SEQ ID NO: 848891 - RNA, 22 nt, Human
uagaagcacagguuaaaggcau

SEQ ID NO: 848892 - RNA, 22 nt, Human
uuccaugagcucugaguucaca

SEQ ID NO: 848893 - RNA, 22 nt, Human
aggcacaguuucauccccgggc

SEQ ID NO: 848894 - RNA, 22 nt, Human
ggccugaggcgucccagcugug

SEQ ID NO: 848895 - RNA, 22 nt, Human
gugcugagauuacaggugugag

SEQ ID NO: 848896 - RNA, 22 nt, Human
uuguuuuaucuuucuacagacu

SEQ ID NO: 848897 - RNA, 22 nt, Human
cuggcugaguuacuccacugag

SEQ ID NO: 848898 - RNA, 23 nt, Human
ggccacaaauagucuccccuggc

SEQ ID NO: 848899 - RNA, 22 nt, Human
gcuggcagggacagcugcgugu

SEQ ID NO: 848900 - RNA, 22 nt, Human
gagcugagacacacuuuggcaa

SEQ ID NO: 848901 - RNA, 22 nt, Human
aaucuguuuaguucugcguaug

SEQ ID NO: 848902 - RNA, 22 nt, Human
uuaaguaacuuguccaaaugag

SEQ ID NO: 848903 - RNA, 22 nt, Human
uuucuucagccuucacaaccug

SEQ ID NO: 848904 - RNA, 22 nt, Human
ccuggagcccaaggcagugaga

SEQ ID NO: 848905 - RNA, 22 nt, Human
cccugccuucuuggccuuuaaa

SEQ ID NO: 848906 - RNA, 19 nt, Human
accaggagacagugagcuu

SEQ ID NO: 848907 - RNA, 21 nt, Human
gauuugcagaaacuagacagg

SEQ ID NO: 848908 - RNA, 22 nt, Human
gagaaacuuggaguuauucugg

SEQ ID NO: 848909 - RNA, 22 nt, Human
caggagauguaagacuucuguu

SEQ ID NO: 848910 - RNA, 22 nt, Human
agcugcccagcuaggaagaagg

SEQ ID NO: 848911 - RNA, 22 nt, Human
aggcuggagugugcaguggcgc

SEQ ID NO: 848912 - RNA, 22 nt, Human
ugcuuagacgucaaguacagcc

SEQ ID NO: 848913 - RNA, 22 nt, Human
cugaggaagacagcagcugugu

SEQ ID NO: 848914 - RNA, 22 nt, Human
aguggcagagugcacucaggca

SEQ ID NO: 848915 - RNA, 22 nt, Human
uuccuggcugaacugaacuccu

SEQ ID NO: 848916 - RNA, 22 nt, Human
uucuucucucauagauuaaggu

SEQ ID NO: 848917 - RNA, 22 nt, Human
ccacuuucugagggaacagcag

SEQ ID NO: 848918 - RNA, 22 nt, Human
ugaggcaguauuuuagugacuu

SEQ ID NO: 848919 - RNA, 22 nt, Human
ccagagcugaggagaugggcuu

SEQ ID NO: 848920 - RNA, 22 nt, Human
uuccucagaaaauacuguccaa

SEQ ID NO: 848921 - RNA, 22 nt, Human
acuaacuugcugagugaccaug

SEQ ID NO: 848922 - RNA, 22 nt, Human
cagucagggacaccagcuagga

SEQ ID NO: 848923 - RNA, 22 nt, Human
cugagcugggaguagagacucu

SEQ ID NO: 848924 - RNA, 22 nt, Human
cugcugccauuagggcacagac

SEQ ID NO: 848925 - RNA, 22 nt, Human
gucuggccugccagcucuggug

SEQ ID NO: 848926 - RNA, 22 nt, Human
agucucugggcaugguugugac

SEQ ID NO: 848927 - RNA, 22 nt, Human
caaggccagagccagcgauaag

SEQ ID NO: 848928 - RNA, 22 nt, Human
guauuagucaauuacagugggg

SEQ ID NO: 848929 - RNA, 22 nt, Human
gaggcugagaguuuguucuacu

SEQ ID NO: 848930 - RNA, 22 nt, Human
acucagaagauauaaugacuca

SEQ ID NO: 848931 - RNA, 22 nt, Human
ccccaccauguagaaacugaga

SEQ ID NO: 848932 - RNA, 22 nt, Human
gcugaagcugcagcaggaggaa

SEQ ID NO: 848933 - RNA, 20 nt, Human
cugagccaacucucuucuug

SEQ ID NO: 848934 - RNA, 22 nt, Human
cccaggagaauauaauguucuu

SEQ ID NO: 848935 - RNA, 22 nt, Human
cagcaggauaugguggagagag

SEQ ID NO: 848936 - RNA, 20 nt, Human
ugcugaggccugaggccugg

SEQ ID NO: 848937 - RNA, 22 nt, Human
ucuggguaugaccuauuuuucc

SEQ ID NO: 848938 - RNA, 22 nt, Human
aaaggcaggcuuucacaucuca

SEQ ID NO: 848939 - RNA, 22 nt, Human
uccuggccuccguucucugcau

SEQ ID NO: 848940 - RNA, 22 nt, Human
gucuuuaugguaugaaaacuga

SEQ ID NO: 848941 - RNA, 22 nt, Human
uggucaaauuuagucucuggaa

SEQ ID NO: 848942 - RNA, 22 nt, Human
cagagcugcgcuuuuuccuggu

SEQ ID NO: 848943 - RNA, 22 nt, Human
agaaaaaucuuggcgcuugucu

SEQ ID NO: 848944 - RNA, 22 nt, Human
ugagagggcccagagcacacca

SEQ ID NO: 848945 - RNA, 22 nt, Human
ucaucugucccaggcuuuuuuc

SEQ ID NO: 848946 - RNA, 22 nt, Human
uauuuccaagcugaauccaaug

SEQ ID NO: 848947 - RNA, 22 nt, Human
aagggaggaggauuuauuguac

SEQ ID NO: 848948 - RNA, 22 nt, Human
gaaaacuuggaucucuagaaug

SEQ ID NO: 848949 - RNA, 22 nt, Human
gacuucuauuaauaccucuacu

SEQ ID NO: 848950 - RNA, 21 nt, Human
uagaagcacauagguucaaag

SEQ ID NO: 848951 - RNA, 22 nt, Human
aaauuauucucauguguuucuu

SEQ ID NO: 848952 - RNA, 22 nt, Human
cuuaauaaaugguagcuguuau

SEQ ID NO: 848953 - RNA, 20 nt, Human
uuuauucacagagaagaguu

SEQ ID NO: 848954 - RNA, 22 nt, Human
uuuggaaagugugauuucaagg

SEQ ID NO: 848955 - RNA, 20 nt, Human
uuggcagcaguuccaaguga

SEQ ID NO: 848956 - RNA, 22 nt, Human
cagugcuguugggcccagagag

SEQ ID NO: 848957 - RNA, 22 nt, Human
gcucccaggcauggagguaauu

SEQ ID NO: 848958 - RNA, 22 nt, Human
guuaggauguggggacuuuggg

SEQ ID NO: 848959 - RNA, 22 nt, Human
ccuggcugccgagugugcagcg

SEQ ID NO: 848960 - RNA, 22 nt, Human
cagggucuuauaaggccaauuu

SEQ ID NO: 848961 - RNA, 22 nt, Human
aacuccagggcauugucuccug

SEQ ID NO: 848962 - RNA, 22 nt, Human
uggcacaugguuaaucauaauu

SEQ ID NO: 848963 - RNA, 22 nt, Human
ggccagcagucacagggucaga

SEQ ID NO: 848964 - RNA, 22 nt, Human
uuucuauuuuaaaggcauaugg

SEQ ID NO: 848965 - RNA, 22 nt, Human
uucacagacuuuccauagauug

SEQ ID NO: 848966 - RNA, 22 nt, Human
caguugccuacuacauggcagg

SEQ ID NO: 848967 - RNA, 22 nt, Human
uagcaagaccaauauguagaua

SEQ ID NO: 848968 - RNA, 22 nt, Human
gaaaggcaguacagcugagccu

SEQ ID NO: 848969 - RNA, 22 nt, Human
ugagcagagcaguaacaggagc

SEQ ID NO: 848970 - RNA, 20 nt, Human
ucauuguguugccaauuccc

SEQ ID NO: 848971 - RNA, 22 nt, Human
ucugagccaaaauaaacagcau

SEQ ID NO: 848972 - RNA, 22 nt, Human
acccaggacaugggcacccgug

SEQ ID NO: 848973 - RNA, 22 nt, Human
ugauuuccccagucuugcugcu

SEQ ID NO: 848974 - RNA, 22 nt, Human
acuucuucuucagcugggggau

SEQ ID NO: 848975 - RNA, 17 nt, Human
caggcagacauguaagc

SEQ ID NO: 848976 - RNA, 22 nt, Human
auacacuugaccuggagugaag

SEQ ID NO: 848977 - RNA, 22 nt, Human
ccauggcaauggucagucuauu

SEQ ID NO: 848978 - RNA, 22 nt, Human
ccccaggagcuuguuuuagaga

SEQ ID NO: 848979 - RNA, 22 nt, Human
aucauacacucacauaaacaga

SEQ ID NO: 848980 - RNA, 18 nt, Human
ucagcuggggcugcagcc

SEQ ID NO: 848981 - RNA, 22 nt, Human
ggagggcugagacuggggucug

SEQ ID NO: 848982 - RNA, 22 nt, Human
aggcuccacccuacagagcucc

SEQ ID NO: 848983 - RNA, 22 nt, Human
guaaucguggugguuaauucca

SEQ ID NO: 848984 - RNA, 22 nt, Human
cuggcucaccuccgcuccagca

SEQ ID NO: 848985 - RNA, 22 nt, Human
aaauucacuugccugcuuagcu

SEQ ID NO: 848986 - RNA, 22 nt, Human
gaggcagcauucgcauagacag

SEQ ID NO: 848987 - RNA, 22 nt, Human
ucugagguuaauccugcugcau

SEQ ID NO: 848988 - RNA, 22 nt, Human
agugcuuugaacgaaaggcuga

SEQ ID NO: 848989 - RNA, 22 nt, Human
ugaggcaggacuugcauaaagu

SEQ ID NO: 848990 - RNA, 22 nt, Human
acucaggaaaaauguagugaua

SEQ ID NO: 848991 - RNA, 22 nt, Human
cccaaggaagacgcuugugaua

SEQ ID NO: 848992 - RNA, 22 nt, Human
uauuucagggagaauaaauuug

SEQ ID NO: 848993 - RNA, 20 nt, Human
uuggcagcagcucagccacc

SEQ ID NO: 848994 - RNA, 22 nt, Human
ugaaggccagggauuugcagcc

SEQ ID NO: 848995 - RNA, 22 nt, Human
aaggcugagguagggccuaaaa

SEQ ID NO: 848996 - RNA, 22 nt, Human
cagaggcacaagaaagcaaggc

SEQ ID NO: 848997 - RNA, 22 nt, Human
uggcuucucagaauacucugga

SEQ ID NO: 848998 - RNA, 22 nt, Human
augacaaauucagaccauagca

SEQ ID NO: 848999 - RNA, 22 nt, Human
aggugcuguuugucagcaguuu

SEQ ID NO: 849000 - RNA, 21 nt, Human
uccaggagcacgggacuagga

SEQ ID NO: 849001 - RNA, 22 nt, Human
acuggcaggcugcuggccggcg

SEQ ID NO: 849002 - RNA, 22 nt, Human
caucaucaaaagugacagagaa

SEQ ID NO: 849003 - RNA, 20 nt, Human
augauuuugcacuaacuuca

SEQ ID NO: 849004 - RNA, 22 nt, Human
cgccucagccguggucaucuuc

SEQ ID NO: 849005 - RNA, 22 nt, Human
uuucaguucaguuuauuauauc

SEQ ID NO: 849006 - RNA, 22 nt, Human
uuagccauugucagcacauggc

SEQ ID NO: 849007 - RNA, 22 nt, Human
uucugagacaauugagagucua

SEQ ID NO: 849008 - RNA, 23 nt, Human
cccauuuucauguuaacuccugg

SEQ ID NO: 849009 - RNA, 22 nt, Human
gucaggauuuuaaaaucccagu

SEQ ID NO: 849010 - RNA, 22 nt, Human
gcccaggagccuggagaugugu

SEQ ID NO: 849011 - RNA, 22 nt, Human
agugucauuccagggacccucg

SEQ ID NO: 849012 - RNA, 22 nt, Human
uagggcugccuauggcuagaua

SEQ ID NO: 849013 - RNA, 22 nt, Human
uagacagauuuaaaggaaugga

SEQ ID NO: 849014 - RNA, 22 nt, Human
uaaggccaauuacauauguuca

SEQ ID NO: 849015 - RNA, 22 nt, Human
gcugccucuccugaguugacag

SEQ ID NO: 849016 - RNA, 22 nt, Human
uggcaaacuggaggaagcccug

SEQ ID NO: 849017 - RNA, 21 nt, Human
gcuguugcccgccgccucuuc

SEQ ID NO: 849018 - RNA, 22 nt, Human
gaaauuauugcuagagacugca

SEQ ID NO: 849019 - RNA, 22 nt, Human
gcagaggcuguagggaagguug

SEQ ID NO: 849020 - RNA, 22 nt, Human
gagggcauaguuaaauaggagg

SEQ ID NO: 849021 - RNA, 22 nt, Human
auuuagaacuuuguuugccaau

SEQ ID NO: 849022 - RNA, 22 nt, Human
uuucuucauagaccuugucuug

SEQ ID NO: 849023 - RNA, 22 nt, Human
ucuucagacccuuagcugugau

SEQ ID NO: 849024 - RNA, 22 nt, Human
aagaacuguuuacaauuuucac

SEQ ID NO: 849025 - RNA, 22 nt, Human
ucuucucuacaccagcagcccc

SEQ ID NO: 849026 - RNA, 21 nt, Human
uucuccccagcgaauccucgg

SEQ ID NO: 849027 - RNA, 22 nt, Human
uuggccaaggaaguagcaacgg

SEQ ID NO: 849028 - RNA, 22 nt, Human
aggauauuugcuuaagauagcu

SEQ ID NO: 849029 - RNA, 23 nt, Human
agaugaggcuucuccauguuggu

SEQ ID NO: 849030 - RNA, 21 nt, Human
agaggcaggcauuaaguacac

SEQ ID NO: 849031 - RNA, 22 nt, Human
uuagaaagggugucugaaucug

SEQ ID NO: 849032 - RNA, 22 nt, Human
uggcaacaugucgaagugcugu

SEQ ID NO: 849033 - RNA, 22 nt, Human
aacuucugccaaacagcuguua

SEQ ID NO: 849034 - RNA, 22 nt, Human
auuaggaaauguguugcaagca

SEQ ID NO: 849035 - RNA, 22 nt, Human
cucuccucagaacaggcccucu

SEQ ID NO: 849036 - RNA, 22 nt, Human
cccuggaggcggagcuugcagu

SEQ ID NO: 849037 - RNA, 22 nt, Human
uccaugaguuugaggaaaagag

SEQ ID NO: 849038 - RNA, 22 nt, Human
ugaggcucuccaagcagaugag

SEQ ID NO: 849039 - RNA, 22 nt, Human
auuaguagcuguaauaacuggg

SEQ ID NO: 849040 - RNA, 22 nt, Human
caagagagaugcagcucacuca

SEQ ID NO: 849041 - RNA, 17 nt, Human
uuucuccuuccaucuca

SEQ ID NO: 849042 - RNA, 22 nt, Human
gagggaggugauacugaacgua

SEQ ID NO: 849043 - RNA, 22 nt, Human
uagggaggaggguuuucaaauc

SEQ ID NO: 849044 - RNA, 22 nt, Human
ccugagccuggcucaugcacuc

SEQ ID NO: 849045 - RNA, 22 nt, Human
agaggcaggagguugacuugag

SEQ ID NO: 849046 - RNA, 22 nt, Human
guucucucugcuuccaagaugg

SEQ ID NO: 849047 - RNA, 22 nt, Human
aggauguuaucugugcaggugg

SEQ ID NO: 849048 - RNA, 22 nt, Human
cagagcugcuucccaguuugug

SEQ ID NO: 849049 - RNA, 19 nt, Human
cugaagucuuuucagcugg

SEQ ID NO: 849050 - RNA, 22 nt, Human
uuugaaaggguuaugagacuga

SEQ ID NO: 849051 - RNA, 22 nt, Human
ucugcugugggucuauauuuua

SEQ ID NO: 849052 - RNA, 22 nt, Human
acucagaaugacugaugcugug

SEQ ID NO: 849053 - RNA, 22 nt, Human
guguguuucagaagccaggugu

SEQ ID NO: 849054 - RNA, 22 nt, Human
ccaaaugugccuguuucaacaa

SEQ ID NO: 849055 - RNA, 22 nt, Human
cagcuggcaaguggagcagggu

SEQ ID NO: 849056 - RNA, 20 nt, Human
uucuucucuaguuaucuuca

SEQ ID NO: 849057 - RNA, 22 nt, Human
uuauuuacaacucuucucuucc

SEQ ID NO: 849058 - RNA, 22 nt, Human
cccaggagauaacguucccaag

SEQ ID NO: 849059 - RNA, 22 nt, Human
aguuauuacucuuuaacauauu

SEQ ID NO: 849060 - RNA, 22 nt, Human
gcaggcugcugagauccuuagg

SEQ ID NO: 849061 - RNA, 22 nt, Human
aggccagaaauuuggaguaugu

SEQ ID NO: 849062 - RNA, 19 nt, Human
ugcaagcuuuuucuuguua

SEQ ID NO: 849063 - RNA, 22 nt, Human
uagugcuuuaaguuuacagaga

SEQ ID NO: 849064 - RNA, 22 nt, Human
aaggcagcuucaccacagcauu

SEQ ID NO: 849065 - RNA, 22 nt, Human
uguagaaagaauauguuucaua

SEQ ID NO: 849066 - RNA, 22 nt, Human
cagccuuuuccauguauuguug

SEQ ID NO: 849067 - RNA, 22 nt, Human
auugcuaggaacagguugcacc

SEQ ID NO: 849068 - RNA, 22 nt, Human
aaagauuugaguucugcuuaua

SEQ ID NO: 849069 - RNA, 22 nt, Human
ggcaggcaaugaggaugggaag

SEQ ID NO: 849070 - RNA, 22 nt, Human
cugcugugaguuuggaggucua

SEQ ID NO: 849071 - RNA, 22 nt, Human
gccucugcaauuacauugugcc

SEQ ID NO: 849072 - RNA, 22 nt, Human
gagggccagcagccucagcaug

SEQ ID NO: 849073 - RNA, 22 nt, Human
guucacagaaauuguguaccuc

SEQ ID NO: 849074 - RNA, 22 nt, Human
ccuggccauuugaacuucagac

SEQ ID NO: 849075 - RNA, 22 nt, Human
auuaaauuggacgcugggggaa

SEQ ID NO: 849076 - RNA, 22 nt, Human
gagugucacuugaugcagggca

SEQ ID NO: 849077 - RNA, 22 nt, Human
gaggcagcagggcugguuccuu

SEQ ID NO: 849078 - RNA, 23 nt, Human
uauacacauguggcaguauagug

SEQ ID NO: 849079 - RNA, 22 nt, Human
gagagucuagugcaccuaguuu

SEQ ID NO: 849080 - RNA, 22 nt, Human
agugcuuuauguuguugugcaa

SEQ ID NO: 849081 - RNA, 22 nt, Human
acaggcuggugguccuggccau

SEQ ID NO: 849082 - RNA, 17 nt, Human
gagacagcaggagcccc

SEQ ID NO: 849083 - RNA, 22 nt, Human
agacaggaugcauacucuuggu

SEQ ID NO: 849084 - RNA, 22 nt, Human
gccuccccaaagugcugacagc

SEQ ID NO: 849085 - RNA, 21 nt, Human
uaaggccaagucuauuucugu

SEQ ID NO: 849086 - RNA, 22 nt, Human
cugccuuugaaaguucuguuga

SEQ ID NO: 849087 - RNA, 22 nt, Human
uucuuaacucaaauauauaucc

SEQ ID NO: 849088 - RNA, 22 nt, Human
acaguuaucuuugaaauagaga

SEQ ID NO: 849089 - RNA, 22 nt, Human
auuagagcaguguauuaugaua

SEQ ID NO: 849090 - RNA, 22 nt, Human
ccugccucccagagguccucua

SEQ ID NO: 849091 - RNA, 22 nt, Human
uggcucagccauucguguugcc

SEQ ID NO: 849092 - RNA, 22 nt, Human
uggaaggaaagguagcagagaa

SEQ ID NO: 849093 - RNA, 22 nt, Human
uuuacuuuugguaaggucauuu

SEQ ID NO: 849094 - RNA, 22 nt, Human
cucugcaugccuugcucagaca

SEQ ID NO: 849095 - RNA, 22 nt, Human
uuggcaucaguguaggaccugu

SEQ ID NO: 849096 - RNA, 22 nt, Human
uugcugaaguuaaugcuugcaa

SEQ ID NO: 849097 - RNA, 22 nt, Human
gcugccugcucacccggccugg

SEQ ID NO: 849098 - RNA, 22 nt, Human
ggagggaaugucuagcauucuu

SEQ ID NO: 849099 - RNA, 22 nt, Human
uucaugcuuuuaccgcuguuaa

SEQ ID NO: 849100 - RNA, 22 nt, Human
auuuuacuuugugaauauugac

SEQ ID NO: 849101 - RNA, 22 nt, Human
ccugguggcgaauggugguagg

SEQ ID NO: 849102 - RNA, 21 nt, Human
auaagcaugcugauuacauuu

SEQ ID NO: 849103 - RNA, 22 nt, Human
aaaggugacugcagcagcuauu

SEQ ID NO: 849104 - RNA, 22 nt, Human
acaggcagcaaaaucagccuca

SEQ ID NO: 849105 - RNA, 19 nt, Human
agaggcagucuccaacagg

SEQ ID NO: 849106 - RNA, 22 nt, Human
ucagagaguuacacaaauuguu

SEQ ID NO: 849107 - RNA, 22 nt, Human
ucuucuccagugcuucugcaca

SEQ ID NO: 849108 - RNA, 22 nt, Human
aaucuauaugcuuuucacauac

SEQ ID NO: 849109 - RNA, 22 nt, Human
uucaggauucucucccauuuac

SEQ ID NO: 849110 - RNA, 22 nt, Human
gaaauauucuugucuuguuuuc

SEQ ID NO: 849111 - RNA, 22 nt, Human
agugcugacucugggcacagug

SEQ ID NO: 849112 - RNA, 18 nt, Human
aggccaaacuuguaagca

SEQ ID NO: 849113 - RNA, 22 nt, Human
ucaggcugauuucuuuugaggg

SEQ ID NO: 849114 - RNA, 22 nt, Human
augaaggcuguguggagccccc

SEQ ID NO: 849115 - RNA, 22 nt, Human
auacaacagaaaaugauuauuc

SEQ ID NO: 849116 - RNA, 22 nt, Human
ucugcuguaaagaauuucugcc

SEQ ID NO: 849117 - RNA, 22 nt, Human
uuucaguguaucuuccaaaagc

SEQ ID NO: 849118 - RNA, 22 nt, Human
cugucuggauauaccuuggcca

SEQ ID NO: 849119 - RNA, 22 nt, Human
agaggccggccgagcccauggg

SEQ ID NO: 849120 - RNA, 22 nt, Human
cagcaagagaggcagggcaaau

SEQ ID NO: 849121 - RNA, 22 nt, Human
ucuuuccaaggacucuguagca

SEQ ID NO: 849122 - RNA, 22 nt, Human
uagaaagagcauaguauuauaa

SEQ ID NO: 849123 - RNA, 22 nt, Human
caaggccauaagagauacaaaa

SEQ ID NO: 849124 - RNA, 22 nt, Human
cacaggagagcugggaggugcc

SEQ ID NO: 849125 - RNA, 22 nt, Human
uggcugaggcuuuucuuaaaga

SEQ ID NO: 849126 - RNA, 22 nt, Human
aauccugugugacucuggggag

SEQ ID NO: 849127 - RNA, 22 nt, Human
gagggcguucagucagugucuc

SEQ ID NO: 849128 - RNA, 22 nt, Human
uuuuaucuucauuccuaucuac

SEQ ID NO: 849129 - RNA, 22 nt, Human
cccaggaaaagcagugccagca

SEQ ID NO: 849130 - RNA, 22 nt, Human
uucaggauucugugucugacaa

SEQ ID NO: 849131 - RNA, 22 nt, Human
cagcaggaggugaguagcaggu

SEQ ID NO: 849132 - RNA, 22 nt, Human
aggagacauaacuaugaugaga

SEQ ID NO: 849133 - RNA, 22 nt, Human
cucuggcuucuaccuugcaguu

SEQ ID NO: 849134 - RNA, 22 nt, Human
ucugcagguguuggaaggguca

SEQ ID NO: 849135 - RNA, 22 nt, Human
ggugaaggucagagcaggaaaa

SEQ ID NO: 849136 - RNA, 22 nt, Human
ccaggagacccagggaaggagc

SEQ ID NO: 849137 - RNA, 22 nt, Human
aauuuguuaaaagugagugaca

SEQ ID NO: 849138 - RNA, 22 nt, Human
cugaggccggagcacugaagag

SEQ ID NO: 849139 - RNA, 22 nt, Human
aggaagcugccugggaugggaa

SEQ ID NO: 849140 - RNA, 22 nt, Human
ccuggccacagggcucugcauu

SEQ ID NO: 849141 - RNA, 22 nt, Human
gcagacagcauguugggcuauu

SEQ ID NO: 849142 - RNA, 22 nt, Human
gaauuauaggcaaagcagucau

SEQ ID NO: 849143 - RNA, 22 nt, Human
auaucacaguaguuguuuaguu

SEQ ID NO: 849144 - RNA, 22 nt, Human
gugcugaggugggugggcagcc

SEQ ID NO: 849145 - RNA, 22 nt, Human
gccaugaggaacuguaagacaa

SEQ ID NO: 849146 - RNA, 22 nt, Human
gaggcagcugggcuggugguuu

SEQ ID NO: 849147 - RNA, 22 nt, Human
gacccaggguauccagagcugc

SEQ ID NO: 849148 - RNA, 22 nt, Human
cugccucacauuggcuguguga

SEQ ID NO: 849149 - RNA, 22 nt, Human
auugaggcagcauaguucaggg

SEQ ID NO: 849150 - RNA, 22 nt, Human
gagcugagcagggagccucacu

SEQ ID NO: 849151 - RNA, 22 nt, Human
cagauaaauagacuuggucaga

SEQ ID NO: 849152 - RNA, 22 nt, Human
uuucagggagccuagaagagcu

SEQ ID NO: 849153 - RNA, 22 nt, Human
ugaggggagacagaguggacuc

SEQ ID NO: 849154 - RNA, 22 nt, Human
cuccacagcucaggcucagagu

SEQ ID NO: 849155 - RNA, 20 nt, Human
gcccaggaucucugaggcau

SEQ ID NO: 849156 - RNA, 23 nt, Human
ccacuagcaccuguucaacuucu

SEQ ID NO: 849157 - RNA, 22 nt, Human
uuaauuaaauucaugagcauug

SEQ ID NO: 849158 - RNA, 22 nt, Human
uuuuaguuguacugucaacagu

SEQ ID NO: 849159 - RNA, 22 nt, Human
uggcugaguucuccaggaguag

SEQ ID NO: 849160 - RNA, 22 nt, Human
agaccaagaaaggaugaggauc

SEQ ID NO: 849161 - RNA, 18 nt, Human
gaggcagcuagcaauuuu

SEQ ID NO: 849162 - RNA, 22 nt, Human
uuuggacuuagccugcagaauu

SEQ ID NO: 849163 - RNA, 22 nt, Human
aaagauuauggcauugaaauac

SEQ ID NO: 849164 - RNA, 22 nt, Human
cugccaccaugccccagcagag

SEQ ID NO: 849165 - RNA, 22 nt, Human
uugcuuuguuacugcaguuucc

SEQ ID NO: 849166 - RNA, 22 nt, Human
ggagaggauguuuuaguaacuu

SEQ ID NO: 849167 - RNA, 22 nt, Human
ggcagaggaggggugaauuugc

SEQ ID NO: 849168 - RNA, 22 nt, Human
ccaggagauaagcugaguuuau

SEQ ID NO: 849169 - RNA, 22 nt, Human
ugcugaugaguccuucuaucgc

SEQ ID NO: 849170 - RNA, 22 nt, Human
uccauucauucauugaugaaca

SEQ ID NO: 849171 - RNA, 22 nt, Human
ugcaccuuguugcuuuuacgaa

SEQ ID NO: 849172 - RNA, 22 nt, Human
ggaggggaggauuaaugacaaa

SEQ ID NO: 849173 - RNA, 22 nt, Human
ugcugagggcuguuaaggaagc

SEQ ID NO: 849174 - RNA, 22 nt, Human
ucauuuuucacacagggucacc

SEQ ID NO: 849175 - RNA, 22 nt, Human
aggcggcuccgggagugugggc

SEQ ID NO: 849176 - RNA, 22 nt, Human
cagcagagcugggcuuugaauu

SEQ ID NO: 849177 - RNA, 22 nt, Human
cagcugcuguuacugcuuauua

SEQ ID NO: 849178 - RNA, 22 nt, Human
gcaagcugcucuuauguggagg

SEQ ID NO: 849179 - RNA, 22 nt, Human
cuguaugaggaucagacuggac

SEQ ID NO: 849180 - RNA, 22 nt, Human
uucaggauccccuugaugggcu

SEQ ID NO: 849181 - RNA, 22 nt, Human
agaccauagggaccucagguug

SEQ ID NO: 849182 - RNA, 22 nt, Human
aaggcugaguaaaacagagaac

SEQ ID NO: 849183 - RNA, 22 nt, Human
gcuggccaaaguguaccuggag

SEQ ID NO: 849184 - RNA, 19 nt, Human
ucuuggcuuugucuacugu

SEQ ID NO: 849185 - RNA, 22 nt, Human
ccacugcuaacuugcugcagcu

SEQ ID NO: 849186 - RNA, 22 nt, Human
ucuaagccuaggaaaugaguuu

SEQ ID NO: 849187 - RNA, 22 nt, Human
cuggcgcaacagaaaaucugga

SEQ ID NO: 849188 - RNA, 19 nt, Human
agucuuucccacucgucuu

SEQ ID NO: 849189 - RNA, 22 nt, Human
caggagaggcuguacguuucuc

SEQ ID NO: 849190 - RNA, 22 nt, Human
ccucaugguacuuacuguagcu

SEQ ID NO: 849191 - RNA, 22 nt, Human
ugcaccuuguccauuuuuggcc

SEQ ID NO: 849192 - RNA, 22 nt, Human
cccugccuugggguccacaccg

SEQ ID NO: 849193 - RNA, 22 nt, Human
ugugugucagagucuccauggu

SEQ ID NO: 849194 - RNA, 22 nt, Human
gcugccuggaauaacggcuggc

SEQ ID NO: 849195 - RNA, 22 nt, Human
uggcagcugaggggaggcuuug

SEQ ID NO: 849196 - RNA, 22 nt, Human
cccaggagguggaguucacagu

SEQ ID NO: 849197 - RNA, 22 nt, Human
cuuugaauugccguuucaucug

SEQ ID NO: 849198 - RNA, 22 nt, Human
uuuaagauucaguaaggcaaac

SEQ ID NO: 849199 - RNA, 22 nt, Human
gcgucugaguugcgggggcuca

SEQ ID NO: 849200 - RNA, 22 nt, Human
ccuccuggauggauuuggugga

SEQ ID NO: 849201 - RNA, 22 nt, Human
caucacccggaacugugucugc

SEQ ID NO: 849202 - RNA, 22 nt, Human
auucuucacaccuguuccuguu

SEQ ID NO: 849203 - RNA, 21 nt, Human
uucugggaaaugagcuggggc

SEQ ID NO: 849204 - RNA, 22 nt, Human
cagugcugugcuggaagcuguu

SEQ ID NO: 849205 - RNA, 22 nt, Human
aucugccuccaaguccaugugu

SEQ ID NO: 849206 - RNA, 22 nt, Human
ggaggggucucuagcgaggaga

SEQ ID NO: 849207 - RNA, 22 nt, Human
aagggcagaauagagaagaugg

SEQ ID NO: 849208 - RNA, 22 nt, Human
gugcauuuaggucacaugaugu

SEQ ID NO: 849209 - RNA, 22 nt, Human
cuacccagagugaaucucuuaa

SEQ ID NO: 849210 - RNA, 22 nt, Human
gcucaggaaauaguuuaguguu

SEQ ID NO: 849211 - RNA, 22 nt, Human
auccagucaaaauuaguaaggu

SEQ ID NO: 849212 - RNA, 22 nt, Human
uguggaaaauuggaacguuccu

SEQ ID NO: 849213 - RNA, 22 nt, Human
agaagucauuuauguuagauga

SEQ ID NO: 849214 - RNA, 22 nt, Human
cagagggcacaugguuuccuca

SEQ ID NO: 849215 - RNA, 23 nt, Human
uugcuuucaucaugagaugcucc

SEQ ID NO: 849216 - RNA, 22 nt, Human
aauguauuccucaugcaagagu

SEQ ID NO: 849217 - RNA, 22 nt, Human
ggcugagcaauuuugaugacau

SEQ ID NO: 849218 - RNA, 22 nt, Human
uggcagcuggcucugcgcaggc

SEQ ID NO: 849219 - RNA, 22 nt, Human
agucugaguaucucugagccag

SEQ ID NO: 849220 - RNA, 22 nt, Human
ucuggagaagcagugagaguca

SEQ ID NO: 849221 - RNA, 22 nt, Human
guuagagcacauacuuugcaug

SEQ ID NO: 849222 - RNA, 17 nt, Human
uggcagcugaaagcucu

SEQ ID NO: 849223 - RNA, 22 nt, Human
uugugaguagugccgcaauaaa

SEQ ID NO: 849224 - RNA, 22 nt, Human
cagcagagaccaagugauuuga

SEQ ID NO: 849225 - RNA, 21 nt, Human
ugcugcugaucgggguuggcu

SEQ ID NO: 849226 - RNA, 22 nt, Human
uccuggcccucugcaaacgcca

SEQ ID NO: 849227 - RNA, 22 nt, Human
ccaggagaugauguuggggauu

SEQ ID NO: 849228 - RNA, 22 nt, Human
agugagggaugaagaacugcgg

SEQ ID NO: 849229 - RNA, 22 nt, Human
acaggagacccugcugguucug

SEQ ID NO: 849230 - RNA, 21 nt, Human
uucugagcacucaucacuguc

SEQ ID NO: 849231 - RNA, 22 nt, Human
aggucagcaugaguagaaggua

SEQ ID NO: 849232 - RNA, 20 nt, Human
augugucuguaaacaacucu

SEQ ID NO: 849233 - RNA, 22 nt, Human
gaaauacuguaaaguuauuauu

SEQ ID NO: 849234 - RNA, 22 nt, Human
uaagauuauacuuaaagagaaa

SEQ ID NO: 849235 - RNA, 22 nt, Human
agaggggaguccuaaucugauu

SEQ ID NO: 849236 - RNA, 21 nt, Human
cggccaaauuccuccuaggga

SEQ ID NO: 849237 - RNA, 22 nt, Human
auauacuuccccauuauggggg

SEQ ID NO: 849238 - RNA, 22 nt, Human
cagaggcauacucccagucuug

SEQ ID NO: 849239 - RNA, 22 nt, Human
gcugaggugaggcuggaaagga

SEQ ID NO: 849240 - RNA, 22 nt, Human
cugggccagcaacugcaaugga

SEQ ID NO: 849241 - RNA, 22 nt, Human
ccugccugcaccuucucugggg

SEQ ID NO: 849242 - RNA, 22 nt, Human
cuucagaagccugcagccuuug

SEQ ID NO: 849243 - RNA, 22 nt, Human
ccuggccacccagccuuggcca

SEQ ID NO: 849244 - RNA, 22 nt, Human
gagggcugugaaggagcggguu

SEQ ID NO: 849245 - RNA, 22 nt, Human
uuccaugaaggagacugagaag

SEQ ID NO: 849246 - RNA, 22 nt, Human
uuuaaauuauaguuaaugucug

SEQ ID NO: 849247 - RNA, 22 nt, Human
auuggcagaaacagcagggcca

SEQ ID NO: 849248 - RNA, 22 nt, Human
acuuucugucaucuagacaagu

SEQ ID NO: 849249 - RNA, 22 nt, Human
gguggaguaauucgcagagguu

SEQ ID NO: 849250 - RNA, 22 nt, Human
gggagucugggcuagacuccuu

SEQ ID NO: 849251 - RNA, 23 nt, Human
acugucugauauguuuuccauca

SEQ ID NO: 849252 - RNA, 22 nt, Human
aaagaaauagauggcauuuaaa

SEQ ID NO: 849253 - RNA, 23 nt, Human
cuuugccacccagagccugacag

SEQ ID NO: 849254 - RNA, 22 nt, Human
caggcagcaggagcccugcucg

SEQ ID NO: 849255 - RNA, 22 nt, Human
aggcaguuguugcugagcagcu

SEQ ID NO: 849256 - RNA, 22 nt, Human
ugaggccagcuucagcagugga

SEQ ID NO: 849257 - RNA, 22 nt, Human
ugacauuauuaucaugucacca

SEQ ID NO: 849258 - RNA, 22 nt, Human
aggcagugcucaagacagcagc

SEQ ID NO: 849259 - RNA, 22 nt, Human
cagucuuuguucccauuacuga

SEQ ID NO: 849260 - RNA, 22 nt, Human
gagcuguccaagauggucguaa

SEQ ID NO: 849261 - RNA, 22 nt, Human
uggcugagggggcaguucagga

SEQ ID NO: 849262 - RNA, 22 nt, Human
ugccaggauggccagggggcca

SEQ ID NO: 849263 - RNA, 22 nt, Human
uauuagguuggugcaacaguaa

SEQ ID NO: 849264 - RNA, 22 nt, Human
ugaggcucagagcaccugcucc

SEQ ID NO: 849265 - RNA, 22 nt, Human
acuccuggggauccauuccuuu

SEQ ID NO: 849266 - RNA, 22 nt, Human
agaaaugaagcaggaguuauua

SEQ ID NO: 849267 - RNA, 22 nt, Human
uaagaugaccuuauaaagagca

SEQ ID NO: 849268 - RNA, 22 nt, Human
accaggagguguuugcucaagu

SEQ ID NO: 849269 - RNA, 17 nt, Human
gcugagaggcagcacag

SEQ ID NO: 849270 - RNA, 21 nt, Human
acauuauaauucauauuccac

SEQ ID NO: 849271 - RNA, 22 nt, Human
ucucuucuaauuuucccgagua

SEQ ID NO: 849272 - RNA, 22 nt, Human
gcuccugggcccugggcuaacu

SEQ ID NO: 849273 - RNA, 22 nt, Human
ugucaccaaguugaugaaugca

SEQ ID NO: 849274 - RNA, 22 nt, Human
uaaauuaaagauuggagaagga

SEQ ID NO: 849275 - RNA, 22 nt, Human
ggauguugauugaauggccauu

SEQ ID NO: 849276 - RNA, 22 nt, Human
cugagguaugugggacuagccu

SEQ ID NO: 849277 - RNA, 22 nt, Human
acuccuggguugcaguccucaa

SEQ ID NO: 849278 - RNA, 19 nt, Human
ucucacaguuuccuugccu

SEQ ID NO: 849279 - RNA, 22 nt, Human
ugcuggaauaauuucauguuaa

SEQ ID NO: 849280 - RNA, 22 nt, Human
ugucugccugcgggccggcaca

SEQ ID NO: 849281 - RNA, 22 nt, Human
aggcugaggaucccuguguucu

SEQ ID NO: 849282 - RNA, 22 nt, Human
aguggcagagguugacugcagu

SEQ ID NO: 849283 - RNA, 22 nt, Human
aaaccgcaauuacuuuugcguc

SEQ ID NO: 849284 - RNA, 22 nt, Human
aggagcagcuucugaaccaugu

SEQ ID NO: 849285 - RNA, 23 nt, Human
ugucuggcucauggugggucuca

SEQ ID NO: 849286 - RNA, 22 nt, Human
gaggccagaguuccccgaguca

SEQ ID NO: 849287 - RNA, 22 nt, Human
uuuccaagagcuuauuucugaa

SEQ ID NO: 849288 - RNA, 22 nt, Human
aaaguauuugugauuuuuacca

SEQ ID NO: 849289 - RNA, 22 nt, Human
gcuccucugucaaaugagagug

SEQ ID NO: 849290 - RNA, 22 nt, Human
gagggagggccaggucccaacc

SEQ ID NO: 849291 - RNA, 22 nt, Human
caggcugccgugggguccaggc

SEQ ID NO: 849292 - RNA, 23 nt, Human
gcugccucuguuggucuucaguu

SEQ ID NO: 849293 - RNA, 22 nt, Human
uuugacauggaauaacucauuu

SEQ ID NO: 849294 - RNA, 22 nt, Human
uuugcauaaaggagcauuucuc

SEQ ID NO: 849295 - RNA, 22 nt, Human
gcaggcugagaguccaagaagg

SEQ ID NO: 849296 - RNA, 22 nt, Human
uuagaaaggagcuuauuucuuu

SEQ ID NO: 849297 - RNA, 21 nt, Human
aguugcugcugcugcagguga

SEQ ID NO: 849298 - RNA, 22 nt, Human
uuucacaaaugucuuuaacuug

SEQ ID NO: 849299 - RNA, 22 nt, Human
cuuuggcagccucugcuauuga

SEQ ID NO: 849300 - RNA, 22 nt, Human
uuugaaaggugucgagaugugu

SEQ ID NO: 849301 - RNA, 22 nt, Human
ugaggcucacgaacagaagacu

SEQ ID NO: 849302 - RNA, 22 nt, Human
aaugcauauguaggcaagcagu

SEQ ID NO: 849303 - RNA, 16 nt, Human
ccccaggacuuggcac

SEQ ID NO: 849304 - RNA, 22 nt, Human
ugcccugggaacacagaugcca

SEQ ID NO: 849305 - RNA, 22 nt, Human
uggcuucucaaaauaacugguu

SEQ ID NO: 849306 - RNA, 22 nt, Human
auguucuuucagccagugcauc

SEQ ID NO: 849307 - RNA, 22 nt, Human
gccaggagaaaaggcgaaugau

SEQ ID NO: 849308 - RNA, 22 nt, Human
aucugccugagucuagguuuuc

SEQ ID NO: 849309 - RNA, 22 nt, Human
uccugccucuccaugcuaacua

SEQ ID NO: 849310 - RNA, 22 nt, Human
cagcuguggcugccacugcucc

SEQ ID NO: 849311 - RNA, 20 nt, Human
uccaggagguuaguguggcu

SEQ ID NO: 849312 - RNA, 18 nt, Human
gcagaugaguaguguacc

SEQ ID NO: 849313 - RNA, 22 nt, Human
agcauaaguugguacagccacu

SEQ ID NO: 849314 - RNA, 22 nt, Human
uuucaguuacugcuauaucauu

SEQ ID NO: 849315 - RNA, 22 nt, Human
cuccuggaagcccgcccugcug

SEQ ID NO: 849316 - RNA, 22 nt, Human
agagggcagggcgguaaguccu

SEQ ID NO: 849317 - RNA, 22 nt, Human
gaaaggccagcucacagaugag

SEQ ID NO: 849318 - RNA, 22 nt, Human
ucagggugaaccaggcaggaau

SEQ ID NO: 849319 - RNA, 22 nt, Human
aggaaaacacaguauugaugga

SEQ ID NO: 849320 - RNA, 22 nt, Human
uucucuuuugugaugugagaug

SEQ ID NO: 849321 - RNA, 22 nt, Human
uucagaaagugaaucuuguuau

SEQ ID NO: 849322 - RNA, 22 nt, Human
ugaggcccucugggcugguccu

SEQ ID NO: 849323 - RNA, 22 nt, Human
ggagaggggcaaguuuaucuag

SEQ ID NO: 849324 - RNA, 22 nt, Human
cccuggagcuagucugagcaga

SEQ ID NO: 849325 - RNA, 22 nt, Human
ccaggagauuuuuccauagcac

SEQ ID NO: 849326 - RNA, 23 nt, Human
cagggcugguagggaagagcgug

SEQ ID NO: 849327 - RNA, 22 nt, Human
guucuucagucacaucacagaa

SEQ ID NO: 849328 - RNA, 22 nt, Human
cacagcaauagcuaacugauac

SEQ ID NO: 849329 - RNA, 22 nt, Human
caaauaguaugagcaaugauuc

SEQ ID NO: 849330 - RNA, 22 nt, Human
uucauucuuauuugugaucugg

SEQ ID NO: 849331 - RNA, 22 nt, Human
auuuauuaugggauuuggcaca

SEQ ID NO: 849332 - RNA, 22 nt, Human
cugagccaugagccugcgccca

SEQ ID NO: 849333 - RNA, 22 nt, Human
uaacugguuaagggugaaaucc

SEQ ID NO: 849334 - RNA, 22 nt, Human
uuugaaauaugaggcauuauga

SEQ ID NO: 849335 - RNA, 22 nt, Human
uguuugaauuuugcuaacgugu

SEQ ID NO: 849336 - RNA, 22 nt, Human
ucaggaauccagacagggcaca

SEQ ID NO: 849337 - RNA, 22 nt, Human
aaggagagguuguccguguugu

SEQ ID NO: 849338 - RNA, 19 nt, Human
ccuggcucugagcccagcc

SEQ ID NO: 849339 - RNA, 22 nt, Human
ucuccuggucaccucagaaguc

SEQ ID NO: 849340 - RNA, 22 nt, Human
gugcugagcaucaugaggcacu

SEQ ID NO: 849341 - RNA, 22 nt, Human
ucuuuauuuaagucuguuguaa

SEQ ID NO: 849342 - RNA, 20 nt, Human
uccaugaguuagagacuaua

SEQ ID NO: 849343 - RNA, 22 nt, Human
cugggucccacagccugcuggg

SEQ ID NO: 849344 - RNA, 22 nt, Human
cugaggucaauuaaucaacaac

SEQ ID NO: 849345 - RNA, 22 nt, Human
auuauuauauagggaaaguccc

SEQ ID NO: 849346 - RNA, 22 nt, Human
cucaguuucuuacucuguauaa

SEQ ID NO: 849347 - RNA, 22 nt, Human
cauuguuaauugguaucuuaca

SEQ ID NO: 849348 - RNA, 22 nt, Human
caaaugaagguggugggucauu

SEQ ID NO: 849349 - RNA, 22 nt, Human
uggcuucugguuuauccuuaua

SEQ ID NO: 849350 - RNA, 22 nt, Human
ucagcugcucaaauuuauguca

SEQ ID NO: 849351 - RNA, 18 nt, Human
ggucuuuaggucaguguc

SEQ ID NO: 849352 - RNA, 22 nt, Human
cacaugaguccugccagguaug

SEQ ID NO: 849353 - RNA, 17 nt, Human
acucaggaucugggagu

SEQ ID NO: 849354 - RNA, 22 nt, Human
aucagcugcuacauuggccucu

SEQ ID NO: 849355 - RNA, 22 nt, Human
gacuuucuugcagaaauauucc

SEQ ID NO: 849356 - RNA, 22 nt, Human
acccagaggcggagguugcagu

SEQ ID NO: 849357 - RNA, 22 nt, Human
uugaaggacauccuauuucuag

SEQ ID NO: 849358 - RNA, 22 nt, Human
gguuugaacagcuuuggagaag

SEQ ID NO: 849359 - RNA, 22 nt, Human
acugagguagggcacaccuagg

SEQ ID NO: 849360 - RNA, 22 nt, Human
gucuucaacaauaacuaccacu

SEQ ID NO: 849361 - RNA, 22 nt, Human
aucugcagaggacaggcgagga

SEQ ID NO: 849362 - RNA, 22 nt, Human
gcaucuaaauaaacgugggagu

SEQ ID NO: 849363 - RNA, 22 nt, Human
uggcagcugagugcacccccuc

SEQ ID NO: 849364 - RNA, 22 nt, Human
cccaggagacauauagaaggac

SEQ ID NO: 849365 - RNA, 22 nt, Human
gcuggcuugauaguuucugcuu

SEQ ID NO: 849366 - RNA, 22 nt, Human
gcaugucaugucauguaggaau

SEQ ID NO: 849367 - RNA, 22 nt, Human
cuguggaaggccuguccugaaa

SEQ ID NO: 849368 - RNA, 22 nt, Human
ggaggggagauguuugggcuca

SEQ ID NO: 849369 - RNA, 18 nt, Human
uggcagcuagguaaagaa

SEQ ID NO: 849370 - RNA, 22 nt, Human
uagugcuugagucucuccguac

SEQ ID NO: 849371 - RNA, 22 nt, Human
gcugaggcugggagcagccugu

SEQ ID NO: 849372 - RNA, 22 nt, Human
ucaggcuggggugcuaaggugu

SEQ ID NO: 849373 - RNA, 22 nt, Human
gaggccaggaagcccaagauca

SEQ ID NO: 849374 - RNA, 22 nt, Human
aaggcugaggcagugaggcaga

SEQ ID NO: 849375 - RNA, 22 nt, Human
cugcuuugauuagaagaguaca

SEQ ID NO: 849376 - RNA, 22 nt, Human
acuggccaugggauuuauauuu

SEQ ID NO: 849377 - RNA, 22 nt, Human
gcaggcugugguauguugggca

SEQ ID NO: 849378 - RNA, 22 nt, Human
ggcugcagggcagcuggugugg

SEQ ID NO: 849379 - RNA, 22 nt, Human
cugagggugcuauucuugccuu

SEQ ID NO: 849380 - RNA, 22 nt, Human
cuggcaguguccagcucgugau

SEQ ID NO: 849381 - RNA, 22 nt, Human
uaaggccauuauggugggcccg

SEQ ID NO: 849382 - RNA, 22 nt, Human
ucugggaacacacgucacuuca

SEQ ID NO: 849383 - RNA, 22 nt, Human
uguucauuuggcccuuuuguau

SEQ ID NO: 849384 - RNA, 22 nt, Human
gcaggagagccagcaggcuucc

SEQ ID NO: 849385 - RNA, 22 nt, Human
ugugaacuggcagguggacggg

SEQ ID NO: 849386 - RNA, 22 nt, Human
ugcugagggcagaugaauuaga

SEQ ID NO: 849387 - RNA, 21 nt, Human
ccaggcuggccaugguauuga

SEQ ID NO: 849388 - RNA, 22 nt, Human
cugagauggaguuucgcucuuc

SEQ ID NO: 849389 - RNA, 22 nt, Human
uggcugagccacuuguucagau

SEQ ID NO: 849390 - RNA, 22 nt, Human
aagggcugagcacagugagcca

SEQ ID NO: 849391 - RNA, 22 nt, Human
accccagaggcggaggcugcag

SEQ ID NO: 849392 - RNA, 22 nt, Human
auuugcuuucagguauaaaagg

SEQ ID NO: 849393 - RNA, 22 nt, Human
gcuccucuucucccacugaaug

SEQ ID NO: 849394 - RNA, 21 nt, Human
uuucuucacuuugccccaugu

SEQ ID NO: 849395 - RNA, 22 nt, Human
uggcagcugguacagugggucu

SEQ ID NO: 849396 - RNA, 22 nt, Human
ucauuauccuaguaucuugaau

SEQ ID NO: 849397 - RNA, 22 nt, Human
gaggcagcugaagcuucaaaga

SEQ ID NO: 849398 - RNA, 22 nt, Human
guauuaggaaauaugaagaaag

SEQ ID NO: 849399 - RNA, 22 nt, Human
aaacuggugucacugagggcug

SEQ ID NO: 849400 - RNA, 22 nt, Human
ucuaagaucuacuauacaugug

SEQ ID NO: 849401 - RNA, 22 nt, Human
cugccuggguucaaguccuguu

SEQ ID NO: 849402 - RNA, 22 nt, Human
agcuggcagcucucagggguac

SEQ ID NO: 849403 - RNA, 22 nt, Human
aaggcagcagugcacgacugau

SEQ ID NO: 849404 - RNA, 22 nt, Human
ccagguaggagagagggauccu

SEQ ID NO: 849405 - RNA, 21 nt, Human
auggagggaccagggaagcag

SEQ ID NO: 849406 - RNA, 22 nt, Human
gaucuucuagcagaaguaauuu

SEQ ID NO: 849407 - RNA, 22 nt, Human
caugcugugugguuagaacugu

SEQ ID NO: 849408 - RNA, 22 nt, Human
aacuuucuccagugccaacuau

SEQ ID NO: 849409 - RNA, 22 nt, Human
uggcagaguucgcugugccuuu

SEQ ID NO: 849410 - RNA, 22 nt, Human
uucauucuugucuuuguauagu

SEQ ID NO: 849411 - RNA, 22 nt, Human
aggcugugaacucuaugcugaa

SEQ ID NO: 849412 - RNA, 17 nt, Human
gaggacagggaaguagg

SEQ ID NO: 849413 - RNA, 22 nt, Human
agagcagauggagcuggaagag

SEQ ID NO: 849414 - RNA, 19 nt, Human
uuagccauccacagugaaa

SEQ ID NO: 849415 - RNA, 22 nt, Human
cagcugaguuacucugaggucu

SEQ ID NO: 849416 - RNA, 22 nt, Human
ccaggaaaauaccaagcuuuaa

SEQ ID NO: 849417 - RNA, 23 nt, Human
uucauuugucuacuucacuuguu

SEQ ID NO: 849418 - RNA, 22 nt, Human
ugaggcaggaauggggaaaagu

SEQ ID NO: 849419 - RNA, 21 nt, Human
ggcugcagggagcccuggggu

SEQ ID NO: 849420 - RNA, 22 nt, Human
uaauuauaaacugcaguaggua

SEQ ID NO: 849421 - RNA, 23 nt, Human
aaugauuucaugaugauagcagc

SEQ ID NO: 849422 - RNA, 20 nt, Human
cugagcccccagccugcagg

SEQ ID NO: 849423 - RNA, 22 nt, Human
uccuggcccgaucccugugaag

SEQ ID NO: 849424 - RNA, 22 nt, Human
uuacacaacaucuguauuauua

SEQ ID NO: 849425 - RNA, 22 nt, Human
acccaggaugauaauguucaca

SEQ ID NO: 849426 - RNA, 22 nt, Human
caaauguaaauucuuuugaagc

SEQ ID NO: 849427 - RNA, 22 nt, Human
agcugagguuaguauaaaugug

SEQ ID NO: 849428 - RNA, 22 nt, Human
agggcaguucaacuucauagug

SEQ ID NO: 849429 - RNA, 22 nt, Human
aucauucuagcuguuguguuga

SEQ ID NO: 849430 - RNA, 22 nt, Human
uaucuaaauggaauauuccaga

SEQ ID NO: 849431 - RNA, 17 nt, Human
gcugacccuggagaagu

SEQ ID NO: 849432 - RNA, 22 nt, Human
auguuuccauuuucuuguauca

SEQ ID NO: 849433 - RNA, 22 nt, Human
ucagucucuggggcuucuguuu

SEQ ID NO: 849434 - RNA, 22 nt, Human
auaaucuuucuuuuccagauag

SEQ ID NO: 849435 - RNA, 22 nt, Human
gcugagagcaaggacaaagcau

SEQ ID NO: 849436 - RNA, 22 nt, Human
aggcagauuuaggagaaaagaa

SEQ ID NO: 849437 - RNA, 23 nt, Human
aacuccugaaucgugagccaucu

SEQ ID NO: 849438 - RNA, 22 nt, Human
uguccccagguccucugccguc

SEQ ID NO: 849439 - RNA, 20 nt, Human
acaggggcagcacaauaaug

SEQ ID NO: 849440 - RNA, 22 nt, Human
gucauauacacugcauguaauc

SEQ ID NO: 849441 - RNA, 22 nt, Human
ccucaggaaccacauugcugcu

SEQ ID NO: 849442 - RNA, 22 nt, Human
caacuccuggcuguuaggcaca

SEQ ID NO: 849443 - RNA, 22 nt, Human
aaggcagcaagaauuccagguu

SEQ ID NO: 849444 - RNA, 22 nt, Human
aaugccuuggagagccuagagg

SEQ ID NO: 849445 - RNA, 22 nt, Human
ugaaagcagcaccaauaccauu

SEQ ID NO: 849446 - RNA, 22 nt, Human
acaauauuguacccagaaguuu

SEQ ID NO: 849447 - RNA, 22 nt, Human
accagcuggucaccugggcacu

SEQ ID NO: 849448 - RNA, 22 nt, Human
cugagccagggccacacaugga

SEQ ID NO: 849449 - RNA, 22 nt, Human
uuguaaauaguaguaagaugcc

SEQ ID NO: 849450 - RNA, 22 nt, Human
acagucuacuugagcuuguaua

SEQ ID NO: 849451 - RNA, 22 nt, Human
agaguucugcucuucucaguga

SEQ ID NO: 849452 - RNA, 22 nt, Human
ggucugaguagagggcuggcga

SEQ ID NO: 849453 - RNA, 22 nt, Human
accuauuuaugcaauuaugaaa

SEQ ID NO: 849454 - RNA, 19 nt, Human
ugagaggcuuaaggcagcu

SEQ ID NO: 849455 - RNA, 22 nt, Human
ccaggcuguaagagugauguug

SEQ ID NO: 849456 - RNA, 22 nt, Human
gauuuuauauggcauacugugg

SEQ ID NO: 849457 - RNA, 22 nt, Human
cccuggagguggagguugcagg

SEQ ID NO: 849458 - RNA, 22 nt, Human
uucaacuauuaugaauaaaauu

SEQ ID NO: 849459 - RNA, 18 nt, Human
ucauuuguuuugcaugaa

SEQ ID NO: 849460 - RNA, 22 nt, Human
uaguaacucuacacacgacacu

SEQ ID NO: 849461 - RNA, 22 nt, Human
cauuuucaugaguuucuguuca

SEQ ID NO: 849462 - RNA, 22 nt, Human
cugaguccagggacagaggcgu

SEQ ID NO: 849463 - RNA, 22 nt, Human
aagggaggccagagguuuugca

SEQ ID NO: 849464 - RNA, 18 nt, Human
aguaaagcuuauuacaug

SEQ ID NO: 849465 - RNA, 22 nt, Human
aaggcaguacuuuauguccaua

SEQ ID NO: 849466 - RNA, 22 nt, Human
cauuuauucauuugcuagggcu

SEQ ID NO: 849467 - RNA, 22 nt, Human
auacaucuugucagauucaugu

SEQ ID NO: 849468 - RNA, 22 nt, Human
uugaggucucuacagaagagug

SEQ ID NO: 849469 - RNA, 22 nt, Human
ucuuugaacuuggcugaucucu

SEQ ID NO: 849470 - RNA, 22 nt, Human
gacagguggggaaacuaaggua

SEQ ID NO: 849471 - RNA, 22 nt, Human
ugcauaaagugccauaguauua

SEQ ID NO: 849472 - RNA, 22 nt, Human
aggcagaggagaaugaucuucc

SEQ ID NO: 849473 - RNA, 22 nt, Human
cggccaaauugcagagagaagc

SEQ ID NO: 849474 - RNA, 20 nt, Human
uucugccuaggguuagccug

SEQ ID NO: 849475 - RNA, 19 nt, Human
uagggcuggccgggcggug

SEQ ID NO: 849476 - RNA, 22 nt, Human
uauuagguuggugcaaaauuaa

SEQ ID NO: 849477 - RNA, 22 nt, Human
uauuucagcccuacuacuuggc

SEQ ID NO: 849478 - RNA, 22 nt, Human
uggcacaaaucuagucccuggu

SEQ ID NO: 849479 - RNA, 22 nt, Human
cuuuuauuuugaauuaagggcu

SEQ ID NO: 849480 - RNA, 20 nt, Human
ccuggccaaugagauaggaa

SEQ ID NO: 849481 - RNA, 22 nt, Human
cccuggcagagggggcaggugc

SEQ ID NO: 849482 - RNA, 22 nt, Human
aacacugcugcuggguucugug

SEQ ID NO: 849483 - RNA, 22 nt, Human
ggugaagggugucauggcauuu

SEQ ID NO: 849484 - RNA, 23 nt, Human
gagugcagaauagacaugcagug

SEQ ID NO: 849485 - RNA, 22 nt, Human
ugcuuccuauccacacaaugcc

SEQ ID NO: 849486 - RNA, 22 nt, Human
cucagaagaacaaaggcucuac

SEQ ID NO: 849487 - RNA, 22 nt, Human
ugaacaguuucaagaaaacuuu

SEQ ID NO: 849488 - RNA, 22 nt, Human
cccuggaggagcuuagagcuug

SEQ ID NO: 849489 - RNA, 22 nt, Human
uccagccuaggggaacagcugc

SEQ ID NO: 849490 - RNA, 22 nt, Human
ggcagcuaggggcagggaauuc

SEQ ID NO: 849491 - RNA, 20 nt, Human
ccuggcugcauucaggacgg

SEQ ID NO: 849492 - RNA, 22 nt, Human
gaggcagcucuucugaaugggg

SEQ ID NO: 849493 - RNA, 22 nt, Human
gucuucuuuucagucugcuugu

SEQ ID NO: 849494 - RNA, 20 nt, Human
ccagaagagaugaucaucca

SEQ ID NO: 849495 - RNA, 22 nt, Human
uuuuucagccaugaauuacacu

SEQ ID NO: 849496 - RNA, 22 nt, Human
gugcugaguagaaugaaugccu

SEQ ID NO: 849497 - RNA, 22 nt, Human
aacugcuuguaaauaauguuga

SEQ ID NO: 849498 - RNA, 22 nt, Human
uagaacuggcggcuagaccacu

SEQ ID NO: 849499 - RNA, 22 nt, Human
ucuggagaggaggauguggaca

SEQ ID NO: 849500 - RNA, 22 nt, Human
cugucauuuaagacauucugga

SEQ ID NO: 849501 - RNA, 22 nt, Human
auguggcauucuuggucauuuc

SEQ ID NO: 849502 - RNA, 22 nt, Human
augaacagcauugaaauccagc

SEQ ID NO: 849503 - RNA, 22 nt, Human
uucucagagcacugcugacaaa

SEQ ID NO: 849504 - RNA, 22 nt, Human
aaagaaguguugaauuugcaag

SEQ ID NO: 849505 - RNA, 22 nt, Human
uguagcagugucuaccacauua

SEQ ID NO: 849506 - RNA, 22 nt, Human
gcuggccagggcugcucgcgga

SEQ ID NO: 849507 - RNA, 22 nt, Human
agccauuggcugccuggugcgu

SEQ ID NO: 849508 - RNA, 22 nt, Human
gagcaguguuuguggaccugga

SEQ ID NO: 849509 - RNA, 22 nt, Human
auuuauuaagcaucugcuaugu

SEQ ID NO: 849510 - RNA, 22 nt, Human
cagggcugcuggccgugcccuc

SEQ ID NO: 849511 - RNA, 22 nt, Human
guaggcagguggaggagugaag

SEQ ID NO: 849512 - RNA, 22 nt, Human
uaucuguugucuuuuacaugua

SEQ ID NO: 849513 - RNA, 22 nt, Human
gggcagcugccagaggccaugg

SEQ ID NO: 849514 - RNA, 22 nt, Human
uuaggaaagucucuuggcuggg

SEQ ID NO: 849515 - RNA, 18 nt, Human
agggagagaccgcggguc

SEQ ID NO: 849516 - RNA, 22 nt, Human
aucugacaaggccacauauucu

SEQ ID NO: 849517 - RNA, 22 nt, Human
gaggaaccaaaucagcuugcac

SEQ ID NO: 849518 - RNA, 22 nt, Human
ucuucauuuuauagcaucugug

SEQ ID NO: 849519 - RNA, 19 nt, Human
acaaaugauguugcacuga

SEQ ID NO: 849520 - RNA, 22 nt, Human
agggcagcacaaggcauggacu

SEQ ID NO: 849521 - RNA, 22 nt, Human
agcugcccuguggggaggguug

SEQ ID NO: 849522 - RNA, 22 nt, Human
auuagguuagugugcaagagaa

SEQ ID NO: 849523 - RNA, 22 nt, Human
cugagcugcaguccuggcucug

SEQ ID NO: 849524 - RNA, 22 nt, Human
ccaggagagcaggcgugcagcu

SEQ ID NO: 849525 - RNA, 22 nt, Human
ggugaguugggguucacagguc

SEQ ID NO: 849526 - RNA, 22 nt, Human
uuaggauagucuguuagaaaag

SEQ ID NO: 849527 - RNA, 22 nt, Human
agguaaacaggagaaaaugaga

SEQ ID NO: 849528 - RNA, 19 nt, Human
cugaggcccauguaccaug

SEQ ID NO: 849529 - RNA, 19 nt, Human
uucuccaggcugcagaggg

SEQ ID NO: 849530 - RNA, 22 nt, Human
cauagagugauguaagguaugu

SEQ ID NO: 849531 - RNA, 22 nt, Human
acaguggagaaggcaugaggcu

SEQ ID NO: 849532 - RNA, 22 nt, Human
agagggcaaguguaguccagua

SEQ ID NO: 849533 - RNA, 22 nt, Human
uccccaccuacacacugcuccu

SEQ ID NO: 849534 - RNA, 22 nt, Human
gcaggcagagguggaggagaca

SEQ ID NO: 849535 - RNA, 20 nt, Human
uuuuccagaaaguaucauug

SEQ ID NO: 849536 - RNA, 22 nt, Human
aguggaccagaagacugaagcu

SEQ ID NO: 849537 - RNA, 22 nt, Human
ugcuggcugcagugcugucaaa

SEQ ID NO: 849538 - RNA, 22 nt, Human
ggugaagguggaacgcagagca

SEQ ID NO: 849539 - RNA, 22 nt, Human
cuguguuggcuuuucucuugua

SEQ ID NO: 849540 - RNA, 22 nt, Human
gcuggccagugucccagggauc

SEQ ID NO: 849541 - RNA, 22 nt, Human
uaucuguuccaggcacucagcu

SEQ ID NO: 849542 - RNA, 22 nt, Human
uuggaacaggauucaauuaaag

SEQ ID NO: 849543 - RNA, 22 nt, Human
uucuucaaaacaacacuggccu

SEQ ID NO: 849544 - RNA, 22 nt, Human
aagaguuauaccuauuucuaac

SEQ ID NO: 849545 - RNA, 22 nt, Human
aggcugagacugugcauuagug

SEQ ID NO: 849546 - RNA, 19 nt, Human
aaagcagaggagcaucuga

SEQ ID NO: 849547 - RNA, 19 nt, Human
auuagcaugcuugaggaug

SEQ ID NO: 849548 - RNA, 22 nt, Human
agaacguggaauguggcuccuu

SEQ ID NO: 849549 - RNA, 22 nt, Human
aacugguagcugauuaaguaua

SEQ ID NO: 849550 - RNA, 22 nt, Human
agcugccgaugcccagcugcau

SEQ ID NO: 849551 - RNA, 22 nt, Human
gaaggccacaaaaaaugucaua

SEQ ID NO: 849552 - RNA, 22 nt, Human
uauacagucuuuugcuauauuc

SEQ ID NO: 849553 - RNA, 22 nt, Human
auauaauaguuucauaaaggcu

SEQ ID NO: 849554 - RNA, 23 nt, Human
acagaaaguucugcuggacagag

SEQ ID NO: 849555 - RNA, 22 nt, Human
ggcugaguggcugggucuaguu

SEQ ID NO: 849556 - RNA, 22 nt, Human
caccucuuugauuugaggcaag

SEQ ID NO: 849557 - RNA, 21 nt, Human
uucucagagucuauuacaguu

SEQ ID NO: 849558 - RNA, 22 nt, Human
auauucuauaagcaguuggaag

SEQ ID NO: 849559 - RNA, 22 nt, Human
cugguggcaucuugagaugguu

SEQ ID NO: 849560 - RNA, 22 nt, Human
cucaguuuccucaacugcaaaa

SEQ ID NO: 849561 - RNA, 22 nt, Human
uaaaacugaauacauacugagg

SEQ ID NO: 849562 - RNA, 22 nt, Human
uucucagaugauucagauaaac

SEQ ID NO: 849563 - RNA, 23 nt, Human
cagucugcagcccacuugggcag

SEQ ID NO: 849564 - RNA, 22 nt, Human
auggccaaggggccuaggcagg

SEQ ID NO: 849565 - RNA, 21 nt, Human
acugccugucuccauagucua

SEQ ID NO: 849566 - RNA, 22 nt, Human
aguccaugguucugacucaucu

SEQ ID NO: 849567 - RNA, 22 nt, Human
aauaccaccucauucuggaggc

SEQ ID NO: 849568 - RNA, 22 nt, Human
ucucuucucuagugagcaacug

SEQ ID NO: 849569 - RNA, 22 nt, Human
ggauuuggaagaccgggucaca

SEQ ID NO: 849570 - RNA, 22 nt, Human
gggaggugauggcaagcagcgg

SEQ ID NO: 849571 - RNA, 22 nt, Human
uuugaaaggagcuuuauccaga

SEQ ID NO: 849572 - RNA, 22 nt, Human
cccaggagacagaaacagaggu

SEQ ID NO: 849573 - RNA, 22 nt, Human
aaucuucuacuugacaguucuc

SEQ ID NO: 849574 - RNA, 22 nt, Human
uagcacaucuucuuggccugca

SEQ ID NO: 849575 - RNA, 22 nt, Human
ccagagcugauuccugggacuu

SEQ ID NO: 849576 - RNA, 22 nt, Human
agcaagaugcauuauuucuuau

SEQ ID NO: 849577 - RNA, 22 nt, Human
ugacuuuagaauuuuauccaga

SEQ ID NO: 849578 - RNA, 22 nt, Human
ccuggcugcugucacugaccau

SEQ ID NO: 849579 - RNA, 21 nt, Human
gucaaacuugcaccagugccc

SEQ ID NO: 849580 - RNA, 22 nt, Human
uccuugacugugaggaacuagc

SEQ ID NO: 849581 - RNA, 22 nt, Human
uaacuguauuuuucugagauuc

SEQ ID NO: 849582 - RNA, 22 nt, Human
auacacuuccaaauauugauua

SEQ ID NO: 849583 - RNA, 22 nt, Human
aagaggaggacgguucccagaa

SEQ ID NO: 849584 - RNA, 22 nt, Human
uucuccagagggcucugcagga

SEQ ID NO: 849585 - RNA, 22 nt, Human
cuucuuaucaaguggcaaaucu

SEQ ID NO: 849586 - RNA, 20 nt, Human
ucaccuuuguugguauucau

SEQ ID NO: 849587 - RNA, 22 nt, Human
aggcucagccugggccuagagc

SEQ ID NO: 849588 - RNA, 22 nt, Human
guuuauaaggcccaauauuucu

SEQ ID NO: 849589 - RNA, 22 nt, Human
auuaucuauguagaaugauuuu

SEQ ID NO: 849590 - RNA, 23 nt, Human
gccaggaguggguagacuaaugc

SEQ ID NO: 849591 - RNA, 22 nt, Human
ccuggagaccagaggauacuuc

SEQ ID NO: 849592 - RNA, 22 nt, Human
auacaucucuuugaagugcuuu

SEQ ID NO: 849593 - RNA, 22 nt, Human
agggcagcagcuccuccuagcu

SEQ ID NO: 849594 - RNA, 22 nt, Human
uagugucauuucaguggaguuu

SEQ ID NO: 849595 - RNA, 22 nt, Human
gccugcagauauauaggauggu

SEQ ID NO: 849596 - RNA, 22 nt, Human
aggaucuugcuguagaggauag

SEQ ID NO: 849597 - RNA, 22 nt, Human
gaauuauagguuugcaugcuaa

SEQ ID NO: 849598 - RNA, 22 nt, Human
ugaauuagcaguagacagacug

SEQ ID NO: 849599 - RNA, 22 nt, Human
ucucugcuugguguaugugagu

SEQ ID NO: 849600 - RNA, 21 nt, Human
aggcagcaggauccagggaca

SEQ ID NO: 849601 - RNA, 22 nt, Human
cugcgcagggguggcgccagaa

SEQ ID NO: 849602 - RNA, 22 nt, Human
agggaggucuuugaggggcuua

SEQ ID NO: 849603 - RNA, 22 nt, Human
cagcuagcuaagaaggccagag

SEQ ID NO: 849604 - RNA, 22 nt, Human
uggcugaguguuccaaggagca

SEQ ID NO: 849605 - RNA, 22 nt, Human
augcuuccaaggcuaagacaag

SEQ ID NO: 849606 - RNA, 22 nt, Human
ugaaacagcuaucaguagacug

SEQ ID NO: 849607 - RNA, 22 nt, Human
cccuuccuggaguacccucugu

SEQ ID NO: 849608 - RNA, 18 nt, Human
acauacauucugucugca

SEQ ID NO: 849609 - RNA, 21 nt, Human
ccuggccaaucugauaggguu

SEQ ID NO: 849610 - RNA, 22 nt, Human
uggcagcagacaaaaggccauu

SEQ ID NO: 849611 - RNA, 22 nt, Human
cuggcagucugccucuucacug

SEQ ID NO: 849612 - RNA, 22 nt, Human
caaaugaaaauggcgucuugga

SEQ ID NO: 849613 - RNA, 22 nt, Human
ugcauguguguguauuuauaaa

SEQ ID NO: 849614 - RNA, 22 nt, Human
acucuggcccuccugcugccag

SEQ ID NO: 849615 - RNA, 22 nt, Human
uuagauaaaaguguucaauaaa

SEQ ID NO: 849616 - RNA, 22 nt, Human
augcugugucaggaauuugaua

SEQ ID NO: 849617 - RNA, 22 nt, Human
gaauuuaagaggaugaaucugu

SEQ ID NO: 849618 - RNA, 19 nt, Human
acauuuaaauucagaucuc

SEQ ID NO: 849619 - RNA, 19 nt, Human
uuacuuggcaaagucaguc

SEQ ID NO: 849620 - RNA, 22 nt, Human
gcagaggggaagcugaggaauu

SEQ ID NO: 849621 - RNA, 18 nt, Human
cauuguacaaugcuuuau

SEQ ID NO: 849622 - RNA, 20 nt, Human
aggcagcuggccaggcaggu

SEQ ID NO: 849623 - RNA, 22 nt, Human
uaacuggugaguaggauuuaua

SEQ ID NO: 849624 - RNA, 22 nt, Human
gaauagcuuccuuuuuuccaaa

SEQ ID NO: 849625 - RNA, 22 nt, Human
ggcagggaagcuggcaucacgg

SEQ ID NO: 849626 - RNA, 22 nt, Human
caugcugauucuuccugagcuu

SEQ ID NO: 849627 - RNA, 22 nt, Human
ggcacacauagaucugcacugg

SEQ ID NO: 849628 - RNA, 22 nt, Human
uugacaauguccuuugaauuuc

SEQ ID NO: 849629 - RNA, 22 nt, Human
acagucugucccccaggugcua

SEQ ID NO: 849630 - RNA, 22 nt, Human
auugaaaguccuaucuaaggga

SEQ ID NO: 849631 - RNA, 22 nt, Human
ucauuguuucugcuuuucauga

SEQ ID NO: 849632 - RNA, 22 nt, Human
ucuuagcacagcuauauaaguu

SEQ ID NO: 849633 - RNA, 22 nt, Human
gcugagagaucaaggcaggauu

SEQ ID NO: 849634 - RNA, 22 nt, Human
acaaaugugucuaauugugccu

SEQ ID NO: 849635 - RNA, 22 nt, Human
uucugagguccaugcaguacug

SEQ ID NO: 849636 - RNA, 22 nt, Human
cccaugagaccugguuuaaggc

SEQ ID NO: 849637 - RNA, 22 nt, Human
agcggcuggaccagcguucaag

SEQ ID NO: 849638 - RNA, 22 nt, Human
uggcagcuggagggcaauggcc

SEQ ID NO: 849639 - RNA, 22 nt, Human
ugacagguucguuagucauguu

SEQ ID NO: 849640 - RNA, 22 nt, Human
uuauuauuggugaguuaaggaa

SEQ ID NO: 849641 - RNA, 22 nt, Human
agaaguuguagguuugcauauu

SEQ ID NO: 849642 - RNA, 22 nt, Human
ucagucuuugcuuaugacaaua

SEQ ID NO: 849643 - RNA, 22 nt, Human
ucagugaucuaaggguauggcc

SEQ ID NO: 849644 - RNA, 22 nt, Human
aaggcagccagauccuuugggu

SEQ ID NO: 849645 - RNA, 22 nt, Human
gcugccucaggcaccuccuggc

SEQ ID NO: 849646 - RNA, 22 nt, Human
gccaggagccagcuucuuagca

SEQ ID NO: 849647 - RNA, 22 nt, Human
aggucaccauggcaugcuccac

SEQ ID NO: 849648 - RNA, 22 nt, Human
aaaugaugcucacagauuagug

SEQ ID NO: 849649 - RNA, 22 nt, Human
aucacuguguauguauaugcag

SEQ ID NO: 849650 - RNA, 22 nt, Human
cccagggacagcuagguggggc

SEQ ID NO: 849651 - RNA, 22 nt, Human
gcugccuccugagauuugggca

SEQ ID NO: 849652 - RNA, 22 nt, Human
aagagggcugcaaucuuauugc

SEQ ID NO: 849653 - RNA, 22 nt, Human
cuacuucuaaguacauggugau

SEQ ID NO: 849654 - RNA, 22 nt, Human
cuccuggcucugccacuuacua

SEQ ID NO: 849655 - RNA, 22 nt, Human
gauugaaacauaggcagucgag

SEQ ID NO: 849656 - RNA, 19 nt, Human
uagaggagaagggaagugg

SEQ ID NO: 849657 - RNA, 22 nt, Human
acaaugaaaaaauuuacugugg

SEQ ID NO: 849658 - RNA, 22 nt, Human
ggccacaagugguccugagucc

SEQ ID NO: 849659 - RNA, 22 nt, Human
accagagcuggcucugagcacc

SEQ ID NO: 849660 - RNA, 22 nt, Human
auucuagauaagaaaagggcug

SEQ ID NO: 849661 - RNA, 22 nt, Human
gcuggccauucucuuugagaug

SEQ ID NO: 849662 - RNA, 22 nt, Human
uuugaaaguucuucugacacua

SEQ ID NO: 849663 - RNA, 21 nt, Human
aggcagcaucugauuuauaug

SEQ ID NO: 849664 - RNA, 22 nt, Human
gggugaggcccauuugaggcca

SEQ ID NO: 849665 - RNA, 22 nt, Human
uuauugagcacauaguaugugg

SEQ ID NO: 849666 - RNA, 19 nt, Human
cuuauuagagugagagcuu

SEQ ID NO: 849667 - RNA, 22 nt, Human
ccaggcugagcaugauuggagc

SEQ ID NO: 849668 - RNA, 22 nt, Human
cagcugacgccagaguggaauu

SEQ ID NO: 849669 - RNA, 22 nt, Human
gaucauuuugaugcccuuuuag

SEQ ID NO: 849670 - RNA, 21 nt, Human
ucugacuugaucuauucuccc

SEQ ID NO: 849671 - RNA, 22 nt, Human
cacauuaaaauccuaacuucca

SEQ ID NO: 849672 - RNA, 22 nt, Human
auucauaacggcaaaugucacc

SEQ ID NO: 849673 - RNA, 22 nt, Human
ugagugcucuguaugugccaga

SEQ ID NO: 849674 - RNA, 20 nt, Human
caggagggacauuucagcau

SEQ ID NO: 849675 - RNA, 22 nt, Human
uugcuagcugguguaugcauug

SEQ ID NO: 849676 - RNA, 22 nt, Human
uuucaucuuccuuggcauaggu

SEQ ID NO: 849677 - RNA, 22 nt, Human
cuccuggaccagggcuauuggg

SEQ ID NO: 849678 - RNA, 19 nt, Human
ggcagcuggacgcuguuca

SEQ ID NO: 849679 - RNA, 22 nt, Human
gccaggagaaugcuagcagagg

SEQ ID NO: 849680 - RNA, 22 nt, Human
ucuuuccagaggaauuuuuaga

SEQ ID NO: 849681 - RNA, 23 nt, Human
cuugcagggcuggaggcuuagaa

SEQ ID NO: 849682 - RNA, 22 nt, Human
acagaaauucaaacuggaauuu

SEQ ID NO: 849683 - RNA, 22 nt, Human
cagcugccccgcuggcugacca

SEQ ID NO: 849684 - RNA, 22 nt, Human
aggccaaagcacagagcuggaa

SEQ ID NO: 849685 - RNA, 22 nt, Human
uggcagcuagcuguuuucaugc

SEQ ID NO: 849686 - RNA, 22 nt, Human
uacaacauuguguugcuucaua

SEQ ID NO: 849687 - RNA, 22 nt, Human
uuagacaggauguaugaaagcu

SEQ ID NO: 849688 - RNA, 22 nt, Human
ugaaggccagcagagugaaggc

SEQ ID NO: 849689 - RNA, 22 nt, Human
acaccuuugccccaagucauag

SEQ ID NO: 849690 - RNA, 22 nt, Human
uagccaggcugcagcugauccg

SEQ ID NO: 849691 - RNA, 22 nt, Human
uucuucaacaaggacacuguua

SEQ ID NO: 849692 - RNA, 22 nt, Human
ccuggccagaggcgugccugug

SEQ ID NO: 849693 - RNA, 22 nt, Human
guuuauuauacaacaaaagcua

SEQ ID NO: 849694 - RNA, 22 nt, Human
gcccaggaugguguguaguggu

SEQ ID NO: 849695 - RNA, 22 nt, Human
ucauuucuccgaccugcugucc

SEQ ID NO: 849696 - RNA, 22 nt, Human
uuggucagcucaauggagaggg

SEQ ID NO: 849697 - RNA, 22 nt, Human
gcccaggaggucaaguagcuau

SEQ ID NO: 849698 - RNA, 22 nt, Human
ucacugucugaaagaaauggcc

SEQ ID NO: 849699 - RNA, 22 nt, Human
gcccaggaguucaaggcugcag

SEQ ID NO: 849700 - RNA, 22 nt, Human
guuuucaaggggauuuaacuga

SEQ ID NO: 849701 - RNA, 22 nt, Human
cagcaagauuaagggcagaaaa

SEQ ID NO: 849702 - RNA, 22 nt, Human
ccccuuccacagugcuuccuaa

SEQ ID NO: 849703 - RNA, 20 nt, Human
cccaggaguuugcucuuacu

SEQ ID NO: 849704 - RNA, 22 nt, Human
cugcuguggaugcaggaccuca

SEQ ID NO: 849705 - RNA, 22 nt, Human
uuguugguggaauugaugcuag

SEQ ID NO: 849706 - RNA, 22 nt, Human
cccagggaagggcuaccugagg

SEQ ID NO: 849707 - RNA, 22 nt, Human
uuauuuauaucucugcaguuua

SEQ ID NO: 849708 - RNA, 17 nt, Human
agcagcugaagcagcca

SEQ ID NO: 849709 - RNA, 22 nt, Human
aacuuucuggcuuuggggagag

SEQ ID NO: 849710 - RNA, 22 nt, Human
aguguugcaugaggcaguacca

SEQ ID NO: 849711 - RNA, 22 nt, Human
uagcugcugcagcacagggagg

SEQ ID NO: 849712 - RNA, 22 nt, Human
ggcugcugcccaccccugcaug

SEQ ID NO: 849713 - RNA, 22 nt, Human
ggcggcacgcaggcugcugucg

SEQ ID NO: 849714 - RNA, 22 nt, Human
gugugcaggggcuugguggagc

SEQ ID NO: 849715 - RNA, 22 nt, Human
ugcugcucgccacggcccaggg

SEQ ID NO: 849716 - RNA, 22 nt, Human
agggacccauagagagaccagu

SEQ ID NO: 849717 - RNA, 22 nt, Human
uuuucaguaaugucuacauaau

SEQ ID NO: 849718 - RNA, 22 nt, Human
gauacaguauuuaaagagcaac

SEQ ID NO: 849719 - RNA, 22 nt, Human
cccaggaaugagcaggcagggg

SEQ ID NO: 849720 - RNA, 22 nt, Human
gugguaauagagcuccaaacua

SEQ ID NO: 849721 - RNA, 22 nt, Human
cugacaaaggcaaggcaggggg

SEQ ID NO: 849722 - RNA, 22 nt, Human
augauguugauaaauuacuuua

SEQ ID NO: 849723 - RNA, 22 nt, Human
aguaacaugaguuuuucuaaug

SEQ ID NO: 849724 - RNA, 22 nt, Human
uuuucagaggccuaagagguuu

SEQ ID NO: 849725 - RNA, 22 nt, Human
ucagagaguuggaaagaauuaa

SEQ ID NO: 849726 - RNA, 22 nt, Human
gggcagcucugcccaucagagg

SEQ ID NO: 849727 - RNA, 22 nt, Human
ugaaaugaucaguuugguuacu

SEQ ID NO: 849728 - RNA, 22 nt, Human
gggcugagacgauggggucuuc

SEQ ID NO: 849729 - RNA, 22 nt, Human
auggccaacugaaaugaaagau

SEQ ID NO: 849730 - RNA, 22 nt, Human
cugcugugcaggugccuaugau

SEQ ID NO: 849731 - RNA, 22 nt, Human
aggcagcuggaaaacuccaggc

SEQ ID NO: 849732 - RNA, 22 nt, Human
acaggcugaaaguuaaguucug

SEQ ID NO: 849733 - RNA, 22 nt, Human
ggcuggagacaacguccugccc

SEQ ID NO: 849734 - RNA, 22 nt, Human
aucaggaucaugcuggguggga

SEQ ID NO: 849735 - RNA, 22 nt, Human
ucucuguacaguacaugccgug

SEQ ID NO: 849736 - RNA, 22 nt, Human
ucuucaucucagauuaacagga

SEQ ID NO: 849737 - RNA, 22 nt, Human
auauuguugacuauaagaguaa

SEQ ID NO: 849738 - RNA, 22 nt, Human
uucuucucggcugucagauagu

SEQ ID NO: 849739 - RNA, 22 nt, Human
ucuuugcaggccaaauuguuaa

SEQ ID NO: 849740 - RNA, 19 nt, Human
uucacaauuaugaaauuag

SEQ ID NO: 849741 - RNA, 22 nt, Human
agccacagucugaugccugaga

SEQ ID NO: 849742 - RNA, 22 nt, Human
ucucuucuaauuaggguccaug

SEQ ID NO: 849743 - RNA, 22 nt, Human
uccuucuuucccccuagucauu

SEQ ID NO: 849744 - RNA, 22 nt, Human
aaaauacuacugucuucuuccc

SEQ ID NO: 849745 - RNA, 21 nt, Human
gcugcugugggccagggaggc

SEQ ID NO: 849746 - RNA, 22 nt, Human
gacggcagaaacucaugagguc

SEQ ID NO: 849747 - RNA, 22 nt, Human
aaaggccacacagagcagggag

SEQ ID NO: 849748 - RNA, 19 nt, Human
uagaagcacuaggcaaacu

SEQ ID NO: 849749 - RNA, 22 nt, Human
ucaggcugccuaucagacugug

SEQ ID NO: 849750 - RNA, 22 nt, Human
ugagccugguugcagugucugg

SEQ ID NO: 849751 - RNA, 22 nt, Human
ucuggcaaaggcaaccacaguu

SEQ ID NO: 849752 - RNA, 22 nt, Human
uuucuucaauugcuaacaagga

SEQ ID NO: 849753 - RNA, 22 nt, Human
cagcuggcgggcagagccgcca

SEQ ID NO: 849754 - RNA, 22 nt, Human
agcuccugaaaauccagacugg

SEQ ID NO: 849755 - RNA, 22 nt, Human
guccucuguuagaaaugugcuu

SEQ ID NO: 849756 - RNA, 22 nt, Human
agcccaggcagagggaugcuug

SEQ ID NO: 849757 - RNA, 22 nt, Human
cuaacauuuauugagcacuuag

SEQ ID NO: 849758 - RNA, 22 nt, Human
gcccccagaagggccacagauu

SEQ ID NO: 849759 - RNA, 22 nt, Human
agucugucuacuuaaagucugu

SEQ ID NO: 849760 - RNA, 22 nt, Human
gugacagucaaagacaugacuu

SEQ ID NO: 849761 - RNA, 22 nt, Human
gagagcuguccggcugagcagc

SEQ ID NO: 849762 - RNA, 18 nt, Human
aaacuggcuuggccugug

SEQ ID NO: 849763 - RNA, 22 nt, Human
caggcuugagggcaggcccagu

SEQ ID NO: 849764 - RNA, 21 nt, Human
uggcaggcagcuggaagcuug

SEQ ID NO: 849765 - RNA, 22 nt, Human
cucaggauccaucuccugcccu

SEQ ID NO: 849766 - RNA, 22 nt, Human
acuuccugcaaucguccacucc

SEQ ID NO: 849767 - RNA, 22 nt, Human
auucuucauuguugauucaugu

SEQ ID NO: 849768 - RNA, 22 nt, Human
ucagagaggcaauacuguuuaa

SEQ ID NO: 849769 - RNA, 21 nt, Human
ucaggcugaugucgauguuag

SEQ ID NO: 849770 - RNA, 22 nt, Human
gaagcagcaaguauaggacagg

SEQ ID NO: 849771 - RNA, 22 nt, Human
gagagcuggguucaaguagcug

SEQ ID NO: 849772 - RNA, 22 nt, Human
auucaaauuaaguuaauucagc

SEQ ID NO: 849773 - RNA, 22 nt, Human
gggcugagggccaauuccuacu

SEQ ID NO: 849774 - RNA, 22 nt, Human
ugaaagguuaaaaguaguauug

SEQ ID NO: 849775 - RNA, 22 nt, Human
ccaggcugcuuuauuacucugu

SEQ ID NO: 849776 - RNA, 22 nt, Human
uaaaaugaucucucauguucuu

SEQ ID NO: 849777 - RNA, 22 nt, Human
uuugaaagacagaauauuuuug

SEQ ID NO: 849778 - RNA, 23 nt, Human
aggcccaacucugugagggcugc

SEQ ID NO: 849779 - RNA, 22 nt, Human
gcugccugcacagagcugcuuu

SEQ ID NO: 849780 - RNA, 22 nt, Human
agucuugcauuuucugaagaug

SEQ ID NO: 849781 - RNA, 22 nt, Human
cuugagguuuugacucagcuuu

SEQ ID NO: 849782 - RNA, 22 nt, Human
ucagugcacagagauuuuuguu

SEQ ID NO: 849783 - RNA, 20 nt, Human
uucaggauucuagaccacac

SEQ ID NO: 849784 - RNA, 22 nt, Human
auggcuggaggccgggcuuccu

SEQ ID NO: 849785 - RNA, 22 nt, Human
ugcaggcugccuucacagagcc

SEQ ID NO: 849786 - RNA, 22 nt, Human
uuugcagucaaauuugcuaaau

SEQ ID NO: 849787 - RNA, 22 nt, Human
uggaaugacagagagucugaau

SEQ ID NO: 849788 - RNA, 20 nt, Human
ccaggcuggcaaaugggggc

SEQ ID NO: 849789 - RNA, 22 nt, Human
gcuucugaggaaggcucagccu

SEQ ID NO: 849790 - RNA, 21 nt, Human
cuggccgaccccucugugcuc

SEQ ID NO: 849791 - RNA, 22 nt, Human
uugugguuaaccgcacauuuuu

SEQ ID NO: 849792 - RNA, 22 nt, Human
acucaggaaauugagauaaugg

SEQ ID NO: 849793 - RNA, 22 nt, Human
aaugauuuccccuacacagaag

SEQ ID NO: 849794 - RNA, 23 nt, Human
acucguggaauucucugcgaucg

SEQ ID NO: 849795 - RNA, 22 nt, Human
uucaugugauaaaugugugacu

SEQ ID NO: 849796 - RNA, 22 nt, Human
ucaggcuguaaauggugugggu

SEQ ID NO: 849797 - RNA, 22 nt, Human
ugaugaauaaacuugagaguca

SEQ ID NO: 849798 - RNA, 20 nt, Human
aggcagcugggaaaugaggg

SEQ ID NO: 849799 - RNA, 22 nt, Human
ugucaauguguacaggagcuca

SEQ ID NO: 849800 - RNA, 22 nt, Human
caacuauagaucaaaugaguuu

SEQ ID NO: 849801 - RNA, 22 nt, Human
ucaaucacguguuccauguucu

SEQ ID NO: 849802 - RNA, 22 nt, Human
uaagaugaucaccaaaugcugg

SEQ ID NO: 849803 - RNA, 22 nt, Human
uuucucugcugccugugucgau

SEQ ID NO: 849804 - RNA, 22 nt, Human
uuaacaugucuugacuucaucu

SEQ ID NO: 849805 - RNA, 22 nt, Human
ucacaguaaaagcauggaagag

SEQ ID NO: 849806 - RNA, 22 nt, Human
gggcugagugaccucaggccaa

SEQ ID NO: 849807 - RNA, 23 nt, Human
uccaugagaugugggcuucuagu

SEQ ID NO: 849808 - RNA, 22 nt, Human
cuggccaacaucuggggcacau

SEQ ID NO: 849809 - RNA, 22 nt, Human
acaccuuucagguccagacagu

SEQ ID NO: 849810 - RNA, 22 nt, Human
cauuuguaggaugcuucuuguu

SEQ ID NO: 849811 - RNA, 22 nt, Human
aggcagccaaucagaggcugac

SEQ ID NO: 849812 - RNA, 22 nt, Human
augggaggaugcucgggugcuc

SEQ ID NO: 849813 - RNA, 22 nt, Human
ggcagcuuccugagccagcagc

SEQ ID NO: 849814 - RNA, 22 nt, Human
aaauugcauuuuaaagguagau

SEQ ID NO: 849815 - RNA, 22 nt, Human
gcaggcugccaccuucugaguu

SEQ ID NO: 849816 - RNA, 22 nt, Human
ugcugagguuguggagugcauu

SEQ ID NO: 849817 - RNA, 22 nt, Human
acuugcauuauauuuaucacaa

SEQ ID NO: 849818 - RNA, 22 nt, Human
uucuucaguuugguaaauguaa

SEQ ID NO: 849819 - RNA, 22 nt, Human
uggucuuuaagguagcugucau

SEQ ID NO: 849820 - RNA, 22 nt, Human
uuccaugaagggcagccucuca

SEQ ID NO: 849821 - RNA, 22 nt, Human
uguuuuuaaauaaugauagaaa

SEQ ID NO: 849822 - RNA, 22 nt, Human
agaggggagagcuaagcaauuc

SEQ ID NO: 849823 - RNA, 22 nt, Human
ucaggcuggagugcaguggcgc

SEQ ID NO: 849824 - RNA, 22 nt, Human
ucuggccaggauggcaagacca

SEQ ID NO: 849825 - RNA, 21 nt, Human
uuccagaaaucucuuucuuca

SEQ ID NO: 849826 - RNA, 22 nt, Human
auugaaagcauggauuuggauu

SEQ ID NO: 849827 - RNA, 22 nt, Human
uauuuucuggacagucuugcuu

SEQ ID NO: 849828 - RNA, 21 nt, Human
aaucauacaaaacaugucagg

SEQ ID NO: 849829 - RNA, 22 nt, Human
ggcugagacaaccugggaccca

SEQ ID NO: 849830 - RNA, 22 nt, Human
cuggagaggcugggaacagguu

SEQ ID NO: 849831 - RNA, 22 nt, Human
ucaggcugguccccacagugga

SEQ ID NO: 849832 - RNA, 22 nt, Human
uguucucuaagaaaagaagcau

SEQ ID NO: 849833 - RNA, 22 nt, Human
uucaaugauuuuuagggaucau

SEQ ID NO: 849834 - RNA, 22 nt, Human
aaacugguagcaauuuaagggu

SEQ ID NO: 849835 - RNA, 22 nt, Human
cuggaaauuggagaugauguuu

SEQ ID NO: 849836 - RNA, 22 nt, Human
aacauacauauuucagugucca

SEQ ID NO: 849837 - RNA, 22 nt, Human
auguuauaguuauaaaaugagg

SEQ ID NO: 849838 - RNA, 22 nt, Human
uuauuagggugguuuauguucu

SEQ ID NO: 849839 - RNA, 22 nt, Human
aggcaguuguagagagggcucu

SEQ ID NO: 849840 - RNA, 22 nt, Human
aacacuuuccugccuuucugau

SEQ ID NO: 849841 - RNA, 22 nt, Human
aaaauauuuuagggccaggaga

SEQ ID NO: 849842 - RNA, 22 nt, Human
auggagacgcaagggaccuagg

SEQ ID NO: 849843 - RNA, 22 nt, Human
uuacaagauaaccugaugcugu

SEQ ID NO: 849844 - RNA, 22 nt, Human
acauauauuacuaguaaagaca

SEQ ID NO: 849845 - RNA, 22 nt, Human
aauaauuauuugagagcagacc

SEQ ID NO: 849846 - RNA, 22 nt, Human
aguuaaagaaagauaauucgcc

SEQ ID NO: 849847 - RNA, 20 nt, Human
ugugcaggagagugaggcug

SEQ ID NO: 849848 - RNA, 22 nt, Human
acauuuuuauucaucaaagcag

SEQ ID NO: 849849 - RNA, 22 nt, Human
uuucagaauagcaaagcaagcu

SEQ ID NO: 849850 - RNA, 22 nt, Human
uccccuccucuccugauauggg

SEQ ID NO: 849851 - RNA, 22 nt, Human
gugcagcugugguggagccagg

SEQ ID NO: 849852 - RNA, 22 nt, Human
aggcagcuuucuguaggggugu

SEQ ID NO: 849853 - RNA, 22 nt, Human
aggaagcuccaugaaggcagag

SEQ ID NO: 849854 - RNA, 22 nt, Human
ugaugaaaauaugauucugagg

SEQ ID NO: 849855 - RNA, 22 nt, Human
ucugggaaaugcuguuccuugu

SEQ ID NO: 849856 - RNA, 22 nt, Human
uagcaagaaguagcucuggauu

SEQ ID NO: 849857 - RNA, 22 nt, Human
cucaguuugagggguagguguu

SEQ ID NO: 849858 - RNA, 22 nt, Human
uggcuucuugucuaauuuguua

SEQ ID NO: 849859 - RNA, 22 nt, Human
uugcaauagccuuauuuccaaa

SEQ ID NO: 849860 - RNA, 22 nt, Human
guuuuauaauugcuucauaaga

SEQ ID NO: 849861 - RNA, 22 nt, Human
uuuuaugauugagcuggcuaca

SEQ ID NO: 849862 - RNA, 22 nt, Human
uaaagcacauaucuuacaauaa

SEQ ID NO: 849863 - RNA, 22 nt, Human
gaggagaggcuggacgcgguga

SEQ ID NO: 849864 - RNA, 22 nt, Human
cucccaggggaacuaucaagua

SEQ ID NO: 849865 - RNA, 22 nt, Human
cucucuguuaugcuuucaugaa

SEQ ID NO: 849866 - RNA, 22 nt, Human
gacuccugccuccucuguuugc

SEQ ID NO: 849867 - RNA, 18 nt, Human
ggcugagguugacuagaa

SEQ ID NO: 849868 - RNA, 22 nt, Human
cacuccuguuccacuaaaugag

SEQ ID NO: 849869 - RNA, 22 nt, Human
gacugaggcuccccuaggcuca

SEQ ID NO: 849870 - RNA, 22 nt, Human
cagauggaacacagaaaggaga

SEQ ID NO: 849871 - RNA, 22 nt, Human
aggcaagcugcagagaguccuu

SEQ ID NO: 849872 - RNA, 22 nt, Human
acccaggacuuggcaaccucau

SEQ ID NO: 849873 - RNA, 22 nt, Human
cccaggaacagggcucagaccc

SEQ ID NO: 849874 - RNA, 22 nt, Human
uucaauucuaaacuaauauucu

SEQ ID NO: 849875 - RNA, 22 nt, Human
cacagccuuacugagauccacu

SEQ ID NO: 849876 - RNA, 22 nt, Human
agucucuuuaaucacagugucu

SEQ ID NO: 849877 - RNA, 22 nt, Human
uuuauuguuaucaugggugagu

SEQ ID NO: 849878 - RNA, 22 nt, Human
uccugaggcucacuuugaaugu

SEQ ID NO: 849879 - RNA, 22 nt, Human
ucugccugagaaguggggugcc

SEQ ID NO: 849880 - RNA, 22 nt, Human
gagaggaguagacacuuugguu

SEQ ID NO: 849881 - RNA, 22 nt, Human
aagcagaguccccuucccaugg

SEQ ID NO: 849882 - RNA, 22 nt, Human
uugaggucuugaguacugggga

SEQ ID NO: 849883 - RNA, 22 nt, Human
gaaacugugaggaucuuaacuu

SEQ ID NO: 849884 - RNA, 23 nt, Human
guuaauaaugaacacuuucuccc

SEQ ID NO: 849885 - RNA, 19 nt, Human
cuguggcugaccucuggcc

SEQ ID NO: 849886 - RNA, 22 nt, Human
gcugcccacaaugauuacaugg

SEQ ID NO: 849887 - RNA, 19 nt, Human
aucauacauguuacacucu

SEQ ID NO: 849888 - RNA, 22 nt, Human
cacaggcuuccaguccccagcu

SEQ ID NO: 849889 - RNA, 22 nt, Human
ugcugaggcagaugucugugac

SEQ ID NO: 849890 - RNA, 19 nt, Human
uuugaaaggauuguuauuu

SEQ ID NO: 849891 - RNA, 22 nt, Human
uggcugagagucauccugugug

SEQ ID NO: 849892 - RNA, 22 nt, Human
aaauuaacuaucacuuuuguga

SEQ ID NO: 849893 - RNA, 22 nt, Human
uuuguaaauagcaguacucaug

SEQ ID NO: 849894 - RNA, 18 nt, Human
gcagcugacacuggaguu

SEQ ID NO: 849895 - RNA, 23 nt, Human
uaauucacauauacauugcuuca

SEQ ID NO: 849896 - RNA, 22 nt, Human
auucugauaucuuauucuagcu

SEQ ID NO: 849897 - RNA, 22 nt, Human
auuagguaagauaaagcagagg

SEQ ID NO: 849898 - RNA, 22 nt, Human
acuguagcugccacuggaugca

SEQ ID NO: 849899 - RNA, 22 nt, Human
uggcacauagaaaaggaucaau

SEQ ID NO: 849900 - RNA, 22 nt, Human
uacauacauguauguguguauu

SEQ ID NO: 849901 - RNA, 22 nt, Human
cagaaguuccuauuuaccuccu

SEQ ID NO: 849902 - RNA, 22 nt, Human
aggacaggauugagcugaacug

SEQ ID NO: 849903 - RNA, 22 nt, Human
ucugggaacucugucauuuccc

SEQ ID NO: 849904 - RNA, 22 nt, Human
aagaugacccugagggcaauug

SEQ ID NO: 849905 - RNA, 22 nt, Human
uccaaauauucggucuuucuga

SEQ ID NO: 849906 - RNA, 22 nt, Human
gagcugaggcugaggccucacu

SEQ ID NO: 849907 - RNA, 22 nt, Human
uauauuaguggaaugauaugaa

SEQ ID NO: 849908 - RNA, 22 nt, Human
auugucuuuccacugagaaguu

SEQ ID NO: 849909 - RNA, 22 nt, Human
aggcagcagucaugaggaaaga

SEQ ID NO: 849910 - RNA, 22 nt, Human
uuuguuuagaaagagauuggug

SEQ ID NO: 849911 - RNA, 22 nt, Human
ugaggccagucucaucacaggc

SEQ ID NO: 849912 - RNA, 22 nt, Human
cccaggagguggagcuugcagu

SEQ ID NO: 849913 - RNA, 22 nt, Human
aacaugcauauagguaaaugga

SEQ ID NO: 849914 - RNA, 22 nt, Human
gaggucaggcuugcagcagggu

SEQ ID NO: 849915 - RNA, 22 nt, Human
cauuuauuggcauguaguaggu

SEQ ID NO: 849916 - RNA, 20 nt, Human
ugcugagguugacaugccca

SEQ ID NO: 849917 - RNA, 22 nt, Human
cugcuucacuucgguugcauag

SEQ ID NO: 849918 - RNA, 22 nt, Human
aggccagcgcugcuagcucccg

SEQ ID NO: 849919 - RNA, 19 nt, Human
aggcuggagacaccaggcc

SEQ ID NO: 849920 - RNA, 22 nt, Human
agagggauaauauguauuguaa

SEQ ID NO: 849921 - RNA, 22 nt, Human
gaggccagggaugcaaugagag

SEQ ID NO: 849922 - RNA, 22 nt, Human
ucacuucacacccacuaucaug

SEQ ID NO: 849923 - RNA, 22 nt, Human
uccaccagagccuucccaugcu

SEQ ID NO: 849924 - RNA, 22 nt, Human
aaaggugacacucugccagcug

SEQ ID NO: 849925 - RNA, 22 nt, Human
uucaggauuauacucucuuccc

SEQ ID NO: 849926 - RNA, 21 nt, Human
auguaggaguuauuggaacag

SEQ ID NO: 849927 - RNA, 22 nt, Human
aaugcuuuuugcgaaaugugca

SEQ ID NO: 849928 - RNA, 22 nt, Human
ccugaggucacaacuugcuuau

SEQ ID NO: 849929 - RNA, 22 nt, Human
ugcccuggcauuggguuggaua

SEQ ID NO: 849930 - RNA, 22 nt, Human
augaaggcuguguagauggaug

SEQ ID NO: 849931 - RNA, 22 nt, Human
aguaaguuccaguuucauuaug

SEQ ID NO: 849932 - RNA, 22 nt, Human
cauuuguagcuauuuacuguau

SEQ ID NO: 849933 - RNA, 23 nt, Human
ggagugcaauggcgccaucucgg

SEQ ID NO: 849934 - RNA, 22 nt, Human
aagggcuggccacauucugggu

SEQ ID NO: 849935 - RNA, 22 nt, Human
augcagcuucaggauuaugaug

SEQ ID NO: 849936 - RNA, 23 nt, Human
cagaugagguuggcagcaugguc

SEQ ID NO: 849937 - RNA, 22 nt, Human
aggcugaggaucguacuuucca

SEQ ID NO: 849938 - RNA, 23 nt, Human
uucuucucaauuaguugauucag

SEQ ID NO: 849939 - RNA, 22 nt, Human
cacaggcuuuucugacauaggc

SEQ ID NO: 849940 - RNA, 22 nt, Human
aggcugaggcggguagaucacc

SEQ ID NO: 849941 - RNA, 22 nt, Human
gcugagauuacgggcaugagcc

SEQ ID NO: 849942 - RNA, 22 nt, Human
gagcagcuccagccgcaugacu

SEQ ID NO: 849943 - RNA, 22 nt, Human
ggaggccagccugaggcugagg

SEQ ID NO: 849944 - RNA, 22 nt, Human
uuacuuuggguccugcuuauaa

SEQ ID NO: 849945 - RNA, 22 nt, Human
gcugcccaggguggagccggcu

SEQ ID NO: 849946 - RNA, 22 nt, Human
augcuguguggccaccuccaug

SEQ ID NO: 849947 - RNA, 22 nt, Human
ccuggcugaacaaagucccucc

SEQ ID NO: 849948 - RNA, 22 nt, Human
uucuuuucuuuaggcauugugu

SEQ ID NO: 849949 - RNA, 22 nt, Human
gaagaaguauuuuuguccuguu

SEQ ID NO: 849950 - RNA, 22 nt, Human
uggcagcacuugaacuugagcc

SEQ ID NO: 849951 - RNA, 18 nt, Human
ucauuagggauugcaaag

SEQ ID NO: 849952 - RNA, 22 nt, Human
uucaggaugcucagaguagucu

SEQ ID NO: 849953 - RNA, 22 nt, Human
ccacaucucgguccccucuuug

SEQ ID NO: 849954 - RNA, 22 nt, Human
ucccuccccacuucugagcuuu

SEQ ID NO: 849955 - RNA, 22 nt, Human
uucauucuuugaaucugaggua

SEQ ID NO: 849956 - RNA, 17 nt, Human
acagagcacaucaagau

SEQ ID NO: 849957 - RNA, 22 nt, Human
cagaugaggcaaccucauugcu

SEQ ID NO: 849958 - RNA, 22 nt, Human
aaggagaaaugguagaugugca

SEQ ID NO: 849959 - RNA, 22 nt, Human
acaggcugcugggcuccgugcu

SEQ ID NO: 849960 - RNA, 22 nt, Human
auugaaagagaauguagcucuu

SEQ ID NO: 849961 - RNA, 22 nt, Human
uccaagcuugcuuuagccacag

SEQ ID NO: 849962 - RNA, 22 nt, Human
uccccacacagauacagaguag

SEQ ID NO: 849963 - RNA, 22 nt, Human
ucucaagaucucaagauggccc

SEQ ID NO: 849964 - RNA, 22 nt, Human
uagauuuuacuucugucauuac

SEQ ID NO: 849965 - RNA, 22 nt, Human
uagaaauguugguauuaacauu

SEQ ID NO: 849966 - RNA, 22 nt, Human
ggcugcuggggacgugggagag

SEQ ID NO: 849967 - RNA, 17 nt, Human
guguaacuaugagccau

SEQ ID NO: 849968 - RNA, 23 nt, Human
cccagggacacgaugacaccucc

SEQ ID NO: 849969 - RNA, 22 nt, Human
augaggucuggcaaucagaaac

SEQ ID NO: 849970 - RNA, 19 nt, Human
cucugccucuggcuguggc

SEQ ID NO: 849971 - RNA, 22 nt, Human
auuuccuuugcaaagacugugc

SEQ ID NO: 849972 - RNA, 22 nt, Human
ugaagggggagauauaugugug

SEQ ID NO: 849973 - RNA, 22 nt, Human
gacaguaagucagagacuuggu

SEQ ID NO: 849974 - RNA, 22 nt, Human
aaguggacuaauacaaggacua

SEQ ID NO: 849975 - RNA, 22 nt, Human
uuucacauaugguuguugauug

SEQ ID NO: 849976 - RNA, 22 nt, Human
cuucaguuaguuucaugugagc

SEQ ID NO: 849977 - RNA, 20 nt, Human
acuugcugggcuuuguuacc

SEQ ID NO: 849978 - RNA, 22 nt, Human
ugcugcaggcagccccucuacu

SEQ ID NO: 849979 - RNA, 22 nt, Human
gggcugagagcuggaaucugag

SEQ ID NO: 849980 - RNA, 22 nt, Human
cuccccagguucaggagguggg

SEQ ID NO: 849981 - RNA, 22 nt, Human
cccagcaggaggagguugcagu

SEQ ID NO: 849982 - RNA, 22 nt, Human
cuauuuaugugcuauuuuguau

SEQ ID NO: 849983 - RNA, 22 nt, Human
augcugugucuagcaggaacac

SEQ ID NO: 849984 - RNA, 22 nt, Human
aaguuugcauagauuaagcauu

SEQ ID NO: 849985 - RNA, 22 nt, Human
ucugccuccugcuugucccgac

SEQ ID NO: 849986 - RNA, 22 nt, Human
cagggcugguuugucgaagaaa

SEQ ID NO: 849987 - RNA, 22 nt, Human
auauucuuccaaaacaucauuu

SEQ ID NO: 849988 - RNA, 22 nt, Human
ucaggcuggaaugcaguggggc

SEQ ID NO: 849989 - RNA, 22 nt, Human
cugccucucagccugaccgcca

SEQ ID NO: 849990 - RNA, 22 nt, Human
uugcauuuuuagaugcuucugu

SEQ ID NO: 849991 - RNA, 22 nt, Human
uguuuucagucauauagcaggu

SEQ ID NO: 849992 - RNA, 22 nt, Human
ccucagggaaugggaggcuggg

SEQ ID NO: 849993 - RNA, 22 nt, Human
uaacaucuuuagcagcucgaac

SEQ ID NO: 849994 - RNA, 22 nt, Human
cagagcugagucuucaagguug

SEQ ID NO: 849995 - RNA, 22 nt, Human
uggagacucugcaucugugaca

SEQ ID NO: 849996 - RNA, 22 nt, Human
agggcugagacuaaggccagau

SEQ ID NO: 849997 - RNA, 20 nt, Human
ucacuaguaaccaucugcuu

SEQ ID NO: 849998 - RNA, 22 nt, Human
gcuagaaaucgacuucagaauu

SEQ ID NO: 849999 - RNA, 22 nt, Human
ucacagaaaucuguuuuuucua

SEQ ID NO: 850000 - RNA, 22 nt, Human
uagggcugugucuccaggacca

SEQ ID NO: 850001 - RNA, 22 nt, Human
uacuuuuagccuauuugauucu

SEQ ID NO: 850002 - RNA, 22 nt, Human
acucaggaaaugagaggcucuc

SEQ ID NO: 850003 - RNA, 22 nt, Human
acagucuugcuguauggucagg

SEQ ID NO: 850004 - RNA, 22 nt, Human
agcugugaccuucaagagcuac

SEQ ID NO: 850005 - RNA, 22 nt, Human
uugcugaaaacaguggguauug

SEQ ID NO: 850006 - RNA, 22 nt, Human
agguccacaguucagcugccca

SEQ ID NO: 850007 - RNA, 22 nt, Human
cccugagcaacaaacugaauac

SEQ ID NO: 850008 - RNA, 22 nt, Human
ugucaccaugcgaggcuaauuu

SEQ ID NO: 850009 - RNA, 22 nt, Human
uacccaggagaaacagcagggc

SEQ ID NO: 850010 - RNA, 22 nt, Human
aaacuccugggcucaagcaguu

SEQ ID NO: 850011 - RNA, 22 nt, Human
cuaagaaauguugugaaugcca

SEQ ID NO: 850012 - RNA, 22 nt, Human
ggcuguagguuggugcuggaca

SEQ ID NO: 850013 - RNA, 22 nt, Human
guagcagaaucagugcuacaga

SEQ ID NO: 850014 - RNA, 22 nt, Human
agucaauuaucucuaggucauc

SEQ ID NO: 850015 - RNA, 22 nt, Human
aauucacugaacuucucugaga

SEQ ID NO: 850016 - RNA, 23 nt, Human
gcugccuccuacaaaagcccagc

SEQ ID NO: 850017 - RNA, 22 nt, Human
uucucugaguacguuucagugu

SEQ ID NO: 850018 - RNA, 22 nt, Human
guggcaggagacuggaagaugg

SEQ ID NO: 850019 - RNA, 22 nt, Human
auuggcaaggcugcggugucug

SEQ ID NO: 850020 - RNA, 22 nt, Human
uucucagaggagucgggagcug

SEQ ID NO: 850021 - RNA, 20 nt, Human
agagcagcaguuggugaggu

SEQ ID NO: 850022 - RNA, 22 nt, Human
ccacaguagaauucaucucccu

SEQ ID NO: 850023 - RNA, 22 nt, Human
acuuuaaggaggcacucaucuc

SEQ ID NO: 850024 - RNA, 22 nt, Human
guaaaucauggucagaauaaau

SEQ ID NO: 850025 - RNA, 22 nt, Human
uuugcauaagucauguccagug

SEQ ID NO: 850026 - RNA, 22 nt, Human
gcaggcugggguagccccacuu

SEQ ID NO: 850027 - RNA, 20 nt, Human
ggccgaaauaauaguggcuu

SEQ ID NO: 850028 - RNA, 22 nt, Human
ugcucaguagcagugugcugcu

SEQ ID NO: 850029 - RNA, 22 nt, Human
uaggagagcugaacuauugucu

SEQ ID NO: 850030 - RNA, 20 nt, Human
guugaaaguaauaugaugcu

SEQ ID NO: 850031 - RNA, 20 nt, Human
ucagugauuuugaagaggaa

SEQ ID NO: 850032 - RNA, 22 nt, Human
uggcuucuuuguagaaauugaa

SEQ ID NO: 850033 - RNA, 22 nt, Human
gagguccaggguggggccugag

SEQ ID NO: 850034 - RNA, 22 nt, Human
aaauauaguaaaugcauaguuc

SEQ ID NO: 850035 - RNA, 22 nt, Human
gcagcugagagaagaacagggc

SEQ ID NO: 850036 - RNA, 16 nt, Human
gucuggccuaccugcc

SEQ ID NO: 850037 - RNA, 22 nt, Human
uuuaguagaaauauuugggccu

SEQ ID NO: 850038 - RNA, 22 nt, Human
uaggcagcagugcuaugauucu

SEQ ID NO: 850039 - RNA, 22 nt, Human
uggccauagcucagcuccuuca

SEQ ID NO: 850040 - RNA, 22 nt, Human
cccaggaagagugaguggcauu

SEQ ID NO: 850041 - RNA, 22 nt, Human
ucaauuauuugauaugaaaggg

SEQ ID NO: 850042 - RNA, 22 nt, Human
gugaaggacuagcauggagggc

SEQ ID NO: 850043 - RNA, 22 nt, Human
gagucuuugguaaagucugcug

SEQ ID NO: 850044 - RNA, 22 nt, Human
gcugcaggcuguggcaggggag

SEQ ID NO: 850045 - RNA, 20 nt, Human
cugcugugguccuuuauuuu

SEQ ID NO: 850046 - RNA, 22 nt, Human
cugcucugacccuuucaccuuc

SEQ ID NO: 850047 - RNA, 22 nt, Human
acaguaauugugaacuuaacgu

SEQ ID NO: 850048 - RNA, 22 nt, Human
ccagagcuugacgugcaacgga

SEQ ID NO: 850049 - RNA, 22 nt, Human
aagaaguuggaaaugauugaga

SEQ ID NO: 850050 - RNA, 18 nt, Human
uaacugguuucuucccau

SEQ ID NO: 850051 - RNA, 22 nt, Human
cuaagaaaauagaagcaugcua

SEQ ID NO: 850052 - RNA, 22 nt, Human
cuguggucaccaggcuggggcc

SEQ ID NO: 850053 - RNA, 22 nt, Human
uugaauaguuuuggauagcaua

SEQ ID NO: 850054 - RNA, 22 nt, Human
ucuggcaggcaaucggcucugg

SEQ ID NO: 850055 - RNA, 22 nt, Human
ugcuuugggucucucuaguuuc

SEQ ID NO: 850056 - RNA, 22 nt, Human
gauuaggagggagaggcaagua

SEQ ID NO: 850057 - RNA, 22 nt, Human
ggccaggaagggaagaucagca

SEQ ID NO: 850058 - RNA, 21 nt, Human
aaggcugagacaacucaggag

SEQ ID NO: 850059 - RNA, 22 nt, Human
ccucuucuaggacguccuugug

SEQ ID NO: 850060 - RNA, 22 nt, Human
ucucuggccgagagucccuggg

SEQ ID NO: 850061 - RNA, 22 nt, Human
cagcaagacuucagggcuuggu

SEQ ID NO: 850062 - RNA, 22 nt, Human
agguaggggguuugggaacugc

SEQ ID NO: 850063 - RNA, 22 nt, Human
acaguaacucuuuuacccuccu

SEQ ID NO: 850064 - RNA, 22 nt, Human
gcaggaagcauagaagaaugcc

SEQ ID NO: 850065 - RNA, 22 nt, Human
uucuucaaugugcccuguuuuc

SEQ ID NO: 850066 - RNA, 22 nt, Human
ggcucagagaccugcgaucuga

SEQ ID NO: 850067 - RNA, 22 nt, Human
ggguggagaggcuaaguccagu

SEQ ID NO: 850068 - RNA, 22 nt, Human
gauuaaguaacugaacacuuug

SEQ ID NO: 850069 - RNA, 22 nt, Human
ucuucuaguaggccaagaagcu

SEQ ID NO: 850070 - RNA, 22 nt, Human
uguugaagauaaaguucucauu

SEQ ID NO: 850071 - RNA, 22 nt, Human
uugaauuauaagugugucuacu

SEQ ID NO: 850072 - RNA, 23 nt, Human
cugcuguuuucuguaccugaagc

SEQ ID NO: 850073 - RNA, 22 nt, Human
ucugaggucacagauuucaaga

SEQ ID NO: 850074 - RNA, 22 nt, Human
agaggacagacggaaagugcca

SEQ ID NO: 850075 - RNA, 22 nt, Human
auuugcuuuaagguauaaaagg

SEQ ID NO: 850076 - RNA, 22 nt, Human
cuucagagugcagaagauuggg

SEQ ID NO: 850077 - RNA, 19 nt, Human
agcuuccauauucucuagu

SEQ ID NO: 850078 - RNA, 20 nt, Human
uaggcagcuugacccuuggu

SEQ ID NO: 850079 - RNA, 22 nt, Human
ccuuuucaacuaagauucugca

SEQ ID NO: 850080 - RNA, 22 nt, Human
uugaggucuucagcugacaccu

SEQ ID NO: 850081 - RNA, 22 nt, Human
agacaggcagaggcugcagagg

SEQ ID NO: 850082 - RNA, 22 nt, Human
cagcaagauuuuuaaagcaagg

SEQ ID NO: 850083 - RNA, 22 nt, Human
uguccucagauaugucuacucu

SEQ ID NO: 850084 - RNA, 22 nt, Human
uucccucucacuuaaagcuugg

SEQ ID NO: 850085 - RNA, 22 nt, Human
gcauugaguccacucugucuuu

SEQ ID NO: 850086 - RNA, 22 nt, Human
cuuugcaauagaggcacacaug

SEQ ID NO: 850087 - RNA, 22 nt, Human
guugacagaaaaauaacauagc

SEQ ID NO: 850088 - RNA, 22 nt, Human
auuagagaaugugcugacauug

SEQ ID NO: 850089 - RNA, 22 nt, Human
uuuauuagauuaucaaagaggu

SEQ ID NO: 850090 - RNA, 22 nt, Human
aaaggccacugcaagggaaggu

SEQ ID NO: 850091 - RNA, 22 nt, Human
caggcgagggcccugaggagcc

SEQ ID NO: 850092 - RNA, 22 nt, Human
ucuccuggcaugugggucaucu

SEQ ID NO: 850093 - RNA, 22 nt, Human
uggguccacaaacaucagauau

SEQ ID NO: 850094 - RNA, 22 nt, Human
cccaggagagaggccaguuggc

SEQ ID NO: 850095 - RNA, 22 nt, Human
gagggcugccacguugggcgag

SEQ ID NO: 850096 - RNA, 22 nt, Human
guggccaagaggggacuggaua

SEQ ID NO: 850097 - RNA, 22 nt, Human
ucuaaagaagaggguucugcgg

SEQ ID NO: 850098 - RNA, 22 nt, Human
gggcagcuggcuuauagguuug

SEQ ID NO: 850099 - RNA, 22 nt, Human
auuuucaaaacaucugcugugu

SEQ ID NO: 850100 - RNA, 18 nt, Human
agaggggagguaagucug

SEQ ID NO: 850101 - RNA, 22 nt, Human
cacagcuaggaggaaagcagag

SEQ ID NO: 850102 - RNA, 22 nt, Human
aucuucucauguguaaugaggu

SEQ ID NO: 850103 - RNA, 22 nt, Human
ucugccugcggcugcagguggc

SEQ ID NO: 850104 - RNA, 22 nt, Human
cagugauggauauggagaaguc

SEQ ID NO: 850105 - RNA, 22 nt, Human
uauuucagcaagaagaaugugg

SEQ ID NO: 850106 - RNA, 22 nt, Human
caaggcugucuccagcuuccaa

SEQ ID NO: 850107 - RNA, 22 nt, Human
cagucucucugaaguauuaaga

SEQ ID NO: 850108 - RNA, 23 nt, Human
gcagaggagcaagcuggacacca

SEQ ID NO: 850109 - RNA, 22 nt, Human
ucugagccguauggcuuggcua

SEQ ID NO: 850110 - RNA, 22 nt, Human
acccucccauuuccauguagca

SEQ ID NO: 850111 - RNA, 22 nt, Human
acccagagaacugugccuugag

SEQ ID NO: 850112 - RNA, 22 nt, Human
uuuuaucuaccuaugcucauuu

SEQ ID NO: 850113 - RNA, 22 nt, Human
ugcugaggcccaggagcacuuu

SEQ ID NO: 850114 - RNA, 22 nt, Human
gucaggauuggggucaugaguc

SEQ ID NO: 850115 - RNA, 22 nt, Human
ugaaggcugggcucagccagcu

SEQ ID NO: 850116 - RNA, 21 nt, Human
ucacagacuggucagugaggc

SEQ ID NO: 850117 - RNA, 22 nt, Human
gugggguagaucuuucucagga

SEQ ID NO: 850118 - RNA, 23 nt, Human
acauacauggagauaaagugaug

SEQ ID NO: 850119 - RNA, 22 nt, Human
uucaaauacauucuuugccacu

SEQ ID NO: 850120 - RNA, 22 nt, Human
gcccaggaggcagagguugugg

SEQ ID NO: 850121 - RNA, 20 nt, Human
cuucuucaguaguuuguucu

SEQ ID NO: 850122 - RNA, 21 nt, Human
agggagcuuuagguagaaguu

SEQ ID NO: 850123 - RNA, 23 nt, Human
aaaugacauaugguuucugaagg

SEQ ID NO: 850124 - RNA, 22 nt, Human
uuuauucaucaucuguucauau

SEQ ID NO: 850125 - RNA, 22 nt, Human
uuccaagaguaaauucaaauug

SEQ ID NO: 850126 - RNA, 22 nt, Human
cuguccccgcgaguccagagcu

SEQ ID NO: 850127 - RNA, 22 nt, Human
gcugccucugcgacucugggcg

SEQ ID NO: 850128 - RNA, 22 nt, Human
ucuucaaguuccaaagugcagg

SEQ ID NO: 850129 - RNA, 22 nt, Human
aacaugauggggaagaacaaga

SEQ ID NO: 850130 - RNA, 22 nt, Human
uuugcaaauaccaugaaacuug

SEQ ID NO: 850131 - RNA, 22 nt, Human
gguguccaucaggcugugcuuc

SEQ ID NO: 850132 - RNA, 22 nt, Human
gagccaagaucgcaccacugca

SEQ ID NO: 850133 - RNA, 22 nt, Human
caugauuuugucuuguguuaau

SEQ ID NO: 850134 - RNA, 22 nt, Human
gggcagcucuggcugugggaag

SEQ ID NO: 850135 - RNA, 22 nt, Human
auauacaugggaauauguggag

SEQ ID NO: 850136 - RNA, 22 nt, Human
uccccagggcugcagagggugu

SEQ ID NO: 850137 - RNA, 22 nt, Human
ugaaguuauauauguugaaaau

SEQ ID NO: 850138 - RNA, 22 nt, Human
caagauggguguugugaugguu

SEQ ID NO: 850139 - RNA, 22 nt, Human
uugaggucuggcaguagcguug

SEQ ID NO: 850140 - RNA, 22 nt, Human
aaauuguugaucuacaguaagg

SEQ ID NO: 850141 - RNA, 22 nt, Human
uaacaguaaaguaaguuagcuu

SEQ ID NO: 850142 - RNA, 22 nt, Human
uuugcaaagaaauuauugcugu

SEQ ID NO: 850143 - RNA, 22 nt, Human
ugaggcccagccgcccugagag

SEQ ID NO: 850144 - RNA, 22 nt, Human
gcuggcugcacaggggcucacu

SEQ ID NO: 850145 - RNA, 22 nt, Human
agcagccuuugaucaucuggga

SEQ ID NO: 850146 - RNA, 18 nt, Human
aagaggaggagcagguug

SEQ ID NO: 850147 - RNA, 22 nt, Human
uagugcuuaauaaauuucagaa

SEQ ID NO: 850148 - RNA, 22 nt, Human
gacaggcuucauccucagaguu

SEQ ID NO: 850149 - RNA, 22 nt, Human
aguuacagugaccauuuauuua

SEQ ID NO: 850150 - RNA, 22 nt, Human
agccagcugugggcucaggcgg

SEQ ID NO: 850151 - RNA, 22 nt, Human
uccugggcuuuguuucucuccu

SEQ ID NO: 850152 - RNA, 22 nt, Human
uugaaaggguuaaagugguaaa

SEQ ID NO: 850153 - RNA, 22 nt, Human
ugaaaugagagcacagaauaaa

SEQ ID NO: 850154 - RNA, 22 nt, Human
uuggcagcccagcuuacuagca

SEQ ID NO: 850155 - RNA, 22 nt, Human
gccugcuggaggagccucaggg

SEQ ID NO: 850156 - RNA, 20 nt, Human
gggcagcuccccucauucug

SEQ ID NO: 850157 - RNA, 19 nt, Human
ccagaguuggcagagcagg

SEQ ID NO: 850158 - RNA, 20 nt, Human
guaacucuggcuaaguaaau

SEQ ID NO: 850159 - RNA, 22 nt, Human
aacuggauuuugaugagcaguu

SEQ ID NO: 850160 - RNA, 22 nt, Human
cacuuucucaugaauuuggccc

SEQ ID NO: 850161 - RNA, 22 nt, Human
aggcuggcgacaucuggcgggc

SEQ ID NO: 850162 - RNA, 22 nt, Human
auguggaggaaaugaguguaca

SEQ ID NO: 850163 - RNA, 22 nt, Human
gagcugagggucuaggaggguu

SEQ ID NO: 850164 - RNA, 22 nt, Human
guuugcauauuugcacaggaau

SEQ ID NO: 850165 - RNA, 22 nt, Human
cuagccugggauuugaacuuau

SEQ ID NO: 850166 - RNA, 22 nt, Human
auuugcaaagucguaucuguga

SEQ ID NO: 850167 - RNA, 22 nt, Human
cucaggaucgcuugcccuaggg

SEQ ID NO: 850168 - RNA, 22 nt, Human
auggaaagggaagcaaggaaca

SEQ ID NO: 850169 - RNA, 22 nt, Human
guucuucaucuuaaccaucugu

SEQ ID NO: 850170 - RNA, 22 nt, Human
auauuagguuggugcaaaagua

SEQ ID NO: 850171 - RNA, 22 nt, Human
uccugagcugccgcaucagcag

SEQ ID NO: 850172 - RNA, 22 nt, Human
uagaaacaucagcuaaccaaaa

SEQ ID NO: 850173 - RNA, 22 nt, Human
ggagcggagggagggccacugu

SEQ ID NO: 850174 - RNA, 22 nt, Human
uggcacauaguaggugcucaau

SEQ ID NO: 850175 - RNA, 22 nt, Human
cagagggcucuuggcugccugc

SEQ ID NO: 850176 - RNA, 22 nt, Human
gucaggaugggcagccaaacua

SEQ ID NO: 850177 - RNA, 20 nt, Human
aggcaguuagaaggagauga

SEQ ID NO: 850178 - RNA, 22 nt, Human
gcaaauauucaagacuuuucca

SEQ ID NO: 850179 - RNA, 22 nt, Human
gggcagcuggccagguauucug

SEQ ID NO: 850180 - RNA, 21 nt, Human
cagaggucauccugaggacaa

SEQ ID NO: 850181 - RNA, 22 nt, Human
ccuccuggaaaaauucccuggc

SEQ ID NO: 850182 - RNA, 22 nt, Human
uacacauacaccaaugugguca

SEQ ID NO: 850183 - RNA, 22 nt, Human
uuauguaggauaaugaauugcc

SEQ ID NO: 850184 - RNA, 21 nt, Human
gcugcccaacccugcaucucc

SEQ ID NO: 850185 - RNA, 22 nt, Human
ccaggaguggcuggugaccuuc

SEQ ID NO: 850186 - RNA, 22 nt, Human
guggcagagugcgguucugacc

SEQ ID NO: 850187 - RNA, 22 nt, Human
accaggaggccuggagcacaaa

SEQ ID NO: 850188 - RNA, 22 nt, Human
ucuuggcuaguaccuuccugcc

SEQ ID NO: 850189 - RNA, 22 nt, Human
auuagagcuguuagugaagugc

SEQ ID NO: 850190 - RNA, 22 nt, Human
ccugagccucuugcacgcucag

SEQ ID NO: 850191 - RNA, 22 nt, Human
gaggccaggagugcuguaaguu

SEQ ID NO: 850192 - RNA, 22 nt, Human
ucacaaaagcuuuugaauuugg

SEQ ID NO: 850193 - RNA, 22 nt, Human
cugguacaguguuacaaaaugg

SEQ ID NO: 850194 - RNA, 23 nt, Human
uccaggagcaugcuggcuggcga

SEQ ID NO: 850195 - RNA, 22 nt, Human
aggcugagcggggucccagagc

SEQ ID NO: 850196 - RNA, 22 nt, Human
cucaguuuugcuagcuggaguu

SEQ ID NO: 850197 - RNA, 22 nt, Human
gcauguguggaggagaugugcu

SEQ ID NO: 850198 - RNA, 22 nt, Human
gguggagcuggaccaggagagg

SEQ ID NO: 850199 - RNA, 22 nt, Human
gaaggggacuggcagcugcaga

SEQ ID NO: 850200 - RNA, 22 nt, Human
aagcugaggucaaguagcuagu

SEQ ID NO: 850201 - RNA, 22 nt, Human
augaggucauucuuggauuaca

SEQ ID NO: 850202 - RNA, 22 nt, Human
gcugagguuucaggaguggcag

SEQ ID NO: 850203 - RNA, 22 nt, Human
uccaggagguugagacugcagu

SEQ ID NO: 850204 - RNA, 22 nt, Human
acuggcagccacaacuggcagg

SEQ ID NO: 850205 - RNA, 22 nt, Human
agguaacacuacuuaguauacu

SEQ ID NO: 850206 - RNA, 21 nt, Human
uuaccaauggcuucucuuucc

SEQ ID NO: 850207 - RNA, 22 nt, Human
uugguacaugcagauauuuagu

SEQ ID NO: 850208 - RNA, 22 nt, Human
caucucaugggcaugccaagcu

SEQ ID NO: 850209 - RNA, 17 nt, Human
cccacggaggugugaaa

SEQ ID NO: 850210 - RNA, 22 nt, Human
acuaaaguaucuccuauuucau

SEQ ID NO: 850211 - RNA, 22 nt, Human
cauuuguaucauauguaucuua

SEQ ID NO: 850212 - RNA, 22 nt, Human
uccaggagacacccuugugugu

SEQ ID NO: 850213 - RNA, 22 nt, Human
gcagacagaugagggugcuggg

SEQ ID NO: 850214 - RNA, 23 nt, Human
uuucaacuccugccauuauuucu

SEQ ID NO: 850215 - RNA, 22 nt, Human
ccuggcuggauggagccccugg

SEQ ID NO: 850216 - RNA, 22 nt, Human
uagcagaggcaaggaugugaau

SEQ ID NO: 850217 - RNA, 22 nt, Human
cuggcuguauuaguuugauccu

SEQ ID NO: 850218 - RNA, 22 nt, Human
ggccaggagaggagggcacuga

SEQ ID NO: 850219 - RNA, 22 nt, Human
aggccaaagugcuccuuuuaga

SEQ ID NO: 850220 - RNA, 22 nt, Human
cugagccagcuggcaugugcua

SEQ ID NO: 850221 - RNA, 22 nt, Human
gagcaccucaauuugcuauuug

SEQ ID NO: 850222 - RNA, 22 nt, Human
uaguuaggguucugcagagaca

SEQ ID NO: 850223 - RNA, 22 nt, Human
auucuucaguauguguggauug

SEQ ID NO: 850224 - RNA, 20 nt, Human
ucauuacagugcuaagaugu

SEQ ID NO: 850225 - RNA, 22 nt, Human
uccuggccaaguuacucucugc

SEQ ID NO: 850226 - RNA, 22 nt, Human
uauuuccaaaagccuauuauga

SEQ ID NO: 850227 - RNA, 19 nt, Human
caggaaugagguaauggcu

SEQ ID NO: 850228 - RNA, 22 nt, Human
cagcuggccaaucagggcgccc

SEQ ID NO: 850229 - RNA, 22 nt, Human
ucugagguuuucauguuuucug

SEQ ID NO: 850230 - RNA, 22 nt, Human
uacacuuuucaauguagucugu

SEQ ID NO: 850231 - RNA, 22 nt, Human
cugggccagaccuuguggucuu

SEQ ID NO: 850232 - RNA, 22 nt, Human
cagaauggcuuuuauggcucag

SEQ ID NO: 850233 - RNA, 22 nt, Human
ucucaggacuuugggaagcuca

SEQ ID NO: 850234 - RNA, 21 nt, Human
gccuggcucucacuggccugg

SEQ ID NO: 850235 - RNA, 22 nt, Human
uacauacagagaugcuaguuaa

SEQ ID NO: 850236 - RNA, 22 nt, Human
ggaggaggcggcagaaguuccu

SEQ ID NO: 850237 - RNA, 22 nt, Human
gcucaggaucccaggggugugc

SEQ ID NO: 850238 - RNA, 22 nt, Human
uuugaaguucccccauaucaga

SEQ ID NO: 850239 - RNA, 20 nt, Human
cacguuuuuccacuagcaaa

SEQ ID NO: 850240 - RNA, 22 nt, Human
gcccuccccucuggguggugag

SEQ ID NO: 850241 - RNA, 22 nt, Human
aucuucucaagcagcauccugu

SEQ ID NO: 850242 - RNA, 20 nt, Human
aggccaaacccagcgcgccc

SEQ ID NO: 850243 - RNA, 22 nt, Human
cagagagagucaaaucuuugcu

SEQ ID NO: 850244 - RNA, 22 nt, Human
ggguccaccugagcagcagccu

SEQ ID NO: 850245 - RNA, 22 nt, Human
aagcagcuuuugaagagugagg

SEQ ID NO: 850246 - RNA, 22 nt, Human
cucccaggcacagggaggagcc

SEQ ID NO: 850247 - RNA, 22 nt, Human
guuuucaauuauaagauggcuu

SEQ ID NO: 850248 - RNA, 22 nt, Human
guguuuuaagaaagaagcucag

SEQ ID NO: 850249 - RNA, 22 nt, Human
uuagagucaaaauggcauguua

SEQ ID NO: 850250 - RNA, 22 nt, Human
cgaggcagggaagcugcaaaag

SEQ ID NO: 850251 - RNA, 22 nt, Human
cucuucucugcagccuuugaag

SEQ ID NO: 850252 - RNA, 22 nt, Human
uuugaaagggacaaagucacug

SEQ ID NO: 850253 - RNA, 22 nt, Human
ugaaaugaagggcuuguucugg

SEQ ID NO: 850254 - RNA, 22 nt, Human
cugcugugcacccaggaaggcu

SEQ ID NO: 850255 - RNA, 22 nt, Human
ggaguaggaguagaacucauca

SEQ ID NO: 850256 - RNA, 22 nt, Human
ugauuuccuaggucuggagaag

SEQ ID NO: 850257 - RNA, 22 nt, Human
uuuuacuuaauucuuggucaug

SEQ ID NO: 850258 - RNA, 22 nt, Human
gcccagggcuucaaagagagaa

SEQ ID NO: 850259 - RNA, 23 nt, Human
uugcacauuggagcuggucuucu

SEQ ID NO: 850260 - RNA, 22 nt, Human
gagcugaguguccuaggcaugg

SEQ ID NO: 850261 - RNA, 22 nt, Human
gccuggcucccucugcagcucc

SEQ ID NO: 850262 - RNA, 22 nt, Human
aggccagaugucgggcuagaag

SEQ ID NO: 850263 - RNA, 22 nt, Human
cuggaggcacccuuagagaggc

SEQ ID NO: 850264 - RNA, 22 nt, Human
ucacaguaucacacaaggauua

SEQ ID NO: 850265 - RNA, 22 nt, Human
gcucaggaaaacagucuaguaa

SEQ ID NO: 850266 - RNA, 22 nt, Human
ccuccucugggaagauucagag

SEQ ID NO: 850267 - RNA, 22 nt, Human
aucaggaucugcaucauaagaa

SEQ ID NO: 850268 - RNA, 22 nt, Human
uccaggagguaugaguggcccc

SEQ ID NO: 850269 - RNA, 22 nt, Human
uuuaauuaggaaaugggcaggg

SEQ ID NO: 850270 - RNA, 23 nt, Human
ugauuaggucuacucuuggcucc

SEQ ID NO: 850271 - RNA, 22 nt, Human
ucucugcccauccucaguccac

SEQ ID NO: 850272 - RNA, 22 nt, Human
cagcugccugucuggaggcaau

SEQ ID NO: 850273 - RNA, 22 nt, Human
gaaaugaaacaggcuuuuaagg

SEQ ID NO: 850274 - RNA, 22 nt, Human
ugaggcuguucuaccagggcca

SEQ ID NO: 850275 - RNA, 22 nt, Human
acagcauugcuccaucucaaga

SEQ ID NO: 850276 - RNA, 22 nt, Human
agaauaaaauagucugaagaug

SEQ ID NO: 850277 - RNA, 22 nt, Human
cagcgucucguugugggccucg

SEQ ID NO: 850278 - RNA, 22 nt, Human
ggcugcugguagggguaggaag

SEQ ID NO: 850279 - RNA, 23 nt, Human
ccuggcuguggauuugggccugc

SEQ ID NO: 850280 - RNA, 21 nt, Human
agacagaacaacugcucucca

SEQ ID NO: 850281 - RNA, 22 nt, Human
augcaucuauucccaagggcag

SEQ ID NO: 850282 - RNA, 22 nt, Human
acucauuugacacuuuaaacug

SEQ ID NO: 850283 - RNA, 22 nt, Human
uacagagaauaauaggacaggu

SEQ ID NO: 850284 - RNA, 22 nt, Human
ugaaagcacaaguucuaacagg

SEQ ID NO: 850285 - RNA, 22 nt, Human
agcacagggcccagccuaggcc

SEQ ID NO: 850286 - RNA, 22 nt, Human
uucucaaagaaagcugucauua

SEQ ID NO: 850287 - RNA, 19 nt, Human
gaggucagcaagaaguauu

SEQ ID NO: 850288 - RNA, 22 nt, Human
agacaaauggaguaugagcaac

SEQ ID NO: 850289 - RNA, 22 nt, Human
auucuucacuguuucagaauga

SEQ ID NO: 850290 - RNA, 22 nt, Human
uucaccuugaauaugucuuaaa

SEQ ID NO: 850291 - RNA, 22 nt, Human
cucuuucugauucgcugggacc

SEQ ID NO: 850292 - RNA, 22 nt, Human
cagcugcuuuaguuuuccaucc

SEQ ID NO: 850293 - RNA, 22 nt, Human
cuggcuugcagcucaucauaaa

SEQ ID NO: 850294 - RNA, 19 nt, Human
uucuccagccugaccugag

SEQ ID NO: 850295 - RNA, 22 nt, Human
ugucucugauaaguaguucagu

SEQ ID NO: 850296 - RNA, 22 nt, Human
cccaggaauuggaggcugcagu

SEQ ID NO: 850297 - RNA, 22 nt, Human
gagcuguccgccccugggccga

SEQ ID NO: 850298 - RNA, 22 nt, Human
gucaggaugagggaugaggagu

SEQ ID NO: 850299 - RNA, 22 nt, Human
caggaugagguagaggcagaua

SEQ ID NO: 850300 - RNA, 22 nt, Human
uguagauaaguaaaagcccagu

SEQ ID NO: 850301 - RNA, 22 nt, Human
gcucccagacugaccagaggug

SEQ ID NO: 850302 - RNA, 22 nt, Human
agcacuguggggaacucacaga

SEQ ID NO: 850303 - RNA, 22 nt, Human
acaaugaacgcuuuuuaacugu

SEQ ID NO: 850304 - RNA, 22 nt, Human
ucacauucucagcaucuauaca

SEQ ID NO: 850305 - RNA, 22 nt, Human
gauauagguucauaguguuaca

SEQ ID NO: 850306 - RNA, 22 nt, Human
cuuuggcacagucucauuugau

SEQ ID NO: 850307 - RNA, 22 nt, Human
auucuagaaggcaaagcaaggg

SEQ ID NO: 850308 - RNA, 22 nt, Human
uggcucaggggucuggcucugu

SEQ ID NO: 850309 - RNA, 22 nt, Human
gggcaguugauggaggucugga

SEQ ID NO: 850310 - RNA, 22 nt, Human
guguugaugacauuuuagaaac

SEQ ID NO: 850311 - RNA, 22 nt, Human
aaaaacugguaacuauucccca

SEQ ID NO: 850312 - RNA, 22 nt, Human
cagucucucagcuuucagcugu

SEQ ID NO: 850313 - RNA, 22 nt, Human
gcugggaagugcaagaucaagg

SEQ ID NO: 850314 - RNA, 22 nt, Human
agcuucccaagguuggaagguu

SEQ ID NO: 850315 - RNA, 19 nt, Human
uucccaggaaaggggugca

SEQ ID NO: 850316 - RNA, 22 nt, Human
augcugugguagacagcauucc

SEQ ID NO: 850317 - RNA, 21 nt, Human
uuuuauugaugaauggccacu

SEQ ID NO: 850318 - RNA, 22 nt, Human
ugauuuuuagcuauucugaaga

SEQ ID NO: 850319 - RNA, 22 nt, Human
cucaggaugucggugacuauug

SEQ ID NO: 850320 - RNA, 22 nt, Human
uuuuuuaguuaggucagaaugu

SEQ ID NO: 850321 - RNA, 22 nt, Human
uacuuucuagcucuccccaguu

SEQ ID NO: 850322 - RNA, 22 nt, Human
auaguuugugaaacacagcagu

SEQ ID NO: 850323 - RNA, 22 nt, Human
uagggauguaaacauaguaauu

SEQ ID NO: 850324 - RNA, 22 nt, Human
caaauacuggguaaguuaauuu

SEQ ID NO: 850325 - RNA, 22 nt, Human
agaggaggaagagcuuuaaaau

SEQ ID NO: 850326 - RNA, 22 nt, Human
gaggcagcagaacauggaagag

SEQ ID NO: 850327 - RNA, 22 nt, Human
gcugccugccuugccuggagga

SEQ ID NO: 850328 - RNA, 22 nt, Human
uuuuuauaugaaggauagugcg

SEQ ID NO: 850329 - RNA, 22 nt, Human
ggccugagaaccauggggccaa

SEQ ID NO: 850330 - RNA, 22 nt, Human
ugaggcucagagaagugcuguu

SEQ ID NO: 850331 - RNA, 22 nt, Human
ccuggauucaagucuuucuuuc

SEQ ID NO: 850332 - RNA, 22 nt, Human
gggcugagucaucuggggccuc

SEQ ID NO: 850333 - RNA, 22 nt, Human
ccaggcuggucugaauuucuag

SEQ ID NO: 850334 - RNA, 22 nt, Human
cugccuggggaaugugaggauu

SEQ ID NO: 850335 - RNA, 21 nt, Human
uucaaaaugguguguuugucu

SEQ ID NO: 850336 - RNA, 22 nt, Human
agcagcuggaacauaugaagaa

SEQ ID NO: 850337 - RNA, 22 nt, Human
aaaaaugaaacggcugguuggc

SEQ ID NO: 850338 - RNA, 22 nt, Human
acuccuggguuccggagauucu

SEQ ID NO: 850339 - RNA, 22 nt, Human
ggcuaggcgggcacauggugga

SEQ ID NO: 850340 - RNA, 22 nt, Human
ugaguucuaguggcugcagauu

SEQ ID NO: 850341 - RNA, 19 nt, Human
gagcgcagagggcagggga

SEQ ID NO: 850342 - RNA, 22 nt, Human
cuucugcaauaaguuuuggucc

SEQ ID NO: 850343 - RNA, 22 nt, Human
gagaaggaguagcugaccuggg

SEQ ID NO: 850344 - RNA, 22 nt, Human
gccaggggacgcggagcgacga

SEQ ID NO: 850345 - RNA, 22 nt, Human
aaagauuaggcggcaacugggc

SEQ ID NO: 850346 - RNA, 22 nt, Human
aaauaaguuaaacuagaaugau

SEQ ID NO: 850347 - RNA, 22 nt, Human
gacacuuuauuaagcuguuguu

SEQ ID NO: 850348 - RNA, 19 nt, Human
gccaggcuccauagccggc

SEQ ID NO: 850349 - RNA, 22 nt, Human
uuucaaagaguuguaaauuacu

SEQ ID NO: 850350 - RNA, 18 nt, Human
agggaguuuuagggaagg

SEQ ID NO: 850351 - RNA, 20 nt, Human
uuucaguuaucuugaccuuc

SEQ ID NO: 850352 - RNA, 22 nt, Human
cugagggccuuggcuccugccc

SEQ ID NO: 850353 - RNA, 22 nt, Human
uuaaaauagccagugccccucu

SEQ ID NO: 850354 - RNA, 22 nt, Human
ccuguccuccaagagcacaucu

SEQ ID NO: 850355 - RNA, 22 nt, Human
gacugguaagguauuggaauuc

SEQ ID NO: 850356 - RNA, 22 nt, Human
ggcagaggaaggaugaauucac

SEQ ID NO: 850357 - RNA, 22 nt, Human
uaauacagaaguguauuaaaau

SEQ ID NO: 850358 - RNA, 20 nt, Human
uaggcagagcugugcagccu

SEQ ID NO: 850359 - RNA, 22 nt, Human
caguugcuggaugugcagcucu

SEQ ID NO: 850360 - RNA, 19 nt, Human
aucugccuguuaucacaua

SEQ ID NO: 850361 - RNA, 22 nt, Human
ugcugcugaugcauagucugcu

SEQ ID NO: 850362 - RNA, 22 nt, Human
uacacacaugcauuugccuuau

SEQ ID NO: 850363 - RNA, 22 nt, Human
ucugagguggggcuggagcauu

SEQ ID NO: 850364 - RNA, 22 nt, Human
uugcucaggcuggugugcagug

SEQ ID NO: 850365 - RNA, 22 nt, Human
cugcacaguuugauuucuugcu

SEQ ID NO: 850366 - RNA, 18 nt, Human
uuugcaaaggaaguaugg

SEQ ID NO: 850367 - RNA, 22 nt, Human
auauauuugagaauauucauga

SEQ ID NO: 850368 - RNA, 15 nt, Human
caggagaggaagguu

SEQ ID NO: 850369 - RNA, 22 nt, Human
cuuagagccuuacucuucuugu

SEQ ID NO: 850370 - RNA, 22 nt, Human
uuauuuaaugugaucugaagag

SEQ ID NO: 850371 - RNA, 22 nt, Human
ugcccuggggagcccagccagg

SEQ ID NO: 850372 - RNA, 22 nt, Human
guggccaaacaccaguuuagga

SEQ ID NO: 850373 - RNA, 22 nt, Human
cugcuguggccagccaggucaa

SEQ ID NO: 850374 - RNA, 22 nt, Human
acaggcugggcgcuuccugcgg

SEQ ID NO: 850375 - RNA, 22 nt, Human
ucucauugguauauacaugugu

SEQ ID NO: 850376 - RNA, 22 nt, Human
gcuggccauggccugcgccauc

SEQ ID NO: 850377 - RNA, 22 nt, Human
ugaggcaguucuuacuuguauu

SEQ ID NO: 850378 - RNA, 22 nt, Human
ucaggagaaggcaauguggaaa

SEQ ID NO: 850379 - RNA, 23 nt, Human
uggccacagggugcuccauugua

SEQ ID NO: 850380 - RNA, 22 nt, Human
ggaggcugagaaguccaagauc

SEQ ID NO: 850381 - RNA, 22 nt, Human
agaaaguuugagaacuguagau

SEQ ID NO: 850382 - RNA, 22 nt, Human
cagagccacuuggagaugagaa

SEQ ID NO: 850383 - RNA, 22 nt, Human
ucauuugugugagugauuugac

SEQ ID NO: 850384 - RNA, 22 nt, Human
aagacuguacauuuuccagucu

SEQ ID NO: 850385 - RNA, 22 nt, Human
aaagccaugggucuuuggcaua

SEQ ID NO: 850386 - RNA, 22 nt, Human
gaaggccauuuuuagguagaau

SEQ ID NO: 850387 - RNA, 22 nt, Human
uuucaguuuaugucuugaauua

SEQ ID NO: 850388 - RNA, 22 nt, Human
caagaagugucagcuuuuuaaa

SEQ ID NO: 850389 - RNA, 22 nt, Human
uuugaaagcaccauuugaguag

SEQ ID NO: 850390 - RNA, 22 nt, Human
uguagggaggaaggguuggaaa

SEQ ID NO: 850391 - RNA, 22 nt, Human
aaguuacaguuacagaauggag

SEQ ID NO: 850392 - RNA, 22 nt, Human
gcuguagguaaggauggcaaag

SEQ ID NO: 850393 - RNA, 22 nt, Human
ucuuuuggaaaugaugugcagg

SEQ ID NO: 850394 - RNA, 20 nt, Human
guggcaggcagugaaggagc

SEQ ID NO: 850395 - RNA, 22 nt, Human
ggagcagggcagugaauucugg

SEQ ID NO: 850396 - RNA, 22 nt, Human
auuaggauguuccuaugcacau

SEQ ID NO: 850397 - RNA, 22 nt, Human
aaacugguaauaaaauggauua

SEQ ID NO: 850398 - RNA, 22 nt, Human
cuggccaauccauuaauuuguu

SEQ ID NO: 850399 - RNA, 20 nt, Human
cauacacuauucuguauagu

SEQ ID NO: 850400 - RNA, 22 nt, Human
uaaguggaagguuauaugcuaa

SEQ ID NO: 850401 - RNA, 22 nt, Human
caagauggacauaaggagagaa

SEQ ID NO: 850402 - RNA, 22 nt, Human
uauuucuucgggauucaagcua

SEQ ID NO: 850403 - RNA, 22 nt, Human
uagaaaagauaacauucugugc

SEQ ID NO: 850404 - RNA, 22 nt, Human
aauaucaacaguguccuucuaa

SEQ ID NO: 850405 - RNA, 22 nt, Human
cuucugaggcagcuauucaguu

SEQ ID NO: 850406 - RNA, 22 nt, Human
gaggcagcggcucacagagaaa

SEQ ID NO: 850407 - RNA, 22 nt, Human
gagggcugauaaaugcgcaugg

SEQ ID NO: 850408 - RNA, 22 nt, Human
gagcaagacccuggguucucuc

SEQ ID NO: 850409 - RNA, 22 nt, Human
ucaggauguuaauauagcauua

SEQ ID NO: 850410 - RNA, 22 nt, Human
cagugcagguggcagaggacag

SEQ ID NO: 850411 - RNA, 22 nt, Human
ggcugagaacaggcccagccuc

SEQ ID NO: 850412 - RNA, 22 nt, Human
agcccagguucuaaagccaaac

SEQ ID NO: 850413 - RNA, 23 nt, Human
cugcuguguuggucucgauggga

SEQ ID NO: 850414 - RNA, 22 nt, Human
gcucaggaccgaggggugggaa

SEQ ID NO: 850415 - RNA, 22 nt, Human
ugaggucauggcugauauuucc

SEQ ID NO: 850416 - RNA, 22 nt, Human
uacaucuagccuuacaauuauu

SEQ ID NO: 850417 - RNA, 22 nt, Human
ccaggagacaaagaugacugcu

SEQ ID NO: 850418 - RNA, 23 nt, Human
ucucaagaggaagcagggcucau

SEQ ID NO: 850419 - RNA, 22 nt, Human
cccuggaggucagaggccuggg

SEQ ID NO: 850420 - RNA, 22 nt, Human
gagagaagaacaaugucauuca

SEQ ID NO: 850421 - RNA, 19 nt, Human
aggguggcaaaggagggug

SEQ ID NO: 850422 - RNA, 19 nt, Human
caaggccaccauuucuccg

SEQ ID NO: 850423 - RNA, 22 nt, Human
ggagagaaucugaaccugcucc

SEQ ID NO: 850424 - RNA, 19 nt, Human
caggaugaucccaugacac

SEQ ID NO: 850425 - RNA, 21 nt, Human
cccacggaaugaugaggcacu

SEQ ID NO: 850426 - RNA, 22 nt, Human
ccaggcugcuguugguguccgc

SEQ ID NO: 850427 - RNA, 22 nt, Human
ccaggcuguaaacaccuucaaa

SEQ ID NO: 850428 - RNA, 22 nt, Human
ucaacugcaaguuugcuuaguu

SEQ ID NO: 850429 - RNA, 22 nt, Human
uuucuucagccacuccaaacug

SEQ ID NO: 850430 - RNA, 22 nt, Human
gagugcaguuggggugagggga

SEQ ID NO: 850431 - RNA, 22 nt, Human
aaaugauugucaaaguucuguu

SEQ ID NO: 850432 - RNA, 18 nt, Human
gaugggagcaagagaaga

SEQ ID NO: 850433 - RNA, 22 nt, Human
acuuccugaauggggcuaauua

SEQ ID NO: 850434 - RNA, 20 nt, Human
uuggcagcuucaggguacua

SEQ ID NO: 850435 - RNA, 22 nt, Human
ugcuucagaggaaaggcaaaag

SEQ ID NO: 850436 - RNA, 19 nt, Human
uaaggccaaaaguaagugu

SEQ ID NO: 850437 - RNA, 23 nt, Human
gcuggcuggcaguaaagguuguu

SEQ ID NO: 850438 - RNA, 22 nt, Human
uggcuuuaggagcuauauaccu

SEQ ID NO: 850439 - RNA, 22 nt, Human
uaauuccaaguugagacaugca

SEQ ID NO: 850440 - RNA, 22 nt, Human
cagcuccugggccaucuccuag

SEQ ID NO: 850441 - RNA, 22 nt, Human
augcugugagugugccgcagag

SEQ ID NO: 850442 - RNA, 22 nt, Human
caggcagccuucucgucucaca

SEQ ID NO: 850443 - RNA, 19 nt, Human
ugcugcuguccuugcaggg

SEQ ID NO: 850444 - RNA, 22 nt, Human
gcugacagagugccuggccuca

SEQ ID NO: 850445 - RNA, 22 nt, Human
uuccaaagaaguucacauuuac

SEQ ID NO: 850446 - RNA, 22 nt, Human
uagcccagaagagggaagcaac

SEQ ID NO: 850447 - RNA, 22 nt, Human
gaggaacccagcugggguugcc

SEQ ID NO: 850448 - RNA, 22 nt, Human
agucugggagaaggugagauua

SEQ ID NO: 850449 - RNA, 22 nt, Human
uggggcucaccuaggcuggaag

SEQ ID NO: 850450 - RNA, 22 nt, Human
ucacaaauauuuuaacaguagg

SEQ ID NO: 850451 - RNA, 22 nt, Human
cuggcugugcugcaggcuuugg

SEQ ID NO: 850452 - RNA, 22 nt, Human
gcacugguaucaccugagagcu

SEQ ID NO: 850453 - RNA, 22 nt, Human
ccaggagagcgcccucccggcc

SEQ ID NO: 850454 - RNA, 18 nt, Human
auaaagugcuaauaaugg

SEQ ID NO: 850455 - RNA, 22 nt, Human
agaaaacuugucacagcucuca

SEQ ID NO: 850456 - RNA, 20 nt, Human
ucucagcauaagaacccuuc

SEQ ID NO: 850457 - RNA, 22 nt, Human
cugagggcuggagcugaggccu

SEQ ID NO: 850458 - RNA, 19 nt, Human
cucugccucccuccugggu

SEQ ID NO: 850459 - RNA, 22 nt, Human
aaagaguuggacuuucucaggc

SEQ ID NO: 850460 - RNA, 23 nt, Human
auugaugacuugauuacacuuuu

SEQ ID NO: 850461 - RNA, 22 nt, Human
acaggcagagaacucagccaga

SEQ ID NO: 850462 - RNA, 22 nt, Human
uagaaaugaauguuuaaaaguc

SEQ ID NO: 850463 - RNA, 22 nt, Human
cugagccaccggcagggacauc

SEQ ID NO: 850464 - RNA, 22 nt, Human
uuauuagguuauucucuguacu

SEQ ID NO: 850465 - RNA, 22 nt, Human
ccuccugggcuccugucugcac

SEQ ID NO: 850466 - RNA, 22 nt, Human
ugcugaggaaaaaugugacucu

SEQ ID NO: 850467 - RNA, 22 nt, Human
cagaaguugauccugcguuucc

SEQ ID NO: 850468 - RNA, 17 nt, Human
gagagcugcugcuuccg

SEQ ID NO: 850469 - RNA, 22 nt, Human
cagcacaguagaguaguuguaa

SEQ ID NO: 850470 - RNA, 22 nt, Human
aggcugaggggcgagggacccu

SEQ ID NO: 850471 - RNA, 23 nt, Human
cuugcaggaagcagauggcacac

SEQ ID NO: 850472 - RNA, 21 nt, Human
uaauaauuccacuacagagua

SEQ ID NO: 850473 - RNA, 22 nt, Human
gauguagagggaagauuuuaaa

SEQ ID NO: 850474 - RNA, 22 nt, Human
ccuggagcacauggcaggaggc

SEQ ID NO: 850475 - RNA, 20 nt, Human
aguuauaguaucuagccaug

SEQ ID NO: 850476 - RNA, 22 nt, Human
ccaggcuguuuucaaacuuggg

SEQ ID NO: 850477 - RNA, 22 nt, Human
gcaggggcuaaggacacagaga

SEQ ID NO: 850478 - RNA, 22 nt, Human
gcaggcugaguauuacccuagu

SEQ ID NO: 850479 - RNA, 22 nt, Human
cauuuguaguuaaaaaugucuc

SEQ ID NO: 850480 - RNA, 22 nt, Human
ccaggaaauagugcugugaucu

SEQ ID NO: 850481 - RNA, 20 nt, Human
acuguuaguauacuugugcc

SEQ ID NO: 850482 - RNA, 18 nt, Human
uaggagagaauuuauuua

SEQ ID NO: 850483 - RNA, 22 nt, Human
gagggcugauguugccaccuca

SEQ ID NO: 850484 - RNA, 22 nt, Human
cuccuuggccguuaaugucaca

SEQ ID NO: 850485 - RNA, 22 nt, Human
ucuccuggcccugucgccaucu

SEQ ID NO: 850486 - RNA, 22 nt, Human
cucaguuuuugcugucugguuc

SEQ ID NO: 850487 - RNA, 22 nt, Human
ucuccuggcucuaaaaggcugu

SEQ ID NO: 850488 - RNA, 22 nt, Human
ccagugcuuccaggaauacggu

SEQ ID NO: 850489 - RNA, 22 nt, Human
cacauauuguaguucaccagga

SEQ ID NO: 850490 - RNA, 22 nt, Human
uuugaaagaaaccagugaguga

SEQ ID NO: 850491 - RNA, 22 nt, Human
cuguccugauggugccacuggu

SEQ ID NO: 850492 - RNA, 22 nt, Human
cacuggugccagagaacagaau

SEQ ID NO: 850493 - RNA, 22 nt, Human
aaggccagaguacuagaggcug

SEQ ID NO: 850494 - RNA, 22 nt, Human
gaggcaguguuuacugcccugu

SEQ ID NO: 850495 - RNA, 22 nt, Human
uuacaagcagcuacauaucaca

SEQ ID NO: 850496 - RNA, 22 nt, Human
uuucuuauacuauauugucauc

SEQ ID NO: 850497 - RNA, 22 nt, Human
cccgggaggaggaaguugcagu

SEQ ID NO: 850498 - RNA, 22 nt, Human
cugcugugacagcugccguguu

SEQ ID NO: 850499 - RNA, 22 nt, Human
ucauauuaggguaaugauaaga

SEQ ID NO: 850500 - RNA, 22 nt, Human
ggcugucucugugacugccacc

SEQ ID NO: 850501 - RNA, 22 nt, Human
cugacagucucauugauuugcu

SEQ ID NO: 850502 - RNA, 22 nt, Human
caaggccacguucugcaugcgg

SEQ ID NO: 850503 - RNA, 22 nt, Human
caaguaaagaaucacauuucuu

SEQ ID NO: 850504 - RNA, 22 nt, Human
gcccagggcagggcaagaguga

SEQ ID NO: 850505 - RNA, 22 nt, Human
uggcugagguuaugcugguugu

SEQ ID NO: 850506 - RNA, 22 nt, Human
ucauuuauaaggaugcaauuaa

SEQ ID NO: 850507 - RNA, 22 nt, Human
uauacacauuuuuaccuauagu

SEQ ID NO: 850508 - RNA, 22 nt, Human
gauggcaggcaggugaguagag

SEQ ID NO: 850509 - RNA, 22 nt, Human
cggcugagcagugcugauggaa

SEQ ID NO: 850510 - RNA, 22 nt, Human
aggcuguggcccuggucuagca

SEQ ID NO: 850511 - RNA, 22 nt, Human
uagagaaaagcagggaucagga

SEQ ID NO: 850512 - RNA, 22 nt, Human
aggaagcugcuggaguagugug

SEQ ID NO: 850513 - RNA, 22 nt, Human
gaacccaggcuuuugaggcugu

SEQ ID NO: 850514 - RNA, 22 nt, Human
uauuagguaaaggacuugcagg

SEQ ID NO: 850515 - RNA, 20 nt, Human
cacaggcuauaugagagcca

SEQ ID NO: 850516 - RNA, 22 nt, Human
gccugccucaaaaucccaguuc

SEQ ID NO: 850517 - RNA, 22 nt, Human
gggacuucauagcuaggcacuu

SEQ ID NO: 850518 - RNA, 22 nt, Human
auuccaguuggguucuaauaca

SEQ ID NO: 850519 - RNA, 22 nt, Human
agagacugcgugucagcgcugg

SEQ ID NO: 850520 - RNA, 19 nt, Human
ucuuucauuucuagcucug

SEQ ID NO: 850521 - RNA, 22 nt, Human
gcugcuguuccuccaguggauc

SEQ ID NO: 850522 - RNA, 22 nt, Human
ugcugaugcuguucuguuagga

SEQ ID NO: 850523 - RNA, 22 nt, Human
uucaggaugaaagugugcaaca

SEQ ID NO: 850524 - RNA, 22 nt, Human
uuggcagugaugcagcuuguuc

SEQ ID NO: 850525 - RNA, 22 nt, Human
uccugccugcaaucccagcacu

SEQ ID NO: 850526 - RNA, 22 nt, Human
acagaauugaaaguauaaucug

SEQ ID NO: 850527 - RNA, 22 nt, Human
gcagagaagaugcccaggcuuc

SEQ ID NO: 850528 - RNA, 20 nt, Human
aagagaggaaguuauacuag

SEQ ID NO: 850529 - RNA, 22 nt, Human
uauuuccagcaguaagaagaca

SEQ ID NO: 850530 - RNA, 22 nt, Human
caaguaacuugauuaagguaag

SEQ ID NO: 850531 - RNA, 20 nt, Human
cucaggauugucuagccccu

SEQ ID NO: 850532 - RNA, 22 nt, Human
ucauucuuuaccaaguugucac

SEQ ID NO: 850533 - RNA, 22 nt, Human
uuacagaacugucuugaaauuu

SEQ ID NO: 850534 - RNA, 22 nt, Human
ggcgagggagcagugcgguggg

SEQ ID NO: 850535 - RNA, 22 nt, Human
ggagauggaauagauucugacu

SEQ ID NO: 850536 - RNA, 22 nt, Human
aaggaguuuggguagucauaca

SEQ ID NO: 850537 - RNA, 22 nt, Human
aaguuacauaaauguccucuag

SEQ ID NO: 850538 - RNA, 22 nt, Human
ggcagcugcaaaucugcucugu

SEQ ID NO: 850539 - RNA, 22 nt, Human
ccccaggagauuugggagcaca

SEQ ID NO: 850540 - RNA, 22 nt, Human
gucagagagggcacgugcacac

SEQ ID NO: 850541 - RNA, 22 nt, Human
uuuuguuguaauauaccuaucc

SEQ ID NO: 850542 - RNA, 22 nt, Human
accuguuuguguccauuaguga

SEQ ID NO: 850543 - RNA, 22 nt, Human
ucaggcugaccagguuuugcuc

SEQ ID NO: 850544 - RNA, 22 nt, Human
auacaucuaugccuuucugaca

SEQ ID NO: 850545 - RNA, 22 nt, Human
aucauuacuccuguaaaauugu

SEQ ID NO: 850546 - RNA, 21 nt, Human
acauaacugucaaguaacguu

SEQ ID NO: 850547 - RNA, 22 nt, Human
uuucacaaagcauagcacuuua

SEQ ID NO: 850548 - RNA, 22 nt, Human
aacugguaucucuucaguguaa

SEQ ID NO: 850549 - RNA, 22 nt, Human
cauuuguauguuccuccuuagg

SEQ ID NO: 850550 - RNA, 22 nt, Human
ucuccugggcuugguugaaguu

SEQ ID NO: 850551 - RNA, 22 nt, Human
uuuaacagaugcuaugucuacc

SEQ ID NO: 850552 - RNA, 22 nt, Human
ggccagcugggccaccaggugc

SEQ ID NO: 850553 - RNA, 22 nt, Human
aaggcaguuaauuuggcuagaa

SEQ ID NO: 850554 - RNA, 22 nt, Human
cuaggcuggagugcauuggcgu

SEQ ID NO: 850555 - RNA, 22 nt, Human
cauaauaucuccgauuacuugc

SEQ ID NO: 850556 - RNA, 22 nt, Human
ugagaacugaggauuugaauuc

SEQ ID NO: 850557 - RNA, 22 nt, Human
cagagcugggaucccaugggcg

SEQ ID NO: 850558 - RNA, 22 nt, Human
ugaggcaggaugcuugcacagg

SEQ ID NO: 850559 - RNA, 22 nt, Human
agucccuguacuuuccacugcc

SEQ ID NO: 850560 - RNA, 22 nt, Human
ccaccaggcacucacagggaag

SEQ ID NO: 850561 - RNA, 22 nt, Human
uagagcaguggguaccauggca

SEQ ID NO: 850562 - RNA, 22 nt, Human
ggggggugcugaucaguggagc

SEQ ID NO: 850563 - RNA, 18 nt, Human
cugcccagagcauuucau

SEQ ID NO: 850564 - RNA, 22 nt, Human
acacaaguucuaaagauugcgc

SEQ ID NO: 850565 - RNA, 22 nt, Human
ucugagccaauuucugugucca

SEQ ID NO: 850566 - RNA, 22 nt, Human
cuuagaaaugcagauucucagg

SEQ ID NO: 850567 - RNA, 22 nt, Human
caggaaugaggucguaaguguc

SEQ ID NO: 850568 - RNA, 22 nt, Human
uuuugugagcccauaaaugcca

SEQ ID NO: 850569 - RNA, 22 nt, Human
guggcagagccgugcagguagg

SEQ ID NO: 850570 - RNA, 22 nt, Human
uugaacaguccuaagagacccu

SEQ ID NO: 850571 - RNA, 22 nt, Human
agauggagaaugacaauuaagg

SEQ ID NO: 850572 - RNA, 22 nt, Human
uaacugguagauuuuaaaucgg

SEQ ID NO: 850573 - RNA, 22 nt, Human
uuggaaaagcguucucuguagc

SEQ ID NO: 850574 - RNA, 22 nt, Human
ccacugcuagagaugcaucccc

SEQ ID NO: 850575 - RNA, 22 nt, Human
agguccagcuguugcagccucc

SEQ ID NO: 850576 - RNA, 22 nt, Human
auugcuguggaaauauaagaug

SEQ ID NO: 850577 - RNA, 22 nt, Human
gaaucuuaaaucggaaucuuaa

SEQ ID NO: 850578 - RNA, 22 nt, Human
gaggcagcaauaaaaagaauuu

SEQ ID NO: 850579 - RNA, 22 nt, Human
cuucaguguugccagggccuag

SEQ ID NO: 850580 - RNA, 22 nt, Human
gucugcugcagagcauggcuuu

SEQ ID NO: 850581 - RNA, 22 nt, Human
gcugaggaggugugguuaggug

SEQ ID NO: 850582 - RNA, 22 nt, Human
ugcaggaaucagaggggaagcg

SEQ ID NO: 850583 - RNA, 22 nt, Human
ucucugaguaagugacaguuca

SEQ ID NO: 850584 - RNA, 22 nt, Human
ggcaggcugcuugggucauguc

SEQ ID NO: 850585 - RNA, 23 nt, Human
ucaggauauugugugccaaggug

SEQ ID NO: 850586 - RNA, 22 nt, Human
ucacugcucuccaauguggagu

SEQ ID NO: 850587 - RNA, 22 nt, Human
ggcaugcugcguacagaugaac

SEQ ID NO: 850588 - RNA, 22 nt, Human
cauuuguuuagaagucuuuaua

SEQ ID NO: 850589 - RNA, 22 nt, Human
uccuggccucgcuguccaccuu

SEQ ID NO: 850590 - RNA, 22 nt, Human
gaggcugaauggccagaagcca

SEQ ID NO: 850591 - RNA, 22 nt, Human
ggcugagacuagagugaggcau

SEQ ID NO: 850592 - RNA, 22 nt, Human
cuggccaguugccuuccugggu

SEQ ID NO: 850593 - RNA, 22 nt, Human
aggcaggcugcuauggaguaga

SEQ ID NO: 850594 - RNA, 22 nt, Human
aacuccagugucagcugcaaug

SEQ ID NO: 850595 - RNA, 22 nt, Human
gauuucuugaccccugucucag

SEQ ID NO: 850596 - RNA, 22 nt, Human
uggcugagggcacuaugaagcc

SEQ ID NO: 850597 - RNA, 22 nt, Human
ucaggcuguagggccccuggag

SEQ ID NO: 850598 - RNA, 22 nt, Human
uaacuacaagggcggucucugu

SEQ ID NO: 850599 - RNA, 22 nt, Human
gaaggccauugcguccugggau

SEQ ID NO: 850600 - RNA, 21 nt, Human
aggcaucuaaagagaguagac

SEQ ID NO: 850601 - RNA, 22 nt, Human
uuagugauuacuacauagauga

SEQ ID NO: 850602 - RNA, 23 nt, Human
uuucuucagaagccuugcgaggc

SEQ ID NO: 850603 - RNA, 22 nt, Human
cuguccugaaagggagauuggg

SEQ ID NO: 850604 - RNA, 22 nt, Human
ggagagaaauugagguagcaag

SEQ ID NO: 850605 - RNA, 22 nt, Human
uguuuuaagagcgcacuuuaua

SEQ ID NO: 850606 - RNA, 19 nt, Human
ugaggggcucacagucuca

SEQ ID NO: 850607 - RNA, 22 nt, Human
ugaaaugauuauaugguguuug

SEQ ID NO: 850608 - RNA, 22 nt, Human
uagcaaaaacugcaguuacuuu

SEQ ID NO: 850609 - RNA, 22 nt, Human
aguuacaaacacuaucaguucu

SEQ ID NO: 850610 - RNA, 22 nt, Human
cagggcuggcucaugaaaaguu

SEQ ID NO: 850611 - RNA, 22 nt, Human
accaggagagauuuuauugaga

SEQ ID NO: 850612 - RNA, 22 nt, Human
cggcagcugauugcagagcacc

SEQ ID NO: 850613 - RNA, 22 nt, Human
uaaugucagcauaguuuauuuu

SEQ ID NO: 850614 - RNA, 22 nt, Human
caccuuuugugucugcguuugu

SEQ ID NO: 850615 - RNA, 22 nt, Human
aggauuuugacuuauucaggga

SEQ ID NO: 850616 - RNA, 22 nt, Human
cugcuaaaccucucugagagcu

SEQ ID NO: 850617 - RNA, 22 nt, Human
uugaggucuucaggaucaggcu

SEQ ID NO: 850618 - RNA, 22 nt, Human
uuuguuuagaugguaaaucagu

SEQ ID NO: 850619 - RNA, 22 nt, Human
acagucauuagauacaaugucu

SEQ ID NO: 850620 - RNA, 22 nt, Human
cacaugugugcugaggacugug

SEQ ID NO: 850621 - RNA, 22 nt, Human
ugaggcucauucugcaugccaa

SEQ ID NO: 850622 - RNA, 22 nt, Human
uccuggccgccgcguggggccg

SEQ ID NO: 850623 - RNA, 22 nt, Human
ugaaggcccuaucuccauauac

SEQ ID NO: 850624 - RNA, 22 nt, Human
acaggagaaaucuggucaaaag

SEQ ID NO: 850625 - RNA, 22 nt, Human
uggcuucuagcaguguugauuu

SEQ ID NO: 850626 - RNA, 22 nt, Human
uggccaguagagcucagauagu

SEQ ID NO: 850627 - RNA, 22 nt, Human
ugguaacuuucagcauggugac

SEQ ID NO: 850628 - RNA, 21 nt, Human
agaggcccucggacugggcgu

SEQ ID NO: 850629 - RNA, 22 nt, Human
cccucccugaagaaguuacucu

SEQ ID NO: 850630 - RNA, 22 nt, Human
gacagcuguggagaggcaugug

SEQ ID NO: 850631 - RNA, 22 nt, Human
ccuggccagcuaauugcccauc

SEQ ID NO: 850632 - RNA, 22 nt, Human
cugcccaaauccuucuuccucu

SEQ ID NO: 850633 - RNA, 22 nt, Human
gugcugagcacaccuuggagca

SEQ ID NO: 850634 - RNA, 22 nt, Human
augcugugccuggaaagcggcu

SEQ ID NO: 850635 - RNA, 19 nt, Human
uaacuggugccuucaguca

SEQ ID NO: 850636 - RNA, 23 nt, Human
ggcugagaagucccaugauaggu

SEQ ID NO: 850637 - RNA, 22 nt, Human
agcugaggaauaauaacaaggu

SEQ ID NO: 850638 - RNA, 22 nt, Human
uggcugaguaaguugugauaug

SEQ ID NO: 850639 - RNA, 22 nt, Human
uugauguacagaauuguucaca

SEQ ID NO: 850640 - RNA, 22 nt, Human
ggacaguagucacuaaacuaga

SEQ ID NO: 850641 - RNA, 22 nt, Human
auggccaaaucuaaacuguugg

SEQ ID NO: 850642 - RNA, 22 nt, Human
ucuggcaggucaaucauucuuu

SEQ ID NO: 850643 - RNA, 22 nt, Human
gagaggggcccaagccacauag

SEQ ID NO: 850644 - RNA, 22 nt, Human
uuaggauaugaaacaguauaag

SEQ ID NO: 850645 - RNA, 22 nt, Human
uuagccauggacugaauugacu

SEQ ID NO: 850646 - RNA, 22 nt, Human
cuguaacuuaaugagaggcaga

SEQ ID NO: 850647 - RNA, 23 nt, Human
aguaacaugcaaauaacagucug

SEQ ID NO: 850648 - RNA, 22 nt, Human
aaucuuacaccgaauuuaaacu

SEQ ID NO: 850649 - RNA, 22 nt, Human
uucuuaaaacuuauggacaggu

SEQ ID NO: 850650 - RNA, 22 nt, Human
cuucaggauuuaggaagaugaa

SEQ ID NO: 850651 - RNA, 22 nt, Human
gcuggccacacugcugauggag

SEQ ID NO: 850652 - RNA, 22 nt, Human
aagaacugaguacguuaauaaa

SEQ ID NO: 850653 - RNA, 18 nt, Human
augggaggggccaagaga

SEQ ID NO: 850654 - RNA, 22 nt, Human
uucuagauugccuguaaguaaa

SEQ ID NO: 850655 - RNA, 22 nt, Human
auaaagauuucuuuuucucuac

SEQ ID NO: 850656 - RNA, 22 nt, Human
gacagguugaaguaucaaaggu

SEQ ID NO: 850657 - RNA, 22 nt, Human
caguuggaggaaugaggcugua

SEQ ID NO: 850658 - RNA, 22 nt, Human
uggccacaguguccagcagcag

SEQ ID NO: 850659 - RNA, 22 nt, Human
ugccucagcugaggccgcucca

SEQ ID NO: 850660 - RNA, 22 nt, Human
cccaggagaccuagaucuguuu

SEQ ID NO: 850661 - RNA, 20 nt, Human
uuaggcauuuggauuggcuu

SEQ ID NO: 850662 - RNA, 22 nt, Human
ucugagguggacgauggagccu

SEQ ID NO: 850663 - RNA, 22 nt, Human
ugaggcaggaggauugcaggau

SEQ ID NO: 850664 - RNA, 22 nt, Human
ucuggccagaaagacuugaugu

SEQ ID NO: 850665 - RNA, 22 nt, Human
cuugaaagcacuccuuugacug

SEQ ID NO: 850666 - RNA, 22 nt, Human
ucacacagguuugcaaugauuu

SEQ ID NO: 850667 - RNA, 22 nt, Human
ccacuguuuuucaguuaacuuu

SEQ ID NO: 850668 - RNA, 22 nt, Human
gaggagagagggacugucugca

SEQ ID NO: 850669 - RNA, 22 nt, Human
cugcugugccuuaaaaugcaag

SEQ ID NO: 850670 - RNA, 22 nt, Human
augcagcugugggcaagaaaug

SEQ ID NO: 850671 - RNA, 22 nt, Human
gggagagguuacccgagcaacu

SEQ ID NO: 850672 - RNA, 22 nt, Human
ccugaggucagccauucuugcc

SEQ ID NO: 850673 - RNA, 22 nt, Human
cugggccauggaagucucugcc

SEQ ID NO: 850674 - RNA, 22 nt, Human
caaauguauucucacuucaggg

SEQ ID NO: 850675 - RNA, 22 nt, Human
uaucaucuuguugucaugcagc

SEQ ID NO: 850676 - RNA, 22 nt, Human
auacauuagaaucugguacuca

SEQ ID NO: 850677 - RNA, 22 nt, Human
uggcaaggccacaggugcaguu

SEQ ID NO: 850678 - RNA, 22 nt, Human
aggaugaauaacugaaauggug

SEQ ID NO: 850679 - RNA, 22 nt, Human
gcccaggauggagaauaguggu

SEQ ID NO: 850680 - RNA, 20 nt, Human
ccuggagccuggaaggaguc

SEQ ID NO: 850681 - RNA, 22 nt, Human
aagcaccucuaugauugcuuuu

SEQ ID NO: 850682 - RNA, 22 nt, Human
ucaguucuuuauuucacaguga

SEQ ID NO: 850683 - RNA, 22 nt, Human
uuugaauauacuucaaacaaag

SEQ ID NO: 850684 - RNA, 22 nt, Human
cugcuguguuccuccugcaucu

SEQ ID NO: 850685 - RNA, 22 nt, Human
uugagguccaggugugggcagg

SEQ ID NO: 850686 - RNA, 20 nt, Human
aagaaguugguaagcagugc

SEQ ID NO: 850687 - RNA, 22 nt, Human
gcagggaagaucuuggagcugc

SEQ ID NO: 850688 - RNA, 20 nt, Human
caaaugaagcuguuggccuc

SEQ ID NO: 850689 - RNA, 22 nt, Human
ggcagcuggggcagugcccugu

SEQ ID NO: 850690 - RNA, 22 nt, Human
acucuuuuauaaagcaucuuga

SEQ ID NO: 850691 - RNA, 22 nt, Human
gggcugagagugacuguucugu

SEQ ID NO: 850692 - RNA, 22 nt, Human
gcagaggacagggauuuagauu

SEQ ID NO: 850693 - RNA, 22 nt, Human
cccaucacagacacuggguuau

SEQ ID NO: 850694 - RNA, 22 nt, Human
aggaugagccgcgcaagcugac

SEQ ID NO: 850695 - RNA, 22 nt, Human
ugcccaggcuggaaugcagugg

SEQ ID NO: 850696 - RNA, 22 nt, Human
uagugcuuaacacaaagugauu

SEQ ID NO: 850697 - RNA, 22 nt, Human
uuugcagugucagcuucugugu

SEQ ID NO: 850698 - RNA, 22 nt, Human
aagcugaggcccauggcaaggu

SEQ ID NO: 850699 - RNA, 23 nt, Human
uggcugagauccuacuguuugcu

SEQ ID NO: 850700 - RNA, 22 nt, Human
gcaccuuucuauauucaguggc

SEQ ID NO: 850701 - RNA, 22 nt, Human
cuguuuaucuaggaguugcagg

SEQ ID NO: 850702 - RNA, 22 nt, Human
auggcuucgaguauauacauag

SEQ ID NO: 850703 - RNA, 22 nt, Human
agggaguuagaaauccaggaua

SEQ ID NO: 850704 - RNA, 22 nt, Human
uccucagaaaccccugugaggu

SEQ ID NO: 850705 - RNA, 22 nt, Human
ggcaggcaggagcgugcuuggg

SEQ ID NO: 850706 - RNA, 20 nt, Human
cuacacuuggcaccuggcau

SEQ ID NO: 850707 - RNA, 22 nt, Human
acauuucuaguuguucaucucc

SEQ ID NO: 850708 - RNA, 22 nt, Human
cugagguccuugacugcuugcc

SEQ ID NO: 850709 - RNA, 22 nt, Human
gaaaaaugagcugaugucaggg

SEQ ID NO: 850710 - RNA, 17 nt, Human
caagagagaugacugga

SEQ ID NO: 850711 - RNA, 22 nt, Human
cuugaaagcacuuaguaaauua

SEQ ID NO: 850712 - RNA, 22 nt, Human
cuucuucaagagaaugggagac

SEQ ID NO: 850713 - RNA, 22 nt, Human
uuaggcauauggcacaugauag

SEQ ID NO: 850714 - RNA, 22 nt, Human
ucagccucucugaguccagacc

SEQ ID NO: 850715 - RNA, 22 nt, Human
aauuaggaauaaaugaguacuu

SEQ ID NO: 850716 - RNA, 22 nt, Human
gacagaggcuggagcaccuccu

SEQ ID NO: 850717 - RNA, 22 nt, Human
ugaggcaggagaauggcgggaa

SEQ ID NO: 850718 - RNA, 22 nt, Human
uaucuauaaguacuaacauggu

SEQ ID NO: 850719 - RNA, 22 nt, Human
uagugucaaacagggauuagaa

SEQ ID NO: 850720 - RNA, 22 nt, Human
cagggcuggcuguggcaaucuc

SEQ ID NO: 850721 - RNA, 18 nt, Human
acaggcugugggaauggu

SEQ ID NO: 850722 - RNA, 22 nt, Human
ucuuggcuauccaaguuaucca

SEQ ID NO: 850723 - RNA, 22 nt, Human
ugcacuucauuguaaauuguac

SEQ ID NO: 850724 - RNA, 22 nt, Human
auggccaagaaguauuccugac

SEQ ID NO: 850725 - RNA, 22 nt, Human
gacccaggagagaggguugcau

SEQ ID NO: 850726 - RNA, 22 nt, Human
ugaaggccuaacuuccagugcu

SEQ ID NO: 850727 - RNA, 22 nt, Human
aacuuucuaauuuuggcugagc

SEQ ID NO: 850728 - RNA, 22 nt, Human
ccagaagaccccguccaccucc

SEQ ID NO: 850729 - RNA, 22 nt, Human
uugaaagaagaagcugcgaugu

SEQ ID NO: 850730 - RNA, 22 nt, Human
gagaggugaaggcugcccuggg

SEQ ID NO: 850731 - RNA, 22 nt, Human
cccucgccgcagcugcuucccg

SEQ ID NO: 850732 - RNA, 22 nt, Human
uggcaucauagccaaggugcuu

SEQ ID NO: 850733 - RNA, 22 nt, Human
gucauucuuaacaacucaguag

SEQ ID NO: 850734 - RNA, 22 nt, Human
gauggcagcagcagccagggau

SEQ ID NO: 850735 - RNA, 22 nt, Human
uggcugcugcagacagacagga

SEQ ID NO: 850736 - RNA, 22 nt, Human
guccucuggaagaugaguucuu

SEQ ID NO: 850737 - RNA, 22 nt, Human
cagcagaggugguucacauugu

SEQ ID NO: 850738 - RNA, 22 nt, Human
agcugcccugguaagauugaug

SEQ ID NO: 850739 - RNA, 22 nt, Human
ggcagcuuucaauaggguuaug

SEQ ID NO: 850740 - RNA, 22 nt, Human
uccucuccaugucucacgccac

SEQ ID NO: 850741 - RNA, 22 nt, Human
aggcaggccccugagaauagac

SEQ ID NO: 850742 - RNA, 22 nt, Human
cugaggcugggcugaggguaua

SEQ ID NO: 850743 - RNA, 22 nt, Human
gucacuguauccagguuccagc

SEQ ID NO: 850744 - RNA, 23 nt, Human
acuuuauugaccccaggucaguu

SEQ ID NO: 850745 - RNA, 22 nt, Human
cccaggagaucuggaucucguc

SEQ ID NO: 850746 - RNA, 22 nt, Human
cuaaaugauauuuugguuuccu

SEQ ID NO: 850747 - RNA, 22 nt, Human
ggccaaaugaaaucugagcaau

SEQ ID NO: 850748 - RNA, 22 nt, Human
ugaggcagaguaagauacauga

SEQ ID NO: 850749 - RNA, 22 nt, Human
agaggccacuuugccugugaug

SEQ ID NO: 850750 - RNA, 22 nt, Human
uucugagcuacauaguacuggg

SEQ ID NO: 850751 - RNA, 22 nt, Human
agacaggcugcugucugcuagg

SEQ ID NO: 850752 - RNA, 22 nt, Human
uucuuucucaacaugaauguuu

SEQ ID NO: 850753 - RNA, 22 nt, Human
agcccuggguuagggugggagc

SEQ ID NO: 850754 - RNA, 22 nt, Human
aacuccuguucuaugacaagag

SEQ ID NO: 850755 - RNA, 22 nt, Human
aauaugcauuaacuguguacau

SEQ ID NO: 850756 - RNA, 22 nt, Human
cugccuggccacaacccagggu

SEQ ID NO: 850757 - RNA, 22 nt, Human
gaaugaaagauuugcauucuau

SEQ ID NO: 850758 - RNA, 22 nt, Human
cagaacugagucucauggccau

SEQ ID NO: 850759 - RNA, 22 nt, Human
cagcaagagacuguucucuaag

SEQ ID NO: 850760 - RNA, 22 nt, Human
cucuggccuggggccugcuccc

SEQ ID NO: 850761 - RNA, 22 nt, Human
ugcugaggcaguccuaacagga

SEQ ID NO: 850762 - RNA, 22 nt, Human
ucuucucuccugcuuggcagaa

SEQ ID NO: 850763 - RNA, 22 nt, Human
ccuuuauucaauuaguccuaau

SEQ ID NO: 850764 - RNA, 22 nt, Human
ggaggggaacuaaucccgugac

SEQ ID NO: 850765 - RNA, 22 nt, Human
ccuuuuaugaacuugagcaggu

SEQ ID NO: 850766 - RNA, 20 nt, Human
aggcucagcugagcucuugg

SEQ ID NO: 850767 - RNA, 20 nt, Human
aggacagcagcugccacuug

SEQ ID NO: 850768 - RNA, 22 nt, Human
aagaguuagcucaauaacuuga

SEQ ID NO: 850769 - RNA, 18 nt, Human
cuggucucccuucgcuuu

SEQ ID NO: 850770 - RNA, 22 nt, Human
ggagcuguucaggacugcuuca

SEQ ID NO: 850771 - RNA, 22 nt, Human
ucuuuggaucccaacuggcugg

SEQ ID NO: 850772 - RNA, 22 nt, Human
cuggagcauccaugcccagggu

SEQ ID NO: 850773 - RNA, 22 nt, Human
ucccagagccaagcuauggaug

SEQ ID NO: 850774 - RNA, 22 nt, Human
agcugaggcucugagagggaag

SEQ ID NO: 850775 - RNA, 22 nt, Human
aucaggaugacuauaaggcugc

SEQ ID NO: 850776 - RNA, 22 nt, Human
cagggcugaggacacaaguaaa

SEQ ID NO: 850777 - RNA, 22 nt, Human
caaauacuuuauauacuucaaa

SEQ ID NO: 850778 - RNA, 22 nt, Human
ugaggccucugaggccuaggcu

SEQ ID NO: 850779 - RNA, 22 nt, Human
uacacacagaggccaugggauu

SEQ ID NO: 850780 - RNA, 22 nt, Human
agccugagccccauccagcuga

SEQ ID NO: 850781 - RNA, 22 nt, Human
uccaaauauucaucuacuucug

SEQ ID NO: 850782 - RNA, 22 nt, Human
gaggcccaggguacaggccgcu

SEQ ID NO: 850783 - RNA, 22 nt, Human
auucuuugcaucucuggguggc

SEQ ID NO: 850784 - RNA, 22 nt, Human
gcuggagcugaguucccugggc

SEQ ID NO: 850785 - RNA, 19 nt, Human
ugcuagaaauucugugacu

SEQ ID NO: 850786 - RNA, 17 nt, Human
uagauuaaacacggcca

SEQ ID NO: 850787 - RNA, 22 nt, Human
gaggcagcugggauacaaggga

SEQ ID NO: 850788 - RNA, 22 nt, Human
caaaugaagagggcaacuucug

SEQ ID NO: 850789 - RNA, 22 nt, Human
ucuuggccccaccugugccagc

SEQ ID NO: 850790 - RNA, 22 nt, Human
gauguguuuccaggauuuguuu

SEQ ID NO: 850791 - RNA, 22 nt, Human
cugcuucauauuucauagugau

SEQ ID NO: 850792 - RNA, 22 nt, Human
gagaggcuggcagugccagguu

SEQ ID NO: 850793 - RNA, 22 nt, Human
ggcugcagauuguagucuguua

SEQ ID NO: 850794 - RNA, 22 nt, Human
aaggcaguaaaaucuaccuugc

SEQ ID NO: 850795 - RNA, 22 nt, Human
aggcaagcauuuaaccacucau

SEQ ID NO: 850796 - RNA, 22 nt, Human
acugccauuggucaaaugagug

SEQ ID NO: 850797 - RNA, 22 nt, Human
cuucuucauguauugauagucu

SEQ ID NO: 850798 - RNA, 22 nt, Human
ucugcaggaggcuggcugcagg

SEQ ID NO: 850799 - RNA, 22 nt, Human
cucaguuuccccggccugggcg

SEQ ID NO: 850800 - RNA, 22 nt, Human
ucugagccuauuucaaauuccu

SEQ ID NO: 850801 - RNA, 20 nt, Human
gcugaggggucuauggcaua

SEQ ID NO: 850802 - RNA, 22 nt, Human
ggcagcucugcuccacaugagu

SEQ ID NO: 850803 - RNA, 22 nt, Human
aggcugaggcuuuccuuggaga

SEQ ID NO: 850804 - RNA, 22 nt, Human
cagggucuuggcgccaucaccc

SEQ ID NO: 850805 - RNA, 22 nt, Human
ugaggcaggagaaucaccggaa

SEQ ID NO: 850806 - RNA, 18 nt, Human
cucaccauucugcccaau

SEQ ID NO: 850807 - RNA, 22 nt, Human
caacugcugacaccaucacucc

SEQ ID NO: 850808 - RNA, 17 nt, Human
acacagggagagggagc

SEQ ID NO: 850809 - RNA, 22 nt, Human
uucugucaugcucauguaauug

SEQ ID NO: 850810 - RNA, 22 nt, Human
ucuuuauuuuaugcuugugcaa

SEQ ID NO: 850811 - RNA, 22 nt, Human
caggcagaguuagagcaacugg

SEQ ID NO: 850812 - RNA, 22 nt, Human
ccuccuggugggcgcuucuggc

SEQ ID NO: 850813 - RNA, 20 nt, Human
ucacaucuggcagcugauga

SEQ ID NO: 850814 - RNA, 22 nt, Human
gcuggccagcccucuuccucca

SEQ ID NO: 850815 - RNA, 22 nt, Human
ccaggagaugggagcaucuaaa

SEQ ID NO: 850816 - RNA, 22 nt, Human
gacuucuguuaacuuguaagag

SEQ ID NO: 850817 - RNA, 22 nt, Human
caaggcugcaaaacuacauggg

SEQ ID NO: 850818 - RNA, 22 nt, Human
agucuugcucuugcaucugcuu

SEQ ID NO: 850819 - RNA, 22 nt, Human
cggccaagccggggccccgaag

SEQ ID NO: 850820 - RNA, 22 nt, Human
uugcugugucugauggcugaga

SEQ ID NO: 850821 - RNA, 23 nt, Human
uuccuggcagguacaacuuuuac

SEQ ID NO: 850822 - RNA, 23 nt, Human
auauuagggagauuagcccucua

SEQ ID NO: 850823 - RNA, 22 nt, Human
cuagggaguggcagagcuggga

SEQ ID NO: 850824 - RNA, 23 nt, Human
gugagucuugccuuugcugugga

SEQ ID NO: 850825 - RNA, 22 nt, Human
cucaucugauaaaucacucuua

SEQ ID NO: 850826 - RNA, 22 nt, Human
uucugaaagccaauucauugaa

SEQ ID NO: 850827 - RNA, 22 nt, Human
cugcuucugggaugauggagua

SEQ ID NO: 850828 - RNA, 22 nt, Human
aggcagauuacuugaggccagg

SEQ ID NO: 850829 - RNA, 22 nt, Human
aggccagaaaugucagggagug

SEQ ID NO: 850830 - RNA, 22 nt, Human
cagcagagaaauuaaacuucug

SEQ ID NO: 850831 - RNA, 22 nt, Human
cggcugaggaucuccaggccug

SEQ ID NO: 850832 - RNA, 22 nt, Human
cucaggauagcugcgcagccug

SEQ ID NO: 850833 - RNA, 21 nt, Human
aaugcauuaacauaaagcuga

SEQ ID NO: 850834 - RNA, 22 nt, Human
ggcugcaggcagaggcugucug

SEQ ID NO: 850835 - RNA, 22 nt, Human
gggcacagaagucuaagacauc

SEQ ID NO: 850836 - RNA, 23 nt, Human
uggacgccgacuuuggaggcgcu

SEQ ID NO: 850837 - RNA, 22 nt, Human
cugaggucuagacaccccaggg

SEQ ID NO: 850838 - RNA, 22 nt, Human
ggccagcucugcacagcagcug

SEQ ID NO: 850839 - RNA, 22 nt, Human
agcacugugagcaccagcacgc

SEQ ID NO: 850840 - RNA, 22 nt, Human
aucaggauccaccuugagccug

SEQ ID NO: 850841 - RNA, 22 nt, Human
gcuccuucaggugguagcuguu

SEQ ID NO: 850842 - RNA, 22 nt, Human
uccccuccaacuccaacuaugg

SEQ ID NO: 850843 - RNA, 22 nt, Human
cacugguacacugaauggcguu

SEQ ID NO: 850844 - RNA, 22 nt, Human
auagucacucuguuagguguuu

SEQ ID NO: 850845 - RNA, 23 nt, Human
ucugggccacuugucugcacuuc

SEQ ID NO: 850846 - RNA, 22 nt, Human
ggcucagaccucccagcuccag

SEQ ID NO: 850847 - RNA, 22 nt, Human
cugaacucuuuaugacagcuug

SEQ ID NO: 850848 - RNA, 22 nt, Human
cagcaagaguugggguuguugg

SEQ ID NO: 850849 - RNA, 20 nt, Human
aacuuucucccauuggacug

SEQ ID NO: 850850 - RNA, 22 nt, Human
gcuggagguuucaccugaguuu

SEQ ID NO: 850851 - RNA, 23 nt, Human
ucuagaaaaugaaagaaugcagu

SEQ ID NO: 850852 - RNA, 22 nt, Human
agccagcucccuccccugcagg

SEQ ID NO: 850853 - RNA, 22 nt, Human
acacagcuuucagucauuaucu

SEQ ID NO: 850854 - RNA, 22 nt, Human
uccaggaggcaccuuuggacca

SEQ ID NO: 850855 - RNA, 22 nt, Human
cuugccucccucagcucacagc

SEQ ID NO: 850856 - RNA, 21 nt, Human
ugguacagaggaggugaagug

SEQ ID NO: 850857 - RNA, 22 nt, Human
agcugaaagugcuuugaggacu

SEQ ID NO: 850858 - RNA, 22 nt, Human
cagcaagaaaauucacaugcuc

SEQ ID NO: 850859 - RNA, 22 nt, Human
ugugaaagcaagucuaguucuc

SEQ ID NO: 850860 - RNA, 22 nt, Human
ugcuagaauuugcagaagcaua

SEQ ID NO: 850861 - RNA, 22 nt, Human
uccuaggcaguuggugcuccau

SEQ ID NO: 850862 - RNA, 22 nt, Human
gagggcuccauuccccgugccc

SEQ ID NO: 850863 - RNA, 22 nt, Human
gcagaggauagcauaugaaccu

SEQ ID NO: 850864 - RNA, 23 nt, Human
ucuugaaaagccuacagcaguuc

SEQ ID NO: 850865 - RNA, 22 nt, Human
aguugcugcuucucucuagaga

SEQ ID NO: 850866 - RNA, 22 nt, Human
uuauuuagucuagaugaauuuu

SEQ ID NO: 850867 - RNA, 22 nt, Human
gauuucuuuaugaaguacagaa

SEQ ID NO: 850868 - RNA, 22 nt, Human
gaagaggaugacaggagccggu

SEQ ID NO: 850869 - RNA, 22 nt, Human
cugggaaauggcuucgagcuca

SEQ ID NO: 850870 - RNA, 22 nt, Human
acacaaauuguaggauaauugc

SEQ ID NO: 850871 - RNA, 22 nt, Human
uuuccaagacuccaguucuccc

SEQ ID NO: 850872 - RNA, 22 nt, Human
ccagaggaggggggucuuucug

SEQ ID NO: 850873 - RNA, 22 nt, Human
ggccagggccuggggacugucc

SEQ ID NO: 850874 - RNA, 22 nt, Human
cucacugugccuuuucccaaac

SEQ ID NO: 850875 - RNA, 22 nt, Human
gggcugagccauuugaaccuug

SEQ ID NO: 850876 - RNA, 22 nt, Human
agaggaugauuuuaaggacacu

SEQ ID NO: 850877 - RNA, 22 nt, Human
uugaggucugugauaaaaguca

SEQ ID NO: 850878 - RNA, 22 nt, Human
cacagacccagaagggaugaag

SEQ ID NO: 850879 - RNA, 22 nt, Human
auacaaagacaaaucucaaucu

SEQ ID NO: 850880 - RNA, 22 nt, Human
augcuguggaugccuugcccca

SEQ ID NO: 850881 - RNA, 22 nt, Human
uuguuauaaagacuaaauaugu

SEQ ID NO: 850882 - RNA, 22 nt, Human
cugagguggcauccuagcucua

SEQ ID NO: 850883 - RNA, 17 nt, Human
agagggaaaaugcgguu

SEQ ID NO: 850884 - RNA, 22 nt, Human
uagggauguggugagaacugag

SEQ ID NO: 850885 - RNA, 22 nt, Human
uagggaggcuacuucuuguagg

SEQ ID NO: 850886 - RNA, 22 nt, Human
ugaccaaaaaauucccugugag

SEQ ID NO: 850887 - RNA, 22 nt, Human
cuuuccaagaaugcagauaccu

SEQ ID NO: 850888 - RNA, 22 nt, Human
cccaggagguuggggcuacagu

SEQ ID NO: 850889 - RNA, 22 nt, Human
auacauauaugguacuuccugg

SEQ ID NO: 850890 - RNA, 22 nt, Human
cuccuggcuucugaaaucgugg

SEQ ID NO: 850891 - RNA, 21 nt, Human
agcagcugggcaacauggagg

SEQ ID NO: 850892 - RNA, 22 nt, Human
uggucaacaggcagggaugaaa

SEQ ID NO: 850893 - RNA, 22 nt, Human
ucgagcucuggagccaaggaug

SEQ ID NO: 850894 - RNA, 22 nt, Human
gagccagcuauguagcaagagg

SEQ ID NO: 850895 - RNA, 22 nt, Human
gagcugagcuuaacuccuugaa

SEQ ID NO: 850896 - RNA, 22 nt, Human
agaauuagucacaauuauagga

SEQ ID NO: 850897 - RNA, 22 nt, Human
uugcagcuuagugauguuaucu

SEQ ID NO: 850898 - RNA, 22 nt, Human
uucucuuugacauuauucaggu

SEQ ID NO: 850899 - RNA, 22 nt, Human
gcaccuuuggaaugaaaaguug

SEQ ID NO: 850900 - RNA, 23 nt, Human
acugagguacugagguugugaca

SEQ ID NO: 850901 - RNA, 22 nt, Human
uuauuuaauuuucucacucaga

SEQ ID NO: 850902 - RNA, 22 nt, Human
gcugacaguuacugcuguaaca

SEQ ID NO: 850903 - RNA, 22 nt, Human
uagugcuuuaggccugaguguc

SEQ ID NO: 850904 - RNA, 22 nt, Human
uggcagcuacagacagagguga

SEQ ID NO: 850905 - RNA, 22 nt, Human
aaugucugagucucuguauccc

SEQ ID NO: 850906 - RNA, 22 nt, Human
cacaauuuguuuuaucaguauu

SEQ ID NO: 850907 - RNA, 22 nt, Human
uucuucuuaauguccugggaac

SEQ ID NO: 850908 - RNA, 22 nt, Human
cagaaacuagauuuagacacaa

SEQ ID NO: 850909 - RNA, 22 nt, Human
gccagagguucaacaacugucu

SEQ ID NO: 850910 - RNA, 22 nt, Human
uggaaauggaucugaugagucu

SEQ ID NO: 850911 - RNA, 23 nt, Human
ugagacccuaauuuagcaagugu

SEQ ID NO: 850912 - RNA, 22 nt, Human
gugagguccuaauagacaucga

SEQ ID NO: 850913 - RNA, 22 nt, Human
gaggcaguuccugagugacaag

SEQ ID NO: 850914 - RNA, 22 nt, Human
agcugcagucaagcugggccac

SEQ ID NO: 850915 - RNA, 22 nt, Human
uaucuguuaugggcugaauugc

SEQ ID NO: 850916 - RNA, 22 nt, Human
gcagcuaccacccaggaaggac

SEQ ID NO: 850917 - RNA, 22 nt, Human
cugagaguauuggcaggcuugg

SEQ ID NO: 850918 - RNA, 22 nt, Human
uauacacuguuguugggagucu

SEQ ID NO: 850919 - RNA, 22 nt, Human
ucuggccagugaaaugcagaau

SEQ ID NO: 850920 - RNA, 22 nt, Human
ucugaggucauaaagcaacuuu

SEQ ID NO: 850921 - RNA, 22 nt, Human
aggcaguuucugggacagcaua

SEQ ID NO: 850922 - RNA, 19 nt, Human
gcugcucugggucucaucu

SEQ ID NO: 850923 - RNA, 22 nt, Human
uuuuauauugagugagaguucc

SEQ ID NO: 850924 - RNA, 22 nt, Human
gcugcucugugacagccuccgg

SEQ ID NO: 850925 - RNA, 22 nt, Human
uggaguucauccaugacagcuu

SEQ ID NO: 850926 - RNA, 22 nt, Human
gcauuuccugugcuuggcauau

SEQ ID NO: 850927 - RNA, 22 nt, Human
cugccuuugcccuugacacugu

SEQ ID NO: 850928 - RNA, 22 nt, Human
aaggagaguacaggaguuggua

SEQ ID NO: 850929 - RNA, 22 nt, Human
uccugggcuuaagugauccucc

SEQ ID NO: 850930 - RNA, 22 nt, Human
aggcugagcuggcccuugaaau

SEQ ID NO: 850931 - RNA, 22 nt, Human
aguuggagugaacaugagauug

SEQ ID NO: 850932 - RNA, 20 nt, Human
auccaugagagucuggauuc

SEQ ID NO: 850933 - RNA, 22 nt, Human
caggcagcuagauuuauaacaa

SEQ ID NO: 850934 - RNA, 21 nt, Human
gagacagcccagugccagggc

SEQ ID NO: 850935 - RNA, 22 nt, Human
gaggggaaagugugaggcugcg

SEQ ID NO: 850936 - RNA, 23 nt, Human
acuauaaaguuguucugauuuac

SEQ ID NO: 850937 - RNA, 18 nt, Human
gagucuuuguuacugcug

SEQ ID NO: 850938 - RNA, 21 nt, Human
ucucugguuggaguugugcca

SEQ ID NO: 850939 - RNA, 22 nt, Human
ucauuuguaccauuuuuuaaga

SEQ ID NO: 850940 - RNA, 22 nt, Human
uaacuguauagcuuggacuaaa

SEQ ID NO: 850941 - RNA, 22 nt, Human
aucaggauagugguuaccuggg

SEQ ID NO: 850942 - RNA, 22 nt, Human
cucccagagagcaggugggccg

SEQ ID NO: 850943 - RNA, 22 nt, Human
uagaagcaguaauagaaauagg

SEQ ID NO: 850944 - RNA, 22 nt, Human
gcugaaugaauguauuuuaaaa

SEQ ID NO: 850945 - RNA, 21 nt, Human
cauuaaguaccagggcacugu

SEQ ID NO: 850946 - RNA, 23 nt, Human
ugaaggccuggaggacgcguugu

SEQ ID NO: 850947 - RNA, 19 nt, Human
gcugagguggaggaaggag

SEQ ID NO: 850948 - RNA, 22 nt, Human
cugagggccuucuaugcugagc

SEQ ID NO: 850949 - RNA, 22 nt, Human
uguccacaucacucacuuguca

SEQ ID NO: 850950 - RNA, 22 nt, Human
gacuuucuuaggcccccuaaua

SEQ ID NO: 850951 - RNA, 21 nt, Human
uuugaaagcccuauguuuuca

SEQ ID NO: 850952 - RNA, 19 nt, Human
ucccaggaagcaaauguca

SEQ ID NO: 850953 - RNA, 22 nt, Human
aggccacaagaacuaccccauc

SEQ ID NO: 850954 - RNA, 21 nt, Human
ccagugcuacagcugccugac

SEQ ID NO: 850955 - RNA, 22 nt, Human
auuauuauuguugauguuaggg

SEQ ID NO: 850956 - RNA, 22 nt, Human
uacaguaagaugaaauagcaau

SEQ ID NO: 850957 - RNA, 22 nt, Human
aaaggccagguuggcugguauu

SEQ ID NO: 850958 - RNA, 22 nt, Human
gaagcagccacggggagacaga

SEQ ID NO: 850959 - RNA, 22 nt, Human
ucagguccagcuccugugccuc

SEQ ID NO: 850960 - RNA, 22 nt, Human
uaguaacugguugaacaacugu

SEQ ID NO: 850961 - RNA, 22 nt, Human
uagcagcaauuacacaguccgu

SEQ ID NO: 850962 - RNA, 22 nt, Human
agacaaaugguaauuaugucua

SEQ ID NO: 850963 - RNA, 22 nt, Human
uucucuuuucaccaguugcuaa

SEQ ID NO: 850964 - RNA, 22 nt, Human
agagggagcccagucauagcug

SEQ ID NO: 850965 - RNA, 22 nt, Human
cuuauuucagcccugggcaccc

SEQ ID NO: 850966 - RNA, 22 nt, Human
aauaauuagugggacagagaac

SEQ ID NO: 850967 - RNA, 22 nt, Human
ugaaugaguuuggcugcuguuc

SEQ ID NO: 850968 - RNA, 22 nt, Human
auuauuagugauguuguuacug

SEQ ID NO: 850969 - RNA, 20 nt, Human
uguccccaccaaaauuucau

SEQ ID NO: 850970 - RNA, 21 nt, Human
cuguggaagggaacuagaggg

SEQ ID NO: 850971 - RNA, 22 nt, Human
auggcuucuagcauugucacaa

SEQ ID NO: 850972 - RNA, 22 nt, Human
ugauggucaggaugcauggaga

SEQ ID NO: 850973 - RNA, 22 nt, Human
cccaggagcuucucucugccuc

SEQ ID NO: 850974 - RNA, 21 nt, Human
uggcugagccaggugugugga

SEQ ID NO: 850975 - RNA, 22 nt, Human
gaggagaaauuuggggaccuga

SEQ ID NO: 850976 - RNA, 22 nt, Human
cugccucuccccagaguggccc

SEQ ID NO: 850977 - RNA, 22 nt, Human
cucccucaggccuuagcccugc

SEQ ID NO: 850978 - RNA, 22 nt, Human
ucuaaccuuugaaacugcuuuc

SEQ ID NO: 850979 - RNA, 22 nt, Human
uuuucagugggcaaugauguga

SEQ ID NO: 850980 - RNA, 22 nt, Human
uuuguaugugauaagacuauuc

SEQ ID NO: 850981 - RNA, 22 nt, Human
uaucuguuggcuccuaguugua

SEQ ID NO: 850982 - RNA, 22 nt, Human
auauguuacucuuucaagcaga

SEQ ID NO: 850983 - RNA, 22 nt, Human
agucacuguuucagaacugagu

SEQ ID NO: 850984 - RNA, 22 nt, Human
ugaggcucagagaacagugacu

SEQ ID NO: 850985 - RNA, 22 nt, Human
aaccauuugcaguuacugagac

SEQ ID NO: 850986 - RNA, 22 nt, Human
uacaaagagguaauugcauaua

SEQ ID NO: 850987 - RNA, 22 nt, Human
auucuuauuauaguaaaacagu

SEQ ID NO: 850988 - RNA, 22 nt, Human
uccuggccuagcucacccugga

SEQ ID NO: 850989 - RNA, 22 nt, Human
gcugccucacuccagcccaaua

SEQ ID NO: 850990 - RNA, 22 nt, Human
ggagaaaggauaggaaugugcu

SEQ ID NO: 850991 - RNA, 22 nt, Human
guggcagcggugugcaaggagg

SEQ ID NO: 850992 - RNA, 23 nt, Human
aggcagcuggguagcaucuuucu

SEQ ID NO: 850993 - RNA, 22 nt, Human
guccacugcugugugcuucacc

SEQ ID NO: 850994 - RNA, 22 nt, Human
ugacauaauaauccaaacauac

SEQ ID NO: 850995 - RNA, 18 nt, Human
caaauacuguugucuuau

SEQ ID NO: 850996 - RNA, 22 nt, Human
ugucucugggugauucaguccu

SEQ ID NO: 850997 - RNA, 22 nt, Human
ucacugcucagucuguacuaca

SEQ ID NO: 850998 - RNA, 22 nt, Human
uggcagcugcaggccuccugag

SEQ ID NO: 850999 - RNA, 22 nt, Human
cagugccaaggagaaggacagc

SEQ ID NO: 851000 - RNA, 23 nt, Human
ccagugugguagguccacaggug

SEQ ID NO: 851001 - RNA, 22 nt, Human
aggcagcguagcaaggcuagua

SEQ ID NO: 851002 - RNA, 22 nt, Human
cagcuggccccacaguagaggc

SEQ ID NO: 851003 - RNA, 22 nt, Human
gagugucagcagggcagagcac

SEQ ID NO: 851004 - RNA, 22 nt, Human
aaaugccucuggguuauucuag

SEQ ID NO: 851005 - RNA, 22 nt, Human
uggcucaguuucaguccugguu

SEQ ID NO: 851006 - RNA, 20 nt, Human
gggcaguucaaugccacucu

SEQ ID NO: 851007 - RNA, 22 nt, Human
agcagagguguuuauuauggga

SEQ ID NO: 851008 - RNA, 22 nt, Human
ggccugagcuugggcagcguau

SEQ ID NO: 851009 - RNA, 22 nt, Human
aagcagaggguauggccagguu

SEQ ID NO: 851010 - RNA, 22 nt, Human
cugccaucugagccaaaagugc

SEQ ID NO: 851011 - RNA, 22 nt, Human
gacagugcauuuccuggcaugg

SEQ ID NO: 851012 - RNA, 22 nt, Human
gaggaggcacuugagcagaugu

SEQ ID NO: 851013 - RNA, 22 nt, Human
uuuauaagaagcaaugucugag

SEQ ID NO: 851014 - RNA, 17 nt, Human
gccucugcuugugucau

SEQ ID NO: 851015 - RNA, 22 nt, Human
ugccucagucagcuucccuggg

SEQ ID NO: 851016 - RNA, 22 nt, Human
aggauuugaaccugcauccagu

SEQ ID NO: 851017 - RNA, 22 nt, Human
uggagaggaaagugcaguuuug

SEQ ID NO: 851018 - RNA, 22 nt, Human
uaagaaauuuaguuauagaaug

SEQ ID NO: 851019 - RNA, 22 nt, Human
uucuucuccgaggagggcuggu

SEQ ID NO: 851020 - RNA, 22 nt, Human
cuguuuauggagguaaggcauc

SEQ ID NO: 851021 - RNA, 22 nt, Human
aaauaguucagcuuguaaaccc

SEQ ID NO: 851022 - RNA, 22 nt, Human
auucucuuuguauaacaucuug

SEQ ID NO: 851023 - RNA, 21 nt, Human
acugagguuagaugccuugcc

SEQ ID NO: 851024 - RNA, 22 nt, Human
caguuucuauggcugggcucug

SEQ ID NO: 851025 - RNA, 20 nt, Human
uugauucaagggcugaugga

SEQ ID NO: 851026 - RNA, 22 nt, Human
guggccaaggcagagaaagagc

SEQ ID NO: 851027 - RNA, 22 nt, Human
ggcagacaccuuuaugucuaau

SEQ ID NO: 851028 - RNA, 22 nt, Human
cacagucucuguugcugggacc

SEQ ID NO: 851029 - RNA, 22 nt, Human
ccaggaugacccccacuuuccu

SEQ ID NO: 851030 - RNA, 22 nt, Human
uuucuuuguuguuaucacauca

SEQ ID NO: 851031 - RNA, 22 nt, Human
acugagguaauugugaggauua

SEQ ID NO: 851032 - RNA, 22 nt, Human
uggcuucucgccugucaucccg

SEQ ID NO: 851033 - RNA, 22 nt, Human
uucaggauuguguuuuuccuga

SEQ ID NO: 851034 - RNA, 22 nt, Human
auuagagaaauguugccaagau

SEQ ID NO: 851035 - RNA, 22 nt, Human
ucugggaagcugcgugccuguu

SEQ ID NO: 851036 - RNA, 22 nt, Human
agcagcugagccccagcuguga

SEQ ID NO: 851037 - RNA, 22 nt, Human
auuuauuauugugguuacuucu

SEQ ID NO: 851038 - RNA, 22 nt, Human
cccugagccgcugcuccaaccu

SEQ ID NO: 851039 - RNA, 22 nt, Human
ccagagcuccagggcuacagaa

SEQ ID NO: 851040 - RNA, 22 nt, Human
uaaucacagaaacagacuguuu

SEQ ID NO: 851041 - RNA, 22 nt, Human
gcuccuggcuucacugacauca

SEQ ID NO: 851042 - RNA, 22 nt, Human
auuaaauuaaguggcuaauuua

SEQ ID NO: 851043 - RNA, 22 nt, Human
ucugguaaccuuuaucccuccu

SEQ ID NO: 851044 - RNA, 22 nt, Human
ugcugcuguaucaugccuucau

SEQ ID NO: 851045 - RNA, 22 nt, Human
gaggccacuuccuacuggagga

SEQ ID NO: 851046 - RNA, 22 nt, Human
uggcacaugguaagugcuuaac

SEQ ID NO: 851047 - RNA, 22 nt, Human
gagaggcagaggccugaaaccg

SEQ ID NO: 851048 - RNA, 22 nt, Human
agacaguguguguauauauggu

SEQ ID NO: 851049 - RNA, 22 nt, Human
uuucaaaauuuugcagugguaa

SEQ ID NO: 851050 - RNA, 22 nt, Human
guggcagaaauauucuugcucu

SEQ ID NO: 851051 - RNA, 22 nt, Human
aggcugaggcaagaggaucacu

SEQ ID NO: 851052 - RNA, 22 nt, Human
cugcuguguaucauuuuagaug

SEQ ID NO: 851053 - RNA, 22 nt, Human
aggcugagguaggaggaucgcu

SEQ ID NO: 851054 - RNA, 22 nt, Human
acccagagucauggcacuuagc

SEQ ID NO: 851055 - RNA, 22 nt, Human
aucauacauguaacuaaguaaa

SEQ ID NO: 851056 - RNA, 22 nt, Human
cauuuguaucugggcugcugug

SEQ ID NO: 851057 - RNA, 22 nt, Human
ccaggcuggaguguagucgcau

SEQ ID NO: 851058 - RNA, 22 nt, Human
cuucagaauccagaaucagaau

SEQ ID NO: 851059 - RNA, 22 nt, Human
caaaugaagggagcugaagucu

SEQ ID NO: 851060 - RNA, 21 nt, Human
uuccuggcggcagaaacguga

SEQ ID NO: 851061 - RNA, 22 nt, Human
ucauucacuuugaaauaaacga

SEQ ID NO: 851062 - RNA, 22 nt, Human
gcccaggauggcuggaggugcu

SEQ ID NO: 851063 - RNA, 22 nt, Human
gcuguucucuguaacaugcauu

SEQ ID NO: 851064 - RNA, 22 nt, Human
ggccaaaugaaggcaaugggac

SEQ ID NO: 851065 - RNA, 22 nt, Human
guuuuauuuccaugagagaccg

SEQ ID NO: 851066 - RNA, 22 nt, Human
uucucagaauugacugggagca

SEQ ID NO: 851067 - RNA, 22 nt, Human
aggcaguggaaggagaaagcaa

SEQ ID NO: 851068 - RNA, 21 nt, Human
agcagaggcugccuggugacu

SEQ ID NO: 851069 - RNA, 22 nt, Human
augugaggcagcacggagauua

SEQ ID NO: 851070 - RNA, 22 nt, Human
guuuaaauaauuaggggccugu

SEQ ID NO: 851071 - RNA, 22 nt, Human
gaggaaccaaucugugauauuc

SEQ ID NO: 851072 - RNA, 19 nt, Human
gaggagcuaucggagacag

SEQ ID NO: 851073 - RNA, 22 nt, Human
agaaguuauccaccuuagaugc

SEQ ID NO: 851074 - RNA, 22 nt, Human
gcuggccaggugcuuugguucu

SEQ ID NO: 851075 - RNA, 22 nt, Human
aaggcagucugguuucaaagca

SEQ ID NO: 851076 - RNA, 22 nt, Human
uguugauuaguguuuagacuua

SEQ ID NO: 851077 - RNA, 22 nt, Human
ccagaggaaaaauaucucccua

SEQ ID NO: 851078 - RNA, 22 nt, Human
ugaaaugacagucuuaagcucu

SEQ ID NO: 851079 - RNA, 22 nt, Human
accucagauuguggcuccgcug

SEQ ID NO: 851080 - RNA, 22 nt, Human
aaguauuucguucugaaaaagu

SEQ ID NO: 851081 - RNA, 22 nt, Human
gagguggugguggaggcauagc

SEQ ID NO: 851082 - RNA, 22 nt, Human
guuaggauuauauaucccauga

SEQ ID NO: 851083 - RNA, 22 nt, Human
uuuguagaggguaauugacaga

SEQ ID NO: 851084 - RNA, 19 nt, Human
acuggcaguuucugcaugg

SEQ ID NO: 851085 - RNA, 22 nt, Human
cugagccagcgggcucacuuuu

SEQ ID NO: 851086 - RNA, 22 nt, Human
uaaaccuugguagcaucuugcu

SEQ ID NO: 851087 - RNA, 22 nt, Human
agaaaagugcucuagugagagc

SEQ ID NO: 851088 - RNA, 22 nt, Human
auuauuaggugcucucugacaa

SEQ ID NO: 851089 - RNA, 22 nt, Human
uggcaacauggacaggucugcc

SEQ ID NO: 851090 - RNA, 18 nt, Human
uuuaugagcugugggacc

SEQ ID NO: 851091 - RNA, 22 nt, Human
uccaggagacacaagguacaua

SEQ ID NO: 851092 - RNA, 22 nt, Human
aacugcuguggccuaguacuua

SEQ ID NO: 851093 - RNA, 22 nt, Human
cccaggagguagagguugcagu

SEQ ID NO: 851094 - RNA, 22 nt, Human
guugaaagagcauggacuugaa

SEQ ID NO: 851095 - RNA, 22 nt, Human
acuccuggguucuaaauuugaa

SEQ ID NO: 851096 - RNA, 22 nt, Human
uaacaugauuugcuauuuagau

SEQ ID NO: 851097 - RNA, 23 nt, Human
agggagcuaaaaggcuggagcag

SEQ ID NO: 851098 - RNA, 22 nt, Human
uguuacagugacuaauguuuua

SEQ ID NO: 851099 - RNA, 22 nt, Human
gaccauuuguugaaaagauuau

SEQ ID NO: 851100 - RNA, 22 nt, Human
auuuccauagagcgucucacag

SEQ ID NO: 851101 - RNA, 22 nt, Human
auggccaagagucgauuugggg

SEQ ID NO: 851102 - RNA, 22 nt, Human
cuuccugggcaauguucugcuu

SEQ ID NO: 851103 - RNA, 20 nt, Human
acuaaucauccagucacagu

SEQ ID NO: 851104 - RNA, 21 nt, Human
gagaacugaaccagagcagcu

SEQ ID NO: 851105 - RNA, 22 nt, Human
cuuaaauucuuaaugcccucau

SEQ ID NO: 851106 - RNA, 22 nt, Human
uagcucuucaaucacugucucc

SEQ ID NO: 851107 - RNA, 23 nt, Human
uguugaaguaacuguuacauaga

SEQ ID NO: 851108 - RNA, 22 nt, Human
uguucuucuagauugccuuuua

SEQ ID NO: 851109 - RNA, 22 nt, Human
ccugagguugaaguauaaauug

SEQ ID NO: 851110 - RNA, 19 nt, Human
uaucuguuuccugcuuguc

SEQ ID NO: 851111 - RNA, 22 nt, Human
ugcccuggcuccucccacgcug

SEQ ID NO: 851112 - RNA, 21 nt, Human
cugagggccgcagcugggcuc

SEQ ID NO: 851113 - RNA, 22 nt, Human
ugaggcagcuuuuucugugugu

SEQ ID NO: 851114 - RNA, 22 nt, Human
ugcccuggugaagugcucuccu

SEQ ID NO: 851115 - RNA, 22 nt, Human
cagggcuguggaaaacuggugc

SEQ ID NO: 851116 - RNA, 22 nt, Human
aauuaacuaauuugguacaaga

SEQ ID NO: 851117 - RNA, 22 nt, Human
ggcccacacugacagcugagcu

SEQ ID NO: 851118 - RNA, 22 nt, Human
aguacauauaguaauuuagcca

SEQ ID NO: 851119 - RNA, 22 nt, Human
gucaggauguuuauucuccagu

SEQ ID NO: 851120 - RNA, 22 nt, Human
augccuggacuguaucccagau

SEQ ID NO: 851121 - RNA, 22 nt, Human
uucaggaugacaccauguccag

SEQ ID NO: 851122 - RNA, 22 nt, Human
uuagauaaauugcaacuugauu

SEQ ID NO: 851123 - RNA, 22 nt, Human
cuugcugugugguguucucaga

SEQ ID NO: 851124 - RNA, 22 nt, Human
guauuagguuggugcaaaagua

SEQ ID NO: 851125 - RNA, 22 nt, Human
cuuaaauuggaugaguuaaguu

SEQ ID NO: 851126 - RNA, 19 nt, Human
caugcugaccugcuguggu

SEQ ID NO: 851127 - RNA, 22 nt, Human
uaggagaggugaauggcacacu

SEQ ID NO: 851128 - RNA, 22 nt, Human
aacuuucugaaaagcuugauca

SEQ ID NO: 851129 - RNA, 22 nt, Human
ggcugaggguuaagaucagaca

SEQ ID NO: 851130 - RNA, 22 nt, Human
ugacccauggucugaucauagg

SEQ ID NO: 851131 - RNA, 22 nt, Human
ggcagcuguaagaugagugaau

SEQ ID NO: 851132 - RNA, 22 nt, Human
ggcaagcauaaccuguacagcc

SEQ ID NO: 851133 - RNA, 22 nt, Human
cugcuucacguugugccuuguu

SEQ ID NO: 851134 - RNA, 20 nt, Human
aggcugaguucuaugcacuu

SEQ ID NO: 851135 - RNA, 22 nt, Human
uaaguucauaagcuuauucuua

SEQ ID NO: 851136 - RNA, 22 nt, Human
uauuauuaaauggcagaauuuu

SEQ ID NO: 851137 - RNA, 22 nt, Human
ucgcugugguuucuguacaugg

SEQ ID NO: 851138 - RNA, 22 nt, Human
aggagacaucuaacuguagguu

SEQ ID NO: 851139 - RNA, 22 nt, Human
auguuucaaugcacuuuagccu

SEQ ID NO: 851140 - RNA, 22 nt, Human
uggaggaaguggcuggccagaa

SEQ ID NO: 851141 - RNA, 22 nt, Human
cccagggagguagcaggagaaa

SEQ ID NO: 851142 - RNA, 22 nt, Human
augcuguguccuagugaaagaa

SEQ ID NO: 851143 - RNA, 17 nt, Human
gcgcagcuccuggcgcg

SEQ ID NO: 851144 - RNA, 22 nt, Human
ucagggacuuacaaaccagaag

SEQ ID NO: 851145 - RNA, 22 nt, Human
cagaacuggccuuucaucaguc

SEQ ID NO: 851146 - RNA, 22 nt, Human
cuggccagaguuggagggugug

SEQ ID NO: 851147 - RNA, 22 nt, Human
auucuucauuuacuguuacuug

SEQ ID NO: 851148 - RNA, 22 nt, Human
ugaaaugagauagauaaucagg

SEQ ID NO: 851149 - RNA, 22 nt, Human
gcccaggacucagggugucgcg

SEQ ID NO: 851150 - RNA, 22 nt, Human
aaugaaauguagcuuauccaua

SEQ ID NO: 851151 - RNA, 22 nt, Human
ccugcuguucuguuuagugaac

SEQ ID NO: 851152 - RNA, 22 nt, Human
guuaggaauuuguuacugugua

SEQ ID NO: 851153 - RNA, 22 nt, Human
ugucagagcaaugagguucagc

SEQ ID NO: 851154 - RNA, 22 nt, Human
ggcugaggcucaugccaucuug

SEQ ID NO: 851155 - RNA, 19 nt, Human
ugcccaggccagguugggc

SEQ ID NO: 851156 - RNA, 22 nt, Human
uuucacaucagagguagauuag

SEQ ID NO: 851157 - RNA, 22 nt, Human
cuauuucaaggcccagauauga

SEQ ID NO: 851158 - RNA, 22 nt, Human
gggcagcugucuugguucucaa

SEQ ID NO: 851159 - RNA, 22 nt, Human
ggccacaacuugcuccuagccc

SEQ ID NO: 851160 - RNA, 22 nt, Human
gaggcagccagagguucucauu

SEQ ID NO: 851161 - RNA, 22 nt, Human
ugcugaggucauuuccaaguga

SEQ ID NO: 851162 - RNA, 22 nt, Human
uuuggaauuggcauucuauucu

SEQ ID NO: 851163 - RNA, 22 nt, Human
cuucagaagaaaagcagugugu

SEQ ID NO: 851164 - RNA, 22 nt, Human
acacaaugcauauuuuuccaga

SEQ ID NO: 851165 - RNA, 22 nt, Human
uugcuguguaacuccuggccug

SEQ ID NO: 851166 - RNA, 22 nt, Human
agcugcugcggaaagaugccac

SEQ ID NO: 851167 - RNA, 22 nt, Human
gugagguccugagaggcuugug

SEQ ID NO: 851168 - RNA, 22 nt, Human
ugcauaguucuccuuccuccuc

SEQ ID NO: 851169 - RNA, 22 nt, Human
aauuauacaauugucaaguucu

SEQ ID NO: 851170 - RNA, 22 nt, Human
aggcaggcucaggcccaugcuu

SEQ ID NO: 851171 - RNA, 22 nt, Human
aggcuaagauguggucugagca

SEQ ID NO: 851172 - RNA, 22 nt, Human
cagcuuccgaccgggggcugca

SEQ ID NO: 851173 - RNA, 22 nt, Human
aagaggagacuucagcaacuug

SEQ ID NO: 851174 - RNA, 22 nt, Human
ggaggggagucucccaaagccg

SEQ ID NO: 851175 - RNA, 22 nt, Human
cccaggaggccaagguugcagu

SEQ ID NO: 851176 - RNA, 22 nt, Human
ccuggcugagggaccucgggua

SEQ ID NO: 851177 - RNA, 22 nt, Human
uggcuucuucauaugugaucuu

SEQ ID NO: 851178 - RNA, 22 nt, Human
cuggugagacucagggaugcuu

SEQ ID NO: 851179 - RNA, 22 nt, Human
gaaggccacaagagaaguuaag

SEQ ID NO: 851180 - RNA, 22 nt, Human
uauuagcgcuuacugaguugcc

SEQ ID NO: 851181 - RNA, 22 nt, Human
aaaaguuaccucuguaauauaa

SEQ ID NO: 851182 - RNA, 22 nt, Human
guuuuauuggaacacagccaug

SEQ ID NO: 851183 - RNA, 22 nt, Human
cuguccccugugcuuucacuug

SEQ ID NO: 851184 - RNA, 22 nt, Human
uauaucaccaaaaacaguucug

SEQ ID NO: 851185 - RNA, 22 nt, Human
cccaggaaaucaggcuuucuag

SEQ ID NO: 851186 - RNA, 23 nt, Human
uggccaagauaaucucaguuuuc

SEQ ID NO: 851187 - RNA, 23 nt, Human
cagugugacgaggugaggcaggc

SEQ ID NO: 851188 - RNA, 22 nt, Human
ccaugagacagcaacugaaagu

SEQ ID NO: 851189 - RNA, 21 nt, Human
agagagggagaugaaacaucc

SEQ ID NO: 851190 - RNA, 22 nt, Human
gacaggcaauuaccagcgccca

SEQ ID NO: 851191 - RNA, 22 nt, Human
aggcugaggcuggcagcuccag

SEQ ID NO: 851192 - RNA, 22 nt, Human
augaggucacaguguuuggcau

SEQ ID NO: 851193 - RNA, 22 nt, Human
cuugaaagauuuggccucugug

SEQ ID NO: 851194 - RNA, 22 nt, Human
auaaauaucacuguugucccuc

SEQ ID NO: 851195 - RNA, 22 nt, Human
cucaguuuccucuucuguugaa

SEQ ID NO: 851196 - RNA, 22 nt, Human
uagcaagaugucacuccaaguu

SEQ ID NO: 851197 - RNA, 22 nt, Human
cccucccugugugccucauuug

SEQ ID NO: 851198 - RNA, 22 nt, Human
cucagugugaaugcucaguaaa

SEQ ID NO: 851199 - RNA, 22 nt, Human
uuugaauaucacaaacuuucaa

SEQ ID NO: 851200 - RNA, 22 nt, Human
gaagcagcagcuggggacaguu

SEQ ID NO: 851201 - RNA, 22 nt, Human
ucuuagcauuucauaacaacug

SEQ ID NO: 851202 - RNA, 22 nt, Human
agucucugucguagaucagcgu

SEQ ID NO: 851203 - RNA, 20 nt, Human
ucugagguaugauagggucu

SEQ ID NO: 851204 - RNA, 18 nt, Human
ugcuuggagcauuuacca

SEQ ID NO: 851205 - RNA, 22 nt, Human
aagaacugguuauguuaucuug

SEQ ID NO: 851206 - RNA, 22 nt, Human
caggcagcugcgacaagagagc

SEQ ID NO: 851207 - RNA, 22 nt, Human
auggccaaauaacagcuugcau

SEQ ID NO: 851208 - RNA, 18 nt, Human
aagaacugagguccuaga

SEQ ID NO: 851209 - RNA, 22 nt, Human
gcagcugccccgacugugaguc

SEQ ID NO: 851210 - RNA, 22 nt, Human
ggcugcugguggaaugguaggc

SEQ ID NO: 851211 - RNA, 22 nt, Human
gcuggccaguguggugaccacc

SEQ ID NO: 851212 - RNA, 23 nt, Human
ucugagguggcucuugcuuugaa

SEQ ID NO: 851213 - RNA, 22 nt, Human
gggcagcuccuguggaauccac

SEQ ID NO: 851214 - RNA, 22 nt, Human
aggcaugacuuuggcugaagaa

SEQ ID NO: 851215 - RNA, 22 nt, Human
aaggcugacguuuguguuuauu

SEQ ID NO: 851216 - RNA, 22 nt, Human
acuguaacacucauacugaagu

SEQ ID NO: 851217 - RNA, 22 nt, Human
acauuguuugagaauacagaug

SEQ ID NO: 851218 - RNA, 22 nt, Human
uauuagguaugaacuggcaacc

SEQ ID NO: 851219 - RNA, 22 nt, Human
guggccaaaucaugucaaaggc

SEQ ID NO: 851220 - RNA, 22 nt, Human
ccauccugcauugcuauucaga

SEQ ID NO: 851221 - RNA, 22 nt, Human
cugcuuuggacaacuauucuug

SEQ ID NO: 851222 - RNA, 22 nt, Human
aagcaggauggagguugaguua

SEQ ID NO: 851223 - RNA, 22 nt, Human
gugcugugugauccaugcuggc

SEQ ID NO: 851224 - RNA, 19 nt, Human
uccugggcugcgucuugcc

SEQ ID NO: 851225 - RNA, 22 nt, Human
ccaggcugggcuacaaguugag

SEQ ID NO: 851226 - RNA, 22 nt, Human
gcuugaaaauucauagguauuu

SEQ ID NO: 851227 - RNA, 22 nt, Human
aaugagacacgugaagcagaug

SEQ ID NO: 851228 - RNA, 22 nt, Human
uuugaagucagacacugcuuug

SEQ ID NO: 851229 - RNA, 17 nt, Human
ccagagcuacugagacu

SEQ ID NO: 851230 - RNA, 22 nt, Human
uagaacuggaauuuugugguuu

SEQ ID NO: 851231 - RNA, 22 nt, Human
cugccucagcguuguggcccua

SEQ ID NO: 851232 - RNA, 22 nt, Human
uacugcauaacuggcauguggg

SEQ ID NO: 851233 - RNA, 23 nt, Human
agcugaggcagaggggcauucuc

SEQ ID NO: 851234 - RNA, 22 nt, Human
uccaggaggugaggggaccaaa

SEQ ID NO: 851235 - RNA, 22 nt, Human
gacaguaacugagagauguaau

SEQ ID NO: 851236 - RNA, 22 nt, Human
ugcugaaauuagaacauugagg

SEQ ID NO: 851237 - RNA, 22 nt, Human
aauacuggcugucaaagaugga

SEQ ID NO: 851238 - RNA, 22 nt, Human
agagcugaggauccagcugagc

SEQ ID NO: 851239 - RNA, 22 nt, Human
gagggcugaaguguuuuaugag

SEQ ID NO: 851240 - RNA, 23 nt, Human
cuuuuaacuagaguaucagcugc

SEQ ID NO: 851241 - RNA, 18 nt, Human
ggcaucugcacagcagcc

SEQ ID NO: 851242 - RNA, 22 nt, Human
uugguuuacuaggauucaaauu

SEQ ID NO: 851243 - RNA, 18 nt, Human
gagagggaucccucagga

SEQ ID NO: 851244 - RNA, 22 nt, Human
ggcugagguguggggaacuaua

SEQ ID NO: 851245 - RNA, 22 nt, Human
cuacccagcaccuaggcugccu

SEQ ID NO: 851246 - RNA, 22 nt, Human
gaaggccaguuuugagauaggu

SEQ ID NO: 851247 - RNA, 22 nt, Human
agugacagggaaggauaggauu

SEQ ID NO: 851248 - RNA, 22 nt, Human
cagagccaggucuaggagucuc

SEQ ID NO: 851249 - RNA, 22 nt, Human
cugggccagggaggugucugua

SEQ ID NO: 851250 - RNA, 22 nt, Human
uuccuggccccaccccuggaga

SEQ ID NO: 851251 - RNA, 22 nt, Human
uuuacagauguggaaagugagc

SEQ ID NO: 851252 - RNA, 22 nt, Human
ucacaaaugaggaaaucgagca

SEQ ID NO: 851253 - RNA, 22 nt, Human
auggcugagaugggcuccaggc

SEQ ID NO: 851254 - RNA, 22 nt, Human
aggaagcuggugugaggaugaa

SEQ ID NO: 851255 - RNA, 22 nt, Human
aagaacugugcuccaggcucca

SEQ ID NO: 851256 - RNA, 22 nt, Human
ccccaggacguggcccucauag

SEQ ID NO: 851257 - RNA, 22 nt, Human
guuuuucuaggaccaugugauu

SEQ ID NO: 851258 - RNA, 22 nt, Human
gcccaggaguuggaggcugcag

SEQ ID NO: 851259 - RNA, 22 nt, Human
cugccugcacugccuggcucca

SEQ ID NO: 851260 - RNA, 22 nt, Human
aacuucuggauguuucaaaugu

SEQ ID NO: 851261 - RNA, 22 nt, Human
cugagguagcugugaauguucu

SEQ ID NO: 851262 - RNA, 22 nt, Human
uuuuaucugcuucauuaguuga

SEQ ID NO: 851263 - RNA, 22 nt, Human
gauggcagcauauugacagcau

SEQ ID NO: 851264 - RNA, 22 nt, Human
cugccaggcagcagagggagaa

SEQ ID NO: 851265 - RNA, 22 nt, Human
acucaggaagaaagcagcuggu

SEQ ID NO: 851266 - RNA, 22 nt, Human
uuaguuaggaaacaaaguuguu

SEQ ID NO: 851267 - RNA, 22 nt, Human
ucucucuugucaccccaucugc

SEQ ID NO: 851268 - RNA, 22 nt, Human
acauguaaaaggaacaugcaug

SEQ ID NO: 851269 - RNA, 17 nt, Human
uccaugagacaugaaga

SEQ ID NO: 851270 - RNA, 22 nt, Human
aguccuuugggaaaaaugacua

SEQ ID NO: 851271 - RNA, 22 nt, Human
auuauuagacuuauaugguagu

SEQ ID NO: 851272 - RNA, 22 nt, Human
cuguggaauugaugcuuagugu

SEQ ID NO: 851273 - RNA, 22 nt, Human
aaagcagagcagggcacuuaug

SEQ ID NO: 851274 - RNA, 22 nt, Human
uguugccuggggaagcucugau

SEQ ID NO: 851275 - RNA, 22 nt, Human
uggcugaggcuggagugcagug

SEQ ID NO: 851276 - RNA, 19 nt, Human
aguccaugaauggaggaug

SEQ ID NO: 851277 - RNA, 19 nt, Human
ucccaggaaccuuuuauuu

SEQ ID NO: 851278 - RNA, 22 nt, Human
augcugagacuggagcagcugg

SEQ ID NO: 851279 - RNA, 19 nt, Human
agcuccugauugugccucg

SEQ ID NO: 851280 - RNA, 22 nt, Human
guaguucugcagugucaccuga

SEQ ID NO: 851281 - RNA, 22 nt, Human
ugaggcagguggauuacaaggu

SEQ ID NO: 851282 - RNA, 19 nt, Human
ggcucagggcgcugccgcc

SEQ ID NO: 851283 - RNA, 22 nt, Human
uaaggccaaacuauuauaguuc

SEQ ID NO: 851284 - RNA, 19 nt, Human
uggcagcauugguaccuug

SEQ ID NO: 851285 - RNA, 20 nt, Human
gcugaggucccugugguuuu

SEQ ID NO: 851286 - RNA, 22 nt, Human
aacaugaaaacuaccugugauu

SEQ ID NO: 851287 - RNA, 22 nt, Human
cccuuagcuccaagggguuugg

SEQ ID NO: 851288 - RNA, 22 nt, Human
uggagaggagcaccauggccau

SEQ ID NO: 851289 - RNA, 22 nt, Human
gcugaguguaaugauggcagag

SEQ ID NO: 851290 - RNA, 22 nt, Human
aacugcuucuuacugcugggca

SEQ ID NO: 851291 - RNA, 22 nt, Human
uauuucagucacuucuucucug

SEQ ID NO: 851292 - RNA, 22 nt, Human
ccccggaggcggagguugcagu

SEQ ID NO: 851293 - RNA, 22 nt, Human
cccaggaggcgcagguugcggu

SEQ ID NO: 851294 - RNA, 22 nt, Human
ucucaggagccacagcgggagu

SEQ ID NO: 851295 - RNA, 22 nt, Human
uuaaauauuuucagcaggguca

SEQ ID NO: 851296 - RNA, 22 nt, Human
aaugaaacucgaaauaaucaca

SEQ ID NO: 851297 - RNA, 22 nt, Human
caggcgagugaacagacucuca

SEQ ID NO: 851298 - RNA, 22 nt, Human
aacacuuuuuauauauuguauc

SEQ ID NO: 851299 - RNA, 22 nt, Human
cagagcugcaaaugccccuccg

SEQ ID NO: 851300 - RNA, 22 nt, Human
cuugcugucccuugguaugaac

SEQ ID NO: 851301 - RNA, 22 nt, Human
cuaagccacucaaaucuugugg

SEQ ID NO: 851302 - RNA, 22 nt, Human
uggcagcagcuaacuuaggcag

SEQ ID NO: 851303 - RNA, 22 nt, Human
aaguuacaguuaugaaacucac

SEQ ID NO: 851304 - RNA, 22 nt, Human
agcaguguggccuuagacccgg

SEQ ID NO: 851305 - RNA, 22 nt, Human
uugacacaguuuucucauuaag

SEQ ID NO: 851306 - RNA, 22 nt, Human
auuucagguaccugugggaucc

SEQ ID NO: 851307 - RNA, 22 nt, Human
uauaucauggagauuaacauuc

SEQ ID NO: 851308 - RNA, 22 nt, Human
agugugucugaucacuugugag

SEQ ID NO: 851309 - RNA, 22 nt, Human
gaaaugaaauagcaccaagguu

SEQ ID NO: 851310 - RNA, 22 nt, Human
cugccaggcagggagauggcug

SEQ ID NO: 851311 - RNA, 22 nt, Human
ucagguggcuuggagggggacg

SEQ ID NO: 851312 - RNA, 22 nt, Human
uuuaaauuuagaagaaacacug

SEQ ID NO: 851313 - RNA, 22 nt, Human
ucuccucuauuucuguauguau

SEQ ID NO: 851314 - RNA, 22 nt, Human
acccagagcagagcuuggcuuc

SEQ ID NO: 851315 - RNA, 22 nt, Human
uggcuucuugggaugggucauu

SEQ ID NO: 851316 - RNA, 22 nt, Human
aggcagacaaggacacaguggg

SEQ ID NO: 851317 - RNA, 19 nt, Human
uuugcagugguuccuuugu

SEQ ID NO: 851318 - RNA, 22 nt, Human
cccaggaggacauuccauaccc

SEQ ID NO: 851319 - RNA, 22 nt, Human
uggcugcagaucaagggcaggc

SEQ ID NO: 851320 - RNA, 21 nt, Human
agccugaaucccaccaguuca

SEQ ID NO: 851321 - RNA, 22 nt, Human
gcuggccaggaagagucucaga

SEQ ID NO: 851322 - RNA, 22 nt, Human
cugcuguguugccagugucacc

SEQ ID NO: 851323 - RNA, 22 nt, Human
ucugagguguagcugggcuuca

SEQ ID NO: 851324 - RNA, 21 nt, Human
aaugaaguggcuauuuugagg

SEQ ID NO: 851325 - RNA, 22 nt, Human
ccacagcugaccgcaggugagc

SEQ ID NO: 851326 - RNA, 22 nt, Human
uggcucagaaggcugccuucac

SEQ ID NO: 851327 - RNA, 22 nt, Human
ucauuucucccggccaaaaacu

SEQ ID NO: 851328 - RNA, 22 nt, Human
aggagcugggcugcugcuggga

SEQ ID NO: 851329 - RNA, 22 nt, Human
ugguuacauauccuuuggagcc

SEQ ID NO: 851330 - RNA, 22 nt, Human
caggagaggaggcuacuucuua

SEQ ID NO: 851331 - RNA, 22 nt, Human
guagacaucuagauuuaugugu

SEQ ID NO: 851332 - RNA, 22 nt, Human
gagaacugauuagcauuugcca

SEQ ID NO: 851333 - RNA, 22 nt, Human
aacuccugaggaaauggucuca

SEQ ID NO: 851334 - RNA, 22 nt, Human
uggcugagagaagacggggaag

SEQ ID NO: 851335 - RNA, 22 nt, Human
aaauacauacacuguacguggc

SEQ ID NO: 851336 - RNA, 22 nt, Human
aaucuucuuucuuaacaguaca

SEQ ID NO: 851337 - RNA, 22 nt, Human
uuauuucauguaaaauuuaugu

SEQ ID NO: 851338 - RNA, 22 nt, Human
caggacagagcccagacugugu

SEQ ID NO: 851339 - RNA, 22 nt, Human
caacagcugaucuuugaugaag

SEQ ID NO: 851340 - RNA, 22 nt, Human
ugaaucaguauaaauucucaaa

SEQ ID NO: 851341 - RNA, 22 nt, Human
uacagccucacauuuacuuaca

SEQ ID NO: 851342 - RNA, 22 nt, Human
ggaggggaugguuugacccugg

SEQ ID NO: 851343 - RNA, 22 nt, Human
auucuucaucagagaugcacua

SEQ ID NO: 851344 - RNA, 22 nt, Human
agggugguucuuuuaguggaag

SEQ ID NO: 851345 - RNA, 22 nt, Human
agcugaugccauguggaacagu

SEQ ID NO: 851346 - RNA, 22 nt, Human
ucucgacagccuggcacagugg

SEQ ID NO: 851347 - RNA, 22 nt, Human
uuugaaaguccuaggagagucc

SEQ ID NO: 851348 - RNA, 22 nt, Human
ucaggugguccuaagugccauc

SEQ ID NO: 851349 - RNA, 22 nt, Human
uucauucugcaguucucagcuc

SEQ ID NO: 851350 - RNA, 22 nt, Human
ucucuggcagggauaucuggcu

SEQ ID NO: 851351 - RNA, 22 nt, Human
uggcucagucuggguugacuga

SEQ ID NO: 851352 - RNA, 21 nt, Human
cagagcuguccaaacccugac

SEQ ID NO: 851353 - RNA, 22 nt, Human
cacaggcugcccgcagcuggga

SEQ ID NO: 851354 - RNA, 19 nt, Human
uggggcuguguuuugaccc

SEQ ID NO: 851355 - RNA, 22 nt, Human
uggcuucugcauauuuuuagag

SEQ ID NO: 851356 - RNA, 22 nt, Human
cagcagaggcacgucugugaau

SEQ ID NO: 851357 - RNA, 22 nt, Human
uugaggucuucauucuugggca

SEQ ID NO: 851358 - RNA, 22 nt, Human
ggcaagaaggcuucagguagcu

SEQ ID NO: 851359 - RNA, 22 nt, Human
auuuggauucuuauuuagcacu

SEQ ID NO: 851360 - RNA, 22 nt, Human
guggaaugaauagauuugcauu

SEQ ID NO: 851361 - RNA, 22 nt, Human
cagggcuguaaauuagugcuga

SEQ ID NO: 851362 - RNA, 22 nt, Human
aggaaagguagcgugccagcag

SEQ ID NO: 851363 - RNA, 22 nt, Human
uaaaacugcuugguauggucua

SEQ ID NO: 851364 - RNA, 22 nt, Human
cugaacuuauugagugcuugcu

SEQ ID NO: 851365 - RNA, 22 nt, Human
uggcagagcaaaaagauagaau

SEQ ID NO: 851366 - RNA, 20 nt, Human
agguccacugaggcugccuc

SEQ ID NO: 851367 - RNA, 23 nt, Human
aaauuauugcucuucaauugccu

SEQ ID NO: 851368 - RNA, 22 nt, Human
gucaggauuauaauccccaugg

SEQ ID NO: 851369 - RNA, 22 nt, Human
gugucccaggccucuggaauua

SEQ ID NO: 851370 - RNA, 22 nt, Human
agcugaggccacgagugaaggg

SEQ ID NO: 851371 - RNA, 22 nt, Human
ugcuugcuggaggcagacagaa

SEQ ID NO: 851372 - RNA, 21 nt, Human
cucaggaucuuauauauuagu

SEQ ID NO: 851373 - RNA, 22 nt, Human
cgaggcagaggcugaaacggcu

SEQ ID NO: 851374 - RNA, 22 nt, Human
acagaacuggaauuggaacuca

SEQ ID NO: 851375 - RNA, 22 nt, Human
guacacuugacucauaggaaau

SEQ ID NO: 851376 - RNA, 18 nt, Human
auggucucauacugggag

SEQ ID NO: 851377 - RNA, 22 nt, Human
uggcugagguaacuaugaauaa

SEQ ID NO: 851378 - RNA, 20 nt, Human
gaagcagcuucauguagaca

SEQ ID NO: 851379 - RNA, 22 nt, Human
ucucucagaggaagaggcagug

SEQ ID NO: 851380 - RNA, 22 nt, Human
ucugccugcuaacuccugcacc

SEQ ID NO: 851381 - RNA, 22 nt, Human
cuaaaugacagguaccauagug

SEQ ID NO: 851382 - RNA, 22 nt, Human
auuugcuucugugaaaucaagu

SEQ ID NO: 851383 - RNA, 22 nt, Human
cuucagugauauaggcuucucc

SEQ ID NO: 851384 - RNA, 22 nt, Human
gucugucucccugugacugaga

SEQ ID NO: 851385 - RNA, 22 nt, Human
gcucagagcuugaaguuccacu

SEQ ID NO: 851386 - RNA, 22 nt, Human
cugaggccugggggcguggacg

SEQ ID NO: 851387 - RNA, 22 nt, Human
aagacauugucauuuuauaauu

SEQ ID NO: 851388 - RNA, 22 nt, Human
cggagggguuugaacagaggag

SEQ ID NO: 851389 - RNA, 22 nt, Human
ggaggcaggaaagacagguuca

SEQ ID NO: 851390 - RNA, 22 nt, Human
auuaggauguguauauuguguu

SEQ ID NO: 851391 - RNA, 22 nt, Human
ccaggcugggcggggaaccugg

SEQ ID NO: 851392 - RNA, 22 nt, Human
aucauacagaaccugagcacuu

SEQ ID NO: 851393 - RNA, 22 nt, Human
uauuagagaaaagauggaugug

SEQ ID NO: 851394 - RNA, 22 nt, Human
uuaggaaagcauuguguaaaag

SEQ ID NO: 851395 - RNA, 22 nt, Human
guuauaaaaugcacaguuguuu

SEQ ID NO: 851396 - RNA, 22 nt, Human
ucugagguuacugcuuuguaga

SEQ ID NO: 851397 - RNA, 22 nt, Human
ugaggcagcaauugauuauuca

SEQ ID NO: 851398 - RNA, 22 nt, Human
agcagcugguaggaguggccac

SEQ ID NO: 851399 - RNA, 22 nt, Human
gaggcagcaggcugaggaggau

SEQ ID NO: 851400 - RNA, 19 nt, Human
acacuguagauauagcuau

SEQ ID NO: 851401 - RNA, 22 nt, Human
gauuuuaauuauaggagguccu

SEQ ID NO: 851402 - RNA, 22 nt, Human
acugcccucccaucuauugcaa

SEQ ID NO: 851403 - RNA, 22 nt, Human
ucugcugucacucauuugcuuc

SEQ ID NO: 851404 - RNA, 22 nt, Human
uuuauuauccaguguugucaug

SEQ ID NO: 851405 - RNA, 22 nt, Human
uggucaaaaacucucaguggac

SEQ ID NO: 851406 - RNA, 22 nt, Human
ggcagcuggguuggccagaaac

SEQ ID NO: 851407 - RNA, 22 nt, Human
aauacauauggaauuccauguu

SEQ ID NO: 851408 - RNA, 22 nt, Human
uuuagauaaugcucaagcaauu

SEQ ID NO: 851409 - RNA, 22 nt, Human
ugcuguggcaguuuauguauag

SEQ ID NO: 851410 - RNA, 22 nt, Human
cugccucagccuucugggugac

SEQ ID NO: 851411 - RNA, 20 nt, Human
uuucugugagaaacacuguu

SEQ ID NO: 851412 - RNA, 22 nt, Human
cagcugagaguagaaauggagg

SEQ ID NO: 851413 - RNA, 22 nt, Human
gcugagcuagaaaaggaccaca

SEQ ID NO: 851414 - RNA, 19 nt, Human
auacacuaauauaaaccac

SEQ ID NO: 851415 - RNA, 22 nt, Human
caguaguuauuaguugccacug

SEQ ID NO: 851416 - RNA, 22 nt, Human
cugaguguuuucagccacggcc

SEQ ID NO: 851417 - RNA, 22 nt, Human
agaaaagaggcuuucuaagcau

SEQ ID NO: 851418 - RNA, 22 nt, Human
aaaaccugauugaauucuauuu

SEQ ID NO: 851419 - RNA, 22 nt, Human
uuuccuaguucuaagaaaugua

SEQ ID NO: 851420 - RNA, 21 nt, Human
uccaggaguggcugggcaggg

SEQ ID NO: 851421 - RNA, 22 nt, Human
gccaggaggcuuaacuggacag

SEQ ID NO: 851422 - RNA, 22 nt, Human
aggacagcagugcuggcacuug

SEQ ID NO: 851423 - RNA, 22 nt, Human
gagggcaguagccucguacccu

SEQ ID NO: 851424 - RNA, 22 nt, Human
ccuggccagccagggcuggggu

SEQ ID NO: 851425 - RNA, 22 nt, Human
guaacuuaccauuguagcauca

SEQ ID NO: 851426 - RNA, 23 nt, Human
aggauguaggauguauggcagag

SEQ ID NO: 851427 - RNA, 22 nt, Human
agccuaaugcuuuucccaaagu

SEQ ID NO: 851428 - RNA, 22 nt, Human
cuuguagcugcuucuucugaag

SEQ ID NO: 851429 - RNA, 21 nt, Human
ccugcugugaucuuagugagu

SEQ ID NO: 851430 - RNA, 22 nt, Human
uuccagcaggcagacaggagau

SEQ ID NO: 851431 - RNA, 22 nt, Human
uaacugguccucggauguugug

SEQ ID NO: 851432 - RNA, 22 nt, Human
uaugaacucuggagucugagug

SEQ ID NO: 851433 - RNA, 22 nt, Human
accaggaguaacagugaguggu

SEQ ID NO: 851434 - RNA, 22 nt, Human
cuuugaagagauuacugugcuc

SEQ ID NO: 851435 - RNA, 22 nt, Human
cuggcucaauuuguacugcugu

SEQ ID NO: 851436 - RNA, 22 nt, Human
cuggguaaguuccuaaggcuca

SEQ ID NO: 851437 - RNA, 22 nt, Human
ugauugaagaggugaggaaguu

SEQ ID NO: 851438 - RNA, 22 nt, Human
uccaggaggcagggcugugccc

SEQ ID NO: 851439 - RNA, 22 nt, Human
uggcagcaauuugugauguuga

SEQ ID NO: 851440 - RNA, 22 nt, Human
cucuucuuuaguccagaccauc

SEQ ID NO: 851441 - RNA, 22 nt, Human
caggauggugugagugugagga

SEQ ID NO: 851442 - RNA, 22 nt, Human
accaggaguugggggugggacc

SEQ ID NO: 851443 - RNA, 20 nt, Human
uuccaacucacaucucuaca

SEQ ID NO: 851444 - RNA, 22 nt, Human
guuaucaugcuucaucaucacu

SEQ ID NO: 851445 - RNA, 22 nt, Human
auuaacuguacuuucuaauuuu

SEQ ID NO: 851446 - RNA, 22 nt, Human
gcccagugcugagggugcugcu

SEQ ID NO: 851447 - RNA, 20 nt, Human
uccuggccucccuggggcuc

SEQ ID NO: 851448 - RNA, 22 nt, Human
uggguccagugcagcugcgcgu

SEQ ID NO: 851449 - RNA, 22 nt, Human
cggagaggaccugcaacucgcu

SEQ ID NO: 851450 - RNA, 22 nt, Human
ccagagagaaauggauuugagu

SEQ ID NO: 851451 - RNA, 22 nt, Human
ccccaggacacauggaccaagu

SEQ ID NO: 851452 - RNA, 22 nt, Human
uucuuaacuggaaaaugucaga

SEQ ID NO: 851453 - RNA, 22 nt, Human
uucaauucugcucugaucuuag

SEQ ID NO: 851454 - RNA, 22 nt, Human
uuaucacuuaugagcuuuuugc

SEQ ID NO: 851455 - RNA, 22 nt, Human
gaccauuugcuaguaaauugca

SEQ ID NO: 851456 - RNA, 22 nt, Human
uuauggcauauuccucauugua

SEQ ID NO: 851457 - RNA, 22 nt, Human
uuuagaaguucacacauuuaaa

SEQ ID NO: 851458 - RNA, 22 nt, Human
aagaaaugcacacaacugcugg

SEQ ID NO: 851459 - RNA, 22 nt, Human
aaggcugagagucacaguccua

SEQ ID NO: 851460 - RNA, 23 nt, Human
uccuuccuuugagaggcuccauc

SEQ ID NO: 851461 - RNA, 18 nt, Human
cugccugcucuccagcuu

SEQ ID NO: 851462 - RNA, 22 nt, Human
uuauguagcagaaagauguuug

SEQ ID NO: 851463 - RNA, 22 nt, Human
cccaggaaagagacugcugggu

SEQ ID NO: 851464 - RNA, 22 nt, Human
uugauacauuuuuaggauaaac

SEQ ID NO: 851465 - RNA, 21 nt, Human
uugaaaguaaauucagcagcu

SEQ ID NO: 851466 - RNA, 22 nt, Human
ggcugagccaugggcacugcag

SEQ ID NO: 851467 - RNA, 22 nt, Human
auuugcuuaucuccacaguugu

SEQ ID NO: 851468 - RNA, 22 nt, Human
auaaaugauucagcaggaaaua

SEQ ID NO: 851469 - RNA, 21 nt, Human
gcuggagagccaggcaggggc

SEQ ID NO: 851470 - RNA, 22 nt, Human
uaggauaugguagaaaucauuc

SEQ ID NO: 851471 - RNA, 21 nt, Human
gcaaauguucaggaaaaaaga

SEQ ID NO: 851472 - RNA, 17 nt, Human
aggcuggcucacaggga

SEQ ID NO: 851473 - RNA, 22 nt, Human
ucugcuguauuagguugaacug

SEQ ID NO: 851474 - RNA, 22 nt, Human
aauauaugugguauugaccagc

SEQ ID NO: 851475 - RNA, 22 nt, Human
uuuauagggacaguucuuggag

SEQ ID NO: 851476 - RNA, 22 nt, Human
ucuccuggcucaccaggcugga

SEQ ID NO: 851477 - RNA, 22 nt, Human
ucuucucucauguaggagggaa

SEQ ID NO: 851478 - RNA, 22 nt, Human
uaauuaacauacaaaacagcug

SEQ ID NO: 851479 - RNA, 22 nt, Human
uaaauuguuuucuagaaguugu

SEQ ID NO: 851480 - RNA, 21 nt, Human
uuuauuaacaacuguggacgu

SEQ ID NO: 851481 - RNA, 22 nt, Human
ugccugugguuccaguuuuuuc

SEQ ID NO: 851482 - RNA, 21 nt, Human
cugcuguggcccccgacaugc

SEQ ID NO: 851483 - RNA, 22 nt, Human
gggcugagauuggugcccuguc

SEQ ID NO: 851484 - RNA, 22 nt, Human
ugucuagaggccaacaggaaag

SEQ ID NO: 851485 - RNA, 22 nt, Human
gcugagagcggccagcugggaa

SEQ ID NO: 851486 - RNA, 22 nt, Human
uucugaaccauugagcacugcc

SEQ ID NO: 851487 - RNA, 22 nt, Human
ucuguccagaacguacaucuug

SEQ ID NO: 851488 - RNA, 22 nt, Human
ugaggcucuaugugguagauua

SEQ ID NO: 851489 - RNA, 22 nt, Human
ucacugcugcugccaugaugga

SEQ ID NO: 851490 - RNA, 22 nt, Human
uucuuugaguuaguacagucca

SEQ ID NO: 851491 - RNA, 22 nt, Human
agaggggaaggaugugauguga

SEQ ID NO: 851492 - RNA, 22 nt, Human
uaaccuuuguucaauguaagau

SEQ ID NO: 851493 - RNA, 22 nt, Human
gcugaagagcaaggcugggucu

SEQ ID NO: 851494 - RNA, 22 nt, Human
ggcagcucacgggcauggggug

SEQ ID NO: 851495 - RNA, 22 nt, Human
uuugaagugggcauuagaaccu

SEQ ID NO: 851496 - RNA, 21 nt, Human
ggcagccucuguggaagggga

SEQ ID NO: 851497 - RNA, 22 nt, Human
gucaggaucaaauugaaguuau

SEQ ID NO: 851498 - RNA, 22 nt, Human
cccaggaaguggagguugcagu

SEQ ID NO: 851499 - RNA, 22 nt, Human
acuggcagcagcagcccuuggg

SEQ ID NO: 851500 - RNA, 22 nt, Human
gaggcugccccuuccucagcug

SEQ ID NO: 851501 - RNA, 22 nt, Human
aaggcugaccaguuuacacuuu

SEQ ID NO: 851502 - RNA, 22 nt, Human
ccuccugggccuugcucuguga

SEQ ID NO: 851503 - RNA, 22 nt, Human
ucaggcugcaguggcaaaagac

SEQ ID NO: 851504 - RNA, 22 nt, Human
cuggcugaggucaccaguagcu

SEQ ID NO: 851505 - RNA, 22 nt, Human
cacuaaguugguguuaauuagu

SEQ ID NO: 851506 - RNA, 22 nt, Human
uuccuuaggcuguuugcagugc

SEQ ID NO: 851507 - RNA, 22 nt, Human
ccuccccugcucagaacucugg

SEQ ID NO: 851508 - RNA, 23 nt, Human
uggcugagguccagguaguuuca

SEQ ID NO: 851509 - RNA, 22 nt, Human
cgaggcagacaaaaguuggaag

SEQ ID NO: 851510 - RNA, 22 nt, Human
ccucagcuugauuucugcagag

SEQ ID NO: 851511 - RNA, 22 nt, Human
acucaggaaaugaagacugguu

SEQ ID NO: 851512 - RNA, 22 nt, Human
acuucuggauagagucagcuuu

SEQ ID NO: 851513 - RNA, 22 nt, Human
ggcugcugaaguguggcaaucu

SEQ ID NO: 851514 - RNA, 22 nt, Human
gcagaggagaugaagauacuuu

SEQ ID NO: 851515 - RNA, 22 nt, Human
ggccagcuuugagcugcaggaa

SEQ ID NO: 851516 - RNA, 22 nt, Human
cccaggaggcagauguugcagu

SEQ ID NO: 851517 - RNA, 22 nt, Human
guauuaggagguggagccuuug

SEQ ID NO: 851518 - RNA, 22 nt, Human
caauacuuccuuguuagaggca

SEQ ID NO: 851519 - RNA, 22 nt, Human
guucuucagcauuagaagucau

SEQ ID NO: 851520 - RNA, 22 nt, Human
agggagcucaguuggaagcggu

SEQ ID NO: 851521 - RNA, 22 nt, Human
aggguggcaccuggaagggaug

SEQ ID NO: 851522 - RNA, 22 nt, Human
agcaugcgcuugaucagcucca

SEQ ID NO: 851523 - RNA, 20 nt, Human
guacacuucauguuucaccu

SEQ ID NO: 851524 - RNA, 22 nt, Human
gcagagcuucuguccuucagga

SEQ ID NO: 851525 - RNA, 22 nt, Human
aaguaguuggaaauaagacaga

SEQ ID NO: 851526 - RNA, 22 nt, Human
caggcugcggccgugugagcau

SEQ ID NO: 851527 - RNA, 22 nt, Human
ccaggauggggagcagauagaa

SEQ ID NO: 851528 - RNA, 22 nt, Human
uauuuucuguggaggaccagau

SEQ ID NO: 851529 - RNA, 22 nt, Human
agcauacaguugaaaguggcuu

SEQ ID NO: 851530 - RNA, 22 nt, Human
aggggagguggcagaaaugugc

SEQ ID NO: 851531 - RNA, 23 nt, Human
cuccuggaggguccggcccugcc

SEQ ID NO: 851532 - RNA, 22 nt, Human
cagggcugagaauuuagagaca

SEQ ID NO: 851533 - RNA, 22 nt, Human
uugcaggaaacugagugugagc

SEQ ID NO: 851534 - RNA, 22 nt, Human
ucaggaugguguggaggaaaua

SEQ ID NO: 851535 - RNA, 22 nt, Human
auuagcauauuaaauagucauu

SEQ ID NO: 851536 - RNA, 22 nt, Human
cagaggcagugggguugcuccu

SEQ ID NO: 851537 - RNA, 22 nt, Human
gaggcagcugaaggagugacag

SEQ ID NO: 851538 - RNA, 22 nt, Human
uuuguaaaggccugaauuucag

SEQ ID NO: 851539 - RNA, 22 nt, Human
agagggauggccccguaacuca

SEQ ID NO: 851540 - RNA, 22 nt, Human
agagggaucacccuguuucugg

SEQ ID NO: 851541 - RNA, 22 nt, Human
auuacaguaacagcuacaaugc

SEQ ID NO: 851542 - RNA, 22 nt, Human
uaaugucaaggugauagauuug

SEQ ID NO: 851543 - RNA, 17 nt, Human
guccuacccauggucua

SEQ ID NO: 851544 - RNA, 22 nt, Human
aauuuccaaauuucugucacac

SEQ ID NO: 851545 - RNA, 22 nt, Human
uucugggacaucuggacaguuu

SEQ ID NO: 851546 - RNA, 22 nt, Human
acuccugggugcugaccagcgu

SEQ ID NO: 851547 - RNA, 22 nt, Human
cugcugugcaacauugcaccua

SEQ ID NO: 851548 - RNA, 22 nt, Human
ucaauucaacacaugcacauug

SEQ ID NO: 851549 - RNA, 23 nt, Human
gguccacccgagccugcagcuuc

SEQ ID NO: 851550 - RNA, 22 nt, Human
ucauuucccuccuacaaagagg

SEQ ID NO: 851551 - RNA, 22 nt, Human
agucauaugacccuucacaaac

SEQ ID NO: 851552 - RNA, 22 nt, Human
ugaguucucacccauucuucuu

SEQ ID NO: 851553 - RNA, 20 nt, Human
cagaggcaaggagacuugga

SEQ ID NO: 851554 - RNA, 22 nt, Human
ucuuagaaguuuauggcacgga

SEQ ID NO: 851555 - RNA, 20 nt, Human
ugugaaagcaguagaaugac

SEQ ID NO: 851556 - RNA, 22 nt, Human
cauucauuagaauagauaugua

SEQ ID NO: 851557 - RNA, 22 nt, Human
ugguagcaacaucucaguggcu

SEQ ID NO: 851558 - RNA, 22 nt, Human
cuaauacacccuauugcuuguu

SEQ ID NO: 851559 - RNA, 22 nt, Human
ccuggguggcagagguugcagu

SEQ ID NO: 851560 - RNA, 22 nt, Human
guggcacaaggcuuacacagca

SEQ ID NO: 851561 - RNA, 22 nt, Human
ucuuuauuucugaaucccccau

SEQ ID NO: 851562 - RNA, 22 nt, Human
uuuaguagaugcagcauuauuu

SEQ ID NO: 851563 - RNA, 22 nt, Human
caucuuuuggccuauucugagg

SEQ ID NO: 851564 - RNA, 21 nt, Human
uacagaaugcgcuucagucug

SEQ ID NO: 851565 - RNA, 22 nt, Human
acagagagaaacaaucagcagc

SEQ ID NO: 851566 - RNA, 22 nt, Human
ccugggcaacauagggagaccc

SEQ ID NO: 851567 - RNA, 22 nt, Human
auucuucagaauaucuggcacu

SEQ ID NO: 851568 - RNA, 23 nt, Human
guaacuggggaauuugagcuaug

SEQ ID NO: 851569 - RNA, 22 nt, Human
uccaggaggguuuucugccuuc

SEQ ID NO: 851570 - RNA, 22 nt, Human
aagggaggggauguaagccugg

SEQ ID NO: 851571 - RNA, 22 nt, Human
augugaggaagaaagagguaag

SEQ ID NO: 851572 - RNA, 22 nt, Human
cugggcaauaugcugggccugg

SEQ ID NO: 851573 - RNA, 22 nt, Human
uucuuacagaguuuacagagcc

SEQ ID NO: 851574 - RNA, 22 nt, Human
uccaggagugugugcuaauggg

SEQ ID NO: 851575 - RNA, 22 nt, Human
cuucucagucaccugugagucu

SEQ ID NO: 851576 - RNA, 22 nt, Human
cagugcugggcagaggagagcg

SEQ ID NO: 851577 - RNA, 22 nt, Human
aggcugaggagggauguugcuu

SEQ ID NO: 851578 - RNA, 23 nt, Human
acacuuucaaauaugcacagagc

SEQ ID NO: 851579 - RNA, 19 nt, Human
cuucuggcccugagccacc

SEQ ID NO: 851580 - RNA, 22 nt, Human
cugguacaaaaugcugauauca

SEQ ID NO: 851581 - RNA, 22 nt, Human
gagcaagauuuuauaaguugug

SEQ ID NO: 851582 - RNA, 22 nt, Human
uccuggccuuauccccaaacug

SEQ ID NO: 851583 - RNA, 22 nt, Human
gaacuggugagaguucacggga

SEQ ID NO: 851584 - RNA, 22 nt, Human
ugcccugggaguuggagcugcu

SEQ ID NO: 851585 - RNA, 22 nt, Human
ugugaaggagaugaagggagug

SEQ ID NO: 851586 - RNA, 22 nt, Human
aaacugguuucugagauggaac

SEQ ID NO: 851587 - RNA, 22 nt, Human
caggauagaaaggccauggagu

SEQ ID NO: 851588 - RNA, 22 nt, Human
ugcucuucggggccacugcuug

SEQ ID NO: 851589 - RNA, 22 nt, Human
ucaggagaguguucaguggagg

SEQ ID NO: 851590 - RNA, 21 nt, Human
agcaccuuacagcuauaaugg

SEQ ID NO: 851591 - RNA, 22 nt, Human
caaggcugcuggcuucugagcu

SEQ ID NO: 851592 - RNA, 22 nt, Human
cacaaauggccguguucaaaga

SEQ ID NO: 851593 - RNA, 22 nt, Human
ccugccucaggacucugcauau

SEQ ID NO: 851594 - RNA, 18 nt, Human
ucuuuggacaacuacugg

SEQ ID NO: 851595 - RNA, 22 nt, Human
uaggaugaucuuguagagagau

SEQ ID NO: 851596 - RNA, 22 nt, Human
uuuuauuaucuuugaaugggac

SEQ ID NO: 851597 - RNA, 22 nt, Human
cucucagacugaagggccugug

SEQ ID NO: 851598 - RNA, 22 nt, Human
uucaugugaauauauuugucuu

SEQ ID NO: 851599 - RNA, 22 nt, Human
cugaagccaugugcucacuggu

SEQ ID NO: 851600 - RNA, 22 nt, Human
gucuucuuguuuugaaggaaau

SEQ ID NO: 851601 - RNA, 22 nt, Human
gcugagguggagauugcaguga

SEQ ID NO: 851602 - RNA, 22 nt, Human
uucagaaaaaacuucaauaagu

SEQ ID NO: 851603 - RNA, 22 nt, Human
auucuucaccugagucagucua

SEQ ID NO: 851604 - RNA, 22 nt, Human
caggcagcguccugcuuccugu

SEQ ID NO: 851605 - RNA, 22 nt, Human
aagggcuggagaggaaagguug

SEQ ID NO: 851606 - RNA, 22 nt, Human
uuuacauuucccucugucaguu

SEQ ID NO: 851607 - RNA, 22 nt, Human
guuaaauucgaugauggauaaa

SEQ ID NO: 851608 - RNA, 22 nt, Human
aggcaguggaugucaggaaugg

SEQ ID NO: 851609 - RNA, 22 nt, Human
gacagcuggcaguggaaaggug

SEQ ID NO: 851610 - RNA, 22 nt, Human
aggcuggcccuacuggcugccu

SEQ ID NO: 851611 - RNA, 22 nt, Human
ggcugaggguauagcuguccca

SEQ ID NO: 851612 - RNA, 22 nt, Human
augaggauuaacuguugucaua

SEQ ID NO: 851613 - RNA, 22 nt, Human
cuggccacugguggucauaggc

SEQ ID NO: 851614 - RNA, 22 nt, Human
cugcuguguggugaaacucagu

SEQ ID NO: 851615 - RNA, 23 nt, Human
uacuuaggaauggggacggcaag

SEQ ID NO: 851616 - RNA, 22 nt, Human
gaggcugaguagcuuugugcuc

SEQ ID NO: 851617 - RNA, 22 nt, Human
acaaauaugguacucggagaaa

SEQ ID NO: 851618 - RNA, 22 nt, Human
gcagggaagacccggagcagcg

SEQ ID NO: 851619 - RNA, 19 nt, Human
uuucuuaggccuuuggccu

SEQ ID NO: 851620 - RNA, 22 nt, Human
ucccagaggaaauggcagcuga

SEQ ID NO: 851621 - RNA, 22 nt, Human
uaccacaguuuaucuauucagc

SEQ ID NO: 851622 - RNA, 22 nt, Human
ucaggcugagaaaaucuggacc

SEQ ID NO: 851623 - RNA, 22 nt, Human
ggguacuuaauauuuacggggu

SEQ ID NO: 851624 - RNA, 22 nt, Human
uuucaucuaacacuacauaggg

SEQ ID NO: 851625 - RNA, 22 nt, Human
agagaagagcaaugauaaauuu

SEQ ID NO: 851626 - RNA, 22 nt, Human
aacugguauggugagaagagag

SEQ ID NO: 851627 - RNA, 22 nt, Human
gagaagcaaucaguggccaccc

SEQ ID NO: 851628 - RNA, 22 nt, Human
cagacaggagacuggaucaugg

SEQ ID NO: 851629 - RNA, 16 nt, Human
aaggagggaagagaau

SEQ ID NO: 851630 - RNA, 22 nt, Human
cuccuggcucgcccccagcuga

SEQ ID NO: 851631 - RNA, 18 nt, Human
ugugaacacauuuuucug

SEQ ID NO: 851632 - RNA, 22 nt, Human
augcuguguuuuaaauggaaau

SEQ ID NO: 851633 - RNA, 22 nt, Human
uggcugaggagggucuucuggu

SEQ ID NO: 851634 - RNA, 21 nt, Human
gcccagugauuucuucacagu

SEQ ID NO: 851635 - RNA, 22 nt, Human
ugaggccccgaagcugagguuu

SEQ ID NO: 851636 - RNA, 22 nt, Human
aaauacuggcaagugcuaauuc

SEQ ID NO: 851637 - RNA, 23 nt, Human
uggcagcuguguaagagaaagca

SEQ ID NO: 851638 - RNA, 22 nt, Human
gagagcaggaggcagcgggacg

SEQ ID NO: 851639 - RNA, 22 nt, Human
agccugagugcuuaggacuguu

SEQ ID NO: 851640 - RNA, 22 nt, Human
aaauacuagaauucagaguuga

SEQ ID NO: 851641 - RNA, 21 nt, Human
agucuguuaggaugacucuga

SEQ ID NO: 851642 - RNA, 22 nt, Human
auauauaaccuggauaaggcuu

SEQ ID NO: 851643 - RNA, 19 nt, Human
ggggagaacuagagacagc

SEQ ID NO: 851644 - RNA, 18 nt, Human
cucuuucuuuggcacaaa

SEQ ID NO: 851645 - RNA, 22 nt, Human
ccuccugguugcaaugaaaugg

SEQ ID NO: 851646 - RNA, 22 nt, Human
ugaaaugaaacagaacauauca

SEQ ID NO: 851647 - RNA, 22 nt, Human
cauuuguacagaacagcuuuau

SEQ ID NO: 851648 - RNA, 21 nt, Human
gugcuuuuccuuaauguucuu

SEQ ID NO: 851649 - RNA, 19 nt, Human
agggccugcagcucaagcu

SEQ ID NO: 851650 - RNA, 22 nt, Human
uuucuagggcucuugucuucug

SEQ ID NO: 851651 - RNA, 22 nt, Human
acacauuucucuuuuuguaagu

SEQ ID NO: 851652 - RNA, 22 nt, Human
cagaguucaaagccugcuggga

SEQ ID NO: 851653 - RNA, 22 nt, Human
uucuccagaccuugugacuaug

SEQ ID NO: 851654 - RNA, 22 nt, Human
cagggcuggauccuccagacuc

SEQ ID NO: 851655 - RNA, 22 nt, Human
gaguccaguuagugaggcuggg

SEQ ID NO: 851656 - RNA, 22 nt, Human
ucuucagauaaagggagaguau

SEQ ID NO: 851657 - RNA, 22 nt, Human
uuagaaagaacuuuagauauca

SEQ ID NO: 851658 - RNA, 22 nt, Human
cugagcccauugggugcuguua

SEQ ID NO: 851659 - RNA, 20 nt, Human
uguuaaaggacacuugcuuu

SEQ ID NO: 851660 - RNA, 22 nt, Human
aggaugaggcuggcaggucuug

SEQ ID NO: 851661 - RNA, 22 nt, Human
aguugcucaauguggcugugga

SEQ ID NO: 851662 - RNA, 22 nt, Human
aguaaaaauugaggugcaaaau

SEQ ID NO: 851663 - RNA, 19 nt, Human
cucucacucgccacauccu

SEQ ID NO: 851664 - RNA, 22 nt, Human
cagcuggcugcaugaugccaaa

SEQ ID NO: 851665 - RNA, 22 nt, Human
uggcagcaccagcaguguccuu

SEQ ID NO: 851666 - RNA, 17 nt, Human
agaacuguaguagcucc

SEQ ID NO: 851667 - RNA, 22 nt, Human
cuuauuagaguuguguucuguu

SEQ ID NO: 851668 - RNA, 20 nt, Human
aggaaaaauggaaacuggag

SEQ ID NO: 851669 - RNA, 21 nt, Human
cucaggauggcggccuggugg

SEQ ID NO: 851670 - RNA, 22 nt, Human
cugaggccguuggugggccuua

SEQ ID NO: 851671 - RNA, 22 nt, Human
ccuggccaaucuagggcuguua

SEQ ID NO: 851672 - RNA, 22 nt, Human
aauggccagcugggagaguuga

SEQ ID NO: 851673 - RNA, 22 nt, Human
uggagcugggguuugaaucugg

SEQ ID NO: 851674 - RNA, 22 nt, Human
uuucauugcagagucugugugc

SEQ ID NO: 851675 - RNA, 22 nt, Human
uugaggucaauucuguuuccug

SEQ ID NO: 851676 - RNA, 22 nt, Human
aggguaggaacugaguggaagg

SEQ ID NO: 851677 - RNA, 22 nt, Human
ggucugaguggggccugagauu

SEQ ID NO: 851678 - RNA, 22 nt, Human
uuuucaguuccaucucugcucu

SEQ ID NO: 851679 - RNA, 22 nt, Human
uauacacugauauaaggaguaa

SEQ ID NO: 851680 - RNA, 22 nt, Human
gucaggauuuacaaacuucagu

SEQ ID NO: 851681 - RNA, 22 nt, Human
uggagucugugaugcucugggu

SEQ ID NO: 851682 - RNA, 22 nt, Human
ugguaaauauguccauucucuu

SEQ ID NO: 851683 - RNA, 22 nt, Human
aucauucuauuguugagcugcc

SEQ ID NO: 851684 - RNA, 22 nt, Human
gggcugagccacagcuuuuguu

SEQ ID NO: 851685 - RNA, 22 nt, Human
ugaggggagcuagcaugccuug

SEQ ID NO: 851686 - RNA, 22 nt, Human
gcccagggcugcaaguggacgc

SEQ ID NO: 851687 - RNA, 22 nt, Human
ggcagaggagcuggaaacaugg

SEQ ID NO: 851688 - RNA, 22 nt, Human
uggcugagugaacauguccauu

SEQ ID NO: 851689 - RNA, 22 nt, Human
caaauacuguacugaacacugu

SEQ ID NO: 851690 - RNA, 22 nt, Human
uuacacuuuugacaaaccugag

SEQ ID NO: 851691 - RNA, 22 nt, Human
uuacuggcugggccugagggcu

SEQ ID NO: 851692 - RNA, 22 nt, Human
aggcagcuggcaaauucuagag

SEQ ID NO: 851693 - RNA, 22 nt, Human
ccaggagaagcaucugagugua

SEQ ID NO: 851694 - RNA, 22 nt, Human
uuccugagggacuuuugagauu

SEQ ID NO: 851695 - RNA, 22 nt, Human
cagaacugaccucugauucuag

SEQ ID NO: 851696 - RNA, 22 nt, Human
cagucucuugcuucauuaguug

SEQ ID NO: 851697 - RNA, 23 nt, Human
uccugaggguuucccagccuugg

SEQ ID NO: 851698 - RNA, 22 nt, Human
gccaggagcccugggcaaguuc

SEQ ID NO: 851699 - RNA, 22 nt, Human
gaggcauggccugaggcuagga

SEQ ID NO: 851700 - RNA, 22 nt, Human
agcacagagguggaaguguaua

SEQ ID NO: 851701 - RNA, 19 nt, Human
cugggccagaaucagcuca

SEQ ID NO: 851702 - RNA, 22 nt, Human
uauuugcaacauaaaacucuga

SEQ ID NO: 851703 - RNA, 22 nt, Human
acaggacuguggaaggaucucu

SEQ ID NO: 851704 - RNA, 22 nt, Human
cugaggccucucuccugggcuu

SEQ ID NO: 851705 - RNA, 22 nt, Human
uccaggagcucauccacgucaa

SEQ ID NO: 851706 - RNA, 22 nt, Human
cccuuccugggugucccggagu

SEQ ID NO: 851707 - RNA, 22 nt, Human
ccuaauuaucucccaaagaucc

SEQ ID NO: 851708 - RNA, 21 nt, Human
uacaguaaguugggugguccu

SEQ ID NO: 851709 - RNA, 16 nt, Human
cuuccucuucacuggc

SEQ ID NO: 851710 - RNA, 22 nt, Human
acgcuuuuacuauuuugagcuc

SEQ ID NO: 851711 - RNA, 22 nt, Human
ucaggagacuuaugucacagug

SEQ ID NO: 851712 - RNA, 22 nt, Human
uuuggaauuggaaagugcugug

SEQ ID NO: 851713 - RNA, 22 nt, Human
gaggccacaguccugaggcauc

SEQ ID NO: 851714 - RNA, 22 nt, Human
ccuuuuauaaaguuguauugaa

SEQ ID NO: 851715 - RNA, 22 nt, Human
uggcaagccugagauccgggag

SEQ ID NO: 851716 - RNA, 22 nt, Human
uucuucaguguagcaacuguau

SEQ ID NO: 851717 - RNA, 22 nt, Human
uagcaagacaacuuuucucagu

SEQ ID NO: 851718 - RNA, 22 nt, Human
uuugaagucaggcuuucuaccc

SEQ ID NO: 851719 - RNA, 22 nt, Human
guggccaaaaggaagaagguua

SEQ ID NO: 851720 - RNA, 22 nt, Human
uugauuucuauucagauguaga

SEQ ID NO: 851721 - RNA, 22 nt, Human
gauuucuugauaauucaaaucc

SEQ ID NO: 851722 - RNA, 22 nt, Human
guaacucuuuggaaaacauuuu

SEQ ID NO: 851723 - RNA, 22 nt, Human
caguucuuauuuggccaguguc

SEQ ID NO: 851724 - RNA, 22 nt, Human
cacaggcugggaagccuaggcc

SEQ ID NO: 851725 - RNA, 22 nt, Human
uuggccaagggaucgagguugg

SEQ ID NO: 851726 - RNA, 22 nt, Human
gaggauggaggugugagcuaug

SEQ ID NO: 851727 - RNA, 22 nt, Human
acauguuuaaguuuguuauaug

SEQ ID NO: 851728 - RNA, 22 nt, Human
auugaaagguuuugagcagaua

SEQ ID NO: 851729 - RNA, 22 nt, Human
uuaagauagaacccaguagucu

SEQ ID NO: 851730 - RNA, 22 nt, Human
uuacacuucugaaagccuaggu

SEQ ID NO: 851731 - RNA, 16 nt, Human
ucccaggaggcggaac

SEQ ID NO: 851732 - RNA, 22 nt, Human
guccaugauucuguguaguaga

SEQ ID NO: 851733 - RNA, 22 nt, Human
ucugggaaguccucugucaugc

SEQ ID NO: 851734 - RNA, 22 nt, Human
agggccuggaacugugggcagg

SEQ ID NO: 851735 - RNA, 22 nt, Human
uaguccaggacaaucuucauau

SEQ ID NO: 851736 - RNA, 22 nt, Human
gugcugccugccagcuucuggg

SEQ ID NO: 851737 - RNA, 22 nt, Human
cuccaggaaaauagggaaugag

SEQ ID NO: 851738 - RNA, 22 nt, Human
uuggaaauacgaguaguaucau

SEQ ID NO: 851739 - RNA, 22 nt, Human
uccaggaguuugaccugugggc

SEQ ID NO: 851740 - RNA, 22 nt, Human
guacauuucucuuguucuuauu

SEQ ID NO: 851741 - RNA, 22 nt, Human
aucuuucaguuucauaccaauu

SEQ ID NO: 851742 - RNA, 22 nt, Human
uccugagagcagcugcuuugga

SEQ ID NO: 851743 - RNA, 22 nt, Human
gauuucuugauaaguaguguga

SEQ ID NO: 851744 - RNA, 22 nt, Human
gaggcaguguugaaaaggagag

SEQ ID NO: 851745 - RNA, 22 nt, Human
ccuggagagagaggccaacugc

SEQ ID NO: 851746 - RNA, 23 nt, Human
uuccagaguccacaucugccacc

SEQ ID NO: 851747 - RNA, 22 nt, Human
aguggcaggcggagauguagga

SEQ ID NO: 851748 - RNA, 22 nt, Human
auggccaugccaguuuacagcc

SEQ ID NO: 851749 - RNA, 22 nt, Human
caggagagauaugaguccccac

SEQ ID NO: 851750 - RNA, 22 nt, Human
cuggccauguugccucugagac

SEQ ID NO: 851751 - RNA, 22 nt, Human
cuggggcccaucgagggcugag

SEQ ID NO: 851752 - RNA, 22 nt, Human
gagggcugcuggaaaaaugcag

SEQ ID NO: 851753 - RNA, 22 nt, Human
aggccagacagcuagaaacagg

SEQ ID NO: 851754 - RNA, 22 nt, Human
ccuggccaggcauggagucaca

SEQ ID NO: 851755 - RNA, 22 nt, Human
uuggaaagcaagcuggacauac

SEQ ID NO: 851756 - RNA, 22 nt, Human
agacccugcauuuuccaggguu

SEQ ID NO: 851757 - RNA, 22 nt, Human
caaggaaaagaaguauuucaga

SEQ ID NO: 851758 - RNA, 22 nt, Human
gcaggagagucugugccagguu

SEQ ID NO: 851759 - RNA, 22 nt, Human
aaugucugcucuacucaggagg

SEQ ID NO: 851760 - RNA, 22 nt, Human
agcagagccugggcuaggggug

SEQ ID NO: 851761 - RNA, 22 nt, Human
gugagagaucccccacucaucu

SEQ ID NO: 851762 - RNA, 22 nt, Human
gaggcagagugcaccccaggag

SEQ ID NO: 851763 - RNA, 22 nt, Human
cagcuuucaucagugacacuca

SEQ ID NO: 851764 - RNA, 22 nt, Human
cuugaaagaagggucuuuuaau

SEQ ID NO: 851765 - RNA, 23 nt, Human
gcccucccucccagguggguguu

SEQ ID NO: 851766 - RNA, 22 nt, Human
ggcugcuggccagccuaggagu

SEQ ID NO: 851767 - RNA, 19 nt, Human
uccucagugacaaccucag

SEQ ID NO: 851768 - RNA, 20 nt, Human
accagagcucucaguaugug

SEQ ID NO: 851769 - RNA, 22 nt, Human
cugcuuugacuguuaagaacca

SEQ ID NO: 851770 - RNA, 22 nt, Human
gcugccuguccugaggaguccg

SEQ ID NO: 851771 - RNA, 22 nt, Human
cuuuauauccagauguuuggug

SEQ ID NO: 851772 - RNA, 22 nt, Human
cagagcuguuacuauucaugaa

SEQ ID NO: 851773 - RNA, 22 nt, Human
uggcaguccccugugccuggaa

SEQ ID NO: 851774 - RNA, 22 nt, Human
aucugcaggaaugugugcagag

SEQ ID NO: 851775 - RNA, 22 nt, Human
uuucugcugugcuuucuugcgu

SEQ ID NO: 851776 - RNA, 22 nt, Human
cuuagagcuuaggcuagccauu

SEQ ID NO: 851777 - RNA, 22 nt, Human
cuugaaagucagcagaguggau

SEQ ID NO: 851778 - RNA, 22 nt, Human
uuggaaauacagcaguuacuuu

SEQ ID NO: 851779 - RNA, 22 nt, Human
ccuggccagggucugggcugcu

SEQ ID NO: 851780 - RNA, 22 nt, Human
gaggagcugggcugagaggguc

SEQ ID NO: 851781 - RNA, 22 nt, Human
aagugaagaaauacaugagaau

SEQ ID NO: 851782 - RNA, 22 nt, Human
aaggcagccuuuguuugauuga

SEQ ID NO: 851783 - RNA, 21 nt, Human
auucuagacaacacugaaauc

SEQ ID NO: 851784 - RNA, 22 nt, Human
ggcaugaguggcagugggcagu

SEQ ID NO: 851785 - RNA, 19 nt, Human
aauacaguguuauagaauu

SEQ ID NO: 851786 - RNA, 22 nt, Human
aggcagucuaguccccaggcaa

SEQ ID NO: 851787 - RNA, 22 nt, Human
accuuuuauguaaauauauguu

SEQ ID NO: 851788 - RNA, 21 nt, Human
uuucuuaggcucuaaaaugac

SEQ ID NO: 851789 - RNA, 20 nt, Human
ugaggcucagagagguugag

SEQ ID NO: 851790 - RNA, 20 nt, Human
aagcacauuucuacaauaau

SEQ ID NO: 851791 - RNA, 19 nt, Human
uucaggauugacccuacug

SEQ ID NO: 851792 - RNA, 20 nt, Human
gcugagguuucuuccuauau

SEQ ID NO: 851793 - RNA, 22 nt, Human
auuggcaguuagugacgaggcu

SEQ ID NO: 851794 - RNA, 22 nt, Human
ucacaagacugagcuugcuuga

SEQ ID NO: 851795 - RNA, 18 nt, Human
gugcugugggcaguggcc

SEQ ID NO: 851796 - RNA, 22 nt, Human
uggcagcugucuguggggucuc

SEQ ID NO: 851797 - RNA, 22 nt, Human
agaggagguccuuuucugaugu

SEQ ID NO: 851798 - RNA, 22 nt, Human
ccuccugguaauuagcgaaagg

SEQ ID NO: 851799 - RNA, 22 nt, Human
cugcuguguuucacaccucugg

SEQ ID NO: 851800 - RNA, 22 nt, Human
acaccauacucauguugguucc

SEQ ID NO: 851801 - RNA, 22 nt, Human
auaguuugaaggcuguucuacu

SEQ ID NO: 851802 - RNA, 22 nt, Human
cagcuccucacgagucuugaaa

SEQ ID NO: 851803 - RNA, 22 nt, Human
ccagugcuaagguagccucugc

SEQ ID NO: 851804 - RNA, 22 nt, Human
gugcagcugcaggagucagguc

SEQ ID NO: 851805 - RNA, 22 nt, Human
cugagccauccauaccagcuua

SEQ ID NO: 851806 - RNA, 22 nt, Human
cuaggaaagacacagagaguuu

SEQ ID NO: 851807 - RNA, 22 nt, Human
auacaacuuuacaugcaauucc

SEQ ID NO: 851808 - RNA, 22 nt, Human
uucuucaugcuguugcugcuug

SEQ ID NO: 851809 - RNA, 22 nt, Human
ugaaggcccagccacagaaugg

SEQ ID NO: 851810 - RNA, 22 nt, Human
aggcugagaaagugggaagaug

SEQ ID NO: 851811 - RNA, 22 nt, Human
uacaucauaauaauacuuagaa

SEQ ID NO: 851812 - RNA, 22 nt, Human
uuucaaagucaauaucauuacc

SEQ ID NO: 851813 - RNA, 22 nt, Human
aaaaaucuaugacugcuucucc

SEQ ID NO: 851814 - RNA, 22 nt, Human
uuaacauuguccuuagcagauu

SEQ ID NO: 851815 - RNA, 22 nt, Human
ggcuuugccuggaauuuccuug

SEQ ID NO: 851816 - RNA, 22 nt, Human
uccaccagccaggcccaggcug

SEQ ID NO: 851817 - RNA, 22 nt, Human
caggacagcucaacaccuccuc

SEQ ID NO: 851818 - RNA, 22 nt, Human
aguuugaaaguauugacagaag

SEQ ID NO: 851819 - RNA, 20 nt, Human
ucuccuggugacaguaccca

SEQ ID NO: 851820 - RNA, 22 nt, Human
uagagcugggcagugcucugag

SEQ ID NO: 851821 - RNA, 22 nt, Human
uaauuauucuagucacauagca

SEQ ID NO: 851822 - RNA, 22 nt, Human
ucagauggguuuugaaggaugu

SEQ ID NO: 851823 - RNA, 22 nt, Human
uugacacagaucaauauucaac

SEQ ID NO: 851824 - RNA, 18 nt, Human
ugcuggguaacuguaugg

SEQ ID NO: 851825 - RNA, 21 nt, Human
aguguaggucauuagcuguug

SEQ ID NO: 851826 - RNA, 21 nt, Human
uaaaacuguaacuuuguccug

SEQ ID NO: 851827 - RNA, 22 nt, Human
gaugccucuuuuggcugaauua

SEQ ID NO: 851828 - RNA, 22 nt, Human
aaauauagugacacuuauaguc

SEQ ID NO: 851829 - RNA, 22 nt, Human
aggcuccaaauuaccaagcucu

SEQ ID NO: 851830 - RNA, 22 nt, Human
gcugcugucagugguggcaguu

SEQ ID NO: 851831 - RNA, 22 nt, Human
guacacuugucuugaacagccu

SEQ ID NO: 851832 - RNA, 22 nt, Human
cagaaauguacugacaugcagu

SEQ ID NO: 851833 - RNA, 22 nt, Human
caggaugagaggcccagggaag

SEQ ID NO: 851834 - RNA, 22 nt, Human
cagcuuccauaagagauggaga

SEQ ID NO: 851835 - RNA, 22 nt, Human
agaccgagaaguucuccaggcc

SEQ ID NO: 851836 - RNA, 22 nt, Human
uuucuucucgacaccuuauccc

SEQ ID NO: 851837 - RNA, 22 nt, Human
aucaggauggguuuggcuuagg

SEQ ID NO: 851838 - RNA, 22 nt, Human
ggcugcugggaauaugccagcu

SEQ ID NO: 851839 - RNA, 22 nt, Human
ccugguugagggagguguggac

SEQ ID NO: 851840 - RNA, 22 nt, Human
cuuuuuaucucuuaaugauguu

SEQ ID NO: 851841 - RNA, 22 nt, Human
ucccagaguauuagcaauugcu

SEQ ID NO: 851842 - RNA, 22 nt, Human
uagggcugccauuugcuuuucu

SEQ ID NO: 851843 - RNA, 22 nt, Human
aagugagugguaaggagcaugg

SEQ ID NO: 851844 - RNA, 22 nt, Human
gaacuguucccucacaggcugg

SEQ ID NO: 851845 - RNA, 22 nt, Human
gcuggugcauuagcugcaguuc

SEQ ID NO: 851846 - RNA, 22 nt, Human
uggcagcugccauguccacgug

SEQ ID NO: 851847 - RNA, 22 nt, Human
uaacuguacaacugguuaguca

SEQ ID NO: 851848 - RNA, 22 nt, Human
ccagggccugccacuuagcaag

SEQ ID NO: 851849 - RNA, 22 nt, Human
cuuaagauuugagauaccuaau

SEQ ID NO: 851850 - RNA, 22 nt, Human
uuuccuaggagauugaucacau

SEQ ID NO: 851851 - RNA, 22 nt, Human
aaaggccaugguuggaguguuu

SEQ ID NO: 851852 - RNA, 22 nt, Human
ggcugaugagcuuagcuagaga

SEQ ID NO: 851853 - RNA, 22 nt, Human
aagggcugcauuugauguguca

SEQ ID NO: 851854 - RNA, 22 nt, Human
ugguccacagggaguccgugcu

SEQ ID NO: 851855 - RNA, 22 nt, Human
gucaggauuauuuuauuaaaag

SEQ ID NO: 851856 - RNA, 22 nt, Human
gcugagguaggagguugcagug

SEQ ID NO: 851857 - RNA, 22 nt, Human
ugcuggguagaaguauuagucu

SEQ ID NO: 851858 - RNA, 22 nt, Human
uucuaaauuuuggaagaugcag

SEQ ID NO: 851859 - RNA, 22 nt, Human
ucaggaugagcucauaacuaug

SEQ ID NO: 851860 - RNA, 22 nt, Human
gugcaagguacauccuugaugu

SEQ ID NO: 851861 - RNA, 22 nt, Human
ucaggcugguggucagauggcu

SEQ ID NO: 851862 - RNA, 22 nt, Human
gcuccuggcuccaggcagccaa

SEQ ID NO: 851863 - RNA, 22 nt, Human
ggacuucuaagugccagacacu

SEQ ID NO: 851864 - RNA, 22 nt, Human
gaggccaaguuggagaccaggu

SEQ ID NO: 851865 - RNA, 22 nt, Human
gagagguccauuccccugucag

SEQ ID NO: 851866 - RNA, 22 nt, Human
cauuuccacuucugaaaacugg

SEQ ID NO: 851867 - RNA, 22 nt, Human
ucaggcugcuguacugugaaug

SEQ ID NO: 851868 - RNA, 23 nt, Human
aggcugagcucucccagcuucag

SEQ ID NO: 851869 - RNA, 22 nt, Human
caaggccaagucucugugaaga

SEQ ID NO: 851870 - RNA, 22 nt, Human
gagguccacugaggcaacaggg

SEQ ID NO: 851871 - RNA, 22 nt, Human
uuuuauugucaaugaagacaga

SEQ ID NO: 851872 - RNA, 22 nt, Human
gcugaggauauagcaggaacaa

SEQ ID NO: 851873 - RNA, 22 nt, Human
agucuuaggcuccauuaguaga

SEQ ID NO: 851874 - RNA, 22 nt, Human
uuucaugagauuccuccacauc

SEQ ID NO: 851875 - RNA, 22 nt, Human
cauggagauaaacugaaauauu

SEQ ID NO: 851876 - RNA, 22 nt, Human
uuagagaaaggguuugauuccg

SEQ ID NO: 851877 - RNA, 22 nt, Human
aagauggagcacgagcagaagc

SEQ ID NO: 851878 - RNA, 22 nt, Human
ccuggcugcauuuugcuggaug

SEQ ID NO: 851879 - RNA, 22 nt, Human
uggcagcauuaauuauucaggu

SEQ ID NO: 851880 - RNA, 20 nt, Human
aucaggauucuugcuuuguu

SEQ ID NO: 851881 - RNA, 22 nt, Human
uacuuucuuguuccuuucauaa

SEQ ID NO: 851882 - RNA, 22 nt, Human
cccugcuuugcacccaggcugg

SEQ ID NO: 851883 - RNA, 22 nt, Human
ucugagguaccagcugguuuau

SEQ ID NO: 851884 - RNA, 22 nt, Human
auacaguaauuuguaacucauc

SEQ ID NO: 851885 - RNA, 22 nt, Human
uccauuuucaucucauguauaa

SEQ ID NO: 851886 - RNA, 20 nt, Human
aaacauucauguacaaguga

SEQ ID NO: 851887 - RNA, 22 nt, Human
gcugcuguguuggagagggacu

SEQ ID NO: 851888 - RNA, 22 nt, Human
cugaaugaggaaaagagugagg

SEQ ID NO: 851889 - RNA, 22 nt, Human
aggcagcuuuguaguaaagcua

SEQ ID NO: 851890 - RNA, 22 nt, Human
acagugugguuugagcacuggg

SEQ ID NO: 851891 - RNA, 22 nt, Human
uuucaaauagaaucuuuccaaa

SEQ ID NO: 851892 - RNA, 22 nt, Human
cugaggucaccccacuggcugu

SEQ ID NO: 851893 - RNA, 22 nt, Human
agagccugugggagaugcagcu

SEQ ID NO: 851894 - RNA, 22 nt, Human
uaucuagauaccaagaagcaca

SEQ ID NO: 851895 - RNA, 22 nt, Human
acccaggacaaaauaaccaggu

SEQ ID NO: 851896 - RNA, 16 nt, Human
uagggcugggaaggag

SEQ ID NO: 851897 - RNA, 22 nt, Human
aagggcugcaauccaaaacacu

SEQ ID NO: 851898 - RNA, 21 nt, Human
acaggagaccgccuggcaguc

SEQ ID NO: 851899 - RNA, 22 nt, Human
uccucagacuucccuuugugua

SEQ ID NO: 851900 - RNA, 20 nt, Human
cacaggaaagcuacucaguu

SEQ ID NO: 851901 - RNA, 22 nt, Human
cuagaaaaauacuuuauuguga

SEQ ID NO: 851902 - RNA, 22 nt, Human
uuagccaugcccuagaagagga

SEQ ID NO: 851903 - RNA, 22 nt, Human
uggcagcuauuacaaggaaguc

SEQ ID NO: 851904 - RNA, 21 nt, Human
acagucuccccagaucucucc

SEQ ID NO: 851905 - RNA, 22 nt, Human
uugaggucuguguaggcagcaa

SEQ ID NO: 851906 - RNA, 22 nt, Human
agggaagcuuguuacugagaag

SEQ ID NO: 851907 - RNA, 22 nt, Human
cauuuccugucuggaggucaaa

SEQ ID NO: 851908 - RNA, 22 nt, Human
gaggagcuggcugucgggaggc

SEQ ID NO: 851909 - RNA, 23 nt, Human
auguuauuauuagcagucuugcc

SEQ ID NO: 851910 - RNA, 22 nt, Human
aacuuucuuucacagaaguauc

SEQ ID NO: 851911 - RNA, 22 nt, Human
acuccaggguuuugcaccugga

SEQ ID NO: 851912 - RNA, 22 nt, Human
caaugugguggcagaugucagu

SEQ ID NO: 851913 - RNA, 22 nt, Human
gcugagcagguguaaggaaggc

SEQ ID NO: 851914 - RNA, 22 nt, Human
acugagcucuugacugggaguu

SEQ ID NO: 851915 - RNA, 22 nt, Human
auuuggaaaaucugguuauaga

SEQ ID NO: 851916 - RNA, 22 nt, Human
uuauuugcccauguuuagcaga

SEQ ID NO: 851917 - RNA, 22 nt, Human
uagcaagaggaaacaaggggcc

SEQ ID NO: 851918 - RNA, 19 nt, Human
agauggcaaaaugcaaaga

SEQ ID NO: 851919 - RNA, 22 nt, Human
uguccaggcuaaagugcagugg

SEQ ID NO: 851920 - RNA, 22 nt, Human
uuccaagagcuuuaauuguuga

SEQ ID NO: 851921 - RNA, 22 nt, Human
cugcugccaagggugccacagg

SEQ ID NO: 851922 - RNA, 22 nt, Human
acagagcuguacaugugccaug

SEQ ID NO: 851923 - RNA, 22 nt, Human
agcuggcaguaugacuggugac

SEQ ID NO: 851924 - RNA, 22 nt, Human
uacuuucuuucccaagaggugg

SEQ ID NO: 851925 - RNA, 23 nt, Human
ugaguucucaucuuggcuucuau

SEQ ID NO: 851926 - RNA, 20 nt, Human
agugccagggcaggugagag

SEQ ID NO: 851927 - RNA, 22 nt, Human
uuggcagugucugcaaaaugga

SEQ ID NO: 851928 - RNA, 22 nt, Human
acuggcaguagagggagcgcau

SEQ ID NO: 851929 - RNA, 22 nt, Human
ggagccuggucagguuggcucc

SEQ ID NO: 851930 - RNA, 22 nt, Human
gcuuccuaaaugcacagggcag

SEQ ID NO: 851931 - RNA, 22 nt, Human
gaauauuuuuaaagggacuaau

SEQ ID NO: 851932 - RNA, 20 nt, Human
acuaacauuugcaaggggcu

SEQ ID NO: 851933 - RNA, 22 nt, Human
uacuuccuguuuccaugucugu

SEQ ID NO: 851934 - RNA, 22 nt, Human
cuaaucaucuuucucuuaaagc

SEQ ID NO: 851935 - RNA, 22 nt, Human
gcaccaggcagcugagcaggcc

SEQ ID NO: 851936 - RNA, 22 nt, Human
cuguggaaauaaacaaugcuaa

SEQ ID NO: 851937 - RNA, 22 nt, Human
aggcugcuucaauggauaagau

SEQ ID NO: 851938 - RNA, 22 nt, Human
gcuggagaugcuaugcagaggg

SEQ ID NO: 851939 - RNA, 22 nt, Human
ugaggcaggacauggacaacug

SEQ ID NO: 851940 - RNA, 22 nt, Human
cuugaaagucacaugcagcccu

SEQ ID NO: 851941 - RNA, 22 nt, Human
cccuugcaucccauguguggcc

SEQ ID NO: 851942 - RNA, 22 nt, Human
ccugggcaauauagugaggccc

SEQ ID NO: 851943 - RNA, 22 nt, Human
aagauuauuuaagacaggaacc

SEQ ID NO: 851944 - RNA, 22 nt, Human
ggacagcucugccaggagcuca

SEQ ID NO: 851945 - RNA, 22 nt, Human
auuaggcagggcaugguggcuc

SEQ ID NO: 851946 - RNA, 22 nt, Human
uucaggauaugugauaucugaa

SEQ ID NO: 851947 - RNA, 20 nt, Human
ugcugcugcuucacccccau

SEQ ID NO: 851948 - RNA, 19 nt, Human
agggaguuuauauuugcac

SEQ ID NO: 851949 - RNA, 22 nt, Human
uaaacagcuacugugucaaagg

SEQ ID NO: 851950 - RNA, 22 nt, Human
ucauucuugaucacuaguuagu

SEQ ID NO: 851951 - RNA, 22 nt, Human
aggaggggcaaugauagucugg

SEQ ID NO: 851952 - RNA, 22 nt, Human
cccuugcacauuugucuuuaau

SEQ ID NO: 851953 - RNA, 22 nt, Human
ucuuugcaaauguuauuaucuu

SEQ ID NO: 851954 - RNA, 22 nt, Human
cuaggcaguccugacgguacua

SEQ ID NO: 851955 - RNA, 22 nt, Human
uggcuggauuauuggcuaguac

SEQ ID NO: 851956 - RNA, 22 nt, Human
auggacauuugaguuauuucca

SEQ ID NO: 851957 - RNA, 19 nt, Human
gccugccuggguuucugag

SEQ ID NO: 851958 - RNA, 22 nt, Human
auuuggcaacauuaauugaauc

SEQ ID NO: 851959 - RNA, 22 nt, Human
acaggagaauuaucuggaacaa

SEQ ID NO: 851960 - RNA, 22 nt, Human
aaauuauuaugccccucuauaa

SEQ ID NO: 851961 - RNA, 22 nt, Human
cuggcucauccagguguugcuc

SEQ ID NO: 851962 - RNA, 22 nt, Human
auacagauguugaauguuauau

SEQ ID NO: 851963 - RNA, 22 nt, Human
cuguuuauuacacuggauagca

SEQ ID NO: 851964 - RNA, 18 nt, Human
gcugagguggugucagag

SEQ ID NO: 851965 - RNA, 23 nt, Human
uggagcugacagucagagggagg

SEQ ID NO: 851966 - RNA, 22 nt, Human
caaggaaaacagaugaucaaca

SEQ ID NO: 851967 - RNA, 22 nt, Human
gcugucccgcugacuuccagcu

SEQ ID NO: 851968 - RNA, 22 nt, Human
acagcuaacuuaaacuaaccua

SEQ ID NO: 851969 - RNA, 22 nt, Human
cccaggagaccugugaaaggac

SEQ ID NO: 851970 - RNA, 22 nt, Human
ugagguccugcauguugagguc

SEQ ID NO: 851971 - RNA, 22 nt, Human
cagcuacuccucccaugacuuc

SEQ ID NO: 851972 - RNA, 22 nt, Human
cugccuggcuaaacucaagucg

SEQ ID NO: 851973 - RNA, 19 nt, Human
ugaguucugugguucucaa

SEQ ID NO: 851974 - RNA, 21 nt, Human
gccucuccaaauccugccuuc

SEQ ID NO: 851975 - RNA, 22 nt, Human
uugaacuguaagcaugucugcc

SEQ ID NO: 851976 - RNA, 22 nt, Human
uccacaugaccauugugcuccu

SEQ ID NO: 851977 - RNA, 22 nt, Human
uuuauuugaaucaggggagaau

SEQ ID NO: 851978 - RNA, 22 nt, Human
aggcagcuagagagugaaacug

SEQ ID NO: 851979 - RNA, 22 nt, Human
uggaggaaaaaaccaggcagag

SEQ ID NO: 851980 - RNA, 23 nt, Human
cuccccaguguccucaugcaucu

SEQ ID NO: 851981 - RNA, 22 nt, Human
agggggugcccagaugaaggau

SEQ ID NO: 851982 - RNA, 22 nt, Human
ucaggagauggucuuuauaggc

SEQ ID NO: 851983 - RNA, 22 nt, Human
uuccucagcuggccugauuggg

SEQ ID NO: 851984 - RNA, 22 nt, Human
ucccaggaaggauucggcauuu

SEQ ID NO: 851985 - RNA, 15 nt, Human
cuccaugauuuugca

SEQ ID NO: 851986 - RNA, 20 nt, Human
ugagacccgcugacaaguuc

SEQ ID NO: 851987 - RNA, 22 nt, Human
uugcauuucccauugaguaaug

SEQ ID NO: 851988 - RNA, 22 nt, Human
uuaggaaacaguagccuuugcu

SEQ ID NO: 851989 - RNA, 22 nt, Human
auucuucacaaauauauagaag

SEQ ID NO: 851990 - RNA, 22 nt, Human
uuuuaguuguaguuggugagga

SEQ ID NO: 851991 - RNA, 22 nt, Human
gugagguccaguaacuugucca

SEQ ID NO: 851992 - RNA, 22 nt, Human
acagcagcuugcgugucugguc

SEQ ID NO: 851993 - RNA, 22 nt, Human
gcaguucuacuuauccauagac

SEQ ID NO: 851994 - RNA, 22 nt, Human
gcaaagcauucuguggagucua

SEQ ID NO: 851995 - RNA, 22 nt, Human
auguaacugaaggaaaugcaug

SEQ ID NO: 851996 - RNA, 22 nt, Human
cacucuccagcacaccccauuu

SEQ ID NO: 851997 - RNA, 22 nt, Human
uacuaaauaguuuaauuccuca

SEQ ID NO: 851998 - RNA, 18 nt, Human
ucugagguggacgaggag

SEQ ID NO: 851999 - RNA, 21 nt, Human
ggcugcuggggguuggcacag

SEQ ID NO: 852000 - RNA, 23 nt, Human
ucuccuggcugcacuguggccac

SEQ ID NO: 852001 - RNA, 22 nt, Human
gggugggacugaagucugaggg

SEQ ID NO: 852002 - RNA, 22 nt, Human
cucaggaaaggccaugcaaggg

SEQ ID NO: 852003 - RNA, 22 nt, Human
ggcugagaguuuccucuggggc

SEQ ID NO: 852004 - RNA, 22 nt, Human
aucaggaucacagaaacuuuua

SEQ ID NO: 852005 - RNA, 23 nt, Human
uuuuccagaaucgacucuguaga

SEQ ID NO: 852006 - RNA, 22 nt, Human
aagaaguuaaauaaauggacca

SEQ ID NO: 852007 - RNA, 22 nt, Human
gaggagcuugaggcuaggagcc

SEQ ID NO: 852008 - RNA, 20 nt, Human
gcccaagguccagaaggggg

SEQ ID NO: 852009 - RNA, 22 nt, Human
gcugaggaaaggcuggaaggga

SEQ ID NO: 852010 - RNA, 22 nt, Human
cggcagcucgagggccacccgu

SEQ ID NO: 852011 - RNA, 22 nt, Human
ucucccaggcugcccuguggac

SEQ ID NO: 852012 - RNA, 22 nt, Human
cccuggaggcaaagguugcagu

SEQ ID NO: 852013 - RNA, 22 nt, Human
agcaccauugcaaauauggcag

SEQ ID NO: 852014 - RNA, 22 nt, Human
uaacuggugaguugguugagug

SEQ ID NO: 852015 - RNA, 22 nt, Human
uuccuggcgccacggagccggu

SEQ ID NO: 852016 - RNA, 22 nt, Human
cugaggcuuguccucucagcuu

SEQ ID NO: 852017 - RNA, 22 nt, Human
auuaaggaauguaggcaagaag

SEQ ID NO: 852018 - RNA, 22 nt, Human
uuuccagguauuaauacuguau

SEQ ID NO: 852019 - RNA, 22 nt, Human
uaggcagcgcuuggcugugcuu

SEQ ID NO: 852020 - RNA, 22 nt, Human
uuauuaggaacucaggauuuuu

SEQ ID NO: 852021 - RNA, 22 nt, Human
uaguuuuacuugcgaugauaau

SEQ ID NO: 852022 - RNA, 22 nt, Human
auugaaagauauacuguucuca

SEQ ID NO: 852023 - RNA, 22 nt, Human
gacuccugggccucugagaggc

SEQ ID NO: 852024 - RNA, 22 nt, Human
ggacccugggcucugggccuau

SEQ ID NO: 852025 - RNA, 22 nt, Human
augaggccagggugccaugaaa

SEQ ID NO: 852026 - RNA, 22 nt, Human
uauuuguauguguguacauaua

SEQ ID NO: 852027 - RNA, 22 nt, Human
cuguuuaucccuuuggucagca

SEQ ID NO: 852028 - RNA, 22 nt, Human
cccaggagguggagguugcagu

SEQ ID NO: 852029 - RNA, 22 nt, Human
cuggggucagggaucagagagc

SEQ ID NO: 852030 - RNA, 22 nt, Human
gaggaggcuuccgggaggcacg

SEQ ID NO: 852031 - RNA, 22 nt, Human
auucaaguggcugcuauguuaa

SEQ ID NO: 852032 - RNA, 22 nt, Human
gagcagcugagcuggaaugaga

SEQ ID NO: 852033 - RNA, 22 nt, Human
aggaugagaagauuggaaucuu

SEQ ID NO: 852034 - RNA, 22 nt, Human
cugaggcuaaccucgagagaca

SEQ ID NO: 852035 - RNA, 23 nt, Human
ccacagagcugccaauuccugug

SEQ ID NO: 852036 - RNA, 22 nt, Human
gagguggucgaggagggguacc

SEQ ID NO: 852037 - RNA, 22 nt, Human
uccaggaggacugagggggcug

SEQ ID NO: 852038 - RNA, 22 nt, Human
acuuuugguucuguaacuguga

SEQ ID NO: 852039 - RNA, 22 nt, Human
gcccaggagguggaggugcagu

SEQ ID NO: 852040 - RNA, 22 nt, Human
auuaggacagagaugucaagag

SEQ ID NO: 852041 - RNA, 22 nt, Human
ccaggagagcucucguucagug

SEQ ID NO: 852042 - RNA, 23 nt, Human
agaugagccaacaccuccaugcc

SEQ ID NO: 852043 - RNA, 22 nt, Human
uagugucaugaaaaguacacua

SEQ ID NO: 852044 - RNA, 22 nt, Human
cagucccuaguggagcucacag

SEQ ID NO: 852045 - RNA, 18 nt, Human
cugaggcuuagagagguu

SEQ ID NO: 852046 - RNA, 22 nt, Human
gcagaggccaggccaccagcaa

SEQ ID NO: 852047 - RNA, 22 nt, Human
auuguuaugaaaauaagauguu

SEQ ID NO: 852048 - RNA, 22 nt, Human
guuugcauuuauuagucuucug

SEQ ID NO: 852049 - RNA, 22 nt, Human
gaucuucucuuuaguagaaaca

SEQ ID NO: 852050 - RNA, 20 nt, Human
ugacuucuucaugcuguacu

SEQ ID NO: 852051 - RNA, 22 nt, Human
uggcugagcucccuguguguug

SEQ ID NO: 852052 - RNA, 22 nt, Human
augauguuauuuucagaaacau

SEQ ID NO: 852053 - RNA, 22 nt, Human
cagcuccugaggacugcuggga

SEQ ID NO: 852054 - RNA, 22 nt, Human
ugcuugugagaguuuuuucaga

SEQ ID NO: 852055 - RNA, 22 nt, Human
agcuaagaacuugagcucugga

SEQ ID NO: 852056 - RNA, 23 nt, Human
ggagaggggugugggcaucuuua

SEQ ID NO: 852057 - RNA, 22 nt, Human
cagcuuuuuagaaucuagggca

SEQ ID NO: 852058 - RNA, 22 nt, Human
acccaggaggugacacagggcu

SEQ ID NO: 852059 - RNA, 22 nt, Human
caaggccauauugccuguaugu

SEQ ID NO: 852060 - RNA, 22 nt, Human
aucaggaugacaacugcugggu

SEQ ID NO: 852061 - RNA, 22 nt, Human
ccaggcuggaaucaauauucug

SEQ ID NO: 852062 - RNA, 22 nt, Human
cuggcacacaaguauuuccuuu

SEQ ID NO: 852063 - RNA, 23 nt, Human
uugaggucggcucucugagccug

SEQ ID NO: 852064 - RNA, 22 nt, Human
cccuggccccucacuccgaggc

SEQ ID NO: 852065 - RNA, 21 nt, Human
gcucagaguauugcacuguuu

SEQ ID NO: 852066 - RNA, 21 nt, Human
ggcugagauggcagaaucacc

SEQ ID NO: 852067 - RNA, 22 nt, Human
uuuaggaucucucuuguuacau

SEQ ID NO: 852068 - RNA, 22 nt, Human
caggcaggucagugaagaagga

SEQ ID NO: 852069 - RNA, 22 nt, Human
aaauuagucgguuuaggaauuu

SEQ ID NO: 852070 - RNA, 22 nt, Human
acagugagcccacuccaggaga

SEQ ID NO: 852071 - RNA, 22 nt, Human
aggcaggcucaaugcccagucu

SEQ ID NO: 852072 - RNA, 22 nt, Human
uaaggaaaauggacaucaaaca

SEQ ID NO: 852073 - RNA, 22 nt, Human
ucuccugguauguaugcaccug

SEQ ID NO: 852074 - RNA, 22 nt, Human
ggcagucacuuuugcuugugcc

SEQ ID NO: 852075 - RNA, 22 nt, Human
uauuuguugaguuguuaugucu

SEQ ID NO: 852076 - RNA, 22 nt, Human
gaacuguaguuaauacuacaca

SEQ ID NO: 852077 - RNA, 22 nt, Human
gcuccuggagagauugagaaag

SEQ ID NO: 852078 - RNA, 22 nt, Human
cagggcuggcuuccaaguuguu

SEQ ID NO: 852079 - RNA, 18 nt, Human
acugugugaauuagcucc

SEQ ID NO: 852080 - RNA, 22 nt, Human
caggcugauaggguccaaaguu

SEQ ID NO: 852081 - RNA, 22 nt, Human
cuuaaagaaauugaggagagga

SEQ ID NO: 852082 - RNA, 22 nt, Human
uuggcagcauccaagucucggg

SEQ ID NO: 852083 - RNA, 22 nt, Human
aaggccagccugagagcuaaca

SEQ ID NO: 852084 - RNA, 22 nt, Human
ccccaggagaaaucuuaaacua

SEQ ID NO: 852085 - RNA, 22 nt, Human
uggccaaaguagaaaauaauag

SEQ ID NO: 852086 - RNA, 18 nt, Human
ugaggcagucagugaugg

SEQ ID NO: 852087 - RNA, 22 nt, Human
agaggcggagguugcagugagc

SEQ ID NO: 852088 - RNA, 22 nt, Human
ucacuguugaccuggaaguggg

SEQ ID NO: 852089 - RNA, 22 nt, Human
guuuuaguggguggccacugau

SEQ ID NO: 852090 - RNA, 22 nt, Human
ugcuuuggaucuauuugcugag

SEQ ID NO: 852091 - RNA, 22 nt, Human
agguaaauucagcagugacauu

SEQ ID NO: 852092 - RNA, 22 nt, Human
ccacagugggcacagcaggacu

SEQ ID NO: 852093 - RNA, 19 nt, Human
ucaucucacagggccuggc

SEQ ID NO: 852094 - RNA, 21 nt, Human
auacacauacacauaaaugug

SEQ ID NO: 852095 - RNA, 22 nt, Human
auuuauuaugggauuuggcuca

SEQ ID NO: 852096 - RNA, 22 nt, Human
uccuggcccacuaugccagcau

SEQ ID NO: 852097 - RNA, 22 nt, Human
aggcagacugugcgggaagagu

SEQ ID NO: 852098 - RNA, 22 nt, Human
gcuggcugaguucugucgucug

SEQ ID NO: 852099 - RNA, 22 nt, Human
cugcugugggcaggguagcugg

SEQ ID NO: 852100 - RNA, 22 nt, Human
cuggccaagcacuggggucaaa

SEQ ID NO: 852101 - RNA, 22 nt, Human
gaggccagaagugccucgggcu

SEQ ID NO: 852102 - RNA, 22 nt, Human
uuuuaugugcuggacuggcagu

SEQ ID NO: 852103 - RNA, 22 nt, Human
gagccuggacaucucaggccca

SEQ ID NO: 852104 - RNA, 22 nt, Human
agcugaggaggaaugaugggua

SEQ ID NO: 852105 - RNA, 22 nt, Human
gcccaggaaagauagggccuca

SEQ ID NO: 852106 - RNA, 22 nt, Human
uggcagcuuccugcucauagga

SEQ ID NO: 852107 - RNA, 22 nt, Human
aggcaggcuggucugaagagug

SEQ ID NO: 852108 - RNA, 21 nt, Human
ucuugaaaauuguagcaguuu

SEQ ID NO: 852109 - RNA, 22 nt, Human
ugaggcuccuuguagagagugg

SEQ ID NO: 852110 - RNA, 22 nt, Human
aggccagcagcaugacggcauc

SEQ ID NO: 852111 - RNA, 22 nt, Human
cacaaaugguuguagacauuaa

SEQ ID NO: 852112 - RNA, 22 nt, Human
uaaugcuuaacagcuggcuuuu

SEQ ID NO: 852113 - RNA, 22 nt, Human
gccugccuuuguaugacccuga

SEQ ID NO: 852114 - RNA, 22 nt, Human
uuacuuugcuuucucauuacag

SEQ ID NO: 852115 - RNA, 22 nt, Human
aggcugagggcuccugagggca

SEQ ID NO: 852116 - RNA, 22 nt, Human
uuaaauuuuagaaacagacucu

SEQ ID NO: 852117 - RNA, 22 nt, Human
uggucuaaauauggcucuaaau

SEQ ID NO: 852118 - RNA, 22 nt, Human
uagcacugaaucacaugcugcu

SEQ ID NO: 852119 - RNA, 22 nt, Human
cuucugagcagaccuccugggg

SEQ ID NO: 852120 - RNA, 22 nt, Human
aggcugcugccuuggagagugu

SEQ ID NO: 852121 - RNA, 22 nt, Human
guuauuaguaagacucgcacau

SEQ ID NO: 852122 - RNA, 22 nt, Human
caggcagcugaggacuuugcua

SEQ ID NO: 852123 - RNA, 22 nt, Human
aaauuauuacaagcuaguuggc

SEQ ID NO: 852124 - RNA, 22 nt, Human
gcuccugggcucuaccuugcua

SEQ ID NO: 852125 - RNA, 22 nt, Human
ugccugggagugaccaagacuc

SEQ ID NO: 852126 - RNA, 21 nt, Human
ugaaugaggaggauggcauuu

SEQ ID NO: 852127 - RNA, 22 nt, Human
agagcagaggcauggccguggg

SEQ ID NO: 852128 - RNA, 22 nt, Human
uuagcaucugcuguaagcuuau

SEQ ID NO: 852129 - RNA, 22 nt, Human
aggaagcuuagugaaaggacca

SEQ ID NO: 852130 - RNA, 22 nt, Human
acugaaguccacacauguagga

SEQ ID NO: 852131 - RNA, 22 nt, Human
ccugagcugcggggcagugcuc

SEQ ID NO: 852132 - RNA, 22 nt, Human
cccaugagauucugaauuuggc

SEQ ID NO: 852133 - RNA, 22 nt, Human
uaacacauauuucaagaguagu

SEQ ID NO: 852134 - RNA, 22 nt, Human
cugcuucacccaacuuugggau

SEQ ID NO: 852135 - RNA, 22 nt, Human
caaggccaguucaccaagggca

SEQ ID NO: 852136 - RNA, 22 nt, Human
acaacauucuuaaauacacuga

SEQ ID NO: 852137 - RNA, 23 nt, Human
auuugagaaaguauuuuuaagac

SEQ ID NO: 852138 - RNA, 22 nt, Human
uaggaggguuagagggaaauau

SEQ ID NO: 852139 - RNA, 22 nt, Human
caauacacuaaacuucucugaa

SEQ ID NO: 852140 - RNA, 22 nt, Human
aagacugugucuauggcuacuc

SEQ ID NO: 852141 - RNA, 22 nt, Human
cccuggagugugacgaggcauu

SEQ ID NO: 852142 - RNA, 22 nt, Human
gaggucagucagaccaggguuu

SEQ ID NO: 852143 - RNA, 22 nt, Human
ucugaggucauuccaaggacau

SEQ ID NO: 852144 - RNA, 22 nt, Human
aaaacuaaauacgcuuugccuc

SEQ ID NO: 852145 - RNA, 22 nt, Human
accuuguuaaaaugaggauucu

SEQ ID NO: 852146 - RNA, 22 nt, Human
agcugcccagauaggaggaggc

SEQ ID NO: 852147 - RNA, 22 nt, Human
uuucaguuuuugcucgauguau

SEQ ID NO: 852148 - RNA, 23 nt, Human
cuggcucauccugguugcagugg

SEQ ID NO: 852149 - RNA, 22 nt, Human
cuccuggcacugucuugaccca

SEQ ID NO: 852150 - RNA, 22 nt, Human
acuuuacuacauccacagaugg

SEQ ID NO: 852151 - RNA, 22 nt, Human
gaucauuuacuuguucuggacu

SEQ ID NO: 852152 - RNA, 22 nt, Human
uuuauguaguuacggacuauca

SEQ ID NO: 852153 - RNA, 22 nt, Human
uaaauacugaguuggaguuggc

SEQ ID NO: 852154 - RNA, 22 nt, Human
ggaggaggggcgcuuugucuau

SEQ ID NO: 852155 - RNA, 22 nt, Human
agaaaauauucauugagaggcu

SEQ ID NO: 852156 - RNA, 18 nt, Human
gcuccuggagucugacuc

SEQ ID NO: 852157 - RNA, 22 nt, Human
uaguccagccuuggguguagcc

SEQ ID NO: 852158 - RNA, 22 nt, Human
cacauuuaauccuuuauaagua

SEQ ID NO: 852159 - RNA, 22 nt, Human
cccagggauguggcagauguua

SEQ ID NO: 852160 - RNA, 22 nt, Human
auugcuguacacuucuagaucu

SEQ ID NO: 852161 - RNA, 22 nt, Human
gaaauauuucucuugagccccu

SEQ ID NO: 852162 - RNA, 22 nt, Human
uaggagggcccugaaaauggca

SEQ ID NO: 852163 - RNA, 22 nt, Human
gggcagcugccacuccgcuugc

SEQ ID NO: 852164 - RNA, 20 nt, Human
aggaagcugagauguagagg

SEQ ID NO: 852165 - RNA, 22 nt, Human
ccacagugguuguggcaugugg

SEQ ID NO: 852166 - RNA, 22 nt, Human
ccauccuaucugaccuacuugu

SEQ ID NO: 852167 - RNA, 22 nt, Human
gcugagcugggacaguccuggg

SEQ ID NO: 852168 - RNA, 22 nt, Human
cucuucuugcuagacugagugc

SEQ ID NO: 852169 - RNA, 21 nt, Human
uccuuccuugagguccuuucc

SEQ ID NO: 852170 - RNA, 22 nt, Human
ccaugagcuuccuauauagggu

SEQ ID NO: 852171 - RNA, 22 nt, Human
ugcccuggcacacacacagcug

SEQ ID NO: 852172 - RNA, 22 nt, Human
caggauggagggagggcuguua

SEQ ID NO: 852173 - RNA, 22 nt, Human
uaugaacuuuugaugugacaug

SEQ ID NO: 852174 - RNA, 22 nt, Human
uuggccaaauaaucuugcagau

SEQ ID NO: 852175 - RNA, 22 nt, Human
ugcuguguggaugugaagaauc

SEQ ID NO: 852176 - RNA, 22 nt, Human
aaauguuuugcucccauguggu

SEQ ID NO: 852177 - RNA, 22 nt, Human
acccaggaggcaagguugcagu

SEQ ID NO: 852178 - RNA, 21 nt, Human
agacaguaacucuucuacucc

SEQ ID NO: 852179 - RNA, 22 nt, Human
agugcuggcccauagcugcugg

SEQ ID NO: 852180 - RNA, 22 nt, Human
cauaaagucucauaauucacuu

SEQ ID NO: 852181 - RNA, 22 nt, Human
gagggaauggugugcaagaggu

SEQ ID NO: 852182 - RNA, 22 nt, Human
uuuccaaauaaggucacacuca

SEQ ID NO: 852183 - RNA, 22 nt, Human
cagcugagaagugauagcugca

SEQ ID NO: 852184 - RNA, 22 nt, Human
ucauuuguugcuguuaccugag

SEQ ID NO: 852185 - RNA, 22 nt, Human
acauuuaaccuuugaggaacug

SEQ ID NO: 852186 - RNA, 23 nt, Human
aucauucuccaaucuggagcagg

SEQ ID NO: 852187 - RNA, 22 nt, Human
ggucugagagccacugaauccc

SEQ ID NO: 852188 - RNA, 22 nt, Human
aagggcugggucugguuaaccc

SEQ ID NO: 852189 - RNA, 22 nt, Human
ugccugucuuggaguccuggcc

SEQ ID NO: 852190 - RNA, 22 nt, Human
aguuaucaucccuuacacuuug

SEQ ID NO: 852191 - RNA, 22 nt, Human
ucacaguuauagucuguagaau

SEQ ID NO: 852192 - RNA, 22 nt, Human
acaguacauaauccugagucug

SEQ ID NO: 852193 - RNA, 22 nt, Human
uccugccuguuuaccuguacuu

SEQ ID NO: 852194 - RNA, 22 nt, Human
ugcccuggggucuggagcagca

SEQ ID NO: 852195 - RNA, 22 nt, Human
aggcugaguuucucauucucgc

SEQ ID NO: 852196 - RNA, 22 nt, Human
caagaugaaauugugauauuuu

SEQ ID NO: 852197 - RNA, 23 nt, Human
acacauuuuucccguucugaggu

SEQ ID NO: 852198 - RNA, 22 nt, Human
agaccaagugcaggugccacua

SEQ ID NO: 852199 - RNA, 22 nt, Human
cuucuucagcacaauauugaug

SEQ ID NO: 852200 - RNA, 22 nt, Human
uugcuuuguggugguucuucca

SEQ ID NO: 852201 - RNA, 22 nt, Human
aauauaauuuuauuccuagagu

SEQ ID NO: 852202 - RNA, 22 nt, Human
aggcugaaaacgagauggcaau

SEQ ID NO: 852203 - RNA, 23 nt, Human
auguauuuaaauuucagugauga

SEQ ID NO: 852204 - RNA, 22 nt, Human
ccaggacaaguguggccauggc

SEQ ID NO: 852205 - RNA, 22 nt, Human
uaacaaacuggaaauugacauu

SEQ ID NO: 852206 - RNA, 22 nt, Human
uagcagaggcugucugacuuaa

SEQ ID NO: 852207 - RNA, 22 nt, Human
cagggcugaaaucaagguguag

SEQ ID NO: 852208 - RNA, 22 nt, Human
gagcugagaagcagcgcuugau

SEQ ID NO: 852209 - RNA, 22 nt, Human
ugcauguguuugccacagugag

SEQ ID NO: 852210 - RNA, 18 nt, Human
gucacuguguuucugagc

SEQ ID NO: 852211 - RNA, 22 nt, Human
caacugguggucaaccuucugu

SEQ ID NO: 852212 - RNA, 22 nt, Human
gacacuuuggugcuuugugguu

SEQ ID NO: 852213 - RNA, 22 nt, Human
cuggccuaaaauugcuucugca

SEQ ID NO: 852214 - RNA, 22 nt, Human
ggcagccuugacuagugacuua

SEQ ID NO: 852215 - RNA, 22 nt, Human
uggcagcugugcuucauucuuu

SEQ ID NO: 852216 - RNA, 22 nt, Human
gagcagcucugggugacccagu

SEQ ID NO: 852217 - RNA, 22 nt, Human
aaggcugagacagcacaggucc

SEQ ID NO: 852218 - RNA, 22 nt, Human
cccacagggcugcugauggcag

SEQ ID NO: 852219 - RNA, 22 nt, Human
uuagguaaguaggaucaaaaaa

SEQ ID NO: 852220 - RNA, 18 nt, Human
aagaggaggaaacccagg

SEQ ID NO: 852221 - RNA, 22 nt, Human
uuuaaaauuuagaccucuccac

SEQ ID NO: 852222 - RNA, 22 nt, Human
acuggccaugaacuugggaucu

SEQ ID NO: 852223 - RNA, 22 nt, Human
uacaaaaaauugauacugacga

SEQ ID NO: 852224 - RNA, 22 nt, Human
uuucaaaguugggaauuguaau

SEQ ID NO: 852225 - RNA, 19 nt, Human
gacagugcaguuguaguac

SEQ ID NO: 852226 - RNA, 22 nt, Human
caaggcugugcaggguccauau

SEQ ID NO: 852227 - RNA, 22 nt, Human
uccugccuagcaggugaccuau

SEQ ID NO: 852228 - RNA, 22 nt, Human
guggccaauuuccaucuguaag

SEQ ID NO: 852229 - RNA, 18 nt, Human
uuaaggauaagcagacua

SEQ ID NO: 852230 - RNA, 22 nt, Human
agcgagggaggucugaggacag

SEQ ID NO: 852231 - RNA, 22 nt, Human
uagaaaugugauaauagcuuaa

SEQ ID NO: 852232 - RNA, 22 nt, Human
agagcagcugugacauggacag

SEQ ID NO: 852233 - RNA, 22 nt, Human
ucaggcugcaucuguaagggug

SEQ ID NO: 852234 - RNA, 22 nt, Human
auagaaaacagauguccuuaaa

SEQ ID NO: 852235 - RNA, 19 nt, Human
agucuggaguaaaaggaau

SEQ ID NO: 852236 - RNA, 22 nt, Human
ucugugcucauucagucauuca

SEQ ID NO: 852237 - RNA, 22 nt, Human
acaggcugcccgcuccccaccu

SEQ ID NO: 852238 - RNA, 19 nt, Human
gaggcgaggcgugcaggag

SEQ ID NO: 852239 - RNA, 22 nt, Human
gaauacauuggaaaucagaaua

SEQ ID NO: 852240 - RNA, 22 nt, Human
cugggccaagaaguuguguaug

SEQ ID NO: 852241 - RNA, 22 nt, Human
uuuuauagcugaauaguauucc

SEQ ID NO: 852242 - RNA, 22 nt, Human
gaggacagagccgccuggcaag

SEQ ID NO: 852243 - RNA, 22 nt, Human
ggaggcagaauagagugugggu

SEQ ID NO: 852244 - RNA, 22 nt, Human
caggagagcccggguccgggcu

SEQ ID NO: 852245 - RNA, 22 nt, Human
gaccauuuuuacagagcauuca

SEQ ID NO: 852246 - RNA, 22 nt, Human
ucucacugcaaauauuauguau

SEQ ID NO: 852247 - RNA, 22 nt, Human
gaggccuggagccgccuaggcg

SEQ ID NO: 852248 - RNA, 22 nt, Human
acuggccaggcacagcuguggg

SEQ ID NO: 852249 - RNA, 22 nt, Human
ggcaucuccaaaacaugaacuc

SEQ ID NO: 852250 - RNA, 22 nt, Human
uggccaggcagguagaacggcc

SEQ ID NO: 852251 - RNA, 22 nt, Human
gaggaaccacucugagaagcca

SEQ ID NO: 852252 - RNA, 22 nt, Human
guagccauuggcaaugaagccu

SEQ ID NO: 852253 - RNA, 22 nt, Human
uucuggaacauagcaagaaguu

SEQ ID NO: 852254 - RNA, 22 nt, Human
gcuggaaaucaaagaaguggau

SEQ ID NO: 852255 - RNA, 22 nt, Human
ucuccugguacccuuccuagca

SEQ ID NO: 852256 - RNA, 22 nt, Human
aggccaaagcucaccugcagcu

SEQ ID NO: 852257 - RNA, 22 nt, Human
gcacagaacagagaaauagcca

SEQ ID NO: 852258 - RNA, 22 nt, Human
uggcugaguuacgaacagagca

SEQ ID NO: 852259 - RNA, 22 nt, Human
ccuggcugguugucugauucua

SEQ ID NO: 852260 - RNA, 22 nt, Human
uggcugagaaguucugguggga

SEQ ID NO: 852261 - RNA, 22 nt, Human
agaaaugaagagagucaagguu

SEQ ID NO: 852262 - RNA, 22 nt, Human
ucuuuguaaaugccuagcauaa

SEQ ID NO: 852263 - RNA, 22 nt, Human
cugcuucuaagaaccugcagcu

SEQ ID NO: 852264 - RNA, 22 nt, Human
gcagcugcaauaggcaucaagc

SEQ ID NO: 852265 - RNA, 22 nt, Human
auucuucauaccuacugagguu

SEQ ID NO: 852266 - RNA, 22 nt, Human
guucuucagauuccauuucagu

SEQ ID NO: 852267 - RNA, 22 nt, Human
uauuaggguaaauuugacaugc

SEQ ID NO: 852268 - RNA, 22 nt, Human
ugaggcccggguggaggaaugc

SEQ ID NO: 852269 - RNA, 22 nt, Human
uagcuuuccuuguugccugugc

SEQ ID NO: 852270 - RNA, 22 nt, Human
uauuuccaccuauuauuuucug

SEQ ID NO: 852271 - RNA, 22 nt, Human
caggaaagggaugggcugccac

SEQ ID NO: 852272 - RNA, 17 nt, Human
uuuaaacuacuacaagg

SEQ ID NO: 852273 - RNA, 22 nt, Human
guauuaggaggaacacaggccu

SEQ ID NO: 852274 - RNA, 22 nt, Human
aaaaaagauugaugguggaugc

SEQ ID NO: 852275 - RNA, 22 nt, Human
uuuaugagcaccuuggcccaga

SEQ ID NO: 852276 - RNA, 22 nt, Human
uagggaugacgaaaggacagag

SEQ ID NO: 852277 - RNA, 22 nt, Human
agacagagauacuauguuguca

SEQ ID NO: 852278 - RNA, 22 nt, Human
auuaggauuuuguccaaguagc

SEQ ID NO: 852279 - RNA, 22 nt, Human
agugcuggauuacaggcgugag

SEQ ID NO: 852280 - RNA, 22 nt, Human
ccucuucuagguuucagccugc

SEQ ID NO: 852281 - RNA, 22 nt, Human
agaggacaaaaugagaagugcu

SEQ ID NO: 852282 - RNA, 22 nt, Human
aacacuuucuuccuugcucagg

SEQ ID NO: 852283 - RNA, 22 nt, Human
cucacuguccaacaggcuuuac

SEQ ID NO: 852284 - RNA, 22 nt, Human
ucugaggucuaugacuuugcuu

SEQ ID NO: 852285 - RNA, 22 nt, Human
acuuaaaaagaaucuuuucacg

SEQ ID NO: 852286 - RNA, 20 nt, Human
ugaggcaggagaauggcaug

SEQ ID NO: 852287 - RNA, 22 nt, Human
cuccaggagggggauggcugua

SEQ ID NO: 852288 - RNA, 22 nt, Human
caaauacugaguuuauuuucaa

SEQ ID NO: 852289 - RNA, 22 nt, Human
cuggagucuucagcuugcugcc

SEQ ID NO: 852290 - RNA, 22 nt, Human
gaggagagaacauuccuccaua

SEQ ID NO: 852291 - RNA, 22 nt, Human
caggagggcccgagacucuucc

SEQ ID NO: 852292 - RNA, 22 nt, Human
uggguccauggaacagaggugc

SEQ ID NO: 852293 - RNA, 22 nt, Human
uuucuauucuggaucuguggca

SEQ ID NO: 852294 - RNA, 22 nt, Human
aggcugagauagguggaucauu

SEQ ID NO: 852295 - RNA, 22 nt, Human
uuuccucacuucaugagaguuu

SEQ ID NO: 852296 - RNA, 22 nt, Human
cuuaacauccugcauuuuucuu

SEQ ID NO: 852297 - RNA, 17 nt, Human
cagacaggcugucaccc

SEQ ID NO: 852298 - RNA, 22 nt, Human
caaaugaauuucccugcaaaug

SEQ ID NO: 852299 - RNA, 22 nt, Human
ucaaugacugguccaagguggc

SEQ ID NO: 852300 - RNA, 22 nt, Human
uuuaucuuuaggacuuugcaga

SEQ ID NO: 852301 - RNA, 22 nt, Human
aagugcugagacuacaggcaug

SEQ ID NO: 852302 - RNA, 22 nt, Human
agauggcagggguaccuggaag

SEQ ID NO: 852303 - RNA, 22 nt, Human
gagcaagaguguuggacuuuga

SEQ ID NO: 852304 - RNA, 22 nt, Human
uuugacaugcaaagcacuuuag

SEQ ID NO: 852305 - RNA, 22 nt, Human
aggcugagucgggaggaucacu

SEQ ID NO: 852306 - RNA, 22 nt, Human
gaggcagugucgguggcaggau

SEQ ID NO: 852307 - RNA, 22 nt, Human
acuccugguuuguguccuggcu

SEQ ID NO: 852308 - RNA, 22 nt, Human
agagccaguuguuaagcacuua

SEQ ID NO: 852309 - RNA, 22 nt, Human
uuauuucauugauuucuaagac

SEQ ID NO: 852310 - RNA, 22 nt, Human
aaauauaauuucugccucaaua

SEQ ID NO: 852311 - RNA, 22 nt, Human
acaggcugacuuccugccaugu

SEQ ID NO: 852312 - RNA, 22 nt, Human
auuuggcaaauaauuugagggu

SEQ ID NO: 852313 - RNA, 22 nt, Human
gugaggucaccggccguugcca

SEQ ID NO: 852314 - RNA, 22 nt, Human
acagaaauugggcaaauggaag

SEQ ID NO: 852315 - RNA, 22 nt, Human
aagcuggagaguuaggugaaua

SEQ ID NO: 852316 - RNA, 22 nt, Human
aagcagaggaccgacggaggga

SEQ ID NO: 852317 - RNA, 22 nt, Human
gcagcugcagacccucagugcu

SEQ ID NO: 852318 - RNA, 22 nt, Human
aaaaugaauaaguuaacccagg

SEQ ID NO: 852319 - RNA, 22 nt, Human
aacucacuuuguggcuucugaa

SEQ ID NO: 852320 - RNA, 22 nt, Human
uaggcuggaacuuaggcagagg

SEQ ID NO: 852321 - RNA, 22 nt, Human
uuggccaauuccagaggaucau

SEQ ID NO: 852322 - RNA, 22 nt, Human
agucacuguucugucaugucaa

SEQ ID NO: 852323 - RNA, 22 nt, Human
cucaacagcucugccauacucc

SEQ ID NO: 852324 - RNA, 22 nt, Human
cccaggaaaugggcucuugccu

SEQ ID NO: 852325 - RNA, 22 nt, Human
cauuaaaauaucucaugguguu

SEQ ID NO: 852326 - RNA, 17 nt, Human
agacagugagugccuug

SEQ ID NO: 852327 - RNA, 22 nt, Human
aucaggauagucuguaaauugu

SEQ ID NO: 852328 - RNA, 18 nt, Human
ugaacuggcaucagaauc

SEQ ID NO: 852329 - RNA, 22 nt, Human
uaacauuagguagacauaagcc

SEQ ID NO: 852330 - RNA, 22 nt, Human
uucuguuagaauuuugaaaaua

SEQ ID NO: 852331 - RNA, 22 nt, Human
gauagauaaaacuauauuuuca

SEQ ID NO: 852332 - RNA, 22 nt, Human
gcuguguuuuauguuagguuaa

SEQ ID NO: 852333 - RNA, 22 nt, Human
cuuacagagaagaaaauguagu

SEQ ID NO: 852334 - RNA, 22 nt, Human
aggcagcauccagaggagaaug

SEQ ID NO: 852335 - RNA, 19 nt, Human
uggcugagcuggacugagg

SEQ ID NO: 852336 - RNA, 22 nt, Human
gaauuaacuggcaguuagugcu

SEQ ID NO: 852337 - RNA, 23 nt, Human
cuaggcaggauuguaggcgggua

SEQ ID NO: 852338 - RNA, 22 nt, Human
cuguauuuguccucuauuuauu

SEQ ID NO: 852339 - RNA, 20 nt, Human
agaggaggauuauuuuauuc

SEQ ID NO: 852340 - RNA, 22 nt, Human
ccauggcuuacagauggagcau

SEQ ID NO: 852341 - RNA, 22 nt, Human
cguggccagccauuuccuggaa

SEQ ID NO: 852342 - RNA, 22 nt, Human
guggccaacucaauguuuuuca

SEQ ID NO: 852343 - RNA, 22 nt, Human
aggagggacaccaauauauguu

SEQ ID NO: 852344 - RNA, 21 nt, Human
ccuggcugcacaguugcuggu

SEQ ID NO: 852345 - RNA, 22 nt, Human
gcaccugauugauuucacugcu

SEQ ID NO: 852346 - RNA, 22 nt, Human
uggagccagagcgcagccuggg

SEQ ID NO: 852347 - RNA, 22 nt, Human
ggcugcuguuucagagacuguu

SEQ ID NO: 852348 - RNA, 23 nt, Human
caguuggagguacagagacacug

SEQ ID NO: 852349 - RNA, 22 nt, Human
cauugcuguuaauugucucuag

SEQ ID NO: 852350 - RNA, 22 nt, Human
cagccuuugggucagaagauuc

SEQ ID NO: 852351 - RNA, 20 nt, Human
gcagcuacucugucucgcuc

SEQ ID NO: 852352 - RNA, 22 nt, Human
aaagcagaggugauaugacuua

SEQ ID NO: 852353 - RNA, 22 nt, Human
cuugcugggguaagucugugcu

SEQ ID NO: 852354 - RNA, 18 nt, Human
ccuggagcuccacagcaa

SEQ ID NO: 852355 - RNA, 22 nt, Human
gggcugagcuguucugaguuua

SEQ ID NO: 852356 - RNA, 22 nt, Human
gggcugaguuccugccucacuc

SEQ ID NO: 852357 - RNA, 22 nt, Human
uaacugguccugaacagcccag

SEQ ID NO: 852358 - RNA, 22 nt, Human
gggaagcaggugcagcucgccu

SEQ ID NO: 852359 - RNA, 22 nt, Human
uuugaaugcaggacauacagaa

SEQ ID NO: 852360 - RNA, 22 nt, Human
gcugccuguugaagggucugug

SEQ ID NO: 852361 - RNA, 22 nt, Human
acucagaaccauuuacucugag

SEQ ID NO: 852362 - RNA, 22 nt, Human
cugcuguccaggagugcccugu

SEQ ID NO: 852363 - RNA, 22 nt, Human
cugccugcguugccucgugccu

SEQ ID NO: 852364 - RNA, 22 nt, Human
ugaggggauacgguacacauug

SEQ ID NO: 852365 - RNA, 22 nt, Human
uuuauuuggcauccagggagaa

SEQ ID NO: 852366 - RNA, 22 nt, Human
gauggacagccuggaaggaaag

SEQ ID NO: 852367 - RNA, 20 nt, Human
ucuggcaggugaacgagcug

SEQ ID NO: 852368 - RNA, 22 nt, Human
uccaaauauacagaaucuccuc

SEQ ID NO: 852369 - RNA, 22 nt, Human
acagagcuguacuacuuacuga

SEQ ID NO: 852370 - RNA, 18 nt, Human
gaaaggagagacaguagg

SEQ ID NO: 852371 - RNA, 20 nt, Human
cuucuucauuaacccuacug

SEQ ID NO: 852372 - RNA, 22 nt, Human
aaugaauugcaguacugacuug

SEQ ID NO: 852373 - RNA, 19 nt, Human
uggagacugagagugagca

SEQ ID NO: 852374 - RNA, 22 nt, Human
agaggcugcacuugcucaugau

SEQ ID NO: 852375 - RNA, 22 nt, Human
uuuuaaaucuccaguugacccc

SEQ ID NO: 852376 - RNA, 22 nt, Human
ggaagagggaaccacgacugua

SEQ ID NO: 852377 - RNA, 22 nt, Human
cgaggcaggcaggcggaggaua

SEQ ID NO: 852378 - RNA, 22 nt, Human
aaguagugugcuccagcgguga

SEQ ID NO: 852379 - RNA, 22 nt, Human
aggcagcugaccacaguaugau

SEQ ID NO: 852380 - RNA, 22 nt, Human
uggcagcagggccccuggagga

SEQ ID NO: 852381 - RNA, 22 nt, Human
cccuggaggcuggaggcaguag

SEQ ID NO: 852382 - RNA, 17 nt, Human
uuugguaauauauuaag

SEQ ID NO: 852383 - RNA, 22 nt, Human
uccaggagauucauuaggucau

SEQ ID NO: 852384 - RNA, 22 nt, Human
aacuguaauuuuuacauaguaa

SEQ ID NO: 852385 - RNA, 22 nt, Human
ugcauguggaccccuggugccu

SEQ ID NO: 852386 - RNA, 22 nt, Human
uucuuauagaagcaaccauugu

SEQ ID NO: 852387 - RNA, 22 nt, Human
ucacaaauagcuauauuaagga

SEQ ID NO: 852388 - RNA, 22 nt, Human
ggcaggcugggugucauggagu

SEQ ID NO: 852389 - RNA, 22 nt, Human
ucuauaaagggccagauaguag

SEQ ID NO: 852390 - RNA, 22 nt, Human
cuucuucaaccugaaaguuuca

SEQ ID NO: 852391 - RNA, 21 nt, Human
aaaggccauaaucacggagca

SEQ ID NO: 852392 - RNA, 22 nt, Human
gccaggaggcugcuguguaggc

SEQ ID NO: 852393 - RNA, 20 nt, Human
uauuaggaaggaggaaggaa

SEQ ID NO: 852394 - RNA, 22 nt, Human
ggcagaagauaggacagggaau

SEQ ID NO: 852395 - RNA, 22 nt, Human
auguuagugauaguaaauagug

SEQ ID NO: 852396 - RNA, 22 nt, Human
cuguguuugaugagaagccacc

SEQ ID NO: 852397 - RNA, 22 nt, Human
uucacagauguauuggaacucc

SEQ ID NO: 852398 - RNA, 22 nt, Human
caggcagcucgaugccuuguug

SEQ ID NO: 852399 - RNA, 22 nt, Human
ugcugccuccuuccugccagga

SEQ ID NO: 852400 - RNA, 22 nt, Human
uugaggucauauauauuuggca

SEQ ID NO: 852401 - RNA, 22 nt, Human
gcccaggaguuugcauuuuaac

SEQ ID NO: 852402 - RNA, 22 nt, Human
gggcagcucuuugguauccuuc

SEQ ID NO: 852403 - RNA, 22 nt, Human
gggcagcuagcccucuagccca

SEQ ID NO: 852404 - RNA, 22 nt, Human
uaucuguuaggaucagagcugg

SEQ ID NO: 852405 - RNA, 22 nt, Human
ugcuucagcacuuugagagccu

SEQ ID NO: 852406 - RNA, 22 nt, Human
agaaaaguuuucugagacugac

SEQ ID NO: 852407 - RNA, 22 nt, Human
aggcuccauuuuccugcagcug

SEQ ID NO: 852408 - RNA, 22 nt, Human
guguguuuagcauuagcagggg

SEQ ID NO: 852409 - RNA, 22 nt, Human
cucacugugaccucagcagaca

SEQ ID NO: 852410 - RNA, 22 nt, Human
ccugaggucagcgguucccaca

SEQ ID NO: 852411 - RNA, 22 nt, Human
ucauuucaaugauacuacuaag

SEQ ID NO: 852412 - RNA, 22 nt, Human
aacuuucuuggaugucucaaca

SEQ ID NO: 852413 - RNA, 18 nt, Human
caugucugcgccacaagg

SEQ ID NO: 852414 - RNA, 22 nt, Human
ggcugagaguggaucccaggga

SEQ ID NO: 852415 - RNA, 22 nt, Human
ugaggcaggagguugagaacug

SEQ ID NO: 852416 - RNA, 22 nt, Human
cuuuccaaugcauuuccaaugu

SEQ ID NO: 852417 - RNA, 22 nt, Human
ugaaaugauaucugauaacaaa

SEQ ID NO: 852418 - RNA, 22 nt, Human
guggcagcaaaugccuggacua

SEQ ID NO: 852419 - RNA, 22 nt, Human
uuucaggguacauggagcaaau

SEQ ID NO: 852420 - RNA, 22 nt, Human
cuaccuuucugacucuugggau

SEQ ID NO: 852421 - RNA, 22 nt, Human
augauugguggucagcaguaug

SEQ ID NO: 852422 - RNA, 21 nt, Human
uuucacaaaaguaugugacaa

SEQ ID NO: 852423 - RNA, 22 nt, Human
cagaaggcuuuguggaguagac

SEQ ID NO: 852424 - RNA, 22 nt, Human
gugggagcuuuggcaucaggcu

SEQ ID NO: 852425 - RNA, 22 nt, Human
uuaaaguauagaggacaaaaac

SEQ ID NO: 852426 - RNA, 22 nt, Human
uuaauuuuaaccuguuuguguc

SEQ ID NO: 852427 - RNA, 19 nt, Human
caggaaggggcgaaucugg

SEQ ID NO: 852428 - RNA, 22 nt, Human
auggcuucugucuuggaaacuu

SEQ ID NO: 852429 - RNA, 22 nt, Human
uggcucaagugauccuccugcc

SEQ ID NO: 852430 - RNA, 22 nt, Human
guguacagugauuugaguucac

SEQ ID NO: 852431 - RNA, 22 nt, Human
uuauuccaguaaucucuguaau

SEQ ID NO: 852432 - RNA, 22 nt, Human
cacuuucuguguugugcaaaaa

SEQ ID NO: 852433 - RNA, 22 nt, Human
gccaggagacuccauucauuug

SEQ ID NO: 852434 - RNA, 22 nt, Human
uuccaucuuucagcuuuguugg

SEQ ID NO: 852435 - RNA, 23 nt, Human
uucuuucaagaaguucacagugc

SEQ ID NO: 852436 - RNA, 22 nt, Human
auacuaaaguauagaacuuagu

SEQ ID NO: 852437 - RNA, 22 nt, Human
aaggccagcuuguagggcuggu

SEQ ID NO: 852438 - RNA, 22 nt, Human
acucauuuaaacauuuacugaa

SEQ ID NO: 852439 - RNA, 22 nt, Human
cccugccuuguuggagccuaug

SEQ ID NO: 852440 - RNA, 22 nt, Human
cuuugcaaacugucacacuuuc

SEQ ID NO: 852441 - RNA, 22 nt, Human
cugcugugcagacagacucucu

SEQ ID NO: 852442 - RNA, 22 nt, Human
gccugccuguuggcugaggugc

SEQ ID NO: 852443 - RNA, 22 nt, Human
gaggcacuggaggaaaggagaa

SEQ ID NO: 852444 - RNA, 22 nt, Human
aggagagaauguuccaggcuug

SEQ ID NO: 852445 - RNA, 22 nt, Human
cacagcaaagacacucucaacu

SEQ ID NO: 852446 - RNA, 22 nt, Human
ggaggugggauuaggaccuaaa

SEQ ID NO: 852447 - RNA, 22 nt, Human
ccucugcucugguccaugugcu

SEQ ID NO: 852448 - RNA, 20 nt, Human
auggccaaccugcuuaugac

SEQ ID NO: 852449 - RNA, 22 nt, Human
cccugccuacaggguuuucuuu

SEQ ID NO: 852450 - RNA, 22 nt, Human
gcucaggacccaggugugaccu

SEQ ID NO: 852451 - RNA, 22 nt, Human
aaggcugaauucaaggguaggc

SEQ ID NO: 852452 - RNA, 22 nt, Human
agguaggcccugagugcuguug

SEQ ID NO: 852453 - RNA, 22 nt, Human
cagucuucuaaccuagcagccu

SEQ ID NO: 852454 - RNA, 22 nt, Human
ccugaggucaugcauuuccaac

SEQ ID NO: 852455 - RNA, 22 nt, Human
ccaggagagcaaaggucacucu

SEQ ID NO: 852456 - RNA, 22 nt, Human
aacuuucuauagguugggauuu

SEQ ID NO: 852457 - RNA, 22 nt, Human
agucucagaaaagaagcaugga

SEQ ID NO: 852458 - RNA, 22 nt, Human
uucuccucuguuggccuucccu

SEQ ID NO: 852459 - RNA, 22 nt, Human
ccugagguuuuuggauaguugu

SEQ ID NO: 852460 - RNA, 22 nt, Human
ucuuggcugcugccaauuuacu

SEQ ID NO: 852461 - RNA, 22 nt, Human
gaaggccaagaggcuccaagau

SEQ ID NO: 852462 - RNA, 22 nt, Human
uuggcuucuugugaaaucugag

SEQ ID NO: 852463 - RNA, 22 nt, Human
agggagcugagcugugagcagc

SEQ ID NO: 852464 - RNA, 22 nt, Human
caguuuuugccauuaagaguaa

SEQ ID NO: 852465 - RNA, 21 nt, Human
gaacauuuggguuguuucuac

SEQ ID NO: 852466 - RNA, 22 nt, Human
aggagggagcuuaagccaggca

SEQ ID NO: 852467 - RNA, 22 nt, Human
aagaagagaacuggcauccuaa

SEQ ID NO: 852468 - RNA, 23 nt, Human
ugcugaaguguuggcccugccca

SEQ ID NO: 852469 - RNA, 22 nt, Human
caacaauaugccagacucaauu

SEQ ID NO: 852470 - RNA, 22 nt, Human
ccaggagaauaauggcagauua

SEQ ID NO: 852471 - RNA, 22 nt, Human
uagaaagacagagguuuugucu

SEQ ID NO: 852472 - RNA, 22 nt, Human
gcagcucccagcuugaaagguc

SEQ ID NO: 852473 - RNA, 22 nt, Human
uuugaaaggaaguuaauacuuu

SEQ ID NO: 852474 - RNA, 22 nt, Human
ucuucccuaaucaccaucuuca

SEQ ID NO: 852475 - RNA, 22 nt, Human
ugccuugcacauaauauacauu

SEQ ID NO: 852476 - RNA, 22 nt, Human
gaaaggugccccauaggcagga

SEQ ID NO: 852477 - RNA, 22 nt, Human
uuuaaauucugucugccgcuua

SEQ ID NO: 852478 - RNA, 22 nt, Human
ugcugaggaaagaggauaaaag

SEQ ID NO: 852479 - RNA, 19 nt, Human
cugcucuccuugacuugga

SEQ ID NO: 852480 - RNA, 22 nt, Human
ccccaggaagccucagauuugc

SEQ ID NO: 852481 - RNA, 22 nt, Human
gcuggccauauauuuugcuguu

SEQ ID NO: 852482 - RNA, 22 nt, Human
aaggcagcagaggaaaggugcu

SEQ ID NO: 852483 - RNA, 22 nt, Human
ugaaaugagauaauuuaagugc

SEQ ID NO: 852484 - RNA, 22 nt, Human
aaggcaguuugggccaccaucu

SEQ ID NO: 852485 - RNA, 22 nt, Human
gaggcugcccaacuggagugga

SEQ ID NO: 852486 - RNA, 22 nt, Human
ugacccugagagcugaauggcu

SEQ ID NO: 852487 - RNA, 22 nt, Human
caaaugaauauuuccauggguu

SEQ ID NO: 852488 - RNA, 22 nt, Human
gcugugcuugggaagaaucucu

SEQ ID NO: 852489 - RNA, 22 nt, Human
acugguguugauuuggaagggg

SEQ ID NO: 852490 - RNA, 23 nt, Human
gaggcagcuccugcagugcccug

SEQ ID NO: 852491 - RNA, 21 nt, Human
agucugagguggggccuagga

SEQ ID NO: 852492 - RNA, 22 nt, Human
agaaaguuguuuuagccaaacc

SEQ ID NO: 852493 - RNA, 22 nt, Human
auacaacuuuaucuguaaugag

SEQ ID NO: 852494 - RNA, 22 nt, Human
ggagaggacauggcucccacag

SEQ ID NO: 852495 - RNA, 22 nt, Human
caaaugaauagggagugugaug

SEQ ID NO: 852496 - RNA, 21 nt, Human
uuugaaagugggugauucuuu

SEQ ID NO: 852497 - RNA, 22 nt, Human
aggccagcccugggcugagaga

SEQ ID NO: 852498 - RNA, 22 nt, Human
augaguucccaggugauuugug

SEQ ID NO: 852499 - RNA, 22 nt, Human
uuucaguuguccuguuaauagc

SEQ ID NO: 852500 - RNA, 22 nt, Human
gcugggagugggcaagaugaga

SEQ ID NO: 852501 - RNA, 19 nt, Human
cuggcugcaaugccagggu

SEQ ID NO: 852502 - RNA, 22 nt, Human
cuacccaggcuuagagggcugg

SEQ ID NO: 852503 - RNA, 22 nt, Human
augcugugccuucucugugcca

SEQ ID NO: 852504 - RNA, 18 nt, Human
aggcaggugcuggaaguc

SEQ ID NO: 852505 - RNA, 22 nt, Human
guaaguuauauuaaaauuucag

SEQ ID NO: 852506 - RNA, 22 nt, Human
accaggagacaugaccaaugag

SEQ ID NO: 852507 - RNA, 22 nt, Human
uuagccaugugggaaaaacagc

SEQ ID NO: 852508 - RNA, 22 nt, Human
aaauuuucagagcacuagagaa

SEQ ID NO: 852509 - RNA, 23 nt, Human
uuagagaugauuaaaaaaucuug

SEQ ID NO: 852510 - RNA, 22 nt, Human
aaguauaagcuauucuucauga

SEQ ID NO: 852511 - RNA, 22 nt, Human
aggguggccaugagggagagau

SEQ ID NO: 852512 - RNA, 17 nt, Human
ucugaggugaggaugca

SEQ ID NO: 852513 - RNA, 17 nt, Human
agcugaccagauggacu

SEQ ID NO: 852514 - RNA, 22 nt, Human
auauuaggcaaggagauuauuu

SEQ ID NO: 852515 - RNA, 22 nt, Human
uggcagcuagauaguguguuua

SEQ ID NO: 852516 - RNA, 22 nt, Human
gcuucccagcagaggaaagacu

SEQ ID NO: 852517 - RNA, 22 nt, Human
aggcacagagaaugcccuccau

SEQ ID NO: 852518 - RNA, 22 nt, Human
ucugggaaugaauaagaccugu

SEQ ID NO: 852519 - RNA, 22 nt, Human
uuuaacagguaaaguaaaugug

SEQ ID NO: 852520 - RNA, 22 nt, Human
guccaucuagaauuuauuucua

SEQ ID NO: 852521 - RNA, 22 nt, Human
gagggugggccagauaugaggg

SEQ ID NO: 852522 - RNA, 22 nt, Human
ucuuugcaaaauacaacaaugg

SEQ ID NO: 852523 - RNA, 22 nt, Human
cagccuuuuaggacuauuugug

SEQ ID NO: 852524 - RNA, 22 nt, Human
caccguuugguuuggauuuaca

SEQ ID NO: 852525 - RNA, 22 nt, Human
gauuucuuuagguguaauagug

SEQ ID NO: 852526 - RNA, 17 nt, Human
agcugagcuggccaggg

SEQ ID NO: 852527 - RNA, 22 nt, Human
aagauggaguaguguaaugguu

SEQ ID NO: 852528 - RNA, 22 nt, Human
aucacaaaggcugcuucaugau

SEQ ID NO: 852529 - RNA, 22 nt, Human
aggagaggucucccuuccccag

SEQ ID NO: 852530 - RNA, 19 nt, Human
cccaggaggcggagguugc

SEQ ID NO: 852531 - RNA, 17 nt, Human
aaucuguuuacagucag

SEQ ID NO: 852532 - RNA, 22 nt, Human
aaggcaguaggaucuuccacag

SEQ ID NO: 852533 - RNA, 22 nt, Human
gccuuuauuguuuauucagugc

SEQ ID NO: 852534 - RNA, 22 nt, Human
uuucaguuuccagcuuugucau

SEQ ID NO: 852535 - RNA, 22 nt, Human
aaacugccaaaagaccuuggau

SEQ ID NO: 852536 - RNA, 22 nt, Human
uauuagugaaagaauuaguuug

SEQ ID NO: 852537 - RNA, 22 nt, Human
gauuucuuugcaagcuguguuc

SEQ ID NO: 852538 - RNA, 22 nt, Human
ucaggauggcuucugcaucaaa

SEQ ID NO: 852539 - RNA, 22 nt, Human
uaacaauaguguuugcuaguca

SEQ ID NO: 852540 - RNA, 22 nt, Human
auuucccagcuuugaucaguuu

SEQ ID NO: 852541 - RNA, 19 nt, Human
cccaggagcaguauugaug

SEQ ID NO: 852542 - RNA, 22 nt, Human
ccaagaugaucuuuacaguguu

SEQ ID NO: 852543 - RNA, 22 nt, Human
ucuucacauggaacaugaagcu

SEQ ID NO: 852544 - RNA, 22 nt, Human
uuccuuaguugacugucuuagu

SEQ ID NO: 852545 - RNA, 22 nt, Human
cuguauuucccacauucucuau

SEQ ID NO: 852546 - RNA, 22 nt, Human
uagggcaggugaagaaaagcua

SEQ ID NO: 852547 - RNA, 22 nt, Human
uugcccagaguccacagcguac

SEQ ID NO: 852548 - RNA, 22 nt, Human
uuugaaagccuggcuuuucucu

SEQ ID NO: 852549 - RNA, 22 nt, Human
caaauagugucacauugugagg

SEQ ID NO: 852550 - RNA, 22 nt, Human
gaggacaggagacucacuguuu

SEQ ID NO: 852551 - RNA, 22 nt, Human
uggcaccaggcgggguggcugu

SEQ ID NO: 852552 - RNA, 22 nt, Human
ugaaucauggauaaauagcuua

SEQ ID NO: 852553 - RNA, 22 nt, Human
uaaaacuuaacuauccagauua

SEQ ID NO: 852554 - RNA, 22 nt, Human
guggcaggagagacacagccau

SEQ ID NO: 852555 - RNA, 22 nt, Human
caggcugaucagggcugggaug

SEQ ID NO: 852556 - RNA, 22 nt, Human
aggcaggcacuccggaaguguc

SEQ ID NO: 852557 - RNA, 22 nt, Human
aaucuguucuacucuauucaga

SEQ ID NO: 852558 - RNA, 22 nt, Human
ucaugcuuaaaagacacuugag

SEQ ID NO: 852559 - RNA, 22 nt, Human
ugcauggaggaagaugaaugca

SEQ ID NO: 852560 - RNA, 22 nt, Human
gugaggucauauagcgaacucc

SEQ ID NO: 852561 - RNA, 19 nt, Human
uccaggaggcugccauuga

SEQ ID NO: 852562 - RNA, 22 nt, Human
ugcugaggagguggcugugcuu

SEQ ID NO: 852563 - RNA, 22 nt, Human
gcugcugugugggagacaggcg

SEQ ID NO: 852564 - RNA, 22 nt, Human
aaccauuugccauuaucuuaag

SEQ ID NO: 852565 - RNA, 22 nt, Human
ggcuggagaagggugguugaca

SEQ ID NO: 852566 - RNA, 22 nt, Human
guggaauguccuugaucauaag

SEQ ID NO: 852567 - RNA, 22 nt, Human
ggccaaaucuguaaggcaagau

SEQ ID NO: 852568 - RNA, 22 nt, Human
gcaggagaaaugaagauugggu

SEQ ID NO: 852569 - RNA, 22 nt, Human
ucaggcugcuggccagcaggcu

SEQ ID NO: 852570 - RNA, 22 nt, Human
gaggcaacacauuuggaaagca

SEQ ID NO: 852571 - RNA, 18 nt, Human
uggcagcaggaagccauu

SEQ ID NO: 852572 - RNA, 22 nt, Human
ggaaaagacagguuaacuguga

SEQ ID NO: 852573 - RNA, 22 nt, Human
uuauuugguugcugacuuggaa

SEQ ID NO: 852574 - RNA, 22 nt, Human
gcaaguuauuuccauuuaaagc

SEQ ID NO: 852575 - RNA, 22 nt, Human
ucucucuuuuuaaucauguaau

SEQ ID NO: 852576 - RNA, 21 nt, Human
gcaggcuggucaaaccucagu

SEQ ID NO: 852577 - RNA, 23 nt, Human
gggcagcuuaagcuuguuuuucu

SEQ ID NO: 852578 - RNA, 22 nt, Human
auuggcaggaaccgaggagggg

SEQ ID NO: 852579 - RNA, 23 nt, Human
uuuauccaacucuguaaucucuc

SEQ ID NO: 852580 - RNA, 22 nt, Human
gggcagcuguaucugagcuuau

SEQ ID NO: 852581 - RNA, 22 nt, Human
ucuuagaaugucaacugauguu

SEQ ID NO: 852582 - RNA, 22 nt, Human
ccuccuggaggcucuagggaaa

SEQ ID NO: 852583 - RNA, 22 nt, Human
acauguaaaaauuaagguaaga

SEQ ID NO: 852584 - RNA, 20 nt, Human
ggggcugcaugcagagaaga

SEQ ID NO: 852585 - RNA, 22 nt, Human
uaauuauuugaagacauuagag

SEQ ID NO: 852586 - RNA, 22 nt, Human
cucaggaugaaagucaugguga

SEQ ID NO: 852587 - RNA, 22 nt, Human
uacuuucuuucugauccuuaug

SEQ ID NO: 852588 - RNA, 22 nt, Human
guugacagcuggugagcugcua

SEQ ID NO: 852589 - RNA, 22 nt, Human
uggcaugaguauaggcuucuca

SEQ ID NO: 852590 - RNA, 22 nt, Human
gauacacuggagcuuccugaca

SEQ ID NO: 852591 - RNA, 22 nt, Human
ugcugagguuucgucugcuugc

SEQ ID NO: 852592 - RNA, 22 nt, Human
aggagcagaacugauucugacu

SEQ ID NO: 852593 - RNA, 22 nt, Human
uccaggaguuugagacugcagu

SEQ ID NO: 852594 - RNA, 22 nt, Human
auccaugaucaauuuauuacua

SEQ ID NO: 852595 - RNA, 22 nt, Human
ugaugaaauguugaggcaguga

SEQ ID NO: 852596 - RNA, 19 nt, Human
agcagcuguagauagacac

SEQ ID NO: 852597 - RNA, 22 nt, Human
uauuucuaagagauaucuguac

SEQ ID NO: 852598 - RNA, 20 nt, Human
cccagguaggugccaugagu

SEQ ID NO: 852599 - RNA, 21 nt, Human
ucauuugugaucugauuucca

SEQ ID NO: 852600 - RNA, 22 nt, Human
gccaggaguucagaugcauguu

SEQ ID NO: 852601 - RNA, 22 nt, Human
gagcaggcauucuaguggcuga

SEQ ID NO: 852602 - RNA, 20 nt, Human
augugagggguugaaguggg

SEQ ID NO: 852603 - RNA, 22 nt, Human
caggcagcugacugucagauau

SEQ ID NO: 852604 - RNA, 21 nt, Human
cuccugggcuaagauauagug

SEQ ID NO: 852605 - RNA, 22 nt, Human
agggucugcauuccaacuuggg

SEQ ID NO: 852606 - RNA, 22 nt, Human
cagaccucaguccucaguagga

SEQ ID NO: 852607 - RNA, 22 nt, Human
ucuggccaacccucaaguugua

SEQ ID NO: 852608 - RNA, 22 nt, Human
acaugaaaugcagccuguaacc

SEQ ID NO: 852609 - RNA, 19 nt, Human
agcauuuggaauucuacac

SEQ ID NO: 852610 - RNA, 22 nt, Human
ucagugugaguaccaugcucag

SEQ ID NO: 852611 - RNA, 22 nt, Human
ggaagaggcugaggccaugcug

SEQ ID NO: 852612 - RNA, 22 nt, Human
uggcacaugguaagacucagua

SEQ ID NO: 852613 - RNA, 22 nt, Human
uuuauuagugcuuguaucacug

SEQ ID NO: 852614 - RNA, 22 nt, Human
ccuugcguuuuacagcuucuag

SEQ ID NO: 852615 - RNA, 22 nt, Human
gaauacaugauacaugaacugc

SEQ ID NO: 852616 - RNA, 21 nt, Human
cagcagaguaaugcauucgua

SEQ ID NO: 852617 - RNA, 22 nt, Human
caggucuggguugauggccugg

SEQ ID NO: 852618 - RNA, 22 nt, Human
auagcacugguuuuucuugguu

SEQ ID NO: 852619 - RNA, 22 nt, Human
uuggccaagucacugguuaaug

SEQ ID NO: 852620 - RNA, 19 nt, Human
acugccugaggcucacagg

SEQ ID NO: 852621 - RNA, 22 nt, Human
agccuauuccaggaugagcuca

SEQ ID NO: 852622 - RNA, 22 nt, Human
cacucaggcugugucaggagga

SEQ ID NO: 852623 - RNA, 22 nt, Human
guugaaugaaucauucuaugua

SEQ ID NO: 852624 - RNA, 22 nt, Human
caauuauauuuagaaugauaca

SEQ ID NO: 852625 - RNA, 22 nt, Human
gcaaaaaaugcuuguugcuuag

SEQ ID NO: 852626 - RNA, 22 nt, Human
ccagggcaacgcugucucagag

SEQ ID NO: 852627 - RNA, 15 nt, Human
uggcagcuuguuaag

SEQ ID NO: 852628 - RNA, 22 nt, Human
ccagcagagucuaggaaggagg

SEQ ID NO: 852629 - RNA, 22 nt, Human
caggcagcauuuacucugauga

SEQ ID NO: 852630 - RNA, 22 nt, Human
uuugcacuagcauuuguccaug

SEQ ID NO: 852631 - RNA, 22 nt, Human
ugcugaaagucccaaaucucau

SEQ ID NO: 852632 - RNA, 20 nt, Human
cuucuucagccuaugcuuca

SEQ ID NO: 852633 - RNA, 23 nt, Human
ggcuugagcuggaacagcuuggu

SEQ ID NO: 852634 - RNA, 19 nt, Human
cagagcugcuggccucguc

SEQ ID NO: 852635 - RNA, 22 nt, Human
gcagcauauuguacuggccugc

SEQ ID NO: 852636 - RNA, 22 nt, Human
gaucuguuauaaucucuuuuau

SEQ ID NO: 852637 - RNA, 22 nt, Human
gacuuucugaaggucucgcagu

SEQ ID NO: 852638 - RNA, 22 nt, Human
auggcuuccucuggauuggauu

SEQ ID NO: 852639 - RNA, 22 nt, Human
cugaguccuugggcuuagagug

SEQ ID NO: 852640 - RNA, 22 nt, Human
gugauuuugagaccuauauagu

SEQ ID NO: 852641 - RNA, 22 nt, Human
ucccaggaugugcgugccgccg

SEQ ID NO: 852642 - RNA, 22 nt, Human
acuaacauuuguguaugucuug

SEQ ID NO: 852643 - RNA, 22 nt, Human
acagauguacacucauauauaa

SEQ ID NO: 852644 - RNA, 22 nt, Human
ccuuaaauucuccauuugaaag

SEQ ID NO: 852645 - RNA, 22 nt, Human
auucuucacauggauaggaucu

SEQ ID NO: 852646 - RNA, 22 nt, Human
uagcucuucauuucaucugauu

SEQ ID NO: 852647 - RNA, 22 nt, Human
cucuccucugaaguggugaccc

SEQ ID NO: 852648 - RNA, 22 nt, Human
uucuuuugggaauuacguaugc

SEQ ID NO: 852649 - RNA, 22 nt, Human
uucuuuuacauuaagauuucag

SEQ ID NO: 852650 - RNA, 20 nt, Human
ugcguguguauuuauuuucu

SEQ ID NO: 852651 - RNA, 22 nt, Human
ggaggccagggacccagucagc

SEQ ID NO: 852652 - RNA, 22 nt, Human
ucuccuggguaaaaggguugau

SEQ ID NO: 852653 - RNA, 22 nt, Human
cugcuucuccaaaguaggacuu

SEQ ID NO: 852654 - RNA, 22 nt, Human
ucugucccugagagcucaggag

SEQ ID NO: 852655 - RNA, 22 nt, Human
aauuuccagaucagaugacuca

SEQ ID NO: 852656 - RNA, 22 nt, Human
uuggaaaauguauuucuagaag

SEQ ID NO: 852657 - RNA, 22 nt, Human
uccccucccuuccaacagagcu

SEQ ID NO: 852658 - RNA, 22 nt, Human
uguuugaacugaauaacauagu

SEQ ID NO: 852659 - RNA, 22 nt, Human
uucaggaucacuaaacccucca

SEQ ID NO: 852660 - RNA, 22 nt, Human
uagggcugcagaacaauggccu

SEQ ID NO: 852661 - RNA, 22 nt, Human
uaagaugacuacuuaccacuga

SEQ ID NO: 852662 - RNA, 22 nt, Human
ggcugcuguacugaugucaguu

SEQ ID NO: 852663 - RNA, 20 nt, Human
uuucugugcccaggucuguu

SEQ ID NO: 852664 - RNA, 21 nt, Human
ucuuccuccacagcgugccac

SEQ ID NO: 852665 - RNA, 22 nt, Human
ucuuaaagagcgcaauuugagg

SEQ ID NO: 852666 - RNA, 22 nt, Human
uuugcaaagugacuauuauaug

SEQ ID NO: 852667 - RNA, 22 nt, Human
aagauaaacucuugauuucuga

SEQ ID NO: 852668 - RNA, 20 nt, Human
uaguccaguaggggggcuuu

SEQ ID NO: 852669 - RNA, 22 nt, Human
gcaucuaaacuugcaucauugu

SEQ ID NO: 852670 - RNA, 22 nt, Human
ucaggcugaggucaucugcauc

SEQ ID NO: 852671 - RNA, 22 nt, Human
agagcacuuucgagagccggag

SEQ ID NO: 852672 - RNA, 22 nt, Human
uguuuauuuucaggauggauug

SEQ ID NO: 852673 - RNA, 22 nt, Human
cagggagggaggaaaauuugcu

SEQ ID NO: 852674 - RNA, 22 nt, Human
caggcagccugcggucugcaca

SEQ ID NO: 852675 - RNA, 22 nt, Human
uaccuuuugcuuauuaugacac

SEQ ID NO: 852676 - RNA, 19 nt, Human
aggcaggugcagagguccc

SEQ ID NO: 852677 - RNA, 20 nt, Human
aacugccugcccagaggugg

SEQ ID NO: 852678 - RNA, 22 nt, Human
cuggccaggcuugggacagaca

SEQ ID NO: 852679 - RNA, 22 nt, Human
agacucaagcagauaggaauua

SEQ ID NO: 852680 - RNA, 22 nt, Human
agugcuggagggaggcagguuc

SEQ ID NO: 852681 - RNA, 22 nt, Human
aggcagauauuggggugaugug

SEQ ID NO: 852682 - RNA, 22 nt, Human
ugucagguugguuuucagagaa

SEQ ID NO: 852683 - RNA, 22 nt, Human
gccaggaggggagaguguguca

SEQ ID NO: 852684 - RNA, 22 nt, Human
aucacugucgucaucugagauu

SEQ ID NO: 852685 - RNA, 22 nt, Human
ugcugugagguugagaaggaag

SEQ ID NO: 852686 - RNA, 22 nt, Human
cagcugcuuacuagcuguguga

SEQ ID NO: 852687 - RNA, 20 nt, Human
ugagugcuccauucugccca

SEQ ID NO: 852688 - RNA, 22 nt, Human
uucaguuucguuaucuaugaga

SEQ ID NO: 852689 - RNA, 22 nt, Human
aggcaccuugagagcaggagcu

SEQ ID NO: 852690 - RNA, 22 nt, Human
guuuuauaggcuguugcuauau

SEQ ID NO: 852691 - RNA, 22 nt, Human
ugcccaggaucuggcgaugcuc

SEQ ID NO: 852692 - RNA, 20 nt, Human
uauauaggaaauauuguguu

SEQ ID NO: 852693 - RNA, 22 nt, Human
auaguuacaaagacuuuuuaaa

SEQ ID NO: 852694 - RNA, 22 nt, Human
agggagcuucuggccucagccu

SEQ ID NO: 852695 - RNA, 22 nt, Human
ccagaggagaugccuccucugu

SEQ ID NO: 852696 - RNA, 22 nt, Human
ggcugagaaggagugggugagg

SEQ ID NO: 852697 - RNA, 22 nt, Human
uuuggaauguaguuuaaucauc

SEQ ID NO: 852698 - RNA, 22 nt, Human
ugaaacauuugaugaucuuugg

SEQ ID NO: 852699 - RNA, 22 nt, Human
ugaaucugauuucccuggaggc

SEQ ID NO: 852700 - RNA, 22 nt, Human
gagagggagccagccaggaacc

SEQ ID NO: 852701 - RNA, 17 nt, Human
uuugaaaggaugucagu

SEQ ID NO: 852702 - RNA, 22 nt, Human
auuacacagcgguuacuacuag

SEQ ID NO: 852703 - RNA, 22 nt, Human
cccaggaguuugaguucagcau

SEQ ID NO: 852704 - RNA, 22 nt, Human
auuuaaauuuucugauggagag

SEQ ID NO: 852705 - RNA, 22 nt, Human
uucauacauuuuuacuaacagc

SEQ ID NO: 852706 - RNA, 22 nt, Human
uagggcuggcgugcucagggaa

SEQ ID NO: 852707 - RNA, 19 nt, Human
uggagaggaaaugcugcuc

SEQ ID NO: 852708 - RNA, 22 nt, Human
aaacugcuuuccacaguggcua

SEQ ID NO: 852709 - RNA, 22 nt, Human
cugcaucacagcaggaggcaca

SEQ ID NO: 852710 - RNA, 22 nt, Human
cagcuucugcuaucgaacaucu

SEQ ID NO: 852711 - RNA, 21 nt, Human
gauugaaaccauggcagugag

SEQ ID NO: 852712 - RNA, 21 nt, Human
ucuccuggguccaacccaugc

SEQ ID NO: 852713 - RNA, 22 nt, Human
ggcucaggcuggagugcagugg

SEQ ID NO: 852714 - RNA, 22 nt, Human
aggcugagugcuccccuagaug

SEQ ID NO: 852715 - RNA, 21 nt, Human
ucaggagagcccaucuacaaa

SEQ ID NO: 852716 - RNA, 18 nt, Human
cugcccagagcacuugug

SEQ ID NO: 852717 - RNA, 22 nt, Human
cccucccucugcuggguguaga

SEQ ID NO: 852718 - RNA, 22 nt, Human
uugacuucccagacuuguguuu

SEQ ID NO: 852719 - RNA, 22 nt, Human
uccugucuaaagaccugcaggc

SEQ ID NO: 852720 - RNA, 22 nt, Human
ugaggggagcccgcccuggacg

SEQ ID NO: 852721 - RNA, 22 nt, Human
uugcauuugaucuuggguucuc

SEQ ID NO: 852722 - RNA, 22 nt, Human
cagcugccuucugcgggaaguc

SEQ ID NO: 852723 - RNA, 22 nt, Human
aucauuucccuuuagaucacaa

SEQ ID NO: 852724 - RNA, 22 nt, Human
gucagcugggcaucugcagaug

SEQ ID NO: 852725 - RNA, 19 nt, Human
uguguguuuauauauguau

SEQ ID NO: 852726 - RNA, 22 nt, Human
ggagcaggagucucuugaauuu

SEQ ID NO: 852727 - RNA, 22 nt, Human
agcugaggccugauuucgccgu

SEQ ID NO: 852728 - RNA, 22 nt, Human
ugucaccaugccagcuucugcc

SEQ ID NO: 852729 - RNA, 22 nt, Human
ugcugagguaaccauauccugc

SEQ ID NO: 852730 - RNA, 22 nt, Human
ucagucucaucaacucuauucc

SEQ ID NO: 852731 - RNA, 22 nt, Human
aaaggccaccaacaugaagcau

SEQ ID NO: 852732 - RNA, 22 nt, Human
guuaggauauggugaaauggag

SEQ ID NO: 852733 - RNA, 22 nt, Human
cccugguggggccagacuugcu

SEQ ID NO: 852734 - RNA, 19 nt, Human
gcuggccacgccccaguug

SEQ ID NO: 852735 - RNA, 19 nt, Human
ccugaggugggguggaagg

SEQ ID NO: 852736 - RNA, 22 nt, Human
gcaggcuggaggcuguucuggg

SEQ ID NO: 852737 - RNA, 22 nt, Human
aauuuuaagcauaugacugguu

SEQ ID NO: 852738 - RNA, 17 nt, Human
cuccuggcagccucagg

SEQ ID NO: 852739 - RNA, 22 nt, Human
cugccucaugcugccugcagcc

SEQ ID NO: 852740 - RNA, 22 nt, Human
gcucucuuuuuccagugguggu

SEQ ID NO: 852741 - RNA, 22 nt, Human
ggcaggcagaggcugagacagg

SEQ ID NO: 852742 - RNA, 21 nt, Human
acagcauguuuguguguuugc

SEQ ID NO: 852743 - RNA, 22 nt, Human
agucuccuuggccucaaugccu

SEQ ID NO: 852744 - RNA, 22 nt, Human
cagcugaguggacccuagaggc

SEQ ID NO: 852745 - RNA, 22 nt, Human
uguucuuuggcuucacagcucu

SEQ ID NO: 852746 - RNA, 22 nt, Human
uuggccaaacagaguucaacag

SEQ ID NO: 852747 - RNA, 22 nt, Human
uggccacauccuuuccuuguca

SEQ ID NO: 852748 - RNA, 22 nt, Human
agugcuuugguauagaacuauu

SEQ ID NO: 852749 - RNA, 18 nt, Human
aagggcuggccuuuggag

SEQ ID NO: 852750 - RNA, 22 nt, Human
acagaacugcaggaggaaaagc

SEQ ID NO: 852751 - RNA, 22 nt, Human
ucucuuucuauaugugagucuu

SEQ ID NO: 852752 - RNA, 22 nt, Human
cucaggcugcccugacagcccc

SEQ ID NO: 852753 - RNA, 22 nt, Human
cugagggucaacuugauuguau

SEQ ID NO: 852754 - RNA, 22 nt, Human
auacacauguguaugugcaugc

SEQ ID NO: 852755 - RNA, 22 nt, Human
uggaggggcaauggagcgcgga

SEQ ID NO: 852756 - RNA, 22 nt, Human
cagguuggucggcaaguacaca

SEQ ID NO: 852757 - RNA, 22 nt, Human
cuggcucaggaaaguugcugcu

SEQ ID NO: 852758 - RNA, 19 nt, Human
cuuugucagaacaugcuuc

SEQ ID NO: 852759 - RNA, 22 nt, Human
gcagcugccuucagcuggaugg

SEQ ID NO: 852760 - RNA, 22 nt, Human
uagggcagaguccaggaugggc

SEQ ID NO: 852761 - RNA, 22 nt, Human
ggccagaaguuggaaaagagcc

SEQ ID NO: 852762 - RNA, 17 nt, Human
ucuccuggcucuaucag

SEQ ID NO: 852763 - RNA, 22 nt, Human
uuguaaaugaccuuuucuaauu

SEQ ID NO: 852764 - RNA, 22 nt, Human
uuauccuggauuauauauguga

SEQ ID NO: 852765 - RNA, 22 nt, Human
uuacacuuguaaauggcaugua

SEQ ID NO: 852766 - RNA, 22 nt, Human
guuguuuuuguucucuauagcu

SEQ ID NO: 852767 - RNA, 22 nt, Human
uucuacagacuauaacugugau

SEQ ID NO: 852768 - RNA, 22 nt, Human
aggcugaggcagguggaucacu

SEQ ID NO: 852769 - RNA, 22 nt, Human
aaguaguuaggaacauucucuc

SEQ ID NO: 852770 - RNA, 22 nt, Human
aguaaaucagaccucauuaugu

SEQ ID NO: 852771 - RNA, 22 nt, Human
aggaguggugcaggaccugcca

SEQ ID NO: 852772 - RNA, 22 nt, Human
ggcaggcaucauguggucauua

SEQ ID NO: 852773 - RNA, 22 nt, Human
caggauggccccggggcugugc

SEQ ID NO: 852774 - RNA, 22 nt, Human
aggccagccucaggcagggacc

SEQ ID NO: 852775 - RNA, 22 nt, Human
ggucagagggugggcugccugu

SEQ ID NO: 852776 - RNA, 22 nt, Human
gaggucaggggagaggcugaug

SEQ ID NO: 852777 - RNA, 22 nt, Human
ggcuguaguuaccugaugaaau

SEQ ID NO: 852778 - RNA, 22 nt, Human
cggagaggugggggcagcaucu

SEQ ID NO: 852779 - RNA, 22 nt, Human
gguuauauaauucagugcuuuc

SEQ ID NO: 852780 - RNA, 22 nt, Human
gugcugaggauacagcugugaa

SEQ ID NO: 852781 - RNA, 23 nt, Human
aggucagcaggcaaggaaauggc

SEQ ID NO: 852782 - RNA, 20 nt, Human
gggagucuggaugaaagaug

SEQ ID NO: 852783 - RNA, 22 nt, Human
agaggagugggaagcagugcaa

SEQ ID NO: 852784 - RNA, 22 nt, Human
gcaggcugugaggcucagaugg

SEQ ID NO: 852785 - RNA, 22 nt, Human
aaguguagauuauggagugucu

SEQ ID NO: 852786 - RNA, 22 nt, Human
acauguuuggcucuaugcuaua

SEQ ID NO: 852787 - RNA, 22 nt, Human
cccaggaggcagagguugcagu

SEQ ID NO: 852788 - RNA, 22 nt, Human
agagaagagucuugucaaauua

SEQ ID NO: 852789 - RNA, 22 nt, Human
gcucuggguucugauuuaugag

SEQ ID NO: 852790 - RNA, 22 nt, Human
cagaagaggacuggguagcuca

SEQ ID NO: 852791 - RNA, 22 nt, Human
gcaggcugaugacuggaguugg

SEQ ID NO: 852792 - RNA, 22 nt, Human
aaggcagcccuggcucagccug

SEQ ID NO: 852793 - RNA, 21 nt, Human
agcugagguaaggcaagagag

SEQ ID NO: 852794 - RNA, 19 nt, Human
caacugcccccucaaacau

SEQ ID NO: 852795 - RNA, 22 nt, Human
ugcccaggauugugaggucagg

SEQ ID NO: 852796 - RNA, 22 nt, Human
aucuagguuuggaagauagagu

SEQ ID NO: 852797 - RNA, 22 nt, Human
cuuuguaucuaaauaucuugaa

SEQ ID NO: 852798 - RNA, 22 nt, Human
caccuugugauccucuugccuu

SEQ ID NO: 852799 - RNA, 23 nt, Human
gggcaguuauguuguccuuggcu

SEQ ID NO: 852800 - RNA, 19 nt, Human
cauggcugcugcuugggag

SEQ ID NO: 852801 - RNA, 21 nt, Human
uagaacugacgauuucagagu

SEQ ID NO: 852802 - RNA, 22 nt, Human
agaucaaugugucagaagagau

SEQ ID NO: 852803 - RNA, 22 nt, Human
gagguagcgaguggacagugca

SEQ ID NO: 852804 - RNA, 22 nt, Human
agaaaugacaagacugaucagg

SEQ ID NO: 852805 - RNA, 22 nt, Human
ucuuuccauggccacacagucu

SEQ ID NO: 852806 - RNA, 23 nt, Human
uagagcaguagaucaccauggga

SEQ ID NO: 852807 - RNA, 22 nt, Human
uuaauaggcuucuaacauagcu

SEQ ID NO: 852808 - RNA, 23 nt, Human
uauuagggccaggacuggcaaau

SEQ ID NO: 852809 - RNA, 22 nt, Human
ucaggagacuggcagugcccac

SEQ ID NO: 852810 - RNA, 22 nt, Human
agcaccuugcucuuggccuucc

SEQ ID NO: 852811 - RNA, 22 nt, Human
uucagcaagaccaccauguacc

SEQ ID NO: 852812 - RNA, 22 nt, Human
gccaggaggucagccccucaac

SEQ ID NO: 852813 - RNA, 22 nt, Human
cccaggaggucgaagcugcagu

SEQ ID NO: 852814 - RNA, 22 nt, Human
cccagaaggucgaggcugcagu

SEQ ID NO: 852815 - RNA, 22 nt, Human
uaaccuuucaggcauguagguu

SEQ ID NO: 852816 - RNA, 22 nt, Human
cagcuggcuggucagugcacaa

SEQ ID NO: 852817 - RNA, 22 nt, Human
ggcagcuucucccaggcuguuu

SEQ ID NO: 852818 - RNA, 22 nt, Human
cacacuuuuggcauguuugguu

SEQ ID NO: 852819 - RNA, 22 nt, Human
uccugccuucauacugcuguau

SEQ ID NO: 852820 - RNA, 20 nt, Human
cuguggaauuuuaccaugcg

SEQ ID NO: 852821 - RNA, 22 nt, Human
cuguaaauaugaagaauauaug

SEQ ID NO: 852822 - RNA, 22 nt, Human
cugaggcuuugugugcaugccu

SEQ ID NO: 852823 - RNA, 22 nt, Human
guuuuauaggugaaauauuacu

SEQ ID NO: 852824 - RNA, 22 nt, Human
uucagaauauuuguuuuacaug

SEQ ID NO: 852825 - RNA, 17 nt, Human
acuccuggucugaaggg

SEQ ID NO: 852826 - RNA, 22 nt, Human
cugccuggaugaauggcgccuu

SEQ ID NO: 852827 - RNA, 22 nt, Human
gcuaacauugauucagugccug

SEQ ID NO: 852828 - RNA, 22 nt, Human
uugaagagugccuuccagacau

SEQ ID NO: 852829 - RNA, 22 nt, Human
uaaauuaugucacaugacucug

SEQ ID NO: 852830 - RNA, 22 nt, Human
caagauuaucuucuucuuguua

SEQ ID NO: 852831 - RNA, 22 nt, Human
acucuuuacuuaaacucuaagu

SEQ ID NO: 852832 - RNA, 22 nt, Human
cagugucuccagaugcuccaau

SEQ ID NO: 852833 - RNA, 22 nt, Human
aggcagacaaggucccuggucu

SEQ ID NO: 852834 - RNA, 22 nt, Human
auacuguuucucuucuacauga

SEQ ID NO: 852835 - RNA, 22 nt, Human
uaaauacuuuacaggaugucuc

SEQ ID NO: 852836 - RNA, 21 nt, Human
cucuugugucagagccagagg

SEQ ID NO: 852837 - RNA, 21 nt, Human
cagcaagacauguuuaucaag

SEQ ID NO: 852838 - RNA, 22 nt, Human
augcuguggggagugaggguag

SEQ ID NO: 852839 - RNA, 22 nt, Human
guccaugacugugacucacaug

SEQ ID NO: 852840 - RNA, 22 nt, Human
aggcggcugguguccugcaggu

SEQ ID NO: 852841 - RNA, 22 nt, Human
cacaaugugguuugucaucuuu

SEQ ID NO: 852842 - RNA, 22 nt, Human
uauuuuaucugccagaguggag

SEQ ID NO: 852843 - RNA, 22 nt, Human
agggcugugucccuaggggagc

SEQ ID NO: 852844 - RNA, 22 nt, Human
aucccugcccucauggagcuua

SEQ ID NO: 852845 - RNA, 22 nt, Human
uuuuccagagcugucucuugca

SEQ ID NO: 852846 - RNA, 19 nt, Human
uagugucaaggaggagggu

SEQ ID NO: 852847 - RNA, 22 nt, Human
uacuaucucuucuaacuucaga

SEQ ID NO: 852848 - RNA, 22 nt, Human
ucugcaggcucuagaugagguu

SEQ ID NO: 852849 - RNA, 22 nt, Human
gaggucccccauggcugugacu

SEQ ID NO: 852850 - RNA, 22 nt, Human
gcuggcugguccagcaggggcu

SEQ ID NO: 852851 - RNA, 22 nt, Human
ucugaggucucaugacuugcau

SEQ ID NO: 852852 - RNA, 22 nt, Human
ugguaacacaggcauuaaaguu

SEQ ID NO: 852853 - RNA, 22 nt, Human
cugagauggaguuuugcucuug

SEQ ID NO: 852854 - RNA, 22 nt, Human
uauuugaaaguguacaaaaacu

SEQ ID NO: 852855 - RNA, 20 nt, Human
gugcugagggcugggcaaug

SEQ ID NO: 852856 - RNA, 22 nt, Human
acuguaacacaaugguaucugu

SEQ ID NO: 852857 - RNA, 22 nt, Human
uacacuaauagccacacuaaug

SEQ ID NO: 852858 - RNA, 22 nt, Human
caguucuuaauaccaugugguu

SEQ ID NO: 852859 - RNA, 22 nt, Human
gcagcugcuggagggaggcagg

SEQ ID NO: 852860 - RNA, 22 nt, Human
uaaggccaccguuauagaacca

SEQ ID NO: 852861 - RNA, 22 nt, Human
aguuaucagguguuuucaugga

SEQ ID NO: 852862 - RNA, 22 nt, Human
cauuuguuaaccaguguggauu

SEQ ID NO: 852863 - RNA, 22 nt, Human
ugccacaguuguuugugcucua

SEQ ID NO: 852864 - RNA, 22 nt, Human
ucugucaccccuguuucuggcu

SEQ ID NO: 852865 - RNA, 22 nt, Human
gagcugaguaucccacugaagu

SEQ ID NO: 852866 - RNA, 22 nt, Human
auacauacauguaugcacauac

SEQ ID NO: 852867 - RNA, 22 nt, Human
uuuugaauaauucagaaacagc

SEQ ID NO: 852868 - RNA, 22 nt, Human
gugcuuuuaaaggcaauuagua

SEQ ID NO: 852869 - RNA, 22 nt, Human
ccuccuuuccuguuuuccugag

SEQ ID NO: 852870 - RNA, 22 nt, Human
uccugugccuccaccugcuccg

SEQ ID NO: 852871 - RNA, 22 nt, Human
caggaggaagaacucugcaaca

SEQ ID NO: 852872 - RNA, 19 nt, Human
uucauucuuucuacuuacc

SEQ ID NO: 852873 - RNA, 22 nt, Human
uaaaugaaaggguuuaauuuau

SEQ ID NO: 852874 - RNA, 22 nt, Human
auuucccaugugaaucaauugg

SEQ ID NO: 852875 - RNA, 22 nt, Human
uaggcugggagccugaggcuag

SEQ ID NO: 852876 - RNA, 22 nt, Human
ugcacuucaaaaaugucacuga

SEQ ID NO: 852877 - RNA, 22 nt, Human
uugcugaaaucuaugacauccu

SEQ ID NO: 852878 - RNA, 22 nt, Human
uugaacugguaguuggaaaucu

SEQ ID NO: 852879 - RNA, 20 nt, Human
gaaauacuuacccaacuguu

SEQ ID NO: 852880 - RNA, 22 nt, Human
ucccaggaaugucugaaaguga

SEQ ID NO: 852881 - RNA, 20 nt, Human
agggugagacaugagccucc

SEQ ID NO: 852882 - RNA, 22 nt, Human
aggagagcuggugucuggaauc

SEQ ID NO: 852883 - RNA, 22 nt, Human
aguuauaugugaaaacacguau

SEQ ID NO: 852884 - RNA, 22 nt, Human
uaggacaugcuacauaaauagg

SEQ ID NO: 852885 - RNA, 22 nt, Human
uccaugaggaccaaauucguag

SEQ ID NO: 852886 - RNA, 23 nt, Human
aggcagcagguuguccaggguga

SEQ ID NO: 852887 - RNA, 22 nt, Human
uaacaguguggacuugagaucu

SEQ ID NO: 852888 - RNA, 22 nt, Human
ucuggccagcaugagaccuggu

SEQ ID NO: 852889 - RNA, 22 nt, Human
cagggaggaugggcuguuuugc

SEQ ID NO: 852890 - RNA, 18 nt, Human
gcaggagauggguggggu

SEQ ID NO: 852891 - RNA, 22 nt, Human
uucucacuauguauguagauug

SEQ ID NO: 852892 - RNA, 22 nt, Human
uucuucuuuccuauaauuaauu

SEQ ID NO: 852893 - RNA, 22 nt, Human
aggcagccaucugcaggaagga

SEQ ID NO: 852894 - RNA, 22 nt, Human
uauguagguaaacacagacaua

SEQ ID NO: 852895 - RNA, 22 nt, Human
ggucugaguggugcugacucag

SEQ ID NO: 852896 - RNA, 23 nt, Human
cccaggaguuucacugcaaaggu

SEQ ID NO: 852897 - RNA, 22 nt, Human
aagcagcagcaggauuaaagag

SEQ ID NO: 852898 - RNA, 22 nt, Human
caucaucaaaacaaauggaguc

SEQ ID NO: 852899 - RNA, 22 nt, Human
gacccaggaagcuacuucuggu

SEQ ID NO: 852900 - RNA, 22 nt, Human
cuugcaggccuuucuagcucua

SEQ ID NO: 852901 - RNA, 20 nt, Human
gcugccuguuucuguaagua

SEQ ID NO: 852902 - RNA, 22 nt, Human
guuaaauaaccucauguccguu

SEQ ID NO: 852903 - RNA, 22 nt, Human
uuaugauuugccacagauuggu

SEQ ID NO: 852904 - RNA, 22 nt, Human
cucucuggcacuucauugcugu

SEQ ID NO: 852905 - RNA, 22 nt, Human
ccccuccuggccacacugucag

SEQ ID NO: 852906 - RNA, 23 nt, Human
gagcugaguguagggagacuagg

SEQ ID NO: 852907 - RNA, 22 nt, Human
gaaccucagugaaacuggaggu

SEQ ID NO: 852908 - RNA, 22 nt, Human
acauuuuuuagagucccacauu

SEQ ID NO: 852909 - RNA, 22 nt, Human
ccuggccaggcucucagcacug

SEQ ID NO: 852910 - RNA, 22 nt, Human
uugaaauaucaaguuauuagug

SEQ ID NO: 852911 - RNA, 22 nt, Human
uaacauuauacagagaggacag

SEQ ID NO: 852912 - RNA, 22 nt, Human
cuuuuccacugagccucacaaa

SEQ ID NO: 852913 - RNA, 22 nt, Human
augcugagcagagcugacaugc

SEQ ID NO: 852914 - RNA, 22 nt, Human
gauggcagguaguggucucauc

SEQ ID NO: 852915 - RNA, 22 nt, Human
aggcagcuggacauaacuaacc

SEQ ID NO: 852916 - RNA, 22 nt, Human
uggcagcuggaucccaaggcag

SEQ ID NO: 852917 - RNA, 22 nt, Human
uugcugaauugaauccuuuggu

SEQ ID NO: 852918 - RNA, 22 nt, Human
gcccaguaguucaagguugcag

SEQ ID NO: 852919 - RNA, 22 nt, Human
agagugucugguagcugcucug

SEQ ID NO: 852920 - RNA, 22 nt, Human
cugagcuguuuaaucccagaua

SEQ ID NO: 852921 - RNA, 22 nt, Human
uccccagauucaugucugcugu

SEQ ID NO: 852922 - RNA, 22 nt, Human
aacuguaagagaauaaaugugu

SEQ ID NO: 852923 - RNA, 20 nt, Human
cagagccaagagcagcaucu

SEQ ID NO: 852924 - RNA, 22 nt, Human
auggccaagaauauuucucaac

SEQ ID NO: 852925 - RNA, 22 nt, Human
gcuggccauagaagccaaagag

SEQ ID NO: 852926 - RNA, 22 nt, Human
aaaaugaacagaacaaugggga

SEQ ID NO: 852927 - RNA, 20 nt, Human
ugaaggccagcagcauaggg

SEQ ID NO: 852928 - RNA, 22 nt, Human
uuugcauaggauggacauuuua

SEQ ID NO: 852929 - RNA, 22 nt, Human
ucuccuggccgggcuguccccu

SEQ ID NO: 852930 - RNA, 20 nt, Human
aggaggggauagaaucaaag

SEQ ID NO: 852931 - RNA, 22 nt, Human
aaagccauugaacuguacuuua

SEQ ID NO: 852932 - RNA, 22 nt, Human
agcaggcuuucaagagucuucu

SEQ ID NO: 852933 - RNA, 22 nt, Human
auucuuaauugccaugcuguau

SEQ ID NO: 852934 - RNA, 22 nt, Human
gcuuugaagucugugucuuuug

SEQ ID NO: 852935 - RNA, 22 nt, Human
uucucagagcucacuguaguaa

SEQ ID NO: 852936 - RNA, 22 nt, Human
acccaggagacggaggugcagu

SEQ ID NO: 852937 - RNA, 22 nt, Human
auucugagacaauugccgucag

SEQ ID NO: 852938 - RNA, 22 nt, Human
ggagaagggacagacucagcuu

SEQ ID NO: 852939 - RNA, 22 nt, Human
ccuucauugcaucuuuaagaga

SEQ ID NO: 852940 - RNA, 22 nt, Human
cagcaagacaguuuccuaagug

SEQ ID NO: 852941 - RNA, 22 nt, Human
ugcugaggucaccuugcugcua

SEQ ID NO: 852942 - RNA, 22 nt, Human
gaggcagccucaguggaccucg

SEQ ID NO: 852943 - RNA, 22 nt, Human
ccccugccagcuaucccugaac

SEQ ID NO: 852944 - RNA, 22 nt, Human
gagaggugaauguggaugccac

SEQ ID NO: 852945 - RNA, 22 nt, Human
aggaggcacucacucucagggu

SEQ ID NO: 852946 - RNA, 22 nt, Human
uugauuaaacaggcauauucaa

SEQ ID NO: 852947 - RNA, 22 nt, Human
uucuucaaacaaaaguggcaug

SEQ ID NO: 852948 - RNA, 22 nt, Human
cuacccaggcuggagugcagua

SEQ ID NO: 852949 - RNA, 22 nt, Human
auccaugaagguacuucucagg

SEQ ID NO: 852950 - RNA, 22 nt, Human
gaggagagggcugcgggcccac

SEQ ID NO: 852951 - RNA, 22 nt, Human
aaggcugagggcuguaccuggc

SEQ ID NO: 852952 - RNA, 22 nt, Human
agcggcugcucuuuucagaucc

SEQ ID NO: 852953 - RNA, 22 nt, Human
cagcugccccuccagggcuggg

SEQ ID NO: 852954 - RNA, 22 nt, Human
gcugagucagauugcagucuug

SEQ ID NO: 852955 - RNA, 22 nt, Human
gucugagcgcuggagcuugugu

SEQ ID NO: 852956 - RNA, 22 nt, Human
agauauauuuccugcccaaggc

SEQ ID NO: 852957 - RNA, 22 nt, Human
aagcuggcaugucaccugagaa

SEQ ID NO: 852958 - RNA, 22 nt, Human
aggcagaucacuugaggccagg

SEQ ID NO: 852959 - RNA, 22 nt, Human
ucugggaacugagcuccccuag

SEQ ID NO: 852960 - RNA, 22 nt, Human
caggcagcucugcuuuuccuaa

SEQ ID NO: 852961 - RNA, 22 nt, Human
guaacucuggguagaacucaug

SEQ ID NO: 852962 - RNA, 18 nt, Human
aauuuccauaugaauugc

SEQ ID NO: 852963 - RNA, 23 nt, Human
cagcccuuccugcauguuuuugu

SEQ ID NO: 852964 - RNA, 22 nt, Human
gcuccucuauuccccacauuuu

SEQ ID NO: 852965 - RNA, 22 nt, Human
uaagcugugggagauuggcaua

SEQ ID NO: 852966 - RNA, 22 nt, Human
gagggagucugugcaaagaauu

SEQ ID NO: 852967 - RNA, 22 nt, Human
ggagcuguuggcagcuaucuug

SEQ ID NO: 852968 - RNA, 17 nt, Human
cuccuggccaccccucu

SEQ ID NO: 852969 - RNA, 22 nt, Human
uucacauuggugauauguuucu

SEQ ID NO: 852970 - RNA, 23 nt, Human
cagagcuggcucagagcugccug

SEQ ID NO: 852971 - RNA, 22 nt, Human
gaaauccaguucccuacucuua

SEQ ID NO: 852972 - RNA, 22 nt, Human
uguuggcaucucugagagaguu

SEQ ID NO: 852973 - RNA, 22 nt, Human
uucuuuggugggagauugaggu

SEQ ID NO: 852974 - RNA, 22 nt, Human
uuucagcugguaaaggaguagc

SEQ ID NO: 852975 - RNA, 22 nt, Human
ggcagcaucucuggcagcagcu

SEQ ID NO: 852976 - RNA, 22 nt, Human
ucaggauguccaaaauccagcc

SEQ ID NO: 852977 - RNA, 22 nt, Human
aagggcugaucucacuuucuuu

SEQ ID NO: 852978 - RNA, 22 nt, Human
gcagacagggcuacagagguac

SEQ ID NO: 852979 - RNA, 22 nt, Human
gauuuggccuuucgcaugguau

SEQ ID NO: 852980 - RNA, 22 nt, Human
ugccuggcaccccagucugcac

SEQ ID NO: 852981 - RNA, 22 nt, Human
ccacaguacaggaaaucuuguu

SEQ ID NO: 852982 - RNA, 22 nt, Human
gucaggaucucccaguacauau

SEQ ID NO: 852983 - RNA, 22 nt, Human
guugaaagaugucuugguuccc

SEQ ID NO: 852984 - RNA, 22 nt, Human
gcugagcacaccuaggguagag

SEQ ID NO: 852985 - RNA, 20 nt, Human
ugaggcccagcagagucggg

SEQ ID NO: 852986 - RNA, 22 nt, Human
uuucaugaggggcaaaaucuca

SEQ ID NO: 852987 - RNA, 22 nt, Human
cccaggagagaggggauaaagc

SEQ ID NO: 852988 - RNA, 22 nt, Human
ccuggccaguuuccaggcccug

SEQ ID NO: 852989 - RNA, 22 nt, Human
cagcaacugugccugacacaca

SEQ ID NO: 852990 - RNA, 22 nt, Human
gggcugaggcuaccacuggucu

SEQ ID NO: 852991 - RNA, 22 nt, Human
gagggcuguggggcaugaccag

SEQ ID NO: 852992 - RNA, 22 nt, Human
aagaagagaaaugugcugcugg

SEQ ID NO: 852993 - RNA, 21 nt, Human
aaauacugggcagugacuuga

SEQ ID NO: 852994 - RNA, 22 nt, Human
ucacagaaggaccuuguuucau

SEQ ID NO: 852995 - RNA, 22 nt, Human
ugggucagaaucagagaguugc

SEQ ID NO: 852996 - RNA, 23 nt, Human
aucuaauuucuccaaaucucuac

SEQ ID NO: 852997 - RNA, 22 nt, Human
ggccugagucccaccuggcugu

SEQ ID NO: 852998 - RNA, 22 nt, Human
ucacagaacaauguuuaguucu

SEQ ID NO: 852999 - RNA, 22 nt, Human
uggaguucucaggugagggcuu

SEQ ID NO: 853000 - RNA, 22 nt, Human
ucugggaagcugguccuguucu

SEQ ID NO: 853001 - RNA, 21 nt, Human
agccuguugguuuacugcuca

SEQ ID NO: 853002 - RNA, 22 nt, Human
ggaggaggggugacugaaugcu

SEQ ID NO: 853003 - RNA, 22 nt, Human
cugggccaucuccuuugugugg

SEQ ID NO: 853004 - RNA, 22 nt, Human
uuacacuuaggguuugucagag

SEQ ID NO: 853005 - RNA, 20 nt, Human
agggcagcuugaggagccgg

SEQ ID NO: 853006 - RNA, 22 nt, Human
auaagguauaaggccuauuuuu

SEQ ID NO: 853007 - RNA, 22 nt, Human
cccuggugguacggcacuggca

SEQ ID NO: 853008 - RNA, 22 nt, Human
aucugccugcaguggagguggg

SEQ ID NO: 853009 - RNA, 22 nt, Human
aaaaugaugcuguaauuuggca

SEQ ID NO: 853010 - RNA, 22 nt, Human
cuggagagagaaaaagccuuaa

SEQ ID NO: 853011 - RNA, 22 nt, Human
ucccaggagcaccuuuugagcc

SEQ ID NO: 853012 - RNA, 19 nt, Human
ccuggcugugaagccugca

SEQ ID NO: 853013 - RNA, 22 nt, Human
cagagagggagcaguagucucu

SEQ ID NO: 853014 - RNA, 22 nt, Human
caggcagcagccacucugguau

SEQ ID NO: 853015 - RNA, 22 nt, Human
agugcuuucccugaaaccuucc

SEQ ID NO: 853016 - RNA, 22 nt, Human
gcagacaucaagcacaggccca

SEQ ID NO: 853017 - RNA, 21 nt, Human
aaauacagaaacuuguuuuca

SEQ ID NO: 853018 - RNA, 22 nt, Human
agggagcuaggauccugaaggu

SEQ ID NO: 853019 - RNA, 22 nt, Human
ugucuucagcaaaugccuuucu

SEQ ID NO: 853020 - RNA, 22 nt, Human
uuuuagauaguuuaacugcacu

SEQ ID NO: 853021 - RNA, 22 nt, Human
cugaggcugggcauggggucca

SEQ ID NO: 853022 - RNA, 22 nt, Human
cugaaaauguuacacaggaaga

SEQ ID NO: 853023 - RNA, 22 nt, Human
ccaggagaugggaaaguagcag

SEQ ID NO: 853024 - RNA, 20 nt, Human
ugacuucugggauuuguggu

SEQ ID NO: 853025 - RNA, 22 nt, Human
gcugagguggugaugguucauc

SEQ ID NO: 853026 - RNA, 22 nt, Human
uggagacugugcuaagggaguu

SEQ ID NO: 853027 - RNA, 22 nt, Human
gggucccuggaauuacuugaca

SEQ ID NO: 853028 - RNA, 22 nt, Human
ccacaguccgggcuggcaggac

SEQ ID NO: 853029 - RNA, 22 nt, Human
cagagcuguugcggggcuuggc

SEQ ID NO: 853030 - RNA, 22 nt, Human
cuuaagaugaggucaugcuaua

SEQ ID NO: 853031 - RNA, 22 nt, Human
uaauauaccaaacuguaauuuu

SEQ ID NO: 853032 - RNA, 22 nt, Human
ggcuuuagggcaggcaguguua

SEQ ID NO: 853033 - RNA, 22 nt, Human
uaggcugggcugagcuggacgg

SEQ ID NO: 853034 - RNA, 22 nt, Human
caggaugaagggcaaaggcaag

SEQ ID NO: 853035 - RNA, 22 nt, Human
accaggaggcuacacuguccca

SEQ ID NO: 853036 - RNA, 22 nt, Human
gagggcuccucacauucucuau

SEQ ID NO: 853037 - RNA, 22 nt, Human
accuuauuaaaaugaugaugua

SEQ ID NO: 853038 - RNA, 22 nt, Human
agcagacauaucucaugucaca

SEQ ID NO: 853039 - RNA, 22 nt, Human
caggcugagcucuggccugggc

SEQ ID NO: 853040 - RNA, 22 nt, Human
ggagaaaggcauagcagaaccu

SEQ ID NO: 853041 - RNA, 22 nt, Human
uuggcagauuugucaguaagcu

SEQ ID NO: 853042 - RNA, 22 nt, Human
ugcugagguuucugacuaugga

SEQ ID NO: 853043 - RNA, 22 nt, Human
ugaugaaacugagguuccaaga

SEQ ID NO: 853044 - RNA, 22 nt, Human
uugaaaguuaucuagauucuga

SEQ ID NO: 853045 - RNA, 22 nt, Human
cugaggcucagcgugaggaaag

SEQ ID NO: 853046 - RNA, 22 nt, Human
cacagauaaggauguuaauuuu

SEQ ID NO: 853047 - RNA, 19 nt, Human
cuugcugggugguuucugc

SEQ ID NO: 853048 - RNA, 22 nt, Human
acuccugggugcauuucugauu

SEQ ID NO: 853049 - RNA, 17 nt, Human
ggcagccucaggcguuu

SEQ ID NO: 853050 - RNA, 22 nt, Human
aaaggccaagcaugagguggac

SEQ ID NO: 853051 - RNA, 22 nt, Human
cucccuggugacucccaaagcu

SEQ ID NO: 853052 - RNA, 22 nt, Human
uaaggccaaggggccauagucu

SEQ ID NO: 853053 - RNA, 22 nt, Human
uuagaaagcuuuccauagucaa

SEQ ID NO: 853054 - RNA, 22 nt, Human
guaaaauagaauaacguggcua

SEQ ID NO: 853055 - RNA, 22 nt, Human
caaauacuuacugaaccugugc

SEQ ID NO: 853056 - RNA, 21 nt, Human
ugcuggaaaaagugguucuag

SEQ ID NO: 853057 - RNA, 22 nt, Human
gcaacuguuuugagcacccagu

SEQ ID NO: 853058 - RNA, 22 nt, Human
gccugcagaacugugaggcaau

SEQ ID NO: 853059 - RNA, 22 nt, Human
aucaggauguuuggcugucaua

SEQ ID NO: 853060 - RNA, 22 nt, Human
cuucuaauucuuauguaagcuu

SEQ ID NO: 853061 - RNA, 22 nt, Human
gaggcagagaccuucaggaccu

SEQ ID NO: 853062 - RNA, 22 nt, Human
uaguacaguggagagcaaagaa

SEQ ID NO: 853063 - RNA, 22 nt, Human
ccugggauuuccugagcacucu

SEQ ID NO: 853064 - RNA, 17 nt, Human
aaggccauuuccaccca

SEQ ID NO: 853065 - RNA, 22 nt, Human
agcugaggguucgguguccaca

SEQ ID NO: 853066 - RNA, 22 nt, Human
auuagggaaggauuuggccuga

SEQ ID NO: 853067 - RNA, 22 nt, Human
ucuuccucuagaucugaggccc

SEQ ID NO: 853068 - RNA, 22 nt, Human
ccuccuggggugaaggauggga

SEQ ID NO: 853069 - RNA, 22 nt, Human
ccugggccugaaaacauuucuc

SEQ ID NO: 853070 - RNA, 22 nt, Human
auggaguucuuuaaauucacag

SEQ ID NO: 853071 - RNA, 22 nt, Human
uuauuagagauauuugguuagg

SEQ ID NO: 853072 - RNA, 23 nt, Human
ccuggcagcaaacgaggagguua

SEQ ID NO: 853073 - RNA, 19 nt, Human
uggcaucuguaaaauggug

SEQ ID NO: 853074 - RNA, 22 nt, Human
cugcauuagucaugcuuugcag

SEQ ID NO: 853075 - RNA, 22 nt, Human
aguuguaagagacagauauaaa

SEQ ID NO: 853076 - RNA, 22 nt, Human
aggucacccguuugacuaucca

SEQ ID NO: 853077 - RNA, 22 nt, Human
auguuucaccaguuuuauaaga

SEQ ID NO: 853078 - RNA, 22 nt, Human
uuaguuuucccaucuuuauggu

SEQ ID NO: 853079 - RNA, 22 nt, Human
caaauacuuuuagccuauugag

SEQ ID NO: 853080 - RNA, 22 nt, Human
uggggcuccuccuggcaggagg

SEQ ID NO: 853081 - RNA, 22 nt, Human
uuuaggauauuaauguucagag

SEQ ID NO: 853082 - RNA, 22 nt, Human
ucauuuguucaucugcucuucu

SEQ ID NO: 853083 - RNA, 22 nt, Human
aaaggaagaugccaggacucug

SEQ ID NO: 853084 - RNA, 22 nt, Human
ucugcagggaugugagggguga

SEQ ID NO: 853085 - RNA, 18 nt, Human
ucaggcugcccugugucu

SEQ ID NO: 853086 - RNA, 22 nt, Human
uucagggagagcgggacgggug

SEQ ID NO: 853087 - RNA, 22 nt, Human
gauuaggacauggauguauguu

SEQ ID NO: 853088 - RNA, 22 nt, Human
agaaaugaaaccaaagccuaga

SEQ ID NO: 853089 - RNA, 22 nt, Human
ucugaagccuuuguacaggccu

SEQ ID NO: 853090 - RNA, 23 nt, Human
gauacacucccugcugggcacug

SEQ ID NO: 853091 - RNA, 22 nt, Human
agugcugagugauugcaaagga

SEQ ID NO: 853092 - RNA, 19 nt, Human
acccagagcccuuugcagg

SEQ ID NO: 853093 - RNA, 22 nt, Human
uccaggagaccagauguaggcc

SEQ ID NO: 853094 - RNA, 22 nt, Human
uuaaagggccgauuuccaggcc

SEQ ID NO: 853095 - RNA, 22 nt, Human
uccauuuuucaugacuccucaa

SEQ ID NO: 853096 - RNA, 22 nt, Human
ucagagagugcaaaauauagcu

SEQ ID NO: 853097 - RNA, 22 nt, Human
accuuauuuugaaauagauugu

SEQ ID NO: 853098 - RNA, 22 nt, Human
cuauuagguaugugguugcuau

SEQ ID NO: 853099 - RNA, 22 nt, Human
aggcagcugugaggacuggauu

SEQ ID NO: 853100 - RNA, 22 nt, Human
aaaggaagauugagcuuuucca

SEQ ID NO: 853101 - RNA, 22 nt, Human
gauacacuggccaaguggagga

SEQ ID NO: 853102 - RNA, 22 nt, Human
uggcagcugaauggcuggaugg

SEQ ID NO: 853103 - RNA, 22 nt, Human
gguggcaccuugaucuuggacu

SEQ ID NO: 853104 - RNA, 22 nt, Human
uggaggccuagguugaugugug

SEQ ID NO: 853105 - RNA, 22 nt, Human
ugaggcagucacccccuccugc

SEQ ID NO: 853106 - RNA, 22 nt, Human
uuccuggcauagagagggcaca

SEQ ID NO: 853107 - RNA, 22 nt, Human
aaaauugaagugaucaggaacu

SEQ ID NO: 853108 - RNA, 22 nt, Human
uucaucaauguguuuaauaaug

SEQ ID NO: 853109 - RNA, 22 nt, Human
caugugcuguagcagagaggaa

SEQ ID NO: 853110 - RNA, 22 nt, Human
acaucugacaugaucuucagua

SEQ ID NO: 853111 - RNA, 22 nt, Human
ccaggcuggauuuugcaguuca

SEQ ID NO: 853112 - RNA, 20 nt, Human
cccagugaagcauggaagag

SEQ ID NO: 853113 - RNA, 22 nt, Human
aaggcagcaggauuuggugacu

SEQ ID NO: 853114 - RNA, 22 nt, Human
uggcugagaccuucccaaauuc

SEQ ID NO: 853115 - RNA, 22 nt, Human
agcaagauuuuccuugaauguu

SEQ ID NO: 853116 - RNA, 22 nt, Human
uucuucuucuggcugcaccugg

SEQ ID NO: 853117 - RNA, 22 nt, Human
uugacuucagccuguacuugua

SEQ ID NO: 853118 - RNA, 21 nt, Human
cgcagagcgaacuugcggcgc

SEQ ID NO: 853119 - RNA, 22 nt, Human
agaugcugccaggccccucagu

SEQ ID NO: 853120 - RNA, 19 nt, Human
ucucugcuucucuuggcau

SEQ ID NO: 853121 - RNA, 21 nt, Human
gauguuggaggcuggggucug

SEQ ID NO: 853122 - RNA, 22 nt, Human
agcccaggaaucugcaucuuga

SEQ ID NO: 853123 - RNA, 22 nt, Human
guggccaagggacucuaaggca

SEQ ID NO: 853124 - RNA, 22 nt, Human
cuccugggcucauaucauucag

SEQ ID NO: 853125 - RNA, 22 nt, Human
uauuaugagguauuuggacuuu

SEQ ID NO: 853126 - RNA, 17 nt, Human
ucauuuguugugacuag

SEQ ID NO: 853127 - RNA, 22 nt, Human
agacagcuaauaaaugagugug

SEQ ID NO: 853128 - RNA, 22 nt, Human
agcccaggaaguugaggcuugc

SEQ ID NO: 853129 - RNA, 22 nt, Human
ugaaggcuugacugaggcagga

SEQ ID NO: 853130 - RNA, 22 nt, Human
uuuagagcaggguguggcacau

SEQ ID NO: 853131 - RNA, 22 nt, Human
ggcugaggcggcgaugcccuug

SEQ ID NO: 853132 - RNA, 22 nt, Human
uuuagagcugugcugccacaug

SEQ ID NO: 853133 - RNA, 22 nt, Human
gugcauuugugcaugcacaugu

SEQ ID NO: 853134 - RNA, 22 nt, Human
aguggacucuucccagugcuug

SEQ ID NO: 853135 - RNA, 22 nt, Human
uacauguauguguuaauaucug

SEQ ID NO: 853136 - RNA, 22 nt, Human
gaaggccauuagagccugugcc

SEQ ID NO: 853137 - RNA, 22 nt, Human
ugaaggccagcucuuuaucagc

SEQ ID NO: 853138 - RNA, 22 nt, Human
auuucucuuagcaagacauuac

SEQ ID NO: 853139 - RNA, 22 nt, Human
cuaaauuaucaugagaauuaug

SEQ ID NO: 853140 - RNA, 22 nt, Human
ggauggagguucucagaugcuc

SEQ ID NO: 853141 - RNA, 22 nt, Human
uguccccagagccuguuccugc

SEQ ID NO: 853142 - RNA, 22 nt, Human
cccaggauggggcugcaguuau

SEQ ID NO: 853143 - RNA, 22 nt, Human
cagggcugucuccaaaggcccc

SEQ ID NO: 853144 - RNA, 22 nt, Human
cacugagcugauagaauuccag

SEQ ID NO: 853145 - RNA, 22 nt, Human
aucacauugccagugauuaccc

SEQ ID NO: 853146 - RNA, 22 nt, Human
ucuacagacagagcagguggga

SEQ ID NO: 853147 - RNA, 22 nt, Human
agaggacagguuuuccaugggc

SEQ ID NO: 853148 - RNA, 21 nt, Human
auugaaagucaacaaucaguu

SEQ ID NO: 853149 - RNA, 22 nt, Human
ggcagcuuguccuggaggaugg

SEQ ID NO: 853150 - RNA, 21 nt, Human
gacaaagugaagcaggcagga

SEQ ID NO: 853151 - RNA, 22 nt, Human
uggaaggaagccaaggaagguu

SEQ ID NO: 853152 - RNA, 21 nt, Human
ucugagagcaacugcccuuua

SEQ ID NO: 853153 - RNA, 22 nt, Human
uugaaaguagcagcugcauaug

SEQ ID NO: 853154 - RNA, 22 nt, Human
uccaggaggcucugguugacgu

SEQ ID NO: 853155 - RNA, 22 nt, Human
augcuguggaaguuccugaagc

SEQ ID NO: 853156 - RNA, 22 nt, Human
uggcugagaccaucagggugua

SEQ ID NO: 853157 - RNA, 19 nt, Human
cauuuuaagcauccccagu

SEQ ID NO: 853158 - RNA, 22 nt, Human
aaaacuccugaaauuguuuccc

SEQ ID NO: 853159 - RNA, 22 nt, Human
cuucucagcaugguuacuguga

SEQ ID NO: 853160 - RNA, 22 nt, Human
gaggagaggccaucguuguuau

SEQ ID NO: 853161 - RNA, 22 nt, Human
uggcaugaagucagcagcuggg

SEQ ID NO: 853162 - RNA, 21 nt, Human
ccugagugagaccuggcccgu

SEQ ID NO: 853163 - RNA, 22 nt, Human
cagguugggcugcgaggaggag

SEQ ID NO: 853164 - RNA, 22 nt, Human
ggcugagaggacgucgggcuca

SEQ ID NO: 853165 - RNA, 22 nt, Human
aggcugagucaaguuaggguga

SEQ ID NO: 853166 - RNA, 22 nt, Human
agccuuguuggucugaguuugg

SEQ ID NO: 853167 - RNA, 22 nt, Human
gcccaggaaguugaggcugccg

SEQ ID NO: 853168 - RNA, 22 nt, Human
guaagauuuaaaauagcaauug

SEQ ID NO: 853169 - RNA, 18 nt, Human
gcuccuggaccaggucac

SEQ ID NO: 853170 - RNA, 22 nt, Human
augaggcaguacacacaaagcc

SEQ ID NO: 853171 - RNA, 22 nt, Human
gaugccuccaaaugagggcaga

SEQ ID NO: 853172 - RNA, 22 nt, Human
aggcagcccacaggacacagga

SEQ ID NO: 853173 - RNA, 22 nt, Human
uaggcugaaaggagaggugaag

SEQ ID NO: 853174 - RNA, 22 nt, Human
ucagagaguuagugucuuagcu

SEQ ID NO: 853175 - RNA, 22 nt, Human
uuucauggcuaggacuagagug

SEQ ID NO: 853176 - RNA, 22 nt, Human
cacugucuuuugugaagacaau

SEQ ID NO: 853177 - RNA, 22 nt, Human
cccaggaaacccgaaggcgacc

SEQ ID NO: 853178 - RNA, 22 nt, Human
ccuucuucuguguggcccaaga

SEQ ID NO: 853179 - RNA, 22 nt, Human
agagugcaaccgaaacaagcag

SEQ ID NO: 853180 - RNA, 22 nt, Human
uguuagcagagcagcugacaga

SEQ ID NO: 853181 - RNA, 22 nt, Human
uaggcugacuuguuucauaaag

SEQ ID NO: 853182 - RNA, 22 nt, Human
cuucucaaaguugugaaucagg

SEQ ID NO: 853183 - RNA, 22 nt, Human
gaccuuuuuacuguguacgcug

SEQ ID NO: 853184 - RNA, 21 nt, Human
caucuuagguuguacauauau

SEQ ID NO: 853185 - RNA, 22 nt, Human
ucugggaguuagaauacauggg

SEQ ID NO: 853186 - RNA, 22 nt, Human
uuuugcuugagugcacaaaaug

SEQ ID NO: 853187 - RNA, 22 nt, Human
uaacugguuucauaucauuucc

SEQ ID NO: 853188 - RNA, 22 nt, Human
gagaggggcgcgcagcucgcga

SEQ ID NO: 853189 - RNA, 22 nt, Human
agcuggaagcugaugagcacag

SEQ ID NO: 853190 - RNA, 22 nt, Human
caaaugauacuguuuuuagucu

SEQ ID NO: 853191 - RNA, 22 nt, Human
uuauuagagugcuuugagaaag

SEQ ID NO: 853192 - RNA, 22 nt, Human
uucuacaugguugcucagaggg

SEQ ID NO: 853193 - RNA, 22 nt, Human
uagaaagagcuuugcuuccuuu

SEQ ID NO: 853194 - RNA, 22 nt, Human
uuauggaaaauacaauuauaag

SEQ ID NO: 853195 - RNA, 22 nt, Human
aagggcugaaagaccuugggca

SEQ ID NO: 853196 - RNA, 22 nt, Human
ggacagaggguugacagaguau

SEQ ID NO: 853197 - RNA, 22 nt, Human
gagugcagaugaacagaagauu

SEQ ID NO: 853198 - RNA, 22 nt, Human
aggagaggguggcauuaaguuu

SEQ ID NO: 853199 - RNA, 22 nt, Human
uggcagcugucagaaugcaaau

SEQ ID NO: 853200 - RNA, 22 nt, Human
acauucuuaacaguuaaaaacu

SEQ ID NO: 853201 - RNA, 22 nt, Human
ucugagcccucuuuugcagccc

SEQ ID NO: 853202 - RNA, 22 nt, Human
uaaggccagcaugaaugcagca

SEQ ID NO: 853203 - RNA, 22 nt, Human
uggaggaaguugcuggaaguca

SEQ ID NO: 853204 - RNA, 22 nt, Human
uaacugccagcagcgaugaaca

SEQ ID NO: 853205 - RNA, 22 nt, Human
uggcugaggucuggggcuucug

SEQ ID NO: 853206 - RNA, 22 nt, Human
cugugcacuucucuuuauuugu

SEQ ID NO: 853207 - RNA, 22 nt, Human
uuauacaguuuauacuuagaau

SEQ ID NO: 853208 - RNA, 22 nt, Human
aagccgaggccacacagcagga

SEQ ID NO: 853209 - RNA, 22 nt, Human
aggacagcaguuggugagguuc

SEQ ID NO: 853210 - RNA, 17 nt, Human
uagcuguguuucagcua

SEQ ID NO: 853211 - RNA, 22 nt, Human
ucccugccaguccuggucugaa

SEQ ID NO: 853212 - RNA, 22 nt, Human
gaggggagacagggaaaucagu

SEQ ID NO: 853213 - RNA, 22 nt, Human
ggcuuggaccagucacaguggu

SEQ ID NO: 853214 - RNA, 22 nt, Human
uuuaggaucaaugagaaagucu

SEQ ID NO: 853215 - RNA, 22 nt, Human
uucuagaugcuuauaggcauau

SEQ ID NO: 853216 - RNA, 22 nt, Human
uuggccaaagcucaccagugcu

SEQ ID NO: 853217 - RNA, 22 nt, Human
gaaauacagaaagggcugaaug

SEQ ID NO: 853218 - RNA, 22 nt, Human
gcugguuuccuuaucuauaaag

SEQ ID NO: 853219 - RNA, 22 nt, Human
uggcuucucuguuuuaguauuu

SEQ ID NO: 853220 - RNA, 22 nt, Human
gcccaggaaauaaaagugggcu

SEQ ID NO: 853221 - RNA, 22 nt, Human
ccugcuguaaugugucuuuauu

SEQ ID NO: 853222 - RNA, 22 nt, Human
acaggcugcugagccauuugcu

SEQ ID NO: 853223 - RNA, 22 nt, Human
aacaugaaaaccuccacagcaa

SEQ ID NO: 853224 - RNA, 22 nt, Human
uaggcagaaaggaaggcaaguu

SEQ ID NO: 853225 - RNA, 22 nt, Human
gaggcagcuuggggcugugggu

SEQ ID NO: 853226 - RNA, 22 nt, Human
uuauucuuuucuccagaauccc

SEQ ID NO: 853227 - RNA, 22 nt, Human
uucagaaguagcuaagcaguca

SEQ ID NO: 853228 - RNA, 22 nt, Human
aggagggagaugcccauccugg

SEQ ID NO: 853229 - RNA, 22 nt, Human
gcuuggcauugaccauuaucau

SEQ ID NO: 853230 - RNA, 22 nt, Human
gccucugcccuccugggacugc

SEQ ID NO: 853231 - RNA, 22 nt, Human
uucaauucaauucuaaauauau

SEQ ID NO: 853232 - RNA, 22 nt, Human
cugccaggcgauggauuggcug

SEQ ID NO: 853233 - RNA, 22 nt, Human
aucaggaugaagcuguagcgaa

SEQ ID NO: 853234 - RNA, 22 nt, Human
ggcaggcucagcagccaaggag

SEQ ID NO: 853235 - RNA, 22 nt, Human
gcuggaggauggacuggaagaa

SEQ ID NO: 853236 - RNA, 22 nt, Human
ucccaggaggugcuuccuagga

SEQ ID NO: 853237 - RNA, 22 nt, Human
aggcaacuuuuggggaugaugg

SEQ ID NO: 853238 - RNA, 22 nt, Human
uagcacauacauaauagauaga

SEQ ID NO: 853239 - RNA, 22 nt, Human
uuaaauuagucaagcuucucug

SEQ ID NO: 853240 - RNA, 22 nt, Human
cugagacuuucaugugcuuuua

SEQ ID NO: 853241 - RNA, 23 nt, Human
ucucuuucaagagcuuaaugugc

SEQ ID NO: 853242 - RNA, 19 nt, Human
augucuggguaacagcugc

SEQ ID NO: 853243 - RNA, 22 nt, Human
aaaguauucuugacuguuuuuc

SEQ ID NO: 853244 - RNA, 22 nt, Human
uggcucagcgcggccuggucuu

SEQ ID NO: 853245 - RNA, 22 nt, Human
uccaugagaacccuuggagaua

SEQ ID NO: 853246 - RNA, 22 nt, Human
gugguaaucggauucuuaccgg

SEQ ID NO: 853247 - RNA, 22 nt, Human
ggccaaaccgcaauuauuuuug

SEQ ID NO: 853248 - RNA, 22 nt, Human
uccaggagucuagccucaggcc

SEQ ID NO: 853249 - RNA, 22 nt, Human
cagcugaguuuccaagucugcc

SEQ ID NO: 853250 - RNA, 22 nt, Human
ugaggggagaagcagcagccug

SEQ ID NO: 853251 - RNA, 22 nt, Human
ccucacugaagaggugacauuu

SEQ ID NO: 853252 - RNA, 20 nt, Human
cugccgaccacagccaugga

SEQ ID NO: 853253 - RNA, 22 nt, Human
ggcagccaggaggguguaguuu

SEQ ID NO: 853254 - RNA, 22 nt, Human
ggcugcugaguuggccaggaga

SEQ ID NO: 853255 - RNA, 22 nt, Human
uuaacauacaucaugaacaaug

SEQ ID NO: 853256 - RNA, 22 nt, Human
guuacacagcuaagcuucuccu

SEQ ID NO: 853257 - RNA, 23 nt, Human
uccaggagaaccccugucugucc

SEQ ID NO: 853258 - RNA, 22 nt, Human
uuucuucauucaccuucacccc

SEQ ID NO: 853259 - RNA, 18 nt, Human
ggagcccagaggugaguu

SEQ ID NO: 853260 - RNA, 22 nt, Human
ucucaguuuccucauauguaaa

SEQ ID NO: 853261 - RNA, 22 nt, Human
aaggcugaggagggccugcagg

SEQ ID NO: 853262 - RNA, 22 nt, Human
ucuucuuccucauuuauacaua

SEQ ID NO: 853263 - RNA, 22 nt, Human
gggucugaggaguaccauuguc

SEQ ID NO: 853264 - RNA, 22 nt, Human
ugaaagggguugaguuacagcu

SEQ ID NO: 853265 - RNA, 22 nt, Human
cagcugacccgugggaggcggg

SEQ ID NO: 853266 - RNA, 22 nt, Human
cacuggugaguccagaagucau

SEQ ID NO: 853267 - RNA, 22 nt, Human
cuuuggcaaggguuuuaauugu

SEQ ID NO: 853268 - RNA, 22 nt, Human
uaugccugauaacugugucucu

SEQ ID NO: 853269 - RNA, 22 nt, Human
gcuggccauggggagugaggag

SEQ ID NO: 853270 - RNA, 22 nt, Human
auacacauauguguguauaugu

SEQ ID NO: 853271 - RNA, 22 nt, Human
ccugcugugaccggggagcagg

SEQ ID NO: 853272 - RNA, 20 nt, Human
agaaaaaguguggaaauuuc

SEQ ID NO: 853273 - RNA, 22 nt, Human
aggcaguggcugagaccagggg

SEQ ID NO: 853274 - RNA, 22 nt, Human
caagauggagaagcagcaaggg

SEQ ID NO: 853275 - RNA, 22 nt, Human
uucucagauauuuacugagcau

SEQ ID NO: 853276 - RNA, 22 nt, Human
aggcagcagugauaagauagga

SEQ ID NO: 853277 - RNA, 22 nt, Human
gaguagcagccacagaggaccc

SEQ ID NO: 853278 - RNA, 22 nt, Human
aaaggccaauaaagacaagcug

SEQ ID NO: 853279 - RNA, 23 nt, Human
cauggcugauuucaagcuaccac

SEQ ID NO: 853280 - RNA, 22 nt, Human
gagugcagaugccagccccagu

SEQ ID NO: 853281 - RNA, 23 nt, Human
cagggcugggcuugguguuaggc

SEQ ID NO: 853282 - RNA, 22 nt, Human
ugugcucuggaguugccuucac

SEQ ID NO: 853283 - RNA, 22 nt, Human
gcauguguugguuuaugcaugu

SEQ ID NO: 853284 - RNA, 22 nt, Human
cugcugugagcacuccagccug

SEQ ID NO: 853285 - RNA, 22 nt, Human
agcugcaggcccaugcucaguc

SEQ ID NO: 853286 - RNA, 19 nt, Human
agccuggcuuugcucugcu

SEQ ID NO: 853287 - RNA, 19 nt, Human
agggccugagcagauguug

SEQ ID NO: 853288 - RNA, 22 nt, Human
ucaggcugaaggaggccuaucu

SEQ ID NO: 853289 - RNA, 22 nt, Human
uggcugaguuucaugcaucaug

SEQ ID NO: 853290 - RNA, 22 nt, Human
uccaggaguccugggagugauu

SEQ ID NO: 853291 - RNA, 22 nt, Human
guauaagguauguaaacuauuu

SEQ ID NO: 853292 - RNA, 22 nt, Human
acagugaggacagggacugugu

SEQ ID NO: 853293 - RNA, 22 nt, Human
ggagagaauuccauggacaugu

SEQ ID NO: 853294 - RNA, 22 nt, Human
uuuaggauaacuccaguuuucc

SEQ ID NO: 853295 - RNA, 22 nt, Human
acugccucuuggugcugagaga

SEQ ID NO: 853296 - RNA, 22 nt, Human
ucauuuguggaagugauugugg

SEQ ID NO: 853297 - RNA, 22 nt, Human
uaugauuuguagacauuugauu

SEQ ID NO: 853298 - RNA, 22 nt, Human
auacacuuguacauuuuuuaau

SEQ ID NO: 853299 - RNA, 22 nt, Human
auuucauugaaguuaauucuuc

SEQ ID NO: 853300 - RNA, 22 nt, Human
uccugccuugccugggacauca

SEQ ID NO: 853301 - RNA, 22 nt, Human
auuaggaaacugaaugucagaa

SEQ ID NO: 853302 - RNA, 22 nt, Human
ucugaagccaccucugcuuguc

SEQ ID NO: 853303 - RNA, 22 nt, Human
uguguuauugccacugaagacc

SEQ ID NO: 853304 - RNA, 22 nt, Human
acuucaugcagaagagagcugu

SEQ ID NO: 853305 - RNA, 22 nt, Human
gaacugguuacagagggauguu

SEQ ID NO: 853306 - RNA, 22 nt, Human
uccaggaguccuggguggcccc

SEQ ID NO: 853307 - RNA, 22 nt, Human
uagugcagaggaggagccucug

SEQ ID NO: 853308 - RNA, 22 nt, Human
gcugccuuaugucuauuaguau

SEQ ID NO: 853309 - RNA, 19 nt, Human
ugcauaaauuauauacuuu

SEQ ID NO: 853310 - RNA, 22 nt, Human
gacuccuggcuuucccucuuag

SEQ ID NO: 853311 - RNA, 22 nt, Human
cucaggauuuacuaauuucaag

SEQ ID NO: 853312 - RNA, 22 nt, Human
gcccugagccuaugagccucuc

SEQ ID NO: 853313 - RNA, 22 nt, Human
aacaaaugaccugauuucuucc

SEQ ID NO: 853314 - RNA, 22 nt, Human
accuguuuuccuaucuagauug

SEQ ID NO: 853315 - RNA, 22 nt, Human
auuuggaagcuugaagauuauu

SEQ ID NO: 853316 - RNA, 22 nt, Human
agggcagccauugagggauucu

SEQ ID NO: 853317 - RNA, 22 nt, Human
gcagacauuuugaaucuaggcu

SEQ ID NO: 853318 - RNA, 21 nt, Human
agggagcuggccacacagccu

SEQ ID NO: 853319 - RNA, 22 nt, Human
agcaccuguugcacuucauaau

SEQ ID NO: 853320 - RNA, 22 nt, Human
agcaccaugaccuugccauuga

SEQ ID NO: 853321 - RNA, 20 nt, Human
ucagaugggagugagccauc

SEQ ID NO: 853322 - RNA, 21 nt, Human
uccugccuuaguccagagcag

SEQ ID NO: 853323 - RNA, 22 nt, Human
aucugccuggcuccaggugagc

SEQ ID NO: 853324 - RNA, 22 nt, Human
ccagagcugagggagccugagc

SEQ ID NO: 853325 - RNA, 22 nt, Human
uccaugucuucaugugucuaac

SEQ ID NO: 853326 - RNA, 17 nt, Human
ggaaaaggaugauacag

SEQ ID NO: 853327 - RNA, 22 nt, Human
uucaggaucaaguugccaguag

SEQ ID NO: 853328 - RNA, 22 nt, Human
acuccugguucccaguugagau

SEQ ID NO: 853329 - RNA, 22 nt, Human
gcugccagcuuuccuuggcuga

SEQ ID NO: 853330 - RNA, 22 nt, Human
ggucuaaaaugagucuuccuag

SEQ ID NO: 853331 - RNA, 22 nt, Human
augguaaccagaagacuaugac

SEQ ID NO: 853332 - RNA, 17 nt, Human
gucauucucagaaaaug

SEQ ID NO: 853333 - RNA, 22 nt, Human
cccaggaggcggagguuguggu

SEQ ID NO: 853334 - RNA, 20 nt, Human
gccaggagggugugaugagc

SEQ ID NO: 853335 - RNA, 22 nt, Human
augcugagugagugaaacccag

SEQ ID NO: 853336 - RNA, 22 nt, Human
uacugccuggagcauuggugcu

SEQ ID NO: 853337 - RNA, 22 nt, Human
agaggccaggcugcagagggau

SEQ ID NO: 853338 - RNA, 22 nt, Human
gcugcugugaauuuuuuaaaug

SEQ ID NO: 853339 - RNA, 22 nt, Human
agcagcauuaugauauaucuua

SEQ ID NO: 853340 - RNA, 22 nt, Human
gcugcagacugggaggcaggug

SEQ ID NO: 853341 - RNA, 22 nt, Human
ccuuuucuaaucuuaagaaugu

SEQ ID NO: 853342 - RNA, 22 nt, Human
ccuucuuaaacaucauuuuggc

SEQ ID NO: 853343 - RNA, 22 nt, Human
uuagccauuaauguccugugca

SEQ ID NO: 853344 - RNA, 22 nt, Human
cugccucucaggucccugagau

SEQ ID NO: 853345 - RNA, 22 nt, Human
caggcugccaaggcuggggagg

SEQ ID NO: 853346 - RNA, 22 nt, Human
caguucuuuguggggaguucuc

SEQ ID NO: 853347 - RNA, 22 nt, Human
uucuaauugaccuuaggcugug

SEQ ID NO: 853348 - RNA, 22 nt, Human
ccaugagccaggcugaggaagc

SEQ ID NO: 853349 - RNA, 22 nt, Human
gcuccuggugcuguagagauuu

SEQ ID NO: 853350 - RNA, 22 nt, Human
ugacaggugcugggggcagugu

SEQ ID NO: 853351 - RNA, 22 nt, Human
uucugggagagaaagggccuug

SEQ ID NO: 853352 - RNA, 20 nt, Human
uugaggucaaggacuaggcc

SEQ ID NO: 853353 - RNA, 22 nt, Human
ggacagguucagcaguuuauaa

SEQ ID NO: 853354 - RNA, 22 nt, Human
cacuggcccauuccugucuggc

SEQ ID NO: 853355 - RNA, 22 nt, Human
ggguacagagagaugagguaac

SEQ ID NO: 853356 - RNA, 22 nt, Human
agcaaaagauagauuaacaaga

SEQ ID NO: 853357 - RNA, 22 nt, Human
uauuauuauaguuauugggaag

SEQ ID NO: 853358 - RNA, 22 nt, Human
uuagauaaagugauguaggcua

SEQ ID NO: 853359 - RNA, 22 nt, Human
aaagcagaacugagagagcugg

SEQ ID NO: 853360 - RNA, 21 nt, Human
aggaggggucuuucccacuga

SEQ ID NO: 853361 - RNA, 22 nt, Human
caaauacucuggauguguuugu

SEQ ID NO: 853362 - RNA, 22 nt, Human
aagggcugcuguagaagcagag

SEQ ID NO: 853363 - RNA, 22 nt, Human
aggucugaguauggccugagaa

SEQ ID NO: 853364 - RNA, 22 nt, Human
uccuuagagacaagaccaguuu

SEQ ID NO: 853365 - RNA, 22 nt, Human
cuuccuucugaagcauagaagc

SEQ ID NO: 853366 - RNA, 20 nt, Human
gcugcucgcugcagucacuc

SEQ ID NO: 853367 - RNA, 22 nt, Human
uuagccauuaaauuacaaggug

SEQ ID NO: 853368 - RNA, 22 nt, Human
uauuuauucauucagcaagcau

SEQ ID NO: 853369 - RNA, 22 nt, Human
aaggcagcacagcaacugcuca

SEQ ID NO: 853370 - RNA, 22 nt, Human
ucuccuggauggaccuucucuu

SEQ ID NO: 853371 - RNA, 22 nt, Human
ccagaccacccuggccaugcac

SEQ ID NO: 853372 - RNA, 22 nt, Human
uacaugaagaaaauuaagcagu

SEQ ID NO: 853373 - RNA, 22 nt, Human
gugagguccauguuaauggguu

SEQ ID NO: 853374 - RNA, 22 nt, Human
cucuucuuauggccguggcuga

SEQ ID NO: 853375 - RNA, 21 nt, Human
gggucugaauaucuggugcug

SEQ ID NO: 853376 - RNA, 22 nt, Human
cuugcacacauguacaugugua

SEQ ID NO: 853377 - RNA, 22 nt, Human
cagcuguguaugagagcaugcu

SEQ ID NO: 853378 - RNA, 22 nt, Human
ccucaggauccgcaggugcagu

SEQ ID NO: 853379 - RNA, 22 nt, Human
aggagaggaaucauuauuacaa

SEQ ID NO: 853380 - RNA, 22 nt, Human
ugcccugguuacacuggagucc

SEQ ID NO: 853381 - RNA, 20 nt, Human
gcucagggccugggucugga

SEQ ID NO: 853382 - RNA, 22 nt, Human
uaggauuuggcuuuagucaggu

SEQ ID NO: 853383 - RNA, 22 nt, Human
agccacaggccaugagauacca

SEQ ID NO: 853384 - RNA, 22 nt, Human
agaccauggccauccuaggaaa

SEQ ID NO: 853385 - RNA, 22 nt, Human
cacugguaguuucagcaaccag

SEQ ID NO: 853386 - RNA, 22 nt, Human
ugcugaaacaauaacauacugg

SEQ ID NO: 853387 - RNA, 22 nt, Human
uacagcuaggcaaaaaugacau

SEQ ID NO: 853388 - RNA, 22 nt, Human
uuaguaggagagcuuguucauu

SEQ ID NO: 853389 - RNA, 22 nt, Human
guugaaaguggagaaccugguu

SEQ ID NO: 853390 - RNA, 22 nt, Human
uccaccaggcuccauguucagu

SEQ ID NO: 853391 - RNA, 15 nt, Human
ccaggcugggugagc

SEQ ID NO: 853392 - RNA, 22 nt, Human
ucuggccauggcaagccgagug

SEQ ID NO: 853393 - RNA, 18 nt, Human
uugcuuuguaagcuugca

SEQ ID NO: 853394 - RNA, 22 nt, Human
uuucccagagguaugaauaagu

SEQ ID NO: 853395 - RNA, 22 nt, Human
cccagcaguaaccaguggaaau

SEQ ID NO: 853396 - RNA, 22 nt, Human
uuucucuguucucuaacuguaa

SEQ ID NO: 853397 - RNA, 22 nt, Human
aggccagcuuccagaggggcag

SEQ ID NO: 853398 - RNA, 22 nt, Human
gcugaggcggaaggauugcuag

SEQ ID NO: 853399 - RNA, 22 nt, Human
cccaggaaaugaacuucugauu

SEQ ID NO: 853400 - RNA, 22 nt, Human
gcucacugcaaccucugcuucc

SEQ ID NO: 853401 - RNA, 22 nt, Human
ugaggcagaaaauagcaguuca

SEQ ID NO: 853402 - RNA, 22 nt, Human
aggcagcuaagauggauaauga

SEQ ID NO: 853403 - RNA, 21 nt, Human
uagggcaggcauuggaagaga

SEQ ID NO: 853404 - RNA, 22 nt, Human
uagugucaggagggaaaugcaa

SEQ ID NO: 853405 - RNA, 22 nt, Human
aaucauucuuauuucacagcaa

SEQ ID NO: 853406 - RNA, 22 nt, Human
aagcugagccaguggcaagugc

SEQ ID NO: 853407 - RNA, 22 nt, Human
uagcuguguaagcuugguaaga

SEQ ID NO: 853408 - RNA, 22 nt, Human
guauuagguuggugcaaaauug

SEQ ID NO: 853409 - RNA, 22 nt, Human
caggcagcagaggaguguggga

SEQ ID NO: 853410 - RNA, 22 nt, Human
ucagcuggaagauggugcagaa

SEQ ID NO: 853411 - RNA, 22 nt, Human
uuggaauucaaguuguagcuua

SEQ ID NO: 853412 - RNA, 22 nt, Human
uccaggagggauugggcugugg

SEQ ID NO: 853413 - RNA, 22 nt, Human
ucucaggaagugauauugagac

SEQ ID NO: 853414 - RNA, 22 nt, Human
ucauuauuuuggacuggagugu

SEQ ID NO: 853415 - RNA, 21 nt, Human
ugaggccugccagucucagaa

SEQ ID NO: 853416 - RNA, 22 nt, Human
accaggaguagaauaucuguga

SEQ ID NO: 853417 - RNA, 22 nt, Human
uuggccaagggcucuuuaggcu

SEQ ID NO: 853418 - RNA, 22 nt, Human
aaggcugauuagacugauagcu

SEQ ID NO: 853419 - RNA, 22 nt, Human
uuucuucacaggguauugggug

SEQ ID NO: 853420 - RNA, 22 nt, Human
ccuccuggaggcucuaagggag

SEQ ID NO: 853421 - RNA, 22 nt, Human
cuccaggaaagccugaggcccg

SEQ ID NO: 853422 - RNA, 22 nt, Human
gcuggagccuucugcucuguug

SEQ ID NO: 853423 - RNA, 22 nt, Human
ucacccuugauaauguucuucu

SEQ ID NO: 853424 - RNA, 22 nt, Human
uccaggagggguaggcaguaug

SEQ ID NO: 853425 - RNA, 22 nt, Human
uuugaaagcaggugugggaggg

SEQ ID NO: 853426 - RNA, 22 nt, Human
uuucuggcagcgggacaggggu

SEQ ID NO: 853427 - RNA, 22 nt, Human
cagaggcagccgggggagaacg

SEQ ID NO: 853428 - RNA, 22 nt, Human
cuccuggcuuucccagaccagg

SEQ ID NO: 853429 - RNA, 20 nt, Human
cucuccucacccgugucagg

SEQ ID NO: 853430 - RNA, 22 nt, Human
gcagagcuccccaagacaccaa

SEQ ID NO: 853431 - RNA, 22 nt, Human
ucugggaauuuauuggcacuuu

SEQ ID NO: 853432 - RNA, 22 nt, Human
gcugcugucacggugcuaaggg

SEQ ID NO: 853433 - RNA, 22 nt, Human
cuucugccccuguagccugagu

SEQ ID NO: 853434 - RNA, 22 nt, Human
aauuaggagaaaacuguugucu

SEQ ID NO: 853435 - RNA, 22 nt, Human
ugcauauuguccuugauauuau

SEQ ID NO: 853436 - RNA, 17 nt, Human
uuucaucugggaccacc

SEQ ID NO: 853437 - RNA, 22 nt, Human
cuggccagcugacagcagggcu

SEQ ID NO: 853438 - RNA, 22 nt, Human
ccaggagaaugggauuacccua

SEQ ID NO: 853439 - RNA, 22 nt, Human
gcuggcuguaucaccuggccag

SEQ ID NO: 853440 - RNA, 22 nt, Human
ucugcucagguuaccuagcuag

SEQ ID NO: 853441 - RNA, 22 nt, Human
uucucagauccaucagaagucc

SEQ ID NO: 853442 - RNA, 22 nt, Human
gaaauauuguacuggagauguu

SEQ ID NO: 853443 - RNA, 18 nt, Human
gccugccuagagcuugcc

SEQ ID NO: 853444 - RNA, 22 nt, Human
acacauauauacauauuugugc

SEQ ID NO: 853445 - RNA, 22 nt, Human
cugcugugccucuuuucacgug

SEQ ID NO: 853446 - RNA, 22 nt, Human
uuucauuuugguuaugccauaa

SEQ ID NO: 853447 - RNA, 22 nt, Human
ccacaggcugcugcaggucccg

SEQ ID NO: 853448 - RNA, 22 nt, Human
ucaggagacauucuuaaaguag

SEQ ID NO: 853449 - RNA, 22 nt, Human
aaguuacagucagagguuaaca

SEQ ID NO: 853450 - RNA, 22 nt, Human
cugaggccagcugcagagcucu

SEQ ID NO: 853451 - RNA, 22 nt, Human
uagaaaguaaaucaguuuuauu

SEQ ID NO: 853452 - RNA, 22 nt, Human
agugcagccgagaucaggugcu

SEQ ID NO: 853453 - RNA, 22 nt, Human
gugugcaggugucagugcagcu

SEQ ID NO: 853454 - RNA, 22 nt, Human
cagcuucugucugauuagcaag

SEQ ID NO: 853455 - RNA, 22 nt, Human
accaggagccacaggaggagcc

SEQ ID NO: 853456 - RNA, 22 nt, Human
ugcccacauggugccauggcca

SEQ ID NO: 853457 - RNA, 22 nt, Human
gcugcagguuugucuagucugg

SEQ ID NO: 853458 - RNA, 22 nt, Human
acaucugauuacaugagaauau

SEQ ID NO: 853459 - RNA, 22 nt, Human
ucugagcuucugcauuuccaac

SEQ ID NO: 853460 - RNA, 22 nt, Human
ccuggcugcccauggacccucu

SEQ ID NO: 853461 - RNA, 22 nt, Human
uugaggucccaaacccacugag

SEQ ID NO: 853462 - RNA, 23 nt, Human
auuucuaggggauuuucuggugc

SEQ ID NO: 853463 - RNA, 22 nt, Human
cagggcuguggcuuugugcugu

SEQ ID NO: 853464 - RNA, 22 nt, Human
ugcugaaaacucaaccauugug

SEQ ID NO: 853465 - RNA, 22 nt, Human
uuuuuggguccaggcuguaucu

SEQ ID NO: 853466 - RNA, 22 nt, Human
acaugcauacacguacauaccu

SEQ ID NO: 853467 - RNA, 22 nt, Human
ccucaggauacaggagccacag

SEQ ID NO: 853468 - RNA, 22 nt, Human
cugacuuuagaacccaaaaagu

SEQ ID NO: 853469 - RNA, 22 nt, Human
aacugcuggggaggccaaacuc

SEQ ID NO: 853470 - RNA, 22 nt, Human
auuugcuugugcuaugaaaguu

SEQ ID NO: 853471 - RNA, 22 nt, Human
uguuuuaaucucccauugcucu

SEQ ID NO: 853472 - RNA, 22 nt, Human
agaagcagcuuucaaggugauu

SEQ ID NO: 853473 - RNA, 22 nt, Human
cagacaggaauucuggcguggu

SEQ ID NO: 853474 - RNA, 22 nt, Human
ccugcugugaagccaggccugu

SEQ ID NO: 853475 - RNA, 22 nt, Human
ccucagaugucuuaaggcacug

SEQ ID NO: 853476 - RNA, 22 nt, Human
cuguuaaucugcuugcaugaug

SEQ ID NO: 853477 - RNA, 23 nt, Human
gcugagguccugcugaguggugg

SEQ ID NO: 853478 - RNA, 22 nt, Human
gcugcugccuguagccagggug

SEQ ID NO: 853479 - RNA, 22 nt, Human
ucagugugaggucuuccacccg

SEQ ID NO: 853480 - RNA, 22 nt, Human
aggcaggcaaccaccugggaag

SEQ ID NO: 853481 - RNA, 17 nt, Human
ugaaggccaugaccacg

SEQ ID NO: 853482 - RNA, 22 nt, Human
ucuggagaagcccagggagcug

SEQ ID NO: 853483 - RNA, 22 nt, Human
ucaggagacaaagggugcggag

SEQ ID NO: 853484 - RNA, 22 nt, Human
uccuggcccggccgggccugcu

SEQ ID NO: 853485 - RNA, 22 nt, Human
gucuccugagccuugacugcaa

SEQ ID NO: 853486 - RNA, 22 nt, Human
uauucaaaguaccuucauugcc

SEQ ID NO: 853487 - RNA, 22 nt, Human
auggccaagcuuacucuguugu

SEQ ID NO: 853488 - RNA, 22 nt, Human
cuggcccagagcucuggccuuu

SEQ ID NO: 853489 - RNA, 22 nt, Human
cagugaaaucacaacuuuaguu

SEQ ID NO: 853490 - RNA, 22 nt, Human
ggagugggaacaaugacauggu

SEQ ID NO: 853491 - RNA, 22 nt, Human
auuaaauuagcaaacugugaaa

SEQ ID NO: 853492 - RNA, 22 nt, Human
acugugugacuguuauuacugu

SEQ ID NO: 853493 - RNA, 22 nt, Human
ugcugcuggguuugacagucac

SEQ ID NO: 853494 - RNA, 22 nt, Human
cagucucagaggugggaguggg

SEQ ID NO: 853495 - RNA, 22 nt, Human
gcuggagccauuggcuuggccu

SEQ ID NO: 853496 - RNA, 22 nt, Human
ucuucacaugaccuucaugucu

SEQ ID NO: 853497 - RNA, 22 nt, Human
aaagcagauucugaugcaguag

SEQ ID NO: 853498 - RNA, 22 nt, Human
acaggcuguacuucuaaucauc

SEQ ID NO: 853499 - RNA, 22 nt, Human
acacaaaaucaaaguccuaggc

SEQ ID NO: 853500 - RNA, 22 nt, Human
gcagcuucaguaggugaagaca

SEQ ID NO: 853501 - RNA, 22 nt, Human
ucuccuggaagaauaccacacu

SEQ ID NO: 853502 - RNA, 22 nt, Human
aaacuccugcauacucagaagc

SEQ ID NO: 853503 - RNA, 22 nt, Human
caugcaggcccgccugaauggg

SEQ ID NO: 853504 - RNA, 22 nt, Human
agccacagagcaggagaccuuu

SEQ ID NO: 853505 - RNA, 22 nt, Human
acuccuggggcugccaucacag

SEQ ID NO: 853506 - RNA, 22 nt, Human
gugcauuugacgaauacucacu

SEQ ID NO: 853507 - RNA, 17 nt, Human
agauggcaggaggcaga

SEQ ID NO: 853508 - RNA, 22 nt, Human
uccauuuuagagaugaagaaac

SEQ ID NO: 853509 - RNA, 22 nt, Human
cuguuuauagcagagcaagccu

SEQ ID NO: 853510 - RNA, 22 nt, Human
caacuccuccccagcaugccaa

SEQ ID NO: 853511 - RNA, 22 nt, Human
cauacauuaccuaacuuaaugc

SEQ ID NO: 853512 - RNA, 20 nt, Human
agcaagaguaaggacagcga

SEQ ID NO: 853513 - RNA, 22 nt, Human
gcugcuggccccacaugcucca

SEQ ID NO: 853514 - RNA, 22 nt, Human
gcuggagguagggagguccugu

SEQ ID NO: 853515 - RNA, 22 nt, Human
cuugaucuacauagugaaaccc

SEQ ID NO: 853516 - RNA, 21 nt, Human
uggcugcacuguggcuuucau

SEQ ID NO: 853517 - RNA, 22 nt, Human
aucaggaucacugggagucuug

SEQ ID NO: 853518 - RNA, 22 nt, Human
uuuuagcacuaagugauaugcu

SEQ ID NO: 853519 - RNA, 22 nt, Human
acucuucuugcugcucauuaau

SEQ ID NO: 853520 - RNA, 22 nt, Human
cagcagaaaauaccuguaacuc

SEQ ID NO: 853521 - RNA, 22 nt, Human
auuauuagauucuuaauuguaa

SEQ ID NO: 853522 - RNA, 22 nt, Human
uugaauaggacucagcagugau

SEQ ID NO: 853523 - RNA, 22 nt, Human
uuauguagugacugacuguuag

SEQ ID NO: 853524 - RNA, 22 nt, Human
aggguagggcccggagacagac

SEQ ID NO: 853525 - RNA, 22 nt, Human
ggaugggagcagaggacgacca

SEQ ID NO: 853526 - RNA, 22 nt, Human
gacccuggagccgucugaggca

SEQ ID NO: 853527 - RNA, 22 nt, Human
acuaagugauucuaagcaucuu

SEQ ID NO: 853528 - RNA, 22 nt, Human
ugaggcaggaguucaggcugcg

SEQ ID NO: 853529 - RNA, 22 nt, Human
aggauaguugugaagauaggcu

SEQ ID NO: 853530 - RNA, 22 nt, Human
ccucaggggucacugugaggag

SEQ ID NO: 853531 - RNA, 22 nt, Human
auuuucaucauggguuuaacau

SEQ ID NO: 853532 - RNA, 22 nt, Human
auaagcauguuagaauauuuga

SEQ ID NO: 853533 - RNA, 20 nt, Human
uugagcuuuuaguacagaca

SEQ ID NO: 853534 - RNA, 22 nt, Human
ucuuugcagaauuuaacuuugc

SEQ ID NO: 853535 - RNA, 22 nt, Human
uuggcacagagcugcagccugg

SEQ ID NO: 853536 - RNA, 22 nt, Human
ggcagcuuucucacccaugacc

SEQ ID NO: 853537 - RNA, 22 nt, Human
cggcagcuccgcgccguaggac

SEQ ID NO: 853538 - RNA, 20 nt, Human
caguccaaucagaggccacc

SEQ ID NO: 853539 - RNA, 22 nt, Human
cugucauugagccugucagggc

SEQ ID NO: 853540 - RNA, 22 nt, Human
auauuucaugggguuccauacu

SEQ ID NO: 853541 - RNA, 22 nt, Human
uagauaaaagggcaaagggcau

SEQ ID NO: 853542 - RNA, 22 nt, Human
ucugccucuuucaggccuggca

SEQ ID NO: 853543 - RNA, 22 nt, Human
cagcaagacaaggaacaaacug

SEQ ID NO: 853544 - RNA, 22 nt, Human
gacuuucuguccagugauuucu

SEQ ID NO: 853545 - RNA, 22 nt, Human
uaguccaggaagguggggcaga

SEQ ID NO: 853546 - RNA, 22 nt, Human
aggcagcuggaggcagagacua

SEQ ID NO: 853547 - RNA, 22 nt, Human
cacaggcuugucagcaugaggc

SEQ ID NO: 853548 - RNA, 20 nt, Human
acugagcugcauggagagga

SEQ ID NO: 853549 - RNA, 22 nt, Human
gggcagcugcagggauggugac

SEQ ID NO: 853550 - RNA, 18 nt, Human
cugcugugucgucugggc

SEQ ID NO: 853551 - RNA, 18 nt, Human
guccacagauucuucacu

SEQ ID NO: 853552 - RNA, 22 nt, Human
caugcaggcacccagagcccac

SEQ ID NO: 853553 - RNA, 22 nt, Human
caaaauuagggagugagcugga

SEQ ID NO: 853554 - RNA, 22 nt, Human
aaggcugacucaacagggggcc

SEQ ID NO: 853555 - RNA, 22 nt, Human
auuuggaacuuauaauaaguuu

SEQ ID NO: 853556 - RNA, 22 nt, Human
cagaagaguagcugaacaaguu

SEQ ID NO: 853557 - RNA, 22 nt, Human
agugcuuugagcguuugaaaag

SEQ ID NO: 853558 - RNA, 22 nt, Human
ugucccucugaggcuucccugg

SEQ ID NO: 853559 - RNA, 22 nt, Human
uuugcagugauucuugcaguga

SEQ ID NO: 853560 - RNA, 22 nt, Human
aagagaggacauggugaaccug

SEQ ID NO: 853561 - RNA, 22 nt, Human
acuauacaguauguacgugcac

SEQ ID NO: 853562 - RNA, 22 nt, Human
ugaggcagugcugggaagccug

SEQ ID NO: 853563 - RNA, 22 nt, Human
agcccagggaaccaggaagugg

SEQ ID NO: 853564 - RNA, 21 nt, Human
agcugcagucaagccagaggu

SEQ ID NO: 853565 - RNA, 22 nt, Human
ucuccuggcauuugguugagua

SEQ ID NO: 853566 - RNA, 22 nt, Human
uugcaggauuuuagagaugaca

SEQ ID NO: 853567 - RNA, 22 nt, Human
aagcaagaguuggagugauguu

SEQ ID NO: 853568 - RNA, 22 nt, Human
aaggcaguagguguuucaaacu

SEQ ID NO: 853569 - RNA, 22 nt, Human
ccuugagccagggagcuggcag

SEQ ID NO: 853570 - RNA, 22 nt, Human
auucugaguccaugggggcagg

SEQ ID NO: 853571 - RNA, 22 nt, Human
aucugccucuucuucauugcga

SEQ ID NO: 853572 - RNA, 22 nt, Human
uuugacaucuaagaauucuuac

SEQ ID NO: 853573 - RNA, 22 nt, Human
cauaaaguaaagaugucuucca

SEQ ID NO: 853574 - RNA, 21 nt, Human
uggcagacuagaguauagaug

SEQ ID NO: 853575 - RNA, 22 nt, Human
uauugaugcuuggauugggcca

SEQ ID NO: 853576 - RNA, 22 nt, Human
augcugcagcugcaggaucaga

SEQ ID NO: 853577 - RNA, 22 nt, Human
ugcauggacucaucagacaaga

SEQ ID NO: 853578 - RNA, 22 nt, Human
gcugagagugggugcagugcuu

SEQ ID NO: 853579 - RNA, 18 nt, Human
ccugaggugggaggaagg

SEQ ID NO: 853580 - RNA, 22 nt, Human
gauuuuauuagcccaaacuuug

SEQ ID NO: 853581 - RNA, 22 nt, Human
cugaauuaauacacagaauggc

SEQ ID NO: 853582 - RNA, 23 nt, Human
ucugagguccaccaguuugcaga

SEQ ID NO: 853583 - RNA, 22 nt, Human
uggaaagcgaggaguuggcauu

SEQ ID NO: 853584 - RNA, 22 nt, Human
gccuggcuaguuagugucaggu

SEQ ID NO: 853585 - RNA, 22 nt, Human
ucugaggucagugcugcaguua

SEQ ID NO: 853586 - RNA, 22 nt, Human
uuuggaaaguugucacuuuaga

SEQ ID NO: 853587 - RNA, 22 nt, Human
gcacaauuauuuaugcaguaug

SEQ ID NO: 853588 - RNA, 22 nt, Human
ucauuuguacuugugugcuugu

SEQ ID NO: 853589 - RNA, 22 nt, Human
ccugggcaucucaugcaccugc

SEQ ID NO: 853590 - RNA, 22 nt, Human
aggugcugugcuaugcacuugu

SEQ ID NO: 853591 - RNA, 22 nt, Human
cucaggauugugccuagggaga

SEQ ID NO: 853592 - RNA, 20 nt, Human
cugcccagccacugagggau

SEQ ID NO: 853593 - RNA, 22 nt, Human
guggccaauaggagcagcuauc

SEQ ID NO: 853594 - RNA, 22 nt, Human
ucaggagauguaaccuuagcug

SEQ ID NO: 853595 - RNA, 22 nt, Human
uuuaaauaggacuccugggggu

SEQ ID NO: 853596 - RNA, 22 nt, Human
cagccuuugugaacaucaggug

SEQ ID NO: 853597 - RNA, 18 nt, Human
cugaggccaacuacacug

SEQ ID NO: 853598 - RNA, 22 nt, Human
caggaaaggugugucaugaugg

SEQ ID NO: 853599 - RNA, 22 nt, Human
ucacaucucccuggaggacaca

SEQ ID NO: 853600 - RNA, 22 nt, Human
ucucaguguguuuucucucaga

SEQ ID NO: 853601 - RNA, 22 nt, Human
uggcgcaacucauucauggugu

SEQ ID NO: 853602 - RNA, 22 nt, Human
gcuggagagauaggcauggggu

SEQ ID NO: 853603 - RNA, 19 nt, Human
guugaaaguaggugagggu

SEQ ID NO: 853604 - RNA, 22 nt, Human
aaauagcagccuuuaguuaaca

SEQ ID NO: 853605 - RNA, 22 nt, Human
gacugaggugcccagaggugac

SEQ ID NO: 853606 - RNA, 22 nt, Human
uaggauaugcauuuuuauacau

SEQ ID NO: 853607 - RNA, 22 nt, Human
gggcugagcacauacugacagc

SEQ ID NO: 853608 - RNA, 22 nt, Human
gucugucuguuguugagaagca

SEQ ID NO: 853609 - RNA, 22 nt, Human
auaagugacugcagggaauuca

SEQ ID NO: 853610 - RNA, 22 nt, Human
ugcccaggguuucuaagagcag

SEQ ID NO: 853611 - RNA, 22 nt, Human
ucagggaccaccacucacccag

SEQ ID NO: 853612 - RNA, 22 nt, Human
cagcaagaacagccugaugugc

SEQ ID NO: 853613 - RNA, 22 nt, Human
uccaaaguaauuucacuucugu

SEQ ID NO: 853614 - RNA, 22 nt, Human
aagggcuggaauaucucuuaga

SEQ ID NO: 853615 - RNA, 22 nt, Human
gaagcagcugccagagaugucu

SEQ ID NO: 853616 - RNA, 22 nt, Human
aaacugguaaucggcaagugag

SEQ ID NO: 853617 - RNA, 22 nt, Human
ucauuguuauguuuugcugucu

SEQ ID NO: 853618 - RNA, 22 nt, Human
aacauagagacaggaagugcuu

SEQ ID NO: 853619 - RNA, 22 nt, Human
gaaacugugaucguguucuggg

SEQ ID NO: 853620 - RNA, 22 nt, Human
aaucuuucccuauuaaaugugg

SEQ ID NO: 853621 - RNA, 22 nt, Human
caggcugauuaggccucgucca

SEQ ID NO: 853622 - RNA, 22 nt, Human
aggcuaagggaugacuggagug

SEQ ID NO: 853623 - RNA, 22 nt, Human
acucugggcuuugauuuguuac

SEQ ID NO: 853624 - RNA, 22 nt, Human
ggaggagggguuuacauuggaa

SEQ ID NO: 853625 - RNA, 22 nt, Human
caggaugggauguagugggccc

SEQ ID NO: 853626 - RNA, 22 nt, Human
acgagagguccuuagaaucugu

SEQ ID NO: 853627 - RNA, 22 nt, Human
gcaagcugaugugauagugaaa

SEQ ID NO: 853628 - RNA, 22 nt, Human
gcugcagggagcuggaaggcuc

SEQ ID NO: 853629 - RNA, 22 nt, Human
agcacagguacggagaugcuac

SEQ ID NO: 853630 - RNA, 22 nt, Human
ugcugcuggaucuuacucaucu

SEQ ID NO: 853631 - RNA, 22 nt, Human
uaggaaaugcuccauugcauaa

SEQ ID NO: 853632 - RNA, 23 nt, Human
uggcaaggaaugggauggagacu

SEQ ID NO: 853633 - RNA, 22 nt, Human
cccaugagguggagguugcagu

SEQ ID NO: 853634 - RNA, 22 nt, Human
gugaauuaaauauagccagguc

SEQ ID NO: 853635 - RNA, 22 nt, Human
auguuuccagguucuuccuaug

SEQ ID NO: 853636 - RNA, 20 nt, Human
guauuagguguuccucuuuc

SEQ ID NO: 853637 - RNA, 22 nt, Human
aagggcuguaagccaaguaaag

SEQ ID NO: 853638 - RNA, 22 nt, Human
acaggcugagcguccaucuuca

SEQ ID NO: 853639 - RNA, 22 nt, Human
aggcuggaguacaguggcuauu

SEQ ID NO: 853640 - RNA, 22 nt, Human
gucuucuguaagaugagguccc

SEQ ID NO: 853641 - RNA, 22 nt, Human
uaacuguaguuauaaagcuauc

SEQ ID NO: 853642 - RNA, 22 nt, Human
uuggccaaggucacugggugag

SEQ ID NO: 853643 - RNA, 22 nt, Human
ucucuucuauuugagacuauuu

SEQ ID NO: 853644 - RNA, 22 nt, Human
accaggagucuagccuagucaa

SEQ ID NO: 853645 - RNA, 17 nt, Human
uucucugagcuguauug

SEQ ID NO: 853646 - RNA, 21 nt, Human
auuuggcaaaggcgaugcaca

SEQ ID NO: 853647 - RNA, 22 nt, Human
aggaaacuccccuacaucucaa

SEQ ID NO: 853648 - RNA, 22 nt, Human
gaggcuccgugcugcugcccug

SEQ ID NO: 853649 - RNA, 22 nt, Human
uggcagcuccuggggccagcac

SEQ ID NO: 853650 - RNA, 22 nt, Human
uaggcugagcuuguagaucgua

SEQ ID NO: 853651 - RNA, 22 nt, Human
gcucaggacuggaggagcgggg

SEQ ID NO: 853652 - RNA, 22 nt, Human
auggccaaagccacagcagagg

SEQ ID NO: 853653 - RNA, 22 nt, Human
uucugugaaucuuuuuucccac

SEQ ID NO: 853654 - RNA, 22 nt, Human
aaacauuugcaacucgguuugg

SEQ ID NO: 853655 - RNA, 22 nt, Human
aguucuuuugugaacauaugcu

SEQ ID NO: 853656 - RNA, 19 nt, Human
uggcagggagaguuugaag

SEQ ID NO: 853657 - RNA, 22 nt, Human
uauuuccauguuagaacuaagu

SEQ ID NO: 853658 - RNA, 21 nt, Human
acagcaagccuucacaugagu

SEQ ID NO: 853659 - RNA, 22 nt, Human
uggcaaggcugugggggcagag

SEQ ID NO: 853660 - RNA, 22 nt, Human
uccuggccagaggacaaagcug

SEQ ID NO: 853661 - RNA, 22 nt, Human
ccaggagagcagaagcccaggc

SEQ ID NO: 853662 - RNA, 22 nt, Human
gucaggaugacaagugcuuuca

SEQ ID NO: 853663 - RNA, 22 nt, Human
gcagaagucagaccaucugaau

SEQ ID NO: 853664 - RNA, 22 nt, Human
auggaaagugcauggaagucau

SEQ ID NO: 853665 - RNA, 22 nt, Human
ucugagguugaacuuugcaaag

SEQ ID NO: 853666 - RNA, 20 nt, Human
agcugccccugggcacugcc

SEQ ID NO: 853667 - RNA, 22 nt, Human
ucaggcugggagacaaucacug

SEQ ID NO: 853668 - RNA, 19 nt, Human
uuacacuucugcuuuguga

SEQ ID NO: 853669 - RNA, 22 nt, Human
aggguccugggugcaguugcuu

SEQ ID NO: 853670 - RNA, 22 nt, Human
uucuucuccuaaggagaguccu

SEQ ID NO: 853671 - RNA, 22 nt, Human
uuugacaucaauacccuagaau

SEQ ID NO: 853672 - RNA, 22 nt, Human
cagggcugaagaaauucaaaag

SEQ ID NO: 853673 - RNA, 21 nt, Human
uggccaaaaccauauuauuaa

SEQ ID NO: 853674 - RNA, 22 nt, Human
uaggaaauauuugaacauagga

SEQ ID NO: 853675 - RNA, 22 nt, Human
uaggauaggauggagacagaau

SEQ ID NO: 853676 - RNA, 22 nt, Human
caggguggggaaauagcgcccu

SEQ ID NO: 853677 - RNA, 22 nt, Human
ugaggcagccugcauuaaagag

SEQ ID NO: 853678 - RNA, 22 nt, Human
cuuugcaaacgauuaccacaug

SEQ ID NO: 853679 - RNA, 22 nt, Human
ggagcccugcccuaggcagcuc

SEQ ID NO: 853680 - RNA, 22 nt, Human
uaggcugagguugaugccaggg

SEQ ID NO: 853681 - RNA, 22 nt, Human
ccaggcugugguuuagauagag

SEQ ID NO: 853682 - RNA, 22 nt, Human
acuggccaggcagcaguagcuu

SEQ ID NO: 853683 - RNA, 22 nt, Human
uacuaggaagcagcugcauugg

SEQ ID NO: 853684 - RNA, 22 nt, Human
ugaaggaaugaguauacuguuu

SEQ ID NO: 853685 - RNA, 22 nt, Human
cuggaguuagaguagacacuga

SEQ ID NO: 853686 - RNA, 21 nt, Human
auguaggguuugccuucucua

SEQ ID NO: 853687 - RNA, 22 nt, Human
aaaaaugucauuauggaacuga

SEQ ID NO: 853688 - RNA, 22 nt, Human
ucuggccacuugcuucacacug

SEQ ID NO: 853689 - RNA, 22 nt, Human
agcccuggcagagccagguagu

SEQ ID NO: 853690 - RNA, 19 nt, Human
cagcaagaaugaaggcaua

SEQ ID NO: 853691 - RNA, 22 nt, Human
guucuucaucauuuuagauagg

SEQ ID NO: 853692 - RNA, 22 nt, Human
ucugcaggcuguacaggaagca

SEQ ID NO: 853693 - RNA, 22 nt, Human
acugagguugaaauagugaugu

SEQ ID NO: 853694 - RNA, 22 nt, Human
cagaaccaggaacugauggaga

SEQ ID NO: 853695 - RNA, 22 nt, Human
aaggcagccauagcaccaucca

SEQ ID NO: 853696 - RNA, 22 nt, Human
caaauguauaaauguacuuucu

SEQ ID NO: 853697 - RNA, 22 nt, Human
gcccaggaguugaaugcagcag

SEQ ID NO: 853698 - RNA, 22 nt, Human
ugucuuuggaauauuuagcuga

SEQ ID NO: 853699 - RNA, 19 nt, Human
aaaaacuuaguccagaaag

SEQ ID NO: 853700 - RNA, 21 nt, Human
ugauacaggaaugguucuaug

SEQ ID NO: 853701 - RNA, 22 nt, Human
ucagauggcacacagagccugc

SEQ ID NO: 853702 - RNA, 22 nt, Human
aguuagaauggauguugagagc

SEQ ID NO: 853703 - RNA, 22 nt, Human
cacugguagagagaagacaagg

SEQ ID NO: 853704 - RNA, 22 nt, Human
aacagccucagugagauuagga

SEQ ID NO: 853705 - RNA, 22 nt, Human
gcuccuggcauccugcuuuuaa

SEQ ID NO: 853706 - RNA, 20 nt, Human
ccuuuauuauuuguaugaug

SEQ ID NO: 853707 - RNA, 22 nt, Human
aaguguauauaugacuuauaaa

SEQ ID NO: 853708 - RNA, 22 nt, Human
gagggcugaugcuuacuuauuu

SEQ ID NO: 853709 - RNA, 22 nt, Human
gucacaaaggugagggacauga

SEQ ID NO: 853710 - RNA, 22 nt, Human
guuauuagaagugaaggauugu

SEQ ID NO: 853711 - RNA, 22 nt, Human
uuauuuaaaagugguaagauuc

SEQ ID NO: 853712 - RNA, 22 nt, Human
gccaccagggggugcaaggucc

SEQ ID NO: 853713 - RNA, 22 nt, Human
uggcugagugauauuugcaaag

SEQ ID NO: 853714 - RNA, 19 nt, Human
ugugaaagcuaguguucuu

SEQ ID NO: 853715 - RNA, 22 nt, Human
gcugaagggagugcugagucug

SEQ ID NO: 853716 - RNA, 22 nt, Human
uccuggccaggaugaccuaaca

SEQ ID NO: 853717 - RNA, 22 nt, Human
uccacauccauugcuugacuuu

SEQ ID NO: 853718 - RNA, 20 nt, Human
ggcaggcuuuauauggaggg

SEQ ID NO: 853719 - RNA, 22 nt, Human
cagacagggaccucgcuccaga

SEQ ID NO: 853720 - RNA, 22 nt, Human
cccaggaacuccagagcuccuc

SEQ ID NO: 853721 - RNA, 22 nt, Human
aaggcugaaagaccuugaaccu

SEQ ID NO: 853722 - RNA, 22 nt, Human
gaggcaccucgcgggaggaggc

SEQ ID NO: 853723 - RNA, 22 nt, Human
gagggcugauaacaggaauaca

SEQ ID NO: 853724 - RNA, 22 nt, Human
gucacuguuuccuauuauauuu

SEQ ID NO: 853725 - RNA, 22 nt, Human
aggcugagagcaacgugucaga

SEQ ID NO: 853726 - RNA, 22 nt, Human
auuuggaacaaauauuaguaaa

SEQ ID NO: 853727 - RNA, 22 nt, Human
cccuccccacaaagcuucacac

SEQ ID NO: 853728 - RNA, 22 nt, Human
uugagaagaggcuuuguaggaa

SEQ ID NO: 853729 - RNA, 19 nt, Human
agcagcuggagguggagug

SEQ ID NO: 853730 - RNA, 23 nt, Human
uaugaacugcauugcuggugugu

SEQ ID NO: 853731 - RNA, 22 nt, Human
gcugcugugccuggcguccugu

SEQ ID NO: 853732 - RNA, 22 nt, Human
aucauucugauggucaaugcua

SEQ ID NO: 853733 - RNA, 17 nt, Human
caguuggagacaagucc

SEQ ID NO: 853734 - RNA, 22 nt, Human
uugauacaggcucuauuucauc

SEQ ID NO: 853735 - RNA, 22 nt, Human
cuggccaaugccuggggaauag

SEQ ID NO: 853736 - RNA, 22 nt, Human
ucaggcuguggcuuugaccgca

SEQ ID NO: 853737 - RNA, 22 nt, Human
ucuccuggaagugauuccccug

SEQ ID NO: 853738 - RNA, 22 nt, Human
agucugucugucacuucugcag

SEQ ID NO: 853739 - RNA, 22 nt, Human
caggguggcacaucacagcauu

SEQ ID NO: 853740 - RNA, 19 nt, Human
gugcuuuuuaagagcucag

SEQ ID NO: 853741 - RNA, 22 nt, Human
aggccaaauguguauaaaacau

SEQ ID NO: 853742 - RNA, 22 nt, Human
acacuaguauuucuauaaguga

SEQ ID NO: 853743 - RNA, 22 nt, Human
gacuuuauuuccuuauuuguga

SEQ ID NO: 853744 - RNA, 22 nt, Human
aauuuuaaucaguggugcugag

SEQ ID NO: 853745 - RNA, 22 nt, Human
acccaggauaaucuguguaucu

SEQ ID NO: 853746 - RNA, 22 nt, Human
caggccugagacaucugagaua

SEQ ID NO: 853747 - RNA, 22 nt, Human
cauugcuuccuaugucccuucu

SEQ ID NO: 853748 - RNA, 18 nt, Human
uguuaggaagggcacaca

SEQ ID NO: 853749 - RNA, 22 nt, Human
aagcagcuggaagaguaagaug

SEQ ID NO: 853750 - RNA, 22 nt, Human
cucuucuugucucugguuagaa

SEQ ID NO: 853751 - RNA, 22 nt, Human
cugagcugggacucaguagcaa

SEQ ID NO: 853752 - RNA, 22 nt, Human
cccaggagagagacuugaaucu

SEQ ID NO: 853753 - RNA, 20 nt, Human
gucaggauuaguaaacucug

SEQ ID NO: 853754 - RNA, 22 nt, Human
caaggccaugagcagcgagugu

SEQ ID NO: 853755 - RNA, 22 nt, Human
uaacuguaccuagauaacgaac

SEQ ID NO: 853756 - RNA, 22 nt, Human
uucauuaguucugaagaugucu

SEQ ID NO: 853757 - RNA, 22 nt, Human
ugagacaguuuuucuauuucca

SEQ ID NO: 853758 - RNA, 22 nt, Human
ucccugcccucagugcacccgg

SEQ ID NO: 853759 - RNA, 22 nt, Human
ugcuucagugcucugagccugu

SEQ ID NO: 853760 - RNA, 22 nt, Human
agcacauucugccuugcuuugc

SEQ ID NO: 853761 - RNA, 22 nt, Human
acacaguauugugacuauaacu

SEQ ID NO: 853762 - RNA, 22 nt, Human
uuuccagagcaugucugcucag

SEQ ID NO: 853763 - RNA, 22 nt, Human
agucucuuauucccuauugcug

SEQ ID NO: 853764 - RNA, 22 nt, Human
guugaaagcuuuucauuuaguu

SEQ ID NO: 853765 - RNA, 22 nt, Human
uguaaucauuacaguacaugga

SEQ ID NO: 853766 - RNA, 22 nt, Human
cagagggaaaaggggaguaaua

SEQ ID NO: 853767 - RNA, 22 nt, Human
aggaagcuaaccagggagugag

SEQ ID NO: 853768 - RNA, 22 nt, Human
auguuucaccagcaaauuaccu

SEQ ID NO: 853769 - RNA, 23 nt, Human
agggccuggcguggagugugugc

SEQ ID NO: 853770 - RNA, 22 nt, Human
ggcugcagaggcccccaguggg

SEQ ID NO: 853771 - RNA, 22 nt, Human
ucaggcuguggcuucaguucuu

SEQ ID NO: 853772 - RNA, 22 nt, Human
aaugucugccagaacugaucau

SEQ ID NO: 853773 - RNA, 22 nt, Human
auuucacucauucauguuacuu

SEQ ID NO: 853774 - RNA, 22 nt, Human
uugcagcuucgagucuaucugu

SEQ ID NO: 853775 - RNA, 22 nt, Human
gaggcugaacagguucucauga

SEQ ID NO: 853776 - RNA, 22 nt, Human
cauauauucugguuuucacugg

SEQ ID NO: 853777 - RNA, 22 nt, Human
acugagguggggucugcuugga

SEQ ID NO: 853778 - RNA, 22 nt, Human
uagaacugacguuagggaagaa

SEQ ID NO: 853779 - RNA, 22 nt, Human
acauugcugcauucuccuuccc

SEQ ID NO: 853780 - RNA, 22 nt, Human
ucuacugcacuggugucucauc

SEQ ID NO: 853781 - RNA, 22 nt, Human
cugcugugucagaguccagggg

SEQ ID NO: 853782 - RNA, 22 nt, Human
uagugcuuggcccuaccagaua

SEQ ID NO: 853783 - RNA, 22 nt, Human
gcuuuggaugugugccugaggu

SEQ ID NO: 853784 - RNA, 22 nt, Human
ugcuugaaagggguuucccagu

SEQ ID NO: 853785 - RNA, 18 nt, Human
cugcuugggagacgucag

SEQ ID NO: 853786 - RNA, 22 nt, Human
gaccuggaggauccucuucuug

SEQ ID NO: 853787 - RNA, 22 nt, Human
agagcagcuggggcagagacca

SEQ ID NO: 853788 - RNA, 22 nt, Human
aggcagcugaggucuggcgccc

SEQ ID NO: 853789 - RNA, 22 nt, Human
cugugauuguuaguuccuauac

SEQ ID NO: 853790 - RNA, 22 nt, Human
acugaggucagggguaugugau

SEQ ID NO: 853791 - RNA, 22 nt, Human
agcaccugucacaagcagaagg

SEQ ID NO: 853792 - RNA, 19 nt, Human
ccuggccagacuucugccc

SEQ ID NO: 853793 - RNA, 22 nt, Human
uagcacauuguugaccagaagg

SEQ ID NO: 853794 - RNA, 22 nt, Human
auguuauuaaaguacagauucu

SEQ ID NO: 853795 - RNA, 22 nt, Human
auuguucaaagugcuuugcaug

SEQ ID NO: 853796 - RNA, 22 nt, Human
caacugguaaucuccacgguca

SEQ ID NO: 853797 - RNA, 22 nt, Human
uuuaaauggcauuuucccagau

SEQ ID NO: 853798 - RNA, 22 nt, Human
gacuuucucuccucccaggugu

SEQ ID NO: 853799 - RNA, 22 nt, Human
uucacagacauugcagacugaa

SEQ ID NO: 853800 - RNA, 22 nt, Human
ccuguuuaucuaucuagagaug

SEQ ID NO: 853801 - RNA, 22 nt, Human
ugccccagaccuacugaauggg

SEQ ID NO: 853802 - RNA, 22 nt, Human
uccaggaguggggcagaggucu

SEQ ID NO: 853803 - RNA, 22 nt, Human
gaacuggugaagugaagggcag

SEQ ID NO: 853804 - RNA, 22 nt, Human
gugacaguggucacuuguaguu

SEQ ID NO: 853805 - RNA, 22 nt, Human
ugccugggccuucccaccucug

SEQ ID NO: 853806 - RNA, 22 nt, Human
ugaggcaggaguuaaugugcuc

SEQ ID NO: 853807 - RNA, 22 nt, Human
acccaggagccgugagagguua

SEQ ID NO: 853808 - RNA, 22 nt, Human
cggcugagacggccauagacac

SEQ ID NO: 853809 - RNA, 20 nt, Human
ugccccaggccugcaccugc

SEQ ID NO: 853810 - RNA, 23 nt, Human
aguaaagcaauuguuggcgagag

SEQ ID NO: 853811 - RNA, 22 nt, Human
agcugguaaguggcagagauuc

SEQ ID NO: 853812 - RNA, 22 nt, Human
uugaaauacugcauuguucagu

SEQ ID NO: 853813 - RNA, 22 nt, Human
uaaauacuuaguuuugugucua

SEQ ID NO: 853814 - RNA, 22 nt, Human
cacaauguauauguauaucaaa

SEQ ID NO: 853815 - RNA, 22 nt, Human
uuagaaaacauaagugguaaag

SEQ ID NO: 853816 - RNA, 22 nt, Human
cugcuguguuagcagguuuagu

SEQ ID NO: 853817 - RNA, 23 nt, Human
gcugagguacauuuacaggaaga

SEQ ID NO: 853818 - RNA, 22 nt, Human
uaaggccaggcuguggucggca

SEQ ID NO: 853819 - RNA, 22 nt, Human
acuguugucaggcugcuuugga

SEQ ID NO: 853820 - RNA, 22 nt, Human
cuuaagauuugcgauaccuaau

SEQ ID NO: 853821 - RNA, 22 nt, Human
gaaauacugcacacccuguaag

SEQ ID NO: 853822 - RNA, 22 nt, Human
ucugggagccaugccuuggagu

SEQ ID NO: 853823 - RNA, 22 nt, Human
uaugacuuuggaaaaauuacuu

SEQ ID NO: 853824 - RNA, 22 nt, Human
ucugugccucaucugguucagg

SEQ ID NO: 853825 - RNA, 22 nt, Human
ccuugcugaccaucaccuuuga

SEQ ID NO: 853826 - RNA, 17 nt, Human
ugaggcucggugaggag

SEQ ID NO: 853827 - RNA, 22 nt, Human
agcaagauuuaaacccagguca

SEQ ID NO: 853828 - RNA, 22 nt, Human
uuagcagcuaaacugacagacc

SEQ ID NO: 853829 - RNA, 23 nt, Human
uacaugcuauaauuucacccuca

SEQ ID NO: 853830 - RNA, 22 nt, Human
auaaaaguaggaccaacuuaca

SEQ ID NO: 853831 - RNA, 19 nt, Human
uagaacugaggacuugcau

SEQ ID NO: 853832 - RNA, 22 nt, Human
auuaaauuuucacuaggcuccc

SEQ ID NO: 853833 - RNA, 22 nt, Human
ggaggggagguccagcugaucu

SEQ ID NO: 853834 - RNA, 22 nt, Human
augugucuuugagacucugcua

SEQ ID NO: 853835 - RNA, 22 nt, Human
gacugagggacagggcagugga

SEQ ID NO: 853836 - RNA, 22 nt, Human
agcagaggaggauuuaguuagg

SEQ ID NO: 853837 - RNA, 22 nt, Human
ucucaggaauagaguggcagca

SEQ ID NO: 853838 - RNA, 22 nt, Human
uccaugagcuagggauucauca

SEQ ID NO: 853839 - RNA, 20 nt, Human
cugcugugugugccucagcc

SEQ ID NO: 853840 - RNA, 22 nt, Human
gacugagggauagaggugcuuc

SEQ ID NO: 853841 - RNA, 22 nt, Human
uugcauuugacaaauuauuuaa

SEQ ID NO: 853842 - RNA, 22 nt, Human
ucugaacuccagcccugcucuc

SEQ ID NO: 853843 - RNA, 22 nt, Human
ucccagggcucuagagugcugg

SEQ ID NO: 853844 - RNA, 22 nt, Human
cagaggauucccuagugaccug

SEQ ID NO: 853845 - RNA, 22 nt, Human
cugcugugugaccauggacagg

SEQ ID NO: 853846 - RNA, 22 nt, Human
ucaguagcagaaagcaaugagu

SEQ ID NO: 853847 - RNA, 22 nt, Human
gagagaggccuccauguacuga

SEQ ID NO: 853848 - RNA, 22 nt, Human
aagggcuggaucucucugagca

SEQ ID NO: 853849 - RNA, 22 nt, Human
uacaucuauacugaucuacauu

SEQ ID NO: 853850 - RNA, 20 nt, Human
gaggcccagagaggugaagc

SEQ ID NO: 853851 - RNA, 22 nt, Human
acagugacguuuauuugagacg

SEQ ID NO: 853852 - RNA, 20 nt, Human
auaaaauaacugccacaaga

SEQ ID NO: 853853 - RNA, 21 nt, Human
uguuacaguccaaauguuugu

SEQ ID NO: 853854 - RNA, 19 nt, Human
aaggcagcaguagcaucca

SEQ ID NO: 853855 - RNA, 22 nt, Human
cccugguguggaugugauuggc

SEQ ID NO: 853856 - RNA, 22 nt, Human
aucuuucuccauauacaucuuu

SEQ ID NO: 853857 - RNA, 22 nt, Human
aggcugagcugaccugguuugg

SEQ ID NO: 853858 - RNA, 22 nt, Human
agaggcaguauacaauccgagc

SEQ ID NO: 853859 - RNA, 22 nt, Human
cugagagccuccuguuggcuag

SEQ ID NO: 853860 - RNA, 22 nt, Human
ggcagacuguaauaggagaauu

SEQ ID NO: 853861 - RNA, 22 nt, Human
ugcaggugucuccagggcaggu

SEQ ID NO: 853862 - RNA, 22 nt, Human
auucuucacauaagugcuguac

SEQ ID NO: 853863 - RNA, 22 nt, Human
cuauuagguaugcagccuauuu

SEQ ID NO: 853864 - RNA, 22 nt, Human
ggcacagagcccagcuuccuag

SEQ ID NO: 853865 - RNA, 22 nt, Human
aggucagcaggccaggggcgaa

SEQ ID NO: 853866 - RNA, 22 nt, Human
uugaaaggaauacagaggccua

SEQ ID NO: 853867 - RNA, 22 nt, Human
ucugagccagccaccuccuuca

SEQ ID NO: 853868 - RNA, 22 nt, Human
uuugaaguguuauuucuaucac

SEQ ID NO: 853869 - RNA, 22 nt, Human
ggcagccaugcuccaggugcag

SEQ ID NO: 853870 - RNA, 22 nt, Human
ggauuugggcuugcagcagagc

SEQ ID NO: 853871 - RNA, 22 nt, Human
cagggcugaacugagcuuguga

SEQ ID NO: 853872 - RNA, 22 nt, Human
agcuucuuggcucagcacuugg

SEQ ID NO: 853873 - RNA, 22 nt, Human
gcuaugcaggagccuaaugaca

SEQ ID NO: 853874 - RNA, 20 nt, Human
auuuggcaugaaguauugau

SEQ ID NO: 853875 - RNA, 22 nt, Human
gcuguagauggacuggcaucca

SEQ ID NO: 853876 - RNA, 22 nt, Human
ccugguggagaggggcggagcg

SEQ ID NO: 853877 - RNA, 22 nt, Human
agugcuuuagagaaauggugcu

SEQ ID NO: 853878 - RNA, 22 nt, Human
uaggaaauuagaacuuggaaac

SEQ ID NO: 853879 - RNA, 22 nt, Human
aaaauaacuucuacuauuugca

SEQ ID NO: 853880 - RNA, 22 nt, Human
gcuguggucugugagcuccaaa

SEQ ID NO: 853881 - RNA, 22 nt, Human
ucaggagagaaagaauacaauu

SEQ ID NO: 853882 - RNA, 22 nt, Human
ugaggcagggaguuuaauuguc

SEQ ID NO: 853883 - RNA, 22 nt, Human
uucaggauggaguaccuuuuau

SEQ ID NO: 853884 - RNA, 22 nt, Human
ggagugucagaaacaguguccu

SEQ ID NO: 853885 - RNA, 22 nt, Human
cuccugggcucaagugauccuc

SEQ ID NO: 853886 - RNA, 22 nt, Human
acccaggagacagguugcagug

SEQ ID NO: 853887 - RNA, 22 nt, Human
agcuagaauguuccuuuucauu

SEQ ID NO: 853888 - RNA, 22 nt, Human
ucuuuguaacugucuauugaga

SEQ ID NO: 853889 - RNA, 22 nt, Human
cccaggaggcagaaguugcagu

SEQ ID NO: 853890 - RNA, 22 nt, Human
uauguguuugacacccugcaag

SEQ ID NO: 853891 - RNA, 22 nt, Human
guuuucugauuagcaaaucuga

SEQ ID NO: 853892 - RNA, 22 nt, Human
agggccugucagcgguguccug

SEQ ID NO: 853893 - RNA, 22 nt, Human
uugagaagaaauaguuugcaau

SEQ ID NO: 853894 - RNA, 20 nt, Human
uucacagaggacucagguca

SEQ ID NO: 853895 - RNA, 22 nt, Human
agugcugucaguuuuauagaua

SEQ ID NO: 853896 - RNA, 22 nt, Human
aaaagucugcucucauuucaga

SEQ ID NO: 853897 - RNA, 22 nt, Human
cccagggaagccauuucugacu

SEQ ID NO: 853898 - RNA, 22 nt, Human
uguguucuggaaagcucacuga

SEQ ID NO: 853899 - RNA, 22 nt, Human
uucccucuccuacucaggaaag

SEQ ID NO: 853900 - RNA, 21 nt, Human
gcuggcuggcugaccggccuu

SEQ ID NO: 853901 - RNA, 23 nt, Human
caguggagacucaugcuuccuua

SEQ ID NO: 853902 - RNA, 22 nt, Human
ccuccugggagagcacggaggg

SEQ ID NO: 853903 - RNA, 22 nt, Human
uuugcaguagacaucuuauuuu

SEQ ID NO: 853904 - RNA, 22 nt, Human
ucaggaugguccuuuaugagaa

SEQ ID NO: 853905 - RNA, 22 nt, Human
cuucucagaucucagcuuugag

SEQ ID NO: 853906 - RNA, 22 nt, Human
cuguaacuuagcaugguuacua

SEQ ID NO: 853907 - RNA, 22 nt, Human
uuauagaaggagcauucacuua

SEQ ID NO: 853908 - RNA, 22 nt, Human
cauuuuauccucugggaagcua

SEQ ID NO: 853909 - RNA, 22 nt, Human
accuuuuuguucuguucucagc

SEQ ID NO: 853910 - RNA, 22 nt, Human
uucuagaugauaaaccagcagc

SEQ ID NO: 853911 - RNA, 22 nt, Human
gcagcugagcgugaggaagagu

SEQ ID NO: 853912 - RNA, 22 nt, Human
uggcaacaccuggaagacaugg

SEQ ID NO: 853913 - RNA, 22 nt, Human
ugagcagauggaggcuucugca

SEQ ID NO: 853914 - RNA, 22 nt, Human
uugguuuagagagugugguuac

SEQ ID NO: 853915 - RNA, 22 nt, Human
acccagagcugggcuuggcaaa

SEQ ID NO: 853916 - RNA, 22 nt, Human
uguuuuaaagccauugccuuuc

SEQ ID NO: 853917 - RNA, 22 nt, Human
uaaggccaaguucauauacaac

SEQ ID NO: 853918 - RNA, 23 nt, Human
uggcugagcccacuaucuuggcc

SEQ ID NO: 853919 - RNA, 18 nt, Human
aagaaguuggccaaagag

SEQ ID NO: 853920 - RNA, 22 nt, Human
gagcacugauuuauuuuugucu

SEQ ID NO: 853921 - RNA, 21 nt, Human
ucacuagugccuucugucauu

SEQ ID NO: 853922 - RNA, 22 nt, Human
ucuccugggaggacaaggaagg

SEQ ID NO: 853923 - RNA, 22 nt, Human
uccaacuuucuccuccggcuug

SEQ ID NO: 853924 - RNA, 22 nt, Human
agugagaguauuaaugugaacu

SEQ ID NO: 853925 - RNA, 22 nt, Human
cucaugucuucacccauucuaa

SEQ ID NO: 853926 - RNA, 22 nt, Human
aggaagcuagagccaccggacu

SEQ ID NO: 853927 - RNA, 22 nt, Human
uccugggcaaaaguaucuguga

SEQ ID NO: 853928 - RNA, 22 nt, Human
cuggcugaauccuagucucaua

SEQ ID NO: 853929 - RNA, 22 nt, Human
aaguuacaguuggaacugugaa

SEQ ID NO: 853930 - RNA, 22 nt, Human
gaagcagcgaaguggaagggac

SEQ ID NO: 853931 - RNA, 20 nt, Human
cugggccauccuuuuacaau

SEQ ID NO: 853932 - RNA, 22 nt, Human
ucccucucccuauugccuggag

SEQ ID NO: 853933 - RNA, 22 nt, Human
uaaguaaaacauucaagaaguc

SEQ ID NO: 853934 - RNA, 22 nt, Human
cacauauuugaugaagcuuugu

SEQ ID NO: 853935 - RNA, 22 nt, Human
ccuggcaggcaagaggaaggga

SEQ ID NO: 853936 - RNA, 22 nt, Human
gcagcauacagggagaguacuc

SEQ ID NO: 853937 - RNA, 22 nt, Human
uuugaauagaggccccucagaa

SEQ ID NO: 853938 - RNA, 22 nt, Human
uaaccuuuggugaaauauuaac

SEQ ID NO: 853939 - RNA, 22 nt, Human
uggcugagagcaauugacucug

SEQ ID NO: 853940 - RNA, 22 nt, Human
uuuaggaugcucuauucugacu

SEQ ID NO: 853941 - RNA, 22 nt, Human
aggcagcuggcagcacccaggg

SEQ ID NO: 853942 - RNA, 22 nt, Human
gcaggcaguuauuuaguagaau

SEQ ID NO: 853943 - RNA, 22 nt, Human
cagcugcugcccuuggcugcag

SEQ ID NO: 853944 - RNA, 22 nt, Human
gagaaaugcaugcaugucauca

SEQ ID NO: 853945 - RNA, 22 nt, Human
caacugugaauuuuaugauacc

SEQ ID NO: 853946 - RNA, 20 nt, Human
ugcugcugugagcgucccug

SEQ ID NO: 853947 - RNA, 22 nt, Human
uucugccuucaguccucugacu

SEQ ID NO: 853948 - RNA, 22 nt, Human
ugccaggauauaagagugcgau

SEQ ID NO: 853949 - RNA, 19 nt, Human
uuugaaagaguuuuauugg

SEQ ID NO: 853950 - RNA, 21 nt, Human
acucaggagacuaacuauguc

SEQ ID NO: 853951 - RNA, 22 nt, Human
gaggguggguuucuugcacguc

SEQ ID NO: 853952 - RNA, 22 nt, Human
ucuggcuuucauuuguuuaaag

SEQ ID NO: 853953 - RNA, 22 nt, Human
ccugggauuugcgccagaccuu

SEQ ID NO: 853954 - RNA, 22 nt, Human
guauuaggugguggaauuguag

SEQ ID NO: 853955 - RNA, 22 nt, Human
acauccugaagucagucauuug

SEQ ID NO: 853956 - RNA, 23 nt, Human
agaggggagcaucugcuggcuga

SEQ ID NO: 853957 - RNA, 22 nt, Human
gaggcuccucauucaguaugcu

SEQ ID NO: 853958 - RNA, 22 nt, Human
ggcuuggaaauugcaggacaca

SEQ ID NO: 853959 - RNA, 22 nt, Human
cccaggaguucgaggcuguagu

SEQ ID NO: 853960 - RNA, 22 nt, Human
auuguauaacagcauguauuuu

SEQ ID NO: 853961 - RNA, 22 nt, Human
gagcaagacucacugcaucuug

SEQ ID NO: 853962 - RNA, 22 nt, Human
caauuacauuuauugagcauuc

SEQ ID NO: 853963 - RNA, 22 nt, Human
augcugagauccucaggccaga

SEQ ID NO: 853964 - RNA, 22 nt, Human
ggagcacuauaauagagauuuu

SEQ ID NO: 853965 - RNA, 22 nt, Human
cugccagucuaugcugcucggc

SEQ ID NO: 853966 - RNA, 19 nt, Human
uugaaauuguuugauaugg

SEQ ID NO: 853967 - RNA, 22 nt, Human
gcuucccacagcuggacugggg

SEQ ID NO: 853968 - RNA, 22 nt, Human
uggcuguguuaccacuucaugu

SEQ ID NO: 853969 - RNA, 22 nt, Human
agcaccugcuaugugucaggga

SEQ ID NO: 853970 - RNA, 22 nt, Human
uggcuucuugaucuuggacuug

SEQ ID NO: 853971 - RNA, 22 nt, Human
ggacagcugcuuucaggccaca

SEQ ID NO: 853972 - RNA, 22 nt, Human
aaauaguuuagcucucauuuca

SEQ ID NO: 853973 - RNA, 22 nt, Human
ggacuucuggggacuguagauu

SEQ ID NO: 853974 - RNA, 22 nt, Human
augaaggcaguuaaacgucauc

SEQ ID NO: 853975 - RNA, 22 nt, Human
cucacuguuuaauagcuggauc

SEQ ID NO: 853976 - RNA, 22 nt, Human
aacuggugagauaaauuauuua

SEQ ID NO: 853977 - RNA, 22 nt, Human
ucacaugaguauuauuuuccaa

SEQ ID NO: 853978 - RNA, 21 nt, Human
aggcagcucaggcccagagag

SEQ ID NO: 853979 - RNA, 22 nt, Human
uucuaauuaaaucuacgcuagg

SEQ ID NO: 853980 - RNA, 22 nt, Human
cccagggacagaugggcagcua

SEQ ID NO: 853981 - RNA, 22 nt, Human
uuucaaagaccauuaacuauca

SEQ ID NO: 853982 - RNA, 19 nt, Human
uugaaagauuagcuuucua

SEQ ID NO: 853983 - RNA, 22 nt, Human
gacuuucugauguaaacauuua

SEQ ID NO: 853984 - RNA, 22 nt, Human
aaucauaauuguauacauucau

SEQ ID NO: 853985 - RNA, 22 nt, Human
uagaaagacuguccagauuuca

SEQ ID NO: 853986 - RNA, 22 nt, Human
cccaggagguggagguugcggu

SEQ ID NO: 853987 - RNA, 22 nt, Human
acagucuugagcaucagccaga

SEQ ID NO: 853988 - RNA, 22 nt, Human
aaguaaucuggaauuugguuuu

SEQ ID NO: 853989 - RNA, 22 nt, Human
cagggcuggguuaaaagcaggg

SEQ ID NO: 853990 - RNA, 22 nt, Human
acuggccaggagcuggaaauac

SEQ ID NO: 853991 - RNA, 22 nt, Human
aaggccaacuaggaugagcuag

SEQ ID NO: 853992 - RNA, 22 nt, Human
aaguugagaugucauaggagac

SEQ ID NO: 853993 - RNA, 22 nt, Human
aggguggcugaguagauggaag

SEQ ID NO: 853994 - RNA, 22 nt, Human
gaaauaagaguccaugccaggu

SEQ ID NO: 853995 - RNA, 22 nt, Human
gcugagugagguccagagcuug

SEQ ID NO: 853996 - RNA, 22 nt, Human
aagagggcagcacagguggguc

SEQ ID NO: 853997 - RNA, 20 nt, Human
aggcaccugucacaggugag

SEQ ID NO: 853998 - RNA, 22 nt, Human
ugaaagguuauuuaggucugcu

SEQ ID NO: 853999 - RNA, 22 nt, Human
acuggcagagacccugauggcc

SEQ ID NO: 854000 - RNA, 21 nt, Human
caaauacuuagaaacuuaaga

SEQ ID NO: 854001 - RNA, 22 nt, Human
gugaggucaaagccuuggguau

SEQ ID NO: 854002 - RNA, 23 nt, Human
ucagucuucccugucaguaauag

SEQ ID NO: 854003 - RNA, 18 nt, Human
ucaggcuggaaguuugcc

SEQ ID NO: 854004 - RNA, 22 nt, Human
agaaggggagaagcuaccagga

SEQ ID NO: 854005 - RNA, 22 nt, Human
caggcagccaggggaccugucc

SEQ ID NO: 854006 - RNA, 22 nt, Human
ucauuucuauugcuacugucug

SEQ ID NO: 854007 - RNA, 22 nt, Human
gugcugugucuaucaggaauaa

SEQ ID NO: 854008 - RNA, 22 nt, Human
auuugaauggcuuaacacaacg

SEQ ID NO: 854009 - RNA, 22 nt, Human
gacagagaggcugagcaguaca

SEQ ID NO: 854010 - RNA, 22 nt, Human
cugaggcugggcuugccuucuu

SEQ ID NO: 854011 - RNA, 22 nt, Human
acagaaauugcuaauagcucau

SEQ ID NO: 854012 - RNA, 21 nt, Human
caugcaggauuuaaccuagaa

SEQ ID NO: 854013 - RNA, 22 nt, Human
cgucuuccucuuacgaugcgcu

SEQ ID NO: 854014 - RNA, 22 nt, Human
uugagaagaauguguugaguuu

SEQ ID NO: 854015 - RNA, 22 nt, Human
cccaggaguuagagguuguggu

SEQ ID NO: 854016 - RNA, 22 nt, Human
ugaaaaaacaaguuggcccauu

SEQ ID NO: 854017 - RNA, 22 nt, Human
uggaaauguauuugggcaugcc

SEQ ID NO: 854018 - RNA, 22 nt, Human
uuaguaaauaaagucuacuuuc

SEQ ID NO: 854019 - RNA, 22 nt, Human
caaaacugucuagagagagaag

SEQ ID NO: 854020 - RNA, 19 nt, Human
gcuuuggagggagguucua

SEQ ID NO: 854021 - RNA, 22 nt, Human
gaggaggccaguggaaggaagc

SEQ ID NO: 854022 - RNA, 22 nt, Human
ccuggccacucagguguggggc

SEQ ID NO: 854023 - RNA, 22 nt, Human
accaggagggacccugguggcc

SEQ ID NO: 854024 - RNA, 22 nt, Human
uugcaucuagggcaacccagag

SEQ ID NO: 854025 - RNA, 20 nt, Human
gaggcugaaguguuuuugcu

SEQ ID NO: 854026 - RNA, 19 nt, Human
auacagauguauccaugau

SEQ ID NO: 854027 - RNA, 22 nt, Human
gaggcagcuuaggguacugacu

SEQ ID NO: 854028 - RNA, 22 nt, Human
ucaggagaaagccaauuagagu

SEQ ID NO: 854029 - RNA, 22 nt, Human
uccugggcgguuaugugaucug

SEQ ID NO: 854030 - RNA, 22 nt, Human
cugcgcagcaaucagagaggag

SEQ ID NO: 854031 - RNA, 22 nt, Human
cugagagugcucuuugauguca

SEQ ID NO: 854032 - RNA, 22 nt, Human
gcaggagacuggcugugguagu

SEQ ID NO: 854033 - RNA, 22 nt, Human
uuacacuuaccuguccauugaa

SEQ ID NO: 854034 - RNA, 22 nt, Human
uaucuguuguccaugcagaaag

SEQ ID NO: 854035 - RNA, 22 nt, Human
cugagggcccugaagcuuggca

SEQ ID NO: 854036 - RNA, 22 nt, Human
gacugguaaggaaauucacuaa

SEQ ID NO: 854037 - RNA, 22 nt, Human
ccagcagagcauggggaggaag

SEQ ID NO: 854038 - RNA, 22 nt, Human
acugagguuucauuuuaucgcu

SEQ ID NO: 854039 - RNA, 22 nt, Human
ugaaaugaaugugauucgauag

SEQ ID NO: 854040 - RNA, 22 nt, Human
cagaacuguuauaacagcuguu

SEQ ID NO: 854041 - RNA, 23 nt, Human
agcugaggugcagauccaaagaa

SEQ ID NO: 854042 - RNA, 22 nt, Human
gcccaggaagccaccgggaagu

SEQ ID NO: 854043 - RNA, 22 nt, Human
uccuucuuugacaaguggcaga

SEQ ID NO: 854044 - RNA, 21 nt, Human
auuuggauauugcuggcaaau

SEQ ID NO: 854045 - RNA, 22 nt, Human
cagcagagggagccauugaaau

SEQ ID NO: 854046 - RNA, 22 nt, Human
ugacuuuaagcuaucugauucu

SEQ ID NO: 854047 - RNA, 20 nt, Human
uuucaagucagcaauucuca

SEQ ID NO: 854048 - RNA, 22 nt, Human
gaucauuugcaggaaacauuaa

SEQ ID NO: 854049 - RNA, 22 nt, Human
ugcugaggaauuugguuuaugu

SEQ ID NO: 854050 - RNA, 22 nt, Human
agacgagggcccccaggacagc

SEQ ID NO: 854051 - RNA, 22 nt, Human
gccagagccggcuucacaggau

SEQ ID NO: 854052 - RNA, 22 nt, Human
gcugagguggcugccuuaguaa

SEQ ID NO: 854053 - RNA, 22 nt, Human
gaggcagugcauugucuagggg

SEQ ID NO: 854054 - RNA, 22 nt, Human
ucaggagaaaauaucaggaagu

SEQ ID NO: 854055 - RNA, 21 nt, Human
gcugcaucaaucuacccaggg

SEQ ID NO: 854056 - RNA, 22 nt, Human
acaugauuuuaguaucauaaua

SEQ ID NO: 854057 - RNA, 22 nt, Human
acugagguuauugcaauaaaau

SEQ ID NO: 854058 - RNA, 22 nt, Human
uucuucaaccaucuacauaaac

SEQ ID NO: 854059 - RNA, 22 nt, Human
uccaggagaaggccauccagcg

SEQ ID NO: 854060 - RNA, 22 nt, Human
agucagugaaugguguaugcua

SEQ ID NO: 854061 - RNA, 22 nt, Human
cauuuaguuuugcaguagcagg

SEQ ID NO: 854062 - RNA, 22 nt, Human
aggcaguguguagcuggaagag

SEQ ID NO: 854063 - RNA, 22 nt, Human
cugcugugugcuuacuuggguu

SEQ ID NO: 854064 - RNA, 22 nt, Human
gucugcuggugccuggccugcg

SEQ ID NO: 854065 - RNA, 22 nt, Human
agaggauguucuaggcacucau

SEQ ID NO: 854066 - RNA, 22 nt, Human
caguggagagacuuuuacucuu

SEQ ID NO: 854067 - RNA, 22 nt, Human
cuauuaggcuuccauuucaugc

SEQ ID NO: 854068 - RNA, 22 nt, Human
auuaaauuggaucugcauaguu

SEQ ID NO: 854069 - RNA, 22 nt, Human
uugaggucaaagaagugagugg

SEQ ID NO: 854070 - RNA, 22 nt, Human
uuggcaguaaaagaaaaugcuu

SEQ ID NO: 854071 - RNA, 22 nt, Human
cagggcuguuagcugcugcucu

SEQ ID NO: 854072 - RNA, 22 nt, Human
gcugauguuuaguugauguuac

SEQ ID NO: 854073 - RNA, 22 nt, Human
aggcuagauagagggucaucuu

SEQ ID NO: 854074 - RNA, 22 nt, Human
uaaaugagggcugacaugauug

SEQ ID NO: 854075 - RNA, 22 nt, Human
uggugguuaugcgcuuuguggg

SEQ ID NO: 854076 - RNA, 22 nt, Human
aacuggaucaguugagggaggc

SEQ ID NO: 854077 - RNA, 22 nt, Human
agucucuuuguggacucugccu

SEQ ID NO: 854078 - RNA, 22 nt, Human
augaaacaguguguauagcaaa

SEQ ID NO: 854079 - RNA, 22 nt, Human
gcagcugcagagaccggguggg

SEQ ID NO: 854080 - RNA, 22 nt, Human
uugguuuaggaacuggcuugga

SEQ ID NO: 854081 - RNA, 22 nt, Human
cauuuguaauacugacuugcag

SEQ ID NO: 854082 - RNA, 22 nt, Human
gcuccuggauguucaagucggc

SEQ ID NO: 854083 - RNA, 22 nt, Human
aaggcagccgugugacugcaug

SEQ ID NO: 854084 - RNA, 22 nt, Human
gcugccuccugaaagcgcucug

SEQ ID NO: 854085 - RNA, 22 nt, Human
acagaaauuagcagugaguuua

SEQ ID NO: 854086 - RNA, 22 nt, Human
uccaggagaggccugaccaggu

SEQ ID NO: 854087 - RNA, 22 nt, Human
aaguccaugaucaagauguggc

SEQ ID NO: 854088 - RNA, 22 nt, Human
uuucuaggucuuccauacugcc

SEQ ID NO: 854089 - RNA, 22 nt, Human
uucccaugccuggccccuaucc

SEQ ID NO: 854090 - RNA, 22 nt, Human
gcagacaggcccaguggaggga

SEQ ID NO: 854091 - RNA, 22 nt, Human
aggcagcuucugauuagcagcg

SEQ ID NO: 854092 - RNA, 22 nt, Human
acaacauuauacauagaaagcu

SEQ ID NO: 854093 - RNA, 22 nt, Human
cauaauauacuacauugaugaa

SEQ ID NO: 854094 - RNA, 22 nt, Human
gcuccuggcucuggccaaggga

SEQ ID NO: 854095 - RNA, 22 nt, Human
ccaggacagugaacauguaaga

SEQ ID NO: 854096 - RNA, 22 nt, Human
ccccagagagcaccaugaagcc

SEQ ID NO: 854097 - RNA, 22 nt, Human
caaaugauaccuauuacuaggc

SEQ ID NO: 854098 - RNA, 22 nt, Human
uuggccaaaaaagucauuagaa

SEQ ID NO: 854099 - RNA, 22 nt, Human
uauuggucuuggaagguuuugu

SEQ ID NO: 854100 - RNA, 22 nt, Human
uuuuuauaacucuuuugugaca

SEQ ID NO: 854101 - RNA, 22 nt, Human
gugguccaucaugcagagcucc

SEQ ID NO: 854102 - RNA, 22 nt, Human
gcuggcugugauuuugccaaca

SEQ ID NO: 854103 - RNA, 22 nt, Human
gcaggcugauagaggauuccau

SEQ ID NO: 854104 - RNA, 21 nt, Human
cccaggaguccuauuuaaaug

SEQ ID NO: 854105 - RNA, 22 nt, Human
uggcagcacuagguacugagcu

SEQ ID NO: 854106 - RNA, 22 nt, Human
ggugagaggcagaggacagcuu

SEQ ID NO: 854107 - RNA, 19 nt, Human
gcagcugcuugaaaagaaa

SEQ ID NO: 854108 - RNA, 22 nt, Human
acauuuaaccaaacuguuuaau

SEQ ID NO: 854109 - RNA, 22 nt, Human
uaauuauagcauuggaguggcc

SEQ ID NO: 854110 - RNA, 20 nt, Human
cugagagucugugcuuaguc

SEQ ID NO: 854111 - RNA, 21 nt, Human
agagaaagucauggcuguggc

SEQ ID NO: 854112 - RNA, 22 nt, Human
ucugagguccuacuauaagugg

SEQ ID NO: 854113 - RNA, 22 nt, Human
ucauuucaaguucugacagcua

SEQ ID NO: 854114 - RNA, 23 nt, Human
aggcuccacucccugggaugugg

SEQ ID NO: 854115 - RNA, 22 nt, Human
ggauggcagucugcaugagaaa

SEQ ID NO: 854116 - RNA, 22 nt, Human
auuaggauuugguauggucaua

SEQ ID NO: 854117 - RNA, 22 nt, Human
aacaacugaaaagcuuuuucug

SEQ ID NO: 854118 - RNA, 22 nt, Human
aaggcagccucugccagccggg

SEQ ID NO: 854119 - RNA, 22 nt, Human
agugcuguaacaacuuauuugg

SEQ ID NO: 854120 - RNA, 22 nt, Human
aaguuauaucaucucauugacg

SEQ ID NO: 854121 - RNA, 22 nt, Human
uuuagagcccaugugaguguga

SEQ ID NO: 854122 - RNA, 22 nt, Human
uuucuaggcacagugucuuccc

SEQ ID NO: 854123 - RNA, 22 nt, Human
auuuguugcuagcagcacugau

SEQ ID NO: 854124 - RNA, 22 nt, Human
gagggaugguaguugacacuga

SEQ ID NO: 854125 - RNA, 22 nt, Human
cagaggucugacacugaauggu

SEQ ID NO: 854126 - RNA, 22 nt, Human
cacaauuuccuugcuucacuuu

SEQ ID NO: 854127 - RNA, 22 nt, Human
caggaggggguggaguuucgcc

SEQ ID NO: 854128 - RNA, 22 nt, Human
ggauggcaggacaaggacccag

SEQ ID NO: 854129 - RNA, 22 nt, Human
guggccaaggugcagagcagcu

SEQ ID NO: 854130 - RNA, 22 nt, Human
uuuaguucucccagucuugauu

SEQ ID NO: 854131 - RNA, 22 nt, Human
gggcugagcuaagcuggguuga

SEQ ID NO: 854132 - RNA, 22 nt, Human
gauauuuugagaaauccuauga

SEQ ID NO: 854133 - RNA, 18 nt, Human
agcuucccucugagaggg

SEQ ID NO: 854134 - RNA, 22 nt, Human
ugcuuucaaaggcuuucuagau

SEQ ID NO: 854135 - RNA, 22 nt, Human
uccaggagguuuggaggaagca

SEQ ID NO: 854136 - RNA, 22 nt, Human
gaaauuaaccaccuuuggcuuu

SEQ ID NO: 854137 - RNA, 22 nt, Human
uaggaugacacagcaaguauag

SEQ ID NO: 854138 - RNA, 22 nt, Human
auucauuuagguauucacuuac

SEQ ID NO: 854139 - RNA, 22 nt, Human
aacuauacauauuuacauagac

SEQ ID NO: 854140 - RNA, 22 nt, Human
aagcaauagcaacaacuuuaca

SEQ ID NO: 854141 - RNA, 22 nt, Human
ugaggcagugugagauaauaaa

SEQ ID NO: 854142 - RNA, 22 nt, Human
uaucuuguaauagguccacuug

SEQ ID NO: 854143 - RNA, 22 nt, Human
uuagagccccagaaaacagugg

SEQ ID NO: 854144 - RNA, 22 nt, Human
caacugccauacagcuccaugg

SEQ ID NO: 854145 - RNA, 22 nt, Human
caaggccaagguuuugugaacu

SEQ ID NO: 854146 - RNA, 22 nt, Human
ccagugcuucuuugcuagcugg

SEQ ID NO: 854147 - RNA, 22 nt, Human
aaacccugcccuucccaagaug

SEQ ID NO: 854148 - RNA, 22 nt, Human
cagaugagcaugggcacaagca

SEQ ID NO: 854149 - RNA, 21 nt, Human
cacugguagauggcccgcagg

SEQ ID NO: 854150 - RNA, 18 nt, Human
gcagcuagccaggggggc

SEQ ID NO: 854151 - RNA, 22 nt, Human
gcaccuuuuucuaggagaaugu

SEQ ID NO: 854152 - RNA, 22 nt, Human
accaggaggccuugguucugag

SEQ ID NO: 854153 - RNA, 22 nt, Human
uuugacaaaggaaaaaugcaca

SEQ ID NO: 854154 - RNA, 22 nt, Human
ugaacucgggaggaggcugcag

SEQ ID NO: 854155 - RNA, 22 nt, Human
ugucucaguacacuccgauguu

SEQ ID NO: 854156 - RNA, 22 nt, Human
cuucuagagcuggagcaaaugu

SEQ ID NO: 854157 - RNA, 22 nt, Human
uugggcucaggaguuugagacc

SEQ ID NO: 854158 - RNA, 22 nt, Human
acacuuuuguguauauccaguu

SEQ ID NO: 854159 - RNA, 22 nt, Human
ucucagucagccuugauguccc

SEQ ID NO: 854160 - RNA, 19 nt, Human
accaggaguaucagagcug

SEQ ID NO: 854161 - RNA, 22 nt, Human
uccuggcccaaucugcccauga

SEQ ID NO: 854162 - RNA, 22 nt, Human
aaaauacuguggaguguugaaa

SEQ ID NO: 854163 - RNA, 22 nt, Human
gcugccuccacuggcucccagu

SEQ ID NO: 854164 - RNA, 22 nt, Human
cauucucaauaguagaugagua

SEQ ID NO: 854165 - RNA, 22 nt, Human
ucucuguaguugggcagcugcu

SEQ ID NO: 854166 - RNA, 22 nt, Human
aucaggaucugggagccugaaa

SEQ ID NO: 854167 - RNA, 22 nt, Human
guuaauaaagguauagaaucag

SEQ ID NO: 854168 - RNA, 22 nt, Human
cccaggagccaucugucuuggc

SEQ ID NO: 854169 - RNA, 22 nt, Human
ggccagcucuuguccacggagg

SEQ ID NO: 854170 - RNA, 22 nt, Human
ugaacaaacugcauucuucacu

SEQ ID NO: 854171 - RNA, 17 nt, Human
agagagagcaugccacc

SEQ ID NO: 854172 - RNA, 22 nt, Human
uggcagcagaacaugaaaccca

SEQ ID NO: 854173 - RNA, 22 nt, Human
ucugugccuccguaacacacca

SEQ ID NO: 854174 - RNA, 22 nt, Human
uaggauaugugaaaucauauua

SEQ ID NO: 854175 - RNA, 22 nt, Human
uggguccacuucugcacugugg

SEQ ID NO: 854176 - RNA, 22 nt, Human
gaaggucaccuccccucucugg

SEQ ID NO: 854177 - RNA, 22 nt, Human
agcugaggcaugaugcuaucag

SEQ ID NO: 854178 - RNA, 22 nt, Human
uuuauuaauguagcauccaugg

SEQ ID NO: 854179 - RNA, 22 nt, Human
ucuggagaggggccuagaauuu

SEQ ID NO: 854180 - RNA, 22 nt, Human
ugcugcuguugacggcugucca

SEQ ID NO: 854181 - RNA, 18 nt, Human
aggauauuaagaguacag

SEQ ID NO: 854182 - RNA, 22 nt, Human
ugaaggccucugguacaugcca

SEQ ID NO: 854183 - RNA, 22 nt, Human
cagagccauuauggagacuugc

SEQ ID NO: 854184 - RNA, 22 nt, Human
cuggcacaaugucacuuuugcu

SEQ ID NO: 854185 - RNA, 22 nt, Human
uaacuguagcuaaccgaugaga

SEQ ID NO: 854186 - RNA, 22 nt, Human
ggcagcaucacuugucuccagc

SEQ ID NO: 854187 - RNA, 22 nt, Human
cccaggaaugggaaggaggaau

SEQ ID NO: 854188 - RNA, 22 nt, Human
caccagaguuguccaaaugauu

SEQ ID NO: 854189 - RNA, 22 nt, Human
acacuuucuggagcugcacaua

SEQ ID NO: 854190 - RNA, 22 nt, Human
uuucuagucucgaucucuuaau

SEQ ID NO: 854191 - RNA, 22 nt, Human
gcugagaggcagccagacccuc

SEQ ID NO: 854192 - RNA, 22 nt, Human
aucugcuugaaugagcaacagg

SEQ ID NO: 854193 - RNA, 22 nt, Human
ccugaggucaugguccaguguu

SEQ ID NO: 854194 - RNA, 22 nt, Human
auuuauuaccucggaguuucug

SEQ ID NO: 854195 - RNA, 22 nt, Human
uuuacaaccucauauucugaug

SEQ ID NO: 854196 - RNA, 23 nt, Human
agggugagcaagcuauggagacc

SEQ ID NO: 854197 - RNA, 22 nt, Human
gaacuggucuuuuagguuuucu

SEQ ID NO: 854198 - RNA, 22 nt, Human
uagcaagaggugaagguuucau

SEQ ID NO: 854199 - RNA, 22 nt, Human
cugaggccccucuugugagcau

SEQ ID NO: 854200 - RNA, 22 nt, Human
ugguccaagugagguggccucu

SEQ ID NO: 854201 - RNA, 22 nt, Human
ucugaaaugcaaauuugacuga

SEQ ID NO: 854202 - RNA, 22 nt, Human
ucugggaaccagugcggcuggg

SEQ ID NO: 854203 - RNA, 22 nt, Human
ucaggcugauaggaggaacuga

SEQ ID NO: 854204 - RNA, 20 nt, Human
ugaaggccauuuguuccaga

SEQ ID NO: 854205 - RNA, 21 nt, Human
gauuuuaaagagacugccaca

SEQ ID NO: 854206 - RNA, 22 nt, Human
ucaggcugaaucauccuagcuu

SEQ ID NO: 854207 - RNA, 22 nt, Human
aagcacugagcacaguggcuga

SEQ ID NO: 854208 - RNA, 22 nt, Human
agcucccagagcucgagaguaa

SEQ ID NO: 854209 - RNA, 22 nt, Human
gaggggaaaguucugcacaagg

SEQ ID NO: 854210 - RNA, 22 nt, Human
gccacagcucacguuccccauu

SEQ ID NO: 854211 - RNA, 22 nt, Human
cacaggcucuccagggccugga

SEQ ID NO: 854212 - RNA, 22 nt, Human
cuugaacucaaugugaggaaga

SEQ ID NO: 854213 - RNA, 22 nt, Human
gggcugagaauucagcuuuccu

SEQ ID NO: 854214 - RNA, 22 nt, Human
gaggcaucugggcacagaagug

SEQ ID NO: 854215 - RNA, 22 nt, Human
ucauuuaauaauuuuugaguag

SEQ ID NO: 854216 - RNA, 22 nt, Human
ggcugcagauagccagccacca

SEQ ID NO: 854217 - RNA, 19 nt, Human
acuuccugcccgcuccuuu

SEQ ID NO: 854218 - RNA, 22 nt, Human
agaggccagguccagaguuugu

SEQ ID NO: 854219 - RNA, 22 nt, Human
uugaaagaggcaaaguuugauc

SEQ ID NO: 854220 - RNA, 22 nt, Human
ucuucaauuagauuuaccaauu

SEQ ID NO: 854221 - RNA, 22 nt, Human
uucaggauggcggauguugggg

SEQ ID NO: 854222 - RNA, 22 nt, Human
ugguuuugcuaaaauagaaaga

SEQ ID NO: 854223 - RNA, 22 nt, Human
uucuucuugucugcccucacau

SEQ ID NO: 854224 - RNA, 23 nt, Human
uugauuucaaaugcagagaacac

SEQ ID NO: 854225 - RNA, 22 nt, Human
gacacuuucucagguaaagcau

SEQ ID NO: 854226 - RNA, 22 nt, Human
gaaguacaguuuuaucuagcca

SEQ ID NO: 854227 - RNA, 22 nt, Human
gcccaggagguugggcugugca

SEQ ID NO: 854228 - RNA, 22 nt, Human
cuccugggaauuuaguugugag

SEQ ID NO: 854229 - RNA, 22 nt, Human
acuuugcagggcuugauaucca

SEQ ID NO: 854230 - RNA, 22 nt, Human
cuggagucacucauguagcugc

SEQ ID NO: 854231 - RNA, 22 nt, Human
aauaguuaagcaacuuuuucca

SEQ ID NO: 854232 - RNA, 22 nt, Human
cccagggauuauaaaggugaaa

SEQ ID NO: 854233 - RNA, 22 nt, Human
uaaggccagccagcaaaucugu

SEQ ID NO: 854234 - RNA, 22 nt, Human
aggcuccaccagucaggugcau

SEQ ID NO: 854235 - RNA, 22 nt, Human
gggcagcugccccucucugggc

SEQ ID NO: 854236 - RNA, 22 nt, Human
cagagcagucuggagauccagc

SEQ ID NO: 854237 - RNA, 22 nt, Human
ugagaugcuaaagggcugcuca

SEQ ID NO: 854238 - RNA, 22 nt, Human
ccuggacucaggcugugggcac

SEQ ID NO: 854239 - RNA, 22 nt, Human
agcuggcagucauccuagugag

SEQ ID NO: 854240 - RNA, 22 nt, Human
auguauuucuauguagugaaga

SEQ ID NO: 854241 - RNA, 21 nt, Human
uggaggaauaaagcacagaag

SEQ ID NO: 854242 - RNA, 22 nt, Human
aggccaaagcaagacccuguaa

SEQ ID NO: 854243 - RNA, 22 nt, Human
aagauacugaugauguaggcua

SEQ ID NO: 854244 - RNA, 22 nt, Human
gcugaaauucagauuccuaggc

SEQ ID NO: 854245 - RNA, 21 nt, Human
cucuuuauauaguaaagauau

SEQ ID NO: 854246 - RNA, 23 nt, Human
ugcuggcugaaacagccaaagga

SEQ ID NO: 854247 - RNA, 22 nt, Human
aagggcaggaaaagauggaugu

SEQ ID NO: 854248 - RNA, 22 nt, Human
ccaggagagcauugcacagagg

SEQ ID NO: 854249 - RNA, 22 nt, Human
guaggcagggcuguggggagaa

SEQ ID NO: 854250 - RNA, 17 nt, Human
agugucagggcccuucc

SEQ ID NO: 854251 - RNA, 22 nt, Human
cccagggacucgggauucuagg

SEQ ID NO: 854252 - RNA, 22 nt, Human
uaaaugaagcucaugggccaca

SEQ ID NO: 854253 - RNA, 22 nt, Human
acuggccagaacuaagucacau

SEQ ID NO: 854254 - RNA, 22 nt, Human
uauuucagcacaugggauaggu

SEQ ID NO: 854255 - RNA, 22 nt, Human
accaugucauuuauuggccaaa

SEQ ID NO: 854256 - RNA, 22 nt, Human
gcugccucccagagcccugcag

SEQ ID NO: 854257 - RNA, 22 nt, Human
ucagaaaagagaaaaucuuaua

SEQ ID NO: 854258 - RNA, 22 nt, Human
ugacaguuaagguauacauuca

SEQ ID NO: 854259 - RNA, 22 nt, Human
uaggcuggaggaagcagugccu

SEQ ID NO: 854260 - RNA, 22 nt, Human
ugcaccuucauuuuaggcagcu

SEQ ID NO: 854261 - RNA, 22 nt, Human
gugugcagggaugagugcaggu

SEQ ID NO: 854262 - RNA, 22 nt, Human
auuaagaucauuguagaagauu

SEQ ID NO: 854263 - RNA, 22 nt, Human
gcauguguuauuuuauguauga

SEQ ID NO: 854264 - RNA, 22 nt, Human
cagaaguuugacauguuuagcu

SEQ ID NO: 854265 - RNA, 22 nt, Human
agauauauuuaagguaauaagu

SEQ ID NO: 854266 - RNA, 22 nt, Human
cacagagcugaaccugggucau

SEQ ID NO: 854267 - RNA, 22 nt, Human
cucaggauauugggcuggagca

SEQ ID NO: 854268 - RNA, 22 nt, Human
uugcaaaggggaauaaagcaau

SEQ ID NO: 854269 - RNA, 22 nt, Human
cugcugucauagccaucccucc

SEQ ID NO: 854270 - RNA, 22 nt, Human
uccaggagguugagugaguucc

SEQ ID NO: 854271 - RNA, 22 nt, Human
uggcagcagacaucugaggucu

SEQ ID NO: 854272 - RNA, 22 nt, Human
cggagccugcuuguugcagcug

SEQ ID NO: 854273 - RNA, 22 nt, Human
gucccauaaguagugcaacuug

SEQ ID NO: 854274 - RNA, 20 nt, Human
cccaggagugagcagcuuua

SEQ ID NO: 854275 - RNA, 22 nt, Human
augauauuugcaaugugcuugc

SEQ ID NO: 854276 - RNA, 22 nt, Human
acuuucugcaguguuggaaaug

SEQ ID NO: 854277 - RNA, 22 nt, Human
aagacacugauacucugugauu

SEQ ID NO: 854278 - RNA, 22 nt, Human
cugccuggcauggagaagagaa

SEQ ID NO: 854279 - RNA, 21 nt, Human
cccaggaggagcuccggcucc

SEQ ID NO: 854280 - RNA, 22 nt, Human
cccaguuucaacuuuccagugg

SEQ ID NO: 854281 - RNA, 22 nt, Human
ccagagcuucggggcggcugua

SEQ ID NO: 854282 - RNA, 22 nt, Human
agacagguaaauagagaugcug

SEQ ID NO: 854283 - RNA, 22 nt, Human
ugaggcaggacugagcgggaug

SEQ ID NO: 854284 - RNA, 22 nt, Human
auuucagauucagaaauguagg

SEQ ID NO: 854285 - RNA, 18 nt, Human
gcuuuauuucuuggggaa

SEQ ID NO: 854286 - RNA, 22 nt, Human
aggcugagccugggcguggugg

SEQ ID NO: 854287 - RNA, 22 nt, Human
guccaugauucugugacacccu

SEQ ID NO: 854288 - RNA, 17 nt, Human
cagggcugucugccuag

SEQ ID NO: 854289 - RNA, 22 nt, Human
uuucugugguggguaguucaga

SEQ ID NO: 854290 - RNA, 22 nt, Human
aagggcuggucuagaaagggag

SEQ ID NO: 854291 - RNA, 17 nt, Human
ccuguguuugcuccuuc

SEQ ID NO: 854292 - RNA, 22 nt, Human
aaagcagagguugcagugagcu

SEQ ID NO: 854293 - RNA, 17 nt, Human
uggcaugaggguguggg

SEQ ID NO: 854294 - RNA, 20 nt, Human
uacuuaggcuuguuuuggcc

SEQ ID NO: 854295 - RNA, 22 nt, Human
aguuacaguguucuauuacucu

SEQ ID NO: 854296 - RNA, 22 nt, Human
aagacugucuuuucugagugac

SEQ ID NO: 854297 - RNA, 22 nt, Human
aggcuggagagugcaguggcgu

SEQ ID NO: 854298 - RNA, 22 nt, Human
cagugcugagagccuggccagg

SEQ ID NO: 854299 - RNA, 22 nt, Human
ugccugugucacagugauguuu

SEQ ID NO: 854300 - RNA, 22 nt, Human
uucucagguagugcugaugcug

SEQ ID NO: 854301 - RNA, 22 nt, Human
uggcagacuuuagggucuacau

SEQ ID NO: 854302 - RNA, 22 nt, Human
cuuuguauucaguugggcugug

SEQ ID NO: 854303 - RNA, 21 nt, Human
ugcccuggggcucuucccuca

SEQ ID NO: 854304 - RNA, 22 nt, Human
auacaguaaccacauucuauag

SEQ ID NO: 854305 - RNA, 23 nt, Human
uuugaaguugacugccuuccaga

SEQ ID NO: 854306 - RNA, 22 nt, Human
ucacagacauggugagguaaca

SEQ ID NO: 854307 - RNA, 22 nt, Human
gcuccuggcucucugagggcug

SEQ ID NO: 854308 - RNA, 22 nt, Human
aggguggcuggaggaaucagaa

SEQ ID NO: 854309 - RNA, 22 nt, Human
gaaaaaugcuccaaaucugugg

SEQ ID NO: 854310 - RNA, 22 nt, Human
uuaaaugagauguucagauauu

SEQ ID NO: 854311 - RNA, 22 nt, Human
ucuuuucaucauuuaauaggua

SEQ ID NO: 854312 - RNA, 22 nt, Human
ugccgcagugcggggagggccc

SEQ ID NO: 854313 - RNA, 22 nt, Human
gaaacuguauguaguuuuuggg

SEQ ID NO: 854314 - RNA, 22 nt, Human
acaguaaccucuccucugaagg

SEQ ID NO: 854315 - RNA, 22 nt, Human
ucaucucaaaacccaaggggca

SEQ ID NO: 854316 - RNA, 22 nt, Human
ugaggcccuagggcaugggaga

SEQ ID NO: 854317 - RNA, 22 nt, Human
ugcacagugaccccuggugacu

SEQ ID NO: 854318 - RNA, 22 nt, Human
gagugucugaauuagagcacaa

SEQ ID NO: 854319 - RNA, 22 nt, Human
caacugagcaguagcgucugga

SEQ ID NO: 854320 - RNA, 22 nt, Human
ccaggaagcugucugauaugaa

SEQ ID NO: 854321 - RNA, 22 nt, Human
ucuuugaauucaaacuguucaa

SEQ ID NO: 854322 - RNA, 22 nt, Human
agaggcagccguauuucaaagg

SEQ ID NO: 854323 - RNA, 22 nt, Human
cagugauguuucugcaucagag

SEQ ID NO: 854324 - RNA, 20 nt, Human
cccaggagcugugccccauc

SEQ ID NO: 854325 - RNA, 19 nt, Human
uucauucucuuauuguugu

SEQ ID NO: 854326 - RNA, 22 nt, Human
gggcugagggguaucucauggg

SEQ ID NO: 854327 - RNA, 22 nt, Human
uuuucauuguuacuaugagcua

SEQ ID NO: 854328 - RNA, 22 nt, Human
cugagcgcgggaccugaggcug

SEQ ID NO: 854329 - RNA, 22 nt, Human
ucccaggaugaagacaguguug

SEQ ID NO: 854330 - RNA, 22 nt, Human
ggcagcuuguccuucaggagag

SEQ ID NO: 854331 - RNA, 22 nt, Human
agcauccaacaggagggaaggg

SEQ ID NO: 854332 - RNA, 22 nt, Human
aggacugacuuuugccaugaaa

SEQ ID NO: 854333 - RNA, 22 nt, Human
cuggagaguuggaagauggacu

SEQ ID NO: 854334 - RNA, 22 nt, Human
acaggccacaguggagucucug

SEQ ID NO: 854335 - RNA, 22 nt, Human
aagagagggguugcauggaaau

SEQ ID NO: 854336 - RNA, 22 nt, Human
uuggccaauccuauuggguggg

SEQ ID NO: 854337 - RNA, 22 nt, Human
uccuccccucagggcaacggau

SEQ ID NO: 854338 - RNA, 22 nt, Human
uuauuaguguugauauuaggau

SEQ ID NO: 854339 - RNA, 22 nt, Human
agcagcugauggggaaggaguu

SEQ ID NO: 854340 - RNA, 22 nt, Human
gagggaggggagcuccacccuc

SEQ ID NO: 854341 - RNA, 20 nt, Human
ccuccuggucaggugugcag

SEQ ID NO: 854342 - RNA, 22 nt, Human
uuugacauuggcuuauucuguu

SEQ ID NO: 854343 - RNA, 22 nt, Human
acccaggacucucuuccaguag

SEQ ID NO: 854344 - RNA, 22 nt, Human
ugaggggaacugaugcccauug

SEQ ID NO: 854345 - RNA, 22 nt, Human
aucuugcauuugcuaaaaugca

SEQ ID NO: 854346 - RNA, 22 nt, Human
ugugcaggugcaggaagggggc

SEQ ID NO: 854347 - RNA, 19 nt, Human
acagagcucucugcuucug

SEQ ID NO: 854348 - RNA, 22 nt, Human
uuucaucuucccagagaccuug

SEQ ID NO: 854349 - RNA, 22 nt, Human
gaagcagcuuucuggugaggag

SEQ ID NO: 854350 - RNA, 22 nt, Human
agugugagcccuggaguggugc

SEQ ID NO: 854351 - RNA, 22 nt, Human
gaacuggucaguuuagcccacu

SEQ ID NO: 854352 - RNA, 22 nt, Human
uuagaaagguuuugcucugaaa

SEQ ID NO: 854353 - RNA, 22 nt, Human
uuugagauggagucuugcucug

SEQ ID NO: 854354 - RNA, 22 nt, Human
uagcagaguaauacuuuggagc

SEQ ID NO: 854355 - RNA, 22 nt, Human
cagcugcaguucaaugcuugcu

SEQ ID NO: 854356 - RNA, 22 nt, Human
ucaggcugugggcacuggccau

SEQ ID NO: 854357 - RNA, 22 nt, Human
gacugaggugaccuaggacuac

SEQ ID NO: 854358 - RNA, 22 nt, Human
ccagagagauugcuucuaaaga

SEQ ID NO: 854359 - RNA, 19 nt, Human
caagugaagccugggaugg

SEQ ID NO: 854360 - RNA, 22 nt, Human
ugcuuggccuacuuguccuuug

SEQ ID NO: 854361 - RNA, 19 nt, Human
augauacaggugaaaauug

SEQ ID NO: 854362 - RNA, 22 nt, Human
cccaggaagaggggucaggugu

SEQ ID NO: 854363 - RNA, 22 nt, Human
cuggggcccgagccuugggcca

SEQ ID NO: 854364 - RNA, 22 nt, Human
agcugaggacgugaagggcggc

SEQ ID NO: 854365 - RNA, 22 nt, Human
accaggaguuuugaccaggggc

SEQ ID NO: 854366 - RNA, 19 nt, Human
uaacugguuaaaaagcuug

SEQ ID NO: 854367 - RNA, 22 nt, Human
uugcagcugcaguaaauguuca

SEQ ID NO: 854368 - RNA, 22 nt, Human
uguuggcauuagaggguuauug

SEQ ID NO: 854369 - RNA, 22 nt, Human
aauauuuguuaguguuuuaaug

SEQ ID NO: 854370 - RNA, 22 nt, Human
cuggagccccaggcugugcaga

SEQ ID NO: 854371 - RNA, 17 nt, Human
ucaggcugggugcagug

SEQ ID NO: 854372 - RNA, 22 nt, Human
gaugagcauuguuucauguguu

SEQ ID NO: 854373 - RNA, 22 nt, Human
cagcugagcugccagacuacug

SEQ ID NO: 854374 - RNA, 22 nt, Human
cuccuggaggauagugacuggg

SEQ ID NO: 854375 - RNA, 22 nt, Human
caggcagcccugcaccaagugu

SEQ ID NO: 854376 - RNA, 22 nt, Human
ugaaaggugacauuucuuggau

SEQ ID NO: 854377 - RNA, 22 nt, Human
gcugaggacaucauggaaggaa

SEQ ID NO: 854378 - RNA, 22 nt, Human
agaaucugaaggcaccucuggu

SEQ ID NO: 854379 - RNA, 22 nt, Human
aacaguaaagacagaauuuauc

SEQ ID NO: 854380 - RNA, 22 nt, Human
cuggcugggagcgagcugcuca

SEQ ID NO: 854381 - RNA, 22 nt, Human
ucaggcugcccguucagggcuc

SEQ ID NO: 854382 - RNA, 22 nt, Human
guuauacauauguguuaacaaa

SEQ ID NO: 854383 - RNA, 22 nt, Human
ucaggagaacuuccuucuaccc

SEQ ID NO: 854384 - RNA, 22 nt, Human
uucuucaauuuuccauauacug

SEQ ID NO: 854385 - RNA, 18 nt, Human
uuccaugauuccuuucac

SEQ ID NO: 854386 - RNA, 22 nt, Human
cuucugaagagguuaucauaga

SEQ ID NO: 854387 - RNA, 22 nt, Human
auacacauguuauuguggaagc

SEQ ID NO: 854388 - RNA, 22 nt, Human
gaagccuugaacugcaaacccc

SEQ ID NO: 854389 - RNA, 22 nt, Human
guucuucaucauuaacacucug

SEQ ID NO: 854390 - RNA, 22 nt, Human
gccaugcuugguaugcugugag

SEQ ID NO: 854391 - RNA, 22 nt, Human
cucaggaugcaauuccaucaag

SEQ ID NO: 854392 - RNA, 22 nt, Human
caggagaucuuaggaauucuua

SEQ ID NO: 854393 - RNA, 22 nt, Human
uauuuuaaagacugccagccua

SEQ ID NO: 854394 - RNA, 22 nt, Human
aacauaaauuugaaguggcaaa

SEQ ID NO: 854395 - RNA, 22 nt, Human
cagagaaaaaauccugcucuca

SEQ ID NO: 854396 - RNA, 22 nt, Human
agugcuuuaccuagauaauguu

SEQ ID NO: 854397 - RNA, 22 nt, Human
caaggccacugcucagguuucc

SEQ ID NO: 854398 - RNA, 22 nt, Human
uaggcagcugcaaacuucgguc

SEQ ID NO: 854399 - RNA, 22 nt, Human
caaaugauagagccgauuauca

SEQ ID NO: 854400 - RNA, 22 nt, Human
cagggucugaaacugaucacag

SEQ ID NO: 854401 - RNA, 20 nt, Human
acaggagaucugaggaaagg

SEQ ID NO: 854402 - RNA, 19 nt, Human
ggcaggcuggauagagagg

SEQ ID NO: 854403 - RNA, 22 nt, Human
ccuccuggugacaaggcaaagc

SEQ ID NO: 854404 - RNA, 22 nt, Human
ucugugcuggacugauuucaua

SEQ ID NO: 854405 - RNA, 22 nt, Human
auuagagcaguaauuguggcag

SEQ ID NO: 854406 - RNA, 22 nt, Human
auaaaugaacauucacagagcu

SEQ ID NO: 854407 - RNA, 22 nt, Human
gaccauuucuaggaaucagacu

SEQ ID NO: 854408 - RNA, 22 nt, Human
aguggcaguagaugagcugguu

SEQ ID NO: 854409 - RNA, 22 nt, Human
ugccugagugauguggcagcca

SEQ ID NO: 854410 - RNA, 17 nt, Human
cccaugagcccacuccc

SEQ ID NO: 854411 - RNA, 22 nt, Human
agaggcggagcuugcagugagc

SEQ ID NO: 854412 - RNA, 22 nt, Human
gagcagcucgagaaggaagcag

SEQ ID NO: 854413 - RNA, 22 nt, Human
gcggagggcgagcccgcggagc

SEQ ID NO: 854414 - RNA, 22 nt, Human
auccauuauugggccaauaaag

SEQ ID NO: 854415 - RNA, 22 nt, Human
cugcucuguucccccaucaucu

SEQ ID NO: 854416 - RNA, 22 nt, Human
cugaggccucguuggcuggaac

SEQ ID NO: 854417 - RNA, 22 nt, Human
ggaggaugccaagcugugcaca

SEQ ID NO: 854418 - RNA, 21 nt, Human
cccagggaagccgcagucacc

SEQ ID NO: 854419 - RNA, 22 nt, Human
auuccaaagguuaaugcccauu

SEQ ID NO: 854420 - RNA, 22 nt, Human
gauguuucaugcuagcaugugu

SEQ ID NO: 854421 - RNA, 22 nt, Human
acccaggagagagcuauaaaau

SEQ ID NO: 854422 - RNA, 22 nt, Human
cugucccuucauuauucacuac

SEQ ID NO: 854423 - RNA, 22 nt, Human
uuaggaguccagaugucuuggg

SEQ ID NO: 854424 - RNA, 20 nt, Human
accaauguuagcuuaguacu

SEQ ID NO: 854425 - RNA, 22 nt, Human
aguuggcauuuuauuuaaguau

SEQ ID NO: 854426 - RNA, 22 nt, Human
agucuuuccugcuugacuguuc

SEQ ID NO: 854427 - RNA, 22 nt, Human
ugaggcucaagaaagauuuguu

SEQ ID NO: 854428 - RNA, 20 nt, Human
gggugggagagucugagggu

SEQ ID NO: 854429 - RNA, 22 nt, Human
guggucagcagcagugggagug

SEQ ID NO: 854430 - RNA, 22 nt, Human
caaggccaguuucuccuaguca

SEQ ID NO: 854431 - RNA, 22 nt, Human
uagcuaucuguguccagaucca

SEQ ID NO: 854432 - RNA, 22 nt, Human
ugcugaggcauuuggacagagu

SEQ ID NO: 854433 - RNA, 19 nt, Human
ggcugcugguuacagaggc

SEQ ID NO: 854434 - RNA, 22 nt, Human
cccaggaggugugcccaacucg

SEQ ID NO: 854435 - RNA, 21 nt, Human
gggcagcucuguuuuauuuuc

SEQ ID NO: 854436 - RNA, 22 nt, Human
gucuucuuguguugccugucuu

SEQ ID NO: 854437 - RNA, 22 nt, Human
cuuauuucuccauccagaguca

SEQ ID NO: 854438 - RNA, 20 nt, Human
gcugaggucauuaugccuca

SEQ ID NO: 854439 - RNA, 22 nt, Human
aagcaauauacugauaugauua

SEQ ID NO: 854440 - RNA, 22 nt, Human
uagaacuguccaagucugagcu

SEQ ID NO: 854441 - RNA, 22 nt, Human
auucaaguucuucugucuuugc

SEQ ID NO: 854442 - RNA, 22 nt, Human
aaacugccacaagagggacauc

SEQ ID NO: 854443 - RNA, 22 nt, Human
cugaggccgucugggucugcag

SEQ ID NO: 854444 - RNA, 22 nt, Human
cugcuguguuucugcuagaaaa

SEQ ID NO: 854445 - RNA, 22 nt, Human
uuauuacacugaaagaauugcg

SEQ ID NO: 854446 - RNA, 22 nt, Human
gcuggccacauugugccguccu

SEQ ID NO: 854447 - RNA, 22 nt, Human
cucuucuugaaagaggaauuca

SEQ ID NO: 854448 - RNA, 22 nt, Human
aggcagcaugggccccagcucc

SEQ ID NO: 854449 - RNA, 18 nt, Human
agcagcugugccacacug

SEQ ID NO: 854450 - RNA, 22 nt, Human
cagcagcugcaaauggaaacag

SEQ ID NO: 854451 - RNA, 22 nt, Human
uuccuggcaccaccacuucuag

SEQ ID NO: 854452 - RNA, 22 nt, Human
uggccacaugcgucugugaggc

SEQ ID NO: 854453 - RNA, 22 nt, Human
aucacauucuuucaaagcaguc

SEQ ID NO: 854454 - RNA, 22 nt, Human
uaagaacuucggacauguuauc

SEQ ID NO: 854455 - RNA, 22 nt, Human
ucugagccacagauguccuguu

SEQ ID NO: 854456 - RNA, 21 nt, Human
ggcagcucagcagauggggac

SEQ ID NO: 854457 - RNA, 22 nt, Human
ugcccagggauaagccuagaga

SEQ ID NO: 854458 - RNA, 22 nt, Human
aaguaaaauguuuccuuuauua

SEQ ID NO: 854459 - RNA, 21 nt, Human
agccagcuaucacacagcauu

SEQ ID NO: 854460 - RNA, 21 nt, Human
gggugggaggacacagcaggc

SEQ ID NO: 854461 - RNA, 22 nt, Human
gucaggauuaaugggaguaugc

SEQ ID NO: 854462 - RNA, 22 nt, Human
cagaggcaggaagaugggcagu

SEQ ID NO: 854463 - RNA, 20 nt, Human
gccugccucagcuagcugag

SEQ ID NO: 854464 - RNA, 22 nt, Human
ucuuugaauuucugacugucuu

SEQ ID NO: 854465 - RNA, 22 nt, Human
ucucaggaucuaauacauggua

SEQ ID NO: 854466 - RNA, 22 nt, Human
aucaggauuauuaaaucuggau

SEQ ID NO: 854467 - RNA, 23 nt, Human
ggcugagacuacaggcgcuugcc

SEQ ID NO: 854468 - RNA, 19 nt, Human
ucccucccuguaaucucac

SEQ ID NO: 854469 - RNA, 22 nt, Human
auuugguagugauugaaauuau

SEQ ID NO: 854470 - RNA, 22 nt, Human
augaggucauccuggaguaagg

SEQ ID NO: 854471 - RNA, 22 nt, Human
uucacagucacccuucuccaug

SEQ ID NO: 854472 - RNA, 22 nt, Human
ugccuggaaggcccaugggaag

SEQ ID NO: 854473 - RNA, 22 nt, Human
uggcagcucuguucaacaugag

SEQ ID NO: 854474 - RNA, 21 nt, Human
auucugaguugucagucuuca

SEQ ID NO: 854475 - RNA, 20 nt, Human
cagaggcauuuucagacucu

SEQ ID NO: 854476 - RNA, 22 nt, Human
aggcacaggaaugucauccagu

SEQ ID NO: 854477 - RNA, 22 nt, Human
gagguagccacagauagagacu

SEQ ID NO: 854478 - RNA, 22 nt, Human
uugcaucuaccauaucaaagau

SEQ ID NO: 854479 - RNA, 22 nt, Human
aagcaaaggcaggagcuuguga

SEQ ID NO: 854480 - RNA, 22 nt, Human
uccauuuuagaagaaaauccac

SEQ ID NO: 854481 - RNA, 22 nt, Human
uucuugcaggucacucacugag

SEQ ID NO: 854482 - RNA, 22 nt, Human
caaaugaagaaccuucucaccu

SEQ ID NO: 854483 - RNA, 23 nt, Human
uacuacagggucuugcuaugaau

SEQ ID NO: 854484 - RNA, 22 nt, Human
aguugcagacgcagagauguug

SEQ ID NO: 854485 - RNA, 22 nt, Human
cugccuggcccagggaugggcc

SEQ ID NO: 854486 - RNA, 22 nt, Human
aggcugcucaguagauggagcu

SEQ ID NO: 854487 - RNA, 22 nt, Human
aaacugguauucaaauguuugg

SEQ ID NO: 854488 - RNA, 22 nt, Human
aggagcugcagauucugccuug

SEQ ID NO: 854489 - RNA, 22 nt, Human
cagaaguuugcaauuguuuauu

SEQ ID NO: 854490 - RNA, 17 nt, Human
uucugagccacuuccuu

SEQ ID NO: 854491 - RNA, 22 nt, Human
auagcuguuagauuggggucga

SEQ ID NO: 854492 - RNA, 21 nt, Human
ugaaacagauggaaguauuug

SEQ ID NO: 854493 - RNA, 22 nt, Human
acuuccaaauaccaucacauug

SEQ ID NO: 854494 - RNA, 22 nt, Human
uuucagaaagcugaacauauga

SEQ ID NO: 854495 - RNA, 22 nt, Human
ugaggcagguaagcaaguuuug

SEQ ID NO: 854496 - RNA, 22 nt, Human
cauuugcagagggugacacucu

SEQ ID NO: 854497 - RNA, 22 nt, Human
acuguguggaccacucugaggc

SEQ ID NO: 854498 - RNA, 22 nt, Human
gcugcaggcucugcaggaauug

SEQ ID NO: 854499 - RNA, 22 nt, Human
aaguaagucuuacauucacauu

SEQ ID NO: 854500 - RNA, 22 nt, Human
uggcagcuguguccagguagaa

SEQ ID NO: 854501 - RNA, 22 nt, Human
augauguuaccaguacuuagag

SEQ ID NO: 854502 - RNA, 22 nt, Human
ugaggcaguauucuccauucca

SEQ ID NO: 854503 - RNA, 22 nt, Human
caggcagagugagaagcccuug

SEQ ID NO: 854504 - RNA, 22 nt, Human
ggucagccuuggauuugguagc

SEQ ID NO: 854505 - RNA, 22 nt, Human
gccaggaguguguggcuauguu

SEQ ID NO: 854506 - RNA, 22 nt, Human
gagguccagagcagguucagug

SEQ ID NO: 854507 - RNA, 23 nt, Human
ucucaggacacacaugucuauca

SEQ ID NO: 854508 - RNA, 22 nt, Human
aggagaggcucuaacucugugu

SEQ ID NO: 854509 - RNA, 22 nt, Human
agucaguuucccuggaaagcag

SEQ ID NO: 854510 - RNA, 20 nt, Human
agaggccaguuaggagucua

SEQ ID NO: 854511 - RNA, 22 nt, Human
caggcagcucaaccuugggagc

SEQ ID NO: 854512 - RNA, 22 nt, Human
gcugagcagguuugaugcuuuu

SEQ ID NO: 854513 - RNA, 22 nt, Human
uaucuguucaauggaagaugac

SEQ ID NO: 854514 - RNA, 22 nt, Human
uuucacaacugcuuauuugaga

SEQ ID NO: 854515 - RNA, 21 nt, Human
ggacagcugcgcgcagggcuc

SEQ ID NO: 854516 - RNA, 22 nt, Human
auauucuucuuguucagacuau

SEQ ID NO: 854517 - RNA, 22 nt, Human
ccuccugggacaggcuggcaca

SEQ ID NO: 854518 - RNA, 22 nt, Human
uccuggucuacacugcauuggg

SEQ ID NO: 854519 - RNA, 22 nt, Human
acaagcaugggcuuugacauca

SEQ ID NO: 854520 - RNA, 22 nt, Human
cuuaggaugaguuuuugcguuu

SEQ ID NO: 854521 - RNA, 22 nt, Human
gcaggcugaguugggaaaccaa

SEQ ID NO: 854522 - RNA, 22 nt, Human
agcuagccuaggcagagugcau

SEQ ID NO: 854523 - RNA, 22 nt, Human
guugaaaguagaugcuauuugg

SEQ ID NO: 854524 - RNA, 22 nt, Human
cugugccaguguauuccuguga

SEQ ID NO: 854525 - RNA, 22 nt, Human
ucccaggaaaacacucgaggac

SEQ ID NO: 854526 - RNA, 22 nt, Human
ggcugcagaggcgaucugaggu

SEQ ID NO: 854527 - RNA, 22 nt, Human
cauuucacaaauggccacauca

SEQ ID NO: 854528 - RNA, 22 nt, Human
gccaggcuaagaaaggugugau

SEQ ID NO: 854529 - RNA, 22 nt, Human
uggagagguuuaaacaaaaguu

SEQ ID NO: 854530 - RNA, 21 nt, Human
acagaacuguauagugauaaa

SEQ ID NO: 854531 - RNA, 22 nt, Human
agggggugucucugauuggguu

SEQ ID NO: 854532 - RNA, 22 nt, Human
ggcugcagcccucgccuagcca

SEQ ID NO: 854533 - RNA, 22 nt, Human
uuggccaaggaccuuuuuggag

SEQ ID NO: 854534 - RNA, 22 nt, Human
gagccaaggguugccauggaga

SEQ ID NO: 854535 - RNA, 18 nt, Human
gacaaaaguacagacaga

SEQ ID NO: 854536 - RNA, 22 nt, Human
ugagauguaagguaugcuuacu

SEQ ID NO: 854537 - RNA, 22 nt, Human
aggcagcuuucagugucucuca

SEQ ID NO: 854538 - RNA, 21 nt, Human
ugcacuucaguggcuaaauuc

SEQ ID NO: 854539 - RNA, 22 nt, Human
gaggccaggacaugaaagcuga

SEQ ID NO: 854540 - RNA, 22 nt, Human
ugcuguguucuccugacucacc

SEQ ID NO: 854541 - RNA, 23 nt, Human
auaaauuacuaucucccuagagc

SEQ ID NO: 854542 - RNA, 22 nt, Human
uucucugagauagacuaagugg

SEQ ID NO: 854543 - RNA, 22 nt, Human
auagucuuagaucagauaaagu

SEQ ID NO: 854544 - RNA, 22 nt, Human
uuuuuaguagagguggguuuca

SEQ ID NO: 854545 - RNA, 22 nt, Human
aucuuucuuauuugaagaaaga

SEQ ID NO: 854546 - RNA, 17 nt, Human
cagcugugagagccuua

SEQ ID NO: 854547 - RNA, 22 nt, Human
gcugaggucaggagcugugggg

SEQ ID NO: 854548 - RNA, 22 nt, Human
uggcagucuggguuggcaguua

SEQ ID NO: 854549 - RNA, 22 nt, Human
aggcuagcaaugggagaugagu

SEQ ID NO: 854550 - RNA, 22 nt, Human
cagcugugaauugucuuaucua

SEQ ID NO: 854551 - RNA, 22 nt, Human
cuccugggagucuuccuggaug

SEQ ID NO: 854552 - RNA, 22 nt, Human
uaccauuucauucuuuccucau

SEQ ID NO: 854553 - RNA, 22 nt, Human
uccauuuucuaaguaucacuua

SEQ ID NO: 854554 - RNA, 22 nt, Human
gcacagcucgagcucaggaggg

SEQ ID NO: 854555 - RNA, 22 nt, Human
agggucuguggaugcaucuggg

SEQ ID NO: 854556 - RNA, 22 nt, Human
gggcugagugggccucuuacuu

SEQ ID NO: 854557 - RNA, 22 nt, Human
ugaaagguagcuggccucauag

SEQ ID NO: 854558 - RNA, 22 nt, Human
acuccuggaaaagaacgcaggg

SEQ ID NO: 854559 - RNA, 22 nt, Human
uagggauguccugagacuuggc

SEQ ID NO: 854560 - RNA, 22 nt, Human
gacccuccuacuacccuggaaa

SEQ ID NO: 854561 - RNA, 22 nt, Human
cauuuucagcacccaucugaaa

SEQ ID NO: 854562 - RNA, 22 nt, Human
uuagagaagcuguaauuauuca

SEQ ID NO: 854563 - RNA, 22 nt, Human
cagaaguuggagcuuuccauca

SEQ ID NO: 854564 - RNA, 22 nt, Human
ugccugggcucaccgccucuuu

SEQ ID NO: 854565 - RNA, 22 nt, Human
gugcugugcgcuuuuucuguau

SEQ ID NO: 854566 - RNA, 22 nt, Human
ccuggagauuucuucaagcuuu

SEQ ID NO: 854567 - RNA, 22 nt, Human
aguuacagcacucaaaguuuuc

SEQ ID NO: 854568 - RNA, 22 nt, Human
cccaagagcuucuaggacgcug

SEQ ID NO: 854569 - RNA, 22 nt, Human
cccccagucugaacagcagcug

SEQ ID NO: 854570 - RNA, 22 nt, Human
uagggcagagcuuguacacgau

SEQ ID NO: 854571 - RNA, 22 nt, Human
uugaaagucacaauggcauuaa

SEQ ID NO: 854572 - RNA, 22 nt, Human
cuggcccaggaagacguguccc

SEQ ID NO: 854573 - RNA, 20 nt, Human
guauuaggagguaaauguaa

SEQ ID NO: 854574 - RNA, 22 nt, Human
uacccaggaggaaacugaggcu

SEQ ID NO: 854575 - RNA, 22 nt, Human
uaaacauuuguuauucuuguuu

SEQ ID NO: 854576 - RNA, 22 nt, Human
gacaggaggcagagcucaggug

SEQ ID NO: 854577 - RNA, 21 nt, Human
uaugguaaccagacaagaaug

SEQ ID NO: 854578 - RNA, 18 nt, Human
ugagaggcagguagagga

SEQ ID NO: 854579 - RNA, 22 nt, Human
uucuccaacacaagcaugaugu

SEQ ID NO: 854580 - RNA, 22 nt, Human
cagagagggcggcccuggcuuc

SEQ ID NO: 854581 - RNA, 22 nt, Human
uugaaagugccaaguccuagug

SEQ ID NO: 854582 - RNA, 22 nt, Human
ucagagagccucaggcacugcc

SEQ ID NO: 854583 - RNA, 22 nt, Human
agcggcugcuccgcaggcuggc

SEQ ID NO: 854584 - RNA, 22 nt, Human
gugcuuucugcugcauuccucu

SEQ ID NO: 854585 - RNA, 22 nt, Human
cuauuacauuucuggacauuca

SEQ ID NO: 854586 - RNA, 22 nt, Human
uccuggccucacaguccugggu

SEQ ID NO: 854587 - RNA, 22 nt, Human
guaacugguuuucuucccucuc

SEQ ID NO: 854588 - RNA, 22 nt, Human
aguucuucauaaccuuacugug

SEQ ID NO: 854589 - RNA, 22 nt, Human
auuauauaggacuugcccuucc

SEQ ID NO: 854590 - RNA, 22 nt, Human
ggcugcugacaaacaugaucau

SEQ ID NO: 854591 - RNA, 22 nt, Human
uucagaaaucgaguuucauguc

SEQ ID NO: 854592 - RNA, 22 nt, Human
uggcugagggggcucugcucag

SEQ ID NO: 854593 - RNA, 22 nt, Human
gcugauguaagacuuuugguuu

SEQ ID NO: 854594 - RNA, 22 nt, Human
gcuggcaggagccuuucccuuu

SEQ ID NO: 854595 - RNA, 16 nt, Human
auuuccagauuaugca

SEQ ID NO: 854596 - RNA, 22 nt, Human
gagaggcaggcgcugcaauggu

SEQ ID NO: 854597 - RNA, 22 nt, Human
ccuggagcaucaggaggaaggg

SEQ ID NO: 854598 - RNA, 22 nt, Human
ugaggggaaggcaugauaaaua

SEQ ID NO: 854599 - RNA, 22 nt, Human
cccaggaacagcacagaacagc

SEQ ID NO: 854600 - RNA, 23 nt, Human
uggaaagcggaccuggggcagag

SEQ ID NO: 854601 - RNA, 22 nt, Human
aggccaaauagcagguuugcua

SEQ ID NO: 854602 - RNA, 20 nt, Human
gaugggaaucggagcuggua

SEQ ID NO: 854603 - RNA, 22 nt, Human
aacugccuggccaggcugcaac

SEQ ID NO: 854604 - RNA, 22 nt, Human
aguuaacacaaguaagauucca

SEQ ID NO: 854605 - RNA, 20 nt, Human
ucaggcuggugggcuuuccc

SEQ ID NO: 854606 - RNA, 22 nt, Human
cuugauguauaaguugauaugu

SEQ ID NO: 854607 - RNA, 22 nt, Human
acaggcugccacuugcauccaa

SEQ ID NO: 854608 - RNA, 22 nt, Human
acuccuggugcugaugaagaga

SEQ ID NO: 854609 - RNA, 22 nt, Human
uccugccuuagagcaaggaaaa

SEQ ID NO: 854610 - RNA, 22 nt, Human
acaauacaggcuucuggacuua

SEQ ID NO: 854611 - RNA, 22 nt, Human
agcuccaggauaagacaggugc

SEQ ID NO: 854612 - RNA, 22 nt, Human
aggcugagccacggggcuggcu

SEQ ID NO: 854613 - RNA, 22 nt, Human
guucuucaguaaaauuaaaugu

SEQ ID NO: 854614 - RNA, 22 nt, Human
gggcagcugccaagugcaucgc

SEQ ID NO: 854615 - RNA, 19 nt, Human
ggcagcuugggaagguagc

SEQ ID NO: 854616 - RNA, 20 nt, Human
uuaagaaaagcacauccugc

SEQ ID NO: 854617 - RNA, 18 nt, Human
cugaauuaucucaucauu

SEQ ID NO: 854618 - RNA, 22 nt, Human
uaagauuacagugagaaauaaa

SEQ ID NO: 854619 - RNA, 22 nt, Human
gaggagagccugcacuuugacc

SEQ ID NO: 854620 - RNA, 22 nt, Human
uggccacacccaccuagaggag

SEQ ID NO: 854621 - RNA, 22 nt, Human
auaauauuugcauuacugugau

SEQ ID NO: 854622 - RNA, 22 nt, Human
caguaaagcauguaugucuuca

SEQ ID NO: 854623 - RNA, 22 nt, Human
cuagccaugggcauuaaaggua

SEQ ID NO: 854624 - RNA, 22 nt, Human
ucucacuggguauaaaugagua

SEQ ID NO: 854625 - RNA, 22 nt, Human
uggcagacacugucgaagccua

SEQ ID NO: 854626 - RNA, 22 nt, Human
uagaagcagcaggaguaaaggc

SEQ ID NO: 854627 - RNA, 17 nt, Human
caaggccagcaucuuca

SEQ ID NO: 854628 - RNA, 22 nt, Human
auaaucuuguauuuccuaaagu

SEQ ID NO: 854629 - RNA, 22 nt, Human
cccaggcagugugugcaugcgu

SEQ ID NO: 854630 - RNA, 22 nt, Human
agugucagccugggcaaggaac

SEQ ID NO: 854631 - RNA, 22 nt, Human
ccagagcugcauccagcagguu

SEQ ID NO: 854632 - RNA, 20 nt, Human
acuccugguaacuuuuguga

SEQ ID NO: 854633 - RNA, 22 nt, Human
cuaggccacuugcucucaugga

SEQ ID NO: 854634 - RNA, 22 nt, Human
acacauuaucucauuaaauacu

SEQ ID NO: 854635 - RNA, 22 nt, Human
gagcaagacuacaggcagauga

SEQ ID NO: 854636 - RNA, 22 nt, Human
gcugaggauuacuugaagucag

SEQ ID NO: 854637 - RNA, 21 nt, Human
gguguccagaggaguccccag

SEQ ID NO: 854638 - RNA, 22 nt, Human
gacaaaaguguuuugaacaagg

SEQ ID NO: 854639 - RNA, 22 nt, Human
ccaggcugugcuuuucauaaau

SEQ ID NO: 854640 - RNA, 22 nt, Human
gaggcagcaucuauggugggaa

SEQ ID NO: 854641 - RNA, 22 nt, Human
ggcagucuuaucagcauuggac

SEQ ID NO: 854642 - RNA, 21 nt, Human
ugcuggcugaaaggcacagag

SEQ ID NO: 854643 - RNA, 22 nt, Human
aggaagcucaaagccaugaugu

SEQ ID NO: 854644 - RNA, 22 nt, Human
ucuggcugaagcuuuugcagcu

SEQ ID NO: 854645 - RNA, 23 nt, Human
ucccaggaaucugcauuuuuaac

SEQ ID NO: 854646 - RNA, 22 nt, Human
ucuggccacccgaggccccugc

SEQ ID NO: 854647 - RNA, 22 nt, Human
uauuuccaggccccacucuaga

SEQ ID NO: 854648 - RNA, 21 nt, Human
acagacagggccagugucccc

SEQ ID NO: 854649 - RNA, 22 nt, Human
uuugcagucuggccugcuuugg

SEQ ID NO: 854650 - RNA, 22 nt, Human
cugguccauucucucccugaag

SEQ ID NO: 854651 - RNA, 20 nt, Human
gcccaggaauuugcauuucu

SEQ ID NO: 854652 - RNA, 22 nt, Human
gauggcagucaaccaggugagg

SEQ ID NO: 854653 - RNA, 22 nt, Human
ggcagccagagggcagcuggau

SEQ ID NO: 854654 - RNA, 22 nt, Human
ccuugcugcgugcuagcacaga

SEQ ID NO: 854655 - RNA, 22 nt, Human
uuuauguaauuucauaggugug

SEQ ID NO: 854656 - RNA, 22 nt, Human
cuucuucauaggcaguccuguu

SEQ ID NO: 854657 - RNA, 23 nt, Human
uuugaaaguaucaacucgccuga

SEQ ID NO: 854658 - RNA, 22 nt, Human
ggggcagcucccgagggcagga

SEQ ID NO: 854659 - RNA, 21 nt, Human
augucaaaugcuuuauuuuau

SEQ ID NO: 854660 - RNA, 22 nt, Human
auucuucaccauggauaauuug

SEQ ID NO: 854661 - RNA, 22 nt, Human
gcaggagaacaaagcaagcugc

SEQ ID NO: 854662 - RNA, 22 nt, Human
uuccuggcaugaaaaauaucac

SEQ ID NO: 854663 - RNA, 22 nt, Human
ccagggaguuuccaaucugaga

SEQ ID NO: 854664 - RNA, 22 nt, Human
ucugaaggugcuagagaaagcu

SEQ ID NO: 854665 - RNA, 19 nt, Human
cugcuucaggcgccuugcc

SEQ ID NO: 854666 - RNA, 22 nt, Human
uugaggucugagacugugcagg

SEQ ID NO: 854667 - RNA, 22 nt, Human
uagaaauaaaucugcagcuggg

SEQ ID NO: 854668 - RNA, 22 nt, Human
cugagggcaccgacagagugga

SEQ ID NO: 854669 - RNA, 22 nt, Human
ccacagugaguucuguacucug

SEQ ID NO: 854670 - RNA, 22 nt, Human
gucuagagugcuuccuagucau

SEQ ID NO: 854671 - RNA, 22 nt, Human
augguacaauguguuuguuagg

SEQ ID NO: 854672 - RNA, 22 nt, Human
gcagcugaauguccauugcugc

SEQ ID NO: 854673 - RNA, 22 nt, Human
uuuuuuauaucaacugaagucu

SEQ ID NO: 854674 - RNA, 22 nt, Human
uggaagggagugacagucagag

SEQ ID NO: 854675 - RNA, 22 nt, Human
gaauuauaaacuagugacuuca

SEQ ID NO: 854676 - RNA, 20 nt, Human
ggcaugagaugugagggagg

SEQ ID NO: 854677 - RNA, 22 nt, Human
ugcugcuguuuccuacaucuca

SEQ ID NO: 854678 - RNA, 22 nt, Human
auacuuucugaccaauuaauug

SEQ ID NO: 854679 - RNA, 22 nt, Human
ugccuugcgggcguuucuguug

SEQ ID NO: 854680 - RNA, 22 nt, Human
aggcaguuuaggcagcgauuua

SEQ ID NO: 854681 - RNA, 22 nt, Human
aggcaagcauugggaacagggc

SEQ ID NO: 854682 - RNA, 22 nt, Human
cacugguacguagguuggggca

SEQ ID NO: 854683 - RNA, 22 nt, Human
aaggaaccuggaguagagggag

SEQ ID NO: 854684 - RNA, 22 nt, Human
gcugaggccucagaaggcugag

SEQ ID NO: 854685 - RNA, 20 nt, Human
uuuacauuuugaaacaguga

SEQ ID NO: 854686 - RNA, 22 nt, Human
ccucaggaaaugaauaaauggc

SEQ ID NO: 854687 - RNA, 22 nt, Human
auuaggaagaggaugucagcau

SEQ ID NO: 854688 - RNA, 22 nt, Human
gucugaggguugugcuggagga

SEQ ID NO: 854689 - RNA, 22 nt, Human
ccuccuggcccugggccuggaa

SEQ ID NO: 854690 - RNA, 22 nt, Human
uuucuuguaagauguuuauuaa

SEQ ID NO: 854691 - RNA, 20 nt, Human
aagggcagagggaacagacu

SEQ ID NO: 854692 - RNA, 22 nt, Human
agguaacuguggcuagguaacu

SEQ ID NO: 854693 - RNA, 22 nt, Human
aggauguucgggucacauagcc

SEQ ID NO: 854694 - RNA, 22 nt, Human
cauuuuaaaugauuuaagccaa

SEQ ID NO: 854695 - RNA, 22 nt, Human
guauuagggccaaaggcaggaa

SEQ ID NO: 854696 - RNA, 17 nt, Human
ucaggauguagcaguag

SEQ ID NO: 854697 - RNA, 22 nt, Human
ggcugagggccagggcuagucu

SEQ ID NO: 854698 - RNA, 22 nt, Human
auauuagggucucuaaauucua

SEQ ID NO: 854699 - RNA, 22 nt, Human
ucucaggaagauuagggcuaag

SEQ ID NO: 854700 - RNA, 22 nt, Human
uaggccagcccuuaguccuguc

SEQ ID NO: 854701 - RNA, 22 nt, Human
guuguuuugcaggauccuuaca

SEQ ID NO: 854702 - RNA, 22 nt, Human
aggcuggagggcaauggcaaga

SEQ ID NO: 854703 - RNA, 22 nt, Human
acagugcuggcuacaacccugg

SEQ ID NO: 854704 - RNA, 22 nt, Human
ggccugagcagacagcaugaug

SEQ ID NO: 854705 - RNA, 22 nt, Human
agagggagugaaauggaauaga

SEQ ID NO: 854706 - RNA, 22 nt, Human
cugccccauggucccugguggg

SEQ ID NO: 854707 - RNA, 22 nt, Human
aaauuauaggugccaccuugga

SEQ ID NO: 854708 - RNA, 22 nt, Human
aagugcugggauuacagguguc

SEQ ID NO: 854709 - RNA, 19 nt, Human
gccaggagggcucuggcug

SEQ ID NO: 854710 - RNA, 22 nt, Human
aggcugaggcagguggaucauu

SEQ ID NO: 854711 - RNA, 22 nt, Human
auugaaagaguuuucugcugca

SEQ ID NO: 854712 - RNA, 22 nt, Human
uggccaaauuugguguaacuug

SEQ ID NO: 854713 - RNA, 22 nt, Human
aaacaggcaucacucagcaaag

SEQ ID NO: 854714 - RNA, 22 nt, Human
augaggcaaucaugguccaguu

SEQ ID NO: 854715 - RNA, 22 nt, Human
acagaacuuccagggaacauac

SEQ ID NO: 854716 - RNA, 22 nt, Human
acaggcugaggaugauugcauc

SEQ ID NO: 854717 - RNA, 23 nt, Human
cuucuggcucuauaucagaauuc

SEQ ID NO: 854718 - RNA, 21 nt, Human
ggccugaguauaggacaggcc

SEQ ID NO: 854719 - RNA, 22 nt, Human
gcugaguugaaagcagaggaua

SEQ ID NO: 854720 - RNA, 21 nt, Human
uucuucuuggacuguuuuggc

SEQ ID NO: 854721 - RNA, 22 nt, Human
uacuuacagagcuuauaaguua

SEQ ID NO: 854722 - RNA, 22 nt, Human
uugcugugaaaccaugggaagu

SEQ ID NO: 854723 - RNA, 22 nt, Human
ucugagguucuguuuucaacug

SEQ ID NO: 854724 - RNA, 22 nt, Human
ugccucagucuaaagucucuca

SEQ ID NO: 854725 - RNA, 22 nt, Human
cugcuuugggcagcuuuguggc

SEQ ID NO: 854726 - RNA, 23 nt, Human
agcagcugugguuuaccuuagua

SEQ ID NO: 854727 - RNA, 22 nt, Human
cuagcaucagaugagaagcugu

SEQ ID NO: 854728 - RNA, 17 nt, Human
agcaaaaguaucaaagc

SEQ ID NO: 854729 - RNA, 16 nt, Human
gcccaggacgggaggc

SEQ ID NO: 854730 - RNA, 22 nt, Human
caggcugaggguuaggccuuag

SEQ ID NO: 854731 - RNA, 22 nt, Human
aauggccagcaacaggagugaa

SEQ ID NO: 854732 - RNA, 22 nt, Human
ugcuuuggccacuagaauucag

SEQ ID NO: 854733 - RNA, 22 nt, Human
gcugagagaaaagugagguucu

SEQ ID NO: 854734 - RNA, 22 nt, Human
ugcuggguuaccuaagccuaaa

SEQ ID NO: 854735 - RNA, 23 nt, Human
ugccucaguggaaugugagggug

SEQ ID NO: 854736 - RNA, 17 nt, Human
gcuguaguuugauaaga

SEQ ID NO: 854737 - RNA, 22 nt, Human
gaggcugauucggggaacagca

SEQ ID NO: 854738 - RNA, 22 nt, Human
uacaugaauguuucaauauugu

SEQ ID NO: 854739 - RNA, 22 nt, Human
uucaggauccccaccgcguuua

SEQ ID NO: 854740 - RNA, 22 nt, Human
gggagcugaauggcaauggaga

SEQ ID NO: 854741 - RNA, 22 nt, Human
ucaggcuguauaucuugcacuc

SEQ ID NO: 854742 - RNA, 22 nt, Human
aacuucugggcuguccaaaacu

SEQ ID NO: 854743 - RNA, 22 nt, Human
aagggcagccugacucacgguc

SEQ ID NO: 854744 - RNA, 22 nt, Human
aggcagugcugugcccugaacc

SEQ ID NO: 854745 - RNA, 22 nt, Human
cccaggagaugcacuccauugg

SEQ ID NO: 854746 - RNA, 22 nt, Human
agagggcagucucagauuggga

SEQ ID NO: 854747 - RNA, 22 nt, Human
cugccuucaucucugagcuggg

SEQ ID NO: 854748 - RNA, 22 nt, Human
uccaccagcuucuucaccagcu

SEQ ID NO: 854749 - RNA, 22 nt, Human
gcaggagacaacuguaaggaga

SEQ ID NO: 854750 - RNA, 22 nt, Human
aagggcugccagggggugccag

SEQ ID NO: 854751 - RNA, 22 nt, Human
cuguggaaaauuuguauguaau

SEQ ID NO: 854752 - RNA, 22 nt, Human
cugacuuuuccaaauaauacuu

SEQ ID NO: 854753 - RNA, 22 nt, Human
uagaaaguagccacuuacagag

SEQ ID NO: 854754 - RNA, 21 nt, Human
uucuucaguuuaauauaaaau

SEQ ID NO: 854755 - RNA, 22 nt, Human
ggagcugugcagugacuacaga

SEQ ID NO: 854756 - RNA, 22 nt, Human
uacacuuucguuuguggauuag

SEQ ID NO: 854757 - RNA, 22 nt, Human
ucauuuaauagcuuuugucuuu

SEQ ID NO: 854758 - RNA, 22 nt, Human
ggcugcaguugugugaaggccg

SEQ ID NO: 854759 - RNA, 22 nt, Human
gugagguccucccugcugggag

SEQ ID NO: 854760 - RNA, 22 nt, Human
gggcugagaaguugaucccaag

SEQ ID NO: 854761 - RNA, 22 nt, Human
ggacaagccugugaguggguuu

SEQ ID NO: 854762 - RNA, 22 nt, Human
agugcuuugugcucucacugca

SEQ ID NO: 854763 - RNA, 22 nt, Human
uagggaugagccaguggguagu

SEQ ID NO: 854764 - RNA, 22 nt, Human
agagagcauugaggaaaucuuc

SEQ ID NO: 854765 - RNA, 22 nt, Human
uagacagagugaagacaagugg

SEQ ID NO: 854766 - RNA, 18 nt, Human
guauuaguuuucagagag

SEQ ID NO: 854767 - RNA, 22 nt, Human
agggagcuuccgaacuacagcu

SEQ ID NO: 854768 - RNA, 22 nt, Human
ugcugaggacaccuagccuucu

SEQ ID NO: 854769 - RNA, 22 nt, Human
cccugagccacacagagcaggu

SEQ ID NO: 854770 - RNA, 22 nt, Human
gcuccuggccagcacagggccc

SEQ ID NO: 854771 - RNA, 22 nt, Human
gagcgauguggguauguagaag

SEQ ID NO: 854772 - RNA, 22 nt, Human
aauaucaguauauuguaucagu

SEQ ID NO: 854773 - RNA, 22 nt, Human
uauuuuaaagugaagggucuug

SEQ ID NO: 854774 - RNA, 22 nt, Human
acagcugcacacugaacuuggu

SEQ ID NO: 854775 - RNA, 22 nt, Human
ggaggcgauccugggaaacacc

SEQ ID NO: 854776 - RNA, 22 nt, Human
cacagcauaaugaaauauacuu

SEQ ID NO: 854777 - RNA, 22 nt, Human
ucaggagaaucagggcuguccu

SEQ ID NO: 854778 - RNA, 22 nt, Human
ccaggcuggagugcaguagugu

SEQ ID NO: 854779 - RNA, 22 nt, Human
ccacagagacaggguccuugcu

SEQ ID NO: 854780 - RNA, 22 nt, Human
cuuuauuagauguagacuuucu

SEQ ID NO: 854781 - RNA, 22 nt, Human
ucugucuccucugaggugccag

SEQ ID NO: 854782 - RNA, 22 nt, Human
aguagugaacagccacaggauu

SEQ ID NO: 854783 - RNA, 22 nt, Human
aaggccagacaggaccacaucu

SEQ ID NO: 854784 - RNA, 22 nt, Human
auucugagaaaugcauugucag

SEQ ID NO: 854785 - RNA, 22 nt, Human
cauggcugaaauucuucgcuug

SEQ ID NO: 854786 - RNA, 22 nt, Human
caggaugagaagggcucuuacg

SEQ ID NO: 854787 - RNA, 22 nt, Human
uccaggagugauaaggccacug

SEQ ID NO: 854788 - RNA, 22 nt, Human
gggacgggcaguccaagggguc

SEQ ID NO: 854789 - RNA, 22 nt, Human
uggagagguugaauaacuuguc

SEQ ID NO: 854790 - RNA, 22 nt, Human
caggcaugcuucugucugggca

SEQ ID NO: 854791 - RNA, 22 nt, Human
ugaacuccaaauacugcugauu

SEQ ID NO: 854792 - RNA, 22 nt, Human
agcuccugcgcacggugcacac

SEQ ID NO: 854793 - RNA, 22 nt, Human
agaaaacugggaggagagcuuc

SEQ ID NO: 854794 - RNA, 22 nt, Human
aguaccaugcuuccugacuggu

SEQ ID NO: 854795 - RNA, 22 nt, Human
cuggcacaugcucccugagugg

SEQ ID NO: 854796 - RNA, 22 nt, Human
cccuggaguccuggcaguugau

SEQ ID NO: 854797 - RNA, 22 nt, Human
ucuuucaaugagcauucuuucc

SEQ ID NO: 854798 - RNA, 22 nt, Human
agcaccugccugcauuggcuau

SEQ ID NO: 854799 - RNA, 22 nt, Human
cuugcugucuugcauuuagagc

SEQ ID NO: 854800 - RNA, 22 nt, Human
gggcagcucucacagcagccaa

SEQ ID NO: 854801 - RNA, 22 nt, Human
agggcagccucucagccuaggu

SEQ ID NO: 854802 - RNA, 22 nt, Human
uuggcagagaguaugcugaaga

SEQ ID NO: 854803 - RNA, 23 nt, Human
cccaggagccugaguccucucug

SEQ ID NO: 854804 - RNA, 22 nt, Human
cagcucccgccaucgggaggca

SEQ ID NO: 854805 - RNA, 22 nt, Human
gaggcagcgggucaggaccgug

SEQ ID NO: 854806 - RNA, 22 nt, Human
uuugaaauuaagauauugucca

SEQ ID NO: 854807 - RNA, 22 nt, Human
aaaauuauggaguaucccaaag

SEQ ID NO: 854808 - RNA, 22 nt, Human
aggagcagaauuuaaugugcag

SEQ ID NO: 854809 - RNA, 22 nt, Human
gaaauuaagcaggggucugugg

SEQ ID NO: 854810 - RNA, 22 nt, Human
ugcugagggagcaucaaagaaa

SEQ ID NO: 854811 - RNA, 22 nt, Human
gcccucccuacagccuauuucu

SEQ ID NO: 854812 - RNA, 22 nt, Human
agaaaugaauauguagugguua

SEQ ID NO: 854813 - RNA, 22 nt, Human
cuauuagguuggugcaaaagua

SEQ ID NO: 854814 - RNA, 22 nt, Human
caggcagcugcuggguucagcc

SEQ ID NO: 854815 - RNA, 22 nt, Human
aaauacagaguugcuuaaaagc

SEQ ID NO: 854816 - RNA, 22 nt, Human
uucugaauggcaagcauuaggc

SEQ ID NO: 854817 - RNA, 22 nt, Human
ggcagucacaggggagacuggg

SEQ ID NO: 854818 - RNA, 22 nt, Human
uggcugagccuuuggggcuuuc

SEQ ID NO: 854819 - RNA, 20 nt, Human
uccugagccuccaccauguc

SEQ ID NO: 854820 - RNA, 22 nt, Human
guucuucacauuucauugagga

SEQ ID NO: 854821 - RNA, 22 nt, Human
uugcuuugccaccagaagucua

SEQ ID NO: 854822 - RNA, 22 nt, Human
uucucugaaggccaugcucacu

SEQ ID NO: 854823 - RNA, 22 nt, Human
auugaaaggcaaaguaggaagc

SEQ ID NO: 854824 - RNA, 22 nt, Human
gagaggucaucucccaucagca

SEQ ID NO: 854825 - RNA, 22 nt, Human
cagaggcaaaagagguggaggu

SEQ ID NO: 854826 - RNA, 22 nt, Human
gaguguaguucauuccguccua

SEQ ID NO: 854827 - RNA, 21 nt, Human
ggcagccugacccccagagag

SEQ ID NO: 854828 - RNA, 22 nt, Human
uguccauggauagagcugcucg

SEQ ID NO: 854829 - RNA, 22 nt, Human
gagcaagauuaaaaggcugggu

SEQ ID NO: 854830 - RNA, 22 nt, Human
caaguaaacaauaugugauuca

SEQ ID NO: 854831 - RNA, 22 nt, Human
auguuuccgugagcauccuuga

SEQ ID NO: 854832 - RNA, 19 nt, Human
uauucaggaugauggcaca

SEQ ID NO: 854833 - RNA, 22 nt, Human
aggcagcaugggcccagagucc

SEQ ID NO: 854834 - RNA, 22 nt, Human
aaagacuuggcuuaugauuugc

SEQ ID NO: 854835 - RNA, 22 nt, Human
uuugaaguggaaaaggauuuaa

SEQ ID NO: 854836 - RNA, 22 nt, Human
aguuauaaucugcuacugauau

SEQ ID NO: 854837 - RNA, 17 nt, Human
aagagaggcugagcugg

SEQ ID NO: 854838 - RNA, 22 nt, Human
aggcacaguggcucacaccugu

SEQ ID NO: 854839 - RNA, 22 nt, Human
accaggaggaaguguuaaugau

SEQ ID NO: 854840 - RNA, 18 nt, Human
ccagguggugacagagau

SEQ ID NO: 854841 - RNA, 22 nt, Human
ggagagugggagcaacuguugc

SEQ ID NO: 854842 - RNA, 20 nt, Human
ugcugucguguuuucugcuu

SEQ ID NO: 854843 - RNA, 22 nt, Human
cugugccaggcccagcugacuu

SEQ ID NO: 854844 - RNA, 22 nt, Human
uguuggcagauugucuaggguu

SEQ ID NO: 854845 - RNA, 22 nt, Human
ccagacaggaacacacaucucc

SEQ ID NO: 854846 - RNA, 23 nt, Human
agugcuggagaagcuucuggcuu

SEQ ID NO: 854847 - RNA, 22 nt, Human
uggcuucucaguuucauaauga

SEQ ID NO: 854848 - RNA, 21 nt, Human
uggcuucugccaauguuaaga

SEQ ID NO: 854849 - RNA, 22 nt, Human
ugacagacagcuucucauuuua

SEQ ID NO: 854850 - RNA, 22 nt, Human
aagaugacuauuuaucuguaag

SEQ ID NO: 854851 - RNA, 22 nt, Human
aaagccauuacaaaauuucaua

SEQ ID NO: 854852 - RNA, 22 nt, Human
uugcauuuccuguacuguuuga

SEQ ID NO: 854853 - RNA, 22 nt, Human
uauagaggccaccaacaugaaa

SEQ ID NO: 854854 - RNA, 22 nt, Human
acaccuuugugaagugaugaug

SEQ ID NO: 854855 - RNA, 22 nt, Human
acuugcugguggcauuuacagu

SEQ ID NO: 854856 - RNA, 22 nt, Human
gcaccuggcugcccagguggag

SEQ ID NO: 854857 - RNA, 22 nt, Human
aggguagguguaagauagcccu

SEQ ID NO: 854858 - RNA, 22 nt, Human
uagaaaugauugguugagcucu

SEQ ID NO: 854859 - RNA, 22 nt, Human
uaauuauagccgcuauuuugcu

SEQ ID NO: 854860 - RNA, 22 nt, Human
uuauuacaaugcagaaaauaga

SEQ ID NO: 854861 - RNA, 17 nt, Human
gaggagcuccaguaggu

SEQ ID NO: 854862 - RNA, 22 nt, Human
ccagagcugaugggcccagggu

SEQ ID NO: 854863 - RNA, 22 nt, Human
cugagguccucagagggaaagg

SEQ ID NO: 854864 - RNA, 22 nt, Human
cagccuuuaagcuuggauaggu

SEQ ID NO: 854865 - RNA, 20 nt, Human
cauuuguuagcuuucuacug

SEQ ID NO: 854866 - RNA, 22 nt, Human
cugccuccugccgugcagcuuc

SEQ ID NO: 854867 - RNA, 22 nt, Human
aggcuaaggagugugaugcuca

SEQ ID NO: 854868 - RNA, 22 nt, Human
gcagaggagcaaguugcuacag

SEQ ID NO: 854869 - RNA, 22 nt, Human
uuugaaagaauuuauguacuuu

SEQ ID NO: 854870 - RNA, 22 nt, Human
uuugaaagggaaauaaacuccu

SEQ ID NO: 854871 - RNA, 22 nt, Human
augcugugucaccuuaggauuu

SEQ ID NO: 854872 - RNA, 22 nt, Human
uguauuagguugaugcgaaagu

SEQ ID NO: 854873 - RNA, 22 nt, Human
cucuuaguaaugccaugaagca

SEQ ID NO: 854874 - RNA, 22 nt, Human
ggaggugguggcagugacaauu

SEQ ID NO: 854875 - RNA, 22 nt, Human
aggcugaggcagguggaucacc

SEQ ID NO: 854876 - RNA, 18 nt, Human
ucuccuggguaggggccu

SEQ ID NO: 854877 - RNA, 22 nt, Human
aaacaugaauagauauuaaaca

SEQ ID NO: 854878 - RNA, 22 nt, Human
aaagcagacugauuugcaucac

SEQ ID NO: 854879 - RNA, 20 nt, Human
gagauggacagaugaagggg

SEQ ID NO: 854880 - RNA, 22 nt, Human
caguuucuacgaaggucaaccc

SEQ ID NO: 854881 - RNA, 22 nt, Human
gaggccaggggccuggagauga

SEQ ID NO: 854882 - RNA, 22 nt, Human
cuucagugaauguugaguaagg

SEQ ID NO: 854883 - RNA, 22 nt, Human
uguaggucucagugucugagcu

SEQ ID NO: 854884 - RNA, 22 nt, Human
gcagugcagugggacagggcgc

SEQ ID NO: 854885 - RNA, 22 nt, Human
ugaggcagcauucuucaagaca

SEQ ID NO: 854886 - RNA, 16 nt, Human
uucuagaaaagaaggu

SEQ ID NO: 854887 - RNA, 21 nt, Human
gacuuucuuaccagauuuuug

SEQ ID NO: 854888 - RNA, 22 nt, Human
acucaggagggaucagcuauca

SEQ ID NO: 854889 - RNA, 22 nt, Human
cauccugguuaccccauaguca

SEQ ID NO: 854890 - RNA, 22 nt, Human
aggaaaaauaaggcagcagggc

SEQ ID NO: 854891 - RNA, 21 nt, Human
ucucugugucuuuaagcugga

SEQ ID NO: 854892 - RNA, 22 nt, Human
gagagcuguuuaucuucuucaa

SEQ ID NO: 854893 - RNA, 22 nt, Human
cugugccaucugcacucucguc

SEQ ID NO: 854894 - RNA, 22 nt, Human
aggccaaauugaucaucuuuag

SEQ ID NO: 854895 - RNA, 22 nt, Human
gcugagugauucauacgcugcu

SEQ ID NO: 854896 - RNA, 22 nt, Human
uucuuauucuugaaauguggga

SEQ ID NO: 854897 - RNA, 22 nt, Human
uuuaaauuuguguuuagagggu

SEQ ID NO: 854898 - RNA, 22 nt, Human
cugcccagaagccagaugggca

SEQ ID NO: 854899 - RNA, 22 nt, Human
cucaagacugaucgcaguggaa

SEQ ID NO: 854900 - RNA, 22 nt, Human
cuuagcaugugguguccuugua

SEQ ID NO: 854901 - RNA, 21 nt, Human
ggcugcugucaccgcugucac

SEQ ID NO: 854902 - RNA, 22 nt, Human
cugaggucagaguuuagucugg

SEQ ID NO: 854903 - RNA, 22 nt, Human
aagugaccucaugguuucuccu

SEQ ID NO: 854904 - RNA, 22 nt, Human
cugaggugagaggaggccaugu

SEQ ID NO: 854905 - RNA, 22 nt, Human
gucccaggugggcuccaccucu

SEQ ID NO: 854906 - RNA, 22 nt, Human
auuaggacacauacauguacag

SEQ ID NO: 854907 - RNA, 17 nt, Human
uccaggagaggcaaugg

SEQ ID NO: 854908 - RNA, 22 nt, Human
guggcagagagcaagugucuga

SEQ ID NO: 854909 - RNA, 22 nt, Human
cugccugcuuuucugggagccg

SEQ ID NO: 854910 - RNA, 22 nt, Human
agagacagaggcaauauagcuu

SEQ ID NO: 854911 - RNA, 21 nt, Human
gacaggacuagaccagagcuc

SEQ ID NO: 854912 - RNA, 22 nt, Human
cgcagggauuucaaggggccuu

SEQ ID NO: 854913 - RNA, 22 nt, Human
aggcagcauuugaauccagguc

SEQ ID NO: 854914 - RNA, 22 nt, Human
ccuggccagcgccggcugcucg

SEQ ID NO: 854915 - RNA, 22 nt, Human
gagagcaggcucucgggggcca

SEQ ID NO: 854916 - RNA, 22 nt, Human
ugacaguauugauggcaggauu

SEQ ID NO: 854917 - RNA, 22 nt, Human
cuccugaguaguagcauuguca

SEQ ID NO: 854918 - RNA, 22 nt, Human
ugcuagugcaggguuuucaguu

SEQ ID NO: 854919 - RNA, 22 nt, Human
aagcagagcaagcguauuuauu

SEQ ID NO: 854920 - RNA, 22 nt, Human
uuucccaguucccugcucuaua

SEQ ID NO: 854921 - RNA, 22 nt, Human
agugauggugagugagaagcuc

SEQ ID NO: 854922 - RNA, 22 nt, Human
caggauggucucgaucuccuga

SEQ ID NO: 854923 - RNA, 20 nt, Human
uuucaguugguuaauggcau

SEQ ID NO: 854924 - RNA, 22 nt, Human
uuuuaauugcaauuaugguccc

SEQ ID NO: 854925 - RNA, 22 nt, Human
uugaaauggaagugaaaauucu

SEQ ID NO: 854926 - RNA, 22 nt, Human
ugcugaggacuaaaggagauga

SEQ ID NO: 854927 - RNA, 22 nt, Human
ugaaaugacaaagguuuuucuu

SEQ ID NO: 854928 - RNA, 22 nt, Human
gggcugagugucccaggccgaa

SEQ ID NO: 854929 - RNA, 22 nt, Human
gaggcagaaguugcagugagca

SEQ ID NO: 854930 - RNA, 22 nt, Human
uauuggaugauucacuuggcag

SEQ ID NO: 854931 - RNA, 22 nt, Human
uuggcagcagggaguuggccgc

SEQ ID NO: 854932 - RNA, 22 nt, Human
uagcacaucuggcgcuuauagg

SEQ ID NO: 854933 - RNA, 22 nt, Human
agcugcccuuuaugaugcugaa

SEQ ID NO: 854934 - RNA, 22 nt, Human
cugaggccuaagacaugaauga

SEQ ID NO: 854935 - RNA, 22 nt, Human
caacauuucaaggucuuuagga

SEQ ID NO: 854936 - RNA, 22 nt, Human
ugcaggcuccaugaggacaggc

SEQ ID NO: 854937 - RNA, 22 nt, Human
uagcaaaagccacgauuacuuu

SEQ ID NO: 854938 - RNA, 22 nt, Human
uuuaacauguucaagaaacaua

SEQ ID NO: 854939 - RNA, 22 nt, Human
ccugagguggcugcagcacugc

SEQ ID NO: 854940 - RNA, 22 nt, Human
cugcuguguuggcauuggauag

SEQ ID NO: 854941 - RNA, 22 nt, Human
acucugggauuguuucugguau

SEQ ID NO: 854942 - RNA, 22 nt, Human
caaauauuccagguacaucccu

SEQ ID NO: 854943 - RNA, 22 nt, Human
uaucuguuguaguacagaugau

SEQ ID NO: 854944 - RNA, 22 nt, Human
acuauuagcauaucaugaaugg

SEQ ID NO: 854945 - RNA, 22 nt, Human
cagguaaaaauaaauuugugag

SEQ ID NO: 854946 - RNA, 22 nt, Human
ucaaggaaggucuguugcucca

SEQ ID NO: 854947 - RNA, 22 nt, Human
gagugcuguaggacugagcccu

SEQ ID NO: 854948 - RNA, 22 nt, Human
gagugucagugcuuggggcuac

SEQ ID NO: 854949 - RNA, 22 nt, Human
acugagguuuuuaguguuaaau

SEQ ID NO: 854950 - RNA, 22 nt, Human
ucagaaaagguagcugugacaa

SEQ ID NO: 854951 - RNA, 22 nt, Human
ugaguuuuuucaacauaugaag

SEQ ID NO: 854952 - RNA, 22 nt, Human
gcaggcuggucugaccaucccu

SEQ ID NO: 854953 - RNA, 23 nt, Human
uugcauagacauccucauagauu

SEQ ID NO: 854954 - RNA, 22 nt, Human
uccauuuuguagguaugcuaca

SEQ ID NO: 854955 - RNA, 22 nt, Human
uggcagcuccggguaggggcug

SEQ ID NO: 854956 - RNA, 22 nt, Human
aggcagguuggugagaagacug

SEQ ID NO: 854957 - RNA, 22 nt, Human
cagugcuguuguaagcucauug

SEQ ID NO: 854958 - RNA, 23 nt, Human
uccaggagaauuccagggcccgg

SEQ ID NO: 854959 - RNA, 22 nt, Human
gcugccucugcacagcucacuc

SEQ ID NO: 854960 - RNA, 18 nt, Human
ccagagcuggcuccucgc

SEQ ID NO: 854961 - RNA, 22 nt, Human
agcacugugguggaagcaucaa

SEQ ID NO: 854962 - RNA, 22 nt, Human
uuuccucauuuaucugcuggga

SEQ ID NO: 854963 - RNA, 22 nt, Human
uuggccaaccagaacggagguc

SEQ ID NO: 854964 - RNA, 22 nt, Human
uccaggugagugcaggugcaga

SEQ ID NO: 854965 - RNA, 22 nt, Human
aggaaaggccuuugcauuuggu

SEQ ID NO: 854966 - RNA, 18 nt, Human
ucuuccaacacugacacc

SEQ ID NO: 854967 - RNA, 22 nt, Human
aggagagggguaggauuaauuu

SEQ ID NO: 854968 - RNA, 22 nt, Human
cugaggcugagacaggugaaau

SEQ ID NO: 854969 - RNA, 20 nt, Human
uuggccaaaucuuagucaug

SEQ ID NO: 854970 - RNA, 22 nt, Human
caggcugaggcaguaggguuug

SEQ ID NO: 854971 - RNA, 22 nt, Human
ucuccugguuuguuaaauaauu

SEQ ID NO: 854972 - RNA, 21 nt, Human
uggcugccuacaugcugcagg

SEQ ID NO: 854973 - RNA, 22 nt, Human
uugaagaggacuuugcagcugu

SEQ ID NO: 854974 - RNA, 19 nt, Human
aggucuaaucauaagacaa

SEQ ID NO: 854975 - RNA, 22 nt, Human
ucuccucucuuaccugguacaa

SEQ ID NO: 854976 - RNA, 22 nt, Human
acccagaggugucuagcaagcu

SEQ ID NO: 854977 - RNA, 22 nt, Human
cccagcugauuuuugcagagau

SEQ ID NO: 854978 - RNA, 22 nt, Human
ucugccucgcuaacagcagcca

SEQ ID NO: 854979 - RNA, 22 nt, Human
ugcugaggucacggcggccaga

SEQ ID NO: 854980 - RNA, 22 nt, Human
agucucugcugguugugccuau

SEQ ID NO: 854981 - RNA, 22 nt, Human
uuucuuaguccuagagugauuu

SEQ ID NO: 854982 - RNA, 22 nt, Human
cagagcucuauguucauggagg

SEQ ID NO: 854983 - RNA, 22 nt, Human
aggacuuagaacauuauguacu

SEQ ID NO: 854984 - RNA, 22 nt, Human
uuaggaaauuccaccuguauuc

SEQ ID NO: 854985 - RNA, 20 nt, Human
uaagaugagcuauaagaagu

SEQ ID NO: 854986 - RNA, 22 nt, Human
ucaugcuuauugcauauuugga

SEQ ID NO: 854987 - RNA, 22 nt, Human
uuauuuggguuugaguguggca

SEQ ID NO: 854988 - RNA, 22 nt, Human
uccaggaggaggaaggcugcca

SEQ ID NO: 854989 - RNA, 22 nt, Human
cagccugagccuucuguagcaa

SEQ ID NO: 854990 - RNA, 22 nt, Human
ucuucauuccguagauauuuau

SEQ ID NO: 854991 - RNA, 22 nt, Human
ccugguggaaggugagugaggc

SEQ ID NO: 854992 - RNA, 23 nt, Human
agacaguggccgagagguacuag

SEQ ID NO: 854993 - RNA, 22 nt, Human
ggcaugcucuuuguccacagua

SEQ ID NO: 854994 - RNA, 22 nt, Human
aggcaagcgcagaagcggagga

SEQ ID NO: 854995 - RNA, 22 nt, Human
aacugcuuaucuuugguagaug

SEQ ID NO: 854996 - RNA, 22 nt, Human
caauaagauguauugagcagag

SEQ ID NO: 854997 - RNA, 22 nt, Human
caggauggagaguuguugguug

SEQ ID NO: 854998 - RNA, 22 nt, Human
ggcuuggaaaugguaaugagcu

SEQ ID NO: 854999 - RNA, 22 nt, Human
aaugccaacuuggauauacauu

SEQ ID NO: 855000 - RNA, 22 nt, Human
aguaaucaauuuuucgguggau

SEQ ID NO: 855001 - RNA, 22 nt, Human
agaggggacagccaccugcccg

SEQ ID NO: 855002 - RNA, 22 nt, Human
uuugaaagcuacuuucggguca

SEQ ID NO: 855003 - RNA, 22 nt, Human
ggugaaggcacaagagggcaag

SEQ ID NO: 855004 - RNA, 22 nt, Human
gagugcaggccugagcaccauc

SEQ ID NO: 855005 - RNA, 22 nt, Human
caggauggucuucauuuggcuc

SEQ ID NO: 855006 - RNA, 22 nt, Human
gagguggaaggcaggaacaaau

SEQ ID NO: 855007 - RNA, 22 nt, Human
auacuguuuugugacuuaucuu

SEQ ID NO: 855008 - RNA, 20 nt, Human
uauuuguauuugggaaaguu

SEQ ID NO: 855009 - RNA, 22 nt, Human
agugcuuucuugcuccaucagu

SEQ ID NO: 855010 - RNA, 22 nt, Human
ggagguggcagggaacauaauu

SEQ ID NO: 855011 - RNA, 22 nt, Human
aauauaaugcuguuuuaugcca

SEQ ID NO: 855012 - RNA, 22 nt, Human
uucucugaucuugcuagacuga

SEQ ID NO: 855013 - RNA, 22 nt, Human
ucugaaagaagggcagucuuuu

SEQ ID NO: 855014 - RNA, 22 nt, Human
gaaaugaacugauuaucauugc

SEQ ID NO: 855015 - RNA, 22 nt, Human
uacuuuuuagcacagugugugc

SEQ ID NO: 855016 - RNA, 22 nt, Human
uuguuugaggucacugauauuu

SEQ ID NO: 855017 - RNA, 22 nt, Human
ggagaggagcuauugggggcuc

SEQ ID NO: 855018 - RNA, 18 nt, Human
cagggcuguggggucacu

SEQ ID NO: 855019 - RNA, 22 nt, Human
aggauuuguuuauaggucuuaa

SEQ ID NO: 855020 - RNA, 22 nt, Human
cuucccagaccuuagagugcag

SEQ ID NO: 855021 - RNA, 22 nt, Human
gagaggagguggcuaugacagc

SEQ ID NO: 855022 - RNA, 22 nt, Human
gcugaggccccagggugauggg

SEQ ID NO: 855023 - RNA, 22 nt, Human
acaggcuguugggguccagggu

SEQ ID NO: 855024 - RNA, 22 nt, Human
uuucaaaccuacuuguauguuu

SEQ ID NO: 855025 - RNA, 22 nt, Human
aauuccuaguuguacuuaguga

SEQ ID NO: 855026 - RNA, 22 nt, Human
cagucugaacacugggcuacuc

SEQ ID NO: 855027 - RNA, 22 nt, Human
gaggggcagagguagagaacaa

SEQ ID NO: 855028 - RNA, 22 nt, Human
auaaggaaaugaaacucuaaua

SEQ ID NO: 855029 - RNA, 22 nt, Human
cagacaggguccuguccgucac

SEQ ID NO: 855030 - RNA, 20 nt, Human
accuacauguauagugaggg

SEQ ID NO: 855031 - RNA, 22 nt, Human
gagcaagauccuguuuuucuau

SEQ ID NO: 855032 - RNA, 21 nt, Human
cccaggagaagaaaagaugca

SEQ ID NO: 855033 - RNA, 22 nt, Human
aggaugagagauacauggagca

SEQ ID NO: 855034 - RNA, 22 nt, Human
ggguggagcuuggacaccagua

SEQ ID NO: 855035 - RNA, 19 nt, Human
ucugagguggaacuggggg

SEQ ID NO: 855036 - RNA, 22 nt, Human
acugaggauuagcccaggcuag

SEQ ID NO: 855037 - RNA, 22 nt, Human
cccaggaggguggccucugccc

SEQ ID NO: 855038 - RNA, 22 nt, Human
aacauuuaugauugagguaaau

SEQ ID NO: 855039 - RNA, 22 nt, Human
gcacugugcuagaagccagggg

SEQ ID NO: 855040 - RNA, 22 nt, Human
uuggccaagugguuaaucucca

SEQ ID NO: 855041 - RNA, 22 nt, Human
acauuuaaauaccuauguuucu

SEQ ID NO: 855042 - RNA, 22 nt, Human
agaaguuaccacauacuucucu

SEQ ID NO: 855043 - RNA, 22 nt, Human
gcugagacuggcagcaggaagu

SEQ ID NO: 855044 - RNA, 22 nt, Human
cccaggagguguagcugcgugg

SEQ ID NO: 855045 - RNA, 20 nt, Human
ggaggguggaagaaagcaag

SEQ ID NO: 855046 - RNA, 22 nt, Human
gcuggagaaacugcagcugagg

SEQ ID NO: 855047 - RNA, 22 nt, Human
agcuaagacuuagugacuuagu

SEQ ID NO: 855048 - RNA, 22 nt, Human
uucauugugaacacauucugcc

SEQ ID NO: 855049 - RNA, 22 nt, Human
cagcugcuuucagcaggaggga

SEQ ID NO: 855050 - RNA, 22 nt, Human
ccaggagagcucuaaauggcug

SEQ ID NO: 855051 - RNA, 22 nt, Human
gagcccugacacugagggaguu

SEQ ID NO: 855052 - RNA, 17 nt, Human
auuagguuuugucauga

SEQ ID NO: 855053 - RNA, 22 nt, Human
uccaugagggacacuggaugcu

SEQ ID NO: 855054 - RNA, 20 nt, Human
aggauuugagaaggcgucuu

SEQ ID NO: 855055 - RNA, 22 nt, Human
aguaaucugauuuuauagcuau

SEQ ID NO: 855056 - RNA, 22 nt, Human
ucaggcugaaaggacuccaguu

SEQ ID NO: 855057 - RNA, 22 nt, Human
aaugaaacuaguagaaucuuug

SEQ ID NO: 855058 - RNA, 22 nt, Human
uuauuagguuuacauaaagguu

SEQ ID NO: 855059 - RNA, 22 nt, Human
ggcagcauauauucagugggca

SEQ ID NO: 855060 - RNA, 22 nt, Human
gacuuucuuguagugucugaug

SEQ ID NO: 855061 - RNA, 22 nt, Human
ucauuuguugaacuuuagugcg

SEQ ID NO: 855062 - RNA, 22 nt, Human
uuucacagguacaaacacuccu

SEQ ID NO: 855063 - RNA, 22 nt, Human
cucuucuuggcccccaugaggg

SEQ ID NO: 855064 - RNA, 22 nt, Human
ucuacuguagugaugcugcagu

SEQ ID NO: 855065 - RNA, 22 nt, Human
cccuccucucccuaagagucac

SEQ ID NO: 855066 - RNA, 21 nt, Human
aggucagcccagcucuggaag

SEQ ID NO: 855067 - RNA, 18 nt, Human
ggcagcuugacuagcaac

SEQ ID NO: 855068 - RNA, 22 nt, Human
gcugcagagggaggggcucgca

SEQ ID NO: 855069 - RNA, 22 nt, Human
auguuuuugagauacaaacaga

SEQ ID NO: 855070 - RNA, 22 nt, Human
uauuggcagcaugagcuccugg

SEQ ID NO: 855071 - RNA, 20 nt, Human
uuugucuguuaaguguuucu

SEQ ID NO: 855072 - RNA, 22 nt, Human
ggcugagggucccagacccuaa

SEQ ID NO: 855073 - RNA, 22 nt, Human
acucaccacacccuugcacuug

SEQ ID NO: 855074 - RNA, 22 nt, Human
acacauuucuaaauuuuuaccg

SEQ ID NO: 855075 - RNA, 21 nt, Human
uggccaaacuggagcauuuga

SEQ ID NO: 855076 - RNA, 22 nt, Human
aguggcagagccaaguagagcc

SEQ ID NO: 855077 - RNA, 22 nt, Human
uagcaagaagcugucacaggug

SEQ ID NO: 855078 - RNA, 22 nt, Human
gugaggucuuugggaggugauu

SEQ ID NO: 855079 - RNA, 19 nt, Human
uggagggguuugaaugugg

SEQ ID NO: 855080 - RNA, 20 nt, Human
cgugcugugaccuugagcau

SEQ ID NO: 855081 - RNA, 22 nt, Human
uacccaggggcugagcagaggu

SEQ ID NO: 855082 - RNA, 22 nt, Human
aggcagagcuggguuuugaaau

SEQ ID NO: 855083 - RNA, 22 nt, Human
aucaggaugcugucaguuacca

SEQ ID NO: 855084 - RNA, 22 nt, Human
uucugagcugcaacacuaacau

SEQ ID NO: 855085 - RNA, 22 nt, Human
gcugcuugauuagguugacacu

SEQ ID NO: 855086 - RNA, 22 nt, Human
gcuccuggguguggcugccccu

SEQ ID NO: 855087 - RNA, 22 nt, Human
gcccaggaagugacucagaugu

SEQ ID NO: 855088 - RNA, 22 nt, Human
uuauucuucuucucuugccagg

SEQ ID NO: 855089 - RNA, 22 nt, Human
ggcugcagagcugggugggccu

SEQ ID NO: 855090 - RNA, 22 nt, Human
ugccaggagucaggccaggcag

SEQ ID NO: 855091 - RNA, 22 nt, Human
caaggccaguccauuuuggaag

SEQ ID NO: 855092 - RNA, 22 nt, Human
gacccaggguggucaccugaaa

SEQ ID NO: 855093 - RNA, 22 nt, Human
cccaggagacugagcuguaacc

SEQ ID NO: 855094 - RNA, 22 nt, Human
cacagaacauccuuagcucaug

SEQ ID NO: 855095 - RNA, 22 nt, Human
cuggcuuucucugugguguuca

SEQ ID NO: 855096 - RNA, 22 nt, Human
uuagagccaguuacaaggucaa

SEQ ID NO: 855097 - RNA, 22 nt, Human
ucagaaaauaacuguuaguuug

SEQ ID NO: 855098 - RNA, 22 nt, Human
ugcugcugauggcaccuaggca

SEQ ID NO: 855099 - RNA, 22 nt, Human
ucugucucaaguucuugcacuc

SEQ ID NO: 855100 - RNA, 23 nt, Human
uagugucaagagggaguguaauu

SEQ ID NO: 855101 - RNA, 22 nt, Human
acuuuauuuccuauugcaucca

SEQ ID NO: 855102 - RNA, 22 nt, Human
uuauuaggaaaaggucagaugu

SEQ ID NO: 855103 - RNA, 22 nt, Human
uagggcuguggucaguccucua

SEQ ID NO: 855104 - RNA, 22 nt, Human
auggcugggucaccaucagggu

SEQ ID NO: 855105 - RNA, 22 nt, Human
uuuuccagauuggacuuagucc

SEQ ID NO: 855106 - RNA, 22 nt, Human
gcaucuaauccaguccagcauc

SEQ ID NO: 855107 - RNA, 22 nt, Human
aagggcaggagaagacggauau

SEQ ID NO: 855108 - RNA, 22 nt, Human
gccaucacauccaggcuaccuc

SEQ ID NO: 855109 - RNA, 20 nt, Human
guaaaauauggucuuugggu

SEQ ID NO: 855110 - RNA, 22 nt, Human
ucugccugagggagcugaggaa

SEQ ID NO: 855111 - RNA, 20 nt, Human
uccaggagaacugggagccg

SEQ ID NO: 855112 - RNA, 22 nt, Human
ccacagagcauuagauuucaga

SEQ ID NO: 855113 - RNA, 22 nt, Human
ucuucagagugaaagucuguga

SEQ ID NO: 855114 - RNA, 22 nt, Human
ugaacucucucaagugacagaa

SEQ ID NO: 855115 - RNA, 22 nt, Human
aucauucuaguccuuauggucu

SEQ ID NO: 855116 - RNA, 22 nt, Human
ggacugaggacaugugaggcau

SEQ ID NO: 855117 - RNA, 22 nt, Human
uucacagaauggcaaguuaugg

SEQ ID NO: 855118 - RNA, 22 nt, Human
aauccuggaauacaagagugaa

SEQ ID NO: 855119 - RNA, 19 nt, Human
ggcugcagagccccggcgc

SEQ ID NO: 855120 - RNA, 22 nt, Human
caggcagcucuaauggaaagug

SEQ ID NO: 855121 - RNA, 22 nt, Human
agaacuauugcaauaacaagaa

SEQ ID NO: 855122 - RNA, 22 nt, Human
aaaaugagauacaguuugaaag

SEQ ID NO: 855123 - RNA, 22 nt, Human
acccaggagcaggcugggcagu

SEQ ID NO: 855124 - RNA, 22 nt, Human
ugcugaggaauaauuguuccug

SEQ ID NO: 855125 - RNA, 22 nt, Human
uuuucauuguuccucgagcauu

SEQ ID NO: 855126 - RNA, 22 nt, Human
ucuuucuugguauaaagcaggg

SEQ ID NO: 855127 - RNA, 22 nt, Human
auguucuuccaaaucuguaaca

SEQ ID NO: 855128 - RNA, 22 nt, Human
cagaggucaagaucugaaguga

SEQ ID NO: 855129 - RNA, 22 nt, Human
gagggcugcugccagauaugcc

SEQ ID NO: 855130 - RNA, 22 nt, Human
ucuggccaauguugugaucaca

SEQ ID NO: 855131 - RNA, 22 nt, Human
guaggcagucucucaggugauc

SEQ ID NO: 855132 - RNA, 22 nt, Human
gcugaggugucaccuugcuggg

SEQ ID NO: 855133 - RNA, 22 nt, Human
auucacaaaaugauauagauac

SEQ ID NO: 855134 - RNA, 22 nt, Human
ggcagcuuccuaggagagggca

SEQ ID NO: 855135 - RNA, 22 nt, Human
agauaagauaguccagcacaau

SEQ ID NO: 855136 - RNA, 22 nt, Human
auauucuugugauuauaaagua

SEQ ID NO: 855137 - RNA, 22 nt, Human
uagaaagugaagguuaauuaau

SEQ ID NO: 855138 - RNA, 22 nt, Human
auucuuauuuaaauagagucug

SEQ ID NO: 855139 - RNA, 22 nt, Human
cuggcugugcagucuuccagaa

SEQ ID NO: 855140 - RNA, 22 nt, Human
cagggagggacaauugucaccu

SEQ ID NO: 855141 - RNA, 22 nt, Human
aggcacagcacaccuggccccc

SEQ ID NO: 855142 - RNA, 22 nt, Human
cuucucaguugcaagugucaga

SEQ ID NO: 855143 - RNA, 22 nt, Human
agaaaguuagcagacucuuggc

SEQ ID NO: 855144 - RNA, 22 nt, Human
caagaugugccuaaucagaccu

SEQ ID NO: 855145 - RNA, 22 nt, Human
uuagccauuuuauacaagugua

SEQ ID NO: 855146 - RNA, 22 nt, Human
gcagcugaaagggaucucuaca

SEQ ID NO: 855147 - RNA, 22 nt, Human
cauuguuauagcauuacacacc

SEQ ID NO: 855148 - RNA, 22 nt, Human
aggauuuuagauaagacagcaa

SEQ ID NO: 855149 - RNA, 22 nt, Human
uucacagaugccugaugugugg

SEQ ID NO: 855150 - RNA, 17 nt, Human
cauuuguugaucaguug

SEQ ID NO: 855151 - RNA, 22 nt, Human
agaggggaaguaaugaaugaua

SEQ ID NO: 855152 - RNA, 19 nt, Human
agacagagcucaguggguu

SEQ ID NO: 855153 - RNA, 22 nt, Human
gcuccuggcaggcagugugugu

SEQ ID NO: 855154 - RNA, 22 nt, Human
uucauugugauucuuggcuagc

SEQ ID NO: 855155 - RNA, 22 nt, Human
cucuucuugccugaugaggcag

SEQ ID NO: 855156 - RNA, 22 nt, Human
aucaggauucaguaucuccagc

SEQ ID NO: 855157 - RNA, 22 nt, Human
uuuuaauacugcuauuguagga

SEQ ID NO: 855158 - RNA, 22 nt, Human
ugcuuggcuuucugagcuucug

SEQ ID NO: 855159 - RNA, 22 nt, Human
uucuacaaauauuuacuguucc

SEQ ID NO: 855160 - RNA, 22 nt, Human
uuuggaauauuaaaaugucuca

SEQ ID NO: 855161 - RNA, 22 nt, Human
aauugcuaaagauuauguuuuc

SEQ ID NO: 855162 - RNA, 22 nt, Human
ccuggagcucacugggagccgg

SEQ ID NO: 855163 - RNA, 22 nt, Human
cuucuucacacuggucugaagc

SEQ ID NO: 855164 - RNA, 22 nt, Human
auuaggcaauucugggcaucuc

SEQ ID NO: 855165 - RNA, 22 nt, Human
cugaagucagauggcacaaggu

SEQ ID NO: 855166 - RNA, 22 nt, Human
augcuuuuaugucacaugguca

SEQ ID NO: 855167 - RNA, 22 nt, Human
gcugccuggagcucagccugcc

SEQ ID NO: 855168 - RNA, 22 nt, Human
cagucucuaaaucaaucugaau

SEQ ID NO: 855169 - RNA, 22 nt, Human
ucuggcugacauccuguaugag

SEQ ID NO: 855170 - RNA, 22 nt, Human
ggagaggguguggaaaguuauc

SEQ ID NO: 855171 - RNA, 22 nt, Human
cagcugacagugaggugggggc

SEQ ID NO: 855172 - RNA, 21 nt, Human
gccaggaguagauuacauuua

SEQ ID NO: 855173 - RNA, 22 nt, Human
gagcugaggcucaggcuggcgu

SEQ ID NO: 855174 - RNA, 22 nt, Human
cugagggcagugaugaagguga

SEQ ID NO: 855175 - RNA, 22 nt, Human
caugaggugauaaagcugggau

SEQ ID NO: 855176 - RNA, 22 nt, Human
cauuuguuaauuacuauuaucu

SEQ ID NO: 855177 - RNA, 22 nt, Human
accaggagccauagagucaggc

SEQ ID NO: 855178 - RNA, 22 nt, Human
uugaggucaucugaaguacuag

SEQ ID NO: 855179 - RNA, 22 nt, Human
uggcaccagcaccuagaugggg

SEQ ID NO: 855180 - RNA, 22 nt, Human
gagcccugaacaacagcaggaa

SEQ ID NO: 855181 - RNA, 22 nt, Human
aggccagcaagaaagagagucu

SEQ ID NO: 855182 - RNA, 22 nt, Human
auuuguagugaagugaaaauaa

SEQ ID NO: 855183 - RNA, 22 nt, Human
guaucacuuuugagagugagaa

SEQ ID NO: 855184 - RNA, 22 nt, Human
uugaggucaaguaaccacugga

SEQ ID NO: 855185 - RNA, 23 nt, Human
cagggaggagauacuguguaucu

SEQ ID NO: 855186 - RNA, 22 nt, Human
aggcagugccuggaccccagcu

SEQ ID NO: 855187 - RNA, 22 nt, Human
aggcugaggugugcugugaucg

SEQ ID NO: 855188 - RNA, 22 nt, Human
ccccucccugaccugguugggc

SEQ ID NO: 855189 - RNA, 22 nt, Human
gaaggaggcguuagcccuagga

SEQ ID NO: 855190 - RNA, 18 nt, Human
cgaggcaggcggaucacg

SEQ ID NO: 855191 - RNA, 22 nt, Human
uggcugagcugcagcguggcuu

SEQ ID NO: 855192 - RNA, 22 nt, Human
ccuggccaggcuccaaguacug

SEQ ID NO: 855193 - RNA, 22 nt, Human
uauugaggauugaggaaagcac

SEQ ID NO: 855194 - RNA, 22 nt, Human
cagaccagcucuaugaacccaa

SEQ ID NO: 855195 - RNA, 22 nt, Human
uuggccaacauggugaaacccc

SEQ ID NO: 855196 - RNA, 22 nt, Human
uuacacuucuaaaaaaagcagg

SEQ ID NO: 855197 - RNA, 22 nt, Human
auuuuacuacuccaauuaauga

SEQ ID NO: 855198 - RNA, 22 nt, Human
caaauacuacgauucuugcagu

SEQ ID NO: 855199 - RNA, 22 nt, Human
uucuucuucaagugcugcauuc

SEQ ID NO: 855200 - RNA, 22 nt, Human
uuugaauguuuuagguacuuaa

SEQ ID NO: 855201 - RNA, 22 nt, Human
aggcaggcccucuggaaaggua

SEQ ID NO: 855202 - RNA, 22 nt, Human
ggaagaggaggagccaggcuuu

SEQ ID NO: 855203 - RNA, 22 nt, Human
cucaggauggaagccuacagga

SEQ ID NO: 855204 - RNA, 22 nt, Human
cagcaggagcagucagacuccu

SEQ ID NO: 855205 - RNA, 22 nt, Human
gcuacugauugaccuuggagag

SEQ ID NO: 855206 - RNA, 22 nt, Human
uagggcugcugcagaugacagg

SEQ ID NO: 855207 - RNA, 21 nt, Human
uggcugaguggaugcaugaau

SEQ ID NO: 855208 - RNA, 22 nt, Human
gagaggauccacaaaccaggaa

SEQ ID NO: 855209 - RNA, 20 nt, Human
ucuccuggucugguccgugc

SEQ ID NO: 855210 - RNA, 20 nt, Human
auacaguaggugcucaauau

SEQ ID NO: 855211 - RNA, 22 nt, Human
ccucuucugcuucaggagcacu

SEQ ID NO: 855212 - RNA, 22 nt, Human
cucucuggaccucaacuauuuu

SEQ ID NO: 855213 - RNA, 22 nt, Human
uaggacauguguuuuauauaug

SEQ ID NO: 855214 - RNA, 22 nt, Human
gugacagagcugggauuugaag

SEQ ID NO: 855215 - RNA, 23 nt, Human
auucuucauuaucuucuagaaaa

SEQ ID NO: 855216 - RNA, 22 nt, Human
auacacuuuagaaaaacgcugc

SEQ ID NO: 855217 - RNA, 22 nt, Human
aggcagugcaugcaaaggucgg

SEQ ID NO: 855218 - RNA, 22 nt, Human
guagggagcccagagcccagug

SEQ ID NO: 855219 - RNA, 22 nt, Human
auguagagcaguguuguccaau

SEQ ID NO: 855220 - RNA, 22 nt, Human
gggcugaggaacauauuuuguu

SEQ ID NO: 855221 - RNA, 22 nt, Human
uggcagcaauuagcuagagcug

SEQ ID NO: 855222 - RNA, 22 nt, Human
cauuuuaagaugaccugguuuc

SEQ ID NO: 855223 - RNA, 22 nt, Human
ccaggcugcagucaaggggcau

SEQ ID NO: 855224 - RNA, 22 nt, Human
agucuucucauuucacaugcuu

SEQ ID NO: 855225 - RNA, 18 nt, Human
aacaugcauuagaacugc

SEQ ID NO: 855226 - RNA, 20 nt, Human
ccucaguguccuggacuggg

SEQ ID NO: 855227 - RNA, 22 nt, Human
cccaggaggcagagguuggagc

SEQ ID NO: 855228 - RNA, 22 nt, Human
gagcccuguagcaagucauguc

SEQ ID NO: 855229 - RNA, 22 nt, Human
uuugcaguuucauugcugaaau

SEQ ID NO: 855230 - RNA, 22 nt, Human
aauuuccagaccccauccacag

SEQ ID NO: 855231 - RNA, 22 nt, Human
cucacugucuguacuagcugau

SEQ ID NO: 855232 - RNA, 22 nt, Human
auuauggacguuaauuuuggaa

SEQ ID NO: 855233 - RNA, 22 nt, Human
ccagcagaggggcggagugcag

SEQ ID NO: 855234 - RNA, 22 nt, Human
gcccaggaucugcucagaucau

SEQ ID NO: 855235 - RNA, 22 nt, Human
cugagccccaucugaggugccc

SEQ ID NO: 855236 - RNA, 22 nt, Human
cugcuuugcauagcugccagag

SEQ ID NO: 855237 - RNA, 18 nt, Human
gagaggagccagaauuuu

SEQ ID NO: 855238 - RNA, 23 nt, Human
ucucaguuccagaggcuacaagu

SEQ ID NO: 855239 - RNA, 22 nt, Human
uggcuucugggacuugugagca

SEQ ID NO: 855240 - RNA, 22 nt, Human
cuugaaguugcaaaacauuaau

SEQ ID NO: 855241 - RNA, 22 nt, Human
uuucacauuagauaugucauuu

SEQ ID NO: 855242 - RNA, 22 nt, Human
cuggagucucuucuguagcuac

SEQ ID NO: 855243 - RNA, 17 nt, Human
cccagggaccacugcuu

SEQ ID NO: 855244 - RNA, 22 nt, Human
acugcuuuaucugagaaguccu

SEQ ID NO: 855245 - RNA, 17 nt, Human
augaggucauuaagaua

SEQ ID NO: 855246 - RNA, 21 nt, Human
ucacaucuauguuaagcaaac

SEQ ID NO: 855247 - RNA, 22 nt, Human
cugcuguggguuaagacacugu

SEQ ID NO: 855248 - RNA, 22 nt, Human
agaggucagauuucuccuggug

SEQ ID NO: 855249 - RNA, 22 nt, Human
aagggcagagggaaucccacau

SEQ ID NO: 855250 - RNA, 22 nt, Human
ccuggccagcagccccuuccuc

SEQ ID NO: 855251 - RNA, 22 nt, Human
ucucugguuauuaacuaacucc

SEQ ID NO: 855252 - RNA, 19 nt, Human
ggucagcugggcuagaggc

SEQ ID NO: 855253 - RNA, 22 nt, Human
guucuucaggccauccucccag

SEQ ID NO: 855254 - RNA, 22 nt, Human
gcugagggaggcugaacugagu

SEQ ID NO: 855255 - RNA, 22 nt, Human
auggccaagaaauugccgacug

SEQ ID NO: 855256 - RNA, 22 nt, Human
ccugccucaucaacuugucgug

SEQ ID NO: 855257 - RNA, 22 nt, Human
ucucugaguauccugaacugcc

SEQ ID NO: 855258 - RNA, 22 nt, Human
aagaacuguaucaagauguagu

SEQ ID NO: 855259 - RNA, 22 nt, Human
ggaggaugagcuacgaggagcu

SEQ ID NO: 855260 - RNA, 22 nt, Human
uugauagguuuuauguauaguu

SEQ ID NO: 855261 - RNA, 22 nt, Human
agagugcagauaagagaauguu

SEQ ID NO: 855262 - RNA, 22 nt, Human
uacaaaguaauguauaauaucg

SEQ ID NO: 855263 - RNA, 22 nt, Human
aaggcagccaugugcuuugggu

SEQ ID NO: 855264 - RNA, 22 nt, Human
aacauucugguucuaaaaaccu

SEQ ID NO: 855265 - RNA, 22 nt, Human
augagguccagggaaguuaaau

SEQ ID NO: 855266 - RNA, 16 nt, Human
aaggcugauuuucccu

SEQ ID NO: 855267 - RNA, 22 nt, Human
gaaucucaguggaagcaggaag

SEQ ID NO: 855268 - RNA, 22 nt, Human
ucuggccaguagauguggguug

SEQ ID NO: 855269 - RNA, 22 nt, Human
gaggcagcaaaauauaucauaa

SEQ ID NO: 855270 - RNA, 21 nt, Human
ugcugaugucagagaagcaag

SEQ ID NO: 855271 - RNA, 22 nt, Human
uuugaaaguguuuacuugggaa

SEQ ID NO: 855272 - RNA, 22 nt, Human
uggcagcugauuagauggugcc

SEQ ID NO: 855273 - RNA, 22 nt, Human
auugaaagauaggcuacugugg

SEQ ID NO: 855274 - RNA, 22 nt, Human
gcugccucuguagcuuuggacc

SEQ ID NO: 855275 - RNA, 22 nt, Human
ucauuuguucucauucucuacu

SEQ ID NO: 855276 - RNA, 22 nt, Human
acuccaggcaucugcuucugcu

SEQ ID NO: 855277 - RNA, 22 nt, Human
acucauugaaacuuaagaucua

SEQ ID NO: 855278 - RNA, 22 nt, Human
gagggcugaagauuguggcccc

SEQ ID NO: 855279 - RNA, 22 nt, Human
acuacacugcccuggggaucaa

SEQ ID NO: 855280 - RNA, 22 nt, Human
gcacuuucagcaggcagacaga

SEQ ID NO: 855281 - RNA, 22 nt, Human
ggcugaugggcaugagcuguca

SEQ ID NO: 855282 - RNA, 22 nt, Human
agcuaccuggcuuaucacuguc

SEQ ID NO: 855283 - RNA, 22 nt, Human
ucuuuauugcuacugguuuguc

SEQ ID NO: 855284 - RNA, 22 nt, Human
cucuggccugcagauccaugcu

SEQ ID NO: 855285 - RNA, 22 nt, Human
guggccaagagauaaaauugug

SEQ ID NO: 855286 - RNA, 22 nt, Human
agcccaggagguggagguugca

SEQ ID NO: 855287 - RNA, 22 nt, Human
cuugggaaugcuaacagaugac

SEQ ID NO: 855288 - RNA, 22 nt, Human
uuugcaauuugugcugcaaaug

SEQ ID NO: 855289 - RNA, 22 nt, Human
aaacugccuccugggcaacuaa

SEQ ID NO: 855290 - RNA, 19 nt, Human
cccaggagucuggcugguu

SEQ ID NO: 855291 - RNA, 22 nt, Human
ugcucccagggacucuggcugg

SEQ ID NO: 855292 - RNA, 22 nt, Human
uaacugguuuggcucagggucu

SEQ ID NO: 855293 - RNA, 22 nt, Human
aauacacuauuuugugcucagu

SEQ ID NO: 855294 - RNA, 22 nt, Human
ucuuuuauccuacauuuagcuc

SEQ ID NO: 855295 - RNA, 22 nt, Human
augcuguggccagaguucaacu

SEQ ID NO: 855296 - RNA, 22 nt, Human
uuuauauuucccaggauuggcc

SEQ ID NO: 855297 - RNA, 22 nt, Human
ugcucaguccuccugcagugcc

SEQ ID NO: 855298 - RNA, 22 nt, Human
auggcuucugucuuggaaauuu

SEQ ID NO: 855299 - RNA, 22 nt, Human
aaauguuucuacuugugagcau

SEQ ID NO: 855300 - RNA, 22 nt, Human
cuucuucaauagcaagcgcaua

SEQ ID NO: 855301 - RNA, 22 nt, Human
gaggcccacagggaguaccaag

SEQ ID NO: 855302 - RNA, 22 nt, Human
uuuuucaagacaaccugcaugu

SEQ ID NO: 855303 - RNA, 22 nt, Human
acagacuggagcccuuuugccc

SEQ ID NO: 855304 - RNA, 22 nt, Human
ucugagaggcaucugcacuucu

SEQ ID NO: 855305 - RNA, 22 nt, Human
cugaggucucuuuccauaguga

SEQ ID NO: 855306 - RNA, 22 nt, Human
gugguuuugccauuacaaguaa

SEQ ID NO: 855307 - RNA, 22 nt, Human
ucacaauuuggauacagcuaug

SEQ ID NO: 855308 - RNA, 22 nt, Human
cucacugacgaggaagcugaga

SEQ ID NO: 855309 - RNA, 22 nt, Human
gcucacugccauucucuagaug

SEQ ID NO: 855310 - RNA, 22 nt, Human
aggggcucaaagugugcaggga

SEQ ID NO: 855311 - RNA, 22 nt, Human
uagggcaggggaggaaucugaa

SEQ ID NO: 855312 - RNA, 22 nt, Human
ucuccugggugcuuuaucagaa

SEQ ID NO: 855313 - RNA, 22 nt, Human
aaagccagagcaagcugucaca

SEQ ID NO: 855314 - RNA, 22 nt, Human
cggaggggauacauuuucugaa

SEQ ID NO: 855315 - RNA, 21 nt, Human
acauuuucuguuuuaggaagu

SEQ ID NO: 855316 - RNA, 22 nt, Human
ugaggcagcccacuuuccuuag

SEQ ID NO: 855317 - RNA, 22 nt, Human
ucucagaguuuagagcugagcc

SEQ ID NO: 855318 - RNA, 22 nt, Human
ucuuugaauccuuuacaucuga

SEQ ID NO: 855319 - RNA, 22 nt, Human
aaugaacauggacaaguuaaua

SEQ ID NO: 855320 - RNA, 22 nt, Human
acagaagugacaauuucuuggg

SEQ ID NO: 855321 - RNA, 22 nt, Human
cccuuagcucaauuucuugccc

SEQ ID NO: 855322 - RNA, 22 nt, Human
uaggaugaaaauccagcuuaua

SEQ ID NO: 855323 - RNA, 23 nt, Human
cagugcugguucugccugugggg

SEQ ID NO: 855324 - RNA, 22 nt, Human
uggguccacggaagacuuaggg

SEQ ID NO: 855325 - RNA, 22 nt, Human
ggaggacaggggcugcagcaca

SEQ ID NO: 855326 - RNA, 23 nt, Human
cugagguaaaauauucugaagga

SEQ ID NO: 855327 - RNA, 22 nt, Human
gcagagaacccagcagauuggc

SEQ ID NO: 855328 - RNA, 22 nt, Human
uucaggauucuuucagacuggg

SEQ ID NO: 855329 - RNA, 22 nt, Human
uuuauuguuuagaagggggcug

SEQ ID NO: 855330 - RNA, 22 nt, Human
aguuagagacacaugcacaugc

SEQ ID NO: 855331 - RNA, 22 nt, Human
agaggaggcagcuuaacucagu

SEQ ID NO: 855332 - RNA, 23 nt, Human
uagggcagcugggagggacaugc

SEQ ID NO: 855333 - RNA, 22 nt, Human
uuuaaaaucagaugggaguugg

SEQ ID NO: 855334 - RNA, 18 nt, Human
ccucagggagagagacgc

SEQ ID NO: 855335 - RNA, 22 nt, Human
aggcagcccugugcuggaugcu

SEQ ID NO: 855336 - RNA, 22 nt, Human
ugacagaaagaauaugucaauc

SEQ ID NO: 855337 - RNA, 22 nt, Human
acaguaacaccuacucuguccc

SEQ ID NO: 855338 - RNA, 22 nt, Human
aacaugcugccuuucuacgagu

SEQ ID NO: 855339 - RNA, 22 nt, Human
auggccaagcauauacagauug

SEQ ID NO: 855340 - RNA, 22 nt, Human
agcccaggugagggguucgaaa

SEQ ID NO: 855341 - RNA, 22 nt, Human
ugcacauuaguguuugagaugc

SEQ ID NO: 855342 - RNA, 22 nt, Human
acaguacaccacuguguacagu

SEQ ID NO: 855343 - RNA, 22 nt, Human
agccacagcacauuguaagaaa

SEQ ID NO: 855344 - RNA, 22 nt, Human
uacaguaauaaaaugagcuaca

SEQ ID NO: 855345 - RNA, 22 nt, Human
cuuaacagagagaaguguugcu

SEQ ID NO: 855346 - RNA, 22 nt, Human
cuggcaaguacugggccagcuc

SEQ ID NO: 855347 - RNA, 17 nt, Human
aggccagaugaggcaag

SEQ ID NO: 855348 - RNA, 22 nt, Human
cugccugccuuggccuccagga

SEQ ID NO: 855349 - RNA, 22 nt, Human
auggccaagaucacagacuuca

SEQ ID NO: 855350 - RNA, 21 nt, Human
aucauucuggaaaauucaagc

SEQ ID NO: 855351 - RNA, 22 nt, Human
auacacauuacuuucugucuga

SEQ ID NO: 855352 - RNA, 22 nt, Human
aggaggggcauagaaauguaau

SEQ ID NO: 855353 - RNA, 22 nt, Human
aacuuucuuugcaucuaaguuu

SEQ ID NO: 855354 - RNA, 22 nt, Human
aauauccacacugugucccugc

SEQ ID NO: 855355 - RNA, 17 nt, Human
agcugaaauugcugaag

SEQ ID NO: 855356 - RNA, 22 nt, Human
cacccugggcugggccuguuaa

SEQ ID NO: 855357 - RNA, 22 nt, Human
ccugucacgaugacugcacucu

SEQ ID NO: 855358 - RNA, 22 nt, Human
gaguagcauucuagaguaugcu

SEQ ID NO: 855359 - RNA, 22 nt, Human
ggagaggagauuguggcauuuu

SEQ ID NO: 855360 - RNA, 22 nt, Human
ugguaauuuacgcauuucugua

SEQ ID NO: 855361 - RNA, 18 nt, Human
gagcugagaagaggaugc

SEQ ID NO: 855362 - RNA, 22 nt, Human
cuuuugauaguugcugagcagg

SEQ ID NO: 855363 - RNA, 22 nt, Human
uaguuaaaauaauggagauguu

SEQ ID NO: 855364 - RNA, 23 nt, Human
cugaggucugcaauucuaguagu

SEQ ID NO: 855365 - RNA, 22 nt, Human
agggagugguuaagaaggugca

SEQ ID NO: 855366 - RNA, 22 nt, Human
aggcaguuuauccccagagccu

SEQ ID NO: 855367 - RNA, 22 nt, Human
cugggccaguuaugucucaucu

SEQ ID NO: 855368 - RNA, 22 nt, Human
ugcaugcugcacacaugcguag

SEQ ID NO: 855369 - RNA, 22 nt, Human
cauuuguauagugcuuagacca

SEQ ID NO: 855370 - RNA, 22 nt, Human
cuggcugacaccuugauagcag

SEQ ID NO: 855371 - RNA, 22 nt, Human
agcugguaaaggggaaagcaga

SEQ ID NO: 855372 - RNA, 22 nt, Human
auaucaaacgaaguuauuuuaa

SEQ ID NO: 855373 - RNA, 22 nt, Human
cauggcugcgagaagagugggu

SEQ ID NO: 855374 - RNA, 22 nt, Human
augcugugauuguagaaauauu

SEQ ID NO: 855375 - RNA, 22 nt, Human
gaggcugagacucugaauuuuu

SEQ ID NO: 855376 - RNA, 22 nt, Human
acccaggauagagugcugcagu

SEQ ID NO: 855377 - RNA, 22 nt, Human
ccuccuggccugugcagagccc

SEQ ID NO: 855378 - RNA, 22 nt, Human
uccaugagagguaacuuuacaa

SEQ ID NO: 855379 - RNA, 22 nt, Human
uucaugugaucacagauuguaa

SEQ ID NO: 855380 - RNA, 22 nt, Human
uucugugauugacauguggcuu

SEQ ID NO: 855381 - RNA, 22 nt, Human
cuggccaacuugcuuguuggca

SEQ ID NO: 855382 - RNA, 22 nt, Human
aaggcugaggcuggagaauuac

SEQ ID NO: 855383 - RNA, 19 nt, Human
gugaggucuuuccuuuugu

SEQ ID NO: 855384 - RNA, 22 nt, Human
uuuuaacuuaaaauacauagau

SEQ ID NO: 855385 - RNA, 22 nt, Human
agauaacucauuuuguauaucc

SEQ ID NO: 855386 - RNA, 22 nt, Human
accagagcagacuacuggaggu

SEQ ID NO: 855387 - RNA, 22 nt, Human
cuuguaauuauaauguacuguu

SEQ ID NO: 855388 - RNA, 22 nt, Human
ugcccuggcuggagugcagugg

SEQ ID NO: 855389 - RNA, 22 nt, Human
ucuuggcuucuguauuuccugu

SEQ ID NO: 855390 - RNA, 22 nt, Human
uugcugaagugaagguauguuu

SEQ ID NO: 855391 - RNA, 22 nt, Human
ugcugcugcuucuguacagccu

SEQ ID NO: 855392 - RNA, 22 nt, Human
ucugagguuauugucugccauu

SEQ ID NO: 855393 - RNA, 22 nt, Human
guaaauaacugguaauuggggu

SEQ ID NO: 855394 - RNA, 22 nt, Human
ugcccuggaaaugagaggugug

SEQ ID NO: 855395 - RNA, 21 nt, Human
uggcagacaggaggagcucac

SEQ ID NO: 855396 - RNA, 22 nt, Human
cugagccuguguuucucuggca

SEQ ID NO: 855397 - RNA, 22 nt, Human
agggacuuguguccuauguaug

SEQ ID NO: 855398 - RNA, 22 nt, Human
ggcaacauucuccagauccuuu

SEQ ID NO: 855399 - RNA, 22 nt, Human
uugagguccagucuccacccac

SEQ ID NO: 855400 - RNA, 22 nt, Human
cccagggaaggcagauggagga

SEQ ID NO: 855401 - RNA, 22 nt, Human
ucuguccaggcuuacuauauau

SEQ ID NO: 855402 - RNA, 22 nt, Human
cugccaccaaauagcugcauga

SEQ ID NO: 855403 - RNA, 22 nt, Human
ucaggcuguuagccaccuccuc

SEQ ID NO: 855404 - RNA, 22 nt, Human
cugacuguaauucuguucuuaa

SEQ ID NO: 855405 - RNA, 22 nt, Human
auuuggcacacuggguucucgu

SEQ ID NO: 855406 - RNA, 22 nt, Human
cuguccugcccacccugcaggg

SEQ ID NO: 855407 - RNA, 22 nt, Human
gcugccuccaaucugugccccg

SEQ ID NO: 855408 - RNA, 22 nt, Human
gaucuucuauguaaugaagugu

SEQ ID NO: 855409 - RNA, 22 nt, Human
ggcaugagagguccuggggauu

SEQ ID NO: 855410 - RNA, 22 nt, Human
uggcagcuuuuuguuucaggcu

SEQ ID NO: 855411 - RNA, 22 nt, Human
gagaaaggcauuccuaugcaaa

SEQ ID NO: 855412 - RNA, 22 nt, Human
gagugucaaggcucucuuuggc

SEQ ID NO: 855413 - RNA, 22 nt, Human
ucaggcugcuuucaugcuuaga

SEQ ID NO: 855414 - RNA, 22 nt, Human
uugguaaaaucauagugguaac

SEQ ID NO: 855415 - RNA, 22 nt, Human
cccaggaggaggaaaaagcucg

SEQ ID NO: 855416 - RNA, 22 nt, Human
ggccaaauuuggccaugagcau

SEQ ID NO: 855417 - RNA, 21 nt, Human
uucucagaucgaguagugaga

SEQ ID NO: 855418 - RNA, 22 nt, Human
uagcaagauccuucccuggcgu

SEQ ID NO: 855419 - RNA, 22 nt, Human
uguugagacugagggagucagc

SEQ ID NO: 855420 - RNA, 22 nt, Human
aggcagcuuaagcccuggccca

SEQ ID NO: 855421 - RNA, 22 nt, Human
ggcagcauuuagagcacagugu

SEQ ID NO: 855422 - RNA, 22 nt, Human
acauaccauacauggugagaug

SEQ ID NO: 855423 - RNA, 22 nt, Human
caggugagcucuaucuagggag

SEQ ID NO: 855424 - RNA, 22 nt, Human
ggugagggaguggaacgaggug

SEQ ID NO: 855425 - RNA, 22 nt, Human
gaggcugcuuugaugacaggag

SEQ ID NO: 855426 - RNA, 22 nt, Human
ucccaggacaggccacauggaa

SEQ ID NO: 855427 - RNA, 21 nt, Human
cugcucugacagugaggccag

SEQ ID NO: 855428 - RNA, 22 nt, Human
ggagggacccacucuagaggug

SEQ ID NO: 855429 - RNA, 22 nt, Human
ggcagcugucucugaguuagca

SEQ ID NO: 855430 - RNA, 22 nt, Human
auuuccaggagaaaggauuuua

SEQ ID NO: 855431 - RNA, 22 nt, Human
uauagccauuuccaguggcauc

SEQ ID NO: 855432 - RNA, 22 nt, Human
cagcaggauuugaaaggaagag

SEQ ID NO: 855433 - RNA, 22 nt, Human
cuuaaauuuucaucuacaagaa

SEQ ID NO: 855434 - RNA, 22 nt, Human
uuauucuuuaaacauauauguu

SEQ ID NO: 855435 - RNA, 22 nt, Human
guucuucagaggggaaagaacc

SEQ ID NO: 855436 - RNA, 22 nt, Human
uguaggauguaaggcaggcauc

SEQ ID NO: 855437 - RNA, 22 nt, Human
auugcuguaaauuaucuuauua

SEQ ID NO: 855438 - RNA, 22 nt, Human
accaggagcauuuuuuauuagu

SEQ ID NO: 855439 - RNA, 20 nt, Human
gaguuccccauuucuccugg

SEQ ID NO: 855440 - RNA, 22 nt, Human
cuacagacccaccuuggaagaa

SEQ ID NO: 855441 - RNA, 22 nt, Human
uuugaauagcauaggauuacau

SEQ ID NO: 855442 - RNA, 22 nt, Human
acacuucucuuugaagaacaau

SEQ ID NO: 855443 - RNA, 22 nt, Human
ucaggagggugacaggcccugg

SEQ ID NO: 855444 - RNA, 22 nt, Human
augaaacacacacgcgcauacu

SEQ ID NO: 855445 - RNA, 22 nt, Human
agaaguuaauuccugaaauucu

SEQ ID NO: 855446 - RNA, 22 nt, Human
uucaucuguaguuuuuccaagg

SEQ ID NO: 855447 - RNA, 19 nt, Human
uggcaggcccaggauggac

SEQ ID NO: 855448 - RNA, 22 nt, Human
cucaggauucucgacacucaca

SEQ ID NO: 855449 - RNA, 22 nt, Human
ugguggcaucaauugacuucuc

SEQ ID NO: 855450 - RNA, 22 nt, Human
gaaauauuacaguggaggggau

SEQ ID NO: 855451 - RNA, 22 nt, Human
caggcagcugggucaccguccc

SEQ ID NO: 855452 - RNA, 22 nt, Human
ccugaggucuagagucagggug

SEQ ID NO: 855453 - RNA, 22 nt, Human
agcccagggacagggcggaugu

SEQ ID NO: 855454 - RNA, 22 nt, Human
uugaauaguguuuucaguauac

SEQ ID NO: 855455 - RNA, 21 nt, Human
aaaaaugaaguuguucaggaa

SEQ ID NO: 855456 - RNA, 22 nt, Human
uggcagcucauuuggaaaugga

SEQ ID NO: 855457 - RNA, 22 nt, Human
ugaaaugauguacaagaaggca

SEQ ID NO: 855458 - RNA, 22 nt, Human
uucaacuagauuuauacaauuc

SEQ ID NO: 855459 - RNA, 22 nt, Human
aaaggccacuugaaggauuuuu

SEQ ID NO: 855460 - RNA, 22 nt, Human
aucuuucagggccauuuguauu

SEQ ID NO: 855461 - RNA, 22 nt, Human
uaagaugagguagguaagacuu

SEQ ID NO: 855462 - RNA, 22 nt, Human
uuauacagcauugcuagugaug

SEQ ID NO: 855463 - RNA, 22 nt, Human
aaggcagccuuuugaguugauu

SEQ ID NO: 855464 - RNA, 22 nt, Human
cagggcugagucauauagccuu

SEQ ID NO: 855465 - RNA, 22 nt, Human
uuaaaugaggcugauguagauu

SEQ ID NO: 855466 - RNA, 22 nt, Human
caggcugcggucggcucugguc

SEQ ID NO: 855467 - RNA, 22 nt, Human
gaggagcuugugagaagauguc

SEQ ID NO: 855468 - RNA, 22 nt, Human
augcugugaaaaagaaggcuga

SEQ ID NO: 855469 - RNA, 22 nt, Human
uugaaagacuucuccugugaaa

SEQ ID NO: 855470 - RNA, 22 nt, Human
guaguuauugcuguuuacuucu

SEQ ID NO: 855471 - RNA, 22 nt, Human
augcuguguggucaaguuaauu

SEQ ID NO: 855472 - RNA, 17 nt, Human
ggcagcugugugcaugc

SEQ ID NO: 855473 - RNA, 22 nt, Human
cugcuuuguaaaauagacauaa

SEQ ID NO: 855474 - RNA, 22 nt, Human
uuagcgcacaucacagggggaa

SEQ ID NO: 855475 - RNA, 22 nt, Human
uccagaaacuuuuccagucuca

SEQ ID NO: 855476 - RNA, 18 nt, Human
agucuucugauccauuuu

SEQ ID NO: 855477 - RNA, 22 nt, Human
auuaaaauuccaagguaugcca

SEQ ID NO: 855478 - RNA, 22 nt, Human
aaaauuauagaucuagugccug

SEQ ID NO: 855479 - RNA, 22 nt, Human
uugcauuugagaaaguucuccu

SEQ ID NO: 855480 - RNA, 22 nt, Human
uagggcuggguacacucuugcc

SEQ ID NO: 855481 - RNA, 22 nt, Human
uaacuguaauauaaauaugagu

SEQ ID NO: 855482 - RNA, 22 nt, Human
uuuguuaaauauuuauugagug

SEQ ID NO: 855483 - RNA, 22 nt, Human
cauucuuauauuuacucauuca

SEQ ID NO: 855484 - RNA, 22 nt, Human
uaggcagcauggauucugaaua

SEQ ID NO: 855485 - RNA, 22 nt, Human
ggaggacacuggcucugccuuc

SEQ ID NO: 855486 - RNA, 22 nt, Human
uagggcugaggcaacaagggag

SEQ ID NO: 855487 - RNA, 22 nt, Human
uuauuuggaaauauggcuucug

SEQ ID NO: 855488 - RNA, 22 nt, Human
ucugucuucaucagcaugugau

SEQ ID NO: 855489 - RNA, 22 nt, Human
uccuggccuugcgucuugggag

SEQ ID NO: 855490 - RNA, 22 nt, Human
uuauccaagcagaagcugcaca

SEQ ID NO: 855491 - RNA, 22 nt, Human
auuagguugugcuuuguggaca

SEQ ID NO: 855492 - RNA, 22 nt, Human
aaggcagcucagcucauggcag

SEQ ID NO: 855493 - RNA, 22 nt, Human
agcugcuacugcucugccagag

SEQ ID NO: 855494 - RNA, 22 nt, Human
uuagugauaggaagccagauug

SEQ ID NO: 855495 - RNA, 20 nt, Human
uccuggccuucucgggcagu

SEQ ID NO: 855496 - RNA, 22 nt, Human
agacagcugggaaauggagugu

SEQ ID NO: 855497 - RNA, 22 nt, Human
aacuagucagugauucucagaa

SEQ ID NO: 855498 - RNA, 22 nt, Human
uucaggaugcagagguuguagu

SEQ ID NO: 855499 - RNA, 22 nt, Human
aucccaugagaccacguuggcu

SEQ ID NO: 855500 - RNA, 22 nt, Human
acauacauauguuuaaaugcau

SEQ ID NO: 855501 - RNA, 22 nt, Human
cugagaucccaggcaggguggc

SEQ ID NO: 855502 - RNA, 22 nt, Human
aguucucaagacaauuaccugu

SEQ ID NO: 855503 - RNA, 22 nt, Human
guuuauuagaguuuucugucug

SEQ ID NO: 855504 - RNA, 23 nt, Human
accaggaguugucucaggaaaca

SEQ ID NO: 855505 - RNA, 22 nt, Human
cuugcuucauuagugucuuagu

SEQ ID NO: 855506 - RNA, 23 nt, Human
acagaaaucauuuguaagguacc

SEQ ID NO: 855507 - RNA, 22 nt, Human
uuucauuauucaugcuaguuau

SEQ ID NO: 855508 - RNA, 22 nt, Human
aacauuucagcaaauaagaaca

SEQ ID NO: 855509 - RNA, 22 nt, Human
cuccugcgguacuacugugcuu

SEQ ID NO: 855510 - RNA, 22 nt, Human
aagcaccugcaguugacaaaaa

SEQ ID NO: 855511 - RNA, 22 nt, Human
cagaaguuagacuucaacuaau

SEQ ID NO: 855512 - RNA, 22 nt, Human
acuuucuuaggcuguauaaaug

SEQ ID NO: 855513 - RNA, 22 nt, Human
cugcugugcauauuuaucuagg

SEQ ID NO: 855514 - RNA, 22 nt, Human
uggcugagaaugggaugaugcc

SEQ ID NO: 855515 - RNA, 22 nt, Human
cagagacauuaagugccaugau

SEQ ID NO: 855516 - RNA, 22 nt, Human
agcugguauuucugaaggaaag

SEQ ID NO: 855517 - RNA, 18 nt, Human
cugagggcaacagaggcu

SEQ ID NO: 855518 - RNA, 22 nt, Human
cagggcugugcccaucuucccc

SEQ ID NO: 855519 - RNA, 22 nt, Human
ucaucuugcugccauugcuuua

SEQ ID NO: 855520 - RNA, 22 nt, Human
cuucuucaguugcauguauugg

SEQ ID NO: 855521 - RNA, 22 nt, Human
gagagaaaugugcaguuugggc

SEQ ID NO: 855522 - RNA, 22 nt, Human
acugaggucucagguggggaag

SEQ ID NO: 855523 - RNA, 22 nt, Human
cucaguuucugacauuaaaauc

SEQ ID NO: 855524 - RNA, 22 nt, Human
cugacccauauaagaguggagg

SEQ ID NO: 855525 - RNA, 22 nt, Human
cagagcuggagggaacccuggc

SEQ ID NO: 855526 - RNA, 22 nt, Human
ugcaggaacugggagggauagu

SEQ ID NO: 855527 - RNA, 22 nt, Human
augcugagauaaggcuuuaguc

SEQ ID NO: 855528 - RNA, 22 nt, Human
aacaugcucuguuucuuggaug

SEQ ID NO: 855529 - RNA, 22 nt, Human
uggcagcuaucuuuaaugagau

SEQ ID NO: 855530 - RNA, 22 nt, Human
gcccaggagaggccagggcuga

SEQ ID NO: 855531 - RNA, 22 nt, Human
ucuccuccuuuuuucaacauag

SEQ ID NO: 855532 - RNA, 22 nt, Human
ugccacagagcaauucugcuga

SEQ ID NO: 855533 - RNA, 18 nt, Human
ucccucccugcuguggcc

SEQ ID NO: 855534 - RNA, 22 nt, Human
gguggaaggccuggaaggaggc

SEQ ID NO: 855535 - RNA, 22 nt, Human
cagaaggcuggcagauugagau

SEQ ID NO: 855536 - RNA, 22 nt, Human
cuguaguugaugauuucugaua

SEQ ID NO: 855537 - RNA, 19 nt, Human
uuucccagcccuugcugug

SEQ ID NO: 855538 - RNA, 22 nt, Human
aagcuggaacaucuugaggaag

SEQ ID NO: 855539 - RNA, 22 nt, Human
ccaggagacuguacugauauuu

SEQ ID NO: 855540 - RNA, 22 nt, Human
uggccaagaaugauaugugaag

SEQ ID NO: 855541 - RNA, 22 nt, Human
gagguagcaugcuggaagggac

SEQ ID NO: 855542 - RNA, 22 nt, Human
gauuucuucauuuguggugaau

SEQ ID NO: 855543 - RNA, 22 nt, Human
gagacagcacaggccacuggga

SEQ ID NO: 855544 - RNA, 22 nt, Human
cuucaugcugauauccucgaug

SEQ ID NO: 855545 - RNA, 22 nt, Human
uuugacauuauccuguuacugg

SEQ ID NO: 855546 - RNA, 22 nt, Human
auucuucaucacuaccuuguga

SEQ ID NO: 855547 - RNA, 22 nt, Human
gacccaggagugcagagagugg

SEQ ID NO: 855548 - RNA, 22 nt, Human
augcuuuuccaggagaaauaua

SEQ ID NO: 855549 - RNA, 22 nt, Human
ucccaggauguuuauggcuggu

SEQ ID NO: 855550 - RNA, 22 nt, Human
cugcccaggcugaaggaacauc

SEQ ID NO: 855551 - RNA, 22 nt, Human
gacauuuauuagaaaacuauca

SEQ ID NO: 855552 - RNA, 22 nt, Human
uggaggccgcguagucugagca

SEQ ID NO: 855553 - RNA, 22 nt, Human
aggcuuagaaauucagcugagu

SEQ ID NO: 855554 - RNA, 22 nt, Human
cagcaagaggguaagguugaag

SEQ ID NO: 855555 - RNA, 22 nt, Human
cccaggagauggagguugcagu

SEQ ID NO: 855556 - RNA, 22 nt, Human
gacccaggcucgugggacggcu

SEQ ID NO: 855557 - RNA, 22 nt, Human
aaguuacacauuuucauuguaa

SEQ ID NO: 855558 - RNA, 22 nt, Human
gagaggaguuacuauuuccgag

SEQ ID NO: 855559 - RNA, 22 nt, Human
ggcuguguuccaagugucagga

SEQ ID NO: 855560 - RNA, 22 nt, Human
aggagggaccuaggaauauugc

SEQ ID NO: 855561 - RNA, 22 nt, Human
aggcacaggccucagcacccag

SEQ ID NO: 855562 - RNA, 22 nt, Human
acacagaguauuuagaaggggu

SEQ ID NO: 855563 - RNA, 22 nt, Human
aaaacaguuuaggcaucacagu

SEQ ID NO: 855564 - RNA, 22 nt, Human
cugcugagaaaagacugaggga

SEQ ID NO: 855565 - RNA, 23 nt, Human
agggcugaugccauugcagcucu

SEQ ID NO: 855566 - RNA, 22 nt, Human
agcccaggucucaaaguacagg

SEQ ID NO: 855567 - RNA, 22 nt, Human
agucucuuccuucaaggcuggu

SEQ ID NO: 855568 - RNA, 22 nt, Human
guccacagcuggccagggccuc

SEQ ID NO: 855569 - RNA, 22 nt, Human
auggcagccugagcagaggaau

SEQ ID NO: 855570 - RNA, 22 nt, Human
accuuuuccagcuucuagaggc

SEQ ID NO: 855571 - RNA, 22 nt, Human
cugcaucaguggauaugauggu

SEQ ID NO: 855572 - RNA, 19 nt, Human
ggcagucucaagcagcaca

SEQ ID NO: 855573 - RNA, 22 nt, Human
gaggcagcaugguaccuuggag

SEQ ID NO: 855574 - RNA, 22 nt, Human
uucauugucucuguuugccuuc

SEQ ID NO: 855575 - RNA, 22 nt, Human
auugaaagcacaaagaacaagu

SEQ ID NO: 855576 - RNA, 22 nt, Human
aauauuguuucaagaucacaga

SEQ ID NO: 855577 - RNA, 22 nt, Human
guuuauuauucaacuucauguu

SEQ ID NO: 855578 - RNA, 22 nt, Human
uggucaaaagaaagcucagaac

SEQ ID NO: 855579 - RNA, 22 nt, Human
uuaaaaugaauauugauuagca

SEQ ID NO: 855580 - RNA, 21 nt, Human
aucacauuggcuguuauuauu

SEQ ID NO: 855581 - RNA, 22 nt, Human
ucauguuaucuuggcucuggga

SEQ ID NO: 855582 - RNA, 22 nt, Human
aaacugcugguugcuggccagc

SEQ ID NO: 855583 - RNA, 22 nt, Human
agaaaugacacacaugagacau

SEQ ID NO: 855584 - RNA, 19 nt, Human
gcccugaguaagcuaggag

SEQ ID NO: 855585 - RNA, 22 nt, Human
cccuuccuccucgccugucaga

SEQ ID NO: 855586 - RNA, 22 nt, Human
ugucugugaccucuuaggcaag

SEQ ID NO: 855587 - RNA, 22 nt, Human
uuuaucagagauauguguggac

SEQ ID NO: 855588 - RNA, 22 nt, Human
uaaucguauguguaucaaauca

SEQ ID NO: 855589 - RNA, 22 nt, Human
uuuaacagaugugaaauuuuca

SEQ ID NO: 855590 - RNA, 23 nt, Human
ugcuggcuguguuauugccaaca

SEQ ID NO: 855591 - RNA, 22 nt, Human
cagaacugggcagggagcagag

SEQ ID NO: 855592 - RNA, 22 nt, Human
acuccagguuuuuucacugaag

SEQ ID NO: 855593 - RNA, 22 nt, Human
ugguaauuaauuugauagguuc

SEQ ID NO: 855594 - RNA, 22 nt, Human
uuggccaauggugauucccggc

SEQ ID NO: 855595 - RNA, 22 nt, Human
cagcaagacaggauucccgugg

SEQ ID NO: 855596 - RNA, 22 nt, Human
ucccaggaucugagggcagaga

SEQ ID NO: 855597 - RNA, 22 nt, Human
uucuucuuuaucucaguauccu

SEQ ID NO: 855598 - RNA, 21 nt, Human
aauuacagauggaauuacaga

SEQ ID NO: 855599 - RNA, 22 nt, Human
ucucaggaaauaggauuugagu

SEQ ID NO: 855600 - RNA, 22 nt, Human
ggugaagggccuuaggagacag

SEQ ID NO: 855601 - RNA, 22 nt, Human
aggcuagacuuuggcgaagcac

SEQ ID NO: 855602 - RNA, 23 nt, Human
uuucaaauuacucugcagaugac

SEQ ID NO: 855603 - RNA, 22 nt, Human
uucugucacagugcugguauca

SEQ ID NO: 855604 - RNA, 18 nt, Human
ucuuggcagcaucuggca

SEQ ID NO: 855605 - RNA, 22 nt, Human
uuuuauuaguggcuagaugggg

SEQ ID NO: 855606 - RNA, 22 nt, Human
ccaaauuaaaucauacagacag

SEQ ID NO: 855607 - RNA, 22 nt, Human
uaguuacagaagauaaggguau

SEQ ID NO: 855608 - RNA, 22 nt, Human
gggcagcucggaagugggaaag

SEQ ID NO: 855609 - RNA, 17 nt, Human
ucaggcugugccuggua

SEQ ID NO: 855610 - RNA, 22 nt, Human
acccaggagcucugggguccuc

SEQ ID NO: 855611 - RNA, 22 nt, Human
cucaugauguagcgaaugagaa

SEQ ID NO: 855612 - RNA, 22 nt, Human
cauucauuuaugaaauaucuau

SEQ ID NO: 855613 - RNA, 22 nt, Human
uaaauuauguuccauguccuuu

SEQ ID NO: 855614 - RNA, 22 nt, Human
acaaauguggacauggauaaug

SEQ ID NO: 855615 - RNA, 22 nt, Human
uuccuuaguguuagauucugug

SEQ ID NO: 855616 - RNA, 22 nt, Human
augacaguucuacacuuaaucu

SEQ ID NO: 855617 - RNA, 22 nt, Human
acaucuagaagaucugggagau

SEQ ID NO: 855618 - RNA, 15 nt, Human
cccaggaguucgaga

SEQ ID NO: 855619 - RNA, 22 nt, Human
cuggagagaauguggaaugauu

SEQ ID NO: 855620 - RNA, 22 nt, Human
uucuguuacaagugaaaaaaug

SEQ ID NO: 855621 - RNA, 22 nt, Human
uggcagcuauggucuaagggcc

SEQ ID NO: 855622 - RNA, 22 nt, Human
uuccaugaaauguguuaugcuu

SEQ ID NO: 855623 - RNA, 22 nt, Human
ccaggcugcuuagccuuaucuu

SEQ ID NO: 855624 - RNA, 22 nt, Human
uuuguuuacucauucauugaug

SEQ ID NO: 855625 - RNA, 22 nt, Human
aggcagcugcccucuccuuccu

SEQ ID NO: 855626 - RNA, 22 nt, Human
cucagaagccuucagucuuggc

SEQ ID NO: 855627 - RNA, 22 nt, Human
caaauuaaugugucucaaaaua

SEQ ID NO: 855628 - RNA, 22 nt, Human
gggagacacgcugcaggcauaa

SEQ ID NO: 855629 - RNA, 22 nt, Human
uggcugaggcacagcugccgcc

SEQ ID NO: 855630 - RNA, 22 nt, Human
cccaggaggcagagauagcagu

SEQ ID NO: 855631 - RNA, 22 nt, Human
cccaggaguuggaggcuacggu

SEQ ID NO: 855632 - RNA, 19 nt, Human
ucugccucuggucaggcuc

SEQ ID NO: 855633 - RNA, 22 nt, Human
ucugagguccugugauuucucu

SEQ ID NO: 855634 - RNA, 22 nt, Human
cuuuggcaaugucauuuucaau

SEQ ID NO: 855635 - RNA, 18 nt, Human
acucaggaaaugaugaca

SEQ ID NO: 855636 - RNA, 22 nt, Human
aacuaguuuuagcucuagcaac

SEQ ID NO: 855637 - RNA, 23 nt, Human
uggcuaaaggcucuaguccugcu

SEQ ID NO: 855638 - RNA, 17 nt, Human
ugaggccugcaucagug

SEQ ID NO: 855639 - RNA, 22 nt, Human
agagccagcauuugggcccugc

SEQ ID NO: 855640 - RNA, 22 nt, Human
uggcagcacaagguggcccaug

SEQ ID NO: 855641 - RNA, 22 nt, Human
auuaauaaaauaccacuuuguu

SEQ ID NO: 855642 - RNA, 22 nt, Human
uugcacuaggaaaaggcagcca

SEQ ID NO: 855643 - RNA, 22 nt, Human
gcccaggauucuuucuuccuua

SEQ ID NO: 855644 - RNA, 22 nt, Human
augaaauugaucuugaacuuuu

SEQ ID NO: 855645 - RNA, 22 nt, Human
gcucucuugguggcuguccugg

SEQ ID NO: 855646 - RNA, 22 nt, Human
ugucagcucccagucagagaga

SEQ ID NO: 855647 - RNA, 17 nt, Human
aggcagcucagaacauc

SEQ ID NO: 855648 - RNA, 22 nt, Human
ccuguuuacaucaucaaggacu

SEQ ID NO: 855649 - RNA, 22 nt, Human
ucucacuuuccagacuuuucaa

SEQ ID NO: 855650 - RNA, 22 nt, Human
agugcaggagccuggccagagc

SEQ ID NO: 855651 - RNA, 22 nt, Human
gcugagguggaggaaggagacc

SEQ ID NO: 855652 - RNA, 22 nt, Human
ucugccugccagucugguccuc

SEQ ID NO: 855653 - RNA, 22 nt, Human
agccacagagagggagcugcaa

SEQ ID NO: 855654 - RNA, 22 nt, Human
cucugccauuuaucagaacugu

SEQ ID NO: 855655 - RNA, 19 nt, Human
gcuccugggccucacucau

SEQ ID NO: 855656 - RNA, 22 nt, Human
ccuggcugugugaccuuggcaa

SEQ ID NO: 855657 - RNA, 22 nt, Human
ugaggggagguuggggcacauc

SEQ ID NO: 855658 - RNA, 22 nt, Human
aagcaguuuagauaggcaaagg

SEQ ID NO: 855659 - RNA, 22 nt, Human
augaguucaauuguuucaguca

SEQ ID NO: 855660 - RNA, 22 nt, Human
uuucaacaccagagaccaugcg

SEQ ID NO: 855661 - RNA, 22 nt, Human
ugauugaacugagcuucaagau

SEQ ID NO: 855662 - RNA, 22 nt, Human
cauucuuacacaauauuuuaau

SEQ ID NO: 855663 - RNA, 19 nt, Human
acaaugaauguguucucuu

SEQ ID NO: 855664 - RNA, 22 nt, Human
auuuggcauaggcagaggccca

SEQ ID NO: 855665 - RNA, 17 nt, Human
aggcaggcagagcggga

SEQ ID NO: 855666 - RNA, 21 nt, Human
ugaggcaggggugcuuuuguc

SEQ ID NO: 855667 - RNA, 22 nt, Human
ucuagaaugacaugcaagagua

SEQ ID NO: 855668 - RNA, 22 nt, Human
ccuggcuggacuggaccguggc

SEQ ID NO: 855669 - RNA, 22 nt, Human
acugaggucuaucaugagccag

SEQ ID NO: 855670 - RNA, 22 nt, Human
uuucacagcuggguggcagagu

SEQ ID NO: 855671 - RNA, 22 nt, Human
ucaggcugcagcugucagcagc

SEQ ID NO: 855672 - RNA, 22 nt, Human
gaagcagcuggugagauggagc

SEQ ID NO: 855673 - RNA, 22 nt, Human
auauuaggaguuaaauguauua

SEQ ID NO: 855674 - RNA, 22 nt, Human
ggucugaaaauggugaccacca

SEQ ID NO: 855675 - RNA, 21 nt, Human
uacugagaccucacagugugc

SEQ ID NO: 855676 - RNA, 22 nt, Human
gcgcaggagccgcggagggccg

SEQ ID NO: 855677 - RNA, 22 nt, Human
gucugcugcagucguggcucua

SEQ ID NO: 855678 - RNA, 17 nt, Human
uucaaagcuuaucaagg

SEQ ID NO: 855679 - RNA, 22 nt, Human
ggccagaggugguacauagcuu

SEQ ID NO: 855680 - RNA, 22 nt, Human
cuggccaagcuucucuaagcag

SEQ ID NO: 855681 - RNA, 23 nt, Human
cagaaaacccagagcucaguccc

SEQ ID NO: 855682 - RNA, 22 nt, Human
uugcuucaguagcucuuuaaag

SEQ ID NO: 855683 - RNA, 22 nt, Human
cauuguuaccaucuuuuaccua

SEQ ID NO: 855684 - RNA, 22 nt, Human
ugaguaauaaacugucuugcuc

SEQ ID NO: 855685 - RNA, 22 nt, Human
cuccuggcccugagcucccagg

SEQ ID NO: 855686 - RNA, 22 nt, Human
cagugguuauacuuacuguuuc

SEQ ID NO: 855687 - RNA, 22 nt, Human
uccaugagcuagcuuuccaaag

SEQ ID NO: 855688 - RNA, 20 nt, Human
accaggagauggaggcaggg

SEQ ID NO: 855689 - RNA, 22 nt, Human
gcucaggagcucuugguggcgc

SEQ ID NO: 855690 - RNA, 22 nt, Human
agacaggccacucuggucuggu

SEQ ID NO: 855691 - RNA, 22 nt, Human
ucaggaugaccacgagccucua

SEQ ID NO: 855692 - RNA, 22 nt, Human
auuucaaggcuauuaauauaaa

SEQ ID NO: 855693 - RNA, 22 nt, Human
ccaggcugccgaggaaagaaag

SEQ ID NO: 855694 - RNA, 22 nt, Human
cagaggaugaucuggccucucu

SEQ ID NO: 855695 - RNA, 21 nt, Human
auuucagagcacacaaguaaa

SEQ ID NO: 855696 - RNA, 22 nt, Human
agggagcucuaaguagagggac

SEQ ID NO: 855697 - RNA, 22 nt, Human
gaucuuggggggaucaccaugg

SEQ ID NO: 855698 - RNA, 22 nt, Human
accauuuuggguauuuucagag

SEQ ID NO: 855699 - RNA, 22 nt, Human
ugcacauucacuuagguauugu

SEQ ID NO: 855700 - RNA, 22 nt, Human
ggguggaguagaaagaugaauu

SEQ ID NO: 855701 - RNA, 19 nt, Human
auggaaaauuguacucaau

SEQ ID NO: 855702 - RNA, 22 nt, Human
uauguuauuuucauacaacaga

SEQ ID NO: 855703 - RNA, 18 nt, Human
ucaggagacacagacgca

SEQ ID NO: 855704 - RNA, 22 nt, Human
auuacaaaagaagggagaaggu

SEQ ID NO: 855705 - RNA, 23 nt, Human
ggcagcucucaucugaugacuga

SEQ ID NO: 855706 - RNA, 22 nt, Human
uaucuguuugcucacagguguu

SEQ ID NO: 855707 - RNA, 22 nt, Human
ggaggugggcuaaggacucucu

SEQ ID NO: 855708 - RNA, 22 nt, Human
cagaccagaaggaagccgacaa

SEQ ID NO: 855709 - RNA, 22 nt, Human
acuggccaggcgaaccacacug

SEQ ID NO: 855710 - RNA, 22 nt, Human
agcugcuucaaaaugggcuccu

SEQ ID NO: 855711 - RNA, 19 nt, Human
ugcugaggaugcaagaucc

SEQ ID NO: 855712 - RNA, 22 nt, Human
aaaaacugcaauuacuuuuguc

SEQ ID NO: 855713 - RNA, 22 nt, Human
aggguagggccguagggccaug

SEQ ID NO: 855714 - RNA, 22 nt, Human
gcugaagcugacacauagugcu

SEQ ID NO: 855715 - RNA, 22 nt, Human
uaauaggagccaggucacauag

SEQ ID NO: 855716 - RNA, 22 nt, Human
uuugaaagagcugauacaugaa

SEQ ID NO: 855717 - RNA, 22 nt, Human
agaacuguccuuggaggagagu

SEQ ID NO: 855718 - RNA, 22 nt, Human
cccaagagguggagguugcagu

SEQ ID NO: 855719 - RNA, 22 nt, Human
ucugagccaccugccagugcug

SEQ ID NO: 855720 - RNA, 22 nt, Human
acacauuuacauguuuacguau

SEQ ID NO: 855721 - RNA, 22 nt, Human
guuuauuaacugucaagugauu

SEQ ID NO: 855722 - RNA, 22 nt, Human
gcucaggaucagccaccucuuu

SEQ ID NO: 855723 - RNA, 22 nt, Human
uuuaucagaaguuagagaaaga

SEQ ID NO: 855724 - RNA, 22 nt, Human
augaggucuuauugcaguaguu

SEQ ID NO: 855725 - RNA, 22 nt, Human
agacgagggccuggcacacagu

SEQ ID NO: 855726 - RNA, 22 nt, Human
ggaggggauuuaguagaugcua

SEQ ID NO: 855727 - RNA, 22 nt, Human
cagaggcaggauaagaacugcg

SEQ ID NO: 855728 - RNA, 22 nt, Human
ugacagaaauaguucuuaauuu

SEQ ID NO: 855729 - RNA, 18 nt, Human
aggcaggcuggagugacu

SEQ ID NO: 855730 - RNA, 22 nt, Human
ugcaggaaauuccaggguggcc

SEQ ID NO: 855731 - RNA, 22 nt, Human
accagagcuuacaugcuagaaa

SEQ ID NO: 855732 - RNA, 22 nt, Human
aacucuggagcacgcccuggcc

SEQ ID NO: 855733 - RNA, 22 nt, Human
uguggaaaagaauaagggagau

SEQ ID NO: 855734 - RNA, 22 nt, Human
guucuucaggcugugcucuaga

SEQ ID NO: 855735 - RNA, 22 nt, Human
auuuaaaugcuuaagaggguuu

SEQ ID NO: 855736 - RNA, 22 nt, Human
gccuggcuggucacugccuggc

SEQ ID NO: 855737 - RNA, 22 nt, Human
ugcugaggcuagaccuggaagu

SEQ ID NO: 855738 - RNA, 22 nt, Human
agaggcagaaguguucaaaccc

SEQ ID NO: 855739 - RNA, 22 nt, Human
acucaggaauggggcugggacu

SEQ ID NO: 855740 - RNA, 22 nt, Human
aguguaggguggucagagcaga

SEQ ID NO: 855741 - RNA, 22 nt, Human
aucuuguuauaagagauaaugg

SEQ ID NO: 855742 - RNA, 22 nt, Human
uaacaugaaacuccaaauggua

SEQ ID NO: 855743 - RNA, 22 nt, Human
uugaaaggugaacaugaugcac

SEQ ID NO: 855744 - RNA, 22 nt, Human
uugaacauuggcaauuucauau

SEQ ID NO: 855745 - RNA, 22 nt, Human
ggaggagguggguuaaguugua

SEQ ID NO: 855746 - RNA, 22 nt, Human
gacuuucuaaugcucuguagau

SEQ ID NO: 855747 - RNA, 22 nt, Human
gggagggguugcauguuugagu

SEQ ID NO: 855748 - RNA, 22 nt, Human
gagggaggcaucaugaauccag

SEQ ID NO: 855749 - RNA, 22 nt, Human
ggcuaggcaggcucagagccua

SEQ ID NO: 855750 - RNA, 22 nt, Human
aagauauucaaagauuuauuag

SEQ ID NO: 855751 - RNA, 22 nt, Human
aggcagcuuucuggugcaccau

SEQ ID NO: 855752 - RNA, 22 nt, Human
gagccaggggucagcuccgagg

SEQ ID NO: 855753 - RNA, 22 nt, Human
acaguaacaaauggccugagga

SEQ ID NO: 855754 - RNA, 22 nt, Human
uccaggagucagacagauggug

SEQ ID NO: 855755 - RNA, 22 nt, Human
augcugugcuggcuaaccaugg

SEQ ID NO: 855756 - RNA, 22 nt, Human
ugcaggcuggggaggcagacuu

SEQ ID NO: 855757 - RNA, 22 nt, Human
uguucucacuggaugcuucaca

SEQ ID NO: 855758 - RNA, 23 nt, Human
cugagggcuggucugaagucugc

SEQ ID NO: 855759 - RNA, 22 nt, Human
uaguaaucagagguaaacuuua

SEQ ID NO: 855760 - RNA, 22 nt, Human
cccucuacagggaagcgcuuuc

SEQ ID NO: 855761 - RNA, 22 nt, Human
uguaggccuauguccagcaauu

SEQ ID NO: 855762 - RNA, 22 nt, Human
uuucucaguuacuagcuguggu

SEQ ID NO: 855763 - RNA, 23 nt, Human
cccuggaguaaauucuuggaagg

SEQ ID NO: 855764 - RNA, 22 nt, Human
augcccugcucucgggaaggga

SEQ ID NO: 855765 - RNA, 22 nt, Human
uuucacauuuaggcgugaauug

SEQ ID NO: 855766 - RNA, 22 nt, Human
uaggcagcuuagguuagaagug

SEQ ID NO: 855767 - RNA, 22 nt, Human
aggcugaggcgggaggaucacu

SEQ ID NO: 855768 - RNA, 22 nt, Human
auuggaaaugcuacaaguuaga

SEQ ID NO: 855769 - RNA, 21 nt, Human
aagaaguuuggauuuuguccu

SEQ ID NO: 855770 - RNA, 22 nt, Human
gggcagcucagccaccaugcag

SEQ ID NO: 855771 - RNA, 22 nt, Human
ucuuagaaguucauguuccagc

SEQ ID NO: 855772 - RNA, 22 nt, Human
ucugccuggcucauggcaguga

SEQ ID NO: 855773 - RNA, 22 nt, Human
aaguuaacccaguauuucuuuu

SEQ ID NO: 855774 - RNA, 22 nt, Human
ccacugaggcaggcaguaucua

SEQ ID NO: 855775 - RNA, 22 nt, Human
cagagcugucauuugccaguga

SEQ ID NO: 855776 - RNA, 22 nt, Human
cuaggcagauggagaaguggcu

SEQ ID NO: 855777 - RNA, 22 nt, Human
ggagggcugccagguggagcgg

SEQ ID NO: 855778 - RNA, 22 nt, Human
agccagcuguucuggggcagca

SEQ ID NO: 855779 - RNA, 22 nt, Human
auggccaagcaugccuguggcc

SEQ ID NO: 855780 - RNA, 22 nt, Human
auacaguauaacuaauaaaccc

SEQ ID NO: 855781 - RNA, 22 nt, Human
uugaaguuguaguucagugaag

SEQ ID NO: 855782 - RNA, 22 nt, Human
cagcucugaggaacacuccuuu

SEQ ID NO: 855783 - RNA, 22 nt, Human
auucuucauacagacaaguccu

SEQ ID NO: 855784 - RNA, 22 nt, Human
aaagauuaaaucaaauugguca

SEQ ID NO: 855785 - RNA, 20 nt, Human
aggcugagggugauuguguc

SEQ ID NO: 855786 - RNA, 22 nt, Human
acaucucaugaaugauaaauca

SEQ ID NO: 855787 - RNA, 22 nt, Human
ugaaggccacuuccugugagcu

SEQ ID NO: 855788 - RNA, 18 nt, Human
ugaggcccgcagaggugg

SEQ ID NO: 855789 - RNA, 22 nt, Human
cucaggauuuaaaggggcacuc

SEQ ID NO: 855790 - RNA, 22 nt, Human
uugcagcuucuaccacuguuuc

SEQ ID NO: 855791 - RNA, 22 nt, Human
aggcagguccccuggaaggcac

SEQ ID NO: 855792 - RNA, 22 nt, Human
uguuaagaagaggcaguacuua

SEQ ID NO: 855793 - RNA, 21 nt, Human
uggagacucugguucuuugug

SEQ ID NO: 855794 - RNA, 22 nt, Human
uugaggucuuugagcaaacgca

SEQ ID NO: 855795 - RNA, 22 nt, Human
uucuucuuucccccugugguac

SEQ ID NO: 855796 - RNA, 21 nt, Human
acuggccaccacuggcagggg

SEQ ID NO: 855797 - RNA, 22 nt, Human
ccugguccuuacgucauugcuu

SEQ ID NO: 855798 - RNA, 22 nt, Human
cugccugccacguucagcugua

SEQ ID NO: 855799 - RNA, 21 nt, Human
uucuucaaagaagaaggcaca

SEQ ID NO: 855800 - RNA, 22 nt, Human
ucaggauaaaauguaauggcaa

SEQ ID NO: 855801 - RNA, 21 nt, Human
uuccagagauuguuucaccug

SEQ ID NO: 855802 - RNA, 19 nt, Human
agaaguuagacauugcaau

SEQ ID NO: 855803 - RNA, 22 nt, Human
agauggcuuugcuuuuagaagc

SEQ ID NO: 855804 - RNA, 22 nt, Human
cugccugcaucccacagugggg

SEQ ID NO: 855805 - RNA, 20 nt, Human
ggcagcuugggcagcaguua

SEQ ID NO: 855806 - RNA, 22 nt, Human
cacugguauuugaaaauagaug

SEQ ID NO: 855807 - RNA, 22 nt, Human
uugagguccccaguacccacug

SEQ ID NO: 855808 - RNA, 22 nt, Human
caggcugacaacugagcauuuu

SEQ ID NO: 855809 - RNA, 21 nt, Human
uaggcagaggagcagguaucu

SEQ ID NO: 855810 - RNA, 22 nt, Human
uucaggauaguggugaguggca

SEQ ID NO: 855811 - RNA, 22 nt, Human
gugcugagcacagcugcccagg

SEQ ID NO: 855812 - RNA, 22 nt, Human
gagagucuaggaaccucauaua

SEQ ID NO: 855813 - RNA, 23 nt, Human
guaaaauacgcagugcaguguga

SEQ ID NO: 855814 - RNA, 22 nt, Human
ucacacagauugguagagcuga

SEQ ID NO: 855815 - RNA, 22 nt, Human
ucaaauaaugccauucaucauc

SEQ ID NO: 855816 - RNA, 22 nt, Human
agcugcagcacuccaguagccg

SEQ ID NO: 855817 - RNA, 22 nt, Human
caggauggucagaugcauuguc

SEQ ID NO: 855818 - RNA, 21 nt, Human
uuagaaagcucacuacaguua

SEQ ID NO: 855819 - RNA, 22 nt, Human
acucucugguauuggcaaguuu

SEQ ID NO: 855820 - RNA, 22 nt, Human
cagggaggcugucuuaugccug

SEQ ID NO: 855821 - RNA, 19 nt, Human
uccaccuuucuucauuugg

SEQ ID NO: 855822 - RNA, 22 nt, Human
gaggagcugggucagggagaca

SEQ ID NO: 855823 - RNA, 22 nt, Human
ggggcagccuccaggaaagcug

SEQ ID NO: 855824 - RNA, 22 nt, Human
agcugagggcaggaugggguga

SEQ ID NO: 855825 - RNA, 22 nt, Human
ucaauucugguccucaggaacu

SEQ ID NO: 855826 - RNA, 22 nt, Human
ucuacccagagcuaugaccuga

SEQ ID NO: 855827 - RNA, 22 nt, Human
ucccagggcuuuucucaugcuu

SEQ ID NO: 855828 - RNA, 22 nt, Human
ggcagcuauuccaagcagcacu

SEQ ID NO: 855829 - RNA, 18 nt, Human
ucaggcugggccuccuuc

SEQ ID NO: 855830 - RNA, 22 nt, Human
caugugguucaaguacuccaca

SEQ ID NO: 855831 - RNA, 22 nt, Human
auauuaggugcucaauacaugc

SEQ ID NO: 855832 - RNA, 22 nt, Human
uucuucucagggucccacaugg

SEQ ID NO: 855833 - RNA, 22 nt, Human
ucccaggauguuggcggcaggu

SEQ ID NO: 855834 - RNA, 18 nt, Human
ugaauagggguuugcaga

SEQ ID NO: 855835 - RNA, 22 nt, Human
cauuuccagcuccugcaucaug

SEQ ID NO: 855836 - RNA, 22 nt, Human
auggagggugucagagagcgaa

SEQ ID NO: 855837 - RNA, 22 nt, Human
agaccaagacuauaaugagagg

SEQ ID NO: 855838 - RNA, 22 nt, Human
cagagacauccauguuaguugg

SEQ ID NO: 855839 - RNA, 22 nt, Human
ccuggaccaaacacuggccugg

SEQ ID NO: 855840 - RNA, 22 nt, Human
ucaggagagagaaauuggggcu

SEQ ID NO: 855841 - RNA, 22 nt, Human
uaggaaauugccaauauaugac

SEQ ID NO: 855842 - RNA, 20 nt, Human
uacagaaugcaauaaaaugg

SEQ ID NO: 855843 - RNA, 22 nt, Human
gcugcccauuccacuggauggu

SEQ ID NO: 855844 - RNA, 22 nt, Human
ggcugagcuuauauaugugcug

SEQ ID NO: 855845 - RNA, 22 nt, Human
gaggcuccagcgacaccuaggc

SEQ ID NO: 855846 - RNA, 22 nt, Human
ccuccugguccagcaucucuuu

SEQ ID NO: 855847 - RNA, 17 nt, Human
aacugcuuuuuuuagcc

SEQ ID NO: 855848 - RNA, 22 nt, Human
uggcuggaauggagcugagccu

SEQ ID NO: 855849 - RNA, 22 nt, Human
aucaggaucagggcuagcagag

SEQ ID NO: 855850 - RNA, 22 nt, Human
acccuccccaagaggucgugcc

SEQ ID NO: 855851 - RNA, 22 nt, Human
cucccagggucuaggcugcugg

SEQ ID NO: 855852 - RNA, 19 nt, Human
ugaaauggcaguugcuaaa

SEQ ID NO: 855853 - RNA, 19 nt, Human
caggagagcaugcacuuug

SEQ ID NO: 855854 - RNA, 22 nt, Human
agacagugauguaagcaggagu

SEQ ID NO: 855855 - RNA, 22 nt, Human
cuuuaaauaauacaagguccag

SEQ ID NO: 855856 - RNA, 23 nt, Human
accaggagccaagaucucccugg

SEQ ID NO: 855857 - RNA, 22 nt, Human
agagcugagcaccaagcauggu

SEQ ID NO: 855858 - RNA, 23 nt, Human
uuuggacuugugacucuucuccu

SEQ ID NO: 855859 - RNA, 22 nt, Human
gugauuuucuccuccuagaagu

SEQ ID NO: 855860 - RNA, 22 nt, Human
gcccaggauaaugcugucccug

SEQ ID NO: 855861 - RNA, 22 nt, Human
cugcugugauugggagaaaccg

SEQ ID NO: 855862 - RNA, 22 nt, Human
gaggagaagcuaagaaacacag

SEQ ID NO: 855863 - RNA, 22 nt, Human
aguaacucauguaaaccucaca

SEQ ID NO: 855864 - RNA, 23 nt, Human
acagacaacacugaugagagaaa

SEQ ID NO: 855865 - RNA, 22 nt, Human
ugugccagccucuggcuguguc

SEQ ID NO: 855866 - RNA, 22 nt, Human
guucuugccagcauccucaggu

SEQ ID NO: 855867 - RNA, 22 nt, Human
acagugagauccaagggcaggc

SEQ ID NO: 855868 - RNA, 22 nt, Human
accuacauguuccacauaguug

SEQ ID NO: 855869 - RNA, 17 nt, Human
cagcucugcaucuuccu

SEQ ID NO: 855870 - RNA, 22 nt, Human
agggcagcagcggcccaggccu

SEQ ID NO: 855871 - RNA, 22 nt, Human
cuucugugcuucacaguugcca

SEQ ID NO: 855872 - RNA, 22 nt, Human
gugguaauuuaauccuacacug

SEQ ID NO: 855873 - RNA, 22 nt, Human
gaaggccacggaauggagcugg

SEQ ID NO: 855874 - RNA, 22 nt, Human
gagcuccagggaacagcagcua

SEQ ID NO: 855875 - RNA, 22 nt, Human
aggcuccagcagccagaggaag

SEQ ID NO: 855876 - RNA, 22 nt, Human
caugcugugcaucuugaugacc

SEQ ID NO: 855877 - RNA, 23 nt, Human
aaggccagaauuucaauggugcc

SEQ ID NO: 855878 - RNA, 22 nt, Human
cugagcuguuacucuguccucg

SEQ ID NO: 855879 - RNA, 21 nt, Human
uguaaguuucaucugaauugg

SEQ ID NO: 855880 - RNA, 22 nt, Human
ucaggcugggcuccucucccca

SEQ ID NO: 855881 - RNA, 20 nt, Human
ggcugcugugggcagagagg

SEQ ID NO: 855882 - RNA, 20 nt, Human
uucagaaauaaggaaugagg

SEQ ID NO: 855883 - RNA, 22 nt, Human
gcuuuggagccuguguucugcc

SEQ ID NO: 855884 - RNA, 22 nt, Human
cccaggaagaaauucugauuug

SEQ ID NO: 855885 - RNA, 22 nt, Human
uuggccaaauacacaccuuuug

SEQ ID NO: 855886 - RNA, 22 nt, Human
uauuggauagcuugugcagaau

SEQ ID NO: 855887 - RNA, 22 nt, Human
ucugggaacagccuggcugugu

SEQ ID NO: 855888 - RNA, 22 nt, Human
ucuuggcugucuuugaaguuag

SEQ ID NO: 855889 - RNA, 19 nt, Human
ugaggccaaggucacagau

SEQ ID NO: 855890 - RNA, 21 nt, Human
gaaauacugccuuaggagcug

SEQ ID NO: 855891 - RNA, 22 nt, Human
aagaguaaagcaaagcacuugu

SEQ ID NO: 855892 - RNA, 22 nt, Human
caggcagcgcucguggccuggc

SEQ ID NO: 855893 - RNA, 22 nt, Human
uguuuauuacaguucuuggaau

SEQ ID NO: 855894 - RNA, 19 nt, Human
ccauggagagagaugcauu

SEQ ID NO: 855895 - RNA, 22 nt, Human
ugcaggucuccauuggcagacu

SEQ ID NO: 855896 - RNA, 22 nt, Human
ugaggcagggagaguggauaug

SEQ ID NO: 855897 - RNA, 22 nt, Human
aagggcuguaguuuguugauca

SEQ ID NO: 855898 - RNA, 22 nt, Human
gaggggaagacuucuggacagu

SEQ ID NO: 855899 - RNA, 22 nt, Human
uugagggucuggaucugcugcu

SEQ ID NO: 855900 - RNA, 22 nt, Human
agggacuauuuacccaucucac

SEQ ID NO: 855901 - RNA, 22 nt, Human
gagcagcucugugccuggagac

SEQ ID NO: 855902 - RNA, 22 nt, Human
ugaggcagugauguuuaagcac

SEQ ID NO: 855903 - RNA, 22 nt, Human
aagugggaauagaaaugaaggu

SEQ ID NO: 855904 - RNA, 22 nt, Human
acacuaaugagaaaggaauuaa

SEQ ID NO: 855905 - RNA, 22 nt, Human
aggcaggcacacuuccuccagg

SEQ ID NO: 855906 - RNA, 22 nt, Human
gaggcugaggguuagagaguca

SEQ ID NO: 855907 - RNA, 22 nt, Human
uuagagaugucccaaaaugaag

SEQ ID NO: 855908 - RNA, 15 nt, Human
uucaggauaugacuc

SEQ ID NO: 855909 - RNA, 22 nt, Human
uuaggaaaauggaguccuuuua

SEQ ID NO: 855910 - RNA, 22 nt, Human
ucaaauaccagcaauuucaugu

SEQ ID NO: 855911 - RNA, 22 nt, Human
auugugcaaauauuaucuguag

SEQ ID NO: 855912 - RNA, 22 nt, Human
gacuuucugagucaaagaaagg

SEQ ID NO: 855913 - RNA, 22 nt, Human
cuggccuagcucucugcuugaa

SEQ ID NO: 855914 - RNA, 23 nt, Human
ugcaugugaauucauacuuguuu

SEQ ID NO: 855915 - RNA, 22 nt, Human
aggcagucuaucucuggagccu

SEQ ID NO: 855916 - RNA, 22 nt, Human
cucaggauagauuguccucuca

SEQ ID NO: 855917 - RNA, 22 nt, Human
cugagccaguagucagggacaa

SEQ ID NO: 855918 - RNA, 22 nt, Human
ggcuggaggagaauggguguga

SEQ ID NO: 855919 - RNA, 19 nt, Human
uuggcagcugagauccugc

SEQ ID NO: 855920 - RNA, 22 nt, Human
ucccagggauccuccgggucgc

SEQ ID NO: 855921 - RNA, 22 nt, Human
aauaucagcacuuuugugguau

SEQ ID NO: 855922 - RNA, 22 nt, Human
uuuauuaaaacuguuggcucug

SEQ ID NO: 855923 - RNA, 22 nt, Human
ugcugcugaucauuuauagucu

SEQ ID NO: 855924 - RNA, 22 nt, Human
gcugccucccccauggcuggaa

SEQ ID NO: 855925 - RNA, 22 nt, Human
uagugucaucguugcagcugag

SEQ ID NO: 855926 - RNA, 22 nt, Human
uuagauaaauuaagacuuuaca

SEQ ID NO: 855927 - RNA, 20 nt, Human
gcugagguggaggaaggaga

SEQ ID NO: 855928 - RNA, 22 nt, Human
uuggccaacagcgacagggcca

SEQ ID NO: 855929 - RNA, 22 nt, Human
gaggcagcuggguccggucggg

SEQ ID NO: 855930 - RNA, 22 nt, Human
ugcccaaaccucuccuagcucu

SEQ ID NO: 855931 - RNA, 22 nt, Human
gggcugagucugcugccuguca

SEQ ID NO: 855932 - RNA, 22 nt, Human
agcugagguugaagagugaacg

SEQ ID NO: 855933 - RNA, 22 nt, Human
cugcuuccauaaauaaugugcu

SEQ ID NO: 855934 - RNA, 22 nt, Human
acaaugaagauaauguugcagu

SEQ ID NO: 855935 - RNA, 22 nt, Human
uuuauuuggcaucucugccaag

SEQ ID NO: 855936 - RNA, 22 nt, Human
uccaggagugcugguuagagua

SEQ ID NO: 855937 - RNA, 22 nt, Human
gaaggccacuuuguguugagaa

SEQ ID NO: 855938 - RNA, 22 nt, Human
caggggaguuuuaugcaacaga

SEQ ID NO: 855939 - RNA, 22 nt, Human
aggcuccagcccaaggcugcag

SEQ ID NO: 855940 - RNA, 22 nt, Human
ggccagagaauaugccuuacgu

SEQ ID NO: 855941 - RNA, 20 nt, Human
agcugaggcaccugagguua

SEQ ID NO: 855942 - RNA, 22 nt, Human
ucuucagaggaagucagucuuu

SEQ ID NO: 855943 - RNA, 22 nt, Human
ggcucagacucccaggcccucu

SEQ ID NO: 855944 - RNA, 22 nt, Human
uuucaaacauaucuucauuacu

SEQ ID NO: 855945 - RNA, 22 nt, Human
aagggagguaaagcuauuuaaa

SEQ ID NO: 855946 - RNA, 23 nt, Human
gacaccuuugccagaucaagaug

SEQ ID NO: 855947 - RNA, 22 nt, Human
gagggcuggggcuuaggcuuag

SEQ ID NO: 855948 - RNA, 22 nt, Human
cugcagagcaaguaacauccuc

SEQ ID NO: 855949 - RNA, 22 nt, Human
aaccuuuugcaagugccuugac

SEQ ID NO: 855950 - RNA, 22 nt, Human
aacuuucuguuacguccccaga

SEQ ID NO: 855951 - RNA, 22 nt, Human
caaaugaaguccaaagggcuua

SEQ ID NO: 855952 - RNA, 22 nt, Human
aguuucuuuagauagaaaguuc

SEQ ID NO: 855953 - RNA, 22 nt, Human
uucauucuugggaucagagagu

SEQ ID NO: 855954 - RNA, 22 nt, Human
uccaggagguagugcuuaauuu

SEQ ID NO: 855955 - RNA, 22 nt, Human
gagcugagauuugaagcaaguu

SEQ ID NO: 855956 - RNA, 22 nt, Human
ucccagagcccaaguuggagag

SEQ ID NO: 855957 - RNA, 17 nt, Human
ccaggagagaugcuugu

SEQ ID NO: 855958 - RNA, 22 nt, Human
uccaggagggggagccgugccg

SEQ ID NO: 855959 - RNA, 22 nt, Human
ugcugcuguauccuuaguguca

SEQ ID NO: 855960 - RNA, 22 nt, Human
gucuucaauagagccucaauuu

SEQ ID NO: 855961 - RNA, 22 nt, Human
uacacuauuuuacugauacaaa

SEQ ID NO: 855962 - RNA, 22 nt, Human
ccugugccagcugggcccugcc

SEQ ID NO: 855963 - RNA, 22 nt, Human
gcugauggcuugcuggcugaca

SEQ ID NO: 855964 - RNA, 22 nt, Human
ggcugcagguugguuggcagcu

SEQ ID NO: 855965 - RNA, 22 nt, Human
acagugcuaaacacuucuugaa

SEQ ID NO: 855966 - RNA, 22 nt, Human
ucuacugugguccuuguaacca

SEQ ID NO: 855967 - RNA, 21 nt, Human
ucugccugagacuuugcuggu

SEQ ID NO: 855968 - RNA, 22 nt, Human
acaauucugaugguuucccagu

SEQ ID NO: 855969 - RNA, 22 nt, Human
cagugguugguagauacuugag

SEQ ID NO: 855970 - RNA, 22 nt, Human
cugagcucuaaugucagccuug

SEQ ID NO: 855971 - RNA, 17 nt, Human
cucacggaggaugaauc

SEQ ID NO: 855972 - RNA, 22 nt, Human
uucagaaugugaccuuauuugg

SEQ ID NO: 855973 - RNA, 22 nt, Human
cugcccaggaaggagaggaugg

SEQ ID NO: 855974 - RNA, 22 nt, Human
agucucugcaugccugcugugc

SEQ ID NO: 855975 - RNA, 22 nt, Human
uggcugaguuccuggcacacgg

SEQ ID NO: 855976 - RNA, 22 nt, Human
uuuaguagugacagauucuggg

SEQ ID NO: 855977 - RNA, 22 nt, Human
ucugcaggcuuggaguggcagc

SEQ ID NO: 855978 - RNA, 22 nt, Human
ucaggcuguuccuguccaaaau

SEQ ID NO: 855979 - RNA, 22 nt, Human
ucaucugucauccacaaagcug

SEQ ID NO: 855980 - RNA, 22 nt, Human
uugcauuuaaguagauguuaca

SEQ ID NO: 855981 - RNA, 22 nt, Human
aggcugagcugguagugaguac

SEQ ID NO: 855982 - RNA, 22 nt, Human
aggccaaaccggauggaaaagg

SEQ ID NO: 855983 - RNA, 22 nt, Human
gccauuuucugucuuguuuauu

SEQ ID NO: 855984 - RNA, 22 nt, Human
ccauuaguaccucuggaaaauu

SEQ ID NO: 855985 - RNA, 22 nt, Human
gcccugggcucccugcuccaca

SEQ ID NO: 855986 - RNA, 17 nt, Human
agaggcagauacuugga

SEQ ID NO: 855987 - RNA, 22 nt, Human
gccacaggcacuuaagggcugg

SEQ ID NO: 855988 - RNA, 22 nt, Human
gcuguguuugacaguagcagac

SEQ ID NO: 855989 - RNA, 22 nt, Human
ugccuguguugauuacuuuguc

SEQ ID NO: 855990 - RNA, 22 nt, Human
uacucagagucauugcccuucu

SEQ ID NO: 855991 - RNA, 22 nt, Human
acaugcauaggagaagucuuua

SEQ ID NO: 855992 - RNA, 19 nt, Human
cugggccagagcuguccuc

SEQ ID NO: 855993 - RNA, 22 nt, Human
gaggagagaagcuaacggugcu

SEQ ID NO: 855994 - RNA, 22 nt, Human
ucuggccaacaaaaacuaaguc

SEQ ID NO: 855995 - RNA, 22 nt, Human
caggugacccucucaccugcuu

SEQ ID NO: 855996 - RNA, 22 nt, Human
guucuucaaagugacaacuaaa

SEQ ID NO: 855997 - RNA, 22 nt, Human
caagaugggcaccccagcaccu

SEQ ID NO: 855998 - RNA, 22 nt, Human
ugcaugugcccacucuggcuua

SEQ ID NO: 855999 - RNA, 22 nt, Human
cugccucuugacagaucguggc

SEQ ID NO: 856000 - RNA, 22 nt, Human
cuuucauucuuagauauuagug

SEQ ID NO: 856001 - RNA, 22 nt, Human
agcugcccugggcuggagaugg

SEQ ID NO: 856002 - RNA, 22 nt, Human
cagagcugcagauugaaggcau

SEQ ID NO: 856003 - RNA, 22 nt, Human
uucuucaaauagcagggaguca

SEQ ID NO: 856004 - RNA, 22 nt, Human
cuggagagggagcccuggcagu

SEQ ID NO: 856005 - RNA, 22 nt, Human
uaggaugagggguggccaagua

SEQ ID NO: 856006 - RNA, 22 nt, Human
ggcugcuggcauugagguaggu

SEQ ID NO: 856007 - RNA, 22 nt, Human
uacuuucuguccuucuguuaaa

SEQ ID NO: 856008 - RNA, 22 nt, Human
ugccuguguccccuucuuggca

SEQ ID NO: 856009 - RNA, 22 nt, Human
uagcaagaugaugaauuauuca

SEQ ID NO: 856010 - RNA, 22 nt, Human
uuuuaucugugacaucuggcag

SEQ ID NO: 856011 - RNA, 22 nt, Human
caaggccacuccagagacuggu

SEQ ID NO: 856012 - RNA, 22 nt, Human
gacagcugugcaggagaagggg

SEQ ID NO: 856013 - RNA, 20 nt, Human
auacacuugcccagcuugug

SEQ ID NO: 856014 - RNA, 22 nt, Human
ucuuuuggguucuuaugauuua

SEQ ID NO: 856015 - RNA, 22 nt, Human
agagccagcauuugacacuggc

SEQ ID NO: 856016 - RNA, 22 nt, Human
agugcuuuccuucuugugacau

SEQ ID NO: 856017 - RNA, 23 nt, Human
agcugaggcugugggugucagag

SEQ ID NO: 856018 - RNA, 22 nt, Human
ugcugagggagggguuuuccag

SEQ ID NO: 856019 - RNA, 19 nt, Human
agccacagaacuugcagga

SEQ ID NO: 856020 - RNA, 22 nt, Human
agauggaguuaguaccagaguc

SEQ ID NO: 856021 - RNA, 22 nt, Human
ucccaggacuuccaguuggagg

SEQ ID NO: 856022 - RNA, 19 nt, Human
ugccuggacaaaugugggg

SEQ ID NO: 856023 - RNA, 22 nt, Human
uucuuaggacuaguauagcaug

SEQ ID NO: 856024 - RNA, 22 nt, Human
aggacagcccuugagagcacau

SEQ ID NO: 856025 - RNA, 20 nt, Human
aucuucuuggccagcuugcu

SEQ ID NO: 856026 - RNA, 22 nt, Human
aaaaauacuucacuucugggug

SEQ ID NO: 856027 - RNA, 22 nt, Human
gcuggagagugaggggagcaag

SEQ ID NO: 856028 - RNA, 22 nt, Human
gucaggauuugaacucaggucu

SEQ ID NO: 856029 - RNA, 22 nt, Human
auuuugaugcuaucuaaugaau

SEQ ID NO: 856030 - RNA, 22 nt, Human
ucuuggcaauuugaucucaguu

SEQ ID NO: 856031 - RNA, 22 nt, Human
gggcagcuggauaguuuuaaau

SEQ ID NO: 856032 - RNA, 22 nt, Human
acaggcugauagaccauaaaua

SEQ ID NO: 856033 - RNA, 22 nt, Human
gcuccuggugcaaaguuucuuc

SEQ ID NO: 856034 - RNA, 22 nt, Human
ccuccuggcuuuucccauugaa

SEQ ID NO: 856035 - RNA, 22 nt, Human
uagcccagcaugagcagagcug

SEQ ID NO: 856036 - RNA, 22 nt, Human
ucugcuguucauucuuuuagcu

SEQ ID NO: 856037 - RNA, 22 nt, Human
uagugcagguuaauaggacuuc

SEQ ID NO: 856038 - RNA, 22 nt, Human
aaaggagacuucagaucuccuu

SEQ ID NO: 856039 - RNA, 22 nt, Human
caccuuguggcccagucagguu

SEQ ID NO: 856040 - RNA, 22 nt, Human
uaacaguagccuuauguggucu

SEQ ID NO: 856041 - RNA, 22 nt, Human
uuuccauguuggugaaaugagg

SEQ ID NO: 856042 - RNA, 21 nt, Human
ucuuggccuaaguucacugaa

SEQ ID NO: 856043 - RNA, 22 nt, Human
uggcugaggagagggcggaagu

SEQ ID NO: 856044 - RNA, 22 nt, Human
acaggcugguuuguaaaagaug

SEQ ID NO: 856045 - RNA, 21 nt, Human
ggagggcagcccagacuggcu

SEQ ID NO: 856046 - RNA, 18 nt, Human
agcugaggggacugaaga

SEQ ID NO: 856047 - RNA, 21 nt, Human
aggcagcuggaaggccuggcu

SEQ ID NO: 856048 - RNA, 22 nt, Human
auguuguuuuuucauaaaguau

SEQ ID NO: 856049 - RNA, 22 nt, Human
gaagcacauggcuauagcuauu

SEQ ID NO: 856050 - RNA, 19 nt, Human
uggucuaaaugugugcccc

SEQ ID NO: 856051 - RNA, 22 nt, Human
ccaggaaauggcuugcuucuuu

SEQ ID NO: 856052 - RNA, 22 nt, Human
aggauguugcuauuggcagucu

SEQ ID NO: 856053 - RNA, 22 nt, Human
caggaugguggcaugaucagaa

SEQ ID NO: 856054 - RNA, 22 nt, Human
uucaguaaaacacugcaauguc

SEQ ID NO: 856055 - RNA, 22 nt, Human
gcuaggcucggaagcagcaggg

SEQ ID NO: 856056 - RNA, 22 nt, Human
uggcagcugcguuguguuucug

SEQ ID NO: 856057 - RNA, 22 nt, Human
agacagugcaagaagagcaggc

SEQ ID NO: 856058 - RNA, 22 nt, Human
gucaggaugcuauuguuauuaa

SEQ ID NO: 856059 - RNA, 22 nt, Human
gagggagggaaaguuuaacacu

SEQ ID NO: 856060 - RNA, 20 nt, Human
ccagagcugauggcugcccg

SEQ ID NO: 856061 - RNA, 22 nt, Human
ccuggagcaggagcugcagagg

SEQ ID NO: 856062 - RNA, 22 nt, Human
auaaacagccugcccaaauugg

SEQ ID NO: 856063 - RNA, 22 nt, Human
uuaggaaucaccugcagaucuu

SEQ ID NO: 856064 - RNA, 22 nt, Human
ucccaggaauugaagccagugu

SEQ ID NO: 856065 - RNA, 22 nt, Human
caccccagcuucucaggauaga

SEQ ID NO: 856066 - RNA, 20 nt, Human
augcuuucuugugugcugcu

SEQ ID NO: 856067 - RNA, 19 nt, Human
ucuaagccucaauguuuuc

SEQ ID NO: 856068 - RNA, 22 nt, Human
aaggagagagcuuugcuggaac

SEQ ID NO: 856069 - RNA, 22 nt, Human
uuugaaaucuaaucaaggaaca

SEQ ID NO: 856070 - RNA, 22 nt, Human
auucuucagcaggggacacuau

SEQ ID NO: 856071 - RNA, 22 nt, Human
agcugcaggagucgccuaggau

SEQ ID NO: 856072 - RNA, 22 nt, Human
aaauguauugcauaggauauuu

SEQ ID NO: 856073 - RNA, 22 nt, Human
aguuugaauugaaaugcagaug

SEQ ID NO: 856074 - RNA, 22 nt, Human
gccagguggagguugcagugag

SEQ ID NO: 856075 - RNA, 22 nt, Human
gaaggaaaacagaucugccuga

SEQ ID NO: 856076 - RNA, 21 nt, Human
cccaggaggcugagaagagca

SEQ ID NO: 856077 - RNA, 22 nt, Human
ucauacaucuguccuggagcuc

SEQ ID NO: 856078 - RNA, 22 nt, Human
aggcaccuugcgguccagugaa

SEQ ID NO: 856079 - RNA, 22 nt, Human
ucuguggauuuuaguguucaug

SEQ ID NO: 856080 - RNA, 22 nt, Human
aggccagcucuacccuuggacu

SEQ ID NO: 856081 - RNA, 22 nt, Human
gccugccuagaauugcagcuuu

SEQ ID NO: 856082 - RNA, 22 nt, Human
cucccaggguagggagagacua

SEQ ID NO: 856083 - RNA, 22 nt, Human
uuauacuaaaacgcauugaauu

SEQ ID NO: 856084 - RNA, 23 nt, Human
gaggcacucaggaaaugugagug

SEQ ID NO: 856085 - RNA, 22 nt, Human
uacaccuuaaucauaugugucu

SEQ ID NO: 856086 - RNA, 20 nt, Human
ccucaggaugagggugagca

SEQ ID NO: 856087 - RNA, 21 nt, Human
agcagaggcagaauguaugca

SEQ ID NO: 856088 - RNA, 22 nt, Human
uggaaagucucuuuugacugua

SEQ ID NO: 856089 - RNA, 22 nt, Human
ucacagacacagggagaagcau

SEQ ID NO: 856090 - RNA, 22 nt, Human
acccaggaaaacauggugcaga

SEQ ID NO: 856091 - RNA, 23 nt, Human
aggcgagcucuucuccagcacgu

SEQ ID NO: 856092 - RNA, 22 nt, Human
aagauuauggcagauaacaauu

SEQ ID NO: 856093 - RNA, 22 nt, Human
aacacuuucuauuauuaugguu

SEQ ID NO: 856094 - RNA, 22 nt, Human
ggcagcacugcagcuuguuggg

SEQ ID NO: 856095 - RNA, 22 nt, Human
gaaucucaaggcuugugaggau

SEQ ID NO: 856096 - RNA, 23 nt, Human
cacuccuguuucuaagccagcau

SEQ ID NO: 856097 - RNA, 23 nt, Human
uggaggaaacacaucagaagacc

SEQ ID NO: 856098 - RNA, 22 nt, Human
caggcagcaucagucugcugua

SEQ ID NO: 856099 - RNA, 22 nt, Human
ugaggcaggagaaucacaugaa

SEQ ID NO: 856100 - RNA, 22 nt, Human
ggcagccuugagggaggccugg

SEQ ID NO: 856101 - RNA, 22 nt, Human
cuccugugggucaccaauaggc

SEQ ID NO: 856102 - RNA, 22 nt, Human
cagugcugcaggcgccugcggu

SEQ ID NO: 856103 - RNA, 23 nt, Human
uuauugaggguguagauuggugu

SEQ ID NO: 856104 - RNA, 22 nt, Human
aucaggauuacacggggaugcu

SEQ ID NO: 856105 - RNA, 22 nt, Human
ucuggccacuaauaggucucac

SEQ ID NO: 856106 - RNA, 22 nt, Human
uggcuucugucccugcuacauu

SEQ ID NO: 856107 - RNA, 22 nt, Human
cccaggaguaagugacauuguu

SEQ ID NO: 856108 - RNA, 22 nt, Human
auucggaucauguguauguguu

SEQ ID NO: 856109 - RNA, 22 nt, Human
ggggugggcgugcagggacacc

SEQ ID NO: 856110 - RNA, 23 nt, Human
ccuccugggcacaggccugaugg

SEQ ID NO: 856111 - RNA, 22 nt, Human
aggcuagcuuuggcucaguaaa

SEQ ID NO: 856112 - RNA, 22 nt, Human
auguaguuagaagauucaaaca

SEQ ID NO: 856113 - RNA, 22 nt, Human
gggcaguuuauucuagaugguu

SEQ ID NO: 856114 - RNA, 22 nt, Human
uuggccaagauacgagcacaua

SEQ ID NO: 856115 - RNA, 22 nt, Human
uuuagucuaauaaaaguggagu

SEQ ID NO: 856116 - RNA, 22 nt, Human
auucaaguccagcuucucuaca

SEQ ID NO: 856117 - RNA, 22 nt, Human
cagcaagaaucagacaaccuca

SEQ ID NO: 856118 - RNA, 22 nt, Human
uucagugucaauuuuuaaauau

SEQ ID NO: 856119 - RNA, 22 nt, Human
gcuccuggucuggagcuucaag

SEQ ID NO: 856120 - RNA, 19 nt, Human
aucugccuuagugcugcug

SEQ ID NO: 856121 - RNA, 22 nt, Human
gaggcaugcagagcuggagcag

SEQ ID NO: 856122 - RNA, 23 nt, Human
cugcugugaaacaugguuuuggu

SEQ ID NO: 856123 - RNA, 22 nt, Human
ucaagaaggagacuccacugug

SEQ ID NO: 856124 - RNA, 22 nt, Human
cuucucagcauuuugucagucu

SEQ ID NO: 856125 - RNA, 22 nt, Human
gcugccugcucggcuccuggga

SEQ ID NO: 856126 - RNA, 22 nt, Human
aacuacauuuuacagaagauga

SEQ ID NO: 856127 - RNA, 22 nt, Human
ggcaagcucaggccucaggugu

SEQ ID NO: 856128 - RNA, 22 nt, Human
uucaggaucauuuguuuuaucu

SEQ ID NO: 856129 - RNA, 22 nt, Human
aggcagcuuuaacugguaguag

SEQ ID NO: 856130 - RNA, 22 nt, Human
ugcaggcugcuggcaguagcuu

SEQ ID NO: 856131 - RNA, 22 nt, Human
gucuggccuuuuuagcuugugg

SEQ ID NO: 856132 - RNA, 22 nt, Human
uugcugugucauuuguuuaauc

SEQ ID NO: 856133 - RNA, 22 nt, Human
ccaccagcuucagcagccgcgg

SEQ ID NO: 856134 - RNA, 22 nt, Human
auuauuaggacuacugggguug

SEQ ID NO: 856135 - RNA, 22 nt, Human
caggcagggagcuggaaaggau

SEQ ID NO: 856136 - RNA, 18 nt, Human
ggagaagaacagaugugg

SEQ ID NO: 856137 - RNA, 22 nt, Human
ugcuucugggcaaaugugugug

SEQ ID NO: 856138 - RNA, 22 nt, Human
agggcagcucucaccucuggcc

SEQ ID NO: 856139 - RNA, 16 nt, Human
aggccaaaaaggggca

SEQ ID NO: 856140 - RNA, 21 nt, Human
ucaggcugucugcugguucca

SEQ ID NO: 856141 - RNA, 22 nt, Human
cagcucagacgcaggucgagca

SEQ ID NO: 856142 - RNA, 22 nt, Human
accauguguuuuacacauggua

SEQ ID NO: 856143 - RNA, 22 nt, Human
gaaaggccauuucugaggguuu

SEQ ID NO: 856144 - RNA, 22 nt, Human
aagggcuguagacaagauugcu

SEQ ID NO: 856145 - RNA, 22 nt, Human
ucugaggugucacaaggccagg

SEQ ID NO: 856146 - RNA, 22 nt, Human
uacaguaaccuuauuugucauu

SEQ ID NO: 856147 - RNA, 22 nt, Human
aagggcugagaaguggggcugg

SEQ ID NO: 856148 - RNA, 22 nt, Human
ucugcaggcuuauaggaugggu

SEQ ID NO: 856149 - RNA, 17 nt, Human
uugaacugcugagucag

SEQ ID NO: 856150 - RNA, 22 nt, Human
uagcaagaucgugucucuaaaa

SEQ ID NO: 856151 - RNA, 22 nt, Human
gaacuauaugucuuaaagcuuu

SEQ ID NO: 856152 - RNA, 22 nt, Human
gaaaacugugauuagaaugccu

SEQ ID NO: 856153 - RNA, 22 nt, Human
ggcugcugagucacgacaguga

SEQ ID NO: 856154 - RNA, 22 nt, Human
uuggcaggaauauugcagaggu

SEQ ID NO: 856155 - RNA, 22 nt, Human
cuacccagauccaggauggcua

SEQ ID NO: 856156 - RNA, 20 nt, Human
ucccucccuccagcucuggg

SEQ ID NO: 856157 - RNA, 22 nt, Human
ucuuagucacagaggugagaaa

SEQ ID NO: 856158 - RNA, 22 nt, Human
agauaaauuccuaagauuucag

SEQ ID NO: 856159 - RNA, 22 nt, Human
agagcagcacguuguccccaca

SEQ ID NO: 856160 - RNA, 22 nt, Human
uacugcaugguggaguggagcu

SEQ ID NO: 856161 - RNA, 22 nt, Human
uaggaucucaccauagaaggaa

SEQ ID NO: 856162 - RNA, 22 nt, Human
ccugguggcuucuggguggacg

SEQ ID NO: 856163 - RNA, 22 nt, Human
aaagauaauguuuccuuauucu

SEQ ID NO: 856164 - RNA, 22 nt, Human
ucugcugugauuugcuaccugu

SEQ ID NO: 856165 - RNA, 22 nt, Human
uggcuucuugacuucuuggcug

SEQ ID NO: 856166 - RNA, 22 nt, Human
agacaggagagggaacugccgg

SEQ ID NO: 856167 - RNA, 22 nt, Human
ucccagaggacuguuggugcua

SEQ ID NO: 856168 - RNA, 22 nt, Human
auuaggaaguaaguaucacaag

SEQ ID NO: 856169 - RNA, 16 nt, Human
gcuccugggcccucga

SEQ ID NO: 856170 - RNA, 22 nt, Human
cuggccaauauagggaaaucuu

SEQ ID NO: 856171 - RNA, 22 nt, Human
cuucagaggggacucaaaguca

SEQ ID NO: 856172 - RNA, 22 nt, Human
uccaggagcauccaggugaagc

SEQ ID NO: 856173 - RNA, 23 nt, Human
augaggucagccauaagacggaa

SEQ ID NO: 856174 - RNA, 16 nt, Human
aggaggggaauuagga

SEQ ID NO: 856175 - RNA, 22 nt, Human
guccucugaaguugugcaaugc

SEQ ID NO: 856176 - RNA, 22 nt, Human
agcuccugcucuuugucccuaa

SEQ ID NO: 856177 - RNA, 22 nt, Human
gagcacugagcuggaauuggag

SEQ ID NO: 856178 - RNA, 22 nt, Human
cuuagaaaucgaacucagguua

SEQ ID NO: 856179 - RNA, 21 nt, Human
ccaggcugggagggcaguucc

SEQ ID NO: 856180 - RNA, 22 nt, Human
agcugccccaugagaggcaggu

SEQ ID NO: 856181 - RNA, 21 nt, Human
cucaaagaccaaaaguguaga

SEQ ID NO: 856182 - RNA, 22 nt, Human
uguuguuuucucauggagaaua

SEQ ID NO: 856183 - RNA, 22 nt, Human
gcucaguuauccgugugugacu

SEQ ID NO: 856184 - RNA, 22 nt, Human
cuguuucaagugaagucagaca

SEQ ID NO: 856185 - RNA, 20 nt, Human
acugagguuagauaacaggu

SEQ ID NO: 856186 - RNA, 22 nt, Human
uaaucuaucaagcaacaaagug

SEQ ID NO: 856187 - RNA, 22 nt, Human
ggcagcuaguuuaagaaagagg

SEQ ID NO: 856188 - RNA, 18 nt, Human
uggcuucuauuuuacuca

SEQ ID NO: 856189 - RNA, 22 nt, Human
cccuggugcccugggucagccu

SEQ ID NO: 856190 - RNA, 22 nt, Human
cccuggaggaaaaucugaggcu

SEQ ID NO: 856191 - RNA, 22 nt, Human
aauagcucacugauuucucuuu

SEQ ID NO: 856192 - RNA, 22 nt, Human
ucuucagauggccaguuguccc

SEQ ID NO: 856193 - RNA, 22 nt, Human
aguaacucuccuuugacauauu

SEQ ID NO: 856194 - RNA, 22 nt, Human
gcugccagccaacuugcugugc

SEQ ID NO: 856195 - RNA, 20 nt, Human
agcauuugaaauaugacuau

SEQ ID NO: 856196 - RNA, 22 nt, Human
ucuuggccagguguggugccuc

SEQ ID NO: 856197 - RNA, 20 nt, Human
aggaggcauagucuggaaag

SEQ ID NO: 856198 - RNA, 21 nt, Human
ggcagcguguggacaggaagg

SEQ ID NO: 856199 - RNA, 22 nt, Human
acagucucuccacacugcaggg

SEQ ID NO: 856200 - RNA, 22 nt, Human
ucuuugaaagcuguucuagagu

SEQ ID NO: 856201 - RNA, 22 nt, Human
uggcuggagucuggugcuagcc

SEQ ID NO: 856202 - RNA, 22 nt, Human
auuucagaugaccaaauggaaa

SEQ ID NO: 856203 - RNA, 22 nt, Human
cuucugugauuugguuaggaua

SEQ ID NO: 856204 - RNA, 22 nt, Human
aaggcugagccagggccccuau

SEQ ID NO: 856205 - RNA, 22 nt, Human
gcuguguuggugaagcuguagc

SEQ ID NO: 856206 - RNA, 19 nt, Human
ucauuguugguuugucggg

SEQ ID NO: 856207 - RNA, 22 nt, Human
uucauguguauggaacauuuuu

SEQ ID NO: 856208 - RNA, 22 nt, Human
ccuggugggcaggagugagacc

SEQ ID NO: 856209 - RNA, 22 nt, Human
aggcugcugaggccaccacgcu

SEQ ID NO: 856210 - RNA, 22 nt, Human
gaauacacgaauagagcauggu

SEQ ID NO: 856211 - RNA, 22 nt, Human
cagcugacuucauaggaagaca

SEQ ID NO: 856212 - RNA, 22 nt, Human
ucucucuucaacccuuaacuag

SEQ ID NO: 856213 - RNA, 22 nt, Human
ggcugaggggcccagaggaaca

SEQ ID NO: 856214 - RNA, 22 nt, Human
aacuggauuuaggaacagagaa

SEQ ID NO: 856215 - RNA, 17 nt, Human
gcccaggaaggacggcc

SEQ ID NO: 856216 - RNA, 22 nt, Human
ccauuguaaauucuguggaagu

SEQ ID NO: 856217 - RNA, 22 nt, Human
acugagguuguaguaggaauuc

SEQ ID NO: 856218 - RNA, 22 nt, Human
auuaguaaaacauuguauaugu

SEQ ID NO: 856219 - RNA, 16 nt, Human
uggcugagagaggguu

SEQ ID NO: 856220 - RNA, 22 nt, Human
ucuuccaagguugcacacuauc

SEQ ID NO: 856221 - RNA, 22 nt, Human
caguuucuuggaugccaauuuc

SEQ ID NO: 856222 - RNA, 22 nt, Human
gagacagugguugcagaagcuc

SEQ ID NO: 856223 - RNA, 22 nt, Human
cucccagagaccaagcugagaa

SEQ ID NO: 856224 - RNA, 22 nt, Human
aggcagacucaauggcuagaua

SEQ ID NO: 856225 - RNA, 22 nt, Human
uguacauacauagauauacaca

SEQ ID NO: 856226 - RNA, 22 nt, Human
gauggcaggugauagccgaguc

SEQ ID NO: 856227 - RNA, 22 nt, Human
uuggccaaaggaaagacuacug

SEQ ID NO: 856228 - RNA, 22 nt, Human
ggcugcuggaagacugaacaag

SEQ ID NO: 856229 - RNA, 22 nt, Human
aggagaggcaucaagaaaaucg

SEQ ID NO: 856230 - RNA, 21 nt, Human
ccaggaaggacugagcucccu

SEQ ID NO: 856231 - RNA, 22 nt, Human
uuacagcagugggaaggaguca

SEQ ID NO: 856232 - RNA, 22 nt, Human
gcaggcugcccucuuguguuga

SEQ ID NO: 856233 - RNA, 22 nt, Human
gagagaaaggcuugcaggcugu

SEQ ID NO: 856234 - RNA, 22 nt, Human
ccaggcagcaaauuuucugaau

SEQ ID NO: 856235 - RNA, 19 nt, Human
ugaggggaggagaggccug

SEQ ID NO: 856236 - RNA, 22 nt, Human
auuauacauuuuguguagagau

SEQ ID NO: 856237 - RNA, 18 nt, Human
gcucaggcccuagucagu

SEQ ID NO: 856238 - RNA, 22 nt, Human
cuuaaaaucuggcaguuagcua

SEQ ID NO: 856239 - RNA, 22 nt, Human
aggagaaggaagugcaucacua

SEQ ID NO: 856240 - RNA, 21 nt, Human
uccaggaguucuaauaggugu

SEQ ID NO: 856241 - RNA, 19 nt, Human
ccaggagagcuuggagaag

SEQ ID NO: 856242 - RNA, 22 nt, Human
uuauacauguguuuugagauga

SEQ ID NO: 856243 - RNA, 22 nt, Human
uuauuaugguauuucuuugcag

SEQ ID NO: 856244 - RNA, 22 nt, Human
ccuccugggacucauuagcacc

SEQ ID NO: 856245 - RNA, 22 nt, Human
agcagagguuuguuggaaaccu

SEQ ID NO: 856246 - RNA, 18 nt, Human
gcuccugguuggaaagaa

SEQ ID NO: 856247 - RNA, 22 nt, Human
uaauuauacaaaaaggcaugca

SEQ ID NO: 856248 - RNA, 22 nt, Human
gaauuccuuaggcucuugacug

SEQ ID NO: 856249 - RNA, 22 nt, Human
augaggcaucugcagucacuag

SEQ ID NO: 856250 - RNA, 22 nt, Human
uuuuuguagucauuagaagagg

SEQ ID NO: 856251 - RNA, 22 nt, Human
cuggcugaggcagagccugggg

SEQ ID NO: 856252 - RNA, 22 nt, Human
gcaagaugguuauaaaaaaugu

SEQ ID NO: 856253 - RNA, 22 nt, Human
gacccaggcccaaggcugccag

SEQ ID NO: 856254 - RNA, 22 nt, Human
cagauccacccuuguagugaca

SEQ ID NO: 856255 - RNA, 22 nt, Human
uuggccaauuuagaacguguug

SEQ ID NO: 856256 - RNA, 22 nt, Human
acccaggagguggaggcugcag

SEQ ID NO: 856257 - RNA, 22 nt, Human
uuaaauuccagccucauaauag

SEQ ID NO: 856258 - RNA, 22 nt, Human
gaggcugcuguuagcccugggc

SEQ ID NO: 856259 - RNA, 22 nt, Human
ugaaaugagcauuuauucuuua

SEQ ID NO: 856260 - RNA, 22 nt, Human
agagagagggaaacugcuaaac

SEQ ID NO: 856261 - RNA, 22 nt, Human
ccuugcauauauuauaucuuug

SEQ ID NO: 856262 - RNA, 22 nt, Human
ugucucugaggugagggucagc

SEQ ID NO: 856263 - RNA, 22 nt, Human
ccugcucagagcgucuugugug

SEQ ID NO: 856264 - RNA, 21 nt, Human
gagugcagcaagguagagucu

SEQ ID NO: 856265 - RNA, 22 nt, Human
uccaugagacagauacuguaag

SEQ ID NO: 856266 - RNA, 22 nt, Human
auuuucagagacaucuggacuu

SEQ ID NO: 856267 - RNA, 22 nt, Human
ucuucagacuccaaauguuuua

SEQ ID NO: 856268 - RNA, 22 nt, Human
cccaggaggcagagcuugcagu

SEQ ID NO: 856269 - RNA, 22 nt, Human
ugucugugaccucuuuggagcc

SEQ ID NO: 856270 - RNA, 22 nt, Human
gcucccagcaauugaggcagcc

SEQ ID NO: 856271 - RNA, 22 nt, Human
aggccagcacgacagccgcagg

SEQ ID NO: 856272 - RNA, 22 nt, Human
cccuguacagucucuguggcac

SEQ ID NO: 856273 - RNA, 21 nt, Human
agcagaggggacauguuugau

SEQ ID NO: 856274 - RNA, 22 nt, Human
uacuccugcugauccugccagc

SEQ ID NO: 856275 - RNA, 17 nt, Human
ugauaguucauuuuaag

SEQ ID NO: 856276 - RNA, 22 nt, Human
ccuggccauagggcccaggaaa

SEQ ID NO: 856277 - RNA, 22 nt, Human
aucuuucaaucaggaaaaaucu

SEQ ID NO: 856278 - RNA, 22 nt, Human
ccaucccugggccauguccccu

SEQ ID NO: 856279 - RNA, 22 nt, Human
guaggcagauaggagugcagcc

SEQ ID NO: 856280 - RNA, 22 nt, Human
uugcauauccuccaacacaugg

SEQ ID NO: 856281 - RNA, 22 nt, Human
uuucuucucacccaggacagag

SEQ ID NO: 856282 - RNA, 22 nt, Human
cucucugggcccaguuggcacc

SEQ ID NO: 856283 - RNA, 22 nt, Human
uuuguaguuguggaugcugaag

SEQ ID NO: 856284 - RNA, 22 nt, Human
aaaugcacugaauauuccaaau

SEQ ID NO: 856285 - RNA, 19 nt, Human
agggaguuuauauuugcac

SEQ ID NO: 856286 - RNA, 22 nt, Human
uucuacauugugaaguucuuua

SEQ ID NO: 856287 - RNA, 23 nt, Human
ugucuccaucucauuacuugggg

SEQ ID NO: 856288 - RNA, 22 nt, Human
agcuggugauguggucccucac

SEQ ID NO: 856289 - RNA, 22 nt, Human
uugagcugccuggcuguggcuc

SEQ ID NO: 856290 - RNA, 22 nt, Human
ugauuccugugcuuauuccagu

SEQ ID NO: 856291 - RNA, 22 nt, Human
ucaguguagcagacuuguagcc

SEQ ID NO: 856292 - RNA, 22 nt, Human
augcuugcccauguuucugaag

SEQ ID NO: 856293 - RNA, 22 nt, Human
auuuuagagaaacaaacguagg

SEQ ID NO: 856294 - RNA, 22 nt, Human
uuguuuguaaggcucuuagaau

SEQ ID NO: 856295 - RNA, 20 nt, Human
auuugcuuaccuuguuucua

SEQ ID NO: 856296 - RNA, 23 nt, Human
uagauccuuccaacuacucuuac

SEQ ID NO: 856297 - RNA, 23 nt, Human
aacauuuguaaggugauuuuguu

SEQ ID NO: 856298 - RNA, 20 nt, Human
cuuguuaaauaugcagguag

SEQ ID NO: 856299 - RNA, 22 nt, Human
gaguaauuuucuuaaaacauca

SEQ ID NO: 856300 - RNA, 22 nt, Human
aucauugaguaaaaugaauaca

SEQ ID NO: 856301 - RNA, 22 nt, Human
ucuccauggauuuggaaaugau

SEQ ID NO: 856302 - RNA, 22 nt, Human
ugugagauuuuauuugauaugc

SEQ ID NO: 856303 - RNA, 18 nt, Human
auuugcaggcaugcaggc

SEQ ID NO: 856304 - RNA, 22 nt, Human
guguguggaaugcucauuuauu

SEQ ID NO: 856305 - RNA, 22 nt, Human
uggaucuugaugcuccaagagu

SEQ ID NO: 856306 - RNA, 22 nt, Human
gagguauaguucuauuagauga

SEQ ID NO: 856307 - RNA, 22 nt, Human
auccauuuuuucagaaugcucu

SEQ ID NO: 856308 - RNA, 22 nt, Human
uccuuucugucuuuacucugga

SEQ ID NO: 856309 - RNA, 22 nt, Human
uucuucauucccuuacuuccga

SEQ ID NO: 856310 - RNA, 22 nt, Human
uagcugucagcaaucaaguggu

SEQ ID NO: 856311 - RNA, 22 nt, Human
uaugcuguauucuguauguuag

SEQ ID NO: 856312 - RNA, 22 nt, Human
gucaucaucaggcagaugcugc

SEQ ID NO: 856313 - RNA, 22 nt, Human
guucaguuauuucugaagauau

SEQ ID NO: 856314 - RNA, 22 nt, Human
uaacuucucugagccucauucc

SEQ ID NO: 856315 - RNA, 22 nt, Human
uaauucuagauugacauuuuga

SEQ ID NO: 856316 - RNA, 21 nt, Human
ugcauauauaagugcauacac

SEQ ID NO: 856317 - RNA, 23 nt, Human
cguuuuuuccucagauguucugg

SEQ ID NO: 856318 - RNA, 22 nt, Human
auuguauacaagcuuaauuguu

SEQ ID NO: 856319 - RNA, 22 nt, Human
cauuuugugcuagacacuaugg

SEQ ID NO: 856320 - RNA, 22 nt, Human
cucuggagcgcugcuucccgcg

SEQ ID NO: 856321 - RNA, 22 nt, Human
cucucuccuuagcugcagacca

SEQ ID NO: 856322 - RNA, 22 nt, Human
ucuccucuauuucuguauguau

SEQ ID NO: 856323 - RNA, 22 nt, Human
uaauuuugucacagugacaugc

SEQ ID NO: 856324 - RNA, 18 nt, Human
cuuuagcugucaucuuug

SEQ ID NO: 856325 - RNA, 22 nt, Human
uguaucauauggggaagcuuca

SEQ ID NO: 856326 - RNA, 22 nt, Human
ugaguguuguaaccauaugauu

SEQ ID NO: 856327 - RNA, 22 nt, Human
ugaaauguggagaugguaagua

SEQ ID NO: 856328 - RNA, 22 nt, Human
uuuggauugcuuggaugcuucg

SEQ ID NO: 856329 - RNA, 22 nt, Human
aaagaugucauacacauuaaga

SEQ ID NO: 856330 - RNA, 21 nt, Human
guucaauagcucuuugaaugc

SEQ ID NO: 856331 - RNA, 22 nt, Human
auguuguugaacucuuugcaug

SEQ ID NO: 856332 - RNA, 22 nt, Human
aauuauguuugcuuuagaugga

SEQ ID NO: 856333 - RNA, 22 nt, Human
ugguuuguauauguuugugaga

SEQ ID NO: 856334 - RNA, 22 nt, Human
guuguuuuugaacggugguggc

SEQ ID NO: 856335 - RNA, 22 nt, Human
ugguuggauggcucuuguggcu

SEQ ID NO: 856336 - RNA, 22 nt, Human
ucauuguuucugcuuuucauga

SEQ ID NO: 856337 - RNA, 22 nt, Human
auuauguagcuaaaaauugugu

SEQ ID NO: 856338 - RNA, 21 nt, Human
cuuuucuagucccagccccgc

SEQ ID NO: 856339 - RNA, 22 nt, Human
uaucuguuuuuacagugucuuu

SEQ ID NO: 856340 - RNA, 22 nt, Human
acauuguugagccucuuguuca

SEQ ID NO: 856341 - RNA, 22 nt, Human
ugccuggauggcucugagcagg

SEQ ID NO: 856342 - RNA, 22 nt, Human
uuguauuaaaauguguuucugu

SEQ ID NO: 856343 - RNA, 22 nt, Human
acuucagugugguauaaaacgu

SEQ ID NO: 856344 - RNA, 22 nt, Human
uuucuagguguucacagagcau

SEQ ID NO: 856345 - RNA, 20 nt, Human
uauuucugggcaaccauuua

SEQ ID NO: 856346 - RNA, 22 nt, Human
uuuuuugucuugaagaaauggu

SEQ ID NO: 856347 - RNA, 22 nt, Human
auccuucaaaaggaauagcagg

SEQ ID NO: 856348 - RNA, 22 nt, Human
aguguauuugccuauaaaaaug

SEQ ID NO: 856349 - RNA, 22 nt, Human
auuuuguaucuuacggggacua

SEQ ID NO: 856350 - RNA, 22 nt, Human
cugguuuuccaauguuuugacu

SEQ ID NO: 856351 - RNA, 22 nt, Human
augcauugaggaugacaugagu

SEQ ID NO: 856352 - RNA, 22 nt, Human
uagcaucuguacugacauaauc

SEQ ID NO: 856353 - RNA, 22 nt, Human
caauuuuuaaacuaugaaguug

SEQ ID NO: 856354 - RNA, 22 nt, Human
uaaaguauaagcauuggaguau

SEQ ID NO: 856355 - RNA, 22 nt, Human
ggcuuccuccuuccugcuguca

SEQ ID NO: 856356 - RNA, 22 nt, Human
cugauggagagugugauuuggg

SEQ ID NO: 856357 - RNA, 22 nt, Human
ucugccaucaagaugcucuggc

SEQ ID NO: 856358 - RNA, 22 nt, Human
gcugcugcuugaaggcucggag

SEQ ID NO: 856359 - RNA, 22 nt, Human
gcaguugcaggauuuguguugu

SEQ ID NO: 856360 - RNA, 19 nt, Human
uuugauagggcauaauaua

SEQ ID NO: 856361 - RNA, 22 nt, Human
gauguaucugagcugcuuaggu

SEQ ID NO: 856362 - RNA, 22 nt, Human
cuguuccuccaccucaacaaac

SEQ ID NO: 856363 - RNA, 22 nt, Human
uguuugcucugacuaucuugcg

SEQ ID NO: 856364 - RNA, 22 nt, Human
aaguguguauuuuucuucagug

SEQ ID NO: 856365 - RNA, 22 nt, Human
ccauuuguaccauuucuuugua

SEQ ID NO: 856366 - RNA, 22 nt, Human
uugauuugauuguaauggcucu

SEQ ID NO: 856367 - RNA, 22 nt, Human
uuguuuaaagaacuucugacuu

SEQ ID NO: 856368 - RNA, 21 nt, Human
uaagcuaaacauucaguuaac

SEQ ID NO: 856369 - RNA, 22 nt, Human
uucuggaguuugaagaucaggu

SEQ ID NO: 856370 - RNA, 22 nt, Human
uuuuggcucugcagguuugcac

SEQ ID NO: 856371 - RNA, 22 nt, Human
uuuccucacacagaagaucuug

SEQ ID NO: 856372 - RNA, 22 nt, Human
uuuguguuggaagaaaugcuac

SEQ ID NO: 856373 - RNA, 21 nt, Human
agcauucaaaagaugccauaa

SEQ ID NO: 856374 - RNA, 22 nt, Human
ugugugaacucucugauguaca

SEQ ID NO: 856375 - RNA, 22 nt, Human
uuacaauuacuugaucucagcu

SEQ ID NO: 856376 - RNA, 22 nt, Human
ucuuugcagaauuuaacuuugc

SEQ ID NO: 856377 - RNA, 22 nt, Human
uucuguuuauaauuugcaguug

SEQ ID NO: 856378 - RNA, 20 nt, Human
uuugacaccuugggagagac

SEQ ID NO: 856379 - RNA, 22 nt, Human
uuauugagcacauaguaugugg

SEQ ID NO: 856380 - RNA, 20 nt, Human
cuugaguucagagcugucau

SEQ ID NO: 856381 - RNA, 22 nt, Human
auuaguguuguggcuucauggc

SEQ ID NO: 856382 - RNA, 22 nt, Human
uaacuugagcucucagugcuau

SEQ ID NO: 856383 - RNA, 22 nt, Human
ugcacauggccugagugccuga

SEQ ID NO: 856384 - RNA, 22 nt, Human
uaaaugcaguacaaauuguucu

SEQ ID NO: 856385 - RNA, 23 nt, Human
cauuugauccucacaauaaaugg

SEQ ID NO: 856386 - RNA, 22 nt, Human
uauuuguuucuaguggcagcaa

SEQ ID NO: 856387 - RNA, 20 nt, Human
uuugauugccccucugacuu

SEQ ID NO: 856388 - RNA, 22 nt, Human
uuuuguguugccauguuaagca

SEQ ID NO: 856389 - RNA, 22 nt, Human
auauaguuggguuucauucuac

SEQ ID NO: 856390 - RNA, 22 nt, Human
cugcuucacccugccugagaac

SEQ ID NO: 856391 - RNA, 19 nt, Human
auucuucucuuccugcugu

SEQ ID NO: 856392 - RNA, 22 nt, Human
aaugauguuuuuaaagaacaua

SEQ ID NO: 856393 - RNA, 22 nt, Human
uugcaucagcaggcauaauugg

SEQ ID NO: 856394 - RNA, 22 nt, Human
accuggaccugccaccuaugag

SEQ ID NO: 856395 - RNA, 22 nt, Human
acaugcauaaacuacuucuuau

SEQ ID NO: 856396 - RNA, 22 nt, Human
auccauuugccgugcuaugugc

SEQ ID NO: 856397 - RNA, 22 nt, Human
auguuugaaauuguaaguauau

SEQ ID NO: 856398 - RNA, 22 nt, Human
ucaguguccuucguucuuguug

SEQ ID NO: 856399 - RNA, 22 nt, Human
uuuguucaccuagcaaacuuuu

SEQ ID NO: 856400 - RNA, 19 nt, Human
ucucccaugccugugucua

SEQ ID NO: 856401 - RNA, 22 nt, Human
aaaugcacaauaaaguaaaggc

SEQ ID NO: 856402 - RNA, 22 nt, Human
ugaaguuguuaagguugccauu

SEQ ID NO: 856403 - RNA, 22 nt, Human
uagaucuuucacuacuguguag

SEQ ID NO: 856404 - RNA, 22 nt, Human
uuaggcauccugucccuggauu

SEQ ID NO: 856405 - RNA, 22 nt, Human
uuugcuugauuaggauauggaa

SEQ ID NO: 856406 - RNA, 22 nt, Human
gguuuguugggguccaggccca

SEQ ID NO: 856407 - RNA, 21 nt, Human
gucuuuuuaauugcgauuucc

SEQ ID NO: 856408 - RNA, 22 nt, Human
cauucauaggaggagaugauua

SEQ ID NO: 856409 - RNA, 22 nt, Human
guaauucugugugaaucuauua

SEQ ID NO: 856410 - RNA, 22 nt, Human
uucucuucacagggaucauccu

SEQ ID NO: 856411 - RNA, 22 nt, Human
uuauuugcccauguuuagcaga

SEQ ID NO: 856412 - RNA, 22 nt, Human
ugacucauauuucauggauacg

SEQ ID NO: 856413 - RNA, 22 nt, Human
ugaguuagcucuauucuuuugg

SEQ ID NO: 856414 - RNA, 22 nt, Human
uugaggcacagauuuuaguggc

SEQ ID NO: 856415 - RNA, 22 nt, Human
cuuuacuucagcaagcuuuccu

SEQ ID NO: 856416 - RNA, 22 nt, Human
ugugacagugccagcuucauag

SEQ ID NO: 856417 - RNA, 21 nt, Human
uugauuuagcagaucuagcug

SEQ ID NO: 856418 - RNA, 22 nt, Human
uuaaguauauccauuugacugg

SEQ ID NO: 856419 - RNA, 22 nt, Human
uuuugaauaauucagaaacagc

SEQ ID NO: 856420 - RNA, 20 nt, Human
ucauaugugguuguauacaa

SEQ ID NO: 856421 - RNA, 18 nt, Human
uuugggauccucuuuucu

SEQ ID NO: 856422 - RNA, 20 nt, Human
ugugguuuuugccaguugaa

SEQ ID NO: 856423 - RNA, 22 nt, Human
uugaugcugucuuucagaauca

SEQ ID NO: 856424 - RNA, 22 nt, Human
guuuuguucaugaacauugggu

SEQ ID NO: 856425 - RNA, 22 nt, Human
uaccuugugagcuuucuaacau

SEQ ID NO: 856426 - RNA, 22 nt, Human
ugccugugggugaugauuugau

SEQ ID NO: 856427 - RNA, 22 nt, Human
uugcacauguugguucuugaaa

SEQ ID NO: 856428 - RNA, 22 nt, Human
gagaauguuaauguugaaguau

SEQ ID NO: 856429 - RNA, 22 nt, Human
uacuacauacagaauuuagaga

SEQ ID NO: 856430 - RNA, 22 nt, Human
ugugcuauuuuugcauaugugu

SEQ ID NO: 856431 - RNA, 22 nt, Human
uaucuuugguagcuuuccuaag

SEQ ID NO: 856432 - RNA, 22 nt, Human
augacagcucuagcacacagua

SEQ ID NO: 856433 - RNA, 22 nt, Human
caauaauugcuuuccagaguua

SEQ ID NO: 856434 - RNA, 22 nt, Human
cuucucaaaguugugaaucagg

SEQ ID NO: 856435 - RNA, 22 nt, Human
cagcuccaucuugcuuauacca

SEQ ID NO: 856436 - RNA, 20 nt, Human
caauaauuuacuucccuauu

SEQ ID NO: 856437 - RNA, 22 nt, Human
gucuuuuuuacaccuuacauca

SEQ ID NO: 856438 - RNA, 22 nt, Human
uucauugauuuccuuggaauaa

SEQ ID NO: 856439 - RNA, 22 nt, Human
ucuccucuccuuucauguuguu

SEQ ID NO: 856440 - RNA, 22 nt, Human
uuuaauuuucugggcccagcag

SEQ ID NO: 856441 - RNA, 22 nt, Human
ccugugauauuguucauaauau

SEQ ID NO: 856442 - RNA, 22 nt, Human
guugaguguugugcaugcacca

SEQ ID NO: 856443 - RNA, 22 nt, Human
ugucauauagaauguucuauga

SEQ ID NO: 856444 - RNA, 22 nt, Human
agugauguagguggauucuggc

SEQ ID NO: 856445 - RNA, 22 nt, Human
cuuauuugcccauguuucuuua

SEQ ID NO: 856446 - RNA, 22 nt, Human
ucacaacugggugucuucauca

SEQ ID NO: 856447 - RNA, 22 nt, Human
auauuuguuuggcagaguucag

SEQ ID NO: 856448 - RNA, 22 nt, Human
acuuuggugcgaagucacuuua

SEQ ID NO: 856449 - RNA, 22 nt, Human
ugcaucauuaagguacaguugg

SEQ ID NO: 856450 - RNA, 22 nt, Human
augcuuucucuuaguucauuga

SEQ ID NO: 856451 - RNA, 22 nt, Human
gcugcuggcuuccugcuguuuu

SEQ ID NO: 856452 - RNA, 22 nt, Human
uugaguuuccugacagcgaagg

SEQ ID NO: 856453 - RNA, 17 nt, Human
aguuuuuggaccugugu

SEQ ID NO: 856454 - RNA, 22 nt, Human
gcugauggcuugcuggcugaca

SEQ ID NO: 856455 - RNA, 22 nt, Human
guuuauuggguauuguggagcc

SEQ ID NO: 856456 - RNA, 22 nt, Human
ugugguuuugguucagaaacaa

SEQ ID NO: 856457 - RNA, 19 nt, Human
cucugccauuugcugccug

SEQ ID NO: 856458 - RNA, 23 nt, Human
agugaugucacccacagacaagg

SEQ ID NO: 856459 - RNA, 22 nt, Human
gugauuucaaauauagagugag

SEQ ID NO: 856460 - RNA, 22 nt, Human
ucuauuaaugauucaauagugu

SEQ ID NO: 856461 - RNA, 22 nt, Human
aaguuacacauuuucauuguaa

SEQ ID NO: 856462 - RNA, 22 nt, Human
ucugcuguuuacugugugauau

SEQ ID NO: 856463 - RNA, 22 nt, Human
acauuuuuggguugaugucuga

SEQ ID NO: 856464 - RNA, 22 nt, Human
uuucuaguggguauucccuguu

SEQ ID NO: 856465 - RNA, 21 nt, Human
uccugcugagaaacagauggu

SEQ ID NO: 856466 - RNA, 22 nt, Human
cugaugcucuggauguagucaa

SEQ ID NO: 856467 - RNA, 22 nt, Human
cauuguguauuucuguaguacu

SEQ ID NO: 856468 - RNA, 22 nt, Human
gugauuuucuccuccuagaagu

SEQ ID NO: 856469 - RNA, 22 nt, Human
agcuaugaagccacuuuuaaca

SEQ ID NO: 856470 - RNA, 22 nt, Human
cuuguuuucuucugcagucuau

SEQ ID NO: 856471 - RNA, 22 nt, Human
uaguauuuccuguaagcuauag

SEQ ID NO: 856472 - RNA, 22 nt, Human
uuuacuuuugguaaggucauuu

SEQ ID NO: 856473 - RNA, 22 nt, Human
uggcauuggaauuuguguugca

SEQ ID NO: 856474 - RNA, 19 nt, Human
aggugaugugacucuagaa

SEQ ID NO: 856475 - RNA, 22 nt, Human
cuucauuuggcaggcuggccuc

SEQ ID NO: 856476 - RNA, 22 nt, Human
ugacuuuggacuagugauuuaa

SEQ ID NO: 856477 - RNA, 22 nt, Human
uccucuucaaaauagcucugaa

SEQ ID NO: 856478 - RNA, 22 nt, Human
aguguauucugcaugggagacu

SEQ ID NO: 856479 - RNA, 22 nt, Human
ugcuuuggcccaacauugaugc

SEQ ID NO: 856480 - RNA, 22 nt, Human
uguguuuuggaaggaacaugca

SEQ ID NO: 856481 - RNA, 22 nt, Human
guucuccaggggcuguucaucu

SEQ ID NO: 856482 - RNA, 20 nt, Human
agugauuuguuaguacauug

SEQ ID NO: 856483 - RNA, 22 nt, Human
acuagaaacuaauggauuauua

SEQ ID NO: 856484 - RNA, 22 nt, Human
uucuuugcccauguuuccuaag

SEQ ID NO: 856485 - RNA, 22 nt, Human
uuauguauggauggcugaaagu

SEQ ID NO: 856486 - RNA, 23 nt, Human
ugucuggauucgacugugguugg

SEQ ID NO: 856487 - RNA, 22 nt, Human
uuaccugagcggauuuguugca

SEQ ID NO: 856488 - RNA, 22 nt, Human
cugcuuuaaaacugauacauga

SEQ ID NO: 856489 - RNA, 22 nt, Human
uagauuaucccugauuugucca

SEQ ID NO: 856490 - RNA, 22 nt, Human
uagugucucuuccuguuugaaa

SEQ ID NO: 856491 - RNA, 22 nt, Human
ugcuugcugaaaggcauuuaga

SEQ ID NO: 856492 - RNA, 22 nt, Human
cugcauaucaaauuacuccugg

SEQ ID NO: 856493 - RNA, 22 nt, Human
uaucauuuuacugugacauuuu

SEQ ID NO: 856494 - RNA, 22 nt, Human
cugguuuuuagugcuuaggagu

SEQ ID NO: 856495 - RNA, 19 nt, Human
ucuuucauuucuagcucug

SEQ ID NO: 856496 - RNA, 18 nt, Human
gguguguaacguguuuuc

SEQ ID NO: 856497 - RNA, 22 nt, Human
aucugccuggcuccaggugagc

SEQ ID NO: 856498 - RNA, 22 nt, Human
ucuuugcauggacauguguuuu

SEQ ID NO: 856499 - RNA, 22 nt, Human
ucuuuuaucuguuguguaacaa

SEQ ID NO: 856500 - RNA, 22 nt, Human
aucuuuggguacaaacuugccu

SEQ ID NO: 856501 - RNA, 22 nt, Human
aauuauugagcaucuacugugu

SEQ ID NO: 856502 - RNA, 22 nt, Human
caucuuuguuuuggauauaauc

SEQ ID NO: 856503 - RNA, 22 nt, Human
cuuuauguuggggugucuuagu

SEQ ID NO: 856504 - RNA, 22 nt, Human
uucuuuuaauagagauccugug

SEQ ID NO: 856505 - RNA, 22 nt, Human
uuuguugguugcacuggugggu

SEQ ID NO: 856506 - RNA, 22 nt, Human
gugguuguuuccagguuugaaa

SEQ ID NO: 856507 - RNA, 22 nt, Human
auguuuguguuucccauucagg

SEQ ID NO: 856508 - RNA, 22 nt, Human
auugacuuucccuucuccucau

SEQ ID NO: 856509 - RNA, 22 nt, Human
gucauuuuugacuuugaaguga

SEQ ID NO: 856510 - RNA, 22 nt, Human
uuugacaugugcuuauaacuuu

SEQ ID NO: 856511 - RNA, 22 nt, Human
ccucuucuaggacguccuugug

SEQ ID NO: 856512 - RNA, 22 nt, Human
aacuugccaagagcuuugcuag

SEQ ID NO: 856513 - RNA, 22 nt, Human
uuauuuaaaauguagguuggga

SEQ ID NO: 856514 - RNA, 22 nt, Human
agugauaggacauauggauuuu

SEQ ID NO: 856515 - RNA, 22 nt, Human
agcuggugugccaguuccaguu

SEQ ID NO: 856516 - RNA, 22 nt, Human
uauuuggugaaucuauggucag

SEQ ID NO: 856517 - RNA, 22 nt, Human
ccaucuucucuugaaccuccuu

SEQ ID NO: 856518 - RNA, 22 nt, Human
uuuucuuggaguggcuguccuu

SEQ ID NO: 856519 - RNA, 22 nt, Human
cuuucuuucgaagacgugauua

SEQ ID NO: 856520 - RNA, 22 nt, Human
ugaauaugugacuuugauuuca

SEQ ID NO: 856521 - RNA, 22 nt, Human
uauagugucucuagaucaaaga

SEQ ID NO: 856522 - RNA, 22 nt, Human
gucuccugaggcauccauugaa

SEQ ID NO: 856523 - RNA, 22 nt, Human
ucugaauucuuagaauuaaagg

SEQ ID NO: 856524 - RNA, 22 nt, Human
uguuaguauuggcaaauuuguu

SEQ ID NO: 856525 - RNA, 22 nt, Human
auuguugacuugauuacucaac

SEQ ID NO: 856526 - RNA, 22 nt, Human
uugagcuugaggaguuauuuga

SEQ ID NO: 856527 - RNA, 22 nt, Human
gagugugucggucagcguggcg

SEQ ID NO: 856528 - RNA, 22 nt, Human
uucuuuuaauuucugucugcag

SEQ ID NO: 856529 - RNA, 22 nt, Human
ucuucaugucaugguauauuga

SEQ ID NO: 856530 - RNA, 22 nt, Human
agcauucuguggucuucuaugg

SEQ ID NO: 856531 - RNA, 22 nt, Human
ggauguuuauccuaucuuaguu

SEQ ID NO: 856532 - RNA, 22 nt, Human
auuacugaggcaaaguaguuuu

SEQ ID NO: 856533 - RNA, 23 nt, Human
aaugaguugggcagcauacaggc

SEQ ID NO: 856534 - RNA, 22 nt, Human
aauggcuguucucugugauugg

SEQ ID NO: 856535 - RNA, 22 nt, Human
agugaauuagccuauuuguaaa

SEQ ID NO: 856536 - RNA, 22 nt, Human
augcauaucuccuaucuccuca

SEQ ID NO: 856537 - RNA, 22 nt, Human
uguauuucugcuuucucuagua

SEQ ID NO: 856538 - RNA, 22 nt, Human
auacaacagaaaaugauuauuc

SEQ ID NO: 856539 - RNA, 18 nt, Human
cgauguguaugugauuug

SEQ ID NO: 856540 - RNA, 22 nt, Human
uugaauaguuuuggauagcaua

SEQ ID NO: 856541 - RNA, 22 nt, Human
augguuuuguccucuuugguuc

SEQ ID NO: 856542 - RNA, 22 nt, Human
ugcucccaggcauucucuguug

SEQ ID NO: 856543 - RNA, 22 nt, Human
cacaucauguuaauucauuaca

SEQ ID NO: 856544 - RNA, 22 nt, Human
ugcugcuuguuuuguaaauaaa

SEQ ID NO: 856545 - RNA, 22 nt, Human
cuacagcuguguguuuaugugc

SEQ ID NO: 856546 - RNA, 22 nt, Human
uuauuuaaaagugguaagauuc

SEQ ID NO: 856547 - RNA, 22 nt, Human
uaguguguggucucucccuugu

SEQ ID NO: 856548 - RNA, 22 nt, Human
gaauaauugugaugcuugaagu

SEQ ID NO: 856549 - RNA, 22 nt, Human
acauauuuugaaagcuuucuaa

SEQ ID NO: 856550 - RNA, 20 nt, Human
uccaguuuuggagacauucu

SEQ ID NO: 856551 - RNA, 22 nt, Human
uauggcuucugggccaaauuua

SEQ ID NO: 856552 - RNA, 22 nt, Human
agauauguuaggcuuguucccu

SEQ ID NO: 856553 - RNA, 22 nt, Human
gaugaguucuuucuauucuauu

SEQ ID NO: 856554 - RNA, 22 nt, Human
auggugguagaagcacuaugug

SEQ ID NO: 856555 - RNA, 22 nt, Human
augauugaaaaugacauugcca

SEQ ID NO: 856556 - RNA, 22 nt, Human
uuuguguuguacuucugugcau

SEQ ID NO: 856557 - RNA, 22 nt, Human
uuuugguaauuaaguagauauu

SEQ ID NO: 856558 - RNA, 22 nt, Human
ccugguguuaucauaggucaug

SEQ ID NO: 856559 - RNA, 22 nt, Human
auaguguguaaagugcagugau

SEQ ID NO: 856560 - RNA, 23 nt, Human
uuguucuuggaucuuccugaagc

SEQ ID NO: 856561 - RNA, 22 nt, Human
auacuucuuuagcauauugaac

SEQ ID NO: 856562 - RNA, 22 nt, Human
uagcauuucacugaucuucacu

SEQ ID NO: 856563 - RNA, 22 nt, Human
cauugcuuugugcauauuuaaa

SEQ ID NO: 856564 - RNA, 22 nt, Human
gguuuguggagcuggaaacacu

SEQ ID NO: 856565 - RNA, 17 nt, Human
uaaguccuaguuauuuu

SEQ ID NO: 856566 - RNA, 20 nt, Human
agcauuuagccuuuauccac

SEQ ID NO: 856567 - RNA, 22 nt, Human
auauggcuguugcacaucuaag

SEQ ID NO: 856568 - RNA, 22 nt, Human
ugcauguuucuguauguuaaug

SEQ ID NO: 856569 - RNA, 22 nt, Human
uauuacaguucgaguuucuagg

SEQ ID NO: 856570 - RNA, 22 nt, Human
uauaugcagauuuucaucaucg

SEQ ID NO: 856571 - RNA, 22 nt, Human
aucauuugaacagaauuuguuu

SEQ ID NO: 856572 - RNA, 22 nt, Human
uagcauuuagaacaccuugaga

SEQ ID NO: 856573 - RNA, 22 nt, Human
uucuccacccacucuuuuguug

SEQ ID NO: 856574 - RNA, 22 nt, Human
uuucacauacaguguauaguag

SEQ ID NO: 856575 - RNA, 22 nt, Human
cauccauagauugagagauggu

SEQ ID NO: 856576 - RNA, 22 nt, Human
cuuugcuaauguugcauuuuca

SEQ ID NO: 856577 - RNA, 22 nt, Human
uucaguaugcugaaugauuuuu

SEQ ID NO: 856578 - RNA, 22 nt, Human respiratory syncytial virus
augacacuauagcuccaagaga

SEQ ID NO: 856579 - RNA, 22 nt, Human respiratory syncytial virus
cucaucuuauagauguuuuugu

SEQ ID NO: 856580 - RNA, 22 nt, Human respiratory syncytial virus
auuuuuguuggaugcagugcau

SEQ ID NO: 856581 - RNA, 22 nt, Human respiratory syncytial virus
cuugguaaugucaaacuguuca

SEQ ID NO: 856582 - RNA, 22 nt, Human respiratory syncytial virus
ucacugagcaugauaaagguua

SEQ ID NO: 856583 - RNA, 22 nt, Human respiratory syncytial virus
uucuuaggaucuuuggaugaug

SEQ ID NO: 856584 - RNA, 22 nt, Human respiratory syncytial virus
acugaucaaaaaucaucaagug

SEQ ID NO: 856585 - RNA, 22 nt, Human respiratory syncytial virus
acugaucaaaaaucaucaagug

SEQ ID NO: 856586 - RNA, 22 nt, Human respiratory syncytial virus
cucaucuuauagauguuuuugu

SEQ ID NO: 856587 - RNA, 22 nt, Human respiratory syncytial virus
cuugguaaugucaaacuguuca

SEQ ID NO: 856588 - RNA, 22 nt, Human respiratory syncytial virus
auuuuuguuggaugcagugcau

SEQ ID NO: 856589 - RNA, 22 nt, Human respiratory syncytial virus
uggacuguacuuuacaaguguc

SEQ ID NO: 856590 - RNA, 22 nt, Human respiratory syncytial virus
aauuguuugaauacauuaaaua

SEQ ID NO: 856591 - RNA, 22 nt, Human respiratory syncytial virus
uucuuaggaucuuuggaugaug

SEQ ID NO: 856592 - RNA, 22 nt, Human respiratory syncytial virus
cccuuuauugauucuaggaauu

SEQ ID NO: 856593 - RNA, 22 nt, Human respiratory syncytial virus
augacacuauagcuccaagaga

SEQ ID NO: 856594 - RNA, 22 nt, Human
aacaugucuggguauucacaag

SEQ ID NO: 856595 - RNA, 21 nt, Human
caaagccaggcaacucucucc

SEQ ID NO: 856596 - RNA, 22 nt, Human
gcaacuuucaagcaccaugggg

SEQ ID NO: 856597 - RNA, 22 nt, Human
aaugcuuuuugcgaaaugugca

SEQ ID NO: 856598 - RNA, 22 nt, Human
uuugacaucaauacccuagaau

SEQ ID NO: 856599 - RNA, 22 nt, Human
ugaaagguuauuuaggucugcu

SEQ ID NO: 856600 - RNA, 22 nt, Human
cuucuucaucuguaaaacuugg

SEQ ID NO: 856601 - RNA, 22 nt, Human
agaccaagugcaggugccacua

SEQ ID NO: 856602 - RNA, 22 nt, Human
agucucugccagcuuguccucu

SEQ ID NO: 856603 - RNA, 22 nt, Human
uuaacacuugaacucuacaugu

SEQ ID NO: 856604 - RNA, 22 nt, Human
uuuccaagacuccaguucuccc

SEQ ID NO: 856605 - RNA, 22 nt, Human
uuuaauauucugcauucuccuu

SEQ ID NO: 856606 - RNA, 18 nt, Human
aguaaagcuuauuacaug

SEQ ID NO: 856607 - RNA, 22 nt, Human
aucaggauucaccccagagcug

SEQ ID NO: 856608 - RNA, 22 nt, Human
uucuucagucccacuagccaca

SEQ ID NO: 856609 - RNA, 22 nt, Human
cuucuucagcacaauauugaug

SEQ ID NO: 856610 - RNA, 22 nt, Human
cuuaaauucuuaaugcccucau

SEQ ID NO: 856611 - RNA, 22 nt, Human
cccaggagauaacguucccaag

SEQ ID NO: 856612 - RNA, 22 nt, Human
ccagucacucugugagagcuac

SEQ ID NO: 856613 - RNA, 22 nt, Human
ugaggcagggagaguggauaug

SEQ ID NO: 856614 - RNA, 22 nt, Human
ugcuuaauacguauuugcugga

SEQ ID NO: 856615 - RNA, 22 nt, Human
gcagaggacagggauuuagauu

SEQ ID NO: 856616 - RNA, 22 nt, Human
uccaaaguguugggauuauagg

SEQ ID NO: 856617 - RNA, 22 nt, Human
gcuuuggagccuguguucugcc

SEQ ID NO: 856618 - RNA, 20 nt, Human
uguaacaaucuggauguugc

SEQ ID NO: 856619 - RNA, 21 nt, Human
agucuguuaggaugacucuga

SEQ ID NO: 856620 - RNA, 22 nt, Human
ccauggcuuuugagucucaaga

SEQ ID NO: 856621 - RNA, 22 nt, Human
agaaggggagaagcuaccagga

SEQ ID NO: 856622 - RNA, 20 nt, Human
aggacagcagcugccacuug

SEQ ID NO: 856623 - RNA, 22 nt, Human
ucaggagaaagccaauuagagu

SEQ ID NO: 856624 - RNA, 22 nt, Human
ucucuguaguugggcagcugcu

SEQ ID NO: 856625 - RNA, 21 nt, Human
ucuugaaaauuguagcaguuu

SEQ ID NO: 856626 - RNA, 22 nt, Human
aauuccaggaugcaggaggugc

SEQ ID NO: 856627 - RNA, 22 nt, Human
ucagccaguugccccaguuagu

SEQ ID NO: 856628 - RNA, 22 nt, Human
uucaggauaugugauaucugaa

SEQ ID NO: 856629 - RNA, 22 nt, Human
cagaccagaaggaagccgacaa

SEQ ID NO: 856630 - RNA, 22 nt, Human
ggcaucuccaaaacaugaacuc

SEQ ID NO: 856631 - RNA, 22 nt, Human
ucaggagaaaauaucaggaagu

SEQ ID NO: 856632 - RNA, 22 nt, Human
ugcuggcuacauuauugcuguc

SEQ ID NO: 856633 - RNA, 22 nt, Human
cagcugacagugaggugggggc

SEQ ID NO: 856634 - RNA, 22 nt, Human
caggcagcucugcuuuuccuaa

SEQ ID NO: 856635 - RNA, 22 nt, Human
acuagaaauuacucagaauaaa

SEQ ID NO: 856636 - RNA, 22 nt, Human
uuuaggcagcuacauacuaacu

SEQ ID NO: 856637 - RNA, 22 nt, Human
cauucuuacacaauauuuuaau

SEQ ID NO: 856638 - RNA, 22 nt, Human
uaucagaaaucaacacacagug

SEQ ID NO: 856639 - RNA, 22 nt, Human
aaauacugggcucaaaaggguu

SEQ ID NO: 856640 - RNA, 22 nt, Human
uuugaaagacagaauauuuuug

SEQ ID NO: 856641 - RNA, 21 nt, Human
cccaggaguccuauuuaaaug

SEQ ID NO: 856642 - RNA, 22 nt, Human
uaauuauucuagucacauagca

SEQ ID NO: 856643 - RNA, 22 nt, Human
uauacagauggaaagauacaca

SEQ ID NO: 856644 - RNA, 22 nt, Human
uaauaaacugcuacgcuuaguu

SEQ ID NO: 856645 - RNA, 22 nt, Human
uaaguucauaagcuuauucuua

SEQ ID NO: 856646 - RNA, 18 nt, Human
gugcugugggcaguggcc

SEQ ID NO: 856647 - RNA, 22 nt, Human
gcaucuaauccaguccagcauc

SEQ ID NO: 856648 - RNA, 22 nt, Human
cccaggaggaggaaaaagcucg

SEQ ID NO: 856649 - RNA, 22 nt, Human
aaucuuucccuauuaaaugugg

SEQ ID NO: 856650 - RNA, 22 nt, Human
cacucuccagcacaccccauuu

SEQ ID NO: 856651 - RNA, 22 nt, Human
caaggccauauugccuguaugu

SEQ ID NO: 856652 - RNA, 22 nt, Human
cagauuucuauuucaaauacau

SEQ ID NO: 856653 - RNA, 22 nt, Human
cagcuggccccacaguagaggc

SEQ ID NO: 856654 - RNA, 22 nt, Human
gaucuucuauguaaugaagugu

SEQ ID NO: 856655 - RNA, 22 nt, Human
uggcagcuaucuuuaaugagau

SEQ ID NO: 856656 - RNA, 22 nt, Human
ucagaauuuugguuugguuggu

SEQ ID NO: 856657 - RNA, 22 nt, Human
aaagauaauguuuccuuauucu

SEQ ID NO: 856658 - RNA, 22 nt, Human
caucagaauagcucuguggaua

SEQ ID NO: 856659 - RNA, 22 nt, Human
ccaggagacuguacugauauuu

SEQ ID NO: 856660 - RNA, 22 nt, Human
auuuaguguauucuaauaugug

SEQ ID NO: 856661 - RNA, 22 nt, Human
caguaaauuugagggaucuaau

SEQ ID NO: 856662 - RNA, 22 nt, Human
gagacagcacaggccacuggga

SEQ ID NO: 856663 - RNA, 23 nt, Human
aguacaauaaguauaauucuuuc

SEQ ID NO: 856664 - RNA, 22 nt, Human
ugugaauacagcaugugcuucu

SEQ ID NO: 856665 - RNA, 22 nt, Human
uugauacauuuuuaggauaaac

SEQ ID NO: 856666 - RNA, 22 nt, Human
aucugccugcaguggagguggg

SEQ ID NO: 856667 - RNA, 22 nt, Human
uaaggccaggcuguggucggca

SEQ ID NO: 856668 - RNA, 23 nt, Human
uggaauaauaagguacauuaaca

SEQ ID NO: 856669 - RNA, 22 nt, Human
uuugaaagcuacuuucggguca

SEQ ID NO: 856670 - RNA, 22 nt, Human
uuugaaagggacaaagucacug

SEQ ID NO: 856671 - RNA, 22 nt, Human
uucauugucucuguuugccuuc

SEQ ID NO: 856672 - RNA, 19 nt, Human
ucugccucuggucaggcuc

SEQ ID NO: 856673 - RNA, 19 nt, Human
aaagcagaggagcaucuga

SEQ ID NO: 856674 - RNA, 22 nt, Human
ggcagccuugagggaggccugg

SEQ ID NO: 856675 - RNA, 22 nt, Human
uuugaaauaugaggcauuauga

SEQ ID NO: 856676 - RNA, 22 nt, Human
ggaagaggcugagccagguccc

SEQ ID NO: 856677 - RNA, 22 nt, Human
cucaggauccaucuccugcccu

SEQ ID NO: 856678 - RNA, 22 nt, Human
ucucuguacaguacaugccgug

SEQ ID NO: 856679 - RNA, 22 nt, Human
uucauuaguucugaagaugucu

SEQ ID NO: 856680 - RNA, 22 nt, Human
aaucagaaauugagggucuggu

SEQ ID NO: 856681 - RNA, 22 nt, Human
auucuucauuguugauucaugu

SEQ ID NO: 856682 - RNA, 22 nt, Human
gcuagaucucucauaaauucca

SEQ ID NO: 856683 - RNA, 22 nt, Human
ggcaugcucuuuguccacagua

SEQ ID NO: 856684 - RNA, 22 nt, Human
agaggagugggaagcagugcaa

SEQ ID NO: 856685 - RNA, 22 nt, Human
agguacaaaagaguauaugaga

SEQ ID NO: 856686 - RNA, 22 nt, Human
uccaugucuucaugugucuaac

SEQ ID NO: 856687 - RNA, 22 nt, Human
ugaaguaacuguccaggaucca

SEQ ID NO: 856688 - RNA, 22 nt, Human
gaggcagcucuucugaaugggg

SEQ ID NO: 856689 - RNA, 22 nt, Human
agugugagcccuggaguggugc

SEQ ID NO: 856690 - RNA, 22 nt, Human
caucagaagaaagacaaaugau

SEQ ID NO: 856691 - RNA, 17 nt, Human
ccuguguuugcuccuuc

SEQ ID NO: 856692 - RNA, 22 nt, Human
uuuacuuuugguaaggucauuu

SEQ ID NO: 856693 - RNA, 22 nt, Human
accagcugcugauugcuaaaug

SEQ ID NO: 856694 - RNA, 22 nt, Human
uaagaaucggucgcaacagagg

SEQ ID NO: 856695 - RNA, 17 nt, Human
ugcuuaauuuugacugg

SEQ ID NO: 856696 - RNA, 22 nt, Human
gaggcacuggaggaaaggagaa

SEQ ID NO: 856697 - RNA, 22 nt, Human
ucauuuguugaacuuuagugcg

SEQ ID NO: 856698 - RNA, 22 nt, Human
aucuuguuauaagagauaaugg

SEQ ID NO: 856699 - RNA, 22 nt, Human
uucaggauccccaccgcguuua

SEQ ID NO: 856700 - RNA, 22 nt, Human
ccaggcugcagucaaggggcau

SEQ ID NO: 856701 - RNA, 22 nt, Human
aaauuauucucauguguuucuu

SEQ ID NO: 856702 - RNA, 22 nt, Human
caagauuugccaguggccaacu

SEQ ID NO: 856703 - RNA, 22 nt, Human
aagauauucaaagauuuauuag

SEQ ID NO: 856704 - RNA, 21 nt, Human
gaguccuuccaauguccucag

SEQ ID NO: 856705 - RNA, 22 nt, Human
uaacauguuaagaaauuagaua

SEQ ID NO: 856706 - RNA, 22 nt, Human
gauuucaagcccccagagauuc

SEQ ID NO: 856707 - RNA, 19 nt, Human
cccaggaggcggagguugc

SEQ ID NO: 856708 - RNA, 22 nt, Human
uuacuacugcuuuacuacuggg

SEQ ID NO: 856709 - RNA, 22 nt, Human
aaauagcagccuuuaguuaaca

SEQ ID NO: 856710 - RNA, 21 nt, Human
uuugaaagcuacaucuauagc

SEQ ID NO: 856711 - RNA, 22 nt, Human
gugcugugucuaucaggaauaa

SEQ ID NO: 856712 - RNA, 22 nt, Human
ccuugcguuuuacagcuucuag

SEQ ID NO: 856713 - RNA, 22 nt, Human
acagucuugcuguauggucagg

SEQ ID NO: 856714 - RNA, 22 nt, Human
uagaaacaucagcuaaccaaaa

SEQ ID NO: 856715 - RNA, 22 nt, Human
caggcagccugcggucugcaca

SEQ ID NO: 856716 - RNA, 15 nt, Human
cuccaugauuuugca

SEQ ID NO: 856717 - RNA, 22 nt, Human
uugaauaaaugagcagugaauu

SEQ ID NO: 856718 - RNA, 22 nt, Human
uucuucaguuugguaaauguaa

SEQ ID NO: 856719 - RNA, 22 nt, Human
uggcagcucccagagcuuccaa

SEQ ID NO: 856720 - RNA, 22 nt, Human
ucugggaaguccucugucaugc

SEQ ID NO: 856721 - RNA, 22 nt, Human
gcaggagaaaugaagauugggu

SEQ ID NO: 856722 - RNA, 21 nt, Human
cuguggaagggaacuagaggg

SEQ ID NO: 856723 - RNA, 22 nt, Human
agcugcccuuuaugaugcugaa

SEQ ID NO: 856724 - RNA, 22 nt, Human
caaggccauaagagauacaaaa

SEQ ID NO: 856725 - RNA, 22 nt, Human
ucuucagauaaagggagaguau

SEQ ID NO: 856726 - RNA, 22 nt, Human
aagccgaggccacacagcagga

SEQ ID NO: 856727 - RNA, 22 nt, Human
uaguaucuauuaguaacaagag

SEQ ID NO: 856728 - RNA, 22 nt, Human
uaaagcacauaucuuacaauaa

SEQ ID NO: 856729 - RNA, 22 nt, Human
uacaugaaccuuuaugugugau

SEQ ID NO: 856730 - RNA, 22 nt, Human
ucccaggauuuuaggcucucag

SEQ ID NO: 856731 - RNA, 22 nt, Human
caagaugugccuaaucagaccu

SEQ ID NO: 856732 - RNA, 22 nt, Human
uagauuuaagacccugaauuug

SEQ ID NO: 856733 - RNA, 22 nt, Human
uaaagccacuucauucuagucu

SEQ ID NO: 856734 - RNA, 20 nt, Human
gggcaguucaaugccacucu

SEQ ID NO: 856735 - RNA, 17 nt, Human
uucaaagcuuaucaagg

SEQ ID NO: 856736 - RNA, 22 nt, Human
gaggcaguuccugagugacaag

SEQ ID NO: 856737 - RNA, 22 nt, Human
gaugccuccaaaugagggcaga

SEQ ID NO: 856738 - RNA, 22 nt, Human
auuaaauuaaguggcuaauuua

SEQ ID NO: 856739 - RNA, 22 nt, Human
ccccaggagauuugggagcaca

SEQ ID NO: 856740 - RNA, 22 nt, Human
aagucacaagcauauaugcauu

SEQ ID NO: 856741 - RNA, 22 nt, Human
caguucacacugugcuaucugc

SEQ ID NO: 856742 - RNA, 22 nt, Human
aaucagaaauucuacaucacaa

SEQ ID NO: 856743 - RNA, 21 nt, Human
uccuuccuugagguccuuucc

SEQ ID NO: 856744 - RNA, 22 nt, Human
cucaggauuuaaaggggcacuc

SEQ ID NO: 856745 - RNA, 22 nt, Human
guucuaauaggagaaaagacag

SEQ ID NO: 856746 - RNA, 22 nt, Human
aaugggauaauuguucauggga

SEQ ID NO: 856747 - RNA, 20 nt, Human
aguacaauguaugauucaga

SEQ ID NO: 856748 - RNA, 20 nt, Human
ccucaguguccuggacuggg

SEQ ID NO: 856749 - RNA, 22 nt, Human
gaaauauuacaguggaggggau

SEQ ID NO: 856750 - RNA, 22 nt, Human
uguuccaagcugcuggauaagc

SEQ ID NO: 856751 - RNA, 22 nt, Human
gagauuuagagagacuuaaaca

SEQ ID NO: 856752 - RNA, 22 nt, Human
ccaggagacccagggaaggagc

SEQ ID NO: 856753 - RNA, 22 nt, Human
uugaagaaagucauauauaaug

SEQ ID NO: 856754 - RNA, 22 nt, Human
ucaggagggugacaggcccugg

SEQ ID NO: 856755 - RNA, 22 nt, Human
ugaacucucucaagugacagaa

SEQ ID NO: 856756 - RNA, 22 nt, Human
auuucagguaccugugggaucc

SEQ ID NO: 856757 - RNA, 23 nt, Human
gagugcagaauagacaugcagug

SEQ ID NO: 856758 - RNA, 22 nt, Human
uguccuuacaaggucccuuucg

SEQ ID NO: 856759 - RNA, 22 nt, Human
caauuucaaugaggccacaggg

SEQ ID NO: 856760 - RNA, 22 nt, Human
gagauuuagcugcuuaacuccu

SEQ ID NO: 856761 - RNA, 22 nt, Human
ggcagcucugcuccacaugagu

SEQ ID NO: 856762 - RNA, 19 nt, Human
aggguggcaaaggagggug

SEQ ID NO: 856763 - RNA, 22 nt, Human
cacacuuugugcuaaucuauuu

SEQ ID NO: 856764 - RNA, 22 nt, Human
uuucaucuaacacuacauaggg

SEQ ID NO: 856765 - RNA, 22 nt, Human
cugcgcagggguggcgccagaa

SEQ ID NO: 856766 - RNA, 22 nt, Human
augcacaagcaagagauaaugg

SEQ ID NO: 856767 - RNA, 17 nt, Human
caaggccagcaucuuca

SEQ ID NO: 856768 - RNA, 22 nt, Human
gagguagcgaguggacagugca

SEQ ID NO: 856769 - RNA, 22 nt, Human
agcccaggcagagggaugcuug

SEQ ID NO: 856770 - RNA, 22 nt, Human
uaguccuugguaaaauucuaug

SEQ ID NO: 856771 - RNA, 22 nt, Human
uucucagauauuuacugagcau

SEQ ID NO: 856772 - RNA, 23 nt, Human
uaauacugcuucagaggcuuaga

SEQ ID NO: 856773 - RNA, 22 nt, Human
uugggcucaggaguuugagacc

SEQ ID NO: 856774 - RNA, 22 nt, Human
cccaggagagagacuugaaucu

SEQ ID NO: 856775 - RNA, 22 nt, Human
ucuaaccuuugaaacugcuuuc

SEQ ID NO: 856776 - RNA, 22 nt, Human
ucuuuguaaaugccuagcauaa

SEQ ID NO: 856777 - RNA, 22 nt, Human
cuucucagucaccugugagucu

SEQ ID NO: 856778 - RNA, 22 nt, Human
aggcagcuuucuguaggggugu

SEQ ID NO: 856779 - RNA, 22 nt, Human
uuuguaugugauaagacuauuc

SEQ ID NO: 856780 - RNA, 22 nt, Human
cuggcuuucccuggacaacagc

SEQ ID NO: 856781 - RNA, 22 nt, Human
cccaggagguagagguugcagu

SEQ ID NO: 856782 - RNA, 22 nt, Human
ugaggggaacugaugcccauug

SEQ ID NO: 856783 - RNA, 22 nt, Human
cagaauguagaucaucaucaag

SEQ ID NO: 856784 - RNA, 22 nt, Human
cagagccaggucuaggagucuc

SEQ ID NO: 856785 - RNA, 22 nt, Human
aguggacucuucccagugcuug

SEQ ID NO: 856786 - RNA, 19 nt, Human
uucauucuuucuacuuacc

SEQ ID NO: 856787 - RNA, 22 nt, Human
gaauuucaggacaacuggaagg

SEQ ID NO: 856788 - RNA, 22 nt, Human
uuccauaauaaccugagagaaa

SEQ ID NO: 856789 - RNA, 22 nt, Human
guuugcauuuauuagucuucug

SEQ ID NO: 856790 - RNA, 22 nt, Human
cugccaucugagccaaaagugc

SEQ ID NO: 856791 - RNA, 22 nt, Human
gaauuucaagcagugcaauguu

SEQ ID NO: 856792 - RNA, 22 nt, Human
guugaaagagcauggacuugaa

SEQ ID NO: 856793 - RNA, 21 nt, Human
agagagggagaugaaacaucc

SEQ ID NO: 856794 - RNA, 23 nt, Human
acuuuauugaccccaggucaguu

SEQ ID NO: 856795 - RNA, 22 nt, Human
gcuuuaaugaagucacgcaaag

SEQ ID NO: 856796 - RNA, 22 nt, Human
gcuuuuauugucuuuacgacga

SEQ ID NO: 856797 - RNA, 22 nt, Human
uagcucuucaaucacugucucc

SEQ ID NO: 856798 - RNA, 22 nt, Human
uuucaaacauaucuucauuacu

SEQ ID NO: 856799 - RNA, 22 nt, Human
augguuuauugcuuuaaugaaa

SEQ ID NO: 856800 - RNA, 22 nt, Human
gauagaaagagugguucuuuuu

SEQ ID NO: 856801 - RNA, 22 nt, Human
ggaaaugacuuggugcuucguu

SEQ ID NO: 856802 - RNA, 22 nt, Human
cauuuucaugaguuucuguuca

SEQ ID NO: 856803 - RNA, 22 nt, Human
uacaugaaguugucuaaacugg

SEQ ID NO: 856804 - RNA, 22 nt, Human
ggaggggagguccagcugaucu

SEQ ID NO: 856805 - RNA, 22 nt, Human
uggcauuugcucccuuguguuc

SEQ ID NO: 856806 - RNA, 22 nt, Human
uccaggagaccagauguaggcc

SEQ ID NO: 856807 - RNA, 22 nt, Human
ucgagcucuggagccaaggaug

SEQ ID NO: 856808 - RNA, 22 nt, Human
ccugcugugaagccaggccugu

SEQ ID NO: 856809 - RNA, 17 nt, Human
uuucuccuuccaucuca

SEQ ID NO: 856810 - RNA, 22 nt, Human
gcuccucugucaaaugagagug

SEQ ID NO: 856811 - RNA, 22 nt, Human
aaauguuuugcucccauguggu

SEQ ID NO: 856812 - RNA, 22 nt, Human
caguucuuaauaccaugugguu

SEQ ID NO: 856813 - RNA, 23 nt, Human
ggagaggggugugggcaucuuua

SEQ ID NO: 856814 - RNA, 22 nt, Human
cagcagaggcacgucugugaau

SEQ ID NO: 856815 - RNA, 22 nt, Human
ccacuguuuuucaguuaacuuu

SEQ ID NO: 856816 - RNA, 22 nt, Human
aguuugaauugaaaugcagaug

SEQ ID NO: 856817 - RNA, 22 nt, Human
cuguggaaaauuuguauguaau

SEQ ID NO: 856818 - RNA, 22 nt, Human
gaccaaggaagaggggagccag

SEQ ID NO: 856819 - RNA, 22 nt, Human
uuucuagggcucuugucuucug

SEQ ID NO: 856820 - RNA, 22 nt, Human
uucugggacaucuggacaguuu

SEQ ID NO: 856821 - RNA, 22 nt, Human
ugaaaagacugcaagagagcau

SEQ ID NO: 856822 - RNA, 22 nt, Human
augcuguggaugccuugcccca

SEQ ID NO: 856823 - RNA, 22 nt, Human
aauacugagaucccacaaagca

SEQ ID NO: 856824 - RNA, 22 nt, Human
aggcagcuggacauaacuaacc

SEQ ID NO: 856825 - RNA, 20 nt, Human
uacagaaugcaauaaaaugg

SEQ ID NO: 856826 - RNA, 22 nt, Human
aggcagcuggcagcacccaggg

SEQ ID NO: 856827 - RNA, 22 nt, Human
cggcagcugauugcagagcacc

SEQ ID NO: 856828 - RNA, 22 nt, Human
ucuucaaguuccaaagugcagg

SEQ ID NO: 856829 - RNA, 22 nt, Human
cauucuuauauuuacucauuca

SEQ ID NO: 856830 - RNA, 22 nt, Human
cuuugcaauagaggcacacaug

SEQ ID NO: 856831 - RNA, 22 nt, Human
cugaacuuauugagugcuugcu

SEQ ID NO: 856832 - RNA, 22 nt, Human
acccaggauagagugcugcagu

SEQ ID NO: 856833 - RNA, 22 nt, Human
gaguccuuuugugccacaggga

SEQ ID NO: 856834 - RNA, 22 nt, Human
uguaacaaaauaccuuggauug

SEQ ID NO: 856835 - RNA, 22 nt, Human
aaggcaguacuuuauguccaua

SEQ ID NO: 856836 - RNA, 22 nt, Human
ucauuuguugcuguuaccugag

SEQ ID NO: 856837 - RNA, 22 nt, Human
aagauauagauaaaacuaugca

SEQ ID NO: 856838 - RNA, 22 nt, Human
gagggagggacuagcauucucu

SEQ ID NO: 856839 - RNA, 22 nt, Human
agggggugcccagaugaaggau

SEQ ID NO: 856840 - RNA, 22 nt, Human
aauauuucugcagaaugguuuu

SEQ ID NO: 856841 - RNA, 22 nt, Human
cauaauauacuacauugaugaa

SEQ ID NO: 856842 - RNA, 22 nt, Human
gauuucaaagguucugcaugcc

SEQ ID NO: 856843 - RNA, 20 nt, Human
ucuuauacagaaaacauuuu

SEQ ID NO: 856844 - RNA, 22 nt, Human
gcagaggagaugaagauacuuu

SEQ ID NO: 856845 - RNA, 22 nt, Human
auguggaggaaaugaguguaca

SEQ ID NO: 856846 - RNA, 22 nt, Human
uaauuucacaguucaacgcaca

SEQ ID NO: 856847 - RNA, 22 nt, Human
ccagcagaggggcggagugcag

SEQ ID NO: 856848 - RNA, 22 nt, Human
aggccagacagcuagaaacagg

SEQ ID NO: 856849 - RNA, 22 nt, Human
uucucagauccaucagaagucc

SEQ ID NO: 856850 - RNA, 22 nt, Human
ccacagagacaggguccuugcu

SEQ ID NO: 856851 - RNA, 22 nt, Human
gagcagcucugggugacccagu

SEQ ID NO: 856852 - RNA, 22 nt, Human
auggauuuggaugagauuacuu

SEQ ID NO: 856853 - RNA, 22 nt, Human
aagcaccucuaugauugcuuuu

SEQ ID NO: 856854 - RNA, 22 nt, Human
caggcagccuucucgucucaca

SEQ ID NO: 856855 - RNA, 22 nt, Human
ccucaggauacaggagccacag

SEQ ID NO: 856856 - RNA, 22 nt, Human
auuccaaagcacaucagaacua

SEQ ID NO: 856857 - RNA, 22 nt, Human
ucaagugcuugugagguauuug

SEQ ID NO: 856858 - RNA, 22 nt, Human
uuucaguuuaugucuugaauua

SEQ ID NO: 856859 - RNA, 22 nt, Human
uccaggaggugaggggaccaaa

SEQ ID NO: 856860 - RNA, 22 nt, Human
uugaauaguuuuggauagcaua

SEQ ID NO: 856861 - RNA, 22 nt, Human
uccauguguuuuccuguccaca

SEQ ID NO: 856862 - RNA, 23 nt, Human
aaauuauugcucuucaauugccu

SEQ ID NO: 856863 - RNA, 18 nt, Human
gaaagccaugcagcagug

SEQ ID NO: 856864 - RNA, 22 nt, Human
uuuaaugaauaauucaaaucug

SEQ ID NO: 856865 - RNA, 22 nt, Human
cugaauaauuuuauaguugcug

SEQ ID NO: 856866 - RNA, 22 nt, Human
uacagcuaggcaaaaaugacau

SEQ ID NO: 856867 - RNA, 22 nt, Human
auacaaauuuauagaugcauuu

SEQ ID NO: 856868 - RNA, 22 nt, Human
ucauuuaauaauuuuugaguag

SEQ ID NO: 856869 - RNA, 22 nt, Human
ucaggaugagcucauaacuaug

SEQ ID NO: 856870 - RNA, 22 nt, Human
uagugcuuuaggccugaguguc

SEQ ID NO: 856871 - RNA, 22 nt, Human
uuuccaaaggcuaaacucaguu

SEQ ID NO: 856872 - RNA, 22 nt, Human
aggagggagcuuaagccaggca

SEQ ID NO: 856873 - RNA, 22 nt, Human
cacaaauggccguguucaaaga

SEQ ID NO: 856874 - RNA, 22 nt, Human
acucaggaaaaauguagugaua

SEQ ID NO: 856875 - RNA, 22 nt, Human
ugaaaugauaucugauaacaaa

SEQ ID NO: 856876 - RNA, 22 nt, Human
gcaggagacaacuguaaggaga

SEQ ID NO: 856877 - RNA, 22 nt, Human
uuacagaacugucuugaaauuu

SEQ ID NO: 856878 - RNA, 22 nt, Human
auuguauaacagcauguauuuu

SEQ ID NO: 856879 - RNA, 22 nt, Human
uuuuccaaaguaccaugucccu

SEQ ID NO: 856880 - RNA, 22 nt, Human
uggaguuccuuugaaaggcucu

SEQ ID NO: 856881 - RNA, 22 nt, Human
uuuaagauucaguaaggcaaac

SEQ ID NO: 856882 - RNA, 22 nt, Human
guuccaaagcaaaggaggugag

SEQ ID NO: 856883 - RNA, 22 nt, Human
gucuauauauugcuugaauaau

SEQ ID NO: 856884 - RNA, 22 nt, Human
augcagcugugggcaagaaaug

SEQ ID NO: 856885 - RNA, 22 nt, Human
acaacuuucuggguuaucugau

SEQ ID NO: 856886 - RNA, 20 nt, Human
ccacaggaguccagucgacc

SEQ ID NO: 856887 - RNA, 21 nt, Human
uuuaaagaauaggaagggagg

SEQ ID NO: 856888 - RNA, 22 nt, Human
aaaagccaagguccucuucaga

SEQ ID NO: 856889 - RNA, 22 nt, Human
ugugaacuggcagguggacggg

SEQ ID NO: 856890 - RNA, 22 nt, Human
ugcugcuguuuccuacaucuca

SEQ ID NO: 856891 - RNA, 22 nt, Human
cagauuucagcucauauauuau

SEQ ID NO: 856892 - RNA, 22 nt, Human
gcaaaauuuacacuccuucuuc

SEQ ID NO: 856893 - RNA, 22 nt, Human
cagaauuuaaguggauuauucu

SEQ ID NO: 856894 - RNA, 22 nt, Human
aggcaggcugcuauggaguaga

SEQ ID NO: 856895 - RNA, 22 nt, Human
agaugaaaagauaagcagcaau

SEQ ID NO: 856896 - RNA, 22 nt, Human
gaguccuugucauaauucagug

SEQ ID NO: 856897 - RNA, 22 nt, Human
aagaagagaacuggcauccuaa

SEQ ID NO: 856898 - RNA, 22 nt, Human
agagagggcauagaaaaaggga

SEQ ID NO: 856899 - RNA, 22 nt, Human
agaucauaugaaaaauuucaag

SEQ ID NO: 856900 - RNA, 22 nt, Human
auauccaagaaacaauuaauuc

SEQ ID NO: 856901 - RNA, 22 nt, Human
uaggcagcgcuuggcugugcuu

SEQ ID NO: 856902 - RNA, 22 nt, Human
uaguccuuuaauaguuaaugug

SEQ ID NO: 856903 - RNA, 22 nt, Human
ucucucagaggaagaggcagug

SEQ ID NO: 856904 - RNA, 22 nt, Human
uuagccauuaauguccugugca

SEQ ID NO: 856905 - RNA, 22 nt, Human
gcacaauaauuuuuuuaagagg

SEQ ID NO: 856906 - RNA, 22 nt, Human
uagugcuuaacacaaagugauu

SEQ ID NO: 856907 - RNA, 22 nt, Human
ucagaauuugauuccugggaua

SEQ ID NO: 856908 - RNA, 22 nt, Human
ucagccagugccuugaucuugc

SEQ ID NO: 856909 - RNA, 22 nt, Human
agauggcagggguaccuggaag

SEQ ID NO: 856910 - RNA, 22 nt, Human
cagaaauaaacuucucacaucg

SEQ ID NO: 856911 - RNA, 22 nt, Human
gcagaggccaggccaccagcaa

SEQ ID NO: 856912 - RNA, 22 nt, Human
ucacugcugcugccaugaugga

SEQ ID NO: 856913 - RNA, 22 nt, Human
cuugaaagucacaugcagcccu

SEQ ID NO: 856914 - RNA, 22 nt, Human
uguaaauaaugcauguaaauca

SEQ ID NO: 856915 - RNA, 21 nt, Human
acaggagaccgccuggcaguc

SEQ ID NO: 856916 - RNA, 22 nt, Human
caguccuucuccauuaaggcuc

SEQ ID NO: 856917 - RNA, 22 nt, Human
agaccauagggaccucagguug

SEQ ID NO: 856918 - RNA, 22 nt, Human
cagcagaggugguucacauugu

SEQ ID NO: 856919 - RNA, 22 nt, Human
uuugaaaguguuuacuugggaa

SEQ ID NO: 856920 - RNA, 22 nt, Human
ccagaucuaguguuguaaagcu

SEQ ID NO: 856921 - RNA, 22 nt, Human
aaucagaaaauucaguggaauu

SEQ ID NO: 856922 - RNA, 22 nt, Human
aggcagcaugggcccagagucc

SEQ ID NO: 856923 - RNA, 18 nt, Human
agggagagaccgcggguc

SEQ ID NO: 856924 - RNA, 22 nt, Human
uauccaaacauauagucucucu

SEQ ID NO: 856925 - RNA, 22 nt, Human
gcagagcuccccaagacaccaa

SEQ ID NO: 856926 - RNA, 22 nt, Human
acaugcuuuucccacaauuaua

SEQ ID NO: 856927 - RNA, 22 nt, Human
aaggacagggaugguugauugu

SEQ ID NO: 856928 - RNA, 22 nt, Human
cagcaggaccauugaggcauca

SEQ ID NO: 856929 - RNA, 22 nt, Human
aucugccucuucuucauugcga

SEQ ID NO: 856930 - RNA, 22 nt, Human
caguccuuggcuucauccgagu

SEQ ID NO: 856931 - RNA, 22 nt, Human
uguugaagauaaaguucucauu

SEQ ID NO: 856932 - RNA, 22 nt, Human
uaggcagccagcaucaguuggg

SEQ ID NO: 856933 - RNA, 22 nt, Human
gaaaggugccccauaggcagga

SEQ ID NO: 856934 - RNA, 22 nt, Human
gcuggaucaaguccuucaccca

SEQ ID NO: 856935 - RNA, 22 nt, Human
cagcugacgccagaguggaauu

SEQ ID NO: 856936 - RNA, 22 nt, Human
acaugcuuguuuuucacaaccu

SEQ ID NO: 856937 - RNA, 22 nt, Human
cccaggaaaugggcucuugccu

SEQ ID NO: 856938 - RNA, 22 nt, Human
aaguccuuucucauggaggaau

SEQ ID NO: 856939 - RNA, 22 nt, Human
aaggcaguaggaucuuccacag

SEQ ID NO: 856940 - RNA, 22 nt, Human
aaagcagauucugaugcaguag

SEQ ID NO: 856941 - RNA, 21 nt, Human
ucaguaaaccuaaagauugua

SEQ ID NO: 856942 - RNA, 22 nt, Human
augaauaaaacauuuuaaucag

SEQ ID NO: 856943 - RNA, 22 nt, Human
cucuacucuuaacacagcuagg

SEQ ID NO: 856944 - RNA, 22 nt, Human
ucuuucaaugagcauucuuucc

SEQ ID NO: 856945 - RNA, 22 nt, Human
ugcuuuaagacacuaaguuuga

SEQ ID NO: 856946 - RNA, 22 nt, Human
gaaggccacaagagaaguuaag

SEQ ID NO: 856947 - RNA, 20 nt, Human
aucuucuuggccagcuugcu

SEQ ID NO: 856948 - RNA, 22 nt, Human
ucacccuugauaauguucuucu

SEQ ID NO: 856949 - RNA, 22 nt, Human
ccccaggagaaaucuuaaacua

SEQ ID NO: 856950 - RNA, 22 nt, Human
aggaggggcauagaaauguaau

SEQ ID NO: 856951 - RNA, 22 nt, Human
aaucuucuacuugacaguucuc

SEQ ID NO: 856952 - RNA, 22 nt, Human
augcuuuaaacuauaaauccac

SEQ ID NO: 856953 - RNA, 22 nt, Human
gccaggagaaaaggcgaaugau

SEQ ID NO: 856954 - RNA, 22 nt, Human
ggcagcuuguccuucaggagag

SEQ ID NO: 856955 - RNA, 22 nt, Human
agggagcucaguuggaagcggu

SEQ ID NO: 856956 - RNA, 22 nt, Human
caguuuuugccauuaagaguaa

SEQ ID NO: 856957 - RNA, 20 nt, Human
aguuauaguaucuagccaug

SEQ ID NO: 856958 - RNA, 22 nt, Human
aggauuuauuggugggaaguua

SEQ ID NO: 856959 - RNA, 22 nt, Human
agaggccaggcugcagagggau

SEQ ID NO: 856960 - RNA, 22 nt, Human
aucugccugagucuagguuuuc

SEQ ID NO: 856961 - RNA, 22 nt, Human
uguaaauaguuagcuugccucu

SEQ ID NO: 856962 - RNA, 22 nt, Human
gcagggaagacccggagcagcg

SEQ ID NO: 856963 - RNA, 22 nt, Human
uaggcagaauuguugaaugaag

SEQ ID NO: 856964 - RNA, 22 nt, Human
aggacagcaguuggugagguuc

SEQ ID NO: 856965 - RNA, 22 nt, Human
aucuugcauuugcuaaaaugca

SEQ ID NO: 856966 - RNA, 22 nt, Human
aggcagauuacuugaggccagg

SEQ ID NO: 856967 - RNA, 22 nt, Human
uaggcagcugcaaacuucgguc

SEQ ID NO: 856968 - RNA, 22 nt, Human
uuccuuaguuauuugguccccu

SEQ ID NO: 856969 - RNA, 22 nt, Human
uauucaaaguaccuucauugcc

SEQ ID NO: 856970 - RNA, 22 nt, Human
cucugcauuuuaacagaugauu

SEQ ID NO: 856971 - RNA, 21 nt, Human
cagcagaguaaugcauucgua

SEQ ID NO: 856972 - RNA, 22 nt, Human
guuugcauauuugcacaggaau

SEQ ID NO: 856973 - RNA, 22 nt, Human
ucaguaaaugaaugaauauaug

SEQ ID NO: 856974 - RNA, 22 nt, Human
uuugaaaggaaguuaauacuuu

SEQ ID NO: 856975 - RNA, 22 nt, Human
cuagaaauguagauucuuagug

SEQ ID NO: 856976 - RNA, 22 nt, Human
ugucuuuggaauauuuagcuga

SEQ ID NO: 856977 - RNA, 22 nt, Human
caguucuuauuuggccaguguc

SEQ ID NO: 856978 - RNA, 22 nt, Human
ccaggagagcaaaggucacucu

SEQ ID NO: 856979 - RNA, 22 nt, Human
uuagaaaucaccucugaagauc

SEQ ID NO: 856980 - RNA, 22 nt, Human
cugcugugcuuguggccacccg

SEQ ID NO: 856981 - RNA, 19 nt, Human
auacagauguauccaugau

SEQ ID NO: 856982 - RNA, 22 nt, Human
uuucaacaccagagaccaugcg

SEQ ID NO: 856983 - RNA, 22 nt, Human
cuuguccccagcagguugguuu

SEQ ID NO: 856984 - RNA, 22 nt, Human
aaacaaacaauuaguugugugg

SEQ ID NO: 856985 - RNA, 23 nt, Human
cagaaauaaacugguuuguagau

SEQ ID NO: 856986 - RNA, 22 nt, Human
uggcuuuacaucaaauugagua

SEQ ID NO: 856987 - RNA, 22 nt, Human
uucuccagaccuugugacuaug

SEQ ID NO: 856988 - RNA, 20 nt, Human
aggaggggauagaaucaaag

SEQ ID NO: 856989 - RNA, 22 nt, Human
auacagaacucucaguuguaua

SEQ ID NO: 856990 - RNA, 22 nt, Human
cccaggaagaaauucugauuug

SEQ ID NO: 856991 - RNA, 22 nt, Human
auugcuguacacuucuagaucu

SEQ ID NO: 856992 - RNA, 22 nt, Human
gcuguggucugugagcuccaaa

SEQ ID NO: 856993 - RNA, 21 nt, Human
agaauaaugguaucauuugcu

SEQ ID NO: 856994 - RNA, 22 nt, Human
caaggccaagucucugugaaga

SEQ ID NO: 856995 - RNA, 22 nt, Human
ccagagagaaauggauuugagu

SEQ ID NO: 856996 - RNA, 22 nt, Human
cuguuaauugugaauuuuacau

SEQ ID NO: 856997 - RNA, 22 nt, Human
cagucaccugaagacuugacca

SEQ ID NO: 856998 - RNA, 22 nt, Human
auggauuugcuuauacacaugu

SEQ ID NO: 856999 - RNA, 22 nt, Human
aauuucaaacucuugcccucag

SEQ ID NO: 857000 - RNA, 22 nt, Human
uuucacauuagauaugucauuu

SEQ ID NO: 857001 - RNA, 22 nt, Human
gaaucucaaggcuugugaggau

SEQ ID NO: 857002 - RNA, 22 nt, Human
caucauaaaauugagauaacug

SEQ ID NO: 857003 - RNA, 22 nt, Human
agaaagcaucuccauuguaggu

SEQ ID NO: 857004 - RNA, 22 nt, Human
ggaggggaacuaaucccgugac

SEQ ID NO: 857005 - RNA, 22 nt, Human
gaggcagugcauugucuagggg

SEQ ID NO: 857006 - RNA, 22 nt, Human
cugagagugcucuuugauguca

SEQ ID NO: 857007 - RNA, 20 nt, Human
agagcagcaguuggugaggu

SEQ ID NO: 857008 - RNA, 19 nt, Human
cuuugucagaacaugcuuc

SEQ ID NO: 857009 - RNA, 23 nt, Human
cccaggaguuucacugcaaaggu

SEQ ID NO: 857010 - RNA, 17 nt, Human
uccauacaauucucucu

SEQ ID NO: 857011 - RNA, 22 nt, Human
caggcagcccugcaccaagugu

SEQ ID NO: 857012 - RNA, 22 nt, Human
agauuuacugagaacugauuac

SEQ ID NO: 857013 - RNA, 22 nt, Human
accaggaggaaguguuaaugau

SEQ ID NO: 857014 - RNA, 22 nt, Human
gaauagcuuccuuuuuuccaaa

SEQ ID NO: 857015 - RNA, 22 nt, Human
uggcaucucaaacaggcagauu

SEQ ID NO: 857016 - RNA, 22 nt, Human
cccaggaaagagacugcugggu

SEQ ID NO: 857017 - RNA, 22 nt, Human
gccuuaauuuaugucuaacaua

SEQ ID NO: 857018 - RNA, 22 nt, Human
ccuggagaccagaggauacuuc

SEQ ID NO: 857019 - RNA, 22 nt, Human
uuccugagggacuuuugagauu

SEQ ID NO: 857020 - RNA, 22 nt, Human
ucauuuguggaagugauugugg

SEQ ID NO: 857021 - RNA, 22 nt, Human
uuuuaucuaccuaugcucauuu

SEQ ID NO: 857022 - RNA, 22 nt, Human
ggagcugugcagugacuacaga

SEQ ID NO: 857023 - RNA, 22 nt, Human
gagaggucaucucccaucagca

SEQ ID NO: 857024 - RNA, 22 nt, Human
aacauauaaacucuuaaguuca

SEQ ID NO: 857025 - RNA, 22 nt, Human
uucaggaugcagagguuguagu

SEQ ID NO: 857026 - RNA, 22 nt, Human
uuaucacuuaugagcuuuuugc

SEQ ID NO: 857027 - RNA, 22 nt, Human
caaagauuuuagaauuugcaau

SEQ ID NO: 857028 - RNA, 22 nt, Human
uggcagagugcagaagaggcau

SEQ ID NO: 857029 - RNA, 22 nt, Human
uagauuuuacuucugucauuac

SEQ ID NO: 857030 - RNA, 22 nt, Human
auucauuugcuauuguguaugg

SEQ ID NO: 857031 - RNA, 22 nt, Human
uauacagucuuuugcuauauuc

SEQ ID NO: 857032 - RNA, 22 nt, Human
agccagcucccuccccugcagg

SEQ ID NO: 857033 - RNA, 22 nt, Human
aucaggaugcugucaguuacca

SEQ ID NO: 857034 - RNA, 22 nt, Human
auuucccaugugaaucaauugg

SEQ ID NO: 857035 - RNA, 22 nt, Human
ucuauacaugugcacacacauc

SEQ ID NO: 857036 - RNA, 21 nt, Human
agcagaggggacauguuugau

SEQ ID NO: 857037 - RNA, 22 nt, Human
acagaguucccacuccagaagc

SEQ ID NO: 857038 - RNA, 22 nt, Human
cccaggagauggugcguggucu

SEQ ID NO: 857039 - RNA, 22 nt, Human
cugcugugugcuuacuuggguu

SEQ ID NO: 857040 - RNA, 22 nt, Human
cucccagagaccaagcugagaa

SEQ ID NO: 857041 - RNA, 22 nt, Human
acaacuuuucuaucauguggaa

SEQ ID NO: 857042 - RNA, 22 nt, Human
ucacacagauugguagagcuga

SEQ ID NO: 857043 - RNA, 23 nt, Human
cuuugccacccagagccugacag

SEQ ID NO: 857044 - RNA, 22 nt, Human
cagaggaugaucuggccucucu

SEQ ID NO: 857045 - RNA, 22 nt, Human
augugcuuguaauguuaaaugu

SEQ ID NO: 857046 - RNA, 20 nt, Human
cugagagucugugcuuaguc

SEQ ID NO: 857047 - RNA, 22 nt, Human
cuucucagaggccagaagcuau

SEQ ID NO: 857048 - RNA, 22 nt, Human
gcuccucuauuccccacauuuu

SEQ ID NO: 857049 - RNA, 22 nt, Human
ccagauuugagcgucuuaaacc

SEQ ID NO: 857050 - RNA, 21 nt, Human
uuuuauugaugaauggccacu

SEQ ID NO: 857051 - RNA, 22 nt, Human
ugccugugguuccaguuuuuuc

SEQ ID NO: 857052 - RNA, 22 nt, Human
ugcugcugauggcaccuaggca

SEQ ID NO: 857053 - RNA, 22 nt, Human
acaugaaaaauguuugcaguuu

SEQ ID NO: 857054 - RNA, 22 nt, Human
uaggcagcuuagguuagaagug

SEQ ID NO: 857055 - RNA, 22 nt, Human
ccaggcagcaaauuuucugaau

SEQ ID NO: 857056 - RNA, 22 nt, Human
gggcagcugucuugguucucaa

SEQ ID NO: 857057 - RNA, 22 nt, Human
caaauauuccagguacaucccu

SEQ ID NO: 857058 - RNA, 22 nt, Human
uaaauuauggcuggcagagcag

SEQ ID NO: 857059 - RNA, 22 nt, Human
caaagccauagaguagauaaga

SEQ ID NO: 857060 - RNA, 22 nt, Human
ucauuuauaaggaugcaauuaa

SEQ ID NO: 857061 - RNA, 22 nt, Human
uuaaaauagccagugccccucu

SEQ ID NO: 857062 - RNA, 22 nt, Human
gucuucuuuaaccuacuaaagc

SEQ ID NO: 857063 - RNA, 22 nt, Human
uucuuuucuuuaggcauugugu

SEQ ID NO: 857064 - RNA, 22 nt, Human
uugcauuuuuagaugcuucugu

SEQ ID NO: 857065 - RNA, 22 nt, Human
uuucugugguggguaguucaga

SEQ ID NO: 857066 - RNA, 22 nt, Human
uaucuguuccaggcacucagcu

SEQ ID NO: 857067 - RNA, 22 nt, Human
auuugcuuuaagguauaaaagg

SEQ ID NO: 857068 - RNA, 22 nt, Human
aucaggauguuuggcugucaua

SEQ ID NO: 857069 - RNA, 22 nt, Human
cccaggaagagugaguggcauu

SEQ ID NO: 857070 - RNA, 21 nt, Human
uugaaaguaaauucagcagcu

SEQ ID NO: 857071 - RNA, 22 nt, Human
aguacaaugucugacacaguag

SEQ ID NO: 857072 - RNA, 22 nt, Human
ugcacauuaguguuugagaugc

SEQ ID NO: 857073 - RNA, 19 nt, Human
aaucagaaauaucgaggcc

SEQ ID NO: 857074 - RNA, 22 nt, Human
gaggcagccagagguucucauu

SEQ ID NO: 857075 - RNA, 22 nt, Human
acacacucaauugcauaagcac

SEQ ID NO: 857076 - RNA, 22 nt, Human
aacaguaaagacagaauuuauc

SEQ ID NO: 857077 - RNA, 17 nt, Human
uccaggagaggcaaugg

SEQ ID NO: 857078 - RNA, 18 nt, Human
gagagggaucccucagga

SEQ ID NO: 857079 - RNA, 23 nt, Human
uaucagugugaugaggcugcugc

SEQ ID NO: 857080 - RNA, 22 nt, Human
agggcagccauugagggauucu

SEQ ID NO: 857081 - RNA, 23 nt, Human
uggcaaggaaugggauggagacu

SEQ ID NO: 857082 - RNA, 19 nt, Human
guugaaaguaggugagggu

SEQ ID NO: 857083 - RNA, 22 nt, Human
cccagcaggaggagguugcagu

SEQ ID NO: 857084 - RNA, 22 nt, Human
agacaacaucacuaaagcugag

SEQ ID NO: 857085 - RNA, 22 nt, Human
gaguccuuaauacacuggugga

SEQ ID NO: 857086 - RNA, 22 nt, Human
ggguggaguagaaagaugaauu

SEQ ID NO: 857087 - RNA, 22 nt, Human
ugccaggauggccagggggcca

SEQ ID NO: 857088 - RNA, 22 nt, Human
ggcagcuuucucacccaugacc

SEQ ID NO: 857089 - RNA, 22 nt, Human
uucauacuaaaguguaagaugu

SEQ ID NO: 857090 - RNA, 22 nt, Human
cccaggaaaagcagugccagca

SEQ ID NO: 857091 - RNA, 22 nt, Human
aagacugugucuauggcuacuc

SEQ ID NO: 857092 - RNA, 22 nt, Human
aucaggaucacagaaacuuuua

SEQ ID NO: 857093 - RNA, 22 nt, Human
uugcuagcugguguaugcauug

SEQ ID NO: 857094 - RNA, 22 nt, Human
uaaggccagccagcaaaucugu

SEQ ID NO: 857095 - RNA, 22 nt, Human
caggacagagcccagacugugu

SEQ ID NO: 857096 - RNA, 22 nt, Human
aguauugugacucaaguauucu

SEQ ID NO: 857097 - RNA, 22 nt, Human
uaucuuguaauagguccacuug

SEQ ID NO: 857098 - RNA, 22 nt, Human
uccaggaggguuuucugccuuc

SEQ ID NO: 857099 - RNA, 22 nt, Human
uggagaggaaagugcaguuuug

SEQ ID NO: 857100 - RNA, 22 nt, Human
augcagcugucagggagaacau

SEQ ID NO: 857101 - RNA, 22 nt, Human
agacagcuaauaaaugagugug

SEQ ID NO: 857102 - RNA, 22 nt, Human
aaugaaaauuggacccuagaac

SEQ ID NO: 857103 - RNA, 22 nt, Human
gaagaaucugaggacagucauu

SEQ ID NO: 857104 - RNA, 22 nt, Human
acaggccacaguggagucucug

SEQ ID NO: 857105 - RNA, 22 nt, Human
cuggaucaugcauugcuugucc

SEQ ID NO: 857106 - RNA, 22 nt, Human
ccauuucacucuuccugaagga

SEQ ID NO: 857107 - RNA, 22 nt, Human
caguccuuagauuuuacugcca

SEQ ID NO: 857108 - RNA, 22 nt, Human
gauauuuugagaaauccuauga

SEQ ID NO: 857109 - RNA, 22 nt, Human
aggcagcuaagauggauaauga

SEQ ID NO: 857110 - RNA, 22 nt, Human
uugcugugucugauggcugaga

SEQ ID NO: 857111 - RNA, 22 nt, Human
uggaauaaagugcuuugaucag

SEQ ID NO: 857112 - RNA, 22 nt, Human
agggagcuuccgaacuacagcu

SEQ ID NO: 857113 - RNA, 22 nt, Human
gaagcagccacggggagacaga

SEQ ID NO: 857114 - RNA, 21 nt, Human
ucucugguuggaguugugcca

SEQ ID NO: 857115 - RNA, 22 nt, Human
caguugcuggaugugcagcucu

SEQ ID NO: 857116 - RNA, 22 nt, Human
cugugauuguuaguuccuauac

SEQ ID NO: 857117 - RNA, 22 nt, Human
agcuucuuggcucagcacuugg

SEQ ID NO: 857118 - RNA, 22 nt, Human
ccaguacugucuccaauauucc

SEQ ID NO: 857119 - RNA, 19 nt, Human
uuugaaaggauuguuauuu

SEQ ID NO: 857120 - RNA, 22 nt, Human
ccuggaucuaaggaagcuggga

SEQ ID NO: 857121 - RNA, 22 nt, Human
uuaaauauuuucagcaggguca

SEQ ID NO: 857122 - RNA, 22 nt, Human
accaggagccacaggaggagcc

SEQ ID NO: 857123 - RNA, 22 nt, Human
uuucucuguucucuaacuguaa

SEQ ID NO: 857124 - RNA, 22 nt, Human
agggcaguucaacuucauagug

SEQ ID NO: 857125 - RNA, 22 nt, Human
agaggcaggaagagcugauuuu

SEQ ID NO: 857126 - RNA, 22 nt, Human
cccuuagcuccaagggguuugg

SEQ ID NO: 857127 - RNA, 22 nt, Human
auagucuuagaucagauaaagu

SEQ ID NO: 857128 - RNA, 22 nt, Human
uuugacauuggcuuauucuguu

SEQ ID NO: 857129 - RNA, 22 nt, Human
caggaugaagggcaaaggcaag

SEQ ID NO: 857130 - RNA, 20 nt, Human
agaaucugacccagagagac

SEQ ID NO: 857131 - RNA, 22 nt, Human
ucuuuaauaucugccccagagc

SEQ ID NO: 857132 - RNA, 22 nt, Human
gaggcaguguuuacugcccugu

SEQ ID NO: 857133 - RNA, 22 nt, Human
aaauuucaagcaaaguagcuau

SEQ ID NO: 857134 - RNA, 22 nt, Human
ucauuauuuuggacuggagugu

SEQ ID NO: 857135 - RNA, 22 nt, Human
uggaggaaguugcuggaaguca

SEQ ID NO: 857136 - RNA, 22 nt, Human
ugaguucucacccauucuucuu

SEQ ID NO: 857137 - RNA, 19 nt, Human
uugaaagauuagcuuucua

SEQ ID NO: 857138 - RNA, 22 nt, Human
aaguguauauaugacuuauaaa

SEQ ID NO: 857139 - RNA, 19 nt, Human
ugccuggacaaaugugggg

SEQ ID NO: 857140 - RNA, 22 nt, Human
aauaucagcacuuuugugguau

SEQ ID NO: 857141 - RNA, 22 nt, Human
gagguagcaugcuggaagggac

SEQ ID NO: 857142 - RNA, 22 nt, Human
acagaauuugcuugggcaaugg

SEQ ID NO: 857143 - RNA, 22 nt, Human
cuggauuuaggacuaguccaag

SEQ ID NO: 857144 - RNA, 22 nt, Human
auauuauucuaguaacagugau

SEQ ID NO: 857145 - RNA, 19 nt, Human
ccauggagagagaugcauu

SEQ ID NO: 857146 - RNA, 22 nt, Human
uccaggagaaggccauccagcg

SEQ ID NO: 857147 - RNA, 22 nt, Human
guccucugaaguugugcaaugc

SEQ ID NO: 857148 - RNA, 22 nt, Human
aggccagcacgacagccgcagg

SEQ ID NO: 857149 - RNA, 22 nt, Human
guugaaaguagaugcuauuugg

SEQ ID NO: 857150 - RNA, 22 nt, Human
cagcagagcugggcuuugaauu

SEQ ID NO: 857151 - RNA, 22 nt, Human
aggcagcaugggccccagcucc

SEQ ID NO: 857152 - RNA, 22 nt, Human
acaagccaauuacugugccagg

SEQ ID NO: 857153 - RNA, 22 nt, Human
uccaggagagguagaggguucc

SEQ ID NO: 857154 - RNA, 22 nt, Human
cagauccacccuuguagugaca

SEQ ID NO: 857155 - RNA, 22 nt, Human
agugcagccgagaucaggugcu

SEQ ID NO: 857156 - RNA, 22 nt, Human
aaggcagcuuuaaaaaagaugc

SEQ ID NO: 857157 - RNA, 22 nt, Human
uuccuuaggcuguuugcagugc

SEQ ID NO: 857158 - RNA, 22 nt, Human
uuuccaaauaaggucacauucu

SEQ ID NO: 857159 - RNA, 22 nt, Human
aauaacuggcacauaucacaua

SEQ ID NO: 857160 - RNA, 22 nt, Human
gauugaaacauaggcagucgag

SEQ ID NO: 857161 - RNA, 22 nt, Human
caaggccacguucugcaugcgg

SEQ ID NO: 857162 - RNA, 22 nt, Human
uuucccagagguaugaauaagu

SEQ ID NO: 857163 - RNA, 21 nt, Human
auacagaagguggcaaaguac

SEQ ID NO: 857164 - RNA, 19 nt, Human
agaaguuagacauugcaau

SEQ ID NO: 857165 - RNA, 22 nt, Human
aauacauguuuucuacuauucu

SEQ ID NO: 857166 - RNA, 22 nt, Human
uccaugaggaccaaauucguag

SEQ ID NO: 857167 - RNA, 22 nt, Human
cagugguugguagauacuugag

SEQ ID NO: 857168 - RNA, 22 nt, Human
auucuucacauaagugcuguac

SEQ ID NO: 857169 - RNA, 22 nt, Human
cccaggaguuagagguuguggu

SEQ ID NO: 857170 - RNA, 22 nt, Human
aguacaauuuaaugaagauagc

SEQ ID NO: 857171 - RNA, 22 nt, Human
ucgcugugguuucuguacaugg

SEQ ID NO: 857172 - RNA, 21 nt, Human
aggucagcccagcucuggaag

SEQ ID NO: 857173 - RNA, 22 nt, Human
uucuucuucuggcugcaccugg

SEQ ID NO: 857174 - RNA, 22 nt, Human
ugaaaugaucaguuugguuacu

SEQ ID NO: 857175 - RNA, 20 nt, Human
cugcugugugugccucagcc

SEQ ID NO: 857176 - RNA, 22 nt, Human
ccucaggauccgcaggugcagu

SEQ ID NO: 857177 - RNA, 22 nt, Human
aggcagcugaggucuggcgccc

SEQ ID NO: 857178 - RNA, 22 nt, Human
cagaagucacccucagaauaac

SEQ ID NO: 857179 - RNA, 22 nt, Human
auauacaguuuuacaggguuuc

SEQ ID NO: 857180 - RNA, 22 nt, Human
uauuuuaucugccagaguggag

SEQ ID NO: 857181 - RNA, 22 nt, Human
aucaggaucugcaucauaagaa

SEQ ID NO: 857182 - RNA, 22 nt, Human
aaccauuugcaguuacugagac

SEQ ID NO: 857183 - RNA, 22 nt, Human
uaaggccaauuacauauguuca

SEQ ID NO: 857184 - RNA, 22 nt, Human
uuagaaaugucacagaucugau

SEQ ID NO: 857185 - RNA, 21 nt, Human
aaucauacaaaacaugucagg

SEQ ID NO: 857186 - RNA, 22 nt, Human
aaaguccugacugcaggggaug

SEQ ID NO: 857187 - RNA, 22 nt, Human
uauaucauggagauuaacauuc

SEQ ID NO: 857188 - RNA, 22 nt, Human
aucccaugagaccacguuggcu

SEQ ID NO: 857189 - RNA, 21 nt, Human
ccaggaaggacugagcucccu

SEQ ID NO: 857190 - RNA, 22 nt, Human
uugaagaaauuauuuuauauag

SEQ ID NO: 857191 - RNA, 22 nt, Human
gaggagcugggcugagaggguc

SEQ ID NO: 857192 - RNA, 22 nt, Human
uugguuuacuaggauucaaauu

SEQ ID NO: 857193 - RNA, 22 nt, Human
cugacagucucauugauuugcu

SEQ ID NO: 857194 - RNA, 22 nt, Human
uucaacuauuaugaauaaaauu

SEQ ID NO: 857195 - RNA, 22 nt, Human
uacacauguuuggcaaguaugu

SEQ ID NO: 857196 - RNA, 22 nt, Human
acuauacauugaauguuaaggu

SEQ ID NO: 857197 - RNA, 22 nt, Human
aaguccuuaggaagcagucguu

SEQ ID NO: 857198 - RNA, 22 nt, Human
aaaauugaggcucauguuaaau

SEQ ID NO: 857199 - RNA, 22 nt, Human
ucccaggagcaccuuuugagcc

SEQ ID NO: 857200 - RNA, 22 nt, Human
cagcagagaccaagugauuuga

SEQ ID NO: 857201 - RNA, 22 nt, Human
aucuaacacuguaaacugucuu

SEQ ID NO: 857202 - RNA, 22 nt, Human
ugcuugaaagggguuucccagu

SEQ ID NO: 857203 - RNA, 22 nt, Human
cagcugccccuccagggcuggg

SEQ ID NO: 857204 - RNA, 22 nt, Human
ggcacagagcccagcuuccuag

SEQ ID NO: 857205 - RNA, 22 nt, Human
gacccaggagagaggguugcau

SEQ ID NO: 857206 - RNA, 22 nt, Human
acauucuuaacaguuaaaaacu

SEQ ID NO: 857207 - RNA, 22 nt, Human
uuaaugauaccuauguuaauuu

SEQ ID NO: 857208 - RNA, 22 nt, Human
auccagucaaaauuaguaaggu

SEQ ID NO: 857209 - RNA, 22 nt, Human
caggcagaguuagagcaacugg

SEQ ID NO: 857210 - RNA, 22 nt, Human
cagagggcucuuggcugccugc

SEQ ID NO: 857211 - RNA, 22 nt, Human
caucagaacaaaucgguuaaga

SEQ ID NO: 857212 - RNA, 19 nt, Human
aacuggauaauggccacau

SEQ ID NO: 857213 - RNA, 22 nt, Human
ugcuuaauagugcacugguuuc

SEQ ID NO: 857214 - RNA, 22 nt, Human
ugaaugaacuaaaucauaguuc

SEQ ID NO: 857215 - RNA, 22 nt, Human
acaaaauuaugaagaggccuug

SEQ ID NO: 857216 - RNA, 22 nt, Human
agaccaugggcucugaagagca

SEQ ID NO: 857217 - RNA, 19 nt, Human
caguccuuuccgcuuucuc

SEQ ID NO: 857218 - RNA, 18 nt, Human
cucaccauucugcccaau

SEQ ID NO: 857219 - RNA, 23 nt, Human
cugcccugaucuugaucuauugu

SEQ ID NO: 857220 - RNA, 22 nt, Human
cagggaggcugucuuaugccug

SEQ ID NO: 857221 - RNA, 22 nt, Human
acaauguguuuuuauacauuug

SEQ ID NO: 857222 - RNA, 22 nt, Human
uagaaauguugguauuaacauu

SEQ ID NO: 857223 - RNA, 22 nt, Human
auaauucaugggccuuucaccu

SEQ ID NO: 857224 - RNA, 22 nt, Human
gcucucuugguggcuguccugg

SEQ ID NO: 857225 - RNA, 22 nt, Human
agucucugucguagaucagcgu

SEQ ID NO: 857226 - RNA, 19 nt, Human
cuauacagccucugaggaa

SEQ ID NO: 857227 - RNA, 22 nt, Human
aggcagcagucaugaggaaaga

SEQ ID NO: 857228 - RNA, 20 nt, Human
uacagacaugacaauaaugg

SEQ ID NO: 857229 - RNA, 22 nt, Human
cggaggggauacauuuucugaa

SEQ ID NO: 857230 - RNA, 20 nt, Human
gaguccuuaugggcugaggu

SEQ ID NO: 857231 - RNA, 22 nt, Human
uggagucugugaugcucugggu

SEQ ID NO: 857232 - RNA, 22 nt, Human
uucuucaaacaaaaguggcaug

SEQ ID NO: 857233 - RNA, 22 nt, Human
auuuuacuacuccaauuaauga

SEQ ID NO: 857234 - RNA, 22 nt, Human
cugcugugcauauuuaucuagg

SEQ ID NO: 857235 - RNA, 23 nt, Human
gccaggaguggguagacuaaugc

SEQ ID NO: 857236 - RNA, 22 nt, Human
cauaauaucuccgauuacuugc

SEQ ID NO: 857237 - RNA, 22 nt, Human
gaagcagcugccagagaugucu

SEQ ID NO: 857238 - RNA, 22 nt, Human
cuugaacucaaugugaggaaga

SEQ ID NO: 857239 - RNA, 22 nt, Human
uaacagaaauuuuaguuagggg

SEQ ID NO: 857240 - RNA, 22 nt, Human
gcaucuaaacuugcaucauugu

SEQ ID NO: 857241 - RNA, 22 nt, Human
ugaauagauuuuuaacauauaa

SEQ ID NO: 857242 - RNA, 22 nt, Human
augaaacacacacgcgcauacu

SEQ ID NO: 857243 - RNA, 22 nt, Human
aaaguccuugcaguuuccucuu

SEQ ID NO: 857244 - RNA, 22 nt, Human
uccauuuuagagaugaagaaac

SEQ ID NO: 857245 - RNA, 22 nt, Human
agcagaggaggauuuaguuagg

SEQ ID NO: 857246 - RNA, 22 nt, Human
aaagaaggaugggagaaauccu

SEQ ID NO: 857247 - RNA, 22 nt, Human
ugaugaaaauaugauucugagg

SEQ ID NO: 857248 - RNA, 22 nt, Human
uucagaaaaaacuucaauaagu

SEQ ID NO: 857249 - RNA, 22 nt, Human
gagaggaguagacacuuugguu

SEQ ID NO: 857250 - RNA, 22 nt, Human
cucccaggguagggagagacua

SEQ ID NO: 857251 - RNA, 22 nt, Human
agcauaaaggcacuagaaagag

SEQ ID NO: 857252 - RNA, 22 nt, Human
uggcauuuucuccuuugaguuu

SEQ ID NO: 857253 - RNA, 22 nt, Human
acuguguggaccacucugaggc

SEQ ID NO: 857254 - RNA, 22 nt, Human
auauaauuguucugaaguguuu

SEQ ID NO: 857255 - RNA, 22 nt, Human
ucacugcucuccaauguggagu

SEQ ID NO: 857256 - RNA, 22 nt, Human
uuccucagcuggccugauuggg

SEQ ID NO: 857257 - RNA, 22 nt, Human
ccaggagagcagaagcccaggc

SEQ ID NO: 857258 - RNA, 22 nt, Human
gcuguguuugacaguagcagac

SEQ ID NO: 857259 - RNA, 22 nt, Human
aggcaagcccccagugaggcuc

SEQ ID NO: 857260 - RNA, 22 nt, Human
agcaccuguugcacuucauaau

SEQ ID NO: 857261 - RNA, 21 nt, Human
uccagaaaagaggucauuagc

SEQ ID NO: 857262 - RNA, 22 nt, Human
ugaggcagcuuuuucugugugu

SEQ ID NO: 857263 - RNA, 22 nt, Human
guugaaaguggagaaccugguu

SEQ ID NO: 857264 - RNA, 22 nt, Human
ugugaauagugccgcaauaaac

SEQ ID NO: 857265 - RNA, 22 nt, Human
cucaggauagcugcgcagccug

SEQ ID NO: 857266 - RNA, 22 nt, Human
uaccauuucauucuuuccucau

SEQ ID NO: 857267 - RNA, 22 nt, Human
cagauacuguaaaauuucagua

SEQ ID NO: 857268 - RNA, 22 nt, Human
aaaaucugcuuccuuuuacaga

SEQ ID NO: 857269 - RNA, 21 nt, Human
cccaggagaagaaaagaugca

SEQ ID NO: 857270 - RNA, 22 nt, Human
cuggcuuucucugugguguuca

SEQ ID NO: 857271 - RNA, 22 nt, Human
caggaggaagaacucugcaaca

SEQ ID NO: 857272 - RNA, 22 nt, Human
uuaguuuucccaucuuuauggu

SEQ ID NO: 857273 - RNA, 22 nt, Human
ugucaccaaguugaugaaugca

SEQ ID NO: 857274 - RNA, 22 nt, Human
ucuuagaaauuccccaguggcu

SEQ ID NO: 857275 - RNA, 22 nt, Human
aggauuuagauuuggaggaacu

SEQ ID NO: 857276 - RNA, 22 nt, Human
gcagaauuggauaguugugaua

SEQ ID NO: 857277 - RNA, 22 nt, Human
ugaaacaaauuuggaaaaucua

SEQ ID NO: 857278 - RNA, 22 nt, Human
gauuucuugauaauucaaaucc

SEQ ID NO: 857279 - RNA, 22 nt, Human
uauuuccaccuauuauuuucug

SEQ ID NO: 857280 - RNA, 22 nt, Human
gggcagcugccaagugcaucgc

SEQ ID NO: 857281 - RNA, 22 nt, Human
auucuucagaauaucuggcacu

SEQ ID NO: 857282 - RNA, 22 nt, Human
cuacagacccaccuuggaagaa

SEQ ID NO: 857283 - RNA, 22 nt, Human
ggggcagcuaccggaaguaggg

SEQ ID NO: 857284 - RNA, 22 nt, Human
uccaggaggccucauuuccugu

SEQ ID NO: 857285 - RNA, 22 nt, Human
gugaauaaccuacuccaggccu

SEQ ID NO: 857286 - RNA, 22 nt, Human
cucaggauuaaggaaucuaaau

SEQ ID NO: 857287 - RNA, 22 nt, Human
agcuucccaagguuggaagguu

SEQ ID NO: 857288 - RNA, 22 nt, Human
cauaaaauggcuuguucuuuaa

SEQ ID NO: 857289 - RNA, 22 nt, Human
auauacugaggagacuuuauau

SEQ ID NO: 857290 - RNA, 22 nt, Human
caucagaaucugagucucugcc

SEQ ID NO: 857291 - RNA, 22 nt, Human
aggcagguccccuggaaggcac

SEQ ID NO: 857292 - RNA, 21 nt, Human
agccagcuaucacacagcauu

SEQ ID NO: 857293 - RNA, 22 nt, Human
acagucauuagauacaaugucu

SEQ ID NO: 857294 - RNA, 22 nt, Human
gauguagagggaagauuuuaaa

SEQ ID NO: 857295 - RNA, 21 nt, Human
uguccuuaaugcaauguccuu

SEQ ID NO: 857296 - RNA, 22 nt, Human
gauagaaagguguugaaaucca

SEQ ID NO: 857297 - RNA, 22 nt, Human
cuacccaggcuuagagggcugg

SEQ ID NO: 857298 - RNA, 22 nt, Human
cgucuuccucuuacgaugcgcu

SEQ ID NO: 857299 - RNA, 21 nt, Human
cccacggaaugaugaggcacu

SEQ ID NO: 857300 - RNA, 22 nt, Human
aggguaggaacugaguggaagg

SEQ ID NO: 857301 - RNA, 22 nt, Human
aagggagguaaagcuauuuaaa

SEQ ID NO: 857302 - RNA, 23 nt, Human
aggauuuaaaggcaaugcauuuu

SEQ ID NO: 857303 - RNA, 17 nt, Human
caggcagacauguaagc

SEQ ID NO: 857304 - RNA, 23 nt, Human
ccacuagcaccuguucaacuucu

SEQ ID NO: 857305 - RNA, 22 nt, Human
aaugcauauguaggcaagcagu

SEQ ID NO: 857306 - RNA, 22 nt, Human
acaugauuuuaguaucauaaua

SEQ ID NO: 857307 - RNA, 22 nt, Human
guccuuaguuacuuuucauguc

SEQ ID NO: 857308 - RNA, 22 nt, Human
auuuccagacuuuuuccaggaa

SEQ ID NO: 857309 - RNA, 22 nt, Human
gagugcaguuggggugagggga

SEQ ID NO: 857310 - RNA, 22 nt, Human
cuggcuguauuaguuugauccu

SEQ ID NO: 857311 - RNA, 22 nt, Human
auccaaaccuggacaugagugg

SEQ ID NO: 857312 - RNA, 22 nt, Human
uuguaaauaguaguaagaugcc

SEQ ID NO: 857313 - RNA, 22 nt, Human
uucucagaugauucagauaaac

SEQ ID NO: 857314 - RNA, 22 nt, Human
ccccaggagcuuguuuuagaga

SEQ ID NO: 857315 - RNA, 22 nt, Human
cucaggaucgcuugcccuaggg

SEQ ID NO: 857316 - RNA, 22 nt, Human
gggacuucauagcuaggcacuu

SEQ ID NO: 857317 - RNA, 22 nt, Human
uugcauuugacaaauuauuuaa

SEQ ID NO: 857318 - RNA, 22 nt, Human
auuaggcaauucugggcaucuc

SEQ ID NO: 857319 - RNA, 22 nt, Human
gacaguccuugcccaguaucua

SEQ ID NO: 857320 - RNA, 22 nt, Human
gaggagaggccaucguuguuau

SEQ ID NO: 857321 - RNA, 20 nt, Human
uucuauacauaucacugaaa

SEQ ID NO: 857322 - RNA, 22 nt, Human
gcccaggaggcagagguugugg

SEQ ID NO: 857323 - RNA, 22 nt, Human
auuaaauuggacgcugggggaa

SEQ ID NO: 857324 - RNA, 22 nt, Human
cagaccagcucuaugaacccaa

SEQ ID NO: 857325 - RNA, 22 nt, Human
aggaugagccgcgcaagcugac

SEQ ID NO: 857326 - RNA, 22 nt, Human
uuugcagugucagcuucugugu

SEQ ID NO: 857327 - RNA, 22 nt, Human
aguucuucauaaccuuacugug

SEQ ID NO: 857328 - RNA, 22 nt, Human
uucuccagagggcucugcagga

SEQ ID NO: 857329 - RNA, 22 nt, Human
ccaggcugagcaugauuggagc

SEQ ID NO: 857330 - RNA, 21 nt, Human
ggauggauagggaagagauuu

SEQ ID NO: 857331 - RNA, 22 nt, Human
cauguuuacuaccaggagaaug

SEQ ID NO: 857332 - RNA, 22 nt, Human
aucaggauuacacggggaugcu

SEQ ID NO: 857333 - RNA, 22 nt, Human
aucagaaauugcuaccagugga

SEQ ID NO: 857334 - RNA, 22 nt, Human
acucaggaaauugagauaaugg

SEQ ID NO: 857335 - RNA, 22 nt, Human
gagauuuaauuggauuaacuua

SEQ ID NO: 857336 - RNA, 20 nt, Human
auuuggcaugaaguauugau

SEQ ID NO: 857337 - RNA, 22 nt, Human
gaucuucuagcagaaguaauuu

SEQ ID NO: 857338 - RNA, 22 nt, Human
cgaggcagaggcugaaacggcu

SEQ ID NO: 857339 - RNA, 17 nt, Human
agagggaaaaugcgguu

SEQ ID NO: 857340 - RNA, 22 nt, Human
cacaggagagcugggaggugcc

SEQ ID NO: 857341 - RNA, 22 nt, Human
uaaaauagcaugugcagugaaa

SEQ ID NO: 857342 - RNA, 22 nt, Human
cugccuccugccgugcagcuuc

SEQ ID NO: 857343 - RNA, 22 nt, Human
gagagucuagugcaccuaguuu

SEQ ID NO: 857344 - RNA, 22 nt, Human
ggcgcacaaugugcagguuugu

SEQ ID NO: 857345 - RNA, 22 nt, Human
aaggcagccgugugacugcaug

SEQ ID NO: 857346 - RNA, 22 nt, Human
uccaggagacacccuugugugu

SEQ ID NO: 857347 - RNA, 22 nt, Human
aggcaguuguugcugagcagcu

SEQ ID NO: 857348 - RNA, 22 nt, Human
ucuguggauuuuaguguucaug

SEQ ID NO: 857349 - RNA, 22 nt, Human
uggaaagucucuuuugacugua

SEQ ID NO: 857350 - RNA, 22 nt, Human
guucuucagauuccauuucagu

SEQ ID NO: 857351 - RNA, 22 nt, Human
uguacaauguguuuguuggcuu

SEQ ID NO: 857352 - RNA, 22 nt, Human
ucuaaagaagaggguucugcgg

SEQ ID NO: 857353 - RNA, 22 nt, Human
agagggagugaaauggaauaga

SEQ ID NO: 857354 - RNA, 22 nt, Human
ggaggagguggguuaaguugua

SEQ ID NO: 857355 - RNA, 22 nt, Human
ucuuuguaacugucuauugaga

SEQ ID NO: 857356 - RNA, 22 nt, Human
gggauuuaguaggauaguauac

SEQ ID NO: 857357 - RNA, 22 nt, Human
gcagaggcuguagggaagguug

SEQ ID NO: 857358 - RNA, 23 nt, Human
uuugaaguugacugccuuccaga

SEQ ID NO: 857359 - RNA, 22 nt, Human
augcagcuucaggauuaugaug

SEQ ID NO: 857360 - RNA, 22 nt, Human
gucacuguauccagguuccagc

SEQ ID NO: 857361 - RNA, 22 nt, Human
cccaaggacacgggcagggaca

SEQ ID NO: 857362 - RNA, 22 nt, Human
auaaaugauucagcaggaaaua

SEQ ID NO: 857363 - RNA, 22 nt, Human
ucaauaaaucccucugacccug

SEQ ID NO: 857364 - RNA, 22 nt, Human
uucaacccaaguucuccauuuu

SEQ ID NO: 857365 - RNA, 22 nt, Human
caugauaauuguuaacaaagua

SEQ ID NO: 857366 - RNA, 22 nt, Human
aaagcagacugauuugcaucac

SEQ ID NO: 857367 - RNA, 22 nt, Human
uccagaauacucugaaaucauu

SEQ ID NO: 857368 - RNA, 22 nt, Human
acaugcauaggagaagucuuua

SEQ ID NO: 857369 - RNA, 22 nt, Human
cugaaaauguuacacaggaaga

SEQ ID NO: 857370 - RNA, 22 nt, Human
ucaaucacguguuccauguucu

SEQ ID NO: 857371 - RNA, 22 nt, Human
gaggcagagaccuucaggaccu

SEQ ID NO: 857372 - RNA, 22 nt, Human
ucaucugucccaggcuuuuuuc

SEQ ID NO: 857373 - RNA, 22 nt, Human
aaagccaugggucuuuggcaua

SEQ ID NO: 857374 - RNA, 22 nt, Human
caaauaguaugagcaaugauuc

SEQ ID NO: 857375 - RNA, 22 nt, Human
uucuucuucauuucugacgaug

SEQ ID NO: 857376 - RNA, 22 nt, Human
caacagcugaucuuugaugaag

SEQ ID NO: 857377 - RNA, 22 nt, Human
accauuuuggguauuuucagag

SEQ ID NO: 857378 - RNA, 22 nt, Human
aaauuauuacaagcuaguuggc

SEQ ID NO: 857379 - RNA, 22 nt, Human
uccaggaggaggaaggcugcca

SEQ ID NO: 857380 - RNA, 23 nt, Human
aggcgagcucuucuccagcacgu

SEQ ID NO: 857381 - RNA, 22 nt, Human
cugcuuugcauagcugccagag

SEQ ID NO: 857382 - RNA, 22 nt, Human
ucauuucaaguucugacagcua

SEQ ID NO: 857383 - RNA, 22 nt, Human
ugaaaugacagucuuaagcucu

SEQ ID NO: 857384 - RNA, 22 nt, Human
cagucucuaaaucaaucugaau

SEQ ID NO: 857385 - RNA, 22 nt, Human
gauuucaaggauguuagaggug

SEQ ID NO: 857386 - RNA, 22 nt, Human
augcugugaaaaagaaggcuga

SEQ ID NO: 857387 - RNA, 22 nt, Human
aggauuuauuauaugcccucau

SEQ ID NO: 857388 - RNA, 22 nt, Human
cuucuucaauagcaagcgcaua

SEQ ID NO: 857389 - RNA, 22 nt, Human
aaagccaugaauguuauagagg

SEQ ID NO: 857390 - RNA, 22 nt, Human
cagcuggcugcaugaugccaaa

SEQ ID NO: 857391 - RNA, 22 nt, Human
caaggccaugagcagcgagugu

SEQ ID NO: 857392 - RNA, 22 nt, Human
aggcagugccuggaccccagcu

SEQ ID NO: 857393 - RNA, 22 nt, Human
guuaggcagcccaagaugucag

SEQ ID NO: 857394 - RNA, 22 nt, Human
auggagggugguaagacagaga

SEQ ID NO: 857395 - RNA, 22 nt, Human
uuccuuagcugucccuggaaau

SEQ ID NO: 857396 - RNA, 19 nt, Human
uuacuuggcaaagucaguc

SEQ ID NO: 857397 - RNA, 22 nt, Human
ggaugggagcagaggacgacca

SEQ ID NO: 857398 - RNA, 22 nt, Human
aaucuguuuaguucugcguaug

SEQ ID NO: 857399 - RNA, 22 nt, Human
ucacaugaguauuauuuuccaa

SEQ ID NO: 857400 - RNA, 22 nt, Human
agcagcauuaugauauaucuua

SEQ ID NO: 857401 - RNA, 22 nt, Human
gcuuuaaugcuucguggggcca

SEQ ID NO: 857402 - RNA, 22 nt, Human
uccccagggcugcagagggugu

SEQ ID NO: 857403 - RNA, 22 nt, Human
ccuucuucuguguggcccaaga

SEQ ID NO: 857404 - RNA, 22 nt, Human
ggugaaggcacaagagggcaag

SEQ ID NO: 857405 - RNA, 21 nt, Human
gauaaaaugggccuugguccu

SEQ ID NO: 857406 - RNA, 22 nt, Human
uaauuucacugauaugaaguca

SEQ ID NO: 857407 - RNA, 22 nt, Human
ucauuuaauagcuuuugucuuu

SEQ ID NO: 857408 - RNA, 23 nt, Human
aagucaccaagaggaaggcggag

SEQ ID NO: 857409 - RNA, 22 nt, Human
uauuugaaaguguacaaaaacu

SEQ ID NO: 857410 - RNA, 22 nt, Human
auauacugauagcugcacuucu

SEQ ID NO: 857411 - RNA, 22 nt, Human
aucaguuaguuacugcuaagau

SEQ ID NO: 857412 - RNA, 22 nt, Human
uaggcagcauggauucugaaua

SEQ ID NO: 857413 - RNA, 22 nt, Human
acugugugacuguuauuacugu

SEQ ID NO: 857414 - RNA, 22 nt, Human
ccucaggaaaugaauaaauggc

SEQ ID NO: 857415 - RNA, 22 nt, Human
ggaggccagggacccagucagc

SEQ ID NO: 857416 - RNA, 22 nt, Human
ccaggaagcugucugauaugaa

SEQ ID NO: 857417 - RNA, 22 nt, Human
agagggauggccccguaacuca

SEQ ID NO: 857418 - RNA, 22 nt, Human
agcagagguuuguuggaaaccu

SEQ ID NO: 857419 - RNA, 22 nt, Human
uaaguccuggcugguuugaagc

SEQ ID NO: 857420 - RNA, 22 nt, Human
caggauggucagaugcauuguc

SEQ ID NO: 857421 - RNA, 22 nt, Human
uaaucauggccucaaauuuuau

SEQ ID NO: 857422 - RNA, 22 nt, Human
cauggucuacaauuucauuuua

SEQ ID NO: 857423 - RNA, 22 nt, Human
ugaaauaggaaacagauguuuc

SEQ ID NO: 857424 - RNA, 22 nt, Human
gaaguccuccuaucuugcucuu

SEQ ID NO: 857425 - RNA, 22 nt, Human
ggagaggggcaaguuuaucuag

SEQ ID NO: 857426 - RNA, 22 nt, Human
cuggguaaguuccuaaggcuca

SEQ ID NO: 857427 - RNA, 22 nt, Human
cauuuacagcagacugaugaaa

SEQ ID NO: 857428 - RNA, 22 nt, Human
gugacaguggucacuuguaguu

SEQ ID NO: 857429 - RNA, 22 nt, Human
caggcagccaggggaccugucc

SEQ ID NO: 857430 - RNA, 20 nt, Human
gggagucuggaugaaagaug

SEQ ID NO: 857431 - RNA, 22 nt, Human
aauuaauggaaaguaaggaagg

SEQ ID NO: 857432 - RNA, 21 nt, Human
uucuucaugaugauuaauggc

SEQ ID NO: 857433 - RNA, 22 nt, Human
gcaugucaugucauguaggaau

SEQ ID NO: 857434 - RNA, 22 nt, Human
caucagaaccaguggggacauu

SEQ ID NO: 857435 - RNA, 22 nt, Human
gaggagaggggcucccaagagc

SEQ ID NO: 857436 - RNA, 22 nt, Human
gaaagccauagcccagcuuuac

SEQ ID NO: 857437 - RNA, 22 nt, Human
ucuuugaauucaaacuguucaa

SEQ ID NO: 857438 - RNA, 22 nt, Human
aggguggcuggaggaaucagaa

SEQ ID NO: 857439 - RNA, 22 nt, Human
uuugguccugagcaaaacuaug

SEQ ID NO: 857440 - RNA, 22 nt, Human
cucuucuuggcccccaugaggg

SEQ ID NO: 857441 - RNA, 22 nt, Human
aguacauauaguaauuuagcca

SEQ ID NO: 857442 - RNA, 22 nt, Human
gaaaaaggauaaauacaguguu

SEQ ID NO: 857443 - RNA, 20 nt, Human
gcagcuacucugucucgcuc

SEQ ID NO: 857444 - RNA, 22 nt, Human
gcuguguuuuauguuagguuaa

SEQ ID NO: 857445 - RNA, 18 nt, Human
gucacuguguuucugagc

SEQ ID NO: 857446 - RNA, 22 nt, Human
aucaggaucugggagccugaaa

SEQ ID NO: 857447 - RNA, 22 nt, Human
aaguccuucuuuauaugagagu

SEQ ID NO: 857448 - RNA, 22 nt, Human
acagugacguuuauuugagacg

SEQ ID NO: 857449 - RNA, 22 nt, Human
ucuuuaauauaaaggaaugaau

SEQ ID NO: 857450 - RNA, 20 nt, Human
ucauuguguugccaauuccc

SEQ ID NO: 857451 - RNA, 23 nt, Human
uugcuuucaucaugagaugcucc

SEQ ID NO: 857452 - RNA, 22 nt, Human
ugaggcagcaauugauuauuca

SEQ ID NO: 857453 - RNA, 22 nt, Human
uuacagaaaguuucccaugccg

SEQ ID NO: 857454 - RNA, 22 nt, Human
gcccaggaagccaccgggaagu

SEQ ID NO: 857455 - RNA, 22 nt, Human
aucacauugccagugauuaccc

SEQ ID NO: 857456 - RNA, 22 nt, Human
uagcaucuggagaaacaagucc

SEQ ID NO: 857457 - RNA, 22 nt, Human
ucacaguaaaagcauggaagag

SEQ ID NO: 857458 - RNA, 22 nt, Human
ggcagcuuccuaggagagggca

SEQ ID NO: 857459 - RNA, 22 nt, Human
uggggcucaccuaggcuggaag

SEQ ID NO: 857460 - RNA, 22 nt, Human
uugcagcugcaguaaauguuca

SEQ ID NO: 857461 - RNA, 23 nt, Human
ucguugaauagcaauagcacaac

SEQ ID NO: 857462 - RNA, 22 nt, Human
gaguccuuuguuccuugccaca

SEQ ID NO: 857463 - RNA, 22 nt, Human
gaggcagcaauaaaaagaauuu

SEQ ID NO: 857464 - RNA, 22 nt, Human
guaaugaaugaaagaaacuggg

SEQ ID NO: 857465 - RNA, 22 nt, Human
gcagcugagcgugaggaagagu

SEQ ID NO: 857466 - RNA, 22 nt, Human
gcucccaggcauggagguaauu

SEQ ID NO: 857467 - RNA, 22 nt, Human
agggcagcacaaggcauggacu

SEQ ID NO: 857468 - RNA, 22 nt, Human
ucucccaggcugcccuguggac

SEQ ID NO: 857469 - RNA, 22 nt, Human
uugcugaagugaagguauguuu

SEQ ID NO: 857470 - RNA, 22 nt, Human
ucauacacaagagcauguaaca

SEQ ID NO: 857471 - RNA, 22 nt, Human
ggauuuacaaguuuaacucuca

SEQ ID NO: 857472 - RNA, 22 nt, Human
aauaaaauggucaguuuucuca

SEQ ID NO: 857473 - RNA, 22 nt, Human
gccucugcccuccugggacugc

SEQ ID NO: 857474 - RNA, 22 nt, Human
auuccaguuggguucuaauaca

SEQ ID NO: 857475 - RNA, 23 nt, Human
caauuucauaugauucuaccuaa

SEQ ID NO: 857476 - RNA, 22 nt, Human
uaauuucagugggcucugggcu

SEQ ID NO: 857477 - RNA, 22 nt, Human
caggagggcccgagacucuucc

SEQ ID NO: 857478 - RNA, 22 nt, Human
uggcagcuauuacaaggaaguc

SEQ ID NO: 857479 - RNA, 19 nt, Human
gaggcgaggcgugcaggag

SEQ ID NO: 857480 - RNA, 22 nt, Human
uuacauaacgguaugaaaaaug

SEQ ID NO: 857481 - RNA, 22 nt, Human
auagcuuuacagaagaguuuag

SEQ ID NO: 857482 - RNA, 22 nt, Human
uugaaagugccaaguccuagug

SEQ ID NO: 857483 - RNA, 22 nt, Human
cccaggaggcagagcuugcagu

SEQ ID NO: 857484 - RNA, 22 nt, Human
aaucagaaagaggucauguugc

SEQ ID NO: 857485 - RNA, 22 nt, Human
gcugcccagacauugaaucagg

SEQ ID NO: 857486 - RNA, 22 nt, Human
auuauuauauagggaaaguccc

SEQ ID NO: 857487 - RNA, 22 nt, Human
caaugucaugauuuuccauuag

SEQ ID NO: 857488 - RNA, 22 nt, Human
aggggagguggcagaaaugugc

SEQ ID NO: 857489 - RNA, 19 nt, Human
acaaaugauguugcacuga

SEQ ID NO: 857490 - RNA, 22 nt, Human
augcuguguuuuaaauggaaau

SEQ ID NO: 857491 - RNA, 22 nt, Human
aggcagcugugaggacuggauu

SEQ ID NO: 857492 - RNA, 22 nt, Human
agaggaggcagcuuaacucagu

SEQ ID NO: 857493 - RNA, 22 nt, Human
gaaagccagagagaaagggcuc

SEQ ID NO: 857494 - RNA, 22 nt, Human
augcuuaacuuccuagucuaua

SEQ ID NO: 857495 - RNA, 22 nt, Human
gugaacuauuggguaucauaaa

SEQ ID NO: 857496 - RNA, 22 nt, Human
cauggcuuuguucauauaauuu

SEQ ID NO: 857497 - RNA, 22 nt, Human
acagugcuaaacacuucuugaa

SEQ ID NO: 857498 - RNA, 22 nt, Human
uugcuuuguggugguucuucca

SEQ ID NO: 857499 - RNA, 22 nt, Human
uugauuaaacaggcauauucaa

SEQ ID NO: 857500 - RNA, 22 nt, Human
ccucacugcuauguguuugcuc

SEQ ID NO: 857501 - RNA, 22 nt, Human
cugaauaauauuccauuaugag

SEQ ID NO: 857502 - RNA, 22 nt, Human
ugugaauaaugccgcaauaaac

SEQ ID NO: 857503 - RNA, 22 nt, Human
uuauacauguguuuugagauga

SEQ ID NO: 857504 - RNA, 21 nt, Human
auacagaaggcagacucucuc

SEQ ID NO: 857505 - RNA, 22 nt, Human
gucauucuuaacaacucaguag

SEQ ID NO: 857506 - RNA, 22 nt, Human
uggcauuucaguauuuucauaa

SEQ ID NO: 857507 - RNA, 22 nt, Human
uuuguuaaauauuuauugagug

SEQ ID NO: 857508 - RNA, 22 nt, Human
ugcccacauggugccauggcca

SEQ ID NO: 857509 - RNA, 22 nt, Human
guauagaaacccagaaagauag

SEQ ID NO: 857510 - RNA, 20 nt, Human
cugcugugguccuuuauuuu

SEQ ID NO: 857511 - RNA, 22 nt, Human
uagaaacagaaaacuguaauag

SEQ ID NO: 857512 - RNA, 22 nt, Human
aaaugucagaggaacauauuga

SEQ ID NO: 857513 - RNA, 22 nt, Human
guuuucugauuagcaaaucuga

SEQ ID NO: 857514 - RNA, 22 nt, Human
cccaggagccaucugucuuggc

SEQ ID NO: 857515 - RNA, 22 nt, Human
uucuaacaaguggcuuguuagu

SEQ ID NO: 857516 - RNA, 22 nt, Human
gcggagggcgagcccgcggagc

SEQ ID NO: 857517 - RNA, 22 nt, Human
aggccagaugucgggcuagaag

SEQ ID NO: 857518 - RNA, 22 nt, Human
aguguuugagacacauuucacu

SEQ ID NO: 857519 - RNA, 22 nt, Human
uuccaugacaccgagggaaguc

SEQ ID NO: 857520 - RNA, 22 nt, Human
gggcagcugcagggauggugac

SEQ ID NO: 857521 - RNA, 22 nt, Human
aggagaggcaucaagaaaaucg

SEQ ID NO: 857522 - RNA, 22 nt, Human
caaaugauagagccgauuauca

SEQ ID NO: 857523 - RNA, 22 nt, Human
accaggagacaugaccaaugag

SEQ ID NO: 857524 - RNA, 22 nt, Human
cccaggaaugggaaggaggaau

SEQ ID NO: 857525 - RNA, 22 nt, Human
uuucuucauucaccuucacccc

SEQ ID NO: 857526 - RNA, 19 nt, Human
uacauacuuauucuaaaag

SEQ ID NO: 857527 - RNA, 22 nt, Human
ugucaccacuggcugaaacacc

SEQ ID NO: 857528 - RNA, 22 nt, Human
gcccaggaguuggaggcugcag

SEQ ID NO: 857529 - RNA, 22 nt, Human
caggaugguggcaugaucagaa

SEQ ID NO: 857530 - RNA, 22 nt, Human
guaaauuauuucaagaucaucu

SEQ ID NO: 857531 - RNA, 22 nt, Human
aucagaaaguucaucauguuug

SEQ ID NO: 857532 - RNA, 21 nt, Human
aaauggauagggcaauggaag

SEQ ID NO: 857533 - RNA, 22 nt, Human
uacauauacugagugauuugcu

SEQ ID NO: 857534 - RNA, 22 nt, Human
ucugaaaugcaaauuugacuga

SEQ ID NO: 857535 - RNA, 22 nt, Human
aggcagcuagagagugaaacug

SEQ ID NO: 857536 - RNA, 22 nt, Human
agucaaaugaguaaauauauaa

SEQ ID NO: 857537 - RNA, 22 nt, Human
acaaaguccugguguauggcca

SEQ ID NO: 857538 - RNA, 20 nt, Human
ugaggcaggagaauggcaug

SEQ ID NO: 857539 - RNA, 22 nt, Human
ugcauaaagugccauaguauua

SEQ ID NO: 857540 - RNA, 22 nt, Human
cucagagaggcaguggaaguca

SEQ ID NO: 857541 - RNA, 22 nt, Human
agugcuuuaccuagauaauguu

SEQ ID NO: 857542 - RNA, 22 nt, Human
uugcccagaguccacagcguac

SEQ ID NO: 857543 - RNA, 22 nt, Human
aggggcucaaagugugcaggga

SEQ ID NO: 857544 - RNA, 22 nt, Human
ucaucuugcugccauugcuuua

SEQ ID NO: 857545 - RNA, 23 nt, Human
aaugauuucaugaugauagcagc

SEQ ID NO: 857546 - RNA, 20 nt, Human
ucucagcauaagaacccuuc

SEQ ID NO: 857547 - RNA, 22 nt, Human
cauuuauucauuugcuagggcu

SEQ ID NO: 857548 - RNA, 22 nt, Human
auuuccaggagaaaggauuuua

SEQ ID NO: 857549 - RNA, 22 nt, Human
cugcugugauugggagaaaccg

SEQ ID NO: 857550 - RNA, 22 nt, Human
uuuaggcagcacgggcagcccu

SEQ ID NO: 857551 - RNA, 19 nt, Human
ugcaagcuuuuucuuguua

SEQ ID NO: 857552 - RNA, 22 nt, Human
ucagggugaaccaggcaggaau

SEQ ID NO: 857553 - RNA, 22 nt, Human
aaagcagguugcaauuacagug

SEQ ID NO: 857554 - RNA, 22 nt, Human
uaagaaucaguagauauagauu

SEQ ID NO: 857555 - RNA, 22 nt, Human
gcccaggauggagaauaguggu

SEQ ID NO: 857556 - RNA, 22 nt, Human
cuggcuuucuguuauaaagaca

SEQ ID NO: 857557 - RNA, 22 nt, Human
agauggagaaugacaauuaagg

SEQ ID NO: 857558 - RNA, 22 nt, Human
gaacccaggcuuuugaggcugu

SEQ ID NO: 857559 - RNA, 22 nt, Human
accaggagguguuugcucaagu

SEQ ID NO: 857560 - RNA, 22 nt, Human
uuucauaaggguuucuagacuu

SEQ ID NO: 857561 - RNA, 22 nt, Human
gugguaaucggauucuuaccgg

SEQ ID NO: 857562 - RNA, 22 nt, Human
uuccugggacuggagcagccca

SEQ ID NO: 857563 - RNA, 22 nt, Human
cauucauuagaauagauaugua

SEQ ID NO: 857564 - RNA, 22 nt, Human
uauaaaauggcaucagcuccaa

SEQ ID NO: 857565 - RNA, 22 nt, Human
uucaggauggcggauguugggg

SEQ ID NO: 857566 - RNA, 22 nt, Human
uacugaaaguggucaacagugg

SEQ ID NO: 857567 - RNA, 22 nt, Human
cauuucaauacuaucugagaau

SEQ ID NO: 857568 - RNA, 22 nt, Human
cuuuggcagccucugcuauuga

SEQ ID NO: 857569 - RNA, 21 nt, Human
auacacauacacauaaaugug

SEQ ID NO: 857570 - RNA, 22 nt, Human
uucaggaucaaguugccaguag

SEQ ID NO: 857571 - RNA, 22 nt, Human
aauuucaauuacuuuugcacca

SEQ ID NO: 857572 - RNA, 22 nt, Human
gaggagagggcugcgggcccac

SEQ ID NO: 857573 - RNA, 22 nt, Human
aggcuagcaaugggagaugagu

SEQ ID NO: 857574 - RNA, 22 nt, Human
ugaaggcccagccacagaaugg

SEQ ID NO: 857575 - RNA, 22 nt, Human
agcccaggaaucugcaucuuga

SEQ ID NO: 857576 - RNA, 19 nt, Human
aucugccuguuaucacaua

SEQ ID NO: 857577 - RNA, 22 nt, Human
guucuucagaggggaaagaacc

SEQ ID NO: 857578 - RNA, 22 nt, Human
uuuaggcagucauugaacaagu

SEQ ID NO: 857579 - RNA, 22 nt, Human
ggcagucuuaucagcauuggac

SEQ ID NO: 857580 - RNA, 22 nt, Human
cugagccagcuggcaugugcua

SEQ ID NO: 857581 - RNA, 22 nt, Human
uuugaaguucccccauaucaga

SEQ ID NO: 857582 - RNA, 22 nt, Human
caaguccuuagaugguucuuug

SEQ ID NO: 857583 - RNA, 22 nt, Human
aacacuuugggcauggccuucc

SEQ ID NO: 857584 - RNA, 22 nt, Human
uaaauuaugucacaugacucug

SEQ ID NO: 857585 - RNA, 23 nt, Human
uuacagaaaguaugcuuuuguuu

SEQ ID NO: 857586 - RNA, 22 nt, Human
ucucaggacuuugggaagcuca

SEQ ID NO: 857587 - RNA, 22 nt, Human
ucuuccucuagaucugaggccc

SEQ ID NO: 857588 - RNA, 22 nt, Human
aaaggccacacugcucuuucuc

SEQ ID NO: 857589 - RNA, 22 nt, Human
aaauuauuaugccccucuauaa

SEQ ID NO: 857590 - RNA, 22 nt, Human
auacauaauuacuuccgauguu

SEQ ID NO: 857591 - RNA, 22 nt, Human
agcaccuugcucuuggccuucc

SEQ ID NO: 857592 - RNA, 22 nt, Human
gauuucuuuagguguaauagug

SEQ ID NO: 857593 - RNA, 16 nt, Human
aaggagggaagagaau

SEQ ID NO: 857594 - RNA, 22 nt, Human
gccaggaggcugcuguguaggc

SEQ ID NO: 857595 - RNA, 22 nt, Human
uuacagaacugcccuaguuggc

SEQ ID NO: 857596 - RNA, 20 nt, Human
ugaaggccauuuguuccaga

SEQ ID NO: 857597 - RNA, 22 nt, Human
cagcugcuguuacugcuuauua

SEQ ID NO: 857598 - RNA, 20 nt, Human
gagauggacagaugaagggg

SEQ ID NO: 857599 - RNA, 22 nt, Human
cucacuguccaacaggcuuuac

SEQ ID NO: 857600 - RNA, 22 nt, Human
gugaauaacuuucuauguuaau

SEQ ID NO: 857601 - RNA, 22 nt, Human
aaagaaucacauccuucagcaa

SEQ ID NO: 857602 - RNA, 22 nt, Human
uagucaccugugagcugcguag

SEQ ID NO: 857603 - RNA, 21 nt, Human
cauuucaaagagcuggaaauc

SEQ ID NO: 857604 - RNA, 22 nt, Human
ugaauaaucauguccauagugu

SEQ ID NO: 857605 - RNA, 22 nt, Human
aauuccaaauguuuucaaucca

SEQ ID NO: 857606 - RNA, 22 nt, Human
uaucuguuggcuccuaguugua

SEQ ID NO: 857607 - RNA, 19 nt, Human
agauuuaccucauauaguu

SEQ ID NO: 857608 - RNA, 22 nt, Human
augguuuacaauguuuucaguu

SEQ ID NO: 857609 - RNA, 22 nt, Human
acaggagaauuaucuggaacaa

SEQ ID NO: 857610 - RNA, 22 nt, Human
uuacuuugcuuucucauuacag

SEQ ID NO: 857611 - RNA, 22 nt, Human
ccaaaauuauuacauuuguagg

SEQ ID NO: 857612 - RNA, 22 nt, Human
cccaggagaauauuuuuggguc

SEQ ID NO: 857613 - RNA, 22 nt, Human
uagugcuuggcccuaccagaua

SEQ ID NO: 857614 - RNA, 19 nt, Human
ccaggagagcuuggagaag

SEQ ID NO: 857615 - RNA, 22 nt, Human
ggaggaggggcgcuuugucuau

SEQ ID NO: 857616 - RNA, 22 nt, Human
uuuuuauaugaaggauagugcg

SEQ ID NO: 857617 - RNA, 22 nt, Human
uguucuuuggcuucacagcucu

SEQ ID NO: 857618 - RNA, 22 nt, Human
uauauacuuucuuccuggguag

SEQ ID NO: 857619 - RNA, 22 nt, Human
ggaggggaugguuugacccugg

SEQ ID NO: 857620 - RNA, 20 nt, Human
guugaaaguaauaugaugcu

SEQ ID NO: 857621 - RNA, 22 nt, Human
ucauaaaaauagacucuaaagu

SEQ ID NO: 857622 - RNA, 22 nt, Human
aggaagcugccugggaugggaa

SEQ ID NO: 857623 - RNA, 22 nt, Human
ugaggcagguaagcaaguuuug

SEQ ID NO: 857624 - RNA, 22 nt, Human
uucagaaacagagugagugagu

SEQ ID NO: 857625 - RNA, 22 nt, Human
ucagucuucccuccagugcaac

SEQ ID NO: 857626 - RNA, 19 nt, Human
uauuucaaagugccgucua

SEQ ID NO: 857627 - RNA, 22 nt, Human
ccuggaucccgauggcugugag

SEQ ID NO: 857628 - RNA, 22 nt, Human
agcacaauagagcaguuaaaaa

SEQ ID NO: 857629 - RNA, 22 nt, Human
caauuuuuaaacuaugaaguug

SEQ ID NO: 857630 - RNA, 22 nt, Human
gucuuuaugguaugaaaacuga

SEQ ID NO: 857631 - RNA, 22 nt, Human
guucuaauauuuuaaaagccaa

SEQ ID NO: 857632 - RNA, 22 nt, Human
uggagacugugcuaagggaguu

SEQ ID NO: 857633 - RNA, 22 nt, Human
aaucagaaagaucuugaugaga

SEQ ID NO: 857634 - RNA, 22 nt, Human
ggcagaggagcuggaaacaugg

SEQ ID NO: 857635 - RNA, 22 nt, Human
guggaauguccuugaucauaag

SEQ ID NO: 857636 - RNA, 22 nt, Human
ugcauggaggaagaugaaugca

SEQ ID NO: 857637 - RNA, 22 nt, Human
ggccagaggugguacauagcuu

SEQ ID NO: 857638 - RNA, 22 nt, Human
gugcagcugcaggagucagguc

SEQ ID NO: 857639 - RNA, 22 nt, Human
cuuccuucugaagcauagaagc

SEQ ID NO: 857640 - RNA, 22 nt, Human
uacagauauagagauuuauaga

SEQ ID NO: 857641 - RNA, 22 nt, Human
uugaaagaagaagcugcgaugu

SEQ ID NO: 857642 - RNA, 22 nt, Human
ugaaaugacaaagguuuuucuu

SEQ ID NO: 857643 - RNA, 21 nt, Human
ccugcugugaucuuagugagu

SEQ ID NO: 857644 - RNA, 22 nt, Human
gaggcacugcaguacagugacu

SEQ ID NO: 857645 - RNA, 22 nt, Human
aucauucugauggucaaugcua

SEQ ID NO: 857646 - RNA, 22 nt, Human
cauagaaacugagacaaggauu

SEQ ID NO: 857647 - RNA, 22 nt, Human
cuugcugggguaagucugugcu

SEQ ID NO: 857648 - RNA, 22 nt, Human
acuuggcaaguaucuauaaagu

SEQ ID NO: 857649 - RNA, 22 nt, Human
agaccaagaaaggaugaggauc

SEQ ID NO: 857650 - RNA, 21 nt, Human
ucaggagagcccaucuacaaa

SEQ ID NO: 857651 - RNA, 22 nt, Human
ucaauucaacacaugcacauug

SEQ ID NO: 857652 - RNA, 22 nt, Human
uuugaaagaauuuauguacuuu

SEQ ID NO: 857653 - RNA, 22 nt, Human
gaucuucucuuuaguagaaaca

SEQ ID NO: 857654 - RNA, 22 nt, Human
cugcugugcaacauugcaccua

SEQ ID NO: 857655 - RNA, 22 nt, Human
gauuucaaccuaacaguaugac

SEQ ID NO: 857656 - RNA, 22 nt, Human
ccaggaaauagugcugugaucu

SEQ ID NO: 857657 - RNA, 22 nt, Human
uggagacucugcaucugugaca

SEQ ID NO: 857658 - RNA, 22 nt, Human
caacuuuaugauugguuuguca

SEQ ID NO: 857659 - RNA, 22 nt, Human
caaggccacugcucagguuucc

SEQ ID NO: 857660 - RNA, 21 nt, Human
ugaaaugagaaugcugagcac

SEQ ID NO: 857661 - RNA, 22 nt, Human
uuauauuaguuagacuugcugu

SEQ ID NO: 857662 - RNA, 22 nt, Human
uugaacuguaagcaugucugcc

SEQ ID NO: 857663 - RNA, 22 nt, Human
ucagccaggccaggcauucaca

SEQ ID NO: 857664 - RNA, 18 nt, Human
aagucaccccugcucccu

SEQ ID NO: 857665 - RNA, 22 nt, Human
gagguagccacagauagagacu

SEQ ID NO: 857666 - RNA, 22 nt, Human
cauuuguuaauuacuauuaucu

SEQ ID NO: 857667 - RNA, 22 nt, Human
caggagagauaugaguccccac

SEQ ID NO: 857668 - RNA, 22 nt, Human
cauuugcagagggugacacucu

SEQ ID NO: 857669 - RNA, 22 nt, Human
uccaggaggcagggcugugccc

SEQ ID NO: 857670 - RNA, 22 nt, Human
uuagaaagaacuuuagauauca

SEQ ID NO: 857671 - RNA, 22 nt, Human
ggagcaggagucucuugaauuu

SEQ ID NO: 857672 - RNA, 21 nt, Human
ucuuccuccacagcgugccac

SEQ ID NO: 857673 - RNA, 22 nt, Human
accaggaguaacagugaguggu

SEQ ID NO: 857674 - RNA, 22 nt, Human
ucaauaaauagcuuggcucagc

SEQ ID NO: 857675 - RNA, 22 nt, Human
aaaggccaagcaugagguggac

SEQ ID NO: 857676 - RNA, 22 nt, Human
augaggcaaucaugguccaguu

SEQ ID NO: 857677 - RNA, 22 nt, Human
auagacauuuugcauucaagca

SEQ ID NO: 857678 - RNA, 22 nt, Human
caguaaaugcagauauagauac

SEQ ID NO: 857679 - RNA, 22 nt, Human
cuaugacacaggccauuauaua

SEQ ID NO: 857680 - RNA, 22 nt, Human
ugacuucaagguucagcaccuu

SEQ ID NO: 857681 - RNA, 22 nt, Human
caaguccuuuucuuggcucagg

SEQ ID NO: 857682 - RNA, 22 nt, Human
uucuuuugggaauuacguaugc

SEQ ID NO: 857683 - RNA, 22 nt, Human
aaaggccaccaacaugaagcau

SEQ ID NO: 857684 - RNA, 22 nt, Human
caaguccuccaugugacuaggu

SEQ ID NO: 857685 - RNA, 22 nt, Human
gggaggugauuaggaccaugua

SEQ ID NO: 857686 - RNA, 22 nt, Human
uugcaggauuuuagagaugaca

SEQ ID NO: 857687 - RNA, 22 nt, Human
ugagacaguuuuucuauuucca

SEQ ID NO: 857688 - RNA, 22 nt, Human
augaaacaugcuuuguggauga

SEQ ID NO: 857689 - RNA, 21 nt, Human
ugaaacaaucagacagagucu

SEQ ID NO: 857690 - RNA, 22 nt, Human
cccaggagagggaaccaaaugu

SEQ ID NO: 857691 - RNA, 22 nt, Human
uuauuucauguaaaauuuaugu

SEQ ID NO: 857692 - RNA, 22 nt, Human
cugcugugagugguucuugccu

SEQ ID NO: 857693 - RNA, 22 nt, Human
gggcagcuagcccucuagccca

SEQ ID NO: 857694 - RNA, 22 nt, Human
cagauggaacacagaaaggaga

SEQ ID NO: 857695 - RNA, 22 nt, Human
cugccaggcagcagagggagaa

SEQ ID NO: 857696 - RNA, 22 nt, Human
aaguguagauuauggagugucu

SEQ ID NO: 857697 - RNA, 22 nt, Human
ucagugcacagagauuuuuguu

SEQ ID NO: 857698 - RNA, 22 nt, Human
cccuggaggcuggaggcaguag

SEQ ID NO: 857699 - RNA, 22 nt, Human
ccaggagaugauguuggggauu

SEQ ID NO: 857700 - RNA, 22 nt, Human
uacacacaugcauuugccuuau

SEQ ID NO: 857701 - RNA, 20 nt, Human
ucucuucuggggagauaaaa

SEQ ID NO: 857702 - RNA, 22 nt, Human
aaggaaccauuugugugcaugg

SEQ ID NO: 857703 - RNA, 22 nt, Human
caaguccucgcuucuagcugug

SEQ ID NO: 857704 - RNA, 22 nt, Human
aucuccaggcauuucaagagac

SEQ ID NO: 857705 - RNA, 22 nt, Human
caaggccaguuucuccuaguca

SEQ ID NO: 857706 - RNA, 20 nt, Human
agaggaggauuauuuuauuc

SEQ ID NO: 857707 - RNA, 22 nt, Human
auguucuuccaaaucuguaaca

SEQ ID NO: 857708 - RNA, 23 nt, Human
ucagucuucccugucaguaauag

SEQ ID NO: 857709 - RNA, 22 nt, Human
agaagugagugugacucagcag

SEQ ID NO: 857710 - RNA, 19 nt, Human
ugcugcuguccuugcaggg

SEQ ID NO: 857711 - RNA, 22 nt, Human
uuccuuagggucagccagaucu

SEQ ID NO: 857712 - RNA, 22 nt, Human
agccaacuaggagauuaaggua

SEQ ID NO: 857713 - RNA, 22 nt, Human
uccaggaggcucugguugacgu

SEQ ID NO: 857714 - RNA, 22 nt, Human
ugcaggaaucagaggggaagcg

SEQ ID NO: 857715 - RNA, 22 nt, Human
ugucucugaggugagggucagc

SEQ ID NO: 857716 - RNA, 23 nt, Human
augguuuaugucacacuuuugau

SEQ ID NO: 857717 - RNA, 22 nt, Human
ugcauaauacguuuccuauaac

SEQ ID NO: 857718 - RNA, 22 nt, Human
uccaggagucuagccucaggcc

SEQ ID NO: 857719 - RNA, 22 nt, Human
aauaaaaugaacugguagaguu

SEQ ID NO: 857720 - RNA, 22 nt, Human
gcaggaagcauagaagaaugcc

SEQ ID NO: 857721 - RNA, 19 nt, Human
agacagagcucaguggguu

SEQ ID NO: 857722 - RNA, 22 nt, Human
gaggcugcuuugaugacaggag

SEQ ID NO: 857723 - RNA, 22 nt, Human
ucaguaaaugagcaaaaauuuc

SEQ ID NO: 857724 - RNA, 18 nt, Human
agggaguuuuagggaagg

SEQ ID NO: 857725 - RNA, 22 nt, Human
gggcagcugccacuccgcuugc

SEQ ID NO: 857726 - RNA, 22 nt, Human
ucacaguaucacacaaggauua

SEQ ID NO: 857727 - RNA, 22 nt, Human
uggaguucucaggugagggcuu

SEQ ID NO: 857728 - RNA, 22 nt, Human
cuuuccaagaaugcagauaccu

SEQ ID NO: 857729 - RNA, 22 nt, Human
aguccuuugggaaaaaugacua

SEQ ID NO: 857730 - RNA, 22 nt, Human
ucugcaggcuuauaggaugggu

SEQ ID NO: 857731 - RNA, 22 nt, Human
aggauuuaggagcuggcuaacg

SEQ ID NO: 857732 - RNA, 22 nt, Human
gucaggauuauaauccccaugg

SEQ ID NO: 857733 - RNA, 22 nt, Human
uuucuagucucgaucucuuaau

SEQ ID NO: 857734 - RNA, 22 nt, Human
gauggcagcauauugacagcau

SEQ ID NO: 857735 - RNA, 22 nt, Human
uaggcaacaugucgaauacugu

SEQ ID NO: 857736 - RNA, 22 nt, Human
cuauuucaaggcccagauauga

SEQ ID NO: 857737 - RNA, 22 nt, Human
agggugguucuuuuaguggaag

SEQ ID NO: 857738 - RNA, 22 nt, Human
guugaaugaaucauucuaugua

SEQ ID NO: 857739 - RNA, 22 nt, Human
aagggcagagggaaucccacau

SEQ ID NO: 857740 - RNA, 22 nt, Human
aauccugugugacucuggggag

SEQ ID NO: 857741 - RNA, 21 nt, Human
uucuucuuggacuguuuuggc

SEQ ID NO: 857742 - RNA, 22 nt, Human
uugcagcuucuaccacuguuuc

SEQ ID NO: 857743 - RNA, 22 nt, Human
aagagagggguugcauggaaau

SEQ ID NO: 857744 - RNA, 22 nt, Human
ggaccuggcaauuugcaucucu

SEQ ID NO: 857745 - RNA, 22 nt, Human
gaggacaggagacucacuguuu

SEQ ID NO: 857746 - RNA, 22 nt, Human
cagaauuuagcacaauguaugg

SEQ ID NO: 857747 - RNA, 22 nt, Human
aaguccuuuauccuaaaagguc

SEQ ID NO: 857748 - RNA, 22 nt, Human
auucuuauuuaaauagagucug

SEQ ID NO: 857749 - RNA, 22 nt, Human
ugagccugguugcagugucugg

SEQ ID NO: 857750 - RNA, 22 nt, Human
uauuccaaaauaguuaagcacu

SEQ ID NO: 857751 - RNA, 22 nt, Human
aauuucaaguggcaucuuugau

SEQ ID NO: 857752 - RNA, 22 nt, Human
ggccagcucuuguccacggagg

SEQ ID NO: 857753 - RNA, 22 nt, Human
aaucagucucauuuagcaggga

SEQ ID NO: 857754 - RNA, 22 nt, Human
uuugcaauuugugcugcaaaug

SEQ ID NO: 857755 - RNA, 22 nt, Human
ggcagggaagcuggcaucacgg

SEQ ID NO: 857756 - RNA, 22 nt, Human
ucuauacaaguuucacuuugac

SEQ ID NO: 857757 - RNA, 22 nt, Human
uggcuucuugggaugggucauu

SEQ ID NO: 857758 - RNA, 19 nt, Human
aucugccuuagugcugcug

SEQ ID NO: 857759 - RNA, 22 nt, Human
aaauacugucucugagagagcc

SEQ ID NO: 857760 - RNA, 22 nt, Human
uuucuuauacuauauugucauc

SEQ ID NO: 857761 - RNA, 22 nt, Human
uuucaaaauuuugcagugguaa

SEQ ID NO: 857762 - RNA, 22 nt, Human
ugaauaauuaugggaguccuaa

SEQ ID NO: 857763 - RNA, 22 nt, Human
aggagagaauguuccaggcuug

SEQ ID NO: 857764 - RNA, 22 nt, Human
ucacaaaugaggaaaucgagca

SEQ ID NO: 857765 - RNA, 22 nt, Human
uuuauuguuuagaagggggcug

SEQ ID NO: 857766 - RNA, 22 nt, Human
agcaccaugaccuugccauuga

SEQ ID NO: 857767 - RNA, 22 nt, Human
aauuuccagaccccauccacag

SEQ ID NO: 857768 - RNA, 22 nt, Human
agaaaauauucauugagaggcu

SEQ ID NO: 857769 - RNA, 22 nt, Human
aggcuucugugagcucauacaa

SEQ ID NO: 857770 - RNA, 22 nt, Human
agcugcccagauaggaggaggc

SEQ ID NO: 857771 - RNA, 22 nt, Human
uuuauuaugauggacaccuucg

SEQ ID NO: 857772 - RNA, 22 nt, Human
caggcagggagcuggaaaggau

SEQ ID NO: 857773 - RNA, 22 nt, Human
aggagaaggaagugcaucacua

SEQ ID NO: 857774 - RNA, 22 nt, Human
uuuauccagaaucaggauuuuu

SEQ ID NO: 857775 - RNA, 21 nt, Human
uucuccccagcgaauccucgg

SEQ ID NO: 857776 - RNA, 22 nt, Human
ggaggaggggugacugaaugcu

SEQ ID NO: 857777 - RNA, 22 nt, Human
ugaucugaaggacaugggaccc

SEQ ID NO: 857778 - RNA, 22 nt, Human
uucagaaguagcuaagcaguca

SEQ ID NO: 857779 - RNA, 22 nt, Human
uugauuucuauucagauguaga

SEQ ID NO: 857780 - RNA, 22 nt, Human
aucacaaaggguuuucucugag

SEQ ID NO: 857781 - RNA, 22 nt, Human
cuucucagcauuuugucagucu

SEQ ID NO: 857782 - RNA, 22 nt, Human
ucucucuugucaccccaucugc

SEQ ID NO: 857783 - RNA, 22 nt, Human
auugaaagauauacuguucuca

SEQ ID NO: 857784 - RNA, 22 nt, Human
aaaagucugcucucauuucaga

SEQ ID NO: 857785 - RNA, 22 nt, Human
ccagugcuuccaggaauacggu

SEQ ID NO: 857786 - RNA, 22 nt, Human
cuuaagaugaggucaugcuaua

SEQ ID NO: 857787 - RNA, 17 nt, Human
gucauucucagaaaaug

SEQ ID NO: 857788 - RNA, 21 nt, Human
uucaaagacuugaugcugacc

SEQ ID NO: 857789 - RNA, 22 nt, Human
caggcagcagaggaguguggga

SEQ ID NO: 857790 - RNA, 18 nt, Human
cugcccagagcauuucau

SEQ ID NO: 857791 - RNA, 22 nt, Human
aaaugaaaugagugccuggagg

SEQ ID NO: 857792 - RNA, 22 nt, Human
caugcuuauucauucugcuaac

SEQ ID NO: 857793 - RNA, 22 nt, Human
gccugcagaacugugaggcaau

SEQ ID NO: 857794 - RNA, 22 nt, Human
gaagcagcgaaguggaagggac

SEQ ID NO: 857795 - RNA, 22 nt, Human
gaggggaaaguucugcacaagg

SEQ ID NO: 857796 - RNA, 22 nt, Human
cccaaggaagacgcuugugaua

SEQ ID NO: 857797 - RNA, 22 nt, Human
ucacagaagagauauugacaga

SEQ ID NO: 857798 - RNA, 22 nt, Human
gauuuucauuugcacucuagaa

SEQ ID NO: 857799 - RNA, 22 nt, Human
gguacaaugguucauuuuaugu

SEQ ID NO: 857800 - RNA, 22 nt, Human
agacucaagacugcagaagacg

SEQ ID NO: 857801 - RNA, 22 nt, Human
aggcagagcuggguuuugaaau

SEQ ID NO: 857802 - RNA, 22 nt, Human
cauggcuuuguucuguuagaug

SEQ ID NO: 857803 - RNA, 22 nt, Human
aagaaaucagaaaagcauucgu

SEQ ID NO: 857804 - RNA, 21 nt, Human
gauuuuaaagagacugccaca

SEQ ID NO: 857805 - RNA, 22 nt, Human
aaggcagcaagaauuccagguu

SEQ ID NO: 857806 - RNA, 19 nt, Human
caggaaugagguaauggcu

SEQ ID NO: 857807 - RNA, 22 nt, Human
uucucagagcucacuguaguaa

SEQ ID NO: 857808 - RNA, 22 nt, Human
aaucagugguucccagcccagg

SEQ ID NO: 857809 - RNA, 22 nt, Human
caucacccggaacugugucugc

SEQ ID NO: 857810 - RNA, 20 nt, Human
augugucuguaaacaacucu

SEQ ID NO: 857811 - RNA, 22 nt, Human
uuugaaaggagcuuuauccaga

SEQ ID NO: 857812 - RNA, 22 nt, Human
aaucagaauuuauugaaucuuu

SEQ ID NO: 857813 - RNA, 22 nt, Human
uguuguuuucucauggagaaua

SEQ ID NO: 857814 - RNA, 22 nt, Human
ucaacugcaaguuugcuuaguu

SEQ ID NO: 857815 - RNA, 22 nt, Human
gcaaauauucaagacuuuucca

SEQ ID NO: 857816 - RNA, 22 nt, Human
guuaaagaagaauaguuccuuu

SEQ ID NO: 857817 - RNA, 22 nt, Human
gaucugaagagcaaugaaauau

SEQ ID NO: 857818 - RNA, 22 nt, Human
ucagagaguuggaaagaauuaa

SEQ ID NO: 857819 - RNA, 22 nt, Human
cagagccauuauggagacuugc

SEQ ID NO: 857820 - RNA, 22 nt, Human
uguacaaucugaugauguaugg

SEQ ID NO: 857821 - RNA, 22 nt, Human
augcaaaauaaggcagaaacau

SEQ ID NO: 857822 - RNA, 22 nt, Human
cccaggaauuggaggcugcagu

SEQ ID NO: 857823 - RNA, 22 nt, Human
uuucagaaagcugaacauauga

SEQ ID NO: 857824 - RNA, 22 nt, Human
uuuccaaacccagcgagcuaca

SEQ ID NO: 857825 - RNA, 22 nt, Human
uggcaguccccugugccuggaa

SEQ ID NO: 857826 - RNA, 17 nt, Human
ugaaaucagcacccagg

SEQ ID NO: 857827 - RNA, 20 nt, Human
uacaauacacaugcauauga

SEQ ID NO: 857828 - RNA, 22 nt, Human
uuuaggcauugaauuagaauag

SEQ ID NO: 857829 - RNA, 22 nt, Human
ucauuucuccgaccugcugucc

SEQ ID NO: 857830 - RNA, 19 nt, Human
ucccaggaaccuuuuauuu

SEQ ID NO: 857831 - RNA, 22 nt, Human
uugcacuaggaaaaggcagcca

SEQ ID NO: 857832 - RNA, 22 nt, Human
ccaauacacuuuauagaagaaa

SEQ ID NO: 857833 - RNA, 20 nt, Human
agaaaucagaccacacacua

SEQ ID NO: 857834 - RNA, 22 nt, Human
gaggagcuggcugucgggaggc

SEQ ID NO: 857835 - RNA, 22 nt, Human
cccuugcacauuugucuuuaau

SEQ ID NO: 857836 - RNA, 22 nt, Human
ucuggaucucccucauccuggg

SEQ ID NO: 857837 - RNA, 22 nt, Human
ucaaguuuaauugagauguuua

SEQ ID NO: 857838 - RNA, 22 nt, Human
cacaaaugguuguagacauuaa

SEQ ID NO: 857839 - RNA, 22 nt, Human
aggcuggagggcaauggcaaga

SEQ ID NO: 857840 - RNA, 22 nt, Human
cagaggcagccgggggagaacg

SEQ ID NO: 857841 - RNA, 22 nt, Human
gcccaggaaauaaaagugggcu

SEQ ID NO: 857842 - RNA, 22 nt, Human
ugaagaaucagauuggccugcg

SEQ ID NO: 857843 - RNA, 22 nt, Human
acuggaucagaaucugauuuuu

SEQ ID NO: 857844 - RNA, 22 nt, Human
aacauuuaugauugagguaaau

SEQ ID NO: 857845 - RNA, 19 nt, Human
uucuccagccugaccugag

SEQ ID NO: 857846 - RNA, 22 nt, Human
uucuucucggcugucagauagu

SEQ ID NO: 857847 - RNA, 22 nt, Human
cgccucagccguggucaucuuc

SEQ ID NO: 857848 - RNA, 22 nt, Human
guccucuggaagaugaguucuu

SEQ ID NO: 857849 - RNA, 22 nt, Human
ugcuagugcaggguuuucaguu

SEQ ID NO: 857850 - RNA, 22 nt, Human
augcugugucuagcaggaacac

SEQ ID NO: 857851 - RNA, 22 nt, Human
auuaucuauguagaaugauuuu

SEQ ID NO: 857852 - RNA, 22 nt, Human
gccagagguucaacaacugucu

SEQ ID NO: 857853 - RNA, 21 nt, Human
ugaaagaaggugcagucugaa

SEQ ID NO: 857854 - RNA, 22 nt, Human
uggcauuugggcuggcuuuucu

SEQ ID NO: 857855 - RNA, 22 nt, Human
caagagagaugcagcucacuca

SEQ ID NO: 857856 - RNA, 20 nt, Human
uugauucaagggcugaugga

SEQ ID NO: 857857 - RNA, 22 nt, Human
aguauuuagcauagugguuagu

SEQ ID NO: 857858 - RNA, 22 nt, Human
cauuucacaaauggccacauca

SEQ ID NO: 857859 - RNA, 22 nt, Human
acauaccauacauggugagaug

SEQ ID NO: 857860 - RNA, 19 nt, Human
ggcagucucaagcagcaca

SEQ ID NO: 857861 - RNA, 22 nt, Human
aggagagggguaggauuaauuu

SEQ ID NO: 857862 - RNA, 22 nt, Human
uaauuguagcuuuguaaucagc

SEQ ID NO: 857863 - RNA, 22 nt, Human
ccuggagauuucuucaagcuuu

SEQ ID NO: 857864 - RNA, 22 nt, Human
ugaaugaguuuggcugcuguuc

SEQ ID NO: 857865 - RNA, 22 nt, Human
cucuaacaccacagugugguuu

SEQ ID NO: 857866 - RNA, 22 nt, Human
ugaggcagauauuuauuggguu

SEQ ID NO: 857867 - RNA, 20 nt, Human
ucaggaugugcugagugaag

SEQ ID NO: 857868 - RNA, 23 nt, Human
acacauuuuucccguucugaggu

SEQ ID NO: 857869 - RNA, 18 nt, Human
aauuuccauaugaauugc

SEQ ID NO: 857870 - RNA, 18 nt, Human
ucaggagacacagacgca

SEQ ID NO: 857871 - RNA, 22 nt, Human
acuuaaaaagaaucuuuucacg

SEQ ID NO: 857872 - RNA, 22 nt, Human
uuaggaguccagaugucuuggg

SEQ ID NO: 857873 - RNA, 22 nt, Human
auuccaaaaggauguuagaaug

SEQ ID NO: 857874 - RNA, 22 nt, Human
gaauuucagagguaacaucauc

SEQ ID NO: 857875 - RNA, 22 nt, Human
agcugcccuuaauaggcauuca

SEQ ID NO: 857876 - RNA, 22 nt, Human
ucucaggagccacagcgggagu

SEQ ID NO: 857877 - RNA, 22 nt, Human
aguaaaucagaccucauuaugu

SEQ ID NO: 857878 - RNA, 23 nt, Human
uggagcugacagucagagggagg

SEQ ID NO: 857879 - RNA, 21 nt, Human
uccaggaguggcugggcaggg

SEQ ID NO: 857880 - RNA, 22 nt, Human
ugcugaugaguccuucuaucgc

SEQ ID NO: 857881 - RNA, 22 nt, Human
ugacauaauaauccaaacauac

SEQ ID NO: 857882 - RNA, 22 nt, Human
aggagcagaacugauucugacu

SEQ ID NO: 857883 - RNA, 19 nt, Human
caagugaagccugggaugg

SEQ ID NO: 857884 - RNA, 22 nt, Human
ugaggcaggacuugcauaaagu

SEQ ID NO: 857885 - RNA, 22 nt, Human
ggagauggaauagauucugacu

SEQ ID NO: 857886 - RNA, 18 nt, Human
ggucuuuaggucaguguc

SEQ ID NO: 857887 - RNA, 22 nt, Human
uacuuucuguccuucuguuaaa

SEQ ID NO: 857888 - RNA, 22 nt, Human
gaggcagcugggcuggugguuu

SEQ ID NO: 857889 - RNA, 22 nt, Human
cuuuacauaaggauaaaccugg

SEQ ID NO: 857890 - RNA, 22 nt, Human
cccaggagcuucucucugccuc

SEQ ID NO: 857891 - RNA, 22 nt, Human
uucuucuugucugcccucacau

SEQ ID NO: 857892 - RNA, 22 nt, Human
aguggcagagccaaguagagcc

SEQ ID NO: 857893 - RNA, 22 nt, Human
aggcagcguagcaaggcuagua

SEQ ID NO: 857894 - RNA, 22 nt, Human
uucugagacaauugagagucua

SEQ ID NO: 857895 - RNA, 22 nt, Human
agaucugaaucucauccgagga

SEQ ID NO: 857896 - RNA, 22 nt, Human
ggagaggacauggcucccacag

SEQ ID NO: 857897 - RNA, 22 nt, Human
uuucaacuagccccuaaguccu

SEQ ID NO: 857898 - RNA, 22 nt, Human
aucaggaucagggcuagcagag

SEQ ID NO: 857899 - RNA, 22 nt, Human
ugccuguguccccuucuuggca

SEQ ID NO: 857900 - RNA, 22 nt, Human
uuuaggcauacuuuugggagaa

SEQ ID NO: 857901 - RNA, 22 nt, Human
acagauguacacucauauauaa

SEQ ID NO: 857902 - RNA, 21 nt, Human
aggauuuacuauuaacugugu

SEQ ID NO: 857903 - RNA, 22 nt, Human
caguccuuauuccuauauuccu

SEQ ID NO: 857904 - RNA, 22 nt, Human
cauugcuuccuaugucccuucu

SEQ ID NO: 857905 - RNA, 18 nt, Human
ugcuggguaacuguaugg

SEQ ID NO: 857906 - RNA, 22 nt, Human
cagcugccuucugcgggaaguc

SEQ ID NO: 857907 - RNA, 22 nt, Human
uuagccaugugggaaaaacagc

SEQ ID NO: 857908 - RNA, 22 nt, Human
uucuuuuacauuaagauuucag

SEQ ID NO: 857909 - RNA, 22 nt, Human
caauauauaaugaguacuuucc

SEQ ID NO: 857910 - RNA, 19 nt, Human
uucccaggaaaggggugca

SEQ ID NO: 857911 - RNA, 22 nt, Human
uuuccaaaggaggaaccaguuu

SEQ ID NO: 857912 - RNA, 22 nt, Human
ggccaggaagggaagaucagca

SEQ ID NO: 857913 - RNA, 21 nt, Human
uuugaaagcccuauguuuuca

SEQ ID NO: 857914 - RNA, 22 nt, Human
gauuucuugauaaguaguguga

SEQ ID NO: 857915 - RNA, 22 nt, Human
aauuuccaaauuucugucacac

SEQ ID NO: 857916 - RNA, 22 nt, Human
aaaagccaugcauaccuaagag

SEQ ID NO: 857917 - RNA, 22 nt, Human
auucugauaucuuauucuagcu

SEQ ID NO: 857918 - RNA, 22 nt, Human
uucucagagugaccaagucuuu

SEQ ID NO: 857919 - RNA, 22 nt, Human
uggaaauguauuugggcaugcc

SEQ ID NO: 857920 - RNA, 22 nt, Human
agauggaguuaguaccagaguc

SEQ ID NO: 857921 - RNA, 22 nt, Human
uccaggaguccugggagugauu

SEQ ID NO: 857922 - RNA, 22 nt, Human
accaggagucuagccuagucaa

SEQ ID NO: 857923 - RNA, 22 nt, Human
agaauuucuggaagauugcaag

SEQ ID NO: 857924 - RNA, 22 nt, Human
augcuguguggccaccuccaug

SEQ ID NO: 857925 - RNA, 22 nt, Human
cuguaguugaugauuucugaua

SEQ ID NO: 857926 - RNA, 22 nt, Human
gggagacacgcugcaggcauaa

SEQ ID NO: 857927 - RNA, 22 nt, Human
augcuuuuaugucacaugguca

SEQ ID NO: 857928 - RNA, 22 nt, Human
gagaggcagaggccugaaaccg

SEQ ID NO: 857929 - RNA, 22 nt, Human
uuuccaaaguugccauaagcuu

SEQ ID NO: 857930 - RNA, 21 nt, Human
uccaaaaaggagcguccuucu

SEQ ID NO: 857931 - RNA, 19 nt, Human
aggauuuauuaugugcuca

SEQ ID NO: 857932 - RNA, 22 nt, Human
auucuucaaagagugucaaagu

SEQ ID NO: 857933 - RNA, 22 nt, Human
uaacaguguggacuugagaucu

SEQ ID NO: 857934 - RNA, 22 nt, Human
gcagcugaaagggaucucuaca

SEQ ID NO: 857935 - RNA, 22 nt, Human
acugcccucccaucuauugcaa

SEQ ID NO: 857936 - RNA, 18 nt, Human
aguccuuacgaggcuaua

SEQ ID NO: 857937 - RNA, 22 nt, Human
aaauacuagaauucagaguuga

SEQ ID NO: 857938 - RNA, 22 nt, Human
cuuuaacaaaugacucuugucu

SEQ ID NO: 857939 - RNA, 22 nt, Human
gaggagagaacauuccuccaua

SEQ ID NO: 857940 - RNA, 22 nt, Human
cugcuguguuccuccugcaucu

SEQ ID NO: 857941 - RNA, 22 nt, Human
auggaguucuuuaaauucacag

SEQ ID NO: 857942 - RNA, 22 nt, Human
uaguacaguuuaaauauuaaua

SEQ ID NO: 857943 - RNA, 22 nt, Human
augaacaagagagggaagauuc

SEQ ID NO: 857944 - RNA, 22 nt, Human
auacuguuuugugacuuaucuu

SEQ ID NO: 857945 - RNA, 22 nt, Human
cccaggagguguagcugcgugg

SEQ ID NO: 857946 - RNA, 19 nt, Human
uggagaggaaaugcugcuc

SEQ ID NO: 857947 - RNA, 22 nt, Human
ucucugguuauuaacuaacucc

SEQ ID NO: 857948 - RNA, 22 nt, Human
agcuggcagcucucagggguac

SEQ ID NO: 857949 - RNA, 22 nt, Human
uagggaugagccaguggguagu

SEQ ID NO: 857950 - RNA, 22 nt, Human
gucaggaucucccaguacauau

SEQ ID NO: 857951 - RNA, 22 nt, Human
uugcauuuaaguagauguuaca

SEQ ID NO: 857952 - RNA, 22 nt, Human
uacccaggggcugagcagaggu

SEQ ID NO: 857953 - RNA, 22 nt, Human
caauuucauggauaaaagaugu

SEQ ID NO: 857954 - RNA, 22 nt, Human
accaggagagauuuuauugaga

SEQ ID NO: 857955 - RNA, 22 nt, Human
acaguacauaauccugagucug

SEQ ID NO: 857956 - RNA, 22 nt, Human
uuuaaauucugucugccgcuua

SEQ ID NO: 857957 - RNA, 17 nt, Human
acagagcacaucaagau

SEQ ID NO: 857958 - RNA, 22 nt, Human
cuacagaagccguggucaggaa

SEQ ID NO: 857959 - RNA, 16 nt, Human
uuuccaaagggcagcu

SEQ ID NO: 857960 - RNA, 22 nt, Human
caaagaagagauuuacagagcu

SEQ ID NO: 857961 - RNA, 22 nt, Human
uugcauuuccuguacuguuuga

SEQ ID NO: 857962 - RNA, 22 nt, Human
gaaugaauucagcacauggaau

SEQ ID NO: 857963 - RNA, 22 nt, Human
gcucuaauugaaaaauacugca

SEQ ID NO: 857964 - RNA, 22 nt, Human
ugcuggguagaaguauuagucu

SEQ ID NO: 857965 - RNA, 23 nt, Human
ccaaagucgaagucuaguccaga

SEQ ID NO: 857966 - RNA, 22 nt, Human
ugaggggagacagaguggacuc

SEQ ID NO: 857967 - RNA, 22 nt, Human
auggcauuauagcaaugguuug

SEQ ID NO: 857968 - RNA, 22 nt, Human
gagagguccauuccccugucag

SEQ ID NO: 857969 - RNA, 22 nt, Human
acagucuacuugagcuuguaua

SEQ ID NO: 857970 - RNA, 22 nt, Human
guuauacauauguguuaacaaa

SEQ ID NO: 857971 - RNA, 22 nt, Human
ugcuauacauguacauauuagu

SEQ ID NO: 857972 - RNA, 22 nt, Human
uuuaggcacaacuacucagcua

SEQ ID NO: 857973 - RNA, 22 nt, Human
aggccagcaagaaagagagucu

SEQ ID NO: 857974 - RNA, 23 nt, Human
aggcagcuggguagcaucuuucu

SEQ ID NO: 857975 - RNA, 22 nt, Human
uuugaacaugcugcaugauaau

SEQ ID NO: 857976 - RNA, 22 nt, Human
agagauucauguuuacuguagg

SEQ ID NO: 857977 - RNA, 22 nt, Human
caguccuugauccaauaguggg

SEQ ID NO: 857978 - RNA, 22 nt, Human
ccagaagaccccguccaccucc

SEQ ID NO: 857979 - RNA, 22 nt, Human
auaaaugccucagaaucauccc

SEQ ID NO: 857980 - RNA, 22 nt, Human
uuggaugaagucuagcuuuagu

SEQ ID NO: 857981 - RNA, 22 nt, Human
accaggaggcuacacuguccca

SEQ ID NO: 857982 - RNA, 22 nt, Human
uuucacacaacgugaauauacu

SEQ ID NO: 857983 - RNA, 22 nt, Human
agagaugaacauaaaacaagga

SEQ ID NO: 857984 - RNA, 21 nt, Human
uuagaaagcucacuacaguua

SEQ ID NO: 857985 - RNA, 22 nt, Human
gugaauaaagggaguuuucaaa

SEQ ID NO: 857986 - RNA, 22 nt, Human
uuauagaaggagcauucacuua

SEQ ID NO: 857987 - RNA, 22 nt, Human
cccaggagguggagcuugcagu

SEQ ID NO: 857988 - RNA, 22 nt, Human
caucaucaaaagugacagagaa

SEQ ID NO: 857989 - RNA, 22 nt, Human
uguuuucagucauauagcaggu

SEQ ID NO: 857990 - RNA, 22 nt, Human
cagaucuguaguaaaagaucuc

SEQ ID NO: 857991 - RNA, 22 nt, Human
agaucugaggguccaagggagg

SEQ ID NO: 857992 - RNA, 22 nt, Human
aggguccugggugcaguugcuu

SEQ ID NO: 857993 - RNA, 22 nt, Human
uguacaaugccagggaacacca

SEQ ID NO: 857994 - RNA, 22 nt, Human
aggcuucuucuuccuauuuagu

SEQ ID NO: 857995 - RNA, 22 nt, Human
ugaaagguagcuggccucauag

SEQ ID NO: 857996 - RNA, 22 nt, Human
cagaaggcuuuguggaguagac

SEQ ID NO: 857997 - RNA, 22 nt, Human
agacaaauggaguaugagcaac

SEQ ID NO: 857998 - RNA, 22 nt, Human
agcugcccugggcuggagaugg

SEQ ID NO: 857999 - RNA, 22 nt, Human
ucugaagauuaccagcuaaaug

SEQ ID NO: 858000 - RNA, 22 nt, Human
uuuccaaagguggcaggaacaa

SEQ ID NO: 858001 - RNA, 22 nt, Human
cagugauguuucugcaucagag

SEQ ID NO: 858002 - RNA, 22 nt, Human
cauuuacagugagaguuuuuac

SEQ ID NO: 858003 - RNA, 22 nt, Human
gcuacugauugaccuuggagag

SEQ ID NO: 858004 - RNA, 22 nt, Human
uuucuucaauugcuaacaagga

SEQ ID NO: 858005 - RNA, 22 nt, Human
ugaggcagucacccccuccugc

SEQ ID NO: 858006 - RNA, 22 nt, Human
ggagcacuauaauagagauuuu

SEQ ID NO: 858007 - RNA, 22 nt, Human
uaucauaaguuaauuaaacagu

SEQ ID NO: 858008 - RNA, 22 nt, Human
guguguuucagaagccaggugu

SEQ ID NO: 858009 - RNA, 21 nt, Human
uucucagaucgaguagugaga

SEQ ID NO: 858010 - RNA, 22 nt, Human
aaauguuucuacuugugagcau

SEQ ID NO: 858011 - RNA, 17 nt, Human
cuguuaauucauuuccc

SEQ ID NO: 858012 - RNA, 22 nt, Human
ucuaaacacuaagucuugaugc

SEQ ID NO: 858013 - RNA, 22 nt, Human
gagguggugguggaggcauagc

SEQ ID NO: 858014 - RNA, 22 nt, Human
agaggggaaggaugugauguga

SEQ ID NO: 858015 - RNA, 22 nt, Human
cccaggaacuccagagcuccuc

SEQ ID NO: 858016 - RNA, 22 nt, Human
uguauacauuuaacuagauaga

SEQ ID NO: 858017 - RNA, 22 nt, Human
guuuuauaauugcuucauaaga

SEQ ID NO: 858018 - RNA, 22 nt, Human
ccaugcacaccagcaggcagac

SEQ ID NO: 858019 - RNA, 22 nt, Human
ucugcagguguuggaaggguca

SEQ ID NO: 858020 - RNA, 22 nt, Human
cuugcugugugguguucucaga

SEQ ID NO: 858021 - RNA, 23 nt, Human
cagggaggagauacuguguaucu

SEQ ID NO: 858022 - RNA, 22 nt, Human
aaauugcaaaaguacuuuuagg

SEQ ID NO: 858023 - RNA, 23 nt, Human
ugguucuaggccuauaauuauau

SEQ ID NO: 858024 - RNA, 22 nt, Human
aaaucaguuaagaugaggccau

SEQ ID NO: 858025 - RNA, 22 nt, Human
uuaauuacuaagcacaaugcaa

SEQ ID NO: 858026 - RNA, 22 nt, Human
ucagaaaagguagcugugacaa

SEQ ID NO: 858027 - RNA, 20 nt, Human
aaguuacauuguauuguacc

SEQ ID NO: 858028 - RNA, 22 nt, Human
ugaggcaggacugagcgggaug

SEQ ID NO: 858029 - RNA, 22 nt, Human
uucuucuugaaacuuuagguug

SEQ ID NO: 858030 - RNA, 22 nt, Human
cuuccaaaauuuauauguugaa

SEQ ID NO: 858031 - RNA, 22 nt, Human
augauauuugcaaugugcuugc

SEQ ID NO: 858032 - RNA, 22 nt, Human
uguuuuaaucucccauugcucu

SEQ ID NO: 858033 - RNA, 22 nt, Human
accaggagcauuuuuuauuagu

SEQ ID NO: 858034 - RNA, 22 nt, Human
cacagcauaaugaaauauacuu

SEQ ID NO: 858035 - RNA, 20 nt, Human
aggauuuacuacuaccugcu

SEQ ID NO: 858036 - RNA, 22 nt, Human
ccaggcugccgaggaaagaaag

SEQ ID NO: 858037 - RNA, 22 nt, Human
gagggaauggugugcaagaggu

SEQ ID NO: 858038 - RNA, 22 nt, Human
aggacuuagaacauuauguacu

SEQ ID NO: 858039 - RNA, 22 nt, Human
uuagcaucugcuguaagcuuau

SEQ ID NO: 858040 - RNA, 22 nt, Human
ugcauauuguccuugauauuau

SEQ ID NO: 858041 - RNA, 22 nt, Human
uuauuuacaacucuucucuucc

SEQ ID NO: 858042 - RNA, 22 nt, Human
gagguggaaggcaggaacaaau

SEQ ID NO: 858043 - RNA, 22 nt, Human
caguccuuccuugccccuuggg

SEQ ID NO: 858044 - RNA, 22 nt, Human
cuuccaaacccaggguaugggc

SEQ ID NO: 858045 - RNA, 22 nt, Human
auugaaagguuuugagcagaua

SEQ ID NO: 858046 - RNA, 22 nt, Human
ucaauucaauugaacaguuacu

SEQ ID NO: 858047 - RNA, 22 nt, Human
cccaggaggcagaaguugcagu

SEQ ID NO: 858048 - RNA, 22 nt, Human
uugaauaauaugcuucguucuc

SEQ ID NO: 858049 - RNA, 22 nt, Human
agaauuccucuaggaucugccc

SEQ ID NO: 858050 - RNA, 22 nt, Human
ugaugaauaaacuugagaguca

SEQ ID NO: 858051 - RNA, 22 nt, Human
auuugcuuucagguauaaaagg

SEQ ID NO: 858052 - RNA, 22 nt, Human
aggcacagagaaugcccuccau

SEQ ID NO: 858053 - RNA, 22 nt, Human
uuuuaugugcuggacuggcagu

SEQ ID NO: 858054 - RNA, 22 nt, Human
uuuauccaguguuggaauuuuu

SEQ ID NO: 858055 - RNA, 22 nt, Human
uuugaagucaaagauugauucc

SEQ ID NO: 858056 - RNA, 21 nt, Human
agggagcuuuagguagaaguu

SEQ ID NO: 858057 - RNA, 22 nt, Human
agugcuuugagcguuugaaaag

SEQ ID NO: 858058 - RNA, 22 nt, Human
gaggcagcuuaggguacugacu

SEQ ID NO: 858059 - RNA, 22 nt, Human
ugcccagggauaagccuagaga

SEQ ID NO: 858060 - RNA, 22 nt, Human
ggugaagggugucauggcauuu

SEQ ID NO: 858061 - RNA, 20 nt, Human
auacuuguuuucaggcuuuu

SEQ ID NO: 858062 - RNA, 22 nt, Human
uguacaauggcuauaauacccu

SEQ ID NO: 858063 - RNA, 22 nt, Human
gauuuacaaagcucucuagugu

SEQ ID NO: 858064 - RNA, 22 nt, Human
gcuggcuugauaguuucugcuu

SEQ ID NO: 858065 - RNA, 22 nt, Human
gccaggagacuccauucauuug

SEQ ID NO: 858066 - RNA, 22 nt, Human
aggaagcuccuggagagccagu

SEQ ID NO: 858067 - RNA, 22 nt, Human
ugucccucugaggcuucccugg

SEQ ID NO: 858068 - RNA, 22 nt, Human
guuaggcaguuuucuucauucu

SEQ ID NO: 858069 - RNA, 22 nt, Human
uggcagcugagugcacccccuc

SEQ ID NO: 858070 - RNA, 22 nt, Human
gaggcagcaugguaccuuggag

SEQ ID NO: 858071 - RNA, 22 nt, Human
uuugaacaggaguaucuauagu

SEQ ID NO: 858072 - RNA, 22 nt, Human
aaaucucaguguucuaagcauu

SEQ ID NO: 858073 - RNA, 22 nt, Human
uucaacucuucaagaucacauc

SEQ ID NO: 858074 - RNA, 22 nt, Human
guucuugccagcauccucaggu

SEQ ID NO: 858075 - RNA, 22 nt, Human
gcagaagucagaccaucugaau

SEQ ID NO: 858076 - RNA, 22 nt, Human
acaugcauacacguacauaccu

SEQ ID NO: 858077 - RNA, 22 nt, Human
cugaggaagacagcagcugugu

SEQ ID NO: 858078 - RNA, 22 nt, Human
auaucaguaucuauguauuugu

SEQ ID NO: 858079 - RNA, 22 nt, Human
uuaaauuagucaagcuucucug

SEQ ID NO: 858080 - RNA, 22 nt, Human
auaacaugaccugugcuucaca

SEQ ID NO: 858081 - RNA, 22 nt, Human
aggagcagcuucugaaccaugu

SEQ ID NO: 858082 - RNA, 22 nt, Human
gaauuucaaagagguuaagagg

SEQ ID NO: 858083 - RNA, 22 nt, Human
aaaucaguucacguucugaggu

SEQ ID NO: 858084 - RNA, 22 nt, Human
uccaggagguuuggaggaagca

SEQ ID NO: 858085 - RNA, 22 nt, Human
gucacagaguuauuaauugugu

SEQ ID NO: 858086 - RNA, 22 nt, Human
ggaggugguggcagugacaauu

SEQ ID NO: 858087 - RNA, 22 nt, Human
aggagaggcucuaacucugugu

SEQ ID NO: 858088 - RNA, 19 nt, Human
ucauuguugguuugucggg

SEQ ID NO: 858089 - RNA, 22 nt, Human
aucuacccacugaacacaauau

SEQ ID NO: 858090 - RNA, 22 nt, Human
acaaaaagggagaugagguaga

SEQ ID NO: 858091 - RNA, 22 nt, Human
gauuucuucauuuguggugaau

SEQ ID NO: 858092 - RNA, 22 nt, Human
uagucaccucuuuaaauguccu

SEQ ID NO: 858093 - RNA, 22 nt, Human
gaaaggccauuucugaggguuu

SEQ ID NO: 858094 - RNA, 22 nt, Human
ugucugugaccucuuuggagcc

SEQ ID NO: 858095 - RNA, 22 nt, Human
aguucuuuugugaacauaugcu

SEQ ID NO: 858096 - RNA, 22 nt, Human
ucuacugugguccuuguaacca

SEQ ID NO: 858097 - RNA, 22 nt, Human
gcucaggaccgaggggugggaa

SEQ ID NO: 858098 - RNA, 22 nt, Human
augugaggaagaaagagguaag

SEQ ID NO: 858099 - RNA, 22 nt, Human
gcaggagaacaaagcaagcugc

SEQ ID NO: 858100 - RNA, 22 nt, Human
agugugucugaucacuugugag

SEQ ID NO: 858101 - RNA, 22 nt, Human
auucuuaauugccaugcuguau

SEQ ID NO: 858102 - RNA, 22 nt, Human
ucacugcucagucuguacuaca

SEQ ID NO: 858103 - RNA, 22 nt, Human
cuacccagauccaggauggcua

SEQ ID NO: 858104 - RNA, 22 nt, Human
agucauaugacccuucacaaac

SEQ ID NO: 858105 - RNA, 22 nt, Human
aauaauuuuagcucagaguugu

SEQ ID NO: 858106 - RNA, 22 nt, Human
uucagcaagaccaccauguacc

SEQ ID NO: 858107 - RNA, 22 nt, Human
uuacaaaguguuaugauaaaca

SEQ ID NO: 858108 - RNA, 22 nt, Human
auacaacuuuaucuguaaugag

SEQ ID NO: 858109 - RNA, 22 nt, Human
ccaggauggggagcagauagaa

SEQ ID NO: 858110 - RNA, 22 nt, Human
gaggcaguguugaaaaggagag

SEQ ID NO: 858111 - RNA, 22 nt, Human
aaggccagaguacuagaggcug

SEQ ID NO: 858112 - RNA, 22 nt, Human
gacccaggguggucaccugaaa

SEQ ID NO: 858113 - RNA, 22 nt, Human
aacauuucagcaaauaagaaca

SEQ ID NO: 858114 - RNA, 22 nt, Human
ucuggaucccaccgccacacac

SEQ ID NO: 858115 - RNA, 22 nt, Human
uucaacuuuggagauuuaauaa

SEQ ID NO: 858116 - RNA, 22 nt, Human
caauuucauuaauagauauaga

SEQ ID NO: 858117 - RNA, 22 nt, Human
aacuuugaggucacugaauucc

SEQ ID NO: 858118 - RNA, 22 nt, Human
ucugauaacucuggccccaggc

SEQ ID NO: 858119 - RNA, 22 nt, Human
aucuagaacuuaaagucaguca

SEQ ID NO: 858120 - RNA, 22 nt, Human
uggcuuuacugucauucuuaug

SEQ ID NO: 858121 - RNA, 22 nt, Human
uauuucagucacuucuucucug

SEQ ID NO: 858122 - RNA, 22 nt, Human
cccgggaggaggaaguugcagu

SEQ ID NO: 858123 - RNA, 22 nt, Human
ucuacugcacuggugucucauc

SEQ ID NO: 858124 - RNA, 22 nt, Human
cugccagucuaugcugcucggc

SEQ ID NO: 858125 - RNA, 22 nt, Human
gccaggagugucccacucauuu

SEQ ID NO: 858126 - RNA, 22 nt, Human
uugcuuuguuacugcaguuucc

SEQ ID NO: 858127 - RNA, 23 nt, Human
ucuauacauacugcagccucugg

SEQ ID NO: 858128 - RNA, 18 nt, Human
acugugugaauuagcucc

SEQ ID NO: 858129 - RNA, 22 nt, Human
cccaggagagaggggauaaagc

SEQ ID NO: 858130 - RNA, 22 nt, Human
aauguuaauguguuugcuuaug

SEQ ID NO: 858131 - RNA, 20 nt, Human
ugcugucguguuuucugcuu

SEQ ID NO: 858132 - RNA, 22 nt, Human
gcgucugaguugcgggggcuca

SEQ ID NO: 858133 - RNA, 22 nt, Human
ugagauuuguuuuauaaaauag

SEQ ID NO: 858134 - RNA, 22 nt, Human
augguuuuguccucuuugguuc

SEQ ID NO: 858135 - RNA, 22 nt, Human
uaauauguguuacugacuuuuu

SEQ ID NO: 858136 - RNA, 22 nt, Human
gacccaggaagcuacuucuggu

SEQ ID NO: 858137 - RNA, 22 nt, Human
cucaagacugaucgcaguggaa

SEQ ID NO: 858138 - RNA, 22 nt, Human
gauaaaauaacuauggaauacu

SEQ ID NO: 858139 - RNA, 22 nt, Human
gugcugugcgcuuuuucuguau

SEQ ID NO: 858140 - RNA, 22 nt, Human
agagcagcacguuguccccaca

SEQ ID NO: 858141 - RNA, 22 nt, Human
aucugacuucacgcccaugcca

SEQ ID NO: 858142 - RNA, 22 nt, Human
uagcacauacauaauagauaga

SEQ ID NO: 858143 - RNA, 22 nt, Human
uuucacauaugguuguugauug

SEQ ID NO: 858144 - RNA, 22 nt, Human
ccccaggacguggcccucauag

SEQ ID NO: 858145 - RNA, 22 nt, Human
aaaaggcauggagguugauagu

SEQ ID NO: 858146 - RNA, 22 nt, Human
uucuccaacacaagcaugaugu

SEQ ID NO: 858147 - RNA, 22 nt, Human
cuuuggcaaggguuuuaauugu

SEQ ID NO: 858148 - RNA, 22 nt, Human
gcaggagacuggcugugguagu

SEQ ID NO: 858149 - RNA, 22 nt, Human
agaaaucauugaauuauuugcu

SEQ ID NO: 858150 - RNA, 19 nt, Human
uuagccauccacagugaaa

SEQ ID NO: 858151 - RNA, 22 nt, Human
ggcauuuagauugaauuucugu

SEQ ID NO: 858152 - RNA, 22 nt, Human
ggauggcauguugggcucuguu

SEQ ID NO: 858153 - RNA, 22 nt, Human
ugcuuggcuuucugagcuucug

SEQ ID NO: 858154 - RNA, 22 nt, Human
caugguuuauuagagcuuauuu

SEQ ID NO: 858155 - RNA, 22 nt, Human
cauggcugcgagaagagugggu

SEQ ID NO: 858156 - RNA, 23 nt, Human
uagggcagcugggagggacaugc

SEQ ID NO: 858157 - RNA, 22 nt, Human
ucaguagcagaaagcaaugagu

SEQ ID NO: 858158 - RNA, 22 nt, Human
uucacagucacccuucuccaug

SEQ ID NO: 858159 - RNA, 22 nt, Human
auauucuucuuguucagacuau

SEQ ID NO: 858160 - RNA, 22 nt, Human
aauggccagcugggagaguuga

SEQ ID NO: 858161 - RNA, 22 nt, Human
uaguuaaaauaauggagauguu

SEQ ID NO: 858162 - RNA, 22 nt, Human
agcagagguguuuauuauggga

SEQ ID NO: 858163 - RNA, 22 nt, Human
ucccaggaugaagacaguguug

SEQ ID NO: 858164 - RNA, 22 nt, Human
uguucucacuggaugcuucaca

SEQ ID NO: 858165 - RNA, 22 nt, Human
uuugaaagcaggugugggaggg

SEQ ID NO: 858166 - RNA, 22 nt, Human
auuaaauuuucacuaggcuccc

SEQ ID NO: 858167 - RNA, 23 nt, Human
ucuguacacaucagcaucuccca

SEQ ID NO: 858168 - RNA, 22 nt, Human
guacauaaaggaggcucuuugc

SEQ ID NO: 858169 - RNA, 22 nt, Human
uuugaaagccuggcuuuucucu

SEQ ID NO: 858170 - RNA, 22 nt, Human
caacauuucaaggucuuuagga

SEQ ID NO: 858171 - RNA, 23 nt, Human
cuuuuaacuugaucugagaccag

SEQ ID NO: 858172 - RNA, 22 nt, Human
gcuaugcaggagccuaaugaca

SEQ ID NO: 858173 - RNA, 22 nt, Human
augaacaauaaaauagaucaca

SEQ ID NO: 858174 - RNA, 22 nt, Human
uuucaguuguccuguuaauagc

SEQ ID NO: 858175 - RNA, 22 nt, Human
uacagaauuagauuauuagaga

SEQ ID NO: 858176 - RNA, 22 nt, Human
aagaaacaaccacugcucuccu

SEQ ID NO: 858177 - RNA, 22 nt, Human
cggagggguuugaacagaggag

SEQ ID NO: 858178 - RNA, 22 nt, Human
uuugaauaucacaaacuuucaa

SEQ ID NO: 858179 - RNA, 22 nt, Human
auuaugcugguuuacacauuuu

SEQ ID NO: 858180 - RNA, 22 nt, Human
uuagaaauacaagugagguuga

SEQ ID NO: 858181 - RNA, 22 nt, Human
gauggcuucagucuccuugggu

SEQ ID NO: 858182 - RNA, 22 nt, Human
uucagugucaauuuuuaaauau

SEQ ID NO: 858183 - RNA, 22 nt, Human
uucauugugaacacauucugcc

SEQ ID NO: 858184 - RNA, 22 nt, Human
aggcaggcccucuggaaaggua

SEQ ID NO: 858185 - RNA, 22 nt, Human
aucuuucaaucaggaaaaaucu

SEQ ID NO: 858186 - RNA, 22 nt, Human
aggccagcagcaugacggcauc

SEQ ID NO: 858187 - RNA, 22 nt, Human
uuugaauguuuuagguacuuaa

SEQ ID NO: 858188 - RNA, 22 nt, Human
uauuuccauguuagaacuaagu

SEQ ID NO: 858189 - RNA, 22 nt, Human
cccaggaguuggaggcuacggu

SEQ ID NO: 858190 - RNA, 22 nt, Human
augguuuaagggagaauauuga

SEQ ID NO: 858191 - RNA, 22 nt, Human
agauaucaccaguuuuacauac

SEQ ID NO: 858192 - RNA, 22 nt, Human
gcugcugucacggugcuaaggg

SEQ ID NO: 858193 - RNA, 22 nt, Human
ucaggauaaaauguaauggcaa

SEQ ID NO: 858194 - RNA, 21 nt, Human
auugaaagucaacaaucaguu

SEQ ID NO: 858195 - RNA, 22 nt, Human
uuaguacugauagggucaauca

SEQ ID NO: 858196 - RNA, 22 nt, Human
uucuucucucauagauuaaggu

SEQ ID NO: 858197 - RNA, 22 nt, Human
agagggcagucucagauuggga

SEQ ID NO: 858198 - RNA, 22 nt, Human
caggcagccugagggaucuggg

SEQ ID NO: 858199 - RNA, 22 nt, Human
gguacaaugucuuacagaccca

SEQ ID NO: 858200 - RNA, 22 nt, Human
cuguguuggcuuuucucuugua

SEQ ID NO: 858201 - RNA, 21 nt, Human
gcucagaguauugcacuguuu

SEQ ID NO: 858202 - RNA, 18 nt, Human
gaugggagcaagagaaga

SEQ ID NO: 858203 - RNA, 22 nt, Human
gcugcuguugauuuaguccaau

SEQ ID NO: 858204 - RNA, 22 nt, Human
uaaugcuuaacagcuggcuuuu

SEQ ID NO: 858205 - RNA, 19 nt, Human
cccaggagucuggcugguu

SEQ ID NO: 858206 - RNA, 22 nt, Human
uucaggauucuuucagacuggg

SEQ ID NO: 858207 - RNA, 21 nt, Human
auuuccaaauaaggucacauu

SEQ ID NO: 858208 - RNA, 22 nt, Human
ucugggaauuuauuggcacuuu

SEQ ID NO: 858209 - RNA, 22 nt, Human
aggcagaugggagcuggaaguu

SEQ ID NO: 858210 - RNA, 22 nt, Human
acccaggagacggaggugcagu

SEQ ID NO: 858211 - RNA, 22 nt, Human
cccaggaagaggggucaggugu

SEQ ID NO: 858212 - RNA, 22 nt, Human
aauuccagcuaggaaaagcuuc

SEQ ID NO: 858213 - RNA, 22 nt, Human
ucucgacagccuggcacagugg

SEQ ID NO: 858214 - RNA, 23 nt, Human
cuccccaguguccucaugcaucu

SEQ ID NO: 858215 - RNA, 22 nt, Human
uaucuguugucuuuuacaugua

SEQ ID NO: 858216 - RNA, 22 nt, Human
ggauggcaggacaaggacccag

SEQ ID NO: 858217 - RNA, 22 nt, Human
cauucucaauaguagaugagua

SEQ ID NO: 858218 - RNA, 22 nt, Human
augcuuaaccuugguguacaau

SEQ ID NO: 858219 - RNA, 22 nt, Human
acuauacaguauguacgugcac

SEQ ID NO: 858220 - RNA, 22 nt, Human
cauuuacacuucuaaccacaag

SEQ ID NO: 858221 - RNA, 22 nt, Human
uaaagccacgcuggaaaucagg

SEQ ID NO: 858222 - RNA, 22 nt, Human
aaaguauuugugauuuuuacca

SEQ ID NO: 858223 - RNA, 19 nt, Human
acagaaauuaguuauuuuc

SEQ ID NO: 858224 - RNA, 22 nt, Human
uccauuuuagaagaaaauccac

SEQ ID NO: 858225 - RNA, 22 nt, Human
agaauaauacugaaaugcugaa

SEQ ID NO: 858226 - RNA, 22 nt, Human
gcuuugaagacuuuuccagggu

SEQ ID NO: 858227 - RNA, 22 nt, Human
ugcuggguuaccuaagccuaaa

SEQ ID NO: 858228 - RNA, 22 nt, Human
acuucuucuucagcugggggau

SEQ ID NO: 858229 - RNA, 22 nt, Human
auucuucacuguuucagaauga

SEQ ID NO: 858230 - RNA, 20 nt, Human
uuuaggcauuacucuuuugu

SEQ ID NO: 858231 - RNA, 22 nt, Human
uagaauaugauuaauuuucuua

SEQ ID NO: 858232 - RNA, 23 nt, Human
uauggcuuacagugcuuuaggua

SEQ ID NO: 858233 - RNA, 22 nt, Human
caggauggugugagugugagga

SEQ ID NO: 858234 - RNA, 20 nt, Human
agcauuugaaauaugacuau

SEQ ID NO: 858235 - RNA, 22 nt, Human
agucucuuauucccuauugcug

SEQ ID NO: 858236 - RNA, 22 nt, Human
caggguggcacucagcgcaucu

SEQ ID NO: 858237 - RNA, 22 nt, Human
uacacaugaucauuuaguagca

SEQ ID NO: 858238 - RNA, 22 nt, Human
aaaaaucuaugacugcuucucc

SEQ ID NO: 858239 - RNA, 22 nt, Human
uuaacaauagaguuucuucagg

SEQ ID NO: 858240 - RNA, 22 nt, Human
uucagaaugugaccuuauuugg

SEQ ID NO: 858241 - RNA, 22 nt, Human
aucauaaagugcuaucugauug

SEQ ID NO: 858242 - RNA, 22 nt, Human
agggauggaagacuugaagacc

SEQ ID NO: 858243 - RNA, 23 nt, Human
gcagaggagcaagcuggacacca

SEQ ID NO: 858244 - RNA, 22 nt, Human
auuuccuuugcaaagacugugc

SEQ ID NO: 858245 - RNA, 22 nt, Human
ucucaguguguuuucucucaga

SEQ ID NO: 858246 - RNA, 22 nt, Human
ccguagcacaugcuccuggggc

SEQ ID NO: 858247 - RNA, 19 nt, Human
cuugcugggugguuucugc

SEQ ID NO: 858248 - RNA, 22 nt, Human
auaggcuuauauaaaaacaucu

SEQ ID NO: 858249 - RNA, 22 nt, Human
aaggccagccugagagcuaaca

SEQ ID NO: 858250 - RNA, 23 nt, Human
uucuuucaagaaguucacagugc

SEQ ID NO: 858251 - RNA, 22 nt, Human
uaggagagcugaacuauugucu

SEQ ID NO: 858252 - RNA, 22 nt, Human
ggccaggagcugcacagggcuc

SEQ ID NO: 858253 - RNA, 22 nt, Human
gaaauauucuugucuuguuuuc

SEQ ID NO: 858254 - RNA, 20 nt, Human
uugagcuuuuaguacagaca

SEQ ID NO: 858255 - RNA, 22 nt, Human
aggcagguuggugagaagacug

SEQ ID NO: 858256 - RNA, 23 nt, Human
cccauuuucauguuaacuccugg

SEQ ID NO: 858257 - RNA, 22 nt, Human
caaggccagggaauuuuucugg

SEQ ID NO: 858258 - RNA, 22 nt, Human
uaacaagucauuuuaaauuaug

SEQ ID NO: 858259 - RNA, 22 nt, Human
aagauauagauggugguauaaa

SEQ ID NO: 858260 - RNA, 22 nt, Human
gaaggaggcguuagcccuagga

SEQ ID NO: 858261 - RNA, 22 nt, Human
aaacggauauaacagcaaacgc

SEQ ID NO: 858262 - RNA, 22 nt, Human
cccaggcagccugcagggaagg

SEQ ID NO: 858263 - RNA, 22 nt, Human
augcugugagugugccgcagag

SEQ ID NO: 858264 - RNA, 22 nt, Human
aguggaccagaagacugaagcu

SEQ ID NO: 858265 - RNA, 22 nt, Human
uccauuuuguagguaugcuaca

SEQ ID NO: 858266 - RNA, 22 nt, Human
ggcauuuauuugucucauucuu

SEQ ID NO: 858267 - RNA, 22 nt, Human
ucuuuaauguacuuucuuucac

SEQ ID NO: 858268 - RNA, 19 nt, Human
agauggcaaaaugcaaaga

SEQ ID NO: 858269 - RNA, 22 nt, Human
uucuucuccgaggagggcuggu

SEQ ID NO: 858270 - RNA, 22 nt, Human
uucagaaacaucaguggaugga

SEQ ID NO: 858271 - RNA, 22 nt, Human
ucauuauccuaguaucuugaau

SEQ ID NO: 858272 - RNA, 22 nt, Human
uuacagaauguucuuccaacag

SEQ ID NO: 858273 - RNA, 22 nt, Human
aaggcagucugguuucaaagca

SEQ ID NO: 858274 - RNA, 19 nt, Human
aaaaacuuaguccagaaag

SEQ ID NO: 858275 - RNA, 22 nt, Human
ggguggagcuuggacaccagua

SEQ ID NO: 858276 - RNA, 22 nt, Human
cucacuguuuaauagcuggauc

SEQ ID NO: 858277 - RNA, 22 nt, Human
gucccauaaguagugcaacuug

SEQ ID NO: 858278 - RNA, 22 nt, Human
augaaggcaguuaaacgucauc

SEQ ID NO: 858279 - RNA, 22 nt, Human
ccauggcucuagagauugaaaa

SEQ ID NO: 858280 - RNA, 22 nt, Human
ucagugaucuaaggguauggcc

SEQ ID NO: 858281 - RNA, 22 nt, Human
cuccaggagggggauggcugua

SEQ ID NO: 858282 - RNA, 22 nt, Human
cuacccagagugaaucucuuaa

SEQ ID NO: 858283 - RNA, 18 nt, Human
gaggcagcuagcaauuuu

SEQ ID NO: 858284 - RNA, 22 nt, Human
aucaggaucacugggagucuug

SEQ ID NO: 858285 - RNA, 22 nt, Human
gucaggaucaaauugaaguuau

SEQ ID NO: 858286 - RNA, 22 nt, Human
aggauuuauuacaagccauggu

SEQ ID NO: 858287 - RNA, 22 nt, Human
uuugaauagaggccccucagaa

SEQ ID NO: 858288 - RNA, 22 nt, Human
gccauuuucugucuuguuuauu

SEQ ID NO: 858289 - RNA, 22 nt, Human
gucuccugagacugcagucacc

SEQ ID NO: 858290 - RNA, 22 nt, Human
auguuauaguuauaaaaugagg

SEQ ID NO: 858291 - RNA, 22 nt, Human
aaucagaacuucucaggguggg

SEQ ID NO: 858292 - RNA, 22 nt, Human
gcagcugcagagaccggguggg

SEQ ID NO: 858293 - RNA, 22 nt, Human
uuuaggcaaacucauugucaga

SEQ ID NO: 858294 - RNA, 22 nt, Human
uagaacauaagucauucauuug

SEQ ID NO: 858295 - RNA, 22 nt, Human
aggccagaaauuuggaguaugu

SEQ ID NO: 858296 - RNA, 22 nt, Human
gaaggccaguuuugagauaggu

SEQ ID NO: 858297 - RNA, 22 nt, Human
agaaaugacacacaugagacau

SEQ ID NO: 858298 - RNA, 22 nt, Human
uguugauuaguguuuagacuua

SEQ ID NO: 858299 - RNA, 22 nt, Human
augaaaacggaccagagcuauu

SEQ ID NO: 858300 - RNA, 22 nt, Human
ugugugucagagucuccauggu

SEQ ID NO: 858301 - RNA, 22 nt, Human
uguacaauagcuauuaucucca

SEQ ID NO: 858302 - RNA, 22 nt, Human
auuccaaaggcuggccuggagg

SEQ ID NO: 858303 - RNA, 22 nt, Human
agaauuuccuaugagagauucc

SEQ ID NO: 858304 - RNA, 18 nt, Human
ugagaggcagguagagga

SEQ ID NO: 858305 - RNA, 22 nt, Human
ggggcagccuccaggaaagcug

SEQ ID NO: 858306 - RNA, 23 nt, Human
uggacgccgacuuuggaggcgcu

SEQ ID NO: 858307 - RNA, 22 nt, Human
agucuugcauuuucugaagaug

SEQ ID NO: 858308 - RNA, 22 nt, Human
ccaaaauuaagccucuuauguu

SEQ ID NO: 858309 - RNA, 22 nt, Human
gcagaggggaagcugaggaauu

SEQ ID NO: 858310 - RNA, 22 nt, Human
uuacagaaguauugagagaucc

SEQ ID NO: 858311 - RNA, 22 nt, Human
cccaugagaccugguuuaaggc

SEQ ID NO: 858312 - RNA, 22 nt, Human
uauuuccagcaguaagaagaca

SEQ ID NO: 858313 - RNA, 22 nt, Human
aaguauuucguucugaaaaagu

SEQ ID NO: 858314 - RNA, 22 nt, Human
uauuucagcacaugggauaggu

SEQ ID NO: 858315 - RNA, 22 nt, Human
augcuguggaaguuccugaagc

SEQ ID NO: 858316 - RNA, 22 nt, Human
gucaggaugcuauuguuauuaa

SEQ ID NO: 858317 - RNA, 22 nt, Human
aauguuuuaaaagagauugaga

SEQ ID NO: 858318 - RNA, 18 nt, Human
gagaggagccagaauuuu

SEQ ID NO: 858319 - RNA, 22 nt, Human
augcugaauugaugcgagggag

SEQ ID NO: 858320 - RNA, 22 nt, Human
ucuuagaaugucaacugauguu

SEQ ID NO: 858321 - RNA, 22 nt, Human
gggauggggagcuggaaagggg

SEQ ID NO: 858322 - RNA, 22 nt, Human
cuuuuauuuugaauuaagggcu

SEQ ID NO: 858323 - RNA, 22 nt, Human
uggagcugggguuugaaucugg

SEQ ID NO: 858324 - RNA, 22 nt, Human
aaauugaaugauuaagugguga

SEQ ID NO: 858325 - RNA, 22 nt, Human
gggcagcugccccucucugggc

SEQ ID NO: 858326 - RNA, 22 nt, Human
ucuuugcacugugcaagcagaa

SEQ ID NO: 858327 - RNA, 22 nt, Human
uccaggagagguguggggacug

SEQ ID NO: 858328 - RNA, 22 nt, Human
uuauucuuuucuccagaauccc

SEQ ID NO: 858329 - RNA, 22 nt, Human
cccaggagguggagguugcagu

SEQ ID NO: 858330 - RNA, 22 nt, Human
uguggaaaauuggaacguuccu

SEQ ID NO: 858331 - RNA, 22 nt, Human
uauguuaagugggauaaucaaa

SEQ ID NO: 858332 - RNA, 22 nt, Human
guguuuuaagaaagaagcucag

SEQ ID NO: 858333 - RNA, 22 nt, Human
ucugcuguaaagaauuucugcc

SEQ ID NO: 858334 - RNA, 22 nt, Human
gcccaggauggcuggaggugcu

SEQ ID NO: 858335 - RNA, 22 nt, Human
uucaugugaucacagauuguaa

SEQ ID NO: 858336 - RNA, 22 nt, Human
cuacagaauucaacaaaugguu

SEQ ID NO: 858337 - RNA, 19 nt, Human
uccuucagucagaucuggg

SEQ ID NO: 858338 - RNA, 22 nt, Human
cagcgucucguugugggccucg

SEQ ID NO: 858339 - RNA, 22 nt, Human
ugugccagccucuggcuguguc

SEQ ID NO: 858340 - RNA, 22 nt, Human
aaaaacugcaauuacuuuuguc

SEQ ID NO: 858341 - RNA, 22 nt, Human
agaaguuguagguuugcauauu

SEQ ID NO: 858342 - RNA, 22 nt, Human
guuuuauaggugaaauauuacu

SEQ ID NO: 858343 - RNA, 22 nt, Human
ggcagcuaggggcagggaauuc

SEQ ID NO: 858344 - RNA, 22 nt, Human
uaauuauaacaguuacaucuua

SEQ ID NO: 858345 - RNA, 22 nt, Human
ucaggaauccagacagggcaca

SEQ ID NO: 858346 - RNA, 22 nt, Human
auuaaagaaacccagcauguga

SEQ ID NO: 858347 - RNA, 22 nt, Human
uacaguauguucuugaauuugg

SEQ ID NO: 858348 - RNA, 22 nt, Human
aggcagcccacaggacacagga

SEQ ID NO: 858349 - RNA, 22 nt, Human
gaaggucaccuccccucucugg

SEQ ID NO: 858350 - RNA, 22 nt, Human
agggagcucuaaguagagggac

SEQ ID NO: 858351 - RNA, 22 nt, Human
uuaacaugucuugacuucaucu

SEQ ID NO: 858352 - RNA, 22 nt, Human
auugcuguggaaauauaagaug

SEQ ID NO: 858353 - RNA, 22 nt, Human
aggcagacucaauggcuagaua

SEQ ID NO: 858354 - RNA, 23 nt, Human
acaacuuuacagauacauuuugu

SEQ ID NO: 858355 - RNA, 22 nt, Human
aaaguucaugguguuauagaaa

SEQ ID NO: 858356 - RNA, 22 nt, Human
uuauacaguuuauacuuagaau

SEQ ID NO: 858357 - RNA, 22 nt, Human
uggcagcuuccugcucauagga

SEQ ID NO: 858358 - RNA, 22 nt, Human
ucuucuccagugcuucugcaca

SEQ ID NO: 858359 - RNA, 19 nt, Human
uccauaaugaagauagagg

SEQ ID NO: 858360 - RNA, 20 nt, Human
ucacuaguaaccaucugcuu

SEQ ID NO: 858361 - RNA, 22 nt, Human
gucuaacaagcauuaggaaccc

SEQ ID NO: 858362 - RNA, 22 nt, Human
caagaaucaacauuauuuagug

SEQ ID NO: 858363 - RNA, 22 nt, Human
cagucaccuugaggacucagac

SEQ ID NO: 858364 - RNA, 19 nt, Human
uuucuuaggccuuuggccu

SEQ ID NO: 858365 - RNA, 22 nt, Human
cugcuucuccaaaguaggacuu

SEQ ID NO: 858366 - RNA, 22 nt, Human
gggugggacugaagucugaggg

SEQ ID NO: 858367 - RNA, 22 nt, Human
aucaggauagugguuaccuggg

SEQ ID NO: 858368 - RNA, 22 nt, Human
cgaggcagacaaaaguuggaag

SEQ ID NO: 858369 - RNA, 21 nt, Human
aggcagcaggauccagggaca

SEQ ID NO: 858370 - RNA, 22 nt, Human
auggcuuaugguaaauauuucu

SEQ ID NO: 858371 - RNA, 22 nt, Human
gagggaggggagcuccacccuc

SEQ ID NO: 858372 - RNA, 22 nt, Human
ggcauuuaucuaauauaguuua

SEQ ID NO: 858373 - RNA, 20 nt, Human
uauuuguauuugggaaaguu

SEQ ID NO: 858374 - RNA, 22 nt, Human
uuucauuuugguuaugccauaa

SEQ ID NO: 858375 - RNA, 22 nt, Human
uugaaagaggcaaaguuugauc

SEQ ID NO: 858376 - RNA, 22 nt, Human
accaggagccauagagucaggc

SEQ ID NO: 858377 - RNA, 22 nt, Human
uggcagcucauuuggaaaugga

SEQ ID NO: 858378 - RNA, 22 nt, Human
gaggggagacagggaaaucagu

SEQ ID NO: 858379 - RNA, 18 nt, Human
ggcagggaaaagauaggg

SEQ ID NO: 858380 - RNA, 22 nt, Human
aaguuucaaauauaaaauuaca

SEQ ID NO: 858381 - RNA, 23 nt, Human
uuucaaauuacucugcagaugac

SEQ ID NO: 858382 - RNA, 22 nt, Human
uggcagcuauggucuaagggcc

SEQ ID NO: 858383 - RNA, 22 nt, Human
uuugaacuucuaccugucauau

SEQ ID NO: 858384 - RNA, 22 nt, Human
gauggcaggugauagccgaguc

SEQ ID NO: 858385 - RNA, 17 nt, Human
aaucagauuucugagga

SEQ ID NO: 858386 - RNA, 22 nt, Human
gcagcugccuucagcuggaugg

SEQ ID NO: 858387 - RNA, 22 nt, Human
cagaaaaggaagagcuauguaa

SEQ ID NO: 858388 - RNA, 22 nt, Human
cuuaaacugaaagcuacaagau

SEQ ID NO: 858389 - RNA, 22 nt, Human
gaggccaaucaauagggcaaua

SEQ ID NO: 858390 - RNA, 22 nt, Human
cacccugggcugggccuguuaa

SEQ ID NO: 858391 - RNA, 22 nt, Human
auuaggcauauaugcuuuuaau

SEQ ID NO: 858392 - RNA, 22 nt, Human
uccaggagguagugcuuaauuu

SEQ ID NO: 858393 - RNA, 22 nt, Human
cccucuacagggaagcgcuuuc

SEQ ID NO: 858394 - RNA, 22 nt, Human
uauuaaagggaaguuaugcaug

SEQ ID NO: 858395 - RNA, 22 nt, Human
uauuuguauguguguacauaua

SEQ ID NO: 858396 - RNA, 22 nt, Human
caaugaaaauuuaaguugcagc

SEQ ID NO: 858397 - RNA, 22 nt, Human
cuuuacagaauaagaauacugg

SEQ ID NO: 858398 - RNA, 22 nt, Human
cuggaaauuggagaugauguuu

SEQ ID NO: 858399 - RNA, 22 nt, Human
auaugaaaagaagucaccauug

SEQ ID NO: 858400 - RNA, 22 nt, Human
ucugaacuccagcccugcucuc

SEQ ID NO: 858401 - RNA, 22 nt, Human
ggcaggcaaugaggaugggaag

SEQ ID NO: 858402 - RNA, 21 nt, Human
gaacauuuggguuguuucuac

SEQ ID NO: 858403 - RNA, 21 nt, Human
agcaccuuacagcuauaaugg

SEQ ID NO: 858404 - RNA, 22 nt, Human
agaggggagagcuaagcaauuc

SEQ ID NO: 858405 - RNA, 22 nt, Human
uucucugagauagacuaagugg

SEQ ID NO: 858406 - RNA, 18 nt, Human
ugcuuggagcauuuacca

SEQ ID NO: 858407 - RNA, 22 nt, Human
aagaggagacuucagcaacuug

SEQ ID NO: 858408 - RNA, 22 nt, Human
uauggcuuuuuauucaucuuac

SEQ ID NO: 858409 - RNA, 22 nt, Human
gaggcagcggcucacagagaaa

SEQ ID NO: 858410 - RNA, 22 nt, Human
caaggccacuccagagacuggu

SEQ ID NO: 858411 - RNA, 22 nt, Human
aaauacuguagauaauagaguu

SEQ ID NO: 858412 - RNA, 22 nt, Human
gugauuuucuccuccuagaagu

SEQ ID NO: 858413 - RNA, 22 nt, Human
ugaggcaggaauggggaaaagu

SEQ ID NO: 858414 - RNA, 19 nt, Human
uggcaggcccaggauggac

SEQ ID NO: 858415 - RNA, 22 nt, Human
aucacugucgucaucugagauu

SEQ ID NO: 858416 - RNA, 22 nt, Human
aggcacaguggcucacaccugu

SEQ ID NO: 858417 - RNA, 22 nt, Human
ggugagaggcagaggacagcuu

SEQ ID NO: 858418 - RNA, 22 nt, Human
cagucccuaguggagcucacag

SEQ ID NO: 858419 - RNA, 22 nt, Human
cagcuggcgggcagagccgcca

SEQ ID NO: 858420 - RNA, 22 nt, Human
ucacuguugaccuggaaguggg

SEQ ID NO: 858421 - RNA, 22 nt, Human
ucaggagauguaaccuuagcug

SEQ ID NO: 858422 - RNA, 22 nt, Human
cuuaaauuuucaucuacaagaa

SEQ ID NO: 858423 - RNA, 22 nt, Human
caugcugugugguuagaacugu

SEQ ID NO: 858424 - RNA, 22 nt, Human
agggacuuguguccuauguaug

SEQ ID NO: 858425 - RNA, 22 nt, Human
uuuuucagccaugaauuacacu

SEQ ID NO: 858426 - RNA, 22 nt, Human
ucuggaucgccggcgccugggc

SEQ ID NO: 858427 - RNA, 22 nt, Human
gugaauaauauuguuuauaaaa

SEQ ID NO: 858428 - RNA, 22 nt, Human
uuuguuuagaugguaaaucagu

SEQ ID NO: 858429 - RNA, 22 nt, Human
ucuccuccuuuuuucaacauag

SEQ ID NO: 858430 - RNA, 22 nt, Human
cuucuucaguugcauguauugg

SEQ ID NO: 858431 - RNA, 22 nt, Human
ucucacugcaaauauuauguau

SEQ ID NO: 858432 - RNA, 22 nt, Human
uuagccauggacugaauugacu

SEQ ID NO: 858433 - RNA, 22 nt, Human
uuacaagauaaccugaugcugu

SEQ ID NO: 858434 - RNA, 20 nt, Human
acuggaucuggcuggagcug

SEQ ID NO: 858435 - RNA, 22 nt, Human
cagaagaguagcugaacaaguu

SEQ ID NO: 858436 - RNA, 18 nt, Human
gcaggagauggguggggu

SEQ ID NO: 858437 - RNA, 17 nt, Human
aggcaggcagagcggga

SEQ ID NO: 858438 - RNA, 22 nt, Human
aggccagcccugggcugagaga

SEQ ID NO: 858439 - RNA, 22 nt, Human
cccaggagacauauagaaggac

SEQ ID NO: 858440 - RNA, 22 nt, Human
uaauuucagugcaagcucacgg

SEQ ID NO: 858441 - RNA, 22 nt, Human
ucuggauccuaugcacuggacu

SEQ ID NO: 858442 - RNA, 16 nt, Human
aggaggggaauuagga

SEQ ID NO: 858443 - RNA, 22 nt, Human
cccaggaaaugaacuucugauu

SEQ ID NO: 858444 - RNA, 22 nt, Human
uguccuuaaggagcuuaauguc

SEQ ID NO: 858445 - RNA, 23 nt, Human
acagaaaucauuuguaagguacc

SEQ ID NO: 858446 - RNA, 22 nt, Human
uucuucaacaaggacacuguua

SEQ ID NO: 858447 - RNA, 22 nt, Human
cccaggaggcggagguuguggu

SEQ ID NO: 858448 - RNA, 22 nt, Human
cuuucaacuacauacaggcgau

SEQ ID NO: 858449 - RNA, 22 nt, Human
ccauccugcauugcuauucaga

SEQ ID NO: 858450 - RNA, 22 nt, Human
acagaugauuuuuaugaaaaca

SEQ ID NO: 858451 - RNA, 22 nt, Human
uugguuuaggaacuggcuugga

SEQ ID NO: 858452 - RNA, 22 nt, Human
gaauuucagaucagagaccauu

SEQ ID NO: 858453 - RNA, 22 nt, Human
gcagcucccagcuugaaagguc

SEQ ID NO: 858454 - RNA, 22 nt, Human
ucucuuucuauaugugagucuu

SEQ ID NO: 858455 - RNA, 22 nt, Human
ugcuucugggcaaaugugugug

SEQ ID NO: 858456 - RNA, 22 nt, Human
guacagaaaugugaugacgcaa

SEQ ID NO: 858457 - RNA, 22 nt, Human
auuuagcaaaaaaugaugaagc

SEQ ID NO: 858458 - RNA, 23 nt, Human
cugcugugaaacaugguuuuggu

SEQ ID NO: 858459 - RNA, 22 nt, Human
cccaggaaaguggaggcggcug

SEQ ID NO: 858460 - RNA, 22 nt, Human
gauggacagccuggaaggaaag

SEQ ID NO: 858461 - RNA, 22 nt, Human
augguuuuagaaucaggaaaaa

SEQ ID NO: 858462 - RNA, 22 nt, Human
gaauaaucaugaaauucaguga

SEQ ID NO: 858463 - RNA, 22 nt, Human
uugguacaaugugcuagguagg

SEQ ID NO: 858464 - RNA, 22 nt, Human
uccaauauggauaaaaggggcc

SEQ ID NO: 858465 - RNA, 17 nt, Human
ccaggagagaugcuugu

SEQ ID NO: 858466 - RNA, 22 nt, Human
gagucaccuugggucagcgaua

SEQ ID NO: 858467 - RNA, 22 nt, Human
caagaaucagaccugucagggu

SEQ ID NO: 858468 - RNA, 22 nt, Human
augcuuaauacacuguuaaagg

SEQ ID NO: 858469 - RNA, 22 nt, Human
ucugggaaaugcuguuccuugu

SEQ ID NO: 858470 - RNA, 22 nt, Human
uuuaggaaugugguuuuugagc

SEQ ID NO: 858471 - RNA, 22 nt, Human
uacaagaaauuucugcauauau

SEQ ID NO: 858472 - RNA, 22 nt, Human
agaaaucaauaucuauauguug

SEQ ID NO: 858473 - RNA, 22 nt, Human
cuugggaaugcuaacagaugac

SEQ ID NO: 858474 - RNA, 22 nt, Human
cccaggaaugagcaggcagggg

SEQ ID NO: 858475 - RNA, 22 nt, Human
aagcagcuggaagaguaagaug

SEQ ID NO: 858476 - RNA, 23 nt, Human
cuucucagaagucugugccagga

SEQ ID NO: 858477 - RNA, 23 nt, Human
uacuuaggguuuagaucugacug

SEQ ID NO: 858478 - RNA, 22 nt, Human
ggcucagaccucccagcuccag

SEQ ID NO: 858479 - RNA, 22 nt, Human
gauaaugaugacaaugacaacc

SEQ ID NO: 858480 - RNA, 21 nt, Human
cucaggaucuuauauauuagu

SEQ ID NO: 858481 - RNA, 22 nt, Human
gaggcaccucgcgggaggaggc

SEQ ID NO: 858482 - RNA, 22 nt, Human
uuaauuuuaaccuguuuguguc

SEQ ID NO: 858483 - RNA, 22 nt, Human
uuuaggcacagaguugagggac

SEQ ID NO: 858484 - RNA, 22 nt, Human
ggagcagggcagugaauucugg

SEQ ID NO: 858485 - RNA, 22 nt, Human
uuuuuauaacucuuuugugaca

SEQ ID NO: 858486 - RNA, 22 nt, Human
ugcccaggauugugaggucagg

SEQ ID NO: 858487 - RNA, 22 nt, Human
aaguccauucuuccagccagcu

SEQ ID NO: 858488 - RNA, 22 nt, Human
uuugaaauuaagauauugucca

SEQ ID NO: 858489 - RNA, 22 nt, Human
uacuaaacccucgauggaucuu

SEQ ID NO: 858490 - RNA, 22 nt, Human
uuuaggcauugggugcucaagu

SEQ ID NO: 858491 - RNA, 22 nt, Human
agcuggcaguaugacuggugac

SEQ ID NO: 858492 - RNA, 22 nt, Human
aagauuauggcagauaacaauu

SEQ ID NO: 858493 - RNA, 22 nt, Human
uugcugugucauuuguuuaauc

SEQ ID NO: 858494 - RNA, 22 nt, Human
ugcuuagacgucaaguacagcc

SEQ ID NO: 858495 - RNA, 22 nt, Human
gaggccagaagugccucgggcu

SEQ ID NO: 858496 - RNA, 22 nt, Human
aggcagugcugugcccugaacc

SEQ ID NO: 858497 - RNA, 22 nt, Human
uaggauuuaggcuuuaacaucu

SEQ ID NO: 858498 - RNA, 22 nt, Human
auggcuuaagaaugcuuuugug

SEQ ID NO: 858499 - RNA, 22 nt, Human
aagccagauuucacucuuaauu

SEQ ID NO: 858500 - RNA, 22 nt, Human
uuuagaaugugacuguauuuga

SEQ ID NO: 858501 - RNA, 18 nt, Human
cugcugugucgucugggc

SEQ ID NO: 858502 - RNA, 22 nt, Human
acccaggaggugacacagggcu

SEQ ID NO: 858503 - RNA, 22 nt, Human
gagagaaaugugcaguuugggc

SEQ ID NO: 858504 - RNA, 22 nt, Human
uucaggaugcucagaguagucu

SEQ ID NO: 858505 - RNA, 22 nt, Human
cuugaaagcacuuaguaaauua

SEQ ID NO: 858506 - RNA, 22 nt, Human
aguaaaauuucugcugaggaga

SEQ ID NO: 858507 - RNA, 22 nt, Human
ggaagaggaggagccaggcuuu

SEQ ID NO: 858508 - RNA, 22 nt, Human
aaaucagugcucauuugaaagg

SEQ ID NO: 858509 - RNA, 22 nt, Human
acauucacgcucucaaagcuga

SEQ ID NO: 858510 - RNA, 22 nt, Human
gaauuucagggucugguaggaa

SEQ ID NO: 858511 - RNA, 22 nt, Human
uguuuuaagagcgcacuuuaua

SEQ ID NO: 858512 - RNA, 22 nt, Human
ugcuuauuuauagucaauagag

SEQ ID NO: 858513 - RNA, 20 nt, Human
uggccuuuaaauaguauucc

SEQ ID NO: 858514 - RNA, 21 nt, Human
uuucuucacuuugccccaugu

SEQ ID NO: 858515 - RNA, 22 nt, Human
guaggcagguggaggagugaag

SEQ ID NO: 858516 - RNA, 22 nt, Human
guagaaauagugguugacagga

SEQ ID NO: 858517 - RNA, 22 nt, Human
ucacagacauggugagguaaca

SEQ ID NO: 858518 - RNA, 21 nt, Human
gagauuuagaaggaucaauuu

SEQ ID NO: 858519 - RNA, 22 nt, Human
cagaauuuuucgaauguacugu

SEQ ID NO: 858520 - RNA, 22 nt, Human
ggacagaggguugacagaguau

SEQ ID NO: 858521 - RNA, 22 nt, Human
uuucagcugguaaaggaguagc

SEQ ID NO: 858522 - RNA, 22 nt, Human
ugcacagugaccccuggugacu

SEQ ID NO: 858523 - RNA, 22 nt, Human
cacaugaguccugccagguaug

SEQ ID NO: 858524 - RNA, 22 nt, Human
caaucaguaaccggaucauggu

SEQ ID NO: 858525 - RNA, 22 nt, Human
gugagggguggcugagcaguuu

SEQ ID NO: 858526 - RNA, 22 nt, Human
auguuacacauaggcauaaaug

SEQ ID NO: 858527 - RNA, 22 nt, Human
aauaauauuugaagcuucaaag

SEQ ID NO: 858528 - RNA, 22 nt, Human
cccaggagacagaaacagaggu

SEQ ID NO: 858529 - RNA, 22 nt, Human
uucucagagcacugcugacaaa

SEQ ID NO: 858530 - RNA, 22 nt, Human
auggaucagaaucccgggaggg

SEQ ID NO: 858531 - RNA, 22 nt, Human
aaucagaaccuugggucauaac

SEQ ID NO: 858532 - RNA, 19 nt, Human
agaggcagucuccaacagg

SEQ ID NO: 858533 - RNA, 22 nt, Human
ugaggggagcccgcccuggacg

SEQ ID NO: 858534 - RNA, 22 nt, Human
gugaauaauuuuuuaguauaag

SEQ ID NO: 858535 - RNA, 22 nt, Human
gcacaauuauuuaugcaguaug

SEQ ID NO: 858536 - RNA, 22 nt, Human
ugaggcaggagaaucacaugaa

SEQ ID NO: 858537 - RNA, 22 nt, Human
ugucauaaucaguuuugcaugu

SEQ ID NO: 858538 - RNA, 22 nt, Human
ucccaggacuuccaguuggagg

SEQ ID NO: 858539 - RNA, 22 nt, Human
gcugcugugaauuuuuuaaaug

SEQ ID NO: 858540 - RNA, 22 nt, Human
uucaguaaaacacugcaauguc

SEQ ID NO: 858541 - RNA, 22 nt, Human
uuuggaauguaguuuaaucauc

SEQ ID NO: 858542 - RNA, 22 nt, Human
ucccugggcuucuccagacuug

SEQ ID NO: 858543 - RNA, 22 nt, Human
gaucagaauucuuguguguuuc

SEQ ID NO: 858544 - RNA, 22 nt, Human
ugcuuaauaggaguugaacauu

SEQ ID NO: 858545 - RNA, 22 nt, Human
aaaucaguuagugguaggauug

SEQ ID NO: 858546 - RNA, 22 nt, Human
uccaugaggcagggaggcuggc

SEQ ID NO: 858547 - RNA, 22 nt, Human
cugucauugagccugucagggc

SEQ ID NO: 858548 - RNA, 22 nt, Human
agaggacagacggaaagugcca

SEQ ID NO: 858549 - RNA, 22 nt, Human
auuucccagcuuugaucaguuu

SEQ ID NO: 858550 - RNA, 19 nt, Human
ugaggggcucacagucuca

SEQ ID NO: 858551 - RNA, 21 nt, Human
ucauuugugaucugauuucca

SEQ ID NO: 858552 - RNA, 22 nt, Human
cccaggagauggagguugcagu

SEQ ID NO: 858553 - RNA, 22 nt, Human
uucauucuuauuugugaucugg

SEQ ID NO: 858554 - RNA, 22 nt, Human
cagcaggauaugguggagagag

SEQ ID NO: 858555 - RNA, 21 nt, Human
aaauacagaaacuuguuuuca

SEQ ID NO: 858556 - RNA, 22 nt, Human
ugaggcaggaguucaggcugcg

SEQ ID NO: 858557 - RNA, 22 nt, Human
caaggccaguccauuuuggaag

SEQ ID NO: 858558 - RNA, 22 nt, Human
cagucucagaggugggaguggg

SEQ ID NO: 858559 - RNA, 22 nt, Human
acauaaguuauggauaaaaugu

SEQ ID NO: 858560 - RNA, 22 nt, Human
acaacaaaaucacuagucuucc

SEQ ID NO: 858561 - RNA, 22 nt, Human
gauguguuuccaggauuuguuu

SEQ ID NO: 858562 - RNA, 23 nt, Human
ucuccuccuagauacagucaugg

SEQ ID NO: 858563 - RNA, 22 nt, Human
uccaugagaacccuuggagaua

SEQ ID NO: 858564 - RNA, 22 nt, Human
uugcauuugaucuuggguucuc

SEQ ID NO: 858565 - RNA, 22 nt, Human
ucauuuguacuugugugcuugu

SEQ ID NO: 858566 - RNA, 22 nt, Human
uaauuauagccgcuauuuugcu

SEQ ID NO: 858567 - RNA, 22 nt, Human
uguucuucuagauugccuuuua

SEQ ID NO: 858568 - RNA, 19 nt, Human
ucuuucauuucuagcucug

SEQ ID NO: 858569 - RNA, 22 nt, Human
aggcucagaggugagcaucugc

SEQ ID NO: 858570 - RNA, 22 nt, Human
aggcagcauuugaauccagguc

SEQ ID NO: 858571 - RNA, 22 nt, Human
ucugggaacucugucauuuccc

SEQ ID NO: 858572 - RNA, 22 nt, Human
aggcaggcucaaugcccagucu

SEQ ID NO: 858573 - RNA, 22 nt, Human
aggcaggcuggucugaagagug

SEQ ID NO: 858574 - RNA, 22 nt, Human
uugaauaguguuuucaguauac

SEQ ID NO: 858575 - RNA, 22 nt, Human
uuuuuggguccaggcuguaucu

SEQ ID NO: 858576 - RNA, 22 nt, Human
cugcccagaagccagaugggca

SEQ ID NO: 858577 - RNA, 22 nt, Human
auacacauauguguguauaugu

SEQ ID NO: 858578 - RNA, 22 nt, Human
uuuccucacuucaugagaguuu

SEQ ID NO: 858579 - RNA, 22 nt, Human
uuauacuaaaacgcauugaauu

SEQ ID NO: 858580 - RNA, 22 nt, Human
aaugguuugauggacaaaauga

SEQ ID NO: 858581 - RNA, 22 nt, Human
ccaggagcagauauggacauaa

SEQ ID NO: 858582 - RNA, 22 nt, Human
uaaggccaccguuauagaacca

SEQ ID NO: 858583 - RNA, 21 nt, Human
aggaggggucuuucccacuga

SEQ ID NO: 858584 - RNA, 22 nt, Human
gcaggcagagguggaggagaca

SEQ ID NO: 858585 - RNA, 22 nt, Human
cugagacuuucaugugcuuuua

SEQ ID NO: 858586 - RNA, 22 nt, Human
ccagaauuuggaucaugauuuu

SEQ ID NO: 858587 - RNA, 22 nt, Human
caauuucacuaaugaugugggg

SEQ ID NO: 858588 - RNA, 22 nt, Human
guaaacaucagccacucuauuu

SEQ ID NO: 858589 - RNA, 22 nt, Human
caacuuugugugaccuagauag

SEQ ID NO: 858590 - RNA, 22 nt, Human
agaguucugcucuucucaguga

SEQ ID NO: 858591 - RNA, 22 nt, Human
aucagaaauugcccagcuguuu

SEQ ID NO: 858592 - RNA, 22 nt, Human
gaggaaccaaaucagcuugcac

SEQ ID NO: 858593 - RNA, 22 nt, Human
aagaaaucauaucauuucuugg

SEQ ID NO: 858594 - RNA, 22 nt, Human
ggguggagaggcuaaguccagu

SEQ ID NO: 858595 - RNA, 22 nt, Human
uguuuaauaauucuaugauagu

SEQ ID NO: 858596 - RNA, 22 nt, Human
aaacaugaauagauauuaaaca

SEQ ID NO: 858597 - RNA, 22 nt, Human
caugugguucaaguacuccaca

SEQ ID NO: 858598 - RNA, 22 nt, Human
aauuucaaacuaauaggaacca

SEQ ID NO: 858599 - RNA, 22 nt, Human
aguuauaaucugcuacugauau

SEQ ID NO: 858600 - RNA, 22 nt, Human
uacagacaguuuuucagauauu

SEQ ID NO: 858601 - RNA, 22 nt, Human
uugaaauacugcauuguucagu

SEQ ID NO: 858602 - RNA, 22 nt, Human
ugaggcagaaauuccuguuuuc

SEQ ID NO: 858603 - RNA, 22 nt, Human
aggacagcagugcuggcacuug

SEQ ID NO: 858604 - RNA, 22 nt, Human
cuguggaauugaugcuuagugu

SEQ ID NO: 858605 - RNA, 22 nt, Human
aacaaaugaccugauuucuucc

SEQ ID NO: 858606 - RNA, 22 nt, Human
uacuaaacaucuggcauuaaau

SEQ ID NO: 858607 - RNA, 22 nt, Human
aaucauucuuauuucacagcaa

SEQ ID NO: 858608 - RNA, 22 nt, Human
cuuuggcacagucucauuugau

SEQ ID NO: 858609 - RNA, 22 nt, Human
gagcagcugagcuggaaugaga

SEQ ID NO: 858610 - RNA, 22 nt, Human
gcauggcugguguccugaggga

SEQ ID NO: 858611 - RNA, 22 nt, Human
uuugaaaggaauuaggaugaca

SEQ ID NO: 858612 - RNA, 19 nt, Human
aaggcagcaguagcaucca

SEQ ID NO: 858613 - RNA, 20 nt, Human
ugcguguguauuuauuuucu

SEQ ID NO: 858614 - RNA, 20 nt, Human
uauuuacaacuuagagccuc

SEQ ID NO: 858615 - RNA, 22 nt, Human
agcugccgaugcccagcugcau

SEQ ID NO: 858616 - RNA, 22 nt, Human
augauguugauaaauuacuuua

SEQ ID NO: 858617 - RNA, 22 nt, Human
ugaggcaguauuuuagugacuu

SEQ ID NO: 858618 - RNA, 22 nt, Human
uggagagguuuaaacaaaaguu

SEQ ID NO: 858619 - RNA, 23 nt, Human
uccaggagcaugcuggcuggcga

SEQ ID NO: 858620 - RNA, 22 nt, Human
uuugacauuauccuguuacugg

SEQ ID NO: 858621 - RNA, 22 nt, Human
uucaggaugacaccauguccag

SEQ ID NO: 858622 - RNA, 22 nt, Human
uaguccuugcugggcacagagu

SEQ ID NO: 858623 - RNA, 22 nt, Human
ucauuguuucugcuuuucauga

SEQ ID NO: 858624 - RNA, 22 nt, Human
gcccaggaugguguguaguggu

SEQ ID NO: 858625 - RNA, 22 nt, Human
gccucugcaauuacauugugcc

SEQ ID NO: 858626 - RNA, 22 nt, Human
acagaaguuggaauuagauacu

SEQ ID NO: 858627 - RNA, 22 nt, Human
ugagagggcccagagcacacca

SEQ ID NO: 858628 - RNA, 22 nt, Human
ccagggaguuuccaaucugaga

SEQ ID NO: 858629 - RNA, 18 nt, Human
cugcccagagcacuugug

SEQ ID NO: 858630 - RNA, 21 nt, Human
cccagggaagccgcagucacc

SEQ ID NO: 858631 - RNA, 22 nt, Human
uacaaaguaauguauaauaucg

SEQ ID NO: 858632 - RNA, 21 nt, Human
ucacuagugccuucugucauu

SEQ ID NO: 858633 - RNA, 20 nt, Human
uuucuugucggcuguugcug

SEQ ID NO: 858634 - RNA, 22 nt, Human
aguguguccagaaaucuguauu

SEQ ID NO: 858635 - RNA, 22 nt, Human
uagcagaaacuguuacagaagg

SEQ ID NO: 858636 - RNA, 22 nt, Human
uuauccaagcagaagcugcaca

SEQ ID NO: 858637 - RNA, 22 nt, Human
uuugaaagagcugauacaugaa

SEQ ID NO: 858638 - RNA, 22 nt, Human
auucaaguccagcuucucuaca

SEQ ID NO: 858639 - RNA, 21 nt, Human
aaugcauuaacauaaagcuga

SEQ ID NO: 858640 - RNA, 22 nt, Human
uuccuuaguugacugucuuagu

SEQ ID NO: 858641 - RNA, 22 nt, Human
agugcuuucccugaaaccuucc

SEQ ID NO: 858642 - RNA, 22 nt, Human
gcagaauuuggggguaaccuuu

SEQ ID NO: 858643 - RNA, 22 nt, Human
cuacagaaggagaaauggguaa

SEQ ID NO: 858644 - RNA, 22 nt, Human
aagucaccccacacucuuggga

SEQ ID NO: 858645 - RNA, 22 nt, Human
auaguuugugaaacacagcagu

SEQ ID NO: 858646 - RNA, 22 nt, Human
uuguuauaaagacuaaauaugu

SEQ ID NO: 858647 - RNA, 22 nt, Human
uaguuuuacuugcgaugauaau

SEQ ID NO: 858648 - RNA, 22 nt, Human
caagauggaguccgggaaugug

SEQ ID NO: 858649 - RNA, 22 nt, Human
ugcuucagaggaaaggcaaaag

SEQ ID NO: 858650 - RNA, 21 nt, Human
ugcugaugucagagaagcaag

SEQ ID NO: 858651 - RNA, 22 nt, Human
augcuguguauuuuacucuuuc

SEQ ID NO: 858652 - RNA, 22 nt, Human
cuaaucaucuuucucuuaaagc

SEQ ID NO: 858653 - RNA, 22 nt, Human
uacuuccuguuuccaugucugu

SEQ ID NO: 858654 - RNA, 22 nt, Human
aaagccuuugucucaggcucug

SEQ ID NO: 858655 - RNA, 22 nt, Human
ugccuugcgggcguuucuguug

SEQ ID NO: 858656 - RNA, 21 nt, Human
gagacagcccagugccagggc

SEQ ID NO: 858657 - RNA, 22 nt, Human
uucuucaauuuuccauauacug

SEQ ID NO: 858658 - RNA, 22 nt, Human
agccaacuaauuaaacaacuuu

SEQ ID NO: 858659 - RNA, 20 nt, Human
agcuucuucugucuaauuuu

SEQ ID NO: 858660 - RNA, 22 nt, Human
cugaauaaagcccucgcgcgcu

SEQ ID NO: 858661 - RNA, 22 nt, Human
auuucaacagaguuugaaggca

SEQ ID NO: 858662 - RNA, 22 nt, Human
gaagcagcuuucuggugaggag

SEQ ID NO: 858663 - RNA, 22 nt, Human
uguccuuaucuccaaacaauca

SEQ ID NO: 858664 - RNA, 22 nt, Human
cacugagcugauagaauuccag

SEQ ID NO: 858665 - RNA, 22 nt, Human
gucaggauuggggucaugaguc

SEQ ID NO: 858666 - RNA, 22 nt, Human
aacuuucuuggaugucucaaca

SEQ ID NO: 858667 - RNA, 22 nt, Human
gucauaaagcuuguugcauuua

SEQ ID NO: 858668 - RNA, 22 nt, Human
aaaugauugucaaaguucuguu

SEQ ID NO: 858669 - RNA, 22 nt, Human
aaauuccagaaacucaguauau

SEQ ID NO: 858670 - RNA, 22 nt, Human
uauacagaacugcacgugcacg

SEQ ID NO: 858671 - RNA, 22 nt, Human
uagcuguguaagcuugguaaga

SEQ ID NO: 858672 - RNA, 22 nt, Human
caagauggagaagcagcaaggg

SEQ ID NO: 858673 - RNA, 22 nt, Human
uucaugugauaaaugugugacu

SEQ ID NO: 858674 - RNA, 22 nt, Human
acuggaucuaauugguuauagu

SEQ ID NO: 858675 - RNA, 22 nt, Human
cacaauguauauguauaucaaa

SEQ ID NO: 858676 - RNA, 22 nt, Human
auuugcuugugcuaugaaaguu

SEQ ID NO: 858677 - RNA, 22 nt, Human
auggcuuuucacagaggguucu

SEQ ID NO: 858678 - RNA, 22 nt, Human
augcuguggggagugaggguag

SEQ ID NO: 858679 - RNA, 22 nt, Human
cccuggaggucagaggccuggg

SEQ ID NO: 858680 - RNA, 22 nt, Human
aguuauccgaaggcacugagau

SEQ ID NO: 858681 - RNA, 22 nt, Human
uugcagcuucgagucuaucugu

SEQ ID NO: 858682 - RNA, 22 nt, Human
gggcagcucuggcugugggaag

SEQ ID NO: 858683 - RNA, 18 nt, Human
cugcuugggagacgucag

SEQ ID NO: 858684 - RNA, 22 nt, Human
cauucauuuaugaaauaucuau

SEQ ID NO: 858685 - RNA, 22 nt, Human
aaguccuuauguggaggggcua

SEQ ID NO: 858686 - RNA, 22 nt, Human
aucuaacagcaacaccagaaua

SEQ ID NO: 858687 - RNA, 22 nt, Human
aagaagagaaaugugcugcugg

SEQ ID NO: 858688 - RNA, 22 nt, Human
ccagaccacccuggccaugcac

SEQ ID NO: 858689 - RNA, 22 nt, Human
cagcaggagcagucagacuccu

SEQ ID NO: 858690 - RNA, 22 nt, Human
caggcagcugcgacaagagagc

SEQ ID NO: 858691 - RNA, 22 nt, Human
cugcuguguuucugcuagaaaa

SEQ ID NO: 858692 - RNA, 22 nt, Human
ucuuugaaagcuguucuagagu

SEQ ID NO: 858693 - RNA, 22 nt, Human
uguaagaaucagucuuuaaugu

SEQ ID NO: 858694 - RNA, 22 nt, Human
gcugauguuuaguugauguuac

SEQ ID NO: 858695 - RNA, 22 nt, Human
caggauggagaguuguugguug

SEQ ID NO: 858696 - RNA, 22 nt, Human
uggcagcuugaaugcagucuuu

SEQ ID NO: 858697 - RNA, 22 nt, Human
ucagaaaauaacuguuaguuug

SEQ ID NO: 858698 - RNA, 22 nt, Human
ccuuaaauucuccauuugaaag

SEQ ID NO: 858699 - RNA, 22 nt, Human
aucugccuggcuccaggugagc

SEQ ID NO: 858700 - RNA, 22 nt, Human
uucuucuucaagugcugcauuc

SEQ ID NO: 858701 - RNA, 22 nt, Human
uagauauaagguccuuagaaca

SEQ ID NO: 858702 - RNA, 22 nt, Human
caaacauucaaguacaagucuu

SEQ ID NO: 858703 - RNA, 22 nt, Human
cuuugcaaacgauuaccacaug

SEQ ID NO: 858704 - RNA, 22 nt, Human
uucauagaucucaauuuugagg

SEQ ID NO: 858705 - RNA, 22 nt, Human
ccauggcucuuaccuuguuaua

SEQ ID NO: 858706 - RNA, 22 nt, Human
uggauuagugcugaaaugaugg

SEQ ID NO: 858707 - RNA, 21 nt, Human
agccagucuguuuucuagugc

SEQ ID NO: 858708 - RNA, 22 nt, Human
ccugcuguucuguuuagugaac

SEQ ID NO: 858709 - RNA, 22 nt, Human
ugagggagagggcgaaaaugaa

SEQ ID NO: 858710 - RNA, 22 nt, Human
agagguagagguugcagugagc

SEQ ID NO: 858711 - RNA, 22 nt, Human
acaaaauuguguuaaacuuuau

SEQ ID NO: 858712 - RNA, 22 nt, Human
uucacagauguauuggaacucc

SEQ ID NO: 858713 - RNA, 19 nt, Human
caggaugaucccaugacac

SEQ ID NO: 858714 - RNA, 22 nt, Human
ugaggcaggaaguuauauaaug

SEQ ID NO: 858715 - RNA, 22 nt, Human
uagggcaggugaagaaaagcua

SEQ ID NO: 858716 - RNA, 22 nt, Human
cuacccagcaccuaggcugccu

SEQ ID NO: 858717 - RNA, 22 nt, Human
ccauccuaucugaccuacuugu

SEQ ID NO: 858718 - RNA, 21 nt, Human
augucaaaugcuuuauuuuau

SEQ ID NO: 858719 - RNA, 22 nt, Human
acagguuugucugauguaauga

SEQ ID NO: 858720 - RNA, 22 nt, Human
caggcagcugcuggguucagcc

SEQ ID NO: 858721 - RNA, 22 nt, Human
uaauuucaccguugcuagaaau

SEQ ID NO: 858722 - RNA, 20 nt, Human
ucuaauuaaaauugucuagu

SEQ ID NO: 858723 - RNA, 22 nt, Human
agaauaucguagcauauuaucu

SEQ ID NO: 858724 - RNA, 22 nt, Human
caagauggacauaaggagagaa

SEQ ID NO: 858725 - RNA, 22 nt, Human
ccaaaugugccuguuucaacaa

SEQ ID NO: 858726 - RNA, 22 nt, Human
ugucaaauuuuuauugcaguau

SEQ ID NO: 858727 - RNA, 22 nt, Human
auuaguaaaacauuguauaugu

SEQ ID NO: 858728 - RNA, 22 nt, Human
cucccaggcacagggaggagcc

SEQ ID NO: 858729 - RNA, 22 nt, Human
ucccaggaagaucccagggacc

SEQ ID NO: 858730 - RNA, 22 nt, Human
ugccuggaaggcccaugggaag

SEQ ID NO: 858731 - RNA, 22 nt, Human
uugcuucaguagcucuuuaaag

SEQ ID NO: 858732 - RNA, 22 nt, Human
guaggcagugguuggaagagaa

SEQ ID NO: 858733 - RNA, 22 nt, Human
uuccaaagugcuggaauuacau

SEQ ID NO: 858734 - RNA, 22 nt, Human
uaucagaacacauguuuugcag

SEQ ID NO: 858735 - RNA, 22 nt, Human
aagaaugauuacaaagcaacga

SEQ ID NO: 858736 - RNA, 22 nt, Human
agcaucuggcagaaagucagaa

SEQ ID NO: 858737 - RNA, 22 nt, Human
auuuaaauuuucugauggagag

SEQ ID NO: 858738 - RNA, 19 nt, Human
cuucuucuuggcagccaag

SEQ ID NO: 858739 - RNA, 22 nt, Human
uagucaccagcuacaggacagc

SEQ ID NO: 858740 - RNA, 22 nt, Human
ccaggagaaugggauuacccua

SEQ ID NO: 858741 - RNA, 22 nt, Human
cagcaggauuugaaaggaagag

SEQ ID NO: 858742 - RNA, 20 nt, Human
cgugcugugaccuugagcau

SEQ ID NO: 858743 - RNA, 22 nt, Human
uuucuaguaaucaauauaaagu

SEQ ID NO: 858744 - RNA, 22 nt, Human
uuuccaaaggaguaccacgcau

SEQ ID NO: 858745 - RNA, 22 nt, Human
guacagaaugcuugguaaggca

SEQ ID NO: 858746 - RNA, 22 nt, Human
aaaauauuuuagggccaggaga

SEQ ID NO: 858747 - RNA, 22 nt, Human
gagucaccacugugauagucga

SEQ ID NO: 858748 - RNA, 22 nt, Human
cauuuguaucugggcugcugug

SEQ ID NO: 858749 - RNA, 22 nt, Human
gagggaggugauacugaacgua

SEQ ID NO: 858750 - RNA, 22 nt, Human
ugguuuugcuaaaauagaaaga

SEQ ID NO: 858751 - RNA, 22 nt, Human
ucugcugugauuugcuaccugu

SEQ ID NO: 858752 - RNA, 22 nt, Human
ucauuucuauugcuacugucug

SEQ ID NO: 858753 - RNA, 22 nt, Human
uugugaguagugccgcaauaaa

SEQ ID NO: 858754 - RNA, 22 nt, Human
aaaacuuucagggauacagaaa

SEQ ID NO: 858755 - RNA, 22 nt, Human
aauguauuccucaugcaagagu

SEQ ID NO: 858756 - RNA, 22 nt, Human
augggaggaugcucgggugcuc

SEQ ID NO: 858757 - RNA, 22 nt, Human
acuagaaacuaauggauuauua

SEQ ID NO: 858758 - RNA, 22 nt, Human
caggauagaaaggccauggagu

SEQ ID NO: 858759 - RNA, 22 nt, Human
gcugggaagugcaagaucaagg

SEQ ID NO: 858760 - RNA, 22 nt, Human
gagggaugguaguugacacuga

SEQ ID NO: 858761 - RNA, 18 nt, Human
ccagguggugacagagau

SEQ ID NO: 858762 - RNA, 22 nt, Human
cuguauuuguccucuauuuauu

SEQ ID NO: 858763 - RNA, 22 nt, Human
acacaaugcauauuuuuccaga

SEQ ID NO: 858764 - RNA, 22 nt, Human
gggagggguugcauguuugagu

SEQ ID NO: 858765 - RNA, 22 nt, Human
agugcuuuauguuguugugcaa

SEQ ID NO: 858766 - RNA, 22 nt, Human
uuuacagauguggaaagugagc

SEQ ID NO: 858767 - RNA, 22 nt, Human
cuggauuugccuauggugcuuu

SEQ ID NO: 858768 - RNA, 22 nt, Human
cauuuguauguuccuccuuagg

SEQ ID NO: 858769 - RNA, 22 nt, Human
uuaacauacaucaugaacaaug

SEQ ID NO: 858770 - RNA, 22 nt, Human
cagagaaaaaauccugcucuca

SEQ ID NO: 858771 - RNA, 22 nt, Human
ucagcauaucuugagcuucaug

SEQ ID NO: 858772 - RNA, 22 nt, Human
aggccagccucaggcagggacc

SEQ ID NO: 858773 - RNA, 22 nt, Human
gaaauaagaguccaugccaggu

SEQ ID NO: 858774 - RNA, 22 nt, Human
aggauuuauuccagaaaugcaa

SEQ ID NO: 858775 - RNA, 22 nt, Human
aucauucuagcuguuguguuga

SEQ ID NO: 858776 - RNA, 21 nt, Human
ucucugugucuuuaagcugga

SEQ ID NO: 858777 - RNA, 21 nt, Human
uggaggaauaaagcacagaag

SEQ ID NO: 858778 - RNA, 22 nt, Human
gccacaggcacuuaagggcugg

SEQ ID NO: 858779 - RNA, 22 nt, Human
uuuacagagaauguacauaaag

SEQ ID NO: 858780 - RNA, 22 nt, Human
gucaggauuuacaaacuucagu

SEQ ID NO: 858781 - RNA, 22 nt, Human
ggagaggaaaugccagcacuuc

SEQ ID NO: 858782 - RNA, 22 nt, Human
auguucaaacaaguuaaugcca

SEQ ID NO: 858783 - RNA, 22 nt, Human
auaacaugagccagauugaaag

SEQ ID NO: 858784 - RNA, 22 nt, Human
gaggagcuugugagaagauguc

SEQ ID NO: 858785 - RNA, 21 nt, Human
gcuauacagaauggccagagg

SEQ ID NO: 858786 - RNA, 22 nt, Human
aggaguggugcaggaccugcca

SEQ ID NO: 858787 - RNA, 22 nt, Human
ugaggggaaggcaugauaaaua

SEQ ID NO: 858788 - RNA, 22 nt, Human
gaagcagcuggugagauggagc

SEQ ID NO: 858789 - RNA, 22 nt, Human
uguacaaugcugagguuugggg

SEQ ID NO: 858790 - RNA, 22 nt, Human
gaaggccacggaauggagcugg

SEQ ID NO: 858791 - RNA, 22 nt, Human
uuccuuagugacuucuagcuac

SEQ ID NO: 858792 - RNA, 22 nt, Human
uauuauuaaauggcagaauuuu

SEQ ID NO: 858793 - RNA, 22 nt, Human
aaaggcaggcuuucacaucuca

SEQ ID NO: 858794 - RNA, 22 nt, Human
uacacacagaggccaugggauu

SEQ ID NO: 858795 - RNA, 22 nt, Human
ucugcaucauuuuucagagccg

SEQ ID NO: 858796 - RNA, 22 nt, Human
aagagggcagcacagguggguc

SEQ ID NO: 858797 - RNA, 22 nt, Human
gauaaaauauguggccuuuagu

SEQ ID NO: 858798 - RNA, 22 nt, Human
uuugaagacagaucaauauaag

SEQ ID NO: 858799 - RNA, 20 nt, Human
gaugggaaucggagcuggua

SEQ ID NO: 858800 - RNA, 22 nt, Human
agauuucagaugcucggcaguu

SEQ ID NO: 858801 - RNA, 22 nt, Human
uuacagaaguuucagcguuuua

SEQ ID NO: 858802 - RNA, 22 nt, Human
auaaagucauuaugaagaucua

SEQ ID NO: 858803 - RNA, 18 nt, Human
ucauuuguuuugcaugaa

SEQ ID NO: 858804 - RNA, 22 nt, Human
gucuucuuguguugccugucuu

SEQ ID NO: 858805 - RNA, 22 nt, Human
uauuuaucgagugucuacuaug

SEQ ID NO: 858806 - RNA, 22 nt, Human
gcuggaucccugugggaguggu

SEQ ID NO: 858807 - RNA, 22 nt, Human
uucuucuccuaaggagaguccu

SEQ ID NO: 858808 - RNA, 22 nt, Human
ucuucagacccuuagcugugau

SEQ ID NO: 858809 - RNA, 22 nt, Human
uuccaugaaggagacugagaag

SEQ ID NO: 858810 - RNA, 22 nt, Human
cagcugacuucauaggaagaca

SEQ ID NO: 858811 - RNA, 22 nt, Human
guaguucugcagugucaccuga

SEQ ID NO: 858812 - RNA, 22 nt, Human
gcccaggaaaugccccguggug

SEQ ID NO: 858813 - RNA, 22 nt, Human
aauuccagaggaggacaguccu

SEQ ID NO: 858814 - RNA, 22 nt, Human
augaauaaacaggugccucuuc

SEQ ID NO: 858815 - RNA, 22 nt, Human
ggaggggagauguuugggcuca

SEQ ID NO: 858816 - RNA, 22 nt, Human
ucucaggaauagaguggcagca

SEQ ID NO: 858817 - RNA, 22 nt, Human
auaauaaaccaggaugggucug

SEQ ID NO: 858818 - RNA, 22 nt, Human
uucaacuagauuuauacaauuc

SEQ ID NO: 858819 - RNA, 22 nt, Human
guuuuucuaggaccaugugauu

SEQ ID NO: 858820 - RNA, 22 nt, Human
acaugcuuugcacuuacaucau

SEQ ID NO: 858821 - RNA, 22 nt, Human
gcuggauccacaaauaacuuug

SEQ ID NO: 858822 - RNA, 22 nt, Human
caggagauguaagacuucuguu

SEQ ID NO: 858823 - RNA, 22 nt, Human
uuacaagcagcuacauaucaca

SEQ ID NO: 858824 - RNA, 17 nt, Human
aggcagcucagaacauc

SEQ ID NO: 858825 - RNA, 22 nt, Human
uuaauauguugaaauuuauuag

SEQ ID NO: 858826 - RNA, 22 nt, Human
uaaacauggcuguuucaguuau

SEQ ID NO: 858827 - RNA, 22 nt, Human
auggcuuuuuagacuuugguac

SEQ ID NO: 858828 - RNA, 22 nt, Human
uaaggccaaggggccauagucu

SEQ ID NO: 858829 - RNA, 22 nt, Human
aucaggaugaagcuguagcgaa

SEQ ID NO: 858830 - RNA, 22 nt, Human
ugaggcaggagaaucaccggaa

SEQ ID NO: 858831 - RNA, 22 nt, Human
uucagaaagguuaaucuggauu

SEQ ID NO: 858832 - RNA, 22 nt, Human
auggcuuaugaauaacaguagg

SEQ ID NO: 858833 - RNA, 22 nt, Human
aaaauuauagaucuagugccug

SEQ ID NO: 858834 - RNA, 22 nt, Human
ucuacagacagagcagguggga

SEQ ID NO: 858835 - RNA, 22 nt, Human
cagugguuauacuuacuguuuc

SEQ ID NO: 858836 - RNA, 21 nt, Human
auuauuauaaagaccacaggg

SEQ ID NO: 858837 - RNA, 21 nt, Human
auagaacaccaggcauauaua

SEQ ID NO: 858838 - RNA, 22 nt, Human
cuacagaaguuucccuugcuua

SEQ ID NO: 858839 - RNA, 22 nt, Human
gcagaggccuagguggaaggcc

SEQ ID NO: 858840 - RNA, 22 nt, Human
cucuucuuauggccguggcuga

SEQ ID NO: 858841 - RNA, 22 nt, Human
gaaacugugaggaucuuaacuu

SEQ ID NO: 858842 - RNA, 22 nt, Human
ucacagaaauaagauaguuauu

SEQ ID NO: 858843 - RNA, 22 nt, Human
aauagaaaggaggggcucuugu

SEQ ID NO: 858844 - RNA, 22 nt, Human
uuugacaugcaaagcacuuuag

SEQ ID NO: 858845 - RNA, 22 nt, Human
aggagaggucucccuuccccag

SEQ ID NO: 858846 - RNA, 22 nt, Human
aaggcagccauagcaccaucca

SEQ ID NO: 858847 - RNA, 22 nt, Human
gaggagaggcuggacgcgguga

SEQ ID NO: 858848 - RNA, 22 nt, Human
ugaaggccagggauuugcagcc

SEQ ID NO: 858849 - RNA, 22 nt, Human
uagcugcugcagcacagggagg

SEQ ID NO: 858850 - RNA, 22 nt, Human
cccaggaggcagagguuggagc

SEQ ID NO: 858851 - RNA, 22 nt, Human
ggccaggagaggagggcacuga

SEQ ID NO: 858852 - RNA, 22 nt, Human
uuuauccagcagcuauucaaaa

SEQ ID NO: 858853 - RNA, 22 nt, Human
caggguggcacaucacagcauu

SEQ ID NO: 858854 - RNA, 22 nt, Human
auguucuguuuuguaauucaua

SEQ ID NO: 858855 - RNA, 22 nt, Human
gaggcagcagggcugguuccuu

SEQ ID NO: 858856 - RNA, 18 nt, Human
cuggcuuucuuauccauc

SEQ ID NO: 858857 - RNA, 22 nt, Human
ucccaggauguuggcggcaggu

SEQ ID NO: 858858 - RNA, 22 nt, Human
uaguccuuuaucaaacauuuau

SEQ ID NO: 858859 - RNA, 22 nt, Human
gagggagugccagagggccagc

SEQ ID NO: 858860 - RNA, 22 nt, Human
cccauucauccucgcuuccuuc

SEQ ID NO: 858861 - RNA, 22 nt, Human
ugcuuuaagagauuguuaguac

SEQ ID NO: 858862 - RNA, 22 nt, Human
cccaggaggucgaagcugcagu

SEQ ID NO: 858863 - RNA, 22 nt, Human
cccagaaggucgaggcugcagu

SEQ ID NO: 858864 - RNA, 22 nt, Human
acccaggagcucugggguccuc

SEQ ID NO: 858865 - RNA, 22 nt, Human
auaucagaaauaguaagcagag

SEQ ID NO: 858866 - RNA, 22 nt, Human
uuucagggagccuagaagagcu

SEQ ID NO: 858867 - RNA, 22 nt, Human
gaggcagcuuggggcugugggu

SEQ ID NO: 858868 - RNA, 22 nt, Human
uuugacaaaggaaaaaugcaca

SEQ ID NO: 858869 - RNA, 22 nt, Human
acuuuaauuaaugaacuguggc

SEQ ID NO: 858870 - RNA, 22 nt, Human
cagaggcauacucccagucuug

SEQ ID NO: 858871 - RNA, 22 nt, Human
uauggcuuuuaacugucguaug

SEQ ID NO: 858872 - RNA, 22 nt, Human
gaggcaguuugccaugccagga

SEQ ID NO: 858873 - RNA, 22 nt, Human
ggccagcuuugagcugcaggaa

SEQ ID NO: 858874 - RNA, 22 nt, Human
ugcuuauugcuuucaagacugu

SEQ ID NO: 858875 - RNA, 22 nt, Human
gucuucaauagagccucaauuu

SEQ ID NO: 858876 - RNA, 22 nt, Human
gaggguggguuucuugcacguc

SEQ ID NO: 858877 - RNA, 22 nt, Human
guuaaagaguuuggcuuucuuc

SEQ ID NO: 858878 - RNA, 22 nt, Human
agaggcagccguauuucaaagg

SEQ ID NO: 858879 - RNA, 22 nt, Human
cugagcugggaguagagacucu

SEQ ID NO: 858880 - RNA, 22 nt, Human
agccauucauugugcucucaga

SEQ ID NO: 858881 - RNA, 21 nt, Human
gacaaagugaagcaggcagga

SEQ ID NO: 858882 - RNA, 22 nt, Human
gggcagcuggauaguuuuaaau

SEQ ID NO: 858883 - RNA, 22 nt, Human
cucuaacacuguaaugcuuucu

SEQ ID NO: 858884 - RNA, 22 nt, Human
agaggcagcagucauacuacag

SEQ ID NO: 858885 - RNA, 22 nt, Human
uuugaagaccuuaucucuaaau

SEQ ID NO: 858886 - RNA, 22 nt, Human
uucuucuuaauguccugggaac

SEQ ID NO: 858887 - RNA, 22 nt, Human
uuugaagauaaauauggagaaa

SEQ ID NO: 858888 - RNA, 22 nt, Human
ccaggaguggcuggugaccuuc

SEQ ID NO: 858889 - RNA, 22 nt, Human
aggcagcauccagaggagaaug

SEQ ID NO: 858890 - RNA, 22 nt, Human
uguauguugggucaaaguacau

SEQ ID NO: 858891 - RNA, 22 nt, Human
ucuucagacuccaaauguuuua

SEQ ID NO: 858892 - RNA, 22 nt, Human
caauuucagugcuguggagagg

SEQ ID NO: 858893 - RNA, 23 nt, Human
gagauuuagcagacaaagcucuu

SEQ ID NO: 858894 - RNA, 22 nt, Human
aaauacagaguugcuuaaaagc

SEQ ID NO: 858895 - RNA, 22 nt, Human
uucaggaugaaagugugcaaca

SEQ ID NO: 858896 - RNA, 19 nt, Human
uaucuguuuccugcuuguc

SEQ ID NO: 858897 - RNA, 21 nt, Human
uuugaaagugggugauucuuu

SEQ ID NO: 858898 - RNA, 22 nt, Human
agaggacaaaaugagaagugcu

SEQ ID NO: 858899 - RNA, 22 nt, Human
uccaggagguugagugaguucc

SEQ ID NO: 858900 - RNA, 22 nt, Human
uaucuguuguccaugcagaaag

SEQ ID NO: 858901 - RNA, 21 nt, Human
cugcuguggcccccgacaugc

SEQ ID NO: 858902 - RNA, 23 nt, Human
ggagugcaauggcgccaucucgg

SEQ ID NO: 858903 - RNA, 22 nt, Human
ggaggugggcuaaggacucucu

SEQ ID NO: 858904 - RNA, 22 nt, Human
aguacaacauuagaguaucuua

SEQ ID NO: 858905 - RNA, 22 nt, Human
gaagcacauggcuauagcuauu

SEQ ID NO: 858906 - RNA, 22 nt, Human
uccagaauauuugggaaagaug

SEQ ID NO: 858907 - RNA, 22 nt, Human
aaaucaguucucccuuucuuca

SEQ ID NO: 858908 - RNA, 22 nt, Human
ugaaagguuaaaaguaguauug

SEQ ID NO: 858909 - RNA, 22 nt, Human
cucaggauugugccuagggaga

SEQ ID NO: 858910 - RNA, 22 nt, Human
acaguccuuguguggaacauua

SEQ ID NO: 858911 - RNA, 22 nt, Human
agguaggggguuugggaacugc

SEQ ID NO: 858912 - RNA, 22 nt, Human
cucuccucugaaguggugaccc

SEQ ID NO: 858913 - RNA, 22 nt, Human
ucuuagcauuucauaacaacug

SEQ ID NO: 858914 - RNA, 15 nt, Human
caggagaggaagguu

SEQ ID NO: 858915 - RNA, 22 nt, Human
gcaacuuuagaaaaaucuauaa

SEQ ID NO: 858916 - RNA, 22 nt, Human
accaggaguagaauaucuguga

SEQ ID NO: 858917 - RNA, 22 nt, Human
auuuccaauuucauccaugucc

SEQ ID NO: 858918 - RNA, 22 nt, Human
aggcugcugaggccaccacgcu

SEQ ID NO: 858919 - RNA, 22 nt, Human
aaaggccauuacuugcuuuuag

SEQ ID NO: 858920 - RNA, 22 nt, Human
caaucaguuucuguuguauaau

SEQ ID NO: 858921 - RNA, 19 nt, Human
aacuguaauuaauacccua

SEQ ID NO: 858922 - RNA, 22 nt, Human
acagcauucaauaaauaauaac

SEQ ID NO: 858923 - RNA, 22 nt, Human
uuuuaacuuaaaauacauagau

SEQ ID NO: 858924 - RNA, 22 nt, Human
ccuggaucgaugccgagggaaa

SEQ ID NO: 858925 - RNA, 22 nt, Human
cacaauuuggugcuaaagaaag

SEQ ID NO: 858926 - RNA, 22 nt, Human
aagggaggggauguaagccugg

SEQ ID NO: 858927 - RNA, 22 nt, Human
uucauucuugggaucagagagu

SEQ ID NO: 858928 - RNA, 22 nt, Human
uacccagggcuuuucugaugca

SEQ ID NO: 858929 - RNA, 22 nt, Human
augaacaaguauuugcaugagc

SEQ ID NO: 858930 - RNA, 22 nt, Human
aggagagcuggugucuggaauc

SEQ ID NO: 858931 - RNA, 22 nt, Human
uuucaaagaccauuaacuauca

SEQ ID NO: 858932 - RNA, 22 nt, Human
aaagccagguugugugcaggaa

SEQ ID NO: 858933 - RNA, 22 nt, Human
uaaguggaagguuauaugcuaa

SEQ ID NO: 858934 - RNA, 22 nt, Human
agcccaggagguggagguugca

SEQ ID NO: 858935 - RNA, 22 nt, Human
agggcagcucucaccucuggcc

SEQ ID NO: 858936 - RNA, 22 nt, Human
gugaaggacuagcauggagggc

SEQ ID NO: 858937 - RNA, 22 nt, Human
aauuuacacuucauuuggaggg

SEQ ID NO: 858938 - RNA, 22 nt, Human
uugaaaggguuaaagugguaaa

SEQ ID NO: 858939 - RNA, 16 nt, Human
auuuccagauuaugca

SEQ ID NO: 858940 - RNA, 22 nt, Human
gcuguucucuguaacaugcauu

SEQ ID NO: 858941 - RNA, 22 nt, Human
uagggauguggugagaacugag

SEQ ID NO: 858942 - RNA, 22 nt, Human
auugcuguaaauuaucuuauua

SEQ ID NO: 858943 - RNA, 22 nt, Human
aggcaccuugagagcaggagcu

SEQ ID NO: 858944 - RNA, 19 nt, Human
uggauuuauauucuuuauc

SEQ ID NO: 858945 - RNA, 22 nt, Human
uucaggauucucucccauuuac

SEQ ID NO: 858946 - RNA, 22 nt, Human
ugaaaugagauaauuuaagugc

SEQ ID NO: 858947 - RNA, 23 nt, Human
aggucagcaggcaaggaaauggc

SEQ ID NO: 858948 - RNA, 22 nt, Human
aggcacagcacaccuggccccc

SEQ ID NO: 858949 - RNA, 22 nt, Human
uuuucauuuuuguagaugcaag

SEQ ID NO: 858950 - RNA, 22 nt, Human
uauggcuugucuuuauaccagg

SEQ ID NO: 858951 - RNA, 22 nt, Human
guugaaagaucauguggcugcc

SEQ ID NO: 858952 - RNA, 22 nt, Human
gagagucuaggaaccucauaua

SEQ ID NO: 858953 - RNA, 19 nt, Human
uguguguuuauauauguau

SEQ ID NO: 858954 - RNA, 22 nt, Human
uauuccaacugucauagucaua

SEQ ID NO: 858955 - RNA, 23 nt, Human
agaggcaggaguggcuugcccgg

SEQ ID NO: 858956 - RNA, 22 nt, Human
cuccaugaauuugagcuuugug

SEQ ID NO: 858957 - RNA, 22 nt, Human
ucuaaacaguuucacucuuaau

SEQ ID NO: 858958 - RNA, 22 nt, Human
uuuaaauuuguguuuagagggu

SEQ ID NO: 858959 - RNA, 22 nt, Human
cuuaauuacuguccaauaugca

SEQ ID NO: 858960 - RNA, 22 nt, Human
ucaaaauuucagcacuagcccu

SEQ ID NO: 858961 - RNA, 22 nt, Human
gaaauauacaugaagucggcug

SEQ ID NO: 858962 - RNA, 22 nt, Human
cagcuagcuaagaaggccagag

SEQ ID NO: 858963 - RNA, 22 nt, Human
cagcuuccgaccgggggcugca

SEQ ID NO: 858964 - RNA, 22 nt, Human
uuugcagucuggccugcuuugg

SEQ ID NO: 858965 - RNA, 22 nt, Human
gcugcugucagugguggcaguu

SEQ ID NO: 858966 - RNA, 22 nt, Human
uaugcccagcuuaaaguacaca

SEQ ID NO: 858967 - RNA, 22 nt, Human
ucagccagcaucagcuaagugc

SEQ ID NO: 858968 - RNA, 22 nt, Human
agaggaugguugaggaagaccu

SEQ ID NO: 858969 - RNA, 22 nt, Human
aaggagagagcuuugcuggaac

SEQ ID NO: 858970 - RNA, 22 nt, Human
cauacuuucuuuuucacgcaua

SEQ ID NO: 858971 - RNA, 22 nt, Human
ggcagaggaaggaugaauucac

SEQ ID NO: 858972 - RNA, 22 nt, Human
accuugaugccuuuccaagaug

SEQ ID NO: 858973 - RNA, 21 nt, Human
uucuucaguuuaauauaaaau

SEQ ID NO: 858974 - RNA, 22 nt, Human
aaaggaagaugccaggacucug

SEQ ID NO: 858975 - RNA, 22 nt, Human
aagacaauuugauacuaguugc

SEQ ID NO: 858976 - RNA, 22 nt, Human
aucugccuccaaguccaugugu

SEQ ID NO: 858977 - RNA, 22 nt, Human
ucauuuguucaucugcucuucu

SEQ ID NO: 858978 - RNA, 22 nt, Human
caauuucagguggauagguuuu

SEQ ID NO: 858979 - RNA, 22 nt, Human
uuaacacuaucugucauaauua

SEQ ID NO: 858980 - RNA, 22 nt, Human
gaguccuugacacauaguaggu

SEQ ID NO: 858981 - RNA, 22 nt, Human
uuucaguuacugcuauaucauu

SEQ ID NO: 858982 - RNA, 22 nt, Human
acaaagucacaauaauuaaccu

SEQ ID NO: 858983 - RNA, 20 nt, Human
accaggagauggaggcaggg

SEQ ID NO: 858984 - RNA, 23 nt, Human
acauacauggagauaaagugaug

SEQ ID NO: 858985 - RNA, 22 nt, Human
aagcaauagcaacaacuuuaca

SEQ ID NO: 858986 - RNA, 19 nt, Human
gacagugcaguuguaguac

SEQ ID NO: 858987 - RNA, 22 nt, Human
aggcaggcaaccaccugggaag

SEQ ID NO: 858988 - RNA, 22 nt, Human
ggcagcuuccugagccagcagc

SEQ ID NO: 858989 - RNA, 22 nt, Human
uuuuaucugcuucauuaguuga

SEQ ID NO: 858990 - RNA, 17 nt, Human
ugaaggccaugaccacg

SEQ ID NO: 858991 - RNA, 22 nt, Human
caggaugagguagaggcagaua

SEQ ID NO: 858992 - RNA, 22 nt, Human
uccugaggcucacuuugaaugu

SEQ ID NO: 858993 - RNA, 22 nt, Human
uuugcauaagucauguccagug

SEQ ID NO: 858994 - RNA, 22 nt, Human
uccuuagagauacugucuugaa

SEQ ID NO: 858995 - RNA, 22 nt, Human
gucaacuugcaagaugcugggc

SEQ ID NO: 858996 - RNA, 22 nt, Human
gagggagggaaaguuuaacacu

SEQ ID NO: 858997 - RNA, 22 nt, Human
ugaggcagcaauuguauuguau

SEQ ID NO: 858998 - RNA, 20 nt, Human
ucagugauuuugaagaggaa

SEQ ID NO: 858999 - RNA, 22 nt, Human
guuuuauaggcuguugcuauau

SEQ ID NO: 859000 - RNA, 22 nt, Human
caucagaacgugagcuccuugu

SEQ ID NO: 859001 - RNA, 22 nt, Human
auacagaagaacuauagccacu

SEQ ID NO: 859002 - RNA, 22 nt, Human
agucugucuacuuaaagucugu

SEQ ID NO: 859003 - RNA, 22 nt, Human
uguuuuuaaauaaugauagaaa

SEQ ID NO: 859004 - RNA, 22 nt, Human
ucuuuuggguucuuaugauuua

SEQ ID NO: 859005 - RNA, 22 nt, Human
aguccuuacaccuggaaccuau

SEQ ID NO: 859006 - RNA, 22 nt, Human
ucuucccuaaucaccaucuuca

SEQ ID NO: 859007 - RNA, 22 nt, Human
aaucuucuuucuuaacaguaca

SEQ ID NO: 859008 - RNA, 22 nt, Human
aacauguugcuuuaauaauauu

SEQ ID NO: 859009 - RNA, 22 nt, Human
ggaagagggaaccacgacugua

SEQ ID NO: 859010 - RNA, 22 nt, Human
auacaugugggucuaaacauau

SEQ ID NO: 859011 - RNA, 22 nt, Human
aaauguauugcauaggauauuu

SEQ ID NO: 859012 - RNA, 22 nt, Human
acagguuuuuguggauauaugu

SEQ ID NO: 859013 - RNA, 22 nt, Human
acaacauuauacauagaaagcu

SEQ ID NO: 859014 - RNA, 22 nt, Human
ucaaaauucuagggagaauggu

SEQ ID NO: 859015 - RNA, 22 nt, Human
uaucagaaagauauuacugggg

SEQ ID NO: 859016 - RNA, 17 nt, Human
caauuucauagguuuug

SEQ ID NO: 859017 - RNA, 22 nt, Human
cuugaaagucagcagaguggau

SEQ ID NO: 859018 - RNA, 22 nt, Human
aacaaacaaacauuuugucauc

SEQ ID NO: 859019 - RNA, 22 nt, Human
ucauuguuauguuuugcugucu

SEQ ID NO: 859020 - RNA, 22 nt, Human
cauuucaaggaccacccuggga

SEQ ID NO: 859021 - RNA, 22 nt, Human
aauaugcauuaacuguguacau

SEQ ID NO: 859022 - RNA, 22 nt, Human
uucagcaaacacgaugcuuguu

SEQ ID NO: 859023 - RNA, 22 nt, Human
cucuccucagaacaggcccucu

SEQ ID NO: 859024 - RNA, 22 nt, Human
uugguuuagagagugugguuac

SEQ ID NO: 859025 - RNA, 22 nt, Human
uuuaucuguuguacauuuaugc

SEQ ID NO: 859026 - RNA, 19 nt, Human
caggagagcaugcacuuug

SEQ ID NO: 859027 - RNA, 22 nt, Human
ugauaauauuuugaaucauaag

SEQ ID NO: 859028 - RNA, 22 nt, Human
aguccaaggagagacagcauuu

SEQ ID NO: 859029 - RNA, 22 nt, Human
aaacuuuggauugugauugugc

SEQ ID NO: 859030 - RNA, 21 nt, Human
cucaggauggcggccuggugg

SEQ ID NO: 859031 - RNA, 22 nt, Human
agcauuuagucuuuauugcagc

SEQ ID NO: 859032 - RNA, 22 nt, Human
uuuuauagcugaauaguauucc

SEQ ID NO: 859033 - RNA, 22 nt, Human
aaagucaucagaaccuuccaga

SEQ ID NO: 859034 - RNA, 17 nt, Human
gaggacagggaaguagg

SEQ ID NO: 859035 - RNA, 22 nt, Human
aauuuacaggugcacucgccau

SEQ ID NO: 859036 - RNA, 22 nt, Human
auugaaagauaggcuacugugg

SEQ ID NO: 859037 - RNA, 18 nt, Human
ucauagaagugaaucaga

SEQ ID NO: 859038 - RNA, 22 nt, Human
ugcuuggccuacuuguccuuug

SEQ ID NO: 859039 - RNA, 22 nt, Human
cauuuguaauacugacuugcag

SEQ ID NO: 859040 - RNA, 22 nt, Human
ugccuggauucgguuguuguca

SEQ ID NO: 859041 - RNA, 22 nt, Human
uuucaaaguugggaauuguaau

SEQ ID NO: 859042 - RNA, 22 nt, Human
aagccaaugagagaggccucag

SEQ ID NO: 859043 - RNA, 22 nt, Human
caacagucugguuuauauaaua

SEQ ID NO: 859044 - RNA, 22 nt, Human
uuugaagucagacacugcuuug

SEQ ID NO: 859045 - RNA, 22 nt, Human
uaaaugagggcugacaugauug

SEQ ID NO: 859046 - RNA, 22 nt, Human
cucccagggucuaggcugcugg

SEQ ID NO: 859047 - RNA, 22 nt, Human
cccaggagguggagguugcggu

SEQ ID NO: 859048 - RNA, 22 nt, Human
aucugcuugaaugagcaacagg

SEQ ID NO: 859049 - RNA, 22 nt, Human
cugcuuuguaaaauagacauaa

SEQ ID NO: 859050 - RNA, 23 nt, Human
auguauuuaaauuucagugauga

SEQ ID NO: 859051 - RNA, 22 nt, Human
uaaguccuucaccuaauccuca

SEQ ID NO: 859052 - RNA, 22 nt, Human
gaaguucaaaagacagauuuga

SEQ ID NO: 859053 - RNA, 23 nt, Human
cuugcaggaagcagauggcacac

SEQ ID NO: 859054 - RNA, 21 nt, Human
ugaaugaggaggauggcauuu

SEQ ID NO: 859055 - RNA, 22 nt, Human
uugcaucuaccauaucaaagau

SEQ ID NO: 859056 - RNA, 22 nt, Human
gaucagaaugggacauauccug

SEQ ID NO: 859057 - RNA, 22 nt, Human
acauuuuuauucaucaaagcag

SEQ ID NO: 859058 - RNA, 22 nt, Human
ucaggagauggucuuuauaggc

SEQ ID NO: 859059 - RNA, 22 nt, Human
aguaaacauuuucauauuuucu

SEQ ID NO: 859060 - RNA, 22 nt, Human
cuuacagagaagaaaauguagu

SEQ ID NO: 859061 - RNA, 22 nt, Human
uuuauccauaucauuaaaaucu

SEQ ID NO: 859062 - RNA, 22 nt, Human
aacaugauggggaagaacaaga

SEQ ID NO: 859063 - RNA, 22 nt, Human
accaggaggccuugguucugag

SEQ ID NO: 859064 - RNA, 22 nt, Human
uaaugucagcauaguuuauuuu

SEQ ID NO: 859065 - RNA, 22 nt, Human
caauuucaauacaaaauacauu

SEQ ID NO: 859066 - RNA, 21 nt, Human
acagucuccccagaucucucc

SEQ ID NO: 859067 - RNA, 19 nt, Human
agucuuucccacucgucuu

SEQ ID NO: 859068 - RNA, 22 nt, Human
gaauauuuuuaaagggacuaau

SEQ ID NO: 859069 - RNA, 22 nt, Human
aaagcagucacuccagugugau

SEQ ID NO: 859070 - RNA, 20 nt, Human
uccaggagguuaguguggcu

SEQ ID NO: 859071 - RNA, 19 nt, Human
ugaaauggcaguugcuaaa

SEQ ID NO: 859072 - RNA, 22 nt, Human
uuugaaagcaccauuugaguag

SEQ ID NO: 859073 - RNA, 22 nt, Human
caggauggucuucauuuggcuc

SEQ ID NO: 859074 - RNA, 22 nt, Human
uacaggaaguaaguaaugaaau

SEQ ID NO: 859075 - RNA, 22 nt, Human
uugacacaguuuucucauuaag

SEQ ID NO: 859076 - RNA, 22 nt, Human
cccaggaacagcacagaacagc

SEQ ID NO: 859077 - RNA, 22 nt, Human
ugaugaaauguugaggcaguga

SEQ ID NO: 859078 - RNA, 21 nt, Human
acaugucuggucauuuuuagc

SEQ ID NO: 859079 - RNA, 22 nt, Human
cuuagcaugugguguccuugua

SEQ ID NO: 859080 - RNA, 22 nt, Human
cuacagaaucuaccucaagcca

SEQ ID NO: 859081 - RNA, 22 nt, Human
gucaggaugggcagccaaacua

SEQ ID NO: 859082 - RNA, 22 nt, Human
auggagggugucagagagcgaa

SEQ ID NO: 859083 - RNA, 22 nt, Human
aauaauuacccaucuuuuugua

SEQ ID NO: 859084 - RNA, 22 nt, Human
uguaaauaauuccuaggcuuuu

SEQ ID NO: 859085 - RNA, 23 nt, Human
agggagcuaaaaggcuggagcag

SEQ ID NO: 859086 - RNA, 22 nt, Human
ugaaacaagauccacagacuug

SEQ ID NO: 859087 - RNA, 22 nt, Human
guagaaauauuuaucucugaga

SEQ ID NO: 859088 - RNA, 22 nt, Human
aggaaaacacaguauugaugga

SEQ ID NO: 859089 - RNA, 22 nt, Human
uuucaucuuccuuggcauaggu

SEQ ID NO: 859090 - RNA, 22 nt, Human
cagaaauguacugacaugcagu

SEQ ID NO: 859091 - RNA, 22 nt, Human
uuuuucaagacaaccugcaugu

SEQ ID NO: 859092 - RNA, 22 nt, Human
gugaauaaucacccuucuggau

SEQ ID NO: 859093 - RNA, 22 nt, Human
ucuuugcaaaauacaacaaugg

SEQ ID NO: 859094 - RNA, 22 nt, Human
acucaggagggaucagcuauca

SEQ ID NO: 859095 - RNA, 22 nt, Human
cccaggauggggcugcaguuau

SEQ ID NO: 859096 - RNA, 22 nt, Human
aauggcuucugaagcacacuuu

SEQ ID NO: 859097 - RNA, 22 nt, Human
cagcugccugucuggaggcaau

SEQ ID NO: 859098 - RNA, 22 nt, Human
uaugcugugcuagauacaauau

SEQ ID NO: 859099 - RNA, 22 nt, Human
auagaaauggcagcuggugcua

SEQ ID NO: 859100 - RNA, 22 nt, Human
ucuucacaugaccuucaugucu

SEQ ID NO: 859101 - RNA, 17 nt, Human
uccaugagacaugaaga

SEQ ID NO: 859102 - RNA, 22 nt, Human
uggaaugacagagagucugaau

SEQ ID NO: 859103 - RNA, 22 nt, Human
ccagugcuaagguagccucugc

SEQ ID NO: 859104 - RNA, 21 nt, Human
agaggcaggcauuaaguacac

SEQ ID NO: 859105 - RNA, 22 nt, Human
caaguccaggucaauuuaaagc

SEQ ID NO: 859106 - RNA, 22 nt, Human
aggcaacuguuugauaauguug

SEQ ID NO: 859107 - RNA, 21 nt, Human
cucuugugucagagccagagg

SEQ ID NO: 859108 - RNA, 22 nt, Human
auggcuuucagauggugaaaga

SEQ ID NO: 859109 - RNA, 22 nt, Human
ccuugcauauauuauaucuuug

SEQ ID NO: 859110 - RNA, 22 nt, Human
gagcagcucgagaaggaagcag

SEQ ID NO: 859111 - RNA, 22 nt, Human
auacaacuuuacaugcaauucc

SEQ ID NO: 859112 - RNA, 22 nt, Human
aggauuuaccgucauuuagucu

SEQ ID NO: 859113 - RNA, 22 nt, Human
uuuauccaccuuacccuguucc

SEQ ID NO: 859114 - RNA, 22 nt, Human
uaucagaagacuuacaguaucg

SEQ ID NO: 859115 - RNA, 22 nt, Human
ugaaacuaggccaaucaaauua

SEQ ID NO: 859116 - RNA, 22 nt, Human
uauguguuugacacccugcaag

SEQ ID NO: 859117 - RNA, 18 nt, Human
ugugaacacauuuuucug

SEQ ID NO: 859118 - RNA, 22 nt, Human
guucuaauuuggggcuccuuag

SEQ ID NO: 859119 - RNA, 22 nt, Human
aggcagaccaugaaucaugacc

SEQ ID NO: 859120 - RNA, 22 nt, Human
gggcagcugccagaggccaugg

SEQ ID NO: 859121 - RNA, 22 nt, Human
auguucaaacuuuuuacacacc

SEQ ID NO: 859122 - RNA, 22 nt, Human
uuugaaguggaaaaggauuuaa

SEQ ID NO: 859123 - RNA, 22 nt, Human
ucuggaucaccacuucugccuc

SEQ ID NO: 859124 - RNA, 22 nt, Human
ucccaggauguuuauggcuggu

SEQ ID NO: 859125 - RNA, 22 nt, Human
gccaugcuugguaugcugugag

SEQ ID NO: 859126 - RNA, 22 nt, Human
uaucuguucaauggaagaugac

SEQ ID NO: 859127 - RNA, 22 nt, Human
cucagugugaaugcucaguaaa

SEQ ID NO: 859128 - RNA, 22 nt, Human
aaguugagaugucauaggagac

SEQ ID NO: 859129 - RNA, 22 nt, Human
ggcagcuaguuuaagaaagagg

SEQ ID NO: 859130 - RNA, 22 nt, Human
uuugaaagggaaauaaacuccu

SEQ ID NO: 859131 - RNA, 22 nt, Human
augguuuuccucugcugcuuaa

SEQ ID NO: 859132 - RNA, 22 nt, Human
gcagaggagcaaguugcuacag

SEQ ID NO: 859133 - RNA, 22 nt, Human
aaacuuuguagagaaugcuggc

SEQ ID NO: 859134 - RNA, 22 nt, Human
acagucuugagcaucagccaga

SEQ ID NO: 859135 - RNA, 21 nt, Human
cacucaggguaugugccaggc

SEQ ID NO: 859136 - RNA, 22 nt, Human
aggaggggcaaugauagucugg

SEQ ID NO: 859137 - RNA, 22 nt, Human
uaucagaaugcagccaugugca

SEQ ID NO: 859138 - RNA, 22 nt, Human
ugaagaauaagauagauggagc

SEQ ID NO: 859139 - RNA, 22 nt, Human
ucuucuuccucauuuauacaua

SEQ ID NO: 859140 - RNA, 22 nt, Human
guaggcagggcuguggggagaa

SEQ ID NO: 859141 - RNA, 22 nt, Human
cccaggagguuggggcuacagu

SEQ ID NO: 859142 - RNA, 22 nt, Human
gggcagcuggcuuauagguuug

SEQ ID NO: 859143 - RNA, 22 nt, Human
gcaaagcauucuguggagucua

SEQ ID NO: 859144 - RNA, 22 nt, Human
gaauacauuggaaaucagaaua

SEQ ID NO: 859145 - RNA, 22 nt, Human
agaggcggagguugcagugagc

SEQ ID NO: 859146 - RNA, 23 nt, Human
ggccauuucauuugguucaaacu

SEQ ID NO: 859147 - RNA, 22 nt, Human
aaucagaauuuguccccugagu

SEQ ID NO: 859148 - RNA, 22 nt, Human
guacagaauuaugccaugaggg

SEQ ID NO: 859149 - RNA, 22 nt, Human
aaaucucaauuugaauuguagc

SEQ ID NO: 859150 - RNA, 22 nt, Human
ugaaggccucugguacaugcca

SEQ ID NO: 859151 - RNA, 22 nt, Human
ucauuuguaccauuuuuuaaga

SEQ ID NO: 859152 - RNA, 20 nt, Human
gcccaggaauuugcauuucu

SEQ ID NO: 859153 - RNA, 22 nt, Human
auuuguugcuagcagcacugau

SEQ ID NO: 859154 - RNA, 22 nt, Human
aaaggccaauaaagacaagcug

SEQ ID NO: 859155 - RNA, 22 nt, Human
aaagcagaggugauaugacuua

SEQ ID NO: 859156 - RNA, 22 nt, Human
cccaggaguaagugacauuguu

SEQ ID NO: 859157 - RNA, 22 nt, Human
uaucaagugacuaucacagaac

SEQ ID NO: 859158 - RNA, 20 nt, Human
aggcaccugucacaggugag

SEQ ID NO: 859159 - RNA, 20 nt, Human
auucuacaagaauaagcaug

SEQ ID NO: 859160 - RNA, 22 nt, Human
uugaauaauuaauuacacucag

SEQ ID NO: 859161 - RNA, 22 nt, Human
uucuuugaguuaguacagucca

SEQ ID NO: 859162 - RNA, 22 nt, Human
ucuagacacuacuaguaaccgg

SEQ ID NO: 859163 - RNA, 22 nt, Human
guagggagcccagagcccagug

SEQ ID NO: 859164 - RNA, 22 nt, Human
aaaggccacacagagcagggag

SEQ ID NO: 859165 - RNA, 20 nt, Human
cccaggagugagcagcuuua

SEQ ID NO: 859166 - RNA, 20 nt, Human
aagggcagagggaacagacu

SEQ ID NO: 859167 - RNA, 22 nt, Human
uccauuuuucaugacuccucaa

SEQ ID NO: 859168 - RNA, 22 nt, Human
ucagugugaguaccaugcucag

SEQ ID NO: 859169 - RNA, 22 nt, Human
uuggcagugaugcagcuuguuc

SEQ ID NO: 859170 - RNA, 22 nt, Human
guucuucaucuuaaccaucugu

SEQ ID NO: 859171 - RNA, 22 nt, Human
ggaggaugagcuacgaggagcu

SEQ ID NO: 859172 - RNA, 22 nt, Human
augguauugcaacaacugucau

SEQ ID NO: 859173 - RNA, 22 nt, Human
gucccaggugggcuccaccucu

SEQ ID NO: 859174 - RNA, 22 nt, Human
ccucagggaaugggaggcuggg

SEQ ID NO: 859175 - RNA, 22 nt, Human
uagggaugacgaaaggacagag

SEQ ID NO: 859176 - RNA, 22 nt, Human
aguauaauuagauaucaaaagu

SEQ ID NO: 859177 - RNA, 22 nt, Human
ugaggcagaguaagauacauga

SEQ ID NO: 859178 - RNA, 23 nt, Human
aucauucuccaaucuggagcagg

SEQ ID NO: 859179 - RNA, 20 nt, Human
cugcuguguuauuguagaac

SEQ ID NO: 859180 - RNA, 22 nt, Human
aaguuacacauuuucauuguaa

SEQ ID NO: 859181 - RNA, 22 nt, Human
cuuguaauuauaauguacuguu

SEQ ID NO: 859182 - RNA, 22 nt, Human
gcagcugcagacccucagugcu

SEQ ID NO: 859183 - RNA, 20 nt, Human
accaauguuagcuuaguacu

SEQ ID NO: 859184 - RNA, 22 nt, Human
cuuaaaaucuggcaguuagcua

SEQ ID NO: 859185 - RNA, 20 nt, Human
uauuccaaggguagagaaaa

SEQ ID NO: 859186 - RNA, 22 nt, Human
cugcuuuggacaacuauucuug

SEQ ID NO: 859187 - RNA, 22 nt, Human
uuggaucaaauuucaugcuguc

SEQ ID NO: 859188 - RNA, 22 nt, Human
augaaggcuguguagauggaug

SEQ ID NO: 859189 - RNA, 22 nt, Human
aaggcaguuugggccaccaucu

SEQ ID NO: 859190 - RNA, 22 nt, Human
uauaucaccaaaaacaguucug

SEQ ID NO: 859191 - RNA, 20 nt, Human
cucuccucacccgugucagg

SEQ ID NO: 859192 - RNA, 22 nt, Human
uuucuucagccuucacaaccug

SEQ ID NO: 859193 - RNA, 22 nt, Human
uuuuguuguaauauaccuaucc

SEQ ID NO: 859194 - RNA, 23 nt, Human
auuucuaggggauuuucuggugc

SEQ ID NO: 859195 - RNA, 22 nt, Human
ugaacucgggaggaggcugcag

SEQ ID NO: 859196 - RNA, 22 nt, Human
ucagucucaucaacucuauucc

SEQ ID NO: 859197 - RNA, 22 nt, Human
cuuaaagaguauuuaauauaau

SEQ ID NO: 859198 - RNA, 22 nt, Human
gaggucaggggagaggcugaug

SEQ ID NO: 859199 - RNA, 22 nt, Human
cuucuucaagagaaugggagac

SEQ ID NO: 859200 - RNA, 18 nt, Human
uggcagcaggaagccauu

SEQ ID NO: 859201 - RNA, 22 nt, Human
ggcaccagccaccuauuucuag

SEQ ID NO: 859202 - RNA, 22 nt, Human
agagugcagauaagagaauguu

SEQ ID NO: 859203 - RNA, 22 nt, Human
augcugugauuguagaaauauu

SEQ ID NO: 859204 - RNA, 21 nt, Human
cucaaagaccaaaaguguaga

SEQ ID NO: 859205 - RNA, 22 nt, Human
ggaggggagucucccaaagccg

SEQ ID NO: 859206 - RNA, 22 nt, Human
caggaaagggaugggcugccac

SEQ ID NO: 859207 - RNA, 22 nt, Human
agugcagcaugcuggggaggcu

SEQ ID NO: 859208 - RNA, 22 nt, Human
cauuaauauuguucuucuuuag

SEQ ID NO: 859209 - RNA, 22 nt, Human
aauuccaggcagaaaugugagu

SEQ ID NO: 859210 - RNA, 22 nt, Human
aucuuucuauuucuaaaaacua

SEQ ID NO: 859211 - RNA, 22 nt, Human
uccuucuuugacaaguggcaga

SEQ ID NO: 859212 - RNA, 22 nt, Human
ccaggagauaagcugaguuuau

SEQ ID NO: 859213 - RNA, 22 nt, Human
auuaaauuagcaaacugugaaa

SEQ ID NO: 859214 - RNA, 22 nt, Human
ggcagcugucucugaguuagca

SEQ ID NO: 859215 - RNA, 20 nt, Human
caggagggacauuucagcau

SEQ ID NO: 859216 - RNA, 22 nt, Human
caugcugugcaucuugaugacc

SEQ ID NO: 859217 - RNA, 22 nt, Human
uugcuuugccaccagaagucua

SEQ ID NO: 859218 - RNA, 22 nt, Human
aaguccuuguauacagaaucaa

SEQ ID NO: 859219 - RNA, 22 nt, Human
gcagaauugauggagaacuuaa

SEQ ID NO: 859220 - RNA, 22 nt, Human
uaauuuuuccacguacacuggg

SEQ ID NO: 859221 - RNA, 22 nt, Human
ggcuuaaugguucuuuuucuca

SEQ ID NO: 859222 - RNA, 22 nt, Human
ggauguugauugaauggccauu

SEQ ID NO: 859223 - RNA, 22 nt, Human
aggaugaggcuggcaggucuug

SEQ ID NO: 859224 - RNA, 22 nt, Human
ccaggagaauaauggcagauua

SEQ ID NO: 859225 - RNA, 23 nt, Human
uuccacaaugaaaauaaagcagg

SEQ ID NO: 859226 - RNA, 22 nt, Human
aucagaaaauacccaguguuua

SEQ ID NO: 859227 - RNA, 22 nt, Human
acaggauuagcaaguaaucagg

SEQ ID NO: 859228 - RNA, 22 nt, Human
gaggagagaugguagauugggu

SEQ ID NO: 859229 - RNA, 22 nt, Human
uccaggaguuugagacugcagu

SEQ ID NO: 859230 - RNA, 22 nt, Human
auggaucacagugccgugggug

SEQ ID NO: 859231 - RNA, 22 nt, Human
ucccaggaggugcuuccuagga

SEQ ID NO: 859232 - RNA, 22 nt, Human
guguugaugacauuuuagaaac

SEQ ID NO: 859233 - RNA, 22 nt, Human
ccacagagcauuagauuucaga

SEQ ID NO: 859234 - RNA, 22 nt, Human
cauagaaacuugcagcaagcac

SEQ ID NO: 859235 - RNA, 20 nt, Human
uuucugugcccaggucuguu

SEQ ID NO: 859236 - RNA, 17 nt, Human
agcugaccagauggacu

SEQ ID NO: 859237 - RNA, 20 nt, Human
gauuucaaagcagaguggcc

SEQ ID NO: 859238 - RNA, 21 nt, Human
uuucagaccuaucuuugaagg

SEQ ID NO: 859239 - RNA, 22 nt, Human
ugaggcaggagguugagaacug

SEQ ID NO: 859240 - RNA, 22 nt, Human
uaauuuuaugacaguguauuuu

SEQ ID NO: 859241 - RNA, 22 nt, Human
augguuuuucaaguauucagaa

SEQ ID NO: 859242 - RNA, 22 nt, Human
uggcagcugucuguggggucuc

SEQ ID NO: 859243 - RNA, 22 nt, Human
uacagagauacucuagaucaaa

SEQ ID NO: 859244 - RNA, 22 nt, Human
cagcugacccgugggaggcggg

SEQ ID NO: 859245 - RNA, 22 nt, Human
cuugcuggugguguuuucuaug

SEQ ID NO: 859246 - RNA, 22 nt, Human
uggcagagcaaaaagauagaau

SEQ ID NO: 859247 - RNA, 22 nt, Human
ucuucucuccugcuuggcagaa

SEQ ID NO: 859248 - RNA, 22 nt, Human
aaguaaauaucuguuuauagca

SEQ ID NO: 859249 - RNA, 22 nt, Human
uucucuuuugugaugugagaug

SEQ ID NO: 859250 - RNA, 22 nt, Human
uuccaaaguuaguuauuagaaa

SEQ ID NO: 859251 - RNA, 22 nt, Human
aaugguauuugucaagcauagu

SEQ ID NO: 859252 - RNA, 22 nt, Human
cccaggaggccaagguugcagu

SEQ ID NO: 859253 - RNA, 22 nt, Human
cauuuacauaacaguaacgcug

SEQ ID NO: 859254 - RNA, 22 nt, Human
augaggcaucugcagucacuag

SEQ ID NO: 859255 - RNA, 20 nt, Human
aggcaguuagaaggagauga

SEQ ID NO: 859256 - RNA, 22 nt, Human
ucauagaagcaccagaagauau

SEQ ID NO: 859257 - RNA, 22 nt, Human
ucucaggaagauuagggcuaag

SEQ ID NO: 859258 - RNA, 22 nt, Human
aauacugucuuucacagauauu

SEQ ID NO: 859259 - RNA, 22 nt, Human
uaaucuacuguuuauaugaaau

SEQ ID NO: 859260 - RNA, 23 nt, Human
uaugaacugcauugcuggugugu

SEQ ID NO: 859261 - RNA, 19 nt, Human
ucucugcuucucuuggcau

SEQ ID NO: 859262 - RNA, 16 nt, Human
ucccaggaggcggaac

SEQ ID NO: 859263 - RNA, 22 nt, Human
uggcauuuagaaaacaacaugu

SEQ ID NO: 859264 - RNA, 22 nt, Human
uacuuuuagccuauuugauucu

SEQ ID NO: 859265 - RNA, 22 nt, Human
uccaggagcauccaggugaagc

SEQ ID NO: 859266 - RNA, 22 nt, Human
aggguagggccguagggccaug

SEQ ID NO: 859267 - RNA, 22 nt, Human
cuccccagguucaggagguggg

SEQ ID NO: 859268 - RNA, 22 nt, Human
ucaggauggcuucugcaucaaa

SEQ ID NO: 859269 - RNA, 22 nt, Human
uucccucuccuacucaggaaag

SEQ ID NO: 859270 - RNA, 23 nt, Human
agaugaggcuucuccauguuggu

SEQ ID NO: 859271 - RNA, 22 nt, Human
uaagauaaguggguugagaugg

SEQ ID NO: 859272 - RNA, 22 nt, Human
cuuucauucuuagauauuagug

SEQ ID NO: 859273 - RNA, 22 nt, Human
uugaaguuguaguucagugaag

SEQ ID NO: 859274 - RNA, 23 nt, Human
aaacugcuuccaauuccugccau

SEQ ID NO: 859275 - RNA, 22 nt, Human
ucaugcuuaaaagacacuugag

SEQ ID NO: 859276 - RNA, 22 nt, Human
uaacaucuuuagcagcucgaac

SEQ ID NO: 859277 - RNA, 22 nt, Human
gagagcuggguucaaguagcug

SEQ ID NO: 859278 - RNA, 22 nt, Human
auucauaacggcaaaugucacc

SEQ ID NO: 859279 - RNA, 22 nt, Human
uuuaggcagcagugaggaugaa

SEQ ID NO: 859280 - RNA, 22 nt, Human
auccuuagguggugcaucaggg

SEQ ID NO: 859281 - RNA, 22 nt, Human
caguccuuaaggaaacauuugu

SEQ ID NO: 859282 - RNA, 22 nt, Human
ggagaggagcuauugggggcuc

SEQ ID NO: 859283 - RNA, 22 nt, Human
aucuuucagggccauuuguauu

SEQ ID NO: 859284 - RNA, 22 nt, Human
guaggcagauaggagugcagcc

SEQ ID NO: 859285 - RNA, 22 nt, Human
gaggcugcccaacuggagugga

SEQ ID NO: 859286 - RNA, 22 nt, Human
ucagaauucugaccuuggguca

SEQ ID NO: 859287 - RNA, 18 nt, Human
agaugaaagcaaaugaca

SEQ ID NO: 859288 - RNA, 22 nt, Human
uugaaagacuucuccugugaaa

SEQ ID NO: 859289 - RNA, 23 nt, Human
uuuggacuugugacucuucuccu

SEQ ID NO: 859290 - RNA, 22 nt, Human
uuuugugagcccauaaaugcca

SEQ ID NO: 859291 - RNA, 22 nt, Human
uugcugaauugaauccuuuggu

SEQ ID NO: 859292 - RNA, 22 nt, Human
ggagggaaugucuagcauucuu

SEQ ID NO: 859293 - RNA, 20 nt, Human
gaaguccuuucacucuuccc

SEQ ID NO: 859294 - RNA, 22 nt, Human
ggauucuaacugaacagaauau

SEQ ID NO: 859295 - RNA, 22 nt, Human
cucagaauuuagggcucugagg

SEQ ID NO: 859296 - RNA, 18 nt, Human
ucuuccaacacugacacc

SEQ ID NO: 859297 - RNA, 22 nt, Human
agcucccagagcucgagaguaa

SEQ ID NO: 859298 - RNA, 22 nt, Human
uuuaaugauagcuguuucacau
